United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 176

SEQ ID NO: 7347706 - DNA, 22 bp, Homo sapiens
aggaagggtgtcatgagccctt

SEQ ID NO: 7347707 - DNA, 22 bp, Homo sapiens
aggaaggggagaagttaaagct

SEQ ID NO: 7347708 - DNA, 20 bp, Homo sapiens
aggaaggagaatctgagcaa

SEQ ID NO: 7347709 - DNA, 22 bp, Homo sapiens
aggaagggctgtttctccaaga

SEQ ID NO: 7347710 - DNA, 22 bp, Homo sapiens
aggaagggtggatagtaacgtg

SEQ ID NO: 7347711 - DNA, 22 bp, Homo sapiens
aggaaggggagaagttaaagct

SEQ ID NO: 7347712 - DNA, 22 bp, Homo sapiens
aggaaggtaatgaactgaggag

SEQ ID NO: 7347713 - DNA, 22 bp, Homo sapiens
aggaagggttctttgtgaaaga

SEQ ID NO: 7347714 - DNA, 22 bp, Homo sapiens
caggtcctcgggggaggccggc

SEQ ID NO: 7347715 - DNA, 22 bp, Homo sapiens
aggaatgttaagaaggtctacc

SEQ ID NO: 7347716 - DNA, 22 bp, Homo sapiens
aggaattaacaatatatttagg

SEQ ID NO: 7347717 - DNA, 22 bp, Homo sapiens
aggaaacatccttatctattct

SEQ ID NO: 7347718 - DNA, 22 bp, Homo sapiens
cagggtggggctggctatcaaa

SEQ ID NO: 7347719 - DNA, 22 bp, Homo sapiens
cagggtggtaccagcatctagt

SEQ ID NO: 7347720 - DNA, 22 bp, Homo sapiens
cagggtggtaccagcatctagt

SEQ ID NO: 7347721 - DNA, 22 bp, Homo sapiens
cagggtggtgaatagctatagt

SEQ ID NO: 7347722 - DNA, 22 bp, Homo sapiens
cagggtggtgaatagctatagt

SEQ ID NO: 7347723 - DNA, 22 bp, Homo sapiens
aggaaggactgcagcatttggt

SEQ ID NO: 7347724 - DNA, 22 bp, Homo sapiens
cagggttggtttctcctcaggc

SEQ ID NO: 7347725 - DNA, 22 bp, Homo sapiens
aggggaggcagcgataaacctg

SEQ ID NO: 7347726 - DNA, 22 bp, Homo sapiens
aggggaggcagcgataaacctg

SEQ ID NO: 7347727 - DNA, 22 bp, Homo sapiens
aggggaggagcttttcttgcct

SEQ ID NO: 7347728 - DNA, 22 bp, Homo sapiens
aggggaggagcttttcttgcct

SEQ ID NO: 7347729 - DNA, 22 bp, Homo sapiens
aggggaggtgtccccaaatctc

SEQ ID NO: 7347730 - DNA, 22 bp, Homo sapiens
aggggaggtgtccccaaatctc

SEQ ID NO: 7347731 - DNA, 22 bp, Homo sapiens
agggctggctaggtgcgttccc

SEQ ID NO: 7347732 - DNA, 22 bp, Homo sapiens
agggctggcatctctaatgctg

SEQ ID NO: 7347733 - DNA, 22 bp, Homo sapiens
aggggcagcctcacaatcctct

SEQ ID NO: 7347734 - DNA, 22 bp, Homo sapiens
cctcttccactgggccccatcc

SEQ ID NO: 7347735 - DNA, 22 bp, Homo sapiens
cctcttccactgggccccatcc

SEQ ID NO: 7347736 - DNA, 19 bp, Homo sapiens
aggggcactgtctctagag

SEQ ID NO: 7347737 - DNA, 19 bp, Homo sapiens
aggggcactgtctctagag

SEQ ID NO: 7347738 - DNA, 23 bp, Homo sapiens
aggggcagcaagttttggtgtta

SEQ ID NO: 7347739 - DNA, 23 bp, Homo sapiens
aggggcagcaagttttggtgtta

SEQ ID NO: 7347740 - DNA, 22 bp, Homo sapiens
aggggcagcctcacaatcctct

SEQ ID NO: 7347741 - DNA, 22 bp, Homo sapiens
aggggcacgagtagagctctag

SEQ ID NO: 7347742 - DNA, 22 bp, Homo sapiens
aggggcacgagtagagctctag

SEQ ID NO: 7347743 - DNA, 22 bp, Homo sapiens
aggggatggagctggaaggcag

SEQ ID NO: 7347744 - DNA, 22 bp, Homo sapiens
aggggatggagctggaaggcag

SEQ ID NO: 7347745 - DNA, 20 bp, Homo sapiens
aggggcacctgcgacggggc

SEQ ID NO: 7347746 - DNA, 20 bp, Homo sapiens
aggggcacctgcgacggggc

SEQ ID NO: 7347747 - DNA, 22 bp, Homo sapiens
agggtagggccgtagggccatg

SEQ ID NO: 7347748 - DNA, 22 bp, Homo sapiens
agggtagggtaaatgatgcatc

SEQ ID NO: 7347749 - DNA, 22 bp, Homo sapiens
agggtagggccgtagggccatg

SEQ ID NO: 7347750 - DNA, 22 bp, Homo sapiens
agggtagggccgtagggccatg

SEQ ID NO: 7347751 - DNA, 22 bp, Homo sapiens
agggtagggccgtagggccatg

SEQ ID NO: 7347752 - DNA, 22 bp, Homo sapiens
agggtagggcccggagacagac

SEQ ID NO: 7347753 - DNA, 22 bp, Homo sapiens
agggtagggcccggagacagac

SEQ ID NO: 7347754 - DNA, 22 bp, Homo sapiens
agggcgaggagacggaggcaca

SEQ ID NO: 7347755 - DNA, 22 bp, Homo sapiens
agggcgggctcatcacatgctc

SEQ ID NO: 7347756 - DNA, 22 bp, Homo sapiens
agggcgctgtctggccagcggt

SEQ ID NO: 7347757 - DNA, 22 bp, Homo sapiens
agggcgggctcatcacatgctc

SEQ ID NO: 7347758 - DNA, 22 bp, Homo sapiens
agggcgggctcatcacatgctc

SEQ ID NO: 7347759 - DNA, 19 bp, Homo sapiens
agggcggggcccaggcaca

SEQ ID NO: 7347760 - DNA, 19 bp, Homo sapiens
agggcggggcccaggcaca

SEQ ID NO: 7347761 - DNA, 22 bp, Homo sapiens
cctcaggccctgtccctgcgcc

SEQ ID NO: 7347762 - DNA, 22 bp, Homo sapiens
cctcaggcaggaaactgtcccg

SEQ ID NO: 7347763 - DNA, 22 bp, Homo sapiens
agggctggagccacagctggga

SEQ ID NO: 7347764 - DNA, 22 bp, Homo sapiens
agggctgcttacctggaatggc

SEQ ID NO: 7347765 - DNA, 22 bp, Homo sapiens
agggctgcttacctggaatggc

SEQ ID NO: 7347766 - DNA, 22 bp, Homo sapiens
agggctgctttgctaaatatgg

SEQ ID NO: 7347767 - DNA, 22 bp, Homo sapiens
agggctaggaatggaactggag

SEQ ID NO: 7347768 - DNA, 22 bp, Homo sapiens
agggctaggaatggaactggag

SEQ ID NO: 7347769 - DNA, 22 bp, Homo sapiens
agggctgcagtcctaaggtgct

SEQ ID NO: 7347770 - DNA, 22 bp, Homo sapiens
agggctgcagtcctaaggtgct

SEQ ID NO: 7347771 - DNA, 22 bp, Homo sapiens
agggctagagttgagatgggga

SEQ ID NO: 7347772 - DNA, 22 bp, Homo sapiens
agggctactgcctgccttcagg

SEQ ID NO: 7347773 - DNA, 22 bp, Homo sapiens
agggctgcatctgcctggtgaa

SEQ ID NO: 7347774 - DNA, 22 bp, Homo sapiens
agggctgcatctgcctggtgaa

SEQ ID NO: 7347775 - DNA, 22 bp, Homo sapiens
agggctgctgaggaagccttgc

SEQ ID NO: 7347776 - DNA, 22 bp, Homo sapiens
agggctgctgctccgggcccag

SEQ ID NO: 7347777 - DNA, 22 bp, Homo sapiens
agggctgctgctccgggcccag

SEQ ID NO: 7347778 - DNA, 22 bp, Homo sapiens
agggctggcaagggattgaaat

SEQ ID NO: 7347779 - DNA, 22 bp, Homo sapiens
agggctggagccacagctggga

SEQ ID NO: 7347780 - DNA, 22 bp, Homo sapiens
agggctggagccacagctggga

SEQ ID NO: 7347781 - DNA, 22 bp, Homo sapiens
agggctggagccacagctggga

SEQ ID NO: 7347782 - DNA, 22 bp, Homo sapiens
agggcctggcgcgtggccgccg

SEQ ID NO: 7347783 - DNA, 23 bp, Homo sapiens
agggcctggcgtggagtgtgtgc

SEQ ID NO: 7347784 - DNA, 22 bp, Homo sapiens
cctcagagcgcgtggcattatt

SEQ ID NO: 7347785 - DNA, 22 bp, Homo sapiens
agggcctgctctatcactctca

SEQ ID NO: 7347786 - DNA, 22 bp, Homo sapiens
agggcctggaactggagaccac

SEQ ID NO: 7347787 - DNA, 23 bp, Homo sapiens
agggcctgatggctcccgctggc

SEQ ID NO: 7347788 - DNA, 22 bp, Homo sapiens
agggcctgagctggctgacctc

SEQ ID NO: 7347789 - DNA, 22 bp, Homo sapiens
agggcctgcatcaggagcttgg

SEQ ID NO: 7347790 - DNA, 22 bp, Homo sapiens
agggcctccagggcagcagtgg

SEQ ID NO: 7347791 - DNA, 22 bp, Homo sapiens
agggcctccagggcagcagtgg

SEQ ID NO: 7347792 - DNA, 22 bp, Homo sapiens
agggcctcagtgttctcatctg

SEQ ID NO: 7347793 - DNA, 22 bp, Homo sapiens
cccatcaggaacccaggagccc

SEQ ID NO: 7347794 - DNA, 22 bp, Homo sapiens
cccagtcatcctgcaggtgaaa

SEQ ID NO: 7347795 - DNA, 22 bp, Homo sapiens
aggctgtgaaggttaaagacga

SEQ ID NO: 7347796 - DNA, 20 bp, Homo sapiens
aggctgtcatttctggcagg

SEQ ID NO: 7347797 - DNA, 22 bp, Homo sapiens
aggctggtgcctgcagtgaatc

SEQ ID NO: 7347798 - DNA, 22 bp, Homo sapiens
aggctgggtacctgtcatatgc

SEQ ID NO: 7347799 - DNA, 22 bp, Homo sapiens
cccaggagcttctctctgcctc

SEQ ID NO: 7347800 - DNA, 20 bp, Homo sapiens
cccaggagctgtgccccatc

SEQ ID NO: 7347801 - DNA, 22 bp, Homo sapiens
cccaggaattcagggctcaagg

SEQ ID NO: 7347802 - DNA, 22 bp, Homo sapiens
cccaggagatgcactccattgg

SEQ ID NO: 7347803 - DNA, 22 bp, Homo sapiens
cccaggagccatctgtcttggc

SEQ ID NO: 7347804 - DNA, 23 bp, Homo sapiens
cccaggagcctgagtcctctctg

SEQ ID NO: 7347805 - DNA, 22 bp, Homo sapiens
ccctgcccatcggggcggcctg

SEQ ID NO: 7347806 - DNA, 22 bp, Homo sapiens
ccctgcccaccacatgctggga

SEQ ID NO: 7347807 - DNA, 22 bp, Homo sapiens
ccctgcccaccacatgctggga

SEQ ID NO: 7347808 - DNA, 22 bp, Homo sapiens
ccctgccagggtcctgacagac

SEQ ID NO: 7347809 - DNA, 18 bp, Homo sapiens
ccctgccagctcccagca

SEQ ID NO: 7347810 - DNA, 22 bp, Homo sapiens
ccctgccagggtcctgacagac

SEQ ID NO: 7347811 - DNA, 23 bp, Homo sapiens
ccctgcccattgagcaggacgtc

SEQ ID NO: 7347812 - DNA, 22 bp, Homo sapiens
ccctgccccaggcggcttcact

SEQ ID NO: 7347813 - DNA, 22 bp, Homo sapiens
ccctgccctgggcagaagtggg

SEQ ID NO: 7347814 - DNA, 22 bp, Homo sapiens
ccctgctgtgcctgactgccat

SEQ ID NO: 7347815 - DNA, 17 bp, Homo sapiens
ccctgccaccaggaagc

SEQ ID NO: 7347816 - DNA, 18 bp, Homo sapiens
ccctgccagctcccagca

SEQ ID NO: 7347817 - DNA, 22 bp, Homo sapiens
ccctgccagatgtgcttcagtt

SEQ ID NO: 7347818 - DNA, 22 bp, Homo sapiens
ccctccattaaaacagacctat

SEQ ID NO: 7347819 - DNA, 20 bp, Homo sapiens
ccctcccagatgcttcccaa

SEQ ID NO: 7347820 - DNA, 22 bp, Homo sapiens
ccctcaccaggctccaggcatg

SEQ ID NO: 7347821 - DNA, 22 bp, Homo sapiens
ccccagcacttggagtggggag

SEQ ID NO: 7347822 - DNA, 22 bp, Homo sapiens
ccccttccacagtgcttcctaa

SEQ ID NO: 7347823 - DNA, 22 bp, Homo sapiens
ccccttccacagtgcttcctaa

SEQ ID NO: 7347824 - DNA, 21 bp, Homo sapiens
ccccagcaccttgccagcctg

SEQ ID NO: 7347825 - DNA, 22 bp, Homo sapiens
ccccagcactctgactcttacc

SEQ ID NO: 7347826 - DNA, 22 bp, Homo sapiens
cccatgaggtggaggttgcagt

SEQ ID NO: 7347827 - DNA, 22 bp, Homo sapiens
cccatgagtgctgctcagaggc

SEQ ID NO: 7347828 - DNA, 17 bp, Homo sapiens
cccatgagcccactccc

SEQ ID NO: 7347829 - DNA, 22 bp, Homo sapiens
cccatgagattctgaatttggc

SEQ ID NO: 7347830 - DNA, 22 bp, Homo sapiens
cccatgagacctggtttaaggc

SEQ ID NO: 7347831 - DNA, 22 bp, Homo sapiens
ccccagagaaagtcagcagcat

SEQ ID NO: 7347832 - DNA, 22 bp, Homo sapiens
ccaggaaggcaggcctccccgc

SEQ ID NO: 7347833 - DNA, 22 bp, Homo sapiens
aggcctggcatgagacctgaga

SEQ ID NO: 7347834 - DNA, 22 bp, Homo sapiens
aggcctggcatgagacctgaga

SEQ ID NO: 7347835 - DNA, 22 bp, Homo sapiens
aggcgctgagtaggcaaggagg

SEQ ID NO: 7347836 - DNA, 22 bp, Homo sapiens
aggcctgtcccagctgaggacg

SEQ ID NO: 7347837 - DNA, 22 bp, Homo sapiens
aggcggtgtgctttgcagagca

SEQ ID NO: 7347838 - DNA, 22 bp, Homo sapiens
aggcgggtttaggacaatgctt

SEQ ID NO: 7347839 - DNA, 22 bp, Homo sapiens
aggcggctggtgtcctgcaggt

SEQ ID NO: 7347840 - DNA, 19 bp, Homo sapiens
aggcggctcgcgcgcctcc

SEQ ID NO: 7347841 - DNA, 22 bp, Homo sapiens
aggcgctgtgcttggggctgga

SEQ ID NO: 7347842 - DNA, 22 bp, Homo sapiens
aggcgctgtgcttggggctgga

SEQ ID NO: 7347843 - DNA, 22 bp, Homo sapiens
aggcgctgcatgtgaaggagtt

SEQ ID NO: 7347844 - DNA, 22 bp, Homo sapiens
aggcgctgcgctggggccagaa

SEQ ID NO: 7347845 - DNA, 22 bp, Homo sapiens
ccagctctggcttcttgctggg

SEQ ID NO: 7347846 - DNA, 23 bp, Homo sapiens
ccagctccgtgagcctcgggctc

SEQ ID NO: 7347847 - DNA, 22 bp, Homo sapiens
ccagcaggagatgcctgtgtct

SEQ ID NO: 7347848 - DNA, 22 bp, Homo sapiens
ccagcaggagagaacatttccc

SEQ ID NO: 7347849 - DNA, 22 bp, Homo sapiens
ccagcaggagactagcaacata

SEQ ID NO: 7347850 - DNA, 22 bp, Homo sapiens
ccagcaggactttggaaatatg

SEQ ID NO: 7347851 - DNA, 22 bp, Homo sapiens
ccagctcttttggctgagtgag

SEQ ID NO: 7347852 - DNA, 22 bp, Homo sapiens
aggccacatagcttgcatgtag

SEQ ID NO: 7347853 - DNA, 22 bp, Homo sapiens
ccagagctgagggagcctgagc

SEQ ID NO: 7347854 - DNA, 20 bp, Homo sapiens
ccagagctgatggctgcccg

SEQ ID NO: 7347855 - DNA, 17 bp, Homo sapiens
ccagagctactgagact

SEQ ID NO: 7347856 - DNA, 22 bp, Homo sapiens
ccagagcctggcatctgcataa

SEQ ID NO: 7347857 - DNA, 22 bp, Homo sapiens
ccagagctaaacacacaggctg

SEQ ID NO: 7347858 - DNA, 22 bp, Homo sapiens
ccagcaggagactagcaacata

SEQ ID NO: 7347859 - DNA, 22 bp, Homo sapiens
ccagcaggagactagcaacata

SEQ ID NO: 7347860 - DNA, 23 bp, Homo sapiens
aggcccaactctgtgagggctgc

SEQ ID NO: 7347861 - DNA, 22 bp, Homo sapiens
aggccatgaggtcatgggagat

SEQ ID NO: 7347862 - DNA, 22 bp, Homo sapiens
aggccaggatagcatggatcag

SEQ ID NO: 7347863 - DNA, 22 bp, Homo sapiens
ccagaccctgctctggggctct

SEQ ID NO: 7347864 - DNA, 22 bp, Homo sapiens
ccagaccctttcttggcatgtg

SEQ ID NO: 7347865 - DNA, 22 bp, Homo sapiens
aggccacaagaaaatgcttcat

SEQ ID NO: 7347866 - DNA, 22 bp, Homo sapiens
aggccacagtactttgcagacc

SEQ ID NO: 7347867 - DNA, 22 bp, Homo sapiens
ccagaacagacctgcctgacct

SEQ ID NO: 7347868 - DNA, 22 bp, Homo sapiens
ccagaactgggcaacagaaagt

SEQ ID NO: 7347869 - DNA, 22 bp, Homo sapiens
ccagaactgagaaaataaattt

SEQ ID NO: 7347870 - DNA, 22 bp, Homo sapiens
ccagaaaatgcagaacatagaa

SEQ ID NO: 7347871 - DNA, 22 bp, Homo sapiens
ccagaaaatatggctaaggtga

SEQ ID NO: 7347872 - DNA, 22 bp, Homo sapiens
ccaggctgcttagccttatctt

SEQ ID NO: 7347873 - DNA, 22 bp, Homo sapiens
ccaggctgcttagccttatctt

SEQ ID NO: 7347874 - DNA, 22 bp, Homo sapiens
ccaggctgctgttggtgtccgc

SEQ ID NO: 7347875 - DNA, 22 bp, Homo sapiens
aggctacagatacagaggctac

SEQ ID NO: 7347876 - DNA, 22 bp, Homo sapiens
aggctacaataattcccatgca

SEQ ID NO: 7347877 - DNA, 22 bp, Homo sapiens
aggctacaataattcccatgca

SEQ ID NO: 7347878 - DNA, 22 bp, Homo sapiens
aggcgtgggaggatctgaggcc

SEQ ID NO: 7347879 - DNA, 22 bp, Homo sapiens
aggcgtggttgaggcgagcata

SEQ ID NO: 7347880 - DNA, 15 bp, Homo sapiens
ccaggctgggtgagc

SEQ ID NO: 7347881 - DNA, 15 bp, Homo sapiens
ccaggctgggtgagc

SEQ ID NO: 7347882 - DNA, 22 bp, Homo sapiens
ccaggctggtctgaatttctag

SEQ ID NO: 7347883 - DNA, 22 bp, Homo sapiens
ccaggctggtctgaatttctag

SEQ ID NO: 7347884 - DNA, 22 bp, Homo sapiens
ccaggctgggcggggaacctgg

SEQ ID NO: 7347885 - DNA, 22 bp, Homo sapiens
ccaggctgggcggggaacctgg

SEQ ID NO: 7347886 - DNA, 22 bp, Homo sapiens
ccaggctggagtgcaatggcat

SEQ ID NO: 7347887 - DNA, 22 bp, Homo sapiens
ccaggctgggctacaagttgag

SEQ ID NO: 7347888 - DNA, 22 bp, Homo sapiens
ccaggctgggctacaagttgag

SEQ ID NO: 7347889 - DNA, 22 bp, Homo sapiens
ccaggctgctttattactctgt

SEQ ID NO: 7347890 - DNA, 22 bp, Homo sapiens
ccaggctgctttattactctgt

SEQ ID NO: 7347891 - DNA, 22 bp, Homo sapiens
ccaggctggaatcaatattctg

SEQ ID NO: 7347892 - DNA, 22 bp, Homo sapiens
ccaggctggaatcaatattctg

SEQ ID NO: 7347893 - DNA, 22 bp, Homo sapiens
ccaggctggagtatagtggcgc

SEQ ID NO: 7347894 - DNA, 22 bp, Homo sapiens
ccaggctggagtatagtggcgc

SEQ ID NO: 7347895 - DNA, 22 bp, Homo sapiens
ccaggctggagtgcaatggcat

SEQ ID NO: 7347896 - DNA, 22 bp, Homo sapiens
ccaggctgtaaacaccttcaaa

SEQ ID NO: 7347897 - DNA, 22 bp, Homo sapiens
ccaggctgtaaacaccttcaaa

SEQ ID NO: 7347898 - DNA, 22 bp, Homo sapiens
ccagggcctgccacttagcaag

SEQ ID NO: 7347899 - DNA, 22 bp, Homo sapiens
ccagggcctgagggcgacgccc

SEQ ID NO: 7347900 - DNA, 22 bp, Homo sapiens
ccagggcctgccacttagcaag

SEQ ID NO: 7347901 - DNA, 22 bp, Homo sapiens
ccagggctccattgctcatcct

SEQ ID NO: 7347902 - DNA, 22 bp, Homo sapiens
ccagggctccattgctcatcct

SEQ ID NO: 7347903 - DNA, 20 bp, Homo sapiens
ccagggctggctcctgggat

SEQ ID NO: 7347904 - DNA, 22 bp, Homo sapiens
ccagggctggtgggagatgctg

SEQ ID NO: 7347905 - DNA, 22 bp, Homo sapiens
aggctggaaagggaccagagtg

SEQ ID NO: 7347906 - DNA, 19 bp, Homo sapiens
aggctggagacaccaggcc

SEQ ID NO: 7347907 - DNA, 22 bp, Homo sapiens
aggctgcttccttacgtggctg

SEQ ID NO: 7347908 - DNA, 22 bp, Homo sapiens
aggctgctcagtagatggagct

SEQ ID NO: 7347909 - DNA, 22 bp, Homo sapiens
ccaggtgactgtcagaggtttt

SEQ ID NO: 7347910 - DNA, 22 bp, Homo sapiens
aggctggagtgctggagtgctg

SEQ ID NO: 7347911 - DNA, 22 bp, Homo sapiens
aggctggagtgcagtggcgtga

SEQ ID NO: 7347912 - DNA, 22 bp, Homo sapiens
aggctggagtgcagtggtgtga

SEQ ID NO: 7347913 - DNA, 22 bp, Homo sapiens
aggctggagtgcaatggcgtga

SEQ ID NO: 7347914 - DNA, 22 bp, Homo sapiens
aggctggagtgtagcagtgcag

SEQ ID NO: 7347915 - DNA, 22 bp, Homo sapiens
aggctggagtgctggagtgctg

SEQ ID NO: 7347916 - DNA, 19 bp, Homo sapiens
aggctggagacaccaggcc

SEQ ID NO: 7347917 - DNA, 22 bp, Homo sapiens
aggctggaggtttgttgcggct

SEQ ID NO: 7347918 - DNA, 22 bp, Homo sapiens
ccatttgaaatgaatgttttta

SEQ ID NO: 7347919 - DNA, 22 bp, Homo sapiens
ccatttggcaagaaagagtcat

SEQ ID NO: 7347920 - DNA, 22 bp, Homo sapiens
ccatttggtatagtgaaaagga

SEQ ID NO: 7347921 - DNA, 22 bp, Homo sapiens
aggctggccctactggctgcct

SEQ ID NO: 7347922 - DNA, 22 bp, Homo sapiens
aggctgggctccgcccaactcc

SEQ ID NO: 7347923 - DNA, 22 bp, Homo sapiens
atacatatccacaggagataaa

SEQ ID NO: 7347924 - DNA, 22 bp, Homo sapiens
atacatatccacaggagataaa

SEQ ID NO: 7347925 - DNA, 22 bp, Homo sapiens
acttctctccacccaagtccct

SEQ ID NO: 7347926 - DNA, 22 bp, Homo sapiens
acttctctgctacctgcaaaga

SEQ ID NO: 7347927 - DNA, 22 bp, Homo sapiens
atacatcatttcccatcaatcg

SEQ ID NO: 7347928 - DNA, 22 bp, Homo sapiens
atacatcatttcccatcaatcg

SEQ ID NO: 7347929 - DNA, 22 bp, Homo sapiens
atacatcgtttattttagttca

SEQ ID NO: 7347930 - DNA, 22 bp, Homo sapiens
atagagtgatgtaaggtatgtg

SEQ ID NO: 7347931 - DNA, 22 bp, Homo sapiens
actttggattgggtccctccca

SEQ ID NO: 7347932 - DNA, 22 bp, Homo sapiens
atagatacttataacaattgtg

SEQ ID NO: 7347933 - DNA, 23 bp, Homo sapiens
acttttcaattagctatgcttaa

SEQ ID NO: 7347934 - DNA, 21 bp, Homo sapiens
agtttttactcttaactgtgg

SEQ ID NO: 7347935 - DNA, 21 bp, Homo sapiens
agtttttactcttaactgtgg

SEQ ID NO: 7347936 - DNA, 21 bp, Homo sapiens
agtttttactcttaactgtgg

SEQ ID NO: 7347937 - DNA, 22 bp, Homo sapiens
agtttttcctgattttacagaa

SEQ ID NO: 7347938 - DNA, 22 bp, Homo sapiens
agtttttccgtggctacgataa

SEQ ID NO: 7347939 - DNA, 23 bp, Homo sapiens
agtttttaatggtcatagctgag

SEQ ID NO: 7347940 - DNA, 22 bp, Homo sapiens
actgttatttcaccactactga

SEQ ID NO: 7347941 - DNA, 22 bp, Homo sapiens
actgttattgtgaacgggcaat

SEQ ID NO: 7347942 - DNA, 22 bp, Homo sapiens
actgttatttgtaatccattat

SEQ ID NO: 7347943 - DNA, 21 bp, Homo sapiens
actgttattcccattttcacc

SEQ ID NO: 7347944 - DNA, 22 bp, Homo sapiens
agtttttctcccctggcttcat

SEQ ID NO: 7347945 - DNA, 22 bp, Homo sapiens
agtttttctcccctggcttcat

SEQ ID NO: 7347946 - DNA, 23 bp, Homo sapiens
agtttttctgcatggttctgtat

SEQ ID NO: 7347947 - DNA, 22 bp, Homo sapiens
agtttttctgctggtctcacta

SEQ ID NO: 7347948 - DNA, 22 bp, Homo sapiens
agtttttctgggaggcactgct

SEQ ID NO: 7347949 - DNA, 22 bp, Homo sapiens
ataaaaactgacccatcctttg

SEQ ID NO: 7347950 - DNA, 22 bp, Homo sapiens
acttccagcccctgtcagcaaa

SEQ ID NO: 7347951 - DNA, 22 bp, Homo sapiens
acttccagatggccccatctaa

SEQ ID NO: 7347952 - DNA, 22 bp, Homo sapiens
actgttttgtgccttagtttcc

SEQ ID NO: 7347953 - DNA, 22 bp, Homo sapiens
acttaaaaagaatcttttcacg

SEQ ID NO: 7347954 - DNA, 22 bp, Homo sapiens
actgttttctaaagaacagatg

SEQ ID NO: 7347955 - DNA, 22 bp, Homo sapiens
actgtttgctgatagatattta

SEQ ID NO: 7347956 - DNA, 22 bp, Homo sapiens
actgtttgctgatagatattta

SEQ ID NO: 7347957 - DNA, 22 bp, Homo sapiens
actgtttctgccacaatagccc

SEQ ID NO: 7347958 - DNA, 22 bp, Homo sapiens
actgtttctcaaattatgtggt

SEQ ID NO: 7347959 - DNA, 22 bp, Homo sapiens
actgtttatagttttgagctga

SEQ ID NO: 7347960 - DNA, 22 bp, Homo sapiens
acttaaaaagaatcttttcacg

SEQ ID NO: 7347961 - DNA, 22 bp, Homo sapiens
ataaagtctaccgtattaaaga

SEQ ID NO: 7347962 - DNA, 22 bp, Homo sapiens
atctctgctagccttcttcagg

SEQ ID NO: 7347963 - DNA, 22 bp, Homo sapiens
agaacattaatgcgaggtatta

SEQ ID NO: 7347964 - DNA, 22 bp, Homo sapiens
agaacatttgtcgatcaatttg

SEQ ID NO: 7347965 - DNA, 22 bp, Homo sapiens
agaacatttgtcaaaaagccaa

SEQ ID NO: 7347966 - DNA, 22 bp, Homo sapiens
atcccaagtagcaatcctggta

SEQ ID NO: 7347967 - DNA, 19 bp, Homo sapiens
atcccaaggagctgggact

SEQ ID NO: 7347968 - DNA, 22 bp, Homo sapiens
atccatttttgcaaagttgttc

SEQ ID NO: 7347969 - DNA, 22 bp, Homo sapiens
agaaatcattgaattatttgct

SEQ ID NO: 7347970 - DNA, 22 bp, Homo sapiens
agaaatctaagatgctcaagga

SEQ ID NO: 7347971 - DNA, 19 bp, Homo sapiens
agaaatctcgagatttgtt

SEQ ID NO: 7347972 - DNA, 22 bp, Homo sapiens
agaaatctcagtatctcaggga

SEQ ID NO: 7347973 - DNA, 22 bp, Homo sapiens
atctctgtaattacatgatatt

SEQ ID NO: 7347974 - DNA, 22 bp, Homo sapiens
atctctgtaattacatgatatt

SEQ ID NO: 7347975 - DNA, 22 bp, Homo sapiens
atctctgttttaggagatagtg

SEQ ID NO: 7347976 - DNA, 21 bp, Homo sapiens
agaaggcaaaagcagacatct

SEQ ID NO: 7347977 - DNA, 22 bp, Homo sapiens
agaaggcagatgggacggagca

SEQ ID NO: 7347978 - DNA, 22 bp, Homo sapiens
acttttgaagaattatgcaaaa

SEQ ID NO: 7347979 - DNA, 22 bp, Homo sapiens
atatttttccatgtgggactct

SEQ ID NO: 7347980 - DNA, 21 bp, Homo sapiens
atatttttgtttggactgtca

SEQ ID NO: 7347981 - DNA, 22 bp, Homo sapiens
atcagtgcatcctgccacaaag

SEQ ID NO: 7347982 - DNA, 19 bp, Homo sapiens
atcagtgcatgagtgctgt

SEQ ID NO: 7347983 - DNA, 22 bp, Homo sapiens
atcagtgctgagagactatcaa

SEQ ID NO: 7347984 - DNA, 22 bp, Homo sapiens
atcagtgccccatggctaatgc

SEQ ID NO: 7347985 - DNA, 22 bp, Homo sapiens
atcagtgctaaagcaaatgccc

SEQ ID NO: 7347986 - DNA, 22 bp, Homo sapiens
agaaatcatgactaagagcagt

SEQ ID NO: 7347987 - DNA, 22 bp, Homo sapiens
agaaatcaggaacagtaaggag

SEQ ID NO: 7347988 - DNA, 22 bp, Homo sapiens
atcagtttaactgtcaagagcc

SEQ ID NO: 7347989 - DNA, 22 bp, Homo sapiens
atcagtttaaatgggctgttgg

SEQ ID NO: 7347990 - DNA, 22 bp, Homo sapiens
atcagtttaaatgggctgttgg

SEQ ID NO: 7347991 - DNA, 22 bp, Homo sapiens
atcagtgtttcaaatgtaatct

SEQ ID NO: 7347992 - DNA, 22 bp, Homo sapiens
agaaatcattcccaaacccata

SEQ ID NO: 7347993 - DNA, 22 bp, Homo sapiens
atcaaaatgctccagtgatggt

SEQ ID NO: 7347994 - DNA, 20 bp, Homo sapiens
atcaaaatcctattgaggtt

SEQ ID NO: 7347995 - DNA, 22 bp, Homo sapiens
agaaagcacgggccccaggctc

SEQ ID NO: 7347996 - DNA, 22 bp, Homo sapiens
agaaagcacgggccccaggctc

SEQ ID NO: 7347997 - DNA, 22 bp, Homo sapiens
agaaagcactctgtcttttacc

SEQ ID NO: 7347998 - DNA, 22 bp, Homo sapiens
agaaagcaccctgcactttctg

SEQ ID NO: 7347999 - DNA, 22 bp, Homo sapiens
agaaagcacagcgggtccattt

SEQ ID NO: 7348000 - DNA, 22 bp, Homo sapiens
atcagcaagtcctgttaattct

SEQ ID NO: 7348001 - DNA, 22 bp, Homo sapiens
atcagcaatcaaattgcagagt

SEQ ID NO: 7348002 - DNA, 22 bp, Homo sapiens
atcagcaatcaaattgcagagt

SEQ ID NO: 7348003 - DNA, 22 bp, Homo sapiens
atcagcaatctcgtgtattagg

SEQ ID NO: 7348004 - DNA, 22 bp, Homo sapiens
atcagcaatctcgtgtattagg

SEQ ID NO: 7348005 - DNA, 22 bp, Homo sapiens
agaaagcatctccattgtaggt

SEQ ID NO: 7348006 - DNA, 22 bp, Homo sapiens
agaaagcatctccattgtaggt

SEQ ID NO: 7348007 - DNA, 22 bp, Homo sapiens
agaaagcagtcccttccgaccg

SEQ ID NO: 7348008 - DNA, 22 bp, Homo sapiens
agaaagcagcatttatgatctc

SEQ ID NO: 7348009 - DNA, 22 bp, Homo sapiens
agaaagcagcatttatgatctc

SEQ ID NO: 7348010 - DNA, 22 bp, Homo sapiens
actgccattttgaataattact

SEQ ID NO: 7348011 - DNA, 22 bp, Homo sapiens
actgcccttgtcctggcacacc

SEQ ID NO: 7348012 - DNA, 22 bp, Homo sapiens
actgcctgctcctggctccaca

SEQ ID NO: 7348013 - DNA, 22 bp, Homo sapiens
actgcctgccttccaggtactg

SEQ ID NO: 7348014 - DNA, 22 bp, Homo sapiens
actgggccaggtgtgggtgagt

SEQ ID NO: 7348015 - DNA, 22 bp, Homo sapiens
actctgctaaatgtaagttggt

SEQ ID NO: 7348016 - DNA, 22 bp, Homo sapiens
actgagatgaatagatggcaag

SEQ ID NO: 7348017 - DNA, 22 bp, Homo sapiens
agtgaaatttgtttagataggt

SEQ ID NO: 7348018 - DNA, 22 bp, Homo sapiens
actgcactcctgcctgggtaac

SEQ ID NO: 7348019 - DNA, 22 bp, Homo sapiens
actgcacagtcccagaggatgc

SEQ ID NO: 7348020 - DNA, 22 bp, Homo sapiens
agtgctctctccccagtgctac

SEQ ID NO: 7348021 - DNA, 22 bp, Homo sapiens
agtgctctgggtccactccaga

SEQ ID NO: 7348022 - DNA, 22 bp, Homo sapiens
agtgctctgatctccttgggtt

SEQ ID NO: 7348023 - DNA, 22 bp, Homo sapiens
agtgctctaacagtcaaaaaag

SEQ ID NO: 7348024 - DNA, 22 bp, Homo sapiens
agtgctcctttcattgctgccc

SEQ ID NO: 7348025 - DNA, 22 bp, Homo sapiens
agtgctcctttcattgctgccc

SEQ ID NO: 7348026 - DNA, 22 bp, Homo sapiens
agtgctcctcagaagagttgga

SEQ ID NO: 7348027 - DNA, 22 bp, Homo sapiens
agtgctcctgaagcttgaggca

SEQ ID NO: 7348028 - DNA, 22 bp, Homo sapiens
agtgctcctgccagctttctgg

SEQ ID NO: 7348029 - DNA, 22 bp, Homo sapiens
agtgctccaaaggttggtcatt

SEQ ID NO: 7348030 - DNA, 22 bp, Homo sapiens
agtgctccacattgcactattc

SEQ ID NO: 7348031 - DNA, 22 bp, Homo sapiens
agtgctccctagagttgtgcaa

SEQ ID NO: 7348032 - DNA, 22 bp, Homo sapiens
actactgatgtaaaggagcaat

SEQ ID NO: 7348033 - DNA, 22 bp, Homo sapiens
actacagtccctcatatgttgg

SEQ ID NO: 7348034 - DNA, 22 bp, Homo sapiens
aggtgggcacagatggagaagt

SEQ ID NO: 7348035 - DNA, 22 bp, Homo sapiens
aggtgggcactccgctcgaggt

SEQ ID NO: 7348036 - DNA, 22 bp, Homo sapiens
aggtgggcaccaggcttgtggt

SEQ ID NO: 7348037 - DNA, 22 bp, Homo sapiens
actagaaagcaaaagccatttc

SEQ ID NO: 7348038 - DNA, 22 bp, Homo sapiens
acgaggagcctgtggcctggta

SEQ ID NO: 7348039 - DNA, 22 bp, Homo sapiens
aggtctgtttaacaaagtcagg

SEQ ID NO: 7348040 - DNA, 22 bp, Homo sapiens
accttttacggtgtgactagca

SEQ ID NO: 7348041 - DNA, 22 bp, Homo sapiens
accttttcatctgaaactttta

SEQ ID NO: 7348042 - DNA, 20 bp, Homo sapiens
aggtcttccaatcagctcct

SEQ ID NO: 7348043 - DNA, 22 bp, Homo sapiens
aggtatttcaaagcccacttcc

SEQ ID NO: 7348044 - DNA, 22 bp, Homo sapiens
aggtagcttggtgctttcattc

SEQ ID NO: 7348045 - DNA, 21 bp, Homo sapiens
aggtcaaaggcatccatgagg

SEQ ID NO: 7348046 - DNA, 21 bp, Homo sapiens
aggtcaaaggcatccatgagg

SEQ ID NO: 7348047 - DNA, 22 bp, Homo sapiens
aggtcattgttaagtcaccata

SEQ ID NO: 7348048 - DNA, 22 bp, Homo sapiens
aggtcatttttgccttctattt

SEQ ID NO: 7348049 - DNA, 22 bp, Homo sapiens
aggtcatttccttagaggcaga

SEQ ID NO: 7348050 - DNA, 22 bp, Homo sapiens
agtactgtcagcagggtgttga

SEQ ID NO: 7348051 - DNA, 22 bp, Homo sapiens
agtactttttgttcaattgtgc

SEQ ID NO: 7348052 - DNA, 22 bp, Homo sapiens
agtacttttttgatatctgagt

SEQ ID NO: 7348053 - DNA, 22 bp, Homo sapiens
agtatacaaataaatgtgtaat

SEQ ID NO: 7348054 - DNA, 22 bp, Homo sapiens
agtatacatagagatggctgtt

SEQ ID NO: 7348055 - DNA, 22 bp, Homo sapiens
agtataattagatatcaaaagt

SEQ ID NO: 7348056 - DNA, 22 bp, Homo sapiens
aggtgggcgctgctcccgctgg

SEQ ID NO: 7348057 - DNA, 22 bp, Homo sapiens
aggtgggcccagtgggctccag

SEQ ID NO: 7348058 - DNA, 22 bp, Homo sapiens
aggtgggcggatcacaaggtca

SEQ ID NO: 7348059 - DNA, 22 bp, Homo sapiens
aggtgggcatagctagaatatt

SEQ ID NO: 7348060 - DNA, 21 bp, Homo sapiens
aggtgggcaggtggagtggcc

SEQ ID NO: 7348061 - DNA, 22 bp, Homo sapiens
aggtgggcggattcatgaggtc

SEQ ID NO: 7348062 - DNA, 22 bp, Homo sapiens
aggtgggcttggtgccaacatg

SEQ ID NO: 7348063 - DNA, 22 bp, Homo sapiens
agtacatgtggtcctggccaga

SEQ ID NO: 7348064 - DNA, 22 bp, Homo sapiens
agtacatgcagaactaacagat

SEQ ID NO: 7348065 - DNA, 22 bp, Homo sapiens
agtcactgaataccttaatgtt

SEQ ID NO: 7348066 - DNA, 22 bp, Homo sapiens
actcctgggttccggagattct

SEQ ID NO: 7348067 - DNA, 22 bp, Homo sapiens
actcctgggtgctgaccagcgt

SEQ ID NO: 7348068 - DNA, 22 bp, Homo sapiens
actcctggaaaagaacgcaggg

SEQ ID NO: 7348069 - DNA, 22 bp, Homo sapiens
actcctggggctgccatcacag

SEQ ID NO: 7348070 - DNA, 22 bp, Homo sapiens
actcctcagccagcatcaggga

SEQ ID NO: 7348071 - DNA, 22 bp, Homo sapiens
actccgggagccaggagaggct

SEQ ID NO: 7348072 - DNA, 22 bp, Homo sapiens
actcctgctgtcactgcagttc

SEQ ID NO: 7348073 - DNA, 22 bp, Homo sapiens
actcctgcttcttccctgagga

SEQ ID NO: 7348074 - DNA, 22 bp, Homo sapiens
actccctccaaatctgcacagt

SEQ ID NO: 7348075 - DNA, 22 bp, Homo sapiens
actccctccaaatctgcacagt

SEQ ID NO: 7348076 - DNA, 22 bp, Homo sapiens
actccctgcaagattttccatg

SEQ ID NO: 7348077 - DNA, 22 bp, Homo sapiens
actccctgtacttgcctctctt

SEQ ID NO: 7348078 - DNA, 22 bp, Homo sapiens
actccctggcaggtctttatct

SEQ ID NO: 7348079 - DNA, 21 bp, Homo sapiens
actccctgcataagtgattta

SEQ ID NO: 7348080 - DNA, 22 bp, Homo sapiens
actccagggttttgcacctgga

SEQ ID NO: 7348081 - DNA, 22 bp, Homo sapiens
actccagggttttgcacctgga

SEQ ID NO: 7348082 - DNA, 22 bp, Homo sapiens
agtcacttaacatttgctgcag

SEQ ID NO: 7348083 - DNA, 22 bp, Homo sapiens
agtcactgtttaatctagctaa

SEQ ID NO: 7348084 - DNA, 22 bp, Homo sapiens
agtcacttaataggttcatctg

SEQ ID NO: 7348085 - DNA, 22 bp, Homo sapiens
agtcactgtttcagaactgagt

SEQ ID NO: 7348086 - DNA, 22 bp, Homo sapiens
agtcacttcatggtttcttgga

SEQ ID NO: 7348087 - DNA, 22 bp, Homo sapiens
agtcacttcctgcttgacctga

SEQ ID NO: 7348088 - DNA, 22 bp, Homo sapiens
agtcactgggctgcttcctata

SEQ ID NO: 7348089 - DNA, 22 bp, Homo sapiens
agtcactgctttgtccctgtgt

SEQ ID NO: 7348090 - DNA, 22 bp, Homo sapiens
agtcactggttctgtaattaat

SEQ ID NO: 7348091 - DNA, 22 bp, Homo sapiens
agtcactgagatggtgaggcta

SEQ ID NO: 7348092 - DNA, 22 bp, Homo sapiens
agtcactgtcaaagccacacac

SEQ ID NO: 7348093 - DNA, 22 bp, Homo sapiens
agtcactgttctgtcatgtcaa

SEQ ID NO: 7348094 - DNA, 22 bp, Homo sapiens
agtcactgtcttgcaaaggtca

SEQ ID NO: 7348095 - DNA, 22 bp, Homo sapiens
aggaagagcattcacatggtag

SEQ ID NO: 7348096 - DNA, 22 bp, Homo sapiens
aggaaaaagagttgctgccttc

SEQ ID NO: 7348097 - DNA, 22 bp, Homo sapiens
aggaaaaacctgttaatggtag

SEQ ID NO: 7348098 - DNA, 22 bp, Homo sapiens
aggaaaaaagtctgtgattata

SEQ ID NO: 7348099 - DNA, 22 bp, Homo sapiens
agcttttagtacgttaaaattg

SEQ ID NO: 7348100 - DNA, 23 bp, Homo sapiens
agcttttaggtggaaatggcact

SEQ ID NO: 7348101 - DNA, 22 bp, Homo sapiens
agctgtgtagggaatcagagaa

SEQ ID NO: 7348102 - DNA, 22 bp, Homo sapiens
agcttagcacacacaggcaggt

SEQ ID NO: 7348103 - DNA, 22 bp, Homo sapiens
agcttcaggaacaggcagcctg

SEQ ID NO: 7348104 - DNA, 22 bp, Homo sapiens
agctgtgtaagtcatgtaggtg

SEQ ID NO: 7348105 - DNA, 22 bp, Homo sapiens
agctgtgtaagtcatgtaggtg

SEQ ID NO: 7348106 - DNA, 22 bp, Homo sapiens
agctgtgggcctgggagagctg

SEQ ID NO: 7348107 - DNA, 22 bp, Homo sapiens
agctgggcaaaatgtgaggttg

SEQ ID NO: 7348108 - DNA, 22 bp, Homo sapiens
agctgcagctacagtgttggtt

SEQ ID NO: 7348109 - DNA, 22 bp, Homo sapiens
agctgcagccgcagctgtggcc

SEQ ID NO: 7348110 - DNA, 22 bp, Homo sapiens
agctgcagcctcatgattcggt

SEQ ID NO: 7348111 - DNA, 22 bp, Homo sapiens
acagccagtgactggacaagct

SEQ ID NO: 7348112 - DNA, 22 bp, Homo sapiens
acagccagtgctccgtgaggac

SEQ ID NO: 7348113 - DNA, 22 bp, Homo sapiens
acagccagtgctccgtgaggac

SEQ ID NO: 7348114 - DNA, 23 bp, Homo sapiens
acagccagttcacctctccttgg

SEQ ID NO: 7348115 - DNA, 22 bp, Homo sapiens
agctccaggtgcaagtcatggt

SEQ ID NO: 7348116 - DNA, 22 bp, Homo sapiens
agctccaggtgcaagtcatggt

SEQ ID NO: 7348117 - DNA, 22 bp, Homo sapiens
agctcccagaagccagagtcgg

SEQ ID NO: 7348118 - DNA, 22 bp, Homo sapiens
agctcccagaagccagagtcgg

SEQ ID NO: 7348119 - DNA, 22 bp, Homo sapiens
acagccagaggtggtcctgggt

SEQ ID NO: 7348120 - DNA, 22 bp, Homo sapiens
acagccagtcatctcagcaggg

SEQ ID NO: 7348121 - DNA, 22 bp, Homo sapiens
acagccagtcatctcagcaggg

SEQ ID NO: 7348122 - DNA, 22 bp, Homo sapiens
acagccagtaatctacccctgt

SEQ ID NO: 7348123 - DNA, 22 bp, Homo sapiens
acagccagtcctcccacagggt

SEQ ID NO: 7348124 - DNA, 22 bp, Homo sapiens
acagccagtgactgcagaccct

SEQ ID NO: 7348125 - DNA, 22 bp, Homo sapiens
acagccagtgactgcagaccct

SEQ ID NO: 7348126 - DNA, 22 bp, Homo sapiens
acagccagggtctcaggaggcg

SEQ ID NO: 7348127 - DNA, 22 bp, Homo sapiens
acagccagtaaggaaagaccca

SEQ ID NO: 7348128 - DNA, 22 bp, Homo sapiens
acagccaggtaaaggcatggca

SEQ ID NO: 7348129 - DNA, 22 bp, Homo sapiens
acagccaggtaaaggcatggca

SEQ ID NO: 7348130 - DNA, 21 bp, Homo sapiens
acagcctccatctcctgggct

SEQ ID NO: 7348131 - DNA, 21 bp, Homo sapiens
acagcctccatctcctgggct

SEQ ID NO: 7348132 - DNA, 22 bp, Homo sapiens
agctgctggggagggcagacac

SEQ ID NO: 7348133 - DNA, 22 bp, Homo sapiens
agctgctgtcctaggcactgta

SEQ ID NO: 7348134 - DNA, 22 bp, Homo sapiens
agctgctggtttaagggatggg

SEQ ID NO: 7348135 - DNA, 22 bp, Homo sapiens
agctggcctgttagagctgagt

SEQ ID NO: 7348136 - DNA, 22 bp, Homo sapiens
agctggctatgccctgtgaacc

SEQ ID NO: 7348137 - DNA, 22 bp, Homo sapiens
acatacacaagcgtacatgaac

SEQ ID NO: 7348138 - DNA, 22 bp, Homo sapiens
acatacacacatactttctcct

SEQ ID NO: 7348139 - DNA, 22 bp, Homo sapiens
acatacacatgaatatattttt

SEQ ID NO: 7348140 - DNA, 23 bp, Homo sapiens
acatacataagcaccacattttg

SEQ ID NO: 7348141 - DNA, 23 bp, Homo sapiens
acatacataagcaccacattttg

SEQ ID NO: 7348142 - DNA, 17 bp, Homo sapiens
acatacactggtgaaca

SEQ ID NO: 7348143 - DNA, 22 bp, Homo sapiens
acatacacgggaaacctctttt

SEQ ID NO: 7348144 - DNA, 22 bp, Homo sapiens
acatacatcaagtatcacaaga

SEQ ID NO: 7348145 - DNA, 23 bp, Homo sapiens
acatacatggagataaagtgatg

SEQ ID NO: 7348146 - DNA, 23 bp, Homo sapiens
acatacatggagataaagtgatg

SEQ ID NO: 7348147 - DNA, 22 bp, Homo sapiens
acatacatatgacaactttcct

SEQ ID NO: 7348148 - DNA, 22 bp, Homo sapiens
acatacatcaagtatcacaaga

SEQ ID NO: 7348149 - DNA, 22 bp, Homo sapiens
acatacatatgtttaaatgcat

SEQ ID NO: 7348150 - DNA, 22 bp, Homo sapiens
acatacatatgtttaaatgcat

SEQ ID NO: 7348151 - DNA, 22 bp, Homo sapiens
acataaatttcactgttccgtg

SEQ ID NO: 7348152 - DNA, 22 bp, Homo sapiens
aggcaaaattacaaagttatta

SEQ ID NO: 7348153 - DNA, 22 bp, Homo sapiens
aggaggggttctcgggtgctga

SEQ ID NO: 7348154 - DNA, 22 bp, Homo sapiens
aggaggggttctcgggtgctga

SEQ ID NO: 7348155 - DNA, 22 bp, Homo sapiens
aggaggggttctcgggtgctga

SEQ ID NO: 7348156 - DNA, 22 bp, Homo sapiens
aggaggggttctcgggtgctga

SEQ ID NO: 7348157 - DNA, 21 bp, Homo sapiens
aggaggggtctttcccactga

SEQ ID NO: 7348158 - DNA, 21 bp, Homo sapiens
aggaggggtctttcccactga

SEQ ID NO: 7348159 - DNA, 21 bp, Homo sapiens
aggaggggtctttcccactga

SEQ ID NO: 7348160 - DNA, 22 bp, Homo sapiens
aggaggggttctcgggtgctga

SEQ ID NO: 7348161 - DNA, 20 bp, Homo sapiens
aggagggacctggattggcg

SEQ ID NO: 7348162 - DNA, 22 bp, Homo sapiens
aggagggacaccaatatatgtt

SEQ ID NO: 7348163 - DNA, 22 bp, Homo sapiens
aggagggacctaggaatattgc

SEQ ID NO: 7348164 - DNA, 22 bp, Homo sapiens
aggagggagatgcccatcctgg

SEQ ID NO: 7348165 - DNA, 22 bp, Homo sapiens
aggaggggcatagaaatgtaat

SEQ ID NO: 7348166 - DNA, 22 bp, Homo sapiens
aggaggggcatagaaatgtaat

SEQ ID NO: 7348167 - DNA, 22 bp, Homo sapiens
aggaggggcatagaaatgtaat

SEQ ID NO: 7348168 - DNA, 17 bp, Homo sapiens
aggagggaaatagcttg

SEQ ID NO: 7348169 - DNA, 22 bp, Homo sapiens
aggagggaataagaaagagtca

SEQ ID NO: 7348170 - DNA, 17 bp, Homo sapiens
aggagggaaatagcttg

SEQ ID NO: 7348171 - DNA, 22 bp, Homo sapiens
aggaggccgatttcagaggtcg

SEQ ID NO: 7348172 - DNA, 22 bp, Homo sapiens
aggaggctgtggagcactccat

SEQ ID NO: 7348173 - DNA, 22 bp, Homo sapiens
aggagacatactataggaatat

SEQ ID NO: 7348174 - DNA, 22 bp, Homo sapiens
acaggggctccgaaggtgaggg

SEQ ID NO: 7348175 - DNA, 22 bp, Homo sapiens
aggaagggatacataggatagt

SEQ ID NO: 7348176 - DNA, 22 bp, Homo sapiens
aggaagggatacataggatagt

SEQ ID NO: 7348177 - DNA, 17 bp, Homo sapiens
aggaagggcaagtttct

SEQ ID NO: 7348178 - DNA, 22 bp, Homo sapiens
aggaagggagcagtttgttgtt

SEQ ID NO: 7348179 - DNA, 22 bp, Homo sapiens
aggaaggagggcagatattaag

SEQ ID NO: 7348180 - DNA, 23 bp, Homo sapiens
aggaaggaggtcctaacagtatc

SEQ ID NO: 7348181 - DNA, 22 bp, Homo sapiens
aggagccatggaggtgaggcgg

SEQ ID NO: 7348182 - DNA, 22 bp, Homo sapiens
aggagccatggaggtgaggcgg

SEQ ID NO: 7348183 - DNA, 22 bp, Homo sapiens
aggagccatgagtgacatcaca

SEQ ID NO: 7348184 - DNA, 22 bp, Homo sapiens
aggagccatgagtgacatcaca

SEQ ID NO: 7348185 - DNA, 22 bp, Homo sapiens
acaggggtgcatggtgcatggt

SEQ ID NO: 7348186 - DNA, 22 bp, Homo sapiens
acagggggtcccatggcctgga

SEQ ID NO: 7348187 - DNA, 22 bp, Homo sapiens
acaggggctccgaaggtgaggg

SEQ ID NO: 7348188 - DNA, 22 bp, Homo sapiens
acagggtgaatgtgacattatc

SEQ ID NO: 7348189 - DNA, 22 bp, Homo sapiens
acagggtgactttgtgacagat

SEQ ID NO: 7348190 - DNA, 22 bp, Homo sapiens
acagggtggggatggtgagctt

SEQ ID NO: 7348191 - DNA, 22 bp, Homo sapiens
acagggtgactttgtgacagat

SEQ ID NO: 7348192 - DNA, 22 bp, Homo sapiens
aggagctgcttaaatggttggt

SEQ ID NO: 7348193 - DNA, 22 bp, Homo sapiens
aggagccctgcgggaggcagag

SEQ ID NO: 7348194 - DNA, 23 bp, Homo sapiens
aggagcccctaattctgggcagc

SEQ ID NO: 7348195 - DNA, 23 bp, Homo sapiens
aggagcccaaggagaggtaactt

SEQ ID NO: 7348196 - DNA, 22 bp, Homo sapiens
aggagcctgagtcacagtgcct

SEQ ID NO: 7348197 - DNA, 22 bp, Homo sapiens
acccagggtttgagctctgcag

SEQ ID NO: 7348198 - DNA, 22 bp, Homo sapiens
acccagggtagagtgcagtggc

SEQ ID NO: 7348199 - DNA, 22 bp, Homo sapiens
acccagagcagagcttggcttc

SEQ ID NO: 7348200 - DNA, 22 bp, Homo sapiens
acccagagatgtcaatggcttt

SEQ ID NO: 7348201 - DNA, 22 bp, Homo sapiens
acccagggtagagtgcagtggc

SEQ ID NO: 7348202 - DNA, 22 bp, Homo sapiens
acccagggtagaacctcagagc

SEQ ID NO: 7348203 - DNA, 22 bp, Homo sapiens
acccagggaccccgctgacgcc

SEQ ID NO: 7348204 - DNA, 22 bp, Homo sapiens
acccaccctactagcagtgtcc

SEQ ID NO: 7348205 - DNA, 22 bp, Homo sapiens
acccagagaactgtgccttgag

SEQ ID NO: 7348206 - DNA, 22 bp, Homo sapiens
acccagagaactgaggcatgaa

SEQ ID NO: 7348207 - DNA, 22 bp, Homo sapiens
acccactgtcatctctgaccac

SEQ ID NO: 7348208 - DNA, 22 bp, Homo sapiens
acccactgtagccactctgggt

SEQ ID NO: 7348209 - DNA, 22 bp, Homo sapiens
agggcctctggaacactgaggg

SEQ ID NO: 7348210 - DNA, 21 bp, Homo sapiens
agggcctctcatttgtgccag

SEQ ID NO: 7348211 - DNA, 22 bp, Homo sapiens
agggcctctggaacactgaggg

SEQ ID NO: 7348212 - DNA, 23 bp, Homo sapiens
agggcctctgtcccccagcactc

SEQ ID NO: 7348213 - DNA, 22 bp, Homo sapiens
agggcctgacacccttgccagc

SEQ ID NO: 7348214 - DNA, 22 bp, Homo sapiens
agggcctgacacccttgccagc

SEQ ID NO: 7348215 - DNA, 22 bp, Homo sapiens
acccattcctctcctgagggat

SEQ ID NO: 7348216 - DNA, 22 bp, Homo sapiens
acccattcctttacttcatctg

SEQ ID NO: 7348217 - DNA, 22 bp, Homo sapiens
accccactaccccggcagatgg

SEQ ID NO: 7348218 - DNA, 22 bp, Homo sapiens
accccactcacacatggacctg

SEQ ID NO: 7348219 - DNA, 22 bp, Homo sapiens
accccactcctctgttttaact

SEQ ID NO: 7348220 - DNA, 22 bp, Homo sapiens
accctggactggggctgaggct

SEQ ID NO: 7348221 - DNA, 22 bp, Homo sapiens
accctgcctctgcttcctgtag

SEQ ID NO: 7348222 - DNA, 22 bp, Homo sapiens
accctgcctgacaacagaggat

SEQ ID NO: 7348223 - DNA, 22 bp, Homo sapiens
accctgcctgacaacagaggat

SEQ ID NO: 7348224 - DNA, 22 bp, Homo sapiens
accccagccctgcttctgggag

SEQ ID NO: 7348225 - DNA, 20 bp, Homo sapiens
accccagcccctctatctga

SEQ ID NO: 7348226 - DNA, 22 bp, Homo sapiens
accccagcgcatatggtctgcg

SEQ ID NO: 7348227 - DNA, 22 bp, Homo sapiens
accccagctctgagccacacca

SEQ ID NO: 7348228 - DNA, 22 bp, Homo sapiens
accctggctctctggccaccgc

SEQ ID NO: 7348229 - DNA, 22 bp, Homo sapiens
accctggcctggttcatgtgat

SEQ ID NO: 7348230 - DNA, 18 bp, Homo sapiens
accctggcatgctcttcc

SEQ ID NO: 7348231 - DNA, 22 bp, Homo sapiens
accctggcccattgctgtgcct

SEQ ID NO: 7348232 - DNA, 22 bp, Homo sapiens
accctgggcacaccatttcccc

SEQ ID NO: 7348233 - DNA, 22 bp, Homo sapiens
accctgggagggagaaatcaga

SEQ ID NO: 7348234 - DNA, 23 bp, Homo sapiens
accctgggcaagtcacctaacct

SEQ ID NO: 7348235 - DNA, 18 bp, Homo sapiens
accctgggcaattcactc

SEQ ID NO: 7348236 - DNA, 22 bp, Homo sapiens
accctgggaactggaaactgga

SEQ ID NO: 7348237 - DNA, 22 bp, Homo sapiens
accctgggacctggaggtggat

SEQ ID NO: 7348238 - DNA, 22 bp, Homo sapiens
accctgggacttccgagttgag

SEQ ID NO: 7348239 - DNA, 22 bp, Homo sapiens
accctgggcttggcctgctcag

SEQ ID NO: 7348240 - DNA, 22 bp, Homo sapiens
accctgggggtggccagtgcca

SEQ ID NO: 7348241 - DNA, 22 bp, Homo sapiens
accctggggtcacccttctctg

SEQ ID NO: 7348242 - DNA, 16 bp, Homo sapiens
accctgggtagtcctg

SEQ ID NO: 7348243 - DNA, 22 bp, Homo sapiens
accctgggtatttcccaaactt

SEQ ID NO: 7348244 - DNA, 22 bp, Homo sapiens
accctgggtcatatacagtgtg

SEQ ID NO: 7348245 - DNA, 22 bp, Homo sapiens
accctgggttcccgcagcacca

SEQ ID NO: 7348246 - DNA, 21 bp, Homo sapiens
accctgggttctccataccct

SEQ ID NO: 7348247 - DNA, 22 bp, Homo sapiens
accctgggtctcaatcatccta

SEQ ID NO: 7348248 - DNA, 22 bp, Homo sapiens
accctgggtgagaggcaaacag

SEQ ID NO: 7348249 - DNA, 22 bp, Homo sapiens
accaggggatggttggcactgt

SEQ ID NO: 7348250 - DNA, 22 bp, Homo sapiens
accaggggtgtcaacagcattt

SEQ ID NO: 7348251 - DNA, 22 bp, Homo sapiens
accatacattaaatgactttca

SEQ ID NO: 7348252 - DNA, 22 bp, Homo sapiens
agggccagttctacctctgaat

SEQ ID NO: 7348253 - DNA, 22 bp, Homo sapiens
agggcctcctaatttcctcata

SEQ ID NO: 7348254 - DNA, 22 bp, Homo sapiens
agggcctcgggctcagtgggtc

SEQ ID NO: 7348255 - DNA, 22 bp, Homo sapiens
agggcctcgaaggcagagggat

SEQ ID NO: 7348256 - DNA, 22 bp, Homo sapiens
agggcctcgggctcagtgggtc

SEQ ID NO: 7348257 - DNA, 22 bp, Homo sapiens
agggcctcgaaggcagagggat

SEQ ID NO: 7348258 - DNA, 22 bp, Homo sapiens
accagtgtcttattgaccatct

SEQ ID NO: 7348259 - DNA, 22 bp, Homo sapiens
accaggaagctgtgagaccttt

SEQ ID NO: 7348260 - DNA, 22 bp, Homo sapiens
accaaatgcttggctgctgtga

SEQ ID NO: 7348261 - DNA, 22 bp, Homo sapiens
accaagatttaacatgcctttt

SEQ ID NO: 7348262 - DNA, 22 bp, Homo sapiens
accaaggaagaatctatttgag

SEQ ID NO: 7348263 - DNA, 22 bp, Homo sapiens
accaaggagaaggtgcaagctt

SEQ ID NO: 7348264 - DNA, 22 bp, Homo sapiens
accaaggaagagattctcagtt

SEQ ID NO: 7348265 - DNA, 22 bp, Homo sapiens
accaaggagacaaaggtgtatt

SEQ ID NO: 7348266 - DNA, 22 bp, Homo sapiens
accaaggagccacatacaacct

SEQ ID NO: 7348267 - DNA, 22 bp, Homo sapiens
accaaggagtttggtattttag

SEQ ID NO: 7348268 - DNA, 17 bp, Homo sapiens
accaatgtcagacaaag

SEQ ID NO: 7348269 - DNA, 17 bp, Homo sapiens
accaatgtcagacaaag

SEQ ID NO: 7348270 - DNA, 22 bp, Homo sapiens
accacactggctagtgaagaag

SEQ ID NO: 7348271 - DNA, 22 bp, Homo sapiens
accacagaggaatttgaagagg

SEQ ID NO: 7348272 - DNA, 22 bp, Homo sapiens
accacagctttgcaccaggtgt

SEQ ID NO: 7348273 - DNA, 22 bp, Homo sapiens
acatgaaaaatgtttgcagttt

SEQ ID NO: 7348274 - DNA, 22 bp, Homo sapiens
acatgaaaagactatctgatta

SEQ ID NO: 7348275 - DNA, 22 bp, Homo sapiens
aggccagccctgggctgagaga

SEQ ID NO: 7348276 - DNA, 22 bp, Homo sapiens
aggccagcctcaggcagggacc

SEQ ID NO: 7348277 - DNA, 22 bp, Homo sapiens
aggccagcagcatgacggcatc

SEQ ID NO: 7348278 - DNA, 22 bp, Homo sapiens
aggccagcagacgtgggactga

SEQ ID NO: 7348279 - DNA, 22 bp, Homo sapiens
aggccctgagcatccgagggca

SEQ ID NO: 7348280 - DNA, 22 bp, Homo sapiens
aggccctgagaaaatccctgca

SEQ ID NO: 7348281 - DNA, 22 bp, Homo sapiens
aggcccagggctgctctctgaa

SEQ ID NO: 7348282 - DNA, 22 bp, Homo sapiens
aggcatggcattcctcaagcaa

SEQ ID NO: 7348283 - DNA, 22 bp, Homo sapiens
acatacatggtgctttcttggt

SEQ ID NO: 7348284 - DNA, 22 bp, Homo sapiens
aggcatggctttaggcaggcgt

SEQ ID NO: 7348285 - DNA, 22 bp, Homo sapiens
aggcatggctttaggcaggcgt

SEQ ID NO: 7348286 - DNA, 20 bp, Homo sapiens
aggcatgggatgcccagatt

SEQ ID NO: 7348287 - DNA, 22 bp, Homo sapiens
aggccacagagagtgcatgtgc

SEQ ID NO: 7348288 - DNA, 22 bp, Homo sapiens
aggccacaatttgatttggttt

SEQ ID NO: 7348289 - DNA, 22 bp, Homo sapiens
aggccacacaactcttagagat

SEQ ID NO: 7348290 - DNA, 18 bp, Homo sapiens
aggcatggtggtgcgcac

SEQ ID NO: 7348291 - DNA, 22 bp, Homo sapiens
aggccacaggcaccctgtgttc

SEQ ID NO: 7348292 - DNA, 22 bp, Homo sapiens
aggccacaggattgcacagcat

SEQ ID NO: 7348293 - DNA, 22 bp, Homo sapiens
aggccacaggagtactgtcggt

SEQ ID NO: 7348294 - DNA, 22 bp, Homo sapiens
aggccacagcctgggaggtgac

SEQ ID NO: 7348295 - DNA, 22 bp, Homo sapiens
aggccacagcctgggaggtgac

SEQ ID NO: 7348296 - DNA, 22 bp, Homo sapiens
aggccctgatccgaatccagat

SEQ ID NO: 7348297 - DNA, 22 bp, Homo sapiens
aggccctgcaggaagcaggatg

SEQ ID NO: 7348298 - DNA, 22 bp, Homo sapiens
aggccctgcaggagtggggaca

SEQ ID NO: 7348299 - DNA, 22 bp, Homo sapiens
acattcaagatgcattcactta

SEQ ID NO: 7348300 - DNA, 22 bp, Homo sapiens
acattcaagatgcattcactta

SEQ ID NO: 7348301 - DNA, 22 bp, Homo sapiens
aggccctgcattgtactgaggg

SEQ ID NO: 7348302 - DNA, 22 bp, Homo sapiens
acattcatgggttttacattat

SEQ ID NO: 7348303 - DNA, 22 bp, Homo sapiens
acattcaggccacagtggagtc

SEQ ID NO: 7348304 - DNA, 22 bp, Homo sapiens
acattcatgcaccttcctatcc

SEQ ID NO: 7348305 - DNA, 22 bp, Homo sapiens
acattctaacattgtacagata

SEQ ID NO: 7348306 - DNA, 22 bp, Homo sapiens
acattctaaagcatgctcagga

SEQ ID NO: 7348307 - DNA, 22 bp, Homo sapiens
acattcctttcttgagcacagt

SEQ ID NO: 7348308 - DNA, 22 bp, Homo sapiens
acattcctgcctccccggagat

SEQ ID NO: 7348309 - DNA, 22 bp, Homo sapiens
acattcctgccataaatttttt

SEQ ID NO: 7348310 - DNA, 22 bp, Homo sapiens
acattcctacctgctcgggtgt

SEQ ID NO: 7348311 - DNA, 22 bp, Homo sapiens
acattcctcagtgccagttgag

SEQ ID NO: 7348312 - DNA, 22 bp, Homo sapiens
acattcctgaatgggcacattt

SEQ ID NO: 7348313 - DNA, 22 bp, Homo sapiens
acattcctgaggaaatacattc

SEQ ID NO: 7348314 - DNA, 22 bp, Homo sapiens
acattctagatatgttatattt

SEQ ID NO: 7348315 - DNA, 22 bp, Homo sapiens
acattctatgaagataatttta

SEQ ID NO: 7348316 - DNA, 22 bp, Homo sapiens
acattgaaagcatattatctcc

SEQ ID NO: 7348317 - DNA, 22 bp, Homo sapiens
aggcttccgagtagctgggact

SEQ ID NO: 7348318 - DNA, 22 bp, Homo sapiens
aggcttcattgtggcatcagga

SEQ ID NO: 7348319 - DNA, 22 bp, Homo sapiens
aggcttcatatttaggcatatg

SEQ ID NO: 7348320 - DNA, 19 bp, Homo sapiens
aggcttcaggccacatgct

SEQ ID NO: 7348321 - DNA, 22 bp, Homo sapiens
aggctccaggcccttcaccagc

SEQ ID NO: 7348322 - DNA, 22 bp, Homo sapiens
acattgaagggctatccaatag

SEQ ID NO: 7348323 - DNA, 22 bp, Homo sapiens
acattgaattcaaaattactga

SEQ ID NO: 7348324 - DNA, 22 bp, Homo sapiens
acattgaatttcacttttgtac

SEQ ID NO: 7348325 - DNA, 22 bp, Homo sapiens
acattgaacagtacaaatgatc

SEQ ID NO: 7348326 - DNA, 22 bp, Homo sapiens
acattgaaccagtagacacaaa

SEQ ID NO: 7348327 - DNA, 22 bp, Homo sapiens
acattgaactacttgtaatgag

SEQ ID NO: 7348328 - DNA, 22 bp, Homo sapiens
acattgaagctgtgaaatcaaa

SEQ ID NO: 7348329 - DNA, 22 bp, Homo sapiens
acattgagtgctccataaatca

SEQ ID NO: 7348330 - DNA, 22 bp, Homo sapiens
acattgagcctcacctagatgc

SEQ ID NO: 7348331 - DNA, 19 bp, Homo sapiens
acattgaattttcttcttt

SEQ ID NO: 7348332 - DNA, 22 bp, Homo sapiens
acattgacaaagattgagctgt

SEQ ID NO: 7348333 - DNA, 22 bp, Homo sapiens
aggctccagcccaaggctgcag

SEQ ID NO: 7348334 - DNA, 22 bp, Homo sapiens
aggctccagcccaaggctgcag

SEQ ID NO: 7348335 - DNA, 22 bp, Homo sapiens
aggctccagcagccagaggaag

SEQ ID NO: 7348336 - DNA, 22 bp, Homo sapiens
agatgattatgatagcactgtt

SEQ ID NO: 7348337 - DNA, 22 bp, Homo sapiens
agatgctgggatgcttggatgg

SEQ ID NO: 7348338 - DNA, 22 bp, Homo sapiens
attggctttgatatctaaaggg

SEQ ID NO: 7348339 - DNA, 22 bp, Homo sapiens
attggggagagctaatatttta

SEQ ID NO: 7348340 - DNA, 22 bp, Homo sapiens
attggtctggggaaatgaagag

SEQ ID NO: 7348341 - DNA, 22 bp, Homo sapiens
attggtctccacttgttttaga

SEQ ID NO: 7348342 - DNA, 23 bp, Homo sapiens
agatcacatgctgatggaaaatg

SEQ ID NO: 7348343 - DNA, 23 bp, Homo sapiens
agatcacatagttatcagatgac

SEQ ID NO: 7348344 - DNA, 22 bp, Homo sapiens
agatcacataatttcctgtgac

SEQ ID NO: 7348345 - DNA, 22 bp, Homo sapiens
agatcacagtcaattgcaagtt

SEQ ID NO: 7348346 - DNA, 22 bp, Homo sapiens
agatattttgtgtgatgtttca

SEQ ID NO: 7348347 - DNA, 22 bp, Homo sapiens
agatcaaatctgggatttctaa

SEQ ID NO: 7348348 - DNA, 22 bp, Homo sapiens
agatatttaaatcagacaaaga

SEQ ID NO: 7348349 - DNA, 22 bp, Homo sapiens
agatatttgtatcttgctattg

SEQ ID NO: 7348350 - DNA, 20 bp, Homo sapiens
agcaacaataaaatgtcctg

SEQ ID NO: 7348351 - DNA, 22 bp, Homo sapiens
agcaaatggatttctgaaccta

SEQ ID NO: 7348352 - DNA, 22 bp, Homo sapiens
agatgtgggagatgcttctgca

SEQ ID NO: 7348353 - DNA, 22 bp, Homo sapiens
agatgttccagccaatgggaat

SEQ ID NO: 7348354 - DNA, 22 bp, Homo sapiens
agatgtttaaaaagatgactct

SEQ ID NO: 7348355 - DNA, 22 bp, Homo sapiens
attttagttttagcatccatgc

SEQ ID NO: 7348356 - DNA, 17 bp, Homo sapiens
caaaccagtaagactgc

SEQ ID NO: 7348357 - DNA, 22 bp, Homo sapiens
caaagcagaaggttctgtggta

SEQ ID NO: 7348358 - DNA, 22 bp, Homo sapiens
caaaggcaggtcatggccactt

SEQ ID NO: 7348359 - DNA, 22 bp, Homo sapiens
agcaagaagctttgctgtgata

SEQ ID NO: 7348360 - DNA, 22 bp, Homo sapiens
agcaagaaatcttcagtgttct

SEQ ID NO: 7348361 - DNA, 22 bp, Homo sapiens
agaggccaccactgtcagggac

SEQ ID NO: 7348362 - DNA, 22 bp, Homo sapiens
agaggccagcactgcagggaag

SEQ ID NO: 7348363 - DNA, 22 bp, Homo sapiens
agaggccagcactgcagggaag

SEQ ID NO: 7348364 - DNA, 22 bp, Homo sapiens
agaggctggattgagcatagac

SEQ ID NO: 7348365 - DNA, 23 bp, Homo sapiens
agaggctgcagggtattgagaat

SEQ ID NO: 7348366 - DNA, 18 bp, Homo sapiens
agaggctggacaggggat

SEQ ID NO: 7348367 - DNA, 22 bp, Homo sapiens
agaggctgcacttgctcatgat

SEQ ID NO: 7348368 - DNA, 22 bp, Homo sapiens
agaggctgcacttgctcatgat

SEQ ID NO: 7348369 - DNA, 23 bp, Homo sapiens
agaggccagcctttggagacacc

SEQ ID NO: 7348370 - DNA, 22 bp, Homo sapiens
agaggccaggctgcagagggat

SEQ ID NO: 7348371 - DNA, 22 bp, Homo sapiens
attacagaagatatgctcaaca

SEQ ID NO: 7348372 - DNA, 22 bp, Homo sapiens
attacagtaacagctacaatgc

SEQ ID NO: 7348373 - DNA, 22 bp, Homo sapiens
attacagcttgctcagtttgca

SEQ ID NO: 7348374 - DNA, 22 bp, Homo sapiens
attacacagcggttactactag

SEQ ID NO: 7348375 - DNA, 22 bp, Homo sapiens
agagctgggaccgtctggaagt

SEQ ID NO: 7348376 - DNA, 22 bp, Homo sapiens
agaggaggctgggtccagataa

SEQ ID NO: 7348377 - DNA, 22 bp, Homo sapiens
agaggaggctgggtccagataa

SEQ ID NO: 7348378 - DNA, 22 bp, Homo sapiens
agaggcaagttcagagctagga

SEQ ID NO: 7348379 - DNA, 22 bp, Homo sapiens
agaggcacagaggcagtcccct

SEQ ID NO: 7348380 - DNA, 18 bp, Homo sapiens
agaggggaggtaagtctg

SEQ ID NO: 7348381 - DNA, 22 bp, Homo sapiens
agaggggcaagtaaagagtctt

SEQ ID NO: 7348382 - DNA, 22 bp, Homo sapiens
agaggggcaagtaaagagtctt

SEQ ID NO: 7348383 - DNA, 22 bp, Homo sapiens
agaggggcaagtaaagagtctt

SEQ ID NO: 7348384 - DNA, 22 bp, Homo sapiens
agaggggagtcctaatctgatt

SEQ ID NO: 7348385 - DNA, 22 bp, Homo sapiens
agaggggctcaagcagtggtct

SEQ ID NO: 7348386 - DNA, 22 bp, Homo sapiens
agaggggcagggtctccggatt

SEQ ID NO: 7348387 - DNA, 22 bp, Homo sapiens
agaggggcagggtctccggatt

SEQ ID NO: 7348388 - DNA, 22 bp, Homo sapiens
agaggggcagggtctccggatt

SEQ ID NO: 7348389 - DNA, 22 bp, Homo sapiens
agaggggcccggttctccgtct

SEQ ID NO: 7348390 - DNA, 22 bp, Homo sapiens
agaggggcccggttctccgtct

SEQ ID NO: 7348391 - DNA, 22 bp, Homo sapiens
agaggggcgggaactcaacctc

SEQ ID NO: 7348392 - DNA, 22 bp, Homo sapiens
agaggggcgggaactcaacctc

SEQ ID NO: 7348393 - DNA, 22 bp, Homo sapiens
agaggggacagccacctgcccg

SEQ ID NO: 7348394 - DNA, 22 bp, Homo sapiens
agaggggaggcgaaccagagtc

SEQ ID NO: 7348395 - DNA, 22 bp, Homo sapiens
agagggcagtctcagattggga

SEQ ID NO: 7348396 - DNA, 22 bp, Homo sapiens
agagggcagtctcagattggga

SEQ ID NO: 7348397 - DNA, 22 bp, Homo sapiens
agagggctgggatgtgctgtgt

SEQ ID NO: 7348398 - DNA, 22 bp, Homo sapiens
agagggctgggatgtgctgtgt

SEQ ID NO: 7348399 - DNA, 22 bp, Homo sapiens
agagggctggacgcaggttgga

SEQ ID NO: 7348400 - DNA, 22 bp, Homo sapiens
agagggcttccctaggagtgag

SEQ ID NO: 7348401 - DNA, 22 bp, Homo sapiens
agagggcttccctaggagtgag

SEQ ID NO: 7348402 - DNA, 22 bp, Homo sapiens
agagggcttccctaggagtgag

SEQ ID NO: 7348403 - DNA, 22 bp, Homo sapiens
agagggcttccctaggagtgag

SEQ ID NO: 7348404 - DNA, 19 bp, Homo sapiens
agaggctgtcacctgtagc

SEQ ID NO: 7348405 - DNA, 22 bp, Homo sapiens
agagtcaccaaagtaaaacagt

SEQ ID NO: 7348406 - DNA, 22 bp, Homo sapiens
agagtgattctagttagggaat

SEQ ID NO: 7348407 - DNA, 22 bp, Homo sapiens
agagtgatgggttgtgctgacc

SEQ ID NO: 7348408 - DNA, 22 bp, Homo sapiens
agagtgatcagatatcaggtgt

SEQ ID NO: 7348409 - DNA, 22 bp, Homo sapiens
agagtgccctgctctgagctct

SEQ ID NO: 7348410 - DNA, 22 bp, Homo sapiens
agagtgcttagtagtgacatgg

SEQ ID NO: 7348411 - DNA, 22 bp, Homo sapiens
agagtgcttaaagctggctttg

SEQ ID NO: 7348412 - DNA, 22 bp, Homo sapiens
agagtgcagataagagaatgtt

SEQ ID NO: 7348413 - DNA, 22 bp, Homo sapiens
agagtgcagaggtcaaagaaca

SEQ ID NO: 7348414 - DNA, 22 bp, Homo sapiens
atgaaggccaggcttcagtgtg

SEQ ID NO: 7348415 - DNA, 22 bp, Homo sapiens
atgaagggaatataagtgctgc

SEQ ID NO: 7348416 - DNA, 22 bp, Homo sapiens
atgaagggaatataagtgctgc

SEQ ID NO: 7348417 - DNA, 22 bp, Homo sapiens
atgaagggtgtccctgtgagca

SEQ ID NO: 7348418 - DNA, 22 bp, Homo sapiens
atgaagggtgtccctgtgagca

SEQ ID NO: 7348419 - DNA, 19 bp, Homo sapiens
atgaaggcactgagtggga

SEQ ID NO: 7348420 - DNA, 22 bp, Homo sapiens
atctgctgttcttcacagcttg

SEQ ID NO: 7348421 - DNA, 22 bp, Homo sapiens
atctgctgtgtgtaatggaatg

SEQ ID NO: 7348422 - DNA, 22 bp, Homo sapiens
atctgctgtcacatgtttgaag

SEQ ID NO: 7348423 - DNA, 18 bp, Homo sapiens
atctgctggcaggtctgg

SEQ ID NO: 7348424 - DNA, 22 bp, Homo sapiens
atctgctggcatctctagccca

SEQ ID NO: 7348425 - DNA, 17 bp, Homo sapiens
atctgctgacattctgt

SEQ ID NO: 7348426 - DNA, 22 bp, Homo sapiens
atctgctgcccagccacttgct

SEQ ID NO: 7348427 - DNA, 20 bp, Homo sapiens
atctgctgagaatgaaaggc

SEQ ID NO: 7348428 - DNA, 22 bp, Homo sapiens
atgaacacatgtacacatttct

SEQ ID NO: 7348429 - DNA, 22 bp, Homo sapiens
atgaacacaatacgtgcatgca

SEQ ID NO: 7348430 - DNA, 22 bp, Homo sapiens
atctgcttcctccttagggaaa

SEQ ID NO: 7348431 - DNA, 21 bp, Homo sapiens
atctgcttaggtttgttcaga

SEQ ID NO: 7348432 - DNA, 22 bp, Homo sapiens
atgagggaggcaaggagatgct

SEQ ID NO: 7348433 - DNA, 22 bp, Homo sapiens
atgaggcttaaactgctgcaac

SEQ ID NO: 7348434 - DNA, 22 bp, Homo sapiens
atgaggcttaaactgctgcaac

SEQ ID NO: 7348435 - DNA, 22 bp, Homo sapiens
atgagggaggcaaggagatgct

SEQ ID NO: 7348436 - DNA, 22 bp, Homo sapiens
agaatattgaaagttcttgaca

SEQ ID NO: 7348437 - DNA, 22 bp, Homo sapiens
agaatcaattcactgctgcagc

SEQ ID NO: 7348438 - DNA, 22 bp, Homo sapiens
agaatcaactgaaaattggtga

SEQ ID NO: 7348439 - DNA, 22 bp, Homo sapiens
atgaggcacttaaaagtgaaga

SEQ ID NO: 7348440 - DNA, 22 bp, Homo sapiens
atgaggcagaaaaaagtcggag

SEQ ID NO: 7348441 - DNA, 22 bp, Homo sapiens
agacaagaaactgggagtctct

SEQ ID NO: 7348442 - DNA, 22 bp, Homo sapiens
agacaactgcagagcaaagaat

SEQ ID NO: 7348443 - DNA, 22 bp, Homo sapiens
agacaacatcactaaagctgag

SEQ ID NO: 7348444 - DNA, 22 bp, Homo sapiens
agacaacatgatcagcagtcct

SEQ ID NO: 7348445 - DNA, 22 bp, Homo sapiens
agacaacatctagtttggtgga

SEQ ID NO: 7348446 - DNA, 22 bp, Homo sapiens
agacacattttacattaactgt

SEQ ID NO: 7348447 - DNA, 21 bp, Homo sapiens
agacagaacaactgctctcca

SEQ ID NO: 7348448 - DNA, 22 bp, Homo sapiens
agacactgttctcacatgcttg

SEQ ID NO: 7348449 - DNA, 22 bp, Homo sapiens
atgatacattgcaaaattttaa

SEQ ID NO: 7348450 - DNA, 20 bp, Homo sapiens
atgatagtcagaaaactagc

SEQ ID NO: 7348451 - DNA, 22 bp, Homo sapiens
atgatatacttcctagaacagt

SEQ ID NO: 7348452 - DNA, 22 bp, Homo sapiens
atgatatacttcctagaacagt

SEQ ID NO: 7348453 - DNA, 22 bp, Homo sapiens
atgatagctaccgtttatgctg

SEQ ID NO: 7348454 - DNA, 22 bp, Homo sapiens
atgcatttgtaaaatataatcg

SEQ ID NO: 7348455 - DNA, 22 bp, Homo sapiens
atgcatttttgagtatgaatga

SEQ ID NO: 7348456 - DNA, 22 bp, Homo sapiens
atgcatcaaagtctgaaatttc

SEQ ID NO: 7348457 - DNA, 22 bp, Homo sapiens
atgcatcaggcactaggaatag

SEQ ID NO: 7348458 - DNA, 22 bp, Homo sapiens
agacctggagtggggcctcagg

SEQ ID NO: 7348459 - DNA, 22 bp, Homo sapiens
agacccaggattggggctgccg

SEQ ID NO: 7348460 - DNA, 22 bp, Homo sapiens
agaccccatacctcagcaggta

SEQ ID NO: 7348461 - DNA, 22 bp, Homo sapiens
atgccaataaatgttaatatct

SEQ ID NO: 7348462 - DNA, 22 bp, Homo sapiens
agactctgcatttctaataagc

SEQ ID NO: 7348463 - DNA, 22 bp, Homo sapiens
atgcctgtgctatattctcaca

SEQ ID NO: 7348464 - DNA, 22 bp, Homo sapiens
atgcctgtggagatatttaagg

SEQ ID NO: 7348465 - DNA, 22 bp, Homo sapiens
atgcctgtaatcccagtgcttt

SEQ ID NO: 7348466 - DNA, 22 bp, Homo sapiens
agagagaagcaatcagtggcca

SEQ ID NO: 7348467 - DNA, 22 bp, Homo sapiens
agagagaagcaatcagtggcca

SEQ ID NO: 7348468 - DNA, 21 bp, Homo sapiens
agagagaaggccatatggtcc

SEQ ID NO: 7348469 - DNA, 22 bp, Homo sapiens
agagagcatggcacagaggggt

SEQ ID NO: 7348470 - DNA, 22 bp, Homo sapiens
agagacagacacatcgggctgc

SEQ ID NO: 7348471 - DNA, 21 bp, Homo sapiens
agagacagagaaagtaacatt

SEQ ID NO: 7348472 - DNA, 22 bp, Homo sapiens
agagacaatgccaatgcacacg

SEQ ID NO: 7348473 - DNA, 22 bp, Homo sapiens
agagacaatgccaatgcacacg

SEQ ID NO: 7348474 - DNA, 22 bp, Homo sapiens
agagaattggagcagtgacagg

SEQ ID NO: 7348475 - DNA, 22 bp, Homo sapiens
agagaattacagaagaatgtca

SEQ ID NO: 7348476 - DNA, 22 bp, Homo sapiens
agagaggcattcggtgatccca

SEQ ID NO: 7348477 - DNA, 22 bp, Homo sapiens
agagaggctgggcgtagggctt

SEQ ID NO: 7348478 - DNA, 22 bp, Homo sapiens
agagaggctgctggactatatg

SEQ ID NO: 7348479 - DNA, 22 bp, Homo sapiens
agagaggctgggcgtagggctt

SEQ ID NO: 7348480 - DNA, 19 bp, Homo sapiens
agagaggctgtgtgaggga

SEQ ID NO: 7348481 - DNA, 22 bp, Homo sapiens
agagagggaatatttggggtat

SEQ ID NO: 7348482 - DNA, 22 bp, Homo sapiens
agagagggcatagaaaaaggga

SEQ ID NO: 7348483 - DNA, 22 bp, Homo sapiens
agagagggcatagaaaaaggga

SEQ ID NO: 7348484 - DNA, 21 bp, Homo sapiens
agagagggagatgaaacatcc

SEQ ID NO: 7348485 - DNA, 22 bp, Homo sapiens
agagagggaatatttggggtat

SEQ ID NO: 7348486 - DNA, 22 bp, Homo sapiens
agagaatctgggaagatgttaa

SEQ ID NO: 7348487 - DNA, 23 bp, Homo sapiens
agagaaaaatatctgggcacatt

SEQ ID NO: 7348488 - DNA, 22 bp, Homo sapiens
agagaaaactcattgaggtgtc

SEQ ID NO: 7348489 - DNA, 22 bp, Homo sapiens
agagaaggaaagctgacatggg

SEQ ID NO: 7348490 - DNA, 22 bp, Homo sapiens
agagaaaagagttcaggctttg

SEQ ID NO: 7348491 - DNA, 22 bp, Homo sapiens
agagaaggggtaaagagtcctg

SEQ ID NO: 7348492 - DNA, 22 bp, Homo sapiens
agagaaggggtaaagagtcctg

SEQ ID NO: 7348493 - DNA, 22 bp, Homo sapiens
agacttaattctgcaagtgtag

SEQ ID NO: 7348494 - DNA, 22 bp, Homo sapiens
agactgtatgatttgagtttat

SEQ ID NO: 7348495 - DNA, 22 bp, Homo sapiens
agacttaattctgcaagtgtag

SEQ ID NO: 7348496 - DNA, 22 bp, Homo sapiens
agacttaatagaagcatgacat

SEQ ID NO: 7348497 - DNA, 22 bp, Homo sapiens
agacttaaggcatttccaagaa

SEQ ID NO: 7348498 - DNA, 22 bp, Homo sapiens
agactgttaatttcaattaaaa

SEQ ID NO: 7348499 - DNA, 22 bp, Homo sapiens
agacttctcttggctatattat

SEQ ID NO: 7348500 - DNA, 22 bp, Homo sapiens
agacttgatgttaaaagaaact

SEQ ID NO: 7348501 - DNA, 22 bp, Homo sapiens
agacttgggacctaggaatgga

SEQ ID NO: 7348502 - DNA, 22 bp, Homo sapiens
agagcacaggtgctggagccca

SEQ ID NO: 7348503 - DNA, 21 bp, Homo sapiens
agagcacaggtggacaatgct

SEQ ID NO: 7348504 - DNA, 21 bp, Homo sapiens
agagcacaggtggacaatgct

SEQ ID NO: 7348505 - DNA, 22 bp, Homo sapiens
agagcacaggctcaccattgtt

SEQ ID NO: 7348506 - DNA, 22 bp, Homo sapiens
agagcacaggctcaccattgtt

SEQ ID NO: 7348507 - DNA, 22 bp, Homo sapiens
agagcaccccgggaagagcaag

SEQ ID NO: 7348508 - DNA, 22 bp, Homo sapiens
agagcagcacgttgtccccaca

SEQ ID NO: 7348509 - DNA, 20 bp, Homo sapiens
agagcagcagttggtgaggt

SEQ ID NO: 7348510 - DNA, 22 bp, Homo sapiens
agagcctgaggccctgagaggg

SEQ ID NO: 7348511 - DNA, 17 bp, Homo sapiens
agagctcttcactgtga

SEQ ID NO: 7348512 - DNA, 22 bp, Homo sapiens
agagctctttgatttgcttctc

SEQ ID NO: 7348513 - DNA, 22 bp, Homo sapiens
agagcctgagcctgatcttgaa

SEQ ID NO: 7348514 - DNA, 22 bp, Homo sapiens
agagccctcttcactgcccctt

SEQ ID NO: 7348515 - DNA, 22 bp, Homo sapiens
agagccctctgcaatgcctcag

SEQ ID NO: 7348516 - DNA, 22 bp, Homo sapiens
agagccctaaaccctgccttgg

SEQ ID NO: 7348517 - DNA, 22 bp, Homo sapiens
agagctggctgtgggtgacttt

SEQ ID NO: 7348518 - DNA, 22 bp, Homo sapiens
agagctggctggtagccctgat

SEQ ID NO: 7348519 - DNA, 21 bp, Homo sapiens
agagctggcctgccaggccct

SEQ ID NO: 7348520 - DNA, 22 bp, Homo sapiens
agagctggctgctgcggtgctt

SEQ ID NO: 7348521 - DNA, 21 bp, Homo sapiens
agagctggcctgccaggccct

SEQ ID NO: 7348522 - DNA, 22 bp, Homo sapiens
agagctggagcagccccactgg

SEQ ID NO: 7348523 - DNA, 22 bp, Homo sapiens
agagctggacgtctgagcccta

SEQ ID NO: 7348524 - DNA, 22 bp, Homo sapiens
agagctggcactgaccctcacc

SEQ ID NO: 7348525 - DNA, 23 bp, Homo sapiens
agccagatttctttgcagggcag

SEQ ID NO: 7348526 - DNA, 22 bp, Homo sapiens
agccagagttgaatgtgagtct

SEQ ID NO: 7348527 - DNA, 22 bp, Homo sapiens
cactttctgtgtatcttccatt

SEQ ID NO: 7348528 - DNA, 22 bp, Homo sapiens
cactttcaagtttcagaggata

SEQ ID NO: 7348529 - DNA, 19 bp, Homo sapiens
cactttatttctgttttgt

SEQ ID NO: 7348530 - DNA, 22 bp, Homo sapiens
agccagctaccggggctcctgg

SEQ ID NO: 7348531 - DNA, 22 bp, Homo sapiens
agccagcccctgactgtgtcct

SEQ ID NO: 7348532 - DNA, 22 bp, Homo sapiens
agccagcaggtgggaaactgga

SEQ ID NO: 7348533 - DNA, 19 bp, Homo sapiens
agccagcaggcctctgagc

SEQ ID NO: 7348534 - DNA, 22 bp, Homo sapiens
agccagcagggcttagaggaca

SEQ ID NO: 7348535 - DNA, 22 bp, Homo sapiens
cagagcctttgtgtccacattt

SEQ ID NO: 7348536 - DNA, 22 bp, Homo sapiens
cagagccttcctagcagactct

SEQ ID NO: 7348537 - DNA, 22 bp, Homo sapiens
agccaggccttagggagaggca

SEQ ID NO: 7348538 - DNA, 22 bp, Homo sapiens
agccaggccttttctcaaggtt

SEQ ID NO: 7348539 - DNA, 22 bp, Homo sapiens
agccaggccttagggagaggca

SEQ ID NO: 7348540 - DNA, 22 bp, Homo sapiens
cagagacattaagtgccatgat

SEQ ID NO: 7348541 - DNA, 22 bp, Homo sapiens
cagagaccccgctgcccttctg

SEQ ID NO: 7348542 - DNA, 20 bp, Homo sapiens
cagagacccaggcttcagct

SEQ ID NO: 7348543 - DNA, 20 bp, Homo sapiens
cagagaccaggccaggtgtc

SEQ ID NO: 7348544 - DNA, 22 bp, Homo sapiens
cagagacccttctcagtggcca

SEQ ID NO: 7348545 - DNA, 22 bp, Homo sapiens
cagagacctgcccatttacgct

SEQ ID NO: 7348546 - DNA, 17 bp, Homo sapiens
agccaggcatatgaagt

SEQ ID NO: 7348547 - DNA, 18 bp, Homo sapiens
cagagctcctggatgcag

SEQ ID NO: 7348548 - DNA, 22 bp, Homo sapiens
agccagtgcagctggaaattca

SEQ ID NO: 7348549 - DNA, 22 bp, Homo sapiens
agccagtggaattcccaggggt

SEQ ID NO: 7348550 - DNA, 19 bp, Homo sapiens
agccagttggtaagaggct

SEQ ID NO: 7348551 - DNA, 22 bp, Homo sapiens
agcccaggttgaggctgcagtg

SEQ ID NO: 7348552 - DNA, 22 bp, Homo sapiens
agcccaggttgaggctgcagtg

SEQ ID NO: 7348553 - DNA, 22 bp, Homo sapiens
agcccagggacagggcggatgt

SEQ ID NO: 7348554 - DNA, 22 bp, Homo sapiens
agcccagttgctccacgctgca

SEQ ID NO: 7348555 - DNA, 22 bp, Homo sapiens
agcccagtgggccgaggcgggg

SEQ ID NO: 7348556 - DNA, 22 bp, Homo sapiens
agccccacactctctctgagaa

SEQ ID NO: 7348557 - DNA, 20 bp, Homo sapiens
agccccacccttgtcctggc

SEQ ID NO: 7348558 - DNA, 22 bp, Homo sapiens
agccccagtaagggagggcctg

SEQ ID NO: 7348559 - DNA, 22 bp, Homo sapiens
agccccagtccgctgcgggcgg

SEQ ID NO: 7348560 - DNA, 22 bp, Homo sapiens
agccccaggatgggccgcagga

SEQ ID NO: 7348561 - DNA, 22 bp, Homo sapiens
agccccaggatgggccgcagga

SEQ ID NO: 7348562 - DNA, 22 bp, Homo sapiens
agccccacgttgtctagcacct

SEQ ID NO: 7348563 - DNA, 22 bp, Homo sapiens
agcccccacgtttcctgggtcc

SEQ ID NO: 7348564 - DNA, 22 bp, Homo sapiens
agcccccaaaagtgcttatgat

SEQ ID NO: 7348565 - DNA, 22 bp, Homo sapiens
agccccagttccctggaagtct

SEQ ID NO: 7348566 - DNA, 22 bp, Homo sapiens
agccctgcgtgccaggggactg

SEQ ID NO: 7348567 - DNA, 23 bp, Homo sapiens
agccctgctgagacccagctccc

SEQ ID NO: 7348568 - DNA, 22 bp, Homo sapiens
agccctgctcatctggatcccg

SEQ ID NO: 7348569 - DNA, 22 bp, Homo sapiens
agccctggagcaaaggtgtctt

SEQ ID NO: 7348570 - DNA, 22 bp, Homo sapiens
agccctgcttcaccatttactt

SEQ ID NO: 7348571 - DNA, 22 bp, Homo sapiens
agccctgctgcctgaattagct

SEQ ID NO: 7348572 - DNA, 22 bp, Homo sapiens
agccctgctgcttcttgtattt

SEQ ID NO: 7348573 - DNA, 22 bp, Homo sapiens
agccctggcagagccaggtagt

SEQ ID NO: 7348574 - DNA, 22 bp, Homo sapiens
agccctggcagagccaggtagt

SEQ ID NO: 7348575 - DNA, 22 bp, Homo sapiens
agccctggagcaaaggtgtctt

SEQ ID NO: 7348576 - DNA, 22 bp, Homo sapiens
agccctggattctgaggtccaa

SEQ ID NO: 7348577 - DNA, 22 bp, Homo sapiens
agccctgggcgttactgggatg

SEQ ID NO: 7348578 - DNA, 22 bp, Homo sapiens
agccctgggcgttactgggatg

SEQ ID NO: 7348579 - DNA, 22 bp, Homo sapiens
cagatggcagggcagctctgca

SEQ ID NO: 7348580 - DNA, 22 bp, Homo sapiens
cagatggccagaggcagctgca

SEQ ID NO: 7348581 - DNA, 22 bp, Homo sapiens
cagatggctgccaagatgggct

SEQ ID NO: 7348582 - DNA, 22 bp, Homo sapiens
agccctggctcccagcagcgct

SEQ ID NO: 7348583 - DNA, 22 bp, Homo sapiens
agccctggcccggctgtgcttt

SEQ ID NO: 7348584 - DNA, 22 bp, Homo sapiens
agccctgggcacctgtgagggg

SEQ ID NO: 7348585 - DNA, 22 bp, Homo sapiens
agctcctgtggctgaaagagga

SEQ ID NO: 7348586 - DNA, 22 bp, Homo sapiens
agctcctgggccatcacaacca

SEQ ID NO: 7348587 - DNA, 19 bp, Homo sapiens
agctcctgggctctgggcc

SEQ ID NO: 7348588 - DNA, 22 bp, Homo sapiens
agctcctgggggttccaagcag

SEQ ID NO: 7348589 - DNA, 22 bp, Homo sapiens
agctcctgggagcaggtggtac

SEQ ID NO: 7348590 - DNA, 22 bp, Homo sapiens
agctcctggctttcctctcacc

SEQ ID NO: 7348591 - DNA, 18 bp, Homo sapiens
agctcctggtctcaggga

SEQ ID NO: 7348592 - DNA, 20 bp, Homo sapiens
agctcctggtataggtgcct

SEQ ID NO: 7348593 - DNA, 22 bp, Homo sapiens
agctcctggtctttgtccagag

SEQ ID NO: 7348594 - DNA, 20 bp, Homo sapiens
agctcctggtataggtgcct

SEQ ID NO: 7348595 - DNA, 22 bp, Homo sapiens
agctcctgtctcaagggagcct

SEQ ID NO: 7348596 - DNA, 22 bp, Homo sapiens
agctcctggtgcctcagccgaa

SEQ ID NO: 7348597 - DNA, 23 bp, Homo sapiens
agctcctgtaaggtggtcgtcac

SEQ ID NO: 7348598 - DNA, 22 bp, Homo sapiens
agctcctggtgcctcagccgaa

SEQ ID NO: 7348599 - DNA, 22 bp, Homo sapiens
agctagccatgtggctcctgtg

SEQ ID NO: 7348600 - DNA, 22 bp, Homo sapiens
agctcaggcaactctgggcccc

SEQ ID NO: 7348601 - DNA, 23 bp, Homo sapiens
agctccagaacatagcacaggaa

SEQ ID NO: 7348602 - DNA, 23 bp, Homo sapiens
agctccagaacatagcacaggaa

SEQ ID NO: 7348603 - DNA, 23 bp, Homo sapiens
agctccagaacatagcacaggaa

SEQ ID NO: 7348604 - DNA, 22 bp, Homo sapiens
agctccagagccacatccatca

SEQ ID NO: 7348605 - DNA, 22 bp, Homo sapiens
agctccagagtctgaactattc

SEQ ID NO: 7348606 - DNA, 22 bp, Homo sapiens
agctccagaagcctgcaaggta

SEQ ID NO: 7348607 - DNA, 22 bp, Homo sapiens
agctccagaagcctgcaaggta

SEQ ID NO: 7348608 - DNA, 22 bp, Homo sapiens
agctccagccctagtacagctg

SEQ ID NO: 7348609 - DNA, 22 bp, Homo sapiens
agctccagccctagtacagctg

SEQ ID NO: 7348610 - DNA, 22 bp, Homo sapiens
agctccagcccatctgctcgtg

SEQ ID NO: 7348611 - DNA, 22 bp, Homo sapiens
agctccagccgctgatgggttt

SEQ ID NO: 7348612 - DNA, 22 bp, Homo sapiens
agctccagggaaagagtggatc

SEQ ID NO: 7348613 - DNA, 21 bp, Homo sapiens
agctccaggctcctggggttc

SEQ ID NO: 7348614 - DNA, 22 bp, Homo sapiens
agctccaggccttgggccccgg

SEQ ID NO: 7348615 - DNA, 22 bp, Homo sapiens
agctcctggacgaacagggagt

SEQ ID NO: 7348616 - DNA, 20 bp, Homo sapiens
agctcctggactagagagtg

SEQ ID NO: 7348617 - DNA, 22 bp, Homo sapiens
agctcctggaggtgcgcactcg

SEQ ID NO: 7348618 - DNA, 22 bp, Homo sapiens
agctcctggcaaggtcatggtg

SEQ ID NO: 7348619 - DNA, 22 bp, Homo sapiens
agctccaggatctgaaagttcg

SEQ ID NO: 7348620 - DNA, 22 bp, Homo sapiens
agctccaggcagcattaataaa

SEQ ID NO: 7348621 - DNA, 22 bp, Homo sapiens
agctccaggataagacaggtgc

SEQ ID NO: 7348622 - DNA, 23 bp, Homo sapiens
agctccagctgacgtgggcagcc

SEQ ID NO: 7348623 - DNA, 22 bp, Homo sapiens
agctccagcctcttctggaggt

SEQ ID NO: 7348624 - DNA, 22 bp, Homo sapiens
agctccagcctcttctggaggt

SEQ ID NO: 7348625 - DNA, 22 bp, Homo sapiens
agcctggtttaagcattttata

SEQ ID NO: 7348626 - DNA, 22 bp, Homo sapiens
agcctggtgtggggctgcagag

SEQ ID NO: 7348627 - DNA, 22 bp, Homo sapiens
agcctggtgatatcagtggttt

SEQ ID NO: 7348628 - DNA, 22 bp, Homo sapiens
agcctgggtttttattaaggag

SEQ ID NO: 7348629 - DNA, 22 bp, Homo sapiens
agcctgggtgggggttcggaga

SEQ ID NO: 7348630 - DNA, 22 bp, Homo sapiens
agcctgggcctggcttcccgcc

SEQ ID NO: 7348631 - DNA, 22 bp, Homo sapiens
agctaattagaaatagattatt

SEQ ID NO: 7348632 - DNA, 22 bp, Homo sapiens
agctacaaatgtatgtgctgat

SEQ ID NO: 7348633 - DNA, 22 bp, Homo sapiens
agctacaagtcatcagctatca

SEQ ID NO: 7348634 - DNA, 22 bp, Homo sapiens
agctacaatcaatgtacatcat

SEQ ID NO: 7348635 - DNA, 22 bp, Homo sapiens
agctacctcatctgttaaacgg

SEQ ID NO: 7348636 - DNA, 22 bp, Homo sapiens
agctactactaccaaactaaag

SEQ ID NO: 7348637 - DNA, 22 bp, Homo sapiens
agctacctggcttatcactgtc

SEQ ID NO: 7348638 - DNA, 23 bp, Homo sapiens
agctactaggattcattcaccct

SEQ ID NO: 7348639 - DNA, 22 bp, Homo sapiens
agctactagggtgccagacatg

SEQ ID NO: 7348640 - DNA, 22 bp, Homo sapiens
agctactatgtgaaagccaggc

SEQ ID NO: 7348641 - DNA, 22 bp, Homo sapiens
cagcaacatatatgaaactgtg

SEQ ID NO: 7348642 - DNA, 22 bp, Homo sapiens
cagcaacttggacagcagtctt

SEQ ID NO: 7348643 - DNA, 22 bp, Homo sapiens
cagatgtggaatgcagcaggct

SEQ ID NO: 7348644 - DNA, 22 bp, Homo sapiens
cagatgtgcctccagggctttg

SEQ ID NO: 7348645 - DNA, 22 bp, Homo sapiens
cagatgtacatgaagggcaatg

SEQ ID NO: 7348646 - DNA, 22 bp, Homo sapiens
agcctgggaatttagagttcgg

SEQ ID NO: 7348647 - DNA, 22 bp, Homo sapiens
agcctgggcaacaacacagcga

SEQ ID NO: 7348648 - DNA, 22 bp, Homo sapiens
agcacctgtcacaagcagaagg

SEQ ID NO: 7348649 - DNA, 22 bp, Homo sapiens
agcacctgtcacaagcagaagg

SEQ ID NO: 7348650 - DNA, 22 bp, Homo sapiens
caaaggcagttactgaatgaag

SEQ ID NO: 7348651 - DNA, 22 bp, Homo sapiens
caaaggcctgagaactgagggg

SEQ ID NO: 7348652 - DNA, 22 bp, Homo sapiens
agcactggagtttagtgggatt

SEQ ID NO: 7348653 - DNA, 22 bp, Homo sapiens
agcactggaaagttaagagttt

SEQ ID NO: 7348654 - DNA, 22 bp, Homo sapiens
agcactggaaagttaagagttt

SEQ ID NO: 7348655 - DNA, 20 bp, Homo sapiens
agcacctgtgtagaagcatc

SEQ ID NO: 7348656 - DNA, 22 bp, Homo sapiens
agcacctgtgtgagctagatgt

SEQ ID NO: 7348657 - DNA, 22 bp, Homo sapiens
agcaccttcacaggctctcagg

SEQ ID NO: 7348658 - DNA, 22 bp, Homo sapiens
agcagaggacagttcttaggaa

SEQ ID NO: 7348659 - DNA, 21 bp, Homo sapiens
agcagaggcagaatgtatgca

SEQ ID NO: 7348660 - DNA, 22 bp, Homo sapiens
agcagaggtttgttggaaacct

SEQ ID NO: 7348661 - DNA, 16 bp, Homo sapiens
agcagaggtgagtgaa

SEQ ID NO: 7348662 - DNA, 16 bp, Homo sapiens
agcagaggtgagtgaa

SEQ ID NO: 7348663 - DNA, 21 bp, Homo sapiens
agcagaggggacatgtttgat

SEQ ID NO: 7348664 - DNA, 22 bp, Homo sapiens
caagtgagcctcctctttttaa

SEQ ID NO: 7348665 - DNA, 22 bp, Homo sapiens
caagtgagtgaccagagttggt

SEQ ID NO: 7348666 - DNA, 22 bp, Homo sapiens
caataatatcctgtgctgtttg

SEQ ID NO: 7348667 - DNA, 22 bp, Homo sapiens
caatacaattaccagttaatca

SEQ ID NO: 7348668 - DNA, 23 bp, Homo sapiens
agcagcccaatggcaagctctgg

SEQ ID NO: 7348669 - DNA, 22 bp, Homo sapiens
agcagccagagaatgatgcagt

SEQ ID NO: 7348670 - DNA, 22 bp, Homo sapiens
agcagccagagaatgatgcagt

SEQ ID NO: 7348671 - DNA, 22 bp, Homo sapiens
agcagcccagttgtactgagtg

SEQ ID NO: 7348672 - DNA, 22 bp, Homo sapiens
agcagcccagataaagctcagg

SEQ ID NO: 7348673 - DNA, 23 bp, Homo sapiens
agcagcccagatgccttccatcc

SEQ ID NO: 7348674 - DNA, 22 bp, Homo sapiens
agcagcccaggcaaagataaaa

SEQ ID NO: 7348675 - DNA, 22 bp, Homo sapiens
agcagcccgaggatcatgtgtc

SEQ ID NO: 7348676 - DNA, 22 bp, Homo sapiens
agcagcccctcggcgggtgcgc

SEQ ID NO: 7348677 - DNA, 22 bp, Homo sapiens
agcagccctagggattgctgtt

SEQ ID NO: 7348678 - DNA, 22 bp, Homo sapiens
agcagccctatgtaattggact

SEQ ID NO: 7348679 - DNA, 23 bp, Homo sapiens
agcagccctgggacctggcctgc

SEQ ID NO: 7348680 - DNA, 16 bp, Homo sapiens
caatacatggcatttc

SEQ ID NO: 7348681 - DNA, 18 bp, Homo sapiens
caatactgagaggtgggg

SEQ ID NO: 7348682 - DNA, 22 bp, Homo sapiens
caatactgagtttacattcatc

SEQ ID NO: 7348683 - DNA, 18 bp, Homo sapiens
caatactgagaggtgggg

SEQ ID NO: 7348684 - DNA, 22 bp, Homo sapiens
caatactgagtttacattcatc

SEQ ID NO: 7348685 - DNA, 19 bp, Homo sapiens
agcagcagaagtgtgcctt

SEQ ID NO: 7348686 - DNA, 22 bp, Homo sapiens
caatacaattaccagttaatca

SEQ ID NO: 7348687 - DNA, 22 bp, Homo sapiens
caatacagcacacctgtatcag

SEQ ID NO: 7348688 - DNA, 22 bp, Homo sapiens
caatacagcacacctgtatcag

SEQ ID NO: 7348689 - DNA, 22 bp, Homo sapiens
caatacagcacacctgtatcag

SEQ ID NO: 7348690 - DNA, 22 bp, Homo sapiens
agcagcagaggtcagaaaggta

SEQ ID NO: 7348691 - DNA, 22 bp, Homo sapiens
agcagcagaggtcagaaaggta

SEQ ID NO: 7348692 - DNA, 22 bp, Homo sapiens
agcagcagatcaaacaggcttg

SEQ ID NO: 7348693 - DNA, 22 bp, Homo sapiens
cacagagatcggaacagaagta

SEQ ID NO: 7348694 - DNA, 21 bp, Homo sapiens
cacagagatattggtgagcct

SEQ ID NO: 7348695 - DNA, 22 bp, Homo sapiens
cacagagatcggaacagaagta

SEQ ID NO: 7348696 - DNA, 21 bp, Homo sapiens
cacagagatattggtgagcct

SEQ ID NO: 7348697 - DNA, 21 bp, Homo sapiens
cacagagatattggtgagcct

SEQ ID NO: 7348698 - DNA, 22 bp, Homo sapiens
cacagagaggcttgtctccaag

SEQ ID NO: 7348699 - DNA, 22 bp, Homo sapiens
cacagagagctacgtgcagcgt

SEQ ID NO: 7348700 - DNA, 22 bp, Homo sapiens
cacagaactggttaatagcaga

SEQ ID NO: 7348701 - DNA, 22 bp, Homo sapiens
agcagctcagaggcaccagggc

SEQ ID NO: 7348702 - DNA, 22 bp, Homo sapiens
agcagctcatggagtaggcact

SEQ ID NO: 7348703 - DNA, 22 bp, Homo sapiens
cacagagatggccagggcacat

SEQ ID NO: 7348704 - DNA, 22 bp, Homo sapiens
cacagagatggccagggcacat

SEQ ID NO: 7348705 - DNA, 22 bp, Homo sapiens
cacagagatggtctggcaggtg

SEQ ID NO: 7348706 - DNA, 22 bp, Homo sapiens
cacagagattagaattagacta

SEQ ID NO: 7348707 - DNA, 22 bp, Homo sapiens
cacagagattagaattagacta

SEQ ID NO: 7348708 - DNA, 22 bp, Homo sapiens
cacagagcaactcaaatcagct

SEQ ID NO: 7348709 - DNA, 19 bp, Homo sapiens
agcagctggaggtggagtg

SEQ ID NO: 7348710 - DNA, 21 bp, Homo sapiens
agcagctgggcaacatggagg

SEQ ID NO: 7348711 - DNA, 21 bp, Homo sapiens
agcatgcactacttcatctta

SEQ ID NO: 7348712 - DNA, 22 bp, Homo sapiens
agcatgaaaggcgtgccaactt

SEQ ID NO: 7348713 - DNA, 22 bp, Homo sapiens
agcagtcagtcctgaatgaagg

SEQ ID NO: 7348714 - DNA, 22 bp, Homo sapiens
cactgttattactactatacat

SEQ ID NO: 7348715 - DNA, 22 bp, Homo sapiens
cacttaaagtcttagcttacag

SEQ ID NO: 7348716 - DNA, 22 bp, Homo sapiens
cacttaaaactcctggaattgt

SEQ ID NO: 7348717 - DNA, 22 bp, Homo sapiens
cactgtttggctcctgtactta

SEQ ID NO: 7348718 - DNA, 22 bp, Homo sapiens
cactgtgtcagagtatgatgat

SEQ ID NO: 7348719 - DNA, 22 bp, Homo sapiens
cactgtggttattatcactgtt

SEQ ID NO: 7348720 - DNA, 22 bp, Homo sapiens
cactgtgggtcccagactggag

SEQ ID NO: 7348721 - DNA, 22 bp, Homo sapiens
cactgtgggtcccagactggag

SEQ ID NO: 7348722 - DNA, 22 bp, Homo sapiens
cactggtgacttctgagctgga

SEQ ID NO: 7348723 - DNA, 22 bp, Homo sapiens
agcatggtctgatcaggtggct

SEQ ID NO: 7348724 - DNA, 22 bp, Homo sapiens
agcatggggcaatgcatgtgct

SEQ ID NO: 7348725 - DNA, 23 bp, Homo sapiens
agcatggaagaagctggactcct

SEQ ID NO: 7348726 - DNA, 22 bp, Homo sapiens
agcatgcttttttaccttacat

SEQ ID NO: 7348727 - DNA, 22 bp, Homo sapiens
agcatggacagtggcagcagtg

SEQ ID NO: 7348728 - DNA, 22 bp, Homo sapiens
agcatgcttggcatttgtcaga

SEQ ID NO: 7348729 - DNA, 22 bp, Homo sapiens
agcatgcgcttgatcagctcca

SEQ ID NO: 7348730 - DNA, 22 bp, Homo sapiens
cacagcagaacttaatttcaaa

SEQ ID NO: 7348731 - DNA, 22 bp, Homo sapiens
cacagcagacagggaggcggct

SEQ ID NO: 7348732 - DNA, 22 bp, Homo sapiens
cacagcagagggagccattgaa

SEQ ID NO: 7348733 - DNA, 22 bp, Homo sapiens
cacagcaatagctaactgatac

SEQ ID NO: 7348734 - DNA, 22 bp, Homo sapiens
agcaggaactgacaccaagcca

SEQ ID NO: 7348735 - DNA, 22 bp, Homo sapiens
agcaggaactcagggagttctc

SEQ ID NO: 7348736 - DNA, 22 bp, Homo sapiens
agcaggaaggggatgatgggca

SEQ ID NO: 7348737 - DNA, 22 bp, Homo sapiens
agcaggaaggggcctagcctgg

SEQ ID NO: 7348738 - DNA, 22 bp, Homo sapiens
agcaggaaggggcctagcctgg

SEQ ID NO: 7348739 - DNA, 22 bp, Homo sapiens
agcaggaaggtctgtgtgagtc

SEQ ID NO: 7348740 - DNA, 19 bp, Homo sapiens
agcagggagtggttgtggg

SEQ ID NO: 7348741 - DNA, 22 bp, Homo sapiens
agcagggcaaagtcaggctaac

SEQ ID NO: 7348742 - DNA, 22 bp, Homo sapiens
agcagggcactggaaggcactg

SEQ ID NO: 7348743 - DNA, 22 bp, Homo sapiens
agcagggcaggtaaggatcaga

SEQ ID NO: 7348744 - DNA, 22 bp, Homo sapiens
agcagggcaggtaaggatcaga

SEQ ID NO: 7348745 - DNA, 22 bp, Homo sapiens
caccagagttgtccaaatgatt

SEQ ID NO: 7348746 - DNA, 22 bp, Homo sapiens
agcagggctgcagtgtgtcttt

SEQ ID NO: 7348747 - DNA, 22 bp, Homo sapiens
agcagggctctgtggagggtgg

SEQ ID NO: 7348748 - DNA, 22 bp, Homo sapiens
caccagccagagtgacagctcc

SEQ ID NO: 7348749 - DNA, 22 bp, Homo sapiens
aaggacatttctgactaatgca

SEQ ID NO: 7348750 - DNA, 22 bp, Homo sapiens
aaggacatggaaggaggagata

SEQ ID NO: 7348751 - DNA, 22 bp, Homo sapiens
aaggacaggttggggcttcagg

SEQ ID NO: 7348752 - DNA, 22 bp, Homo sapiens
aaattattacaagctagttggc

SEQ ID NO: 7348753 - DNA, 22 bp, Homo sapiens
aaggaaacagaggatgaccttg

SEQ ID NO: 7348754 - DNA, 22 bp, Homo sapiens
aaattaactatcacttttgtga

SEQ ID NO: 7348755 - DNA, 22 bp, Homo sapiens
aaattagatcagtggattttct

SEQ ID NO: 7348756 - DNA, 20 bp, Homo sapiens
aaatttaggaaattttacgc

SEQ ID NO: 7348757 - DNA, 22 bp, Homo sapiens
aaggagaaggcatcattcaagt

SEQ ID NO: 7348758 - DNA, 22 bp, Homo sapiens
aaggagaaggcatcattcaagt

SEQ ID NO: 7348759 - DNA, 22 bp, Homo sapiens
aaggactctccagctagcaaat

SEQ ID NO: 7348760 - DNA, 22 bp, Homo sapiens
aaggaccagttttgcagaattg

SEQ ID NO: 7348761 - DNA, 21 bp, Homo sapiens
aaggaaaagcttggtctctga

SEQ ID NO: 7348762 - DNA, 22 bp, Homo sapiens
aagcccagatgagatccctgga

SEQ ID NO: 7348763 - DNA, 22 bp, Homo sapiens
aagctgattctaaaatttatta

SEQ ID NO: 7348764 - DNA, 22 bp, Homo sapiens
aaatttcaagcaaagtagctat

SEQ ID NO: 7348765 - DNA, 22 bp, Homo sapiens
aaatttcagttggaatgagctc

SEQ ID NO: 7348766 - DNA, 22 bp, Homo sapiens
aaatttcagttacctttacgtt

SEQ ID NO: 7348767 - DNA, 22 bp, Homo sapiens
aaatttctaagtcaagaagaac

SEQ ID NO: 7348768 - DNA, 22 bp, Homo sapiens
aaggcatttgttggatttctca

SEQ ID NO: 7348769 - DNA, 23 bp, Homo sapiens
aaggcattggcttctctcatttc

SEQ ID NO: 7348770 - DNA, 22 bp, Homo sapiens
aaggccacacttgctggccagc

SEQ ID NO: 7348771 - DNA, 22 bp, Homo sapiens
aacaagtgatgctcatgattca

SEQ ID NO: 7348772 - DNA, 22 bp, Homo sapiens
aacaagtgagtcatttaaactc

SEQ ID NO: 7348773 - DNA, 22 bp, Homo sapiens
aacaataactagacatgccatg

SEQ ID NO: 7348774 - DNA, 22 bp, Homo sapiens
aagggagacagttgtgtgagga

SEQ ID NO: 7348775 - DNA, 22 bp, Homo sapiens
aacaataattgcggttctctat

SEQ ID NO: 7348776 - DNA, 22 bp, Homo sapiens
aacaatgaccacacaatgtact

SEQ ID NO: 7348777 - DNA, 22 bp, Homo sapiens
aacaatctgttcgatagaaaat

SEQ ID NO: 7348778 - DNA, 17 bp, Homo sapiens
aacaataggatgtgtat

SEQ ID NO: 7348779 - DNA, 22 bp, Homo sapiens
aacaatgagtcctctgaggtta

SEQ ID NO: 7348780 - DNA, 22 bp, Homo sapiens
aagtattatttaacaaatttgt

SEQ ID NO: 7348781 - DNA, 22 bp, Homo sapiens
aagggaggaggatttattgtac

SEQ ID NO: 7348782 - DNA, 21 bp, Homo sapiens
aagggagataggaatcaggcc

SEQ ID NO: 7348783 - DNA, 22 bp, Homo sapiens
aaggggaagtagcaccagaggt

SEQ ID NO: 7348784 - DNA, 22 bp, Homo sapiens
aaggggcatgcttttgccagga

SEQ ID NO: 7348785 - DNA, 22 bp, Homo sapiens
aacactggtttggcattagatg

SEQ ID NO: 7348786 - DNA, 22 bp, Homo sapiens
aacactgtaacagcatcatttt

SEQ ID NO: 7348787 - DNA, 22 bp, Homo sapiens
aagttgagagaaagcccgtgtt

SEQ ID NO: 7348788 - DNA, 22 bp, Homo sapiens
aagtcaagtgttattattgtag

SEQ ID NO: 7348789 - DNA, 22 bp, Homo sapiens
aagtatttcagcggttctttgt

SEQ ID NO: 7348790 - DNA, 22 bp, Homo sapiens
aagtatttcgttctgaaaaagt

SEQ ID NO: 7348791 - DNA, 22 bp, Homo sapiens
aagtatttcgttctgaaaaagt

SEQ ID NO: 7348792 - DNA, 22 bp, Homo sapiens
aagtatttctggcctgtgaaag

SEQ ID NO: 7348793 - DNA, 22 bp, Homo sapiens
aagtatttggaatggcattttt

SEQ ID NO: 7348794 - DNA, 22 bp, Homo sapiens
aagtttgcgtgtcctatttgat

SEQ ID NO: 7348795 - DNA, 20 bp, Homo sapiens
aagtttctggtttatatctt

SEQ ID NO: 7348796 - DNA, 22 bp, Homo sapiens
aagtttctgttcgctttaataa

SEQ ID NO: 7348797 - DNA, 22 bp, Homo sapiens
aagtttctgttcgctttaataa

SEQ ID NO: 7348798 - DNA, 22 bp, Homo sapiens
aagtttctgttcatatctctga

SEQ ID NO: 7348799 - DNA, 20 bp, Homo sapiens
aagtttctggtttatatctt

SEQ ID NO: 7348800 - DNA, 20 bp, Homo sapiens
aataaactactgagagatgt

SEQ ID NO: 7348801 - DNA, 18 bp, Homo sapiens
aacagtttccagattctc

SEQ ID NO: 7348802 - DNA, 22 bp, Homo sapiens
aacagtttcagttactgatgag

SEQ ID NO: 7348803 - DNA, 22 bp, Homo sapiens
aacagtttcctgactcctatga

SEQ ID NO: 7348804 - DNA, 22 bp, Homo sapiens
aacagtttatgtaaatgtccag

SEQ ID NO: 7348805 - DNA, 22 bp, Homo sapiens
aacagtttgcctgaaatgtatt

SEQ ID NO: 7348806 - DNA, 22 bp, Homo sapiens
aacagtttgctttaagaggcac

SEQ ID NO: 7348807 - DNA, 22 bp, Homo sapiens
aacagtttgagctttgaatttc

SEQ ID NO: 7348808 - DNA, 22 bp, Homo sapiens
aacagtttctatgttagtggtt

SEQ ID NO: 7348809 - DNA, 22 bp, Homo sapiens
aaccatgacaaaccatagacat

SEQ ID NO: 7348810 - DNA, 22 bp, Homo sapiens
aaccatgctagcatcaaaatgt

SEQ ID NO: 7348811 - DNA, 22 bp, Homo sapiens
aactccaggtcctttgaatctg

SEQ ID NO: 7348812 - DNA, 20 bp, Homo sapiens
aatcactttgtacaggaagc

SEQ ID NO: 7348813 - DNA, 22 bp, Homo sapiens
aatcacttttctctaatgtagc

SEQ ID NO: 7348814 - DNA, 22 bp, Homo sapiens
aaccagctctgcaaaatgtcat

SEQ ID NO: 7348815 - DNA, 23 bp, Homo sapiens
aatcacttccctccaaatggatt

SEQ ID NO: 7348816 - DNA, 22 bp, Homo sapiens
aatcacttgtaaggaattcaat

SEQ ID NO: 7348817 - DNA, 22 bp, Homo sapiens
aatcacttgtgccatgggtacc

SEQ ID NO: 7348818 - DNA, 22 bp, Homo sapiens
aatcactttgcactcttatttg

SEQ ID NO: 7348819 - DNA, 22 bp, Homo sapiens
aatcacttaatagctacactgg

SEQ ID NO: 7348820 - DNA, 22 bp, Homo sapiens
aatcacttagaacccaggaagt

SEQ ID NO: 7348821 - DNA, 22 bp, Homo sapiens
aatcacttcagtttttggacag

SEQ ID NO: 7348822 - DNA, 22 bp, Homo sapiens
aacatttcagcaaataagaaca

SEQ ID NO: 7348823 - DNA, 22 bp, Homo sapiens
aacatttcagcaaataagaaca

SEQ ID NO: 7348824 - DNA, 22 bp, Homo sapiens
aatatttgcatcattagctatt

SEQ ID NO: 7348825 - DNA, 22 bp, Homo sapiens
aatcacatgtgctcaattttaa

SEQ ID NO: 7348826 - DNA, 22 bp, Homo sapiens
aatcacatgtgctcaattttaa

SEQ ID NO: 7348827 - DNA, 22 bp, Homo sapiens
aacattgccatggttaatttta

SEQ ID NO: 7348828 - DNA, 20 bp, Homo sapiens
aacattgcttcaatgtaacc

SEQ ID NO: 7348829 - DNA, 22 bp, Homo sapiens
aacattgattgcatctgttcac

SEQ ID NO: 7348830 - DNA, 22 bp, Homo sapiens
aacattgcaaataagcttgcag

SEQ ID NO: 7348831 - DNA, 22 bp, Homo sapiens
aacattgcagcttaattgcagg

SEQ ID NO: 7348832 - DNA, 22 bp, Homo sapiens
aacattgcagcttaattgcagg

SEQ ID NO: 7348833 - DNA, 21 bp, Homo sapiens
aacattggttcaaataaaact

SEQ ID NO: 7348834 - DNA, 22 bp, Homo sapiens
aacattgaacttggcacaccca

SEQ ID NO: 7348835 - DNA, 21 bp, Homo sapiens
aacattgattcatttggctat

SEQ ID NO: 7348836 - DNA, 22 bp, Homo sapiens
aacattgagttctacttccatt

SEQ ID NO: 7348837 - DNA, 22 bp, Homo sapiens
aacattgagttagggagcgtat

SEQ ID NO: 7348838 - DNA, 22 bp, Homo sapiens
aacataaatttgaagtggcaaa

SEQ ID NO: 7348839 - DNA, 22 bp, Homo sapiens
aacagtttttaaagctggcttc

SEQ ID NO: 7348840 - DNA, 22 bp, Homo sapiens
aacagtttgggtaggtatgtag

SEQ ID NO: 7348841 - DNA, 22 bp, Homo sapiens
aacagtttgtggatagcttgta

SEQ ID NO: 7348842 - DNA, 22 bp, Homo sapiens
aacattctttagctcttcctgc

SEQ ID NO: 7348843 - DNA, 22 bp, Homo sapiens
aacattcttaagatttgtgtct

SEQ ID NO: 7348844 - DNA, 22 bp, Homo sapiens
aacattcttcaaatatcactct

SEQ ID NO: 7348845 - DNA, 22 bp, Homo sapiens
aacattctgtcaattgatgacc

SEQ ID NO: 7348846 - DNA, 22 bp, Homo sapiens
aacattctggttctaaaaacct

SEQ ID NO: 7348847 - DNA, 22 bp, Homo sapiens
aattatttaactcctttggaga

SEQ ID NO: 7348848 - DNA, 22 bp, Homo sapiens
aattagcatttcccatataaat

SEQ ID NO: 7348849 - DNA, 20 bp, Homo sapiens
aattagatgtttaatcaata

SEQ ID NO: 7348850 - DNA, 22 bp, Homo sapiens
aattagagaagagtgaccagtc

SEQ ID NO: 7348851 - DNA, 22 bp, Homo sapiens
aattagactaattttacaaggg

SEQ ID NO: 7348852 - DNA, 22 bp, Homo sapiens
aattagagatcgcaataacggg

SEQ ID NO: 7348853 - DNA, 22 bp, Homo sapiens
aagacaataatttttgggcagg

SEQ ID NO: 7348854 - DNA, 22 bp, Homo sapiens
aagacaatattgctgtgaacgt

SEQ ID NO: 7348855 - DNA, 22 bp, Homo sapiens
aagacaatcctggacagtcagc

SEQ ID NO: 7348856 - DNA, 22 bp, Homo sapiens
aagaattggtttcctctgtcat

SEQ ID NO: 7348857 - DNA, 22 bp, Homo sapiens
aagaatttaaactaaccatatg

SEQ ID NO: 7348858 - DNA, 22 bp, Homo sapiens
aagaattcactggtagagtcaa

SEQ ID NO: 7348859 - DNA, 22 bp, Homo sapiens
aagaatgaaggatttagctgtt

SEQ ID NO: 7348860 - DNA, 22 bp, Homo sapiens
aagacaatgagtcctgatggga

SEQ ID NO: 7348861 - DNA, 22 bp, Homo sapiens
aagacaatctaaggggaatggt

SEQ ID NO: 7348862 - DNA, 22 bp, Homo sapiens
aagacaatgcattactaagaag

SEQ ID NO: 7348863 - DNA, 22 bp, Homo sapiens
aagacaatgtttctgatagata

SEQ ID NO: 7348864 - DNA, 22 bp, Homo sapiens
aagacaattttgagtatgcaca

SEQ ID NO: 7348865 - DNA, 22 bp, Homo sapiens
aagacaatttatgttagggtca

SEQ ID NO: 7348866 - DNA, 22 bp, Homo sapiens
aagacaatttgatactagttgc

SEQ ID NO: 7348867 - DNA, 22 bp, Homo sapiens
acaactgtcttcttcatgctcc

SEQ ID NO: 7348868 - DNA, 22 bp, Homo sapiens
aagacacaatgtagcccagcac

SEQ ID NO: 7348869 - DNA, 22 bp, Homo sapiens
aagacacacacatatgctgagt

SEQ ID NO: 7348870 - DNA, 22 bp, Homo sapiens
aagacacacacatatgctgagt

SEQ ID NO: 7348871 - DNA, 22 bp, Homo sapiens
aagacacacacatatgctgagt

SEQ ID NO: 7348872 - DNA, 22 bp, Homo sapiens
aagacacacacatatgctgagt

SEQ ID NO: 7348873 - DNA, 22 bp, Homo sapiens
acaagaaccaaagaaggatatt

SEQ ID NO: 7348874 - DNA, 22 bp, Homo sapiens
acaagaagtcacatctaggagt

SEQ ID NO: 7348875 - DNA, 23 bp, Homo sapiens
acaactttacagatacattttgt

SEQ ID NO: 7348876 - DNA, 22 bp, Homo sapiens
acaactttctgggttatctgat

SEQ ID NO: 7348877 - DNA, 22 bp, Homo sapiens
aatgttaattcacagccaaata

SEQ ID NO: 7348878 - DNA, 22 bp, Homo sapiens
aatgttaatgtgtttgcttatg

SEQ ID NO: 7348879 - DNA, 22 bp, Homo sapiens
aatgttaagtttagattataac

SEQ ID NO: 7348880 - DNA, 22 bp, Homo sapiens
aatgttaagtttagattataac

SEQ ID NO: 7348881 - DNA, 22 bp, Homo sapiens
aatgtcttttgatacaagttac

SEQ ID NO: 7348882 - DNA, 22 bp, Homo sapiens
aatgtcttttcccttactttcc

SEQ ID NO: 7348883 - DNA, 22 bp, Homo sapiens
aatgtgaaaccgcacagaataa

SEQ ID NO: 7348884 - DNA, 22 bp, Homo sapiens
aatgttttgtatgcctctgagc

SEQ ID NO: 7348885 - DNA, 22 bp, Homo sapiens
aatgttttttggtctgatgaat

SEQ ID NO: 7348886 - DNA, 20 bp, Homo sapiens
aatgtattgttttgtttcag

SEQ ID NO: 7348887 - DNA, 22 bp, Homo sapiens
aatgtatttgatgtattagcct

SEQ ID NO: 7348888 - DNA, 22 bp, Homo sapiens
aatgtattttgggagtttcttt

SEQ ID NO: 7348889 - DNA, 22 bp, Homo sapiens
aatgtcaaagtgctttgcaaac

SEQ ID NO: 7348890 - DNA, 22 bp, Homo sapiens
aatgtctttaaagtgcaataga

SEQ ID NO: 7348891 - DNA, 22 bp, Homo sapiens
aactctcagaacttttggtggg

SEQ ID NO: 7348892 - DNA, 23 bp, Homo sapiens
aactctggctagcatagaataga

SEQ ID NO: 7348893 - DNA, 22 bp, Homo sapiens
aactctggttcagtgatttcag

SEQ ID NO: 7348894 - DNA, 22 bp, Homo sapiens
aactctggctgcttcccaggtc

SEQ ID NO: 7348895 - DNA, 22 bp, Homo sapiens
aactctatttaccctactaaac

SEQ ID NO: 7348896 - DNA, 22 bp, Homo sapiens
aactccttaatgaagtccagtt

SEQ ID NO: 7348897 - DNA, 22 bp, Homo sapiens
aactcttgggctgcatgctgtt

SEQ ID NO: 7348898 - DNA, 22 bp, Homo sapiens
aactcttaattttcatgaaatg

SEQ ID NO: 7348899 - DNA, 22 bp, Homo sapiens
aactgaaaccaaacactttagg

SEQ ID NO: 7348900 - DNA, 22 bp, Homo sapiens
aagcacatctcaaacttcatct

SEQ ID NO: 7348901 - DNA, 22 bp, Homo sapiens
aagcacatctcctgtgcagaac

SEQ ID NO: 7348902 - DNA, 22 bp, Homo sapiens
aagcacattaaggaacattgaa

SEQ ID NO: 7348903 - DNA, 22 bp, Homo sapiens
aagcacatttggaaaacatgga

SEQ ID NO: 7348904 - DNA, 22 bp, Homo sapiens
aagcacatttggaaaacatgga

SEQ ID NO: 7348905 - DNA, 22 bp, Homo sapiens
acagatgagactccaggacctt

SEQ ID NO: 7348906 - DNA, 22 bp, Homo sapiens
acagatgaatttatggatggaa

SEQ ID NO: 7348907 - DNA, 22 bp, Homo sapiens
acagatcacttgactaaaatga

SEQ ID NO: 7348908 - DNA, 22 bp, Homo sapiens
acagagcttcccagcctgagca

SEQ ID NO: 7348909 - DNA, 22 bp, Homo sapiens
acagaggaaggctgagctgccc

SEQ ID NO: 7348910 - DNA, 22 bp, Homo sapiens
acagaggaaggctgagctgccc

SEQ ID NO: 7348911 - DNA, 22 bp, Homo sapiens
acagaggaaggctgagctgccc

SEQ ID NO: 7348912 - DNA, 22 bp, Homo sapiens
acagaggaagcatatagcacaa

SEQ ID NO: 7348913 - DNA, 22 bp, Homo sapiens
acagaggacaactaggcgctca

SEQ ID NO: 7348914 - DNA, 22 bp, Homo sapiens
acagaggacaactaggcgctca

SEQ ID NO: 7348915 - DNA, 22 bp, Homo sapiens
acagaagaaagggaggttttgc

SEQ ID NO: 7348916 - DNA, 22 bp, Homo sapiens
acagaagacagagtgttcatct

SEQ ID NO: 7348917 - DNA, 19 bp, Homo sapiens
acagaaatgtaagtgagac

SEQ ID NO: 7348918 - DNA, 22 bp, Homo sapiens
aagatacatgttaggagcaacc

SEQ ID NO: 7348919 - DNA, 22 bp, Homo sapiens
aagatacatcattcaggagtga

SEQ ID NO: 7348920 - DNA, 22 bp, Homo sapiens
aagcaaaaggttacacttctgg

SEQ ID NO: 7348921 - DNA, 22 bp, Homo sapiens
aagcaaaacgtgctctaggagg

SEQ ID NO: 7348922 - DNA, 22 bp, Homo sapiens
acagaagagctggctctgtgct

SEQ ID NO: 7348923 - DNA, 22 bp, Homo sapiens
acagaagaccagagagctaact

SEQ ID NO: 7348924 - DNA, 22 bp, Homo sapiens
acagaagcaaagactcaggcaa

SEQ ID NO: 7348925 - DNA, 23 bp, Homo sapiens
acacgtgtgtgtacatagatagt

SEQ ID NO: 7348926 - DNA, 22 bp, Homo sapiens
acactaattaagctgctttact

SEQ ID NO: 7348927 - DNA, 20 bp, Homo sapiens
aagagtctttactgagctaa

SEQ ID NO: 7348928 - DNA, 22 bp, Homo sapiens
acacacatgcatgcttgccatt

SEQ ID NO: 7348929 - DNA, 19 bp, Homo sapiens
aagagggaaagtgctatgc

SEQ ID NO: 7348930 - DNA, 22 bp, Homo sapiens
acacacagaaggaagccccact

SEQ ID NO: 7348931 - DNA, 22 bp, Homo sapiens
acacacagagtttatacaggca

SEQ ID NO: 7348932 - DNA, 22 bp, Homo sapiens
acacacagagtttatacaggca

SEQ ID NO: 7348933 - DNA, 22 bp, Homo sapiens
acacacagcgcctaccatgtgc

SEQ ID NO: 7348934 - DNA, 22 bp, Homo sapiens
aagaggagggcagattcaaggc

SEQ ID NO: 7348935 - DNA, 23 bp, Homo sapiens
aagaggaggccctgctcccgtcc

SEQ ID NO: 7348936 - DNA, 22 bp, Homo sapiens
aagaggagtagatgtggttggt

SEQ ID NO: 7348937 - DNA, 22 bp, Homo sapiens
aagaggaggattgatgtgggag

SEQ ID NO: 7348938 - DNA, 22 bp, Homo sapiens
aagaggaggattgatgtgggag

SEQ ID NO: 7348939 - DNA, 22 bp, Homo sapiens
aactgacttagccagtggagct

SEQ ID NO: 7348940 - DNA, 22 bp, Homo sapiens
aactgaggtctccagtgcagaa

SEQ ID NO: 7348941 - DNA, 22 bp, Homo sapiens
aactgataatggacacataaaa

SEQ ID NO: 7348942 - DNA, 22 bp, Homo sapiens
aactgataatggacacataaaa

SEQ ID NO: 7348943 - DNA, 20 bp, Homo sapiens
aactgagagttcaggaggag

SEQ ID NO: 7348944 - DNA, 23 bp, Homo sapiens
aactgagataatgtatgtaaagc

SEQ ID NO: 7348945 - DNA, 22 bp, Homo sapiens
aactgagattacaagagacatt

SEQ ID NO: 7348946 - DNA, 22 bp, Homo sapiens
aactgaggccaagtgaggaaag

SEQ ID NO: 7348947 - DNA, 22 bp, Homo sapiens
aactgaggccaagtgaggaaag

SEQ ID NO: 7348948 - DNA, 22 bp, Homo sapiens
aactgaggaataactgagttgc

SEQ ID NO: 7348949 - DNA, 22 bp, Homo sapiens
aactgagggccctgctgaagca

SEQ ID NO: 7348950 - DNA, 22 bp, Homo sapiens
aactcaaagatgcatgacgctt

SEQ ID NO: 7348951 - DNA, 20 bp, Homo sapiens
aactatgaatagaagagatt

SEQ ID NO: 7348952 - DNA, 22 bp, Homo sapiens
aactatgttaataagtttcatt

SEQ ID NO: 7348953 - DNA, 22 bp, Homo sapiens
aacatttgaaaatcaagaatct

SEQ ID NO: 7348954 - DNA, 22 bp, Homo sapiens
aacatttgaaaatcaagaatct

SEQ ID NO: 7348955 - DNA, 22 bp, Homo sapiens
aacatttgcagaggaaagctat

SEQ ID NO: 7348956 - DNA, 22 bp, Homo sapiens
aacatttgcagaggaaagctat

SEQ ID NO: 7348957 - DNA, 22 bp, Homo sapiens
aacatttgcgagtgggtttggg

SEQ ID NO: 7348958 - DNA, 22 bp, Homo sapiens
aacatttgcatgctttattaga

SEQ ID NO: 7348959 - DNA, 22 bp, Homo sapiens
aacatttgcatgctttattaga

SEQ ID NO: 7348960 - DNA, 22 bp, Homo sapiens
aacatttgtactaaagaagttc

SEQ ID NO: 7348961 - DNA, 23 bp, Homo sapiens
aacatttgtaaggtgattttgtt

SEQ ID NO: 7348962 - DNA, 22 bp, Homo sapiens
aacatttgtactaaagaagttc

SEQ ID NO: 7348963 - DNA, 22 bp, Homo sapiens
aacatttgtactaaagaagttc

SEQ ID NO: 7348964 - DNA, 22 bp, Homo sapiens
aacatttgtgtttgctaaaaat

SEQ ID NO: 7348965 - DNA, 22 bp, Homo sapiens
aacagtactggacaaggagtca

SEQ ID NO: 7348966 - DNA, 20 bp, Homo sapiens
aacagtaccatttatctcag

SEQ ID NO: 7348967 - DNA, 22 bp, Homo sapiens
aacaggaatgaggagaaaaggt

SEQ ID NO: 7348968 - DNA, 21 bp, Homo sapiens
aacattagtaatttgactttt

SEQ ID NO: 7348969 - DNA, 22 bp, Homo sapiens
aacattcaaaacccagttcagt

SEQ ID NO: 7348970 - DNA, 22 bp, Homo sapiens
aacattagatttgtttttctag

SEQ ID NO: 7348971 - DNA, 22 bp, Homo sapiens
aacatgcacaattttaggcctg

SEQ ID NO: 7348972 - DNA, 22 bp, Homo sapiens
aacatttcttctgaaactgagt

SEQ ID NO: 7348973 - DNA, 22 bp, Homo sapiens
aacattctactgtactgcattg

SEQ ID NO: 7348974 - DNA, 22 bp, Homo sapiens
aacattctatgtgcattcagaa

SEQ ID NO: 7348975 - DNA, 22 bp, Homo sapiens
aacattcacctctacctccttc

SEQ ID NO: 7348976 - DNA, 22 bp, Homo sapiens
aacattctattttgctaaaaca

SEQ ID NO: 7348977 - DNA, 22 bp, Homo sapiens
aacattctcattgggatatgtg

SEQ ID NO: 7348978 - DNA, 22 bp, Homo sapiens
aacaatgttcttttagcttgaa

SEQ ID NO: 7348979 - DNA, 22 bp, Homo sapiens
aacaatgtgattgaagctagaa

SEQ ID NO: 7348980 - DNA, 22 bp, Homo sapiens
aacaatgtgattgaagctagaa

SEQ ID NO: 7348981 - DNA, 22 bp, Homo sapiens
aacacataggcagagcatgaca

SEQ ID NO: 7348982 - DNA, 22 bp, Homo sapiens
aacacatatttatatatgcaca

SEQ ID NO: 7348983 - DNA, 22 bp, Homo sapiens
aacacatgccttaagaataagt

SEQ ID NO: 7348984 - DNA, 22 bp, Homo sapiens
aacagcagctgaggagctgggc

SEQ ID NO: 7348985 - DNA, 22 bp, Homo sapiens
aacagcttttttggtcagcatt

SEQ ID NO: 7348986 - DNA, 22 bp, Homo sapiens
aacaggaaaacagcacaatagc

SEQ ID NO: 7348987 - DNA, 22 bp, Homo sapiens
aacagctttgcttctggagaca

SEQ ID NO: 7348988 - DNA, 22 bp, Homo sapiens
aacaactgaaaagctttttctg

SEQ ID NO: 7348989 - DNA, 22 bp, Homo sapiens
aaagcacagggtgctagagagt

SEQ ID NO: 7348990 - DNA, 22 bp, Homo sapiens
aaagcacaggagagttcagtaa

SEQ ID NO: 7348991 - DNA, 22 bp, Homo sapiens
aaagcacatagtagaaggattt

SEQ ID NO: 7348992 - DNA, 22 bp, Homo sapiens
aaagcacagggtgctagagagt

SEQ ID NO: 7348993 - DNA, 22 bp, Homo sapiens
aaagcacagagctcccacagga

SEQ ID NO: 7348994 - DNA, 22 bp, Homo sapiens
aaagcaatttaatggaccatga

SEQ ID NO: 7348995 - DNA, 22 bp, Homo sapiens
aaagcacattacaagctcagtc

SEQ ID NO: 7348996 - DNA, 22 bp, Homo sapiens
aaagcacattacaagctcagtc

SEQ ID NO: 7348997 - DNA, 22 bp, Homo sapiens
aaagcacatgagtagtgtagta

SEQ ID NO: 7348998 - DNA, 22 bp, Homo sapiens
aaagcacatgagtagtgtagta

SEQ ID NO: 7348999 - DNA, 22 bp, Homo sapiens
aaagcacatgagtagtgtagta

SEQ ID NO: 7349000 - DNA, 22 bp, Homo sapiens
aaagcacatagtagaaggattt

SEQ ID NO: 7349001 - DNA, 22 bp, Homo sapiens
aaatggtaatgtctttctgttt

SEQ ID NO: 7349002 - DNA, 22 bp, Homo sapiens
aaagcaattgtggtttttgtca

SEQ ID NO: 7349003 - DNA, 22 bp, Homo sapiens
aaatggtgaagtgtaatttagc

SEQ ID NO: 7349004 - DNA, 22 bp, Homo sapiens
aaatggtgagggaattgaacag

SEQ ID NO: 7349005 - DNA, 22 bp, Homo sapiens
aagccacaatctgcatcagcat

SEQ ID NO: 7349006 - DNA, 22 bp, Homo sapiens
aagccagatagaagaactcatt

SEQ ID NO: 7349007 - DNA, 22 bp, Homo sapiens
aagccagatagaagaactcatt

SEQ ID NO: 7349008 - DNA, 18 bp, Homo sapiens
aagccagagaccactgcc

SEQ ID NO: 7349009 - DNA, 22 bp, Homo sapiens
aagcatggtggatgatacagtg

SEQ ID NO: 7349010 - DNA, 22 bp, Homo sapiens
aagcagcataattgctatttta

SEQ ID NO: 7349011 - DNA, 22 bp, Homo sapiens
aagcaccttccagatttgcacg

SEQ ID NO: 7349012 - DNA, 22 bp, Homo sapiens
aagcactgaggaaaaatttgat

SEQ ID NO: 7349013 - DNA, 22 bp, Homo sapiens
aagcactgggaggaggctgaga

SEQ ID NO: 7349014 - DNA, 22 bp, Homo sapiens
aagcactgggaggaggctgaga

SEQ ID NO: 7349015 - DNA, 20 bp, Homo sapiens
aagcactgtggtggcatgga

SEQ ID NO: 7349016 - DNA, 22 bp, Homo sapiens
aagcacttgcttagatgtggtt

SEQ ID NO: 7349017 - DNA, 22 bp, Homo sapiens
aagcactgtacaaatgtcactt

SEQ ID NO: 7349018 - DNA, 22 bp, Homo sapiens
aagcactgggtatagcaatgat

SEQ ID NO: 7349019 - DNA, 22 bp, Homo sapiens
aagcagaactgggaagtagtgg

SEQ ID NO: 7349020 - DNA, 22 bp, Homo sapiens
aagcagaaagaacaactgagtg

SEQ ID NO: 7349021 - DNA, 22 bp, Homo sapiens
aagcagcaacaaactggataaa

SEQ ID NO: 7349022 - DNA, 22 bp, Homo sapiens
aagcagcaagtttatttctatc

SEQ ID NO: 7349023 - DNA, 22 bp, Homo sapiens
aagcaacattctctgtggcatt

SEQ ID NO: 7349024 - DNA, 22 bp, Homo sapiens
aaatatcttaggagtatatgag

SEQ ID NO: 7349025 - DNA, 22 bp, Homo sapiens
aagcacctgcagttgacaaaaa

SEQ ID NO: 7349026 - DNA, 22 bp, Homo sapiens
aagcacctgggttatatcttag

SEQ ID NO: 7349027 - DNA, 22 bp, Homo sapiens
aagaggagacttcagcaacttg

SEQ ID NO: 7349028 - DNA, 22 bp, Homo sapiens
aagaggagacttcagcaacttg

SEQ ID NO: 7349029 - DNA, 22 bp, Homo sapiens
aagaggaggacggttcccagaa

SEQ ID NO: 7349030 - DNA, 18 bp, Homo sapiens
aagaggaggaaacccagg

SEQ ID NO: 7349031 - DNA, 22 bp, Homo sapiens
aactttgcaagggggccctgcg

SEQ ID NO: 7349032 - DNA, 22 bp, Homo sapiens
aactttctttcacagaagtatc

SEQ ID NO: 7349033 - DNA, 22 bp, Homo sapiens
aactttctttgcatctaagttt

SEQ ID NO: 7349034 - DNA, 22 bp, Homo sapiens
aactttgtcttttatgcttaca

SEQ ID NO: 7349035 - DNA, 22 bp, Homo sapiens
aactttgtgtgtttaatatggc

SEQ ID NO: 7349036 - DNA, 22 bp, Homo sapiens
aagaaagccaaagttcatacct

SEQ ID NO: 7349037 - DNA, 22 bp, Homo sapiens
aagaaagctgaatattctgtgt

SEQ ID NO: 7349038 - DNA, 22 bp, Homo sapiens
aagaatgattacaaagcaacga

SEQ ID NO: 7349039 - DNA, 22 bp, Homo sapiens
aagaatgagctcaaagatctta

SEQ ID NO: 7349040 - DNA, 22 bp, Homo sapiens
aagaatgtggcatttatttata

SEQ ID NO: 7349041 - DNA, 22 bp, Homo sapiens
aagaatgtcgttggtattttaa

SEQ ID NO: 7349042 - DNA, 22 bp, Homo sapiens
aagaggagaaaggctggctttg

SEQ ID NO: 7349043 - DNA, 22 bp, Homo sapiens
aagaggagaaaggctggctttg

SEQ ID NO: 7349044 - DNA, 22 bp, Homo sapiens
aagaggacttgtgaagatgtac

SEQ ID NO: 7349045 - DNA, 22 bp, Homo sapiens
aagagcctctgtgtttcagcct

SEQ ID NO: 7349046 - DNA, 22 bp, Homo sapiens
aagagccatacaagtaaaagca

SEQ ID NO: 7349047 - DNA, 22 bp, Homo sapiens
aagagccagctagtgaagaggc

SEQ ID NO: 7349048 - DNA, 22 bp, Homo sapiens
aagagccagtgggaaagtcttg

SEQ ID NO: 7349049 - DNA, 22 bp, Homo sapiens
aagaatgttagtttctgataca

SEQ ID NO: 7349050 - DNA, 22 bp, Homo sapiens
aagaatgttcattaaactgttg

SEQ ID NO: 7349051 - DNA, 22 bp, Homo sapiens
aagaatgttagtttctgataca

SEQ ID NO: 7349052 - DNA, 17 bp, Homo sapiens
aagacagaagccatgag

SEQ ID NO: 7349053 - DNA, 22 bp, Homo sapiens
aagacagagggaagcaatgatg

SEQ ID NO: 7349054 - DNA, 22 bp, Homo sapiens
aagagagagttcctaggcaaaa

SEQ ID NO: 7349055 - DNA, 22 bp, Homo sapiens
aagagagagttcctaggcaaaa

SEQ ID NO: 7349056 - DNA, 17 bp, Homo sapiens
aagacagaagccatgag

SEQ ID NO: 7349057 - DNA, 22 bp, Homo sapiens
aagacagaagtgatttgatgtg

SEQ ID NO: 7349058 - DNA, 22 bp, Homo sapiens
aaacatgagcatctcttcaagc

SEQ ID NO: 7349059 - DNA, 22 bp, Homo sapiens
aaacatgagcacttgcttcata

SEQ ID NO: 7349060 - DNA, 22 bp, Homo sapiens
aaacatgaatagatattaaaca

SEQ ID NO: 7349061 - DNA, 22 bp, Homo sapiens
aaacattgttatgataaattac

SEQ ID NO: 7349062 - DNA, 22 bp, Homo sapiens
aaaccacctccccagctgctgt

SEQ ID NO: 7349063 - DNA, 22 bp, Homo sapiens
aaaccacagttcagtgcttttg

SEQ ID NO: 7349064 - DNA, 22 bp, Homo sapiens
aaaccacacttagcagtttcgt

SEQ ID NO: 7349065 - DNA, 22 bp, Homo sapiens
aaagatctgacttagacacaga

SEQ ID NO: 7349066 - DNA, 21 bp, Homo sapiens
aaagatgagaactggatggct

SEQ ID NO: 7349067 - DNA, 22 bp, Homo sapiens
aaagatgagtccggcagacata

SEQ ID NO: 7349068 - DNA, 22 bp, Homo sapiens
aaagaagatggagacctgacta

SEQ ID NO: 7349069 - DNA, 22 bp, Homo sapiens
aaacttgacagtgagacagttt

SEQ ID NO: 7349070 - DNA, 22 bp, Homo sapiens
aaacttgacagtagacagatta

SEQ ID NO: 7349071 - DNA, 22 bp, Homo sapiens
aaacttgaccctatccaattac

SEQ ID NO: 7349072 - DNA, 22 bp, Homo sapiens
aaacttgagcagtcagatgaag

SEQ ID NO: 7349073 - DNA, 20 bp, Homo sapiens
aaacttgatggcatagaata

SEQ ID NO: 7349074 - DNA, 20 bp, Homo sapiens
aaacttgatggcatagaata

SEQ ID NO: 7349075 - DNA, 23 bp, Homo sapiens
aaacttgctatggctgaaatcat

SEQ ID NO: 7349076 - DNA, 22 bp, Homo sapiens
aaacttgttctcatgttgcaga

SEQ ID NO: 7349077 - DNA, 23 bp, Homo sapiens
aaacttgttaatgaggcaacagg

SEQ ID NO: 7349078 - DNA, 22 bp, Homo sapiens
aaacttgtgtatgtatatgcaa

SEQ ID NO: 7349079 - DNA, 22 bp, Homo sapiens
aaacttgttctcttgtgcctat

SEQ ID NO: 7349080 - DNA, 22 bp, Homo sapiens
aaaaagatgtcctgaagtttag

SEQ ID NO: 7349081 - DNA, 22 bp, Homo sapiens
aaaaatgaattcttcagtggca

SEQ ID NO: 7349082 - DNA, 22 bp, Homo sapiens
aaaaagacagaggatgaggcag

SEQ ID NO: 7349083 - DNA, 19 bp, Homo sapiens
aaaaacttagtccagaaag

SEQ ID NO: 7349084 - DNA, 20 bp, Homo sapiens
aaaaagacaaaacgagttgg

SEQ ID NO: 7349085 - DNA, 22 bp, Homo sapiens
aaaagtcagtctctcctagctc

SEQ ID NO: 7349086 - DNA, 22 bp, Homo sapiens
aaaatagatgaaaggaagtctg

SEQ ID NO: 7349087 - DNA, 22 bp, Homo sapiens
aaaatagcctcacataattgct

SEQ ID NO: 7349088 - DNA, 22 bp, Homo sapiens
aaaatagcctcacataattgct

SEQ ID NO: 7349089 - DNA, 22 bp, Homo sapiens
aaaatagcaatcagggactctc

SEQ ID NO: 7349090 - DNA, 20 bp, Homo sapiens
aaaatagccccaggctcatt

SEQ ID NO: 7349091 - DNA, 22 bp, Homo sapiens
aaaatagctatggaatgtcact

SEQ ID NO: 7349092 - DNA, 22 bp, Homo sapiens
aaaatagctatggaatgtcact

SEQ ID NO: 7349093 - DNA, 22 bp, Homo sapiens
aaacaaatagtgcatgggaatt

SEQ ID NO: 7349094 - DNA, 22 bp, Homo sapiens
aaacaaagcatcttgctatgca

SEQ ID NO: 7349095 - DNA, 22 bp, Homo sapiens
aaacaaagcatcttgctatgca

SEQ ID NO: 7349096 - DNA, 22 bp, Homo sapiens
aaatagaattaactagctactg

SEQ ID NO: 7349097 - DNA, 22 bp, Homo sapiens
aaatagaaaccaacaaggtcag

SEQ ID NO: 7349098 - DNA, 22 bp, Homo sapiens
aaatacagattctgactcagag

SEQ ID NO: 7349099 - DNA, 21 bp, Homo sapiens
aaatactgtcaaatggtgggt

SEQ ID NO: 7349100 - DNA, 21 bp, Homo sapiens
aaatactgtcaaatggtgggt

SEQ ID NO: 7349101 - DNA, 22 bp, Homo sapiens
aaatactgtgaataaaggtttt

SEQ ID NO: 7349102 - DNA, 22 bp, Homo sapiens
aaatactgtgaataaaggtttt

SEQ ID NO: 7349103 - DNA, 22 bp, Homo sapiens
aaatactgtctctgagagagcc

SEQ ID NO: 7349104 - DNA, 22 bp, Homo sapiens
aaatactgtctctgagagagcc

SEQ ID NO: 7349105 - DNA, 22 bp, Homo sapiens
aaatactgtccaccatggagca

SEQ ID NO: 7349106 - DNA, 22 bp, Homo sapiens
aaatactgtccaccatggagca

SEQ ID NO: 7349107 - DNA, 22 bp, Homo sapiens
aaatactgttttattccatgat

SEQ ID NO: 7349108 - DNA, 22 bp, Homo sapiens
aaatagaaaccaacaaggtcag

SEQ ID NO: 7349109 - DNA, 22 bp, Homo sapiens
aaatactgttgaatgaagtaag

SEQ ID NO: 7349110 - DNA, 22 bp, Homo sapiens
aaatactgttttattccatgat

SEQ ID NO: 7349111 - DNA, 22 bp, Homo sapiens
aaatactgttgaatgaagtaag

SEQ ID NO: 7349112 - DNA, 22 bp, Homo sapiens
aaatataatttctgcctcaata

SEQ ID NO: 7349113 - DNA, 22 bp, Homo sapiens
aaactaaggtgctgtggactga

SEQ ID NO: 7349114 - DNA, 22 bp, Homo sapiens
aaatcatgaggacattatgcca

SEQ ID NO: 7349115 - DNA, 22 bp, Homo sapiens
aaatccaggagaatttccactt

SEQ ID NO: 7349116 - DNA, 22 bp, Homo sapiens
aaatccaagctttggtaactga

SEQ ID NO: 7349117 - DNA, 22 bp, Homo sapiens
aaatcagttgttatattaaaga

SEQ ID NO: 7349118 - DNA, 22 bp, Homo sapiens
aaatcatagcccccatccgatt

SEQ ID NO: 7349119 - DNA, 22 bp, Homo sapiens
aaatcagttgttatattaaaga

SEQ ID NO: 7349120 - DNA, 22 bp, Homo sapiens
aaatcagttggaacacaagcag

SEQ ID NO: 7349121 - DNA, 22 bp, Homo sapiens
aaatcagttctccctttcttca

SEQ ID NO: 7349122 - DNA, 22 bp, Homo sapiens
aaatcagttctccctttcttca

SEQ ID NO: 7349123 - DNA, 22 bp, Homo sapiens
aaatcagtgctcatttgaaagg

SEQ ID NO: 7349124 - DNA, 22 bp, Homo sapiens
aaatcagtccctcttggaattt

SEQ ID NO: 7349125 - DNA, 22 bp, Homo sapiens
aaatcagttaagatgaggccat

SEQ ID NO: 7349126 - DNA, 22 bp, Homo sapiens
aaatcagttagtggtaggattg

SEQ ID NO: 7349127 - DNA, 22 bp, Homo sapiens
aaatcagttcacgttctgaggt

SEQ ID NO: 7349128 - DNA, 22 bp, Homo sapiens
aaatatgttttccagttgtcat

SEQ ID NO: 7349129 - DNA, 22 bp, Homo sapiens
aaatggcagtagaaaagaatcc

SEQ ID NO: 7349130 - DNA, 22 bp, Homo sapiens
aaatggcaggctctttgctagt

SEQ ID NO: 7349131 - DNA, 22 bp, Homo sapiens
aaatgcctagaaatcacgcaga

SEQ ID NO: 7349132 - DNA, 20 bp, Homo sapiens
aaatgccagtgattctgctt

SEQ ID NO: 7349133 - DNA, 22 bp, Homo sapiens
aaatgcctcattttctctcact

SEQ ID NO: 7349134 - DNA, 22 bp, Homo sapiens
aaatgcctcccaaacagcacaa

SEQ ID NO: 7349135 - DNA, 22 bp, Homo sapiens
aaatgcctcccattctactgac

SEQ ID NO: 7349136 - DNA, 22 bp, Homo sapiens
aaatgcctctgctgtacacaat

SEQ ID NO: 7349137 - DNA, 22 bp, Homo sapiens
aaatgcctgtgtaaattctagc

SEQ ID NO: 7349138 - DNA, 22 bp, Homo sapiens
aaatgccttcaaacacttaagg

SEQ ID NO: 7349139 - DNA, 22 bp, Homo sapiens
aaagcaatggatgagaatctgt

SEQ ID NO: 7349140 - DNA, 22 bp, Homo sapiens
aaacactgtctctggtattgaa

SEQ ID NO: 7349141 - DNA, 22 bp, Homo sapiens
aaacactgtacaatctgcaggg

SEQ ID NO: 7349142 - DNA, 22 bp, Homo sapiens
aaacactgtacaatctgcaggg

SEQ ID NO: 7349143 - DNA, 22 bp, Homo sapiens
aaacactggtatgatgtatagt

SEQ ID NO: 7349144 - DNA, 22 bp, Homo sapiens
aaacactgcagggtttacttga

SEQ ID NO: 7349145 - DNA, 22 bp, Homo sapiens
aaacactggcaatttcatgcac

SEQ ID NO: 7349146 - DNA, 22 bp, Homo sapiens
aaacactggcaatttcatgcac

SEQ ID NO: 7349147 - DNA, 22 bp, Homo sapiens
aaacatcaccattttacctaat

SEQ ID NO: 7349148 - DNA, 22 bp, Homo sapiens
aaacatcaattgcatctcccaa

SEQ ID NO: 7349149 - DNA, 22 bp, Homo sapiens
aaacagttttctcatttagtgt

SEQ ID NO: 7349150 - DNA, 22 bp, Homo sapiens
aaagtgctgggattccaggcgt

SEQ ID NO: 7349151 - DNA, 22 bp, Homo sapiens
aaagtgctgggattacaggtgt

SEQ ID NO: 7349152 - DNA, 22 bp, Homo sapiens
aaagtgctcggattacaggtat

SEQ ID NO: 7349153 - DNA, 22 bp, Homo sapiens
aaagtgctgaaattacaggtgt

SEQ ID NO: 7349154 - DNA, 22 bp, Homo sapiens
agaaactcatgccatctcgttg

SEQ ID NO: 7349155 - DNA, 22 bp, Homo sapiens
agaaactacttggaggaaagat

SEQ ID NO: 7349156 - DNA, 22 bp, Homo sapiens
aatcttaaagaatattctacca

SEQ ID NO: 7349157 - DNA, 22 bp, Homo sapiens
aatgaaaattggaccctagaac

SEQ ID NO: 7349158 - DNA, 22 bp, Homo sapiens
aatcttgagggactcatgaggt

SEQ ID NO: 7349159 - DNA, 22 bp, Homo sapiens
aatatgtctctgtggttaagta

SEQ ID NO: 7349160 - DNA, 22 bp, Homo sapiens
aatatgtgggtgctaatcaaaa

SEQ ID NO: 7349161 - DNA, 18 bp, Homo sapiens
aatatgtctagttacagc

SEQ ID NO: 7349162 - DNA, 22 bp, Homo sapiens
aatatggcttgttactatgttt

SEQ ID NO: 7349163 - DNA, 22 bp, Homo sapiens
agaaaattactccagagacaag

SEQ ID NO: 7349164 - DNA, 22 bp, Homo sapiens
agaaacctcacagcaattctga

SEQ ID NO: 7349165 - DNA, 22 bp, Homo sapiens
agaaaatattcattgagaggct

SEQ ID NO: 7349166 - DNA, 22 bp, Homo sapiens
aatattcatttgcagaagaagt

SEQ ID NO: 7349167 - DNA, 22 bp, Homo sapiens
agaaaataatttcttggctggt

SEQ ID NO: 7349168 - DNA, 22 bp, Homo sapiens
acttatttattcattcagctca

SEQ ID NO: 7349169 - DNA, 22 bp, Homo sapiens
acttccaggaggtgtcactgaa

SEQ ID NO: 7349170 - DNA, 22 bp, Homo sapiens
acttccagctttataattcagt

SEQ ID NO: 7349171 - DNA, 22 bp, Homo sapiens
acttagttaagtattttggaaa

SEQ ID NO: 7349172 - DNA, 22 bp, Homo sapiens
acttaggttttatttcctccaa

SEQ ID NO: 7349173 - DNA, 22 bp, Homo sapiens
aatatgaattattgttacaagt

SEQ ID NO: 7349174 - DNA, 22 bp, Homo sapiens
aatatcagctctgtcacttact

SEQ ID NO: 7349175 - DNA, 22 bp, Homo sapiens
aatatcagtatattgtatcagt

SEQ ID NO: 7349176 - DNA, 22 bp, Homo sapiens
acttccgattttcagcacacat

SEQ ID NO: 7349177 - DNA, 21 bp, Homo sapiens
acttcccaggacctactcaga

SEQ ID NO: 7349178 - DNA, 21 bp, Homo sapiens
acttcccaggacctactcaga

SEQ ID NO: 7349179 - DNA, 22 bp, Homo sapiens
acttcccatttctctgctttag

SEQ ID NO: 7349180 - DNA, 22 bp, Homo sapiens
acttcccaacgtgggcctccca

SEQ ID NO: 7349181 - DNA, 22 bp, Homo sapiens
acttcccacaccctgttttctc

SEQ ID NO: 7349182 - DNA, 17 bp, Homo sapiens
acttcccacccctccag

SEQ ID NO: 7349183 - DNA, 22 bp, Homo sapiens
aatagaaaggaggggctcttgt

SEQ ID NO: 7349184 - DNA, 22 bp, Homo sapiens
aatacttgaatttcatgtcagg

SEQ ID NO: 7349185 - DNA, 22 bp, Homo sapiens
aatacttgaatttcatgtcagg

SEQ ID NO: 7349186 - DNA, 22 bp, Homo sapiens
aatacttgtcagatgaataaga

SEQ ID NO: 7349187 - DNA, 22 bp, Homo sapiens
aatacttgtcagatgaataaga

SEQ ID NO: 7349188 - DNA, 22 bp, Homo sapiens
aatactgtctttcacagatatt

SEQ ID NO: 7349189 - DNA, 22 bp, Homo sapiens
aatactgtatgagctatggtag

SEQ ID NO: 7349190 - DNA, 22 bp, Homo sapiens
aatactgtatgagctatggtag

SEQ ID NO: 7349191 - DNA, 22 bp, Homo sapiens
aatactggactctcactattta

SEQ ID NO: 7349192 - DNA, 22 bp, Homo sapiens
aatactgctgctgctgaaatca

SEQ ID NO: 7349193 - DNA, 22 bp, Homo sapiens
aatactgctgcctgcaaattat

SEQ ID NO: 7349194 - DNA, 22 bp, Homo sapiens
actgtgggcctttcctttgacc

SEQ ID NO: 7349195 - DNA, 22 bp, Homo sapiens
actgtggggtgcgaggcagtga

SEQ ID NO: 7349196 - DNA, 22 bp, Homo sapiens
aataactggcacatatcacata

SEQ ID NO: 7349197 - DNA, 22 bp, Homo sapiens
aataactggcacatatcacata

SEQ ID NO: 7349198 - DNA, 22 bp, Homo sapiens
aataacagattttcaagctgtg

SEQ ID NO: 7349199 - DNA, 22 bp, Homo sapiens
actgtggagaaagaaagactgc

SEQ ID NO: 7349200 - DNA, 22 bp, Homo sapiens
actgtggataagtcagagatgt

SEQ ID NO: 7349201 - DNA, 22 bp, Homo sapiens
actgtgcttgccaaaccattga

SEQ ID NO: 7349202 - DNA, 22 bp, Homo sapiens
actgtggctcatcaggctggtg

SEQ ID NO: 7349203 - DNA, 22 bp, Homo sapiens
actgagactttgttgagttctt

SEQ ID NO: 7349204 - DNA, 22 bp, Homo sapiens
actgactagacttacaacagag

SEQ ID NO: 7349205 - DNA, 22 bp, Homo sapiens
actgactgtggatggcagcagc

SEQ ID NO: 7349206 - DNA, 22 bp, Homo sapiens
aagttttattggaacatagcca

SEQ ID NO: 7349207 - DNA, 22 bp, Homo sapiens
aataacagagtcttcaagatag

SEQ ID NO: 7349208 - DNA, 22 bp, Homo sapiens
aataacagaaacttgagcatca

SEQ ID NO: 7349209 - DNA, 22 bp, Homo sapiens
aataacagaaacttgagcatca

SEQ ID NO: 7349210 - DNA, 22 bp, Homo sapiens
aataaagtagcgtttaaggtgc

SEQ ID NO: 7349211 - DNA, 22 bp, Homo sapiens
aataaagtagcgtttaaggtgc

SEQ ID NO: 7349212 - DNA, 22 bp, Homo sapiens
aataaagaatggatgagatcgt

SEQ ID NO: 7349213 - DNA, 22 bp, Homo sapiens
actcatctgccattcctgtacc

SEQ ID NO: 7349214 - DNA, 22 bp, Homo sapiens
actcatgtaagcggaatgtagt

SEQ ID NO: 7349215 - DNA, 22 bp, Homo sapiens
aagtggagctataggctcagat

SEQ ID NO: 7349216 - DNA, 22 bp, Homo sapiens
aagtggagctataggctcagat

SEQ ID NO: 7349217 - DNA, 19 bp, Homo sapiens
actcatctgccacctctgt

SEQ ID NO: 7349218 - DNA, 22 bp, Homo sapiens
actcatctattagatatctgtt

SEQ ID NO: 7349219 - DNA, 22 bp, Homo sapiens
actcatcagtggttttaatcaa

SEQ ID NO: 7349220 - DNA, 22 bp, Homo sapiens
actcatatactgttgtttttaa

SEQ ID NO: 7349221 - DNA, 21 bp, Homo sapiens
aagtaaatcagagaaataacc

SEQ ID NO: 7349222 - DNA, 22 bp, Homo sapiens
aagtaaatgttggagctcaaat

SEQ ID NO: 7349223 - DNA, 22 bp, Homo sapiens
aagtaaatatctgtttatagca

SEQ ID NO: 7349224 - DNA, 22 bp, Homo sapiens
aagtaaatatctgtagtcttta

SEQ ID NO: 7349225 - DNA, 22 bp, Homo sapiens
acctgggaggcagaggttgcag

SEQ ID NO: 7349226 - DNA, 22 bp, Homo sapiens
acctgggaggcggaggttgcag

SEQ ID NO: 7349227 - DNA, 20 bp, Homo sapiens
acctggggttgcctgtgctc

SEQ ID NO: 7349228 - DNA, 20 bp, Homo sapiens
accttgaacccgccagccat

SEQ ID NO: 7349229 - DNA, 22 bp, Homo sapiens
aagtgaaattgccattcttata

SEQ ID NO: 7349230 - DNA, 22 bp, Homo sapiens
aagtgaaattgccattcttata

SEQ ID NO: 7349231 - DNA, 22 bp, Homo sapiens
aagtgaaattgccattcttata

SEQ ID NO: 7349232 - DNA, 22 bp, Homo sapiens
aagtgaaattgccattcttata

SEQ ID NO: 7349233 - DNA, 22 bp, Homo sapiens
aagtgaggcctaggcactgggt

SEQ ID NO: 7349234 - DNA, 22 bp, Homo sapiens
aagtgaggtttctgctttcaga

SEQ ID NO: 7349235 - DNA, 22 bp, Homo sapiens
aagtgatgctacgactttgaca

SEQ ID NO: 7349236 - DNA, 22 bp, Homo sapiens
aagtgattctagtcatgattct

SEQ ID NO: 7349237 - DNA, 22 bp, Homo sapiens
aagtgcaggagtggggaaagta

SEQ ID NO: 7349238 - DNA, 22 bp, Homo sapiens
aagtgattttcttcttagttat

SEQ ID NO: 7349239 - DNA, 22 bp, Homo sapiens
aagtgattttcctacttgctaa

SEQ ID NO: 7349240 - DNA, 21 bp, Homo sapiens
acaggagaccgcctggcagtc

SEQ ID NO: 7349241 - DNA, 22 bp, Homo sapiens
acaggaaattggcatatcagtt

SEQ ID NO: 7349242 - DNA, 22 bp, Homo sapiens
acaggaaagagctaggcatagg

SEQ ID NO: 7349243 - DNA, 22 bp, Homo sapiens
acagctttgggcaatgctatga

SEQ ID NO: 7349244 - DNA, 20 bp, Homo sapiens
acaggagatctgaggaaagg

SEQ ID NO: 7349245 - DNA, 20 bp, Homo sapiens
acaggagatctgaggaaagg

SEQ ID NO: 7349246 - DNA, 22 bp, Homo sapiens
acaggagctctagggacagcac

SEQ ID NO: 7349247 - DNA, 22 bp, Homo sapiens
acaggagcccaggatgggcgga

SEQ ID NO: 7349248 - DNA, 22 bp, Homo sapiens
acaggaggagcagctgtgtgcc

SEQ ID NO: 7349249 - DNA, 22 bp, Homo sapiens
acaggcagagaactcagccaga

SEQ ID NO: 7349250 - DNA, 22 bp, Homo sapiens
acaggcactttgacatgccatc

SEQ ID NO: 7349251 - DNA, 22 bp, Homo sapiens
acaggcactttgacatgccatc

SEQ ID NO: 7349252 - DNA, 22 bp, Homo sapiens
acaggcactgtcaagtcatgaa

SEQ ID NO: 7349253 - DNA, 22 bp, Homo sapiens
acaggcactctcattaaaatag

SEQ ID NO: 7349254 - DNA, 22 bp, Homo sapiens
acagtgcataaaaacaactttt

SEQ ID NO: 7349255 - DNA, 22 bp, Homo sapiens
acagtgcaggtctcaacaatta

SEQ ID NO: 7349256 - DNA, 22 bp, Homo sapiens
acagtgcaggtctcaacaatta

SEQ ID NO: 7349257 - DNA, 22 bp, Homo sapiens
acagtgcataaaaacaactttt

SEQ ID NO: 7349258 - DNA, 22 bp, Homo sapiens
acagtgctaaacacttcttgaa

SEQ ID NO: 7349259 - DNA, 22 bp, Homo sapiens
acaggtgattcaggctctggga

SEQ ID NO: 7349260 - DNA, 22 bp, Homo sapiens
acagtgtatgatatttcacagt

SEQ ID NO: 7349261 - DNA, 22 bp, Homo sapiens
acagtgtatattgtttatctgg

SEQ ID NO: 7349262 - DNA, 22 bp, Homo sapiens
acagtgtactaggtacatgttc

SEQ ID NO: 7349263 - DNA, 20 bp, Homo sapiens
acagtgtaatattcacattc

SEQ ID NO: 7349264 - DNA, 18 bp, Homo sapiens
acagtgctgtcactgctt

SEQ ID NO: 7349265 - DNA, 22 bp, Homo sapiens
acagtgctgtcaaatatgtttt

SEQ ID NO: 7349266 - DNA, 22 bp, Homo sapiens
acagtgctggctacaaccctgg

SEQ ID NO: 7349267 - DNA, 22 bp, Homo sapiens
acagtgctggctacaaccctgg

SEQ ID NO: 7349268 - DNA, 22 bp, Homo sapiens
acagtgctgaacgacatggaag

SEQ ID NO: 7349269 - DNA, 22 bp, Homo sapiens
acagtgctgatctagactgacc

SEQ ID NO: 7349270 - DNA, 22 bp, Homo sapiens
acagtgctgatctagactgacc

SEQ ID NO: 7349271 - DNA, 22 bp, Homo sapiens
acagtgctgaacgacatggaag

SEQ ID NO: 7349272 - DNA, 22 bp, Homo sapiens
acagtgctcatgtgacatggtg

SEQ ID NO: 7349273 - DNA, 22 bp, Homo sapiens
acagtgctaatgatgccaagat

SEQ ID NO: 7349274 - DNA, 22 bp, Homo sapiens
acagtgctaatgatgccaagat

SEQ ID NO: 7349275 - DNA, 22 bp, Homo sapiens
acagtgctatcaatagctagaa

SEQ ID NO: 7349276 - DNA, 22 bp, Homo sapiens
acagtgctatcaatagctagaa

SEQ ID NO: 7349277 - DNA, 22 bp, Homo sapiens
acagtgctcatgtgacatggtg

SEQ ID NO: 7349278 - DNA, 22 bp, Homo sapiens
acaggctgccacttgcatccaa

SEQ ID NO: 7349279 - DNA, 22 bp, Homo sapiens
acaggctgccacttgcatccaa

SEQ ID NO: 7349280 - DNA, 22 bp, Homo sapiens
acaggcttacaggctgcaagta

SEQ ID NO: 7349281 - DNA, 22 bp, Homo sapiens
acaggctgacttcctgccatgt

SEQ ID NO: 7349282 - DNA, 22 bp, Homo sapiens
acaggctgacttcctgccatgt

SEQ ID NO: 7349283 - DNA, 22 bp, Homo sapiens
acaggctgaaagttaagttctg

SEQ ID NO: 7349284 - DNA, 22 bp, Homo sapiens
acaggctgacttcctgccatgt

SEQ ID NO: 7349285 - DNA, 22 bp, Homo sapiens
acaggctgaaagttaagttctg

SEQ ID NO: 7349286 - DNA, 22 bp, Homo sapiens
acaggctgaggatgattgcatc

SEQ ID NO: 7349287 - DNA, 22 bp, Homo sapiens
acaggctgatagaccataaata

SEQ ID NO: 7349288 - DNA, 22 bp, Homo sapiens
acaggctgagcgtccatcttca

SEQ ID NO: 7349289 - DNA, 22 bp, Homo sapiens
acaggcttttacggatatcttt

SEQ ID NO: 7349290 - DNA, 22 bp, Homo sapiens
acaggtcaacgagagcaggcaa

SEQ ID NO: 7349291 - DNA, 22 bp, Homo sapiens
accaggcatgatgtggagcaca

SEQ ID NO: 7349292 - DNA, 22 bp, Homo sapiens
aagtaaaatgtttcctttatta

SEQ ID NO: 7349293 - DNA, 22 bp, Homo sapiens
aagtaaaatgtttcctttatta

SEQ ID NO: 7349294 - DNA, 22 bp, Homo sapiens
accaggaaactctcgtctagtt

SEQ ID NO: 7349295 - DNA, 22 bp, Homo sapiens
accaggcagtatggtgctgcaa

SEQ ID NO: 7349296 - DNA, 22 bp, Homo sapiens
accaggcagcactttccttgca

SEQ ID NO: 7349297 - DNA, 22 bp, Homo sapiens
accaggcagagctgggccttaa

SEQ ID NO: 7349298 - DNA, 17 bp, Homo sapiens
accaggcaacacgccca

SEQ ID NO: 7349299 - DNA, 22 bp, Homo sapiens
accaggcaaaaccacaggagca

SEQ ID NO: 7349300 - DNA, 22 bp, Homo sapiens
accagctgctgattgctaaatg

SEQ ID NO: 7349301 - DNA, 22 bp, Homo sapiens
accacaggaggatggctgctgg

SEQ ID NO: 7349302 - DNA, 22 bp, Homo sapiens
acattctgtgagtcatgtttta

SEQ ID NO: 7349303 - DNA, 22 bp, Homo sapiens
acattctgtgatgctgtcccaa

SEQ ID NO: 7349304 - DNA, 22 bp, Homo sapiens
acattctgttgaggctgggtca

SEQ ID NO: 7349305 - DNA, 22 bp, Homo sapiens
accacaggggaggaatgatgcc

SEQ ID NO: 7349306 - DNA, 22 bp, Homo sapiens
acatgggggctgctgccagcga

SEQ ID NO: 7349307 - DNA, 22 bp, Homo sapiens
acatgggacagagaaagaggcc

SEQ ID NO: 7349308 - DNA, 23 bp, Homo sapiens
acatgggaaatgcaaagagaagt

SEQ ID NO: 7349309 - DNA, 22 bp, Homo sapiens
acatacttagagtaaacaagta

SEQ ID NO: 7349310 - DNA, 22 bp, Homo sapiens
acatactttgtccttaacgtac

SEQ ID NO: 7349311 - DNA, 22 bp, Homo sapiens
acatacttatgctaaaaatata

SEQ ID NO: 7349312 - DNA, 22 bp, Homo sapiens
acatagaaatttatttcttaca

SEQ ID NO: 7349313 - DNA, 22 bp, Homo sapiens
acatactttttaaaagattgct

SEQ ID NO: 7349314 - DNA, 22 bp, Homo sapiens
acatgcattaaaaatacttgtg

SEQ ID NO: 7349315 - DNA, 22 bp, Homo sapiens
acataataaaaataacagctca

SEQ ID NO: 7349316 - DNA, 22 bp, Homo sapiens
acataatacctaggacagtttg

SEQ ID NO: 7349317 - DNA, 18 bp, Homo sapiens
acatacattctgtctgca

SEQ ID NO: 7349318 - DNA, 22 bp, Homo sapiens
acatactatgaatacatgtgtc

SEQ ID NO: 7349319 - DNA, 22 bp, Homo sapiens
acatacttaacattaaagtcat

SEQ ID NO: 7349320 - DNA, 22 bp, Homo sapiens
acatacattgcctcattggtaa

SEQ ID NO: 7349321 - DNA, 22 bp, Homo sapiens
acattcaaaatatttctgatgt

SEQ ID NO: 7349322 - DNA, 22 bp, Homo sapiens
acattcaaaatatttctgatgt

SEQ ID NO: 7349323 - DNA, 22 bp, Homo sapiens
acattcaaccaatgtttgctat

SEQ ID NO: 7349324 - DNA, 22 bp, Homo sapiens
acattctggatgtctgatgaga

SEQ ID NO: 7349325 - DNA, 22 bp, Homo sapiens
acattctgaataggcattttat

SEQ ID NO: 7349326 - DNA, 22 bp, Homo sapiens
acattctgaatgcctgacagta

SEQ ID NO: 7349327 - DNA, 22 bp, Homo sapiens
acattctgtatcatctgtctca

SEQ ID NO: 7349328 - DNA, 22 bp, Homo sapiens
acattctgaaatccatgtgggt

SEQ ID NO: 7349329 - DNA, 22 bp, Homo sapiens
acattctgaaaaacagtgtttt

SEQ ID NO: 7349330 - DNA, 22 bp, Homo sapiens
acattcaaaaagcatctgtcac

SEQ ID NO: 7349331 - DNA, 22 bp, Homo sapiens
acattatagttgctacagagta

SEQ ID NO: 7349332 - DNA, 22 bp, Homo sapiens
aaggccagctggagggatgagg

SEQ ID NO: 7349333 - DNA, 22 bp, Homo sapiens
acattacagcaagtttacgtta

SEQ ID NO: 7349334 - DNA, 22 bp, Homo sapiens
agaggtggccatgggcgctgga

SEQ ID NO: 7349335 - DNA, 22 bp, Homo sapiens
agaggtggccatgggcgctgga

SEQ ID NO: 7349336 - DNA, 22 bp, Homo sapiens
aattttgttttagtggaggctg

SEQ ID NO: 7349337 - DNA, 22 bp, Homo sapiens
aattttgtttaagtgatctgct

SEQ ID NO: 7349338 - DNA, 22 bp, Homo sapiens
agagtacactgtacacacaatt

SEQ ID NO: 7349339 - DNA, 22 bp, Homo sapiens
agatataataatttacaagtgt

SEQ ID NO: 7349340 - DNA, 22 bp, Homo sapiens
agagtgaaaagctagagcagta

SEQ ID NO: 7349341 - DNA, 22 bp, Homo sapiens
agagtgaaggccaggttacagt

SEQ ID NO: 7349342 - DNA, 22 bp, Homo sapiens
agagtgaaggttgacacttcac

SEQ ID NO: 7349343 - DNA, 22 bp, Homo sapiens
agagtgaaaagctagagcagta

SEQ ID NO: 7349344 - DNA, 22 bp, Homo sapiens
agatgttttggagacactaacc

SEQ ID NO: 7349345 - DNA, 22 bp, Homo sapiens
agatgttttagagtttgacttg

SEQ ID NO: 7349346 - DNA, 22 bp, Homo sapiens
agatgttttctaattctatatt

SEQ ID NO: 7349347 - DNA, 22 bp, Homo sapiens
agattaactctcagaaaagagg

SEQ ID NO: 7349348 - DNA, 22 bp, Homo sapiens
agatctcacctctgtgtattat

SEQ ID NO: 7349349 - DNA, 22 bp, Homo sapiens
agatcccaggatactggcctat

SEQ ID NO: 7349350 - DNA, 22 bp, Homo sapiens
agatatcaccagttttacatac

SEQ ID NO: 7349351 - DNA, 22 bp, Homo sapiens
agatatacacccatatcacata

SEQ ID NO: 7349352 - DNA, 22 bp, Homo sapiens
agaggccaatagtaggtggcat

SEQ ID NO: 7349353 - DNA, 22 bp, Homo sapiens
aatttcaaagctcactggcata

SEQ ID NO: 7349354 - DNA, 22 bp, Homo sapiens
aatttcaagtcttgaagaagta

SEQ ID NO: 7349355 - DNA, 22 bp, Homo sapiens
aatttcaatgcactcatggttg

SEQ ID NO: 7349356 - DNA, 22 bp, Homo sapiens
aattttgtgtgggatcaaagga

SEQ ID NO: 7349357 - DNA, 22 bp, Homo sapiens
agagggctgctgcacagtgctc

SEQ ID NO: 7349358 - DNA, 22 bp, Homo sapiens
agagggctgctgcacagtgctc

SEQ ID NO: 7349359 - DNA, 22 bp, Homo sapiens
agagggcatgcttggtggcctg

SEQ ID NO: 7349360 - DNA, 22 bp, Homo sapiens
agagggcatgcttggtggcctg

SEQ ID NO: 7349361 - DNA, 22 bp, Homo sapiens
agagggcattaactctgtcttg

SEQ ID NO: 7349362 - DNA, 22 bp, Homo sapiens
agagggctaaggtttgggagat

SEQ ID NO: 7349363 - DNA, 22 bp, Homo sapiens
agagggctaactgggaagcagg

SEQ ID NO: 7349364 - DNA, 22 bp, Homo sapiens
agagggcccatgttgggctgct

SEQ ID NO: 7349365 - DNA, 22 bp, Homo sapiens
agagggcgcccaggcccacgcc

SEQ ID NO: 7349366 - DNA, 19 bp, Homo sapiens
agaggcagtctccaacagg

SEQ ID NO: 7349367 - DNA, 22 bp, Homo sapiens
agaggcagtatacaatccgagc

SEQ ID NO: 7349368 - DNA, 19 bp, Homo sapiens
agaggcagtctccaacagg

SEQ ID NO: 7349369 - DNA, 21 bp, Homo sapiens
agaggcaggcattaagtacac

SEQ ID NO: 7349370 - DNA, 22 bp, Homo sapiens
agagcaggcataaagctttgaa

SEQ ID NO: 7349371 - DNA, 22 bp, Homo sapiens
agagcaggggcaatgtgttgca

SEQ ID NO: 7349372 - DNA, 23 bp, Homo sapiens
agaggcaggagtggcttgcccgg

SEQ ID NO: 7349373 - DNA, 22 bp, Homo sapiens
agagcagctgtgacatggacag

SEQ ID NO: 7349374 - DNA, 22 bp, Homo sapiens
aattcagttgacagctaatgcc

SEQ ID NO: 7349375 - DNA, 22 bp, Homo sapiens
agagcagctgcattcagcacct

SEQ ID NO: 7349376 - DNA, 22 bp, Homo sapiens
agagcagctcgctacctctcta

SEQ ID NO: 7349377 - DNA, 19 bp, Homo sapiens
agaatcatcttgaagtgat

SEQ ID NO: 7349378 - DNA, 21 bp, Homo sapiens
agaatccaagatgccattggc

SEQ ID NO: 7349379 - DNA, 21 bp, Homo sapiens
agaatccattcagaccttctc

SEQ ID NO: 7349380 - DNA, 22 bp, Homo sapiens
agaataatactgaaatgctgaa

SEQ ID NO: 7349381 - DNA, 22 bp, Homo sapiens
agaataaatgctacctatcaca

SEQ ID NO: 7349382 - DNA, 22 bp, Homo sapiens
aatggaacttgtaattatgtcc

SEQ ID NO: 7349383 - DNA, 22 bp, Homo sapiens
aatgaaacaattagctgtaata

SEQ ID NO: 7349384 - DNA, 22 bp, Homo sapiens
aatgctggaagcctcagtagat

SEQ ID NO: 7349385 - DNA, 22 bp, Homo sapiens
aatgtacagctgtctttcctcc

SEQ ID NO: 7349386 - DNA, 22 bp, Homo sapiens
aatgtacagctgctgctgaagg

SEQ ID NO: 7349387 - DNA, 22 bp, Homo sapiens
aatgtacactgaaagcctatca

SEQ ID NO: 7349388 - DNA, 23 bp, Homo sapiens
agacaaaagcctcagtcttaggc

SEQ ID NO: 7349389 - DNA, 22 bp, Homo sapiens
agaatttctggaagattgcaag

SEQ ID NO: 7349390 - DNA, 22 bp, Homo sapiens
agaatttcaaatggaagtttta

SEQ ID NO: 7349391 - DNA, 22 bp, Homo sapiens
agaatttatgacaacgatagcc

SEQ ID NO: 7349392 - DNA, 22 bp, Homo sapiens
agaatttaggcttgtctgctgt

SEQ ID NO: 7349393 - DNA, 22 bp, Homo sapiens
agaatttaggatgcatgtgaat

SEQ ID NO: 7349394 - DNA, 19 bp, Homo sapiens
agaattgttttatgtcttc

SEQ ID NO: 7349395 - DNA, 22 bp, Homo sapiens
agaattgttggggtaataaaag

SEQ ID NO: 7349396 - DNA, 22 bp, Homo sapiens
agagagaggcagcagtgctcac

SEQ ID NO: 7349397 - DNA, 22 bp, Homo sapiens
agagagaggggcgagcaaacac

SEQ ID NO: 7349398 - DNA, 20 bp, Homo sapiens
agagagaggtaaattgagca

SEQ ID NO: 7349399 - DNA, 17 bp, Homo sapiens
agagagagcatgccacc

SEQ ID NO: 7349400 - DNA, 22 bp, Homo sapiens
agagagaggcagcagtgctcac

SEQ ID NO: 7349401 - DNA, 22 bp, Homo sapiens
agagagagaaatgaaatgtgct

SEQ ID NO: 7349402 - DNA, 22 bp, Homo sapiens
agagaaatagattggtccagaa

SEQ ID NO: 7349403 - DNA, 22 bp, Homo sapiens
agagaaagtcctgatctctcta

SEQ ID NO: 7349404 - DNA, 20 bp, Homo sapiens
agagagacctaggcctagtc

SEQ ID NO: 7349405 - DNA, 20 bp, Homo sapiens
agagagacctaggcctagtc

SEQ ID NO: 7349406 - DNA, 22 bp, Homo sapiens
agagagcagtctggaagaaaca

SEQ ID NO: 7349407 - DNA, 20 bp, Homo sapiens
agagagcacaggcaggaaag

SEQ ID NO: 7349408 - DNA, 23 bp, Homo sapiens
agagagagtttgtgtcaggtacc

SEQ ID NO: 7349409 - DNA, 20 bp, Homo sapiens
agagagcacaggcaggaaag

SEQ ID NO: 7349410 - DNA, 22 bp, Homo sapiens
agagatagtgtattagttgggc

SEQ ID NO: 7349411 - DNA, 22 bp, Homo sapiens
aattattgagcatctactgtgt

SEQ ID NO: 7349412 - DNA, 18 bp, Homo sapiens
agagaaagaccaaagcat

SEQ ID NO: 7349413 - DNA, 19 bp, Homo sapiens
agagaaagaattgagtcta

SEQ ID NO: 7349414 - DNA, 19 bp, Homo sapiens
agagaaagaattgagtcta

SEQ ID NO: 7349415 - DNA, 22 bp, Homo sapiens
agactgggccatttccccagct

SEQ ID NO: 7349416 - DNA, 22 bp, Homo sapiens
agagaaacccttcagtgttttg

SEQ ID NO: 7349417 - DNA, 22 bp, Homo sapiens
aatgtataaccataggaaattt

SEQ ID NO: 7349418 - DNA, 22 bp, Homo sapiens
agactctggcatgctaactagt

SEQ ID NO: 7349419 - DNA, 22 bp, Homo sapiens
agactctgggattttgaaagca

SEQ ID NO: 7349420 - DNA, 22 bp, Homo sapiens
agactctggtcctcttgaattt

SEQ ID NO: 7349421 - DNA, 22 bp, Homo sapiens
agacactggtgaagaaatcagg

SEQ ID NO: 7349422 - DNA, 22 bp, Homo sapiens
agactctgctaagaatataatt

SEQ ID NO: 7349423 - DNA, 22 bp, Homo sapiens
agcaggtgacagggctgtggtg

SEQ ID NO: 7349424 - DNA, 22 bp, Homo sapiens
agcaggtgacccaagcaggctg

SEQ ID NO: 7349425 - DNA, 22 bp, Homo sapiens
agcaggtgacccaagcaggctg

SEQ ID NO: 7349426 - DNA, 22 bp, Homo sapiens
agcagggcccactaggggagat

SEQ ID NO: 7349427 - DNA, 19 bp, Homo sapiens
agcaggccacagggccagc

SEQ ID NO: 7349428 - DNA, 22 bp, Homo sapiens
agcagggctgtgctccttccga

SEQ ID NO: 7349429 - DNA, 22 bp, Homo sapiens
agcagccatagatagcatgcaa

SEQ ID NO: 7349430 - DNA, 22 bp, Homo sapiens
agcagccatagatagcatgcaa

SEQ ID NO: 7349431 - DNA, 22 bp, Homo sapiens
agcagccagttctctgtggtag

SEQ ID NO: 7349432 - DNA, 19 bp, Homo sapiens
agcagccatagacaatatg

SEQ ID NO: 7349433 - DNA, 22 bp, Homo sapiens
agcagccatccttagagaaaga

SEQ ID NO: 7349434 - DNA, 23 bp, Homo sapiens
agcagccatagggaagcaataca

SEQ ID NO: 7349435 - DNA, 23 bp, Homo sapiens
agcagccatagggaagcaataca

SEQ ID NO: 7349436 - DNA, 23 bp, Homo sapiens
agcagccatagggaagcaataca

SEQ ID NO: 7349437 - DNA, 21 bp, Homo sapiens
agcagccatttcacagagact

SEQ ID NO: 7349438 - DNA, 22 bp, Homo sapiens
agcagcccaaacagactaagac

SEQ ID NO: 7349439 - DNA, 19 bp, Homo sapiens
agcagccatcgaccatgga

SEQ ID NO: 7349440 - DNA, 19 bp, Homo sapiens
agcagccatcgaccatgga

SEQ ID NO: 7349441 - DNA, 21 bp, Homo sapiens
agcagccatggatggtatgta

SEQ ID NO: 7349442 - DNA, 22 bp, Homo sapiens
agcagccatttaaaatgaattg

SEQ ID NO: 7349443 - DNA, 22 bp, Homo sapiens
agcagctcgggctacagagggg

SEQ ID NO: 7349444 - DNA, 22 bp, Homo sapiens
agcagctcgggctacagagggg

SEQ ID NO: 7349445 - DNA, 22 bp, Homo sapiens
agcagctctgagaggccagcac

SEQ ID NO: 7349446 - DNA, 22 bp, Homo sapiens
agcaggaacgagttcatgggga

SEQ ID NO: 7349447 - DNA, 22 bp, Homo sapiens
agcaggaggagagcctggcggt

SEQ ID NO: 7349448 - DNA, 22 bp, Homo sapiens
agcaggagctgtgggaagatgg

SEQ ID NO: 7349449 - DNA, 22 bp, Homo sapiens
agcagaacattttcagggctgt

SEQ ID NO: 7349450 - DNA, 22 bp, Homo sapiens
agcagaacattatctaggtctt

SEQ ID NO: 7349451 - DNA, 21 bp, Homo sapiens
agcagaacagtcgagcactgc

SEQ ID NO: 7349452 - DNA, 22 bp, Homo sapiens
agcagaacagtcttctagttct

SEQ ID NO: 7349453 - DNA, 22 bp, Homo sapiens
agcagaacagtcttctagttct

SEQ ID NO: 7349454 - DNA, 22 bp, Homo sapiens
agcagcagattcagcaggaatg

SEQ ID NO: 7349455 - DNA, 23 bp, Homo sapiens
agcagcagcaattaagtggatat

SEQ ID NO: 7349456 - DNA, 22 bp, Homo sapiens
agcagcaacttatttttcttat

SEQ ID NO: 7349457 - DNA, 23 bp, Homo sapiens
agcagcagcaattaagtggatat

SEQ ID NO: 7349458 - DNA, 19 bp, Homo sapiens
agcagcagctaccacttgt

SEQ ID NO: 7349459 - DNA, 22 bp, Homo sapiens
agcagccaggaatctgcagagc

SEQ ID NO: 7349460 - DNA, 22 bp, Homo sapiens
agcagccagtgggagtgataca

SEQ ID NO: 7349461 - DNA, 23 bp, Homo sapiens
agcagccagagatcctcggccct

SEQ ID NO: 7349462 - DNA, 23 bp, Homo sapiens
agcagccagagatcctcggccct

SEQ ID NO: 7349463 - DNA, 22 bp, Homo sapiens
agcagccagagtctgaacatta

SEQ ID NO: 7349464 - DNA, 22 bp, Homo sapiens
agcagccagagtctgaacatta

SEQ ID NO: 7349465 - DNA, 16 bp, Homo sapiens
agcagccagcactgga

SEQ ID NO: 7349466 - DNA, 22 bp, Homo sapiens
agcagcagctcattcttcctgt

SEQ ID NO: 7349467 - DNA, 22 bp, Homo sapiens
acacactgttgctcatccaggc

SEQ ID NO: 7349468 - DNA, 22 bp, Homo sapiens
acacactgctcatgaggagcat

SEQ ID NO: 7349469 - DNA, 22 bp, Homo sapiens
acacactgctcatgaggagcat

SEQ ID NO: 7349470 - DNA, 22 bp, Homo sapiens
acacactgagtgccataggacc

SEQ ID NO: 7349471 - DNA, 22 bp, Homo sapiens
agcacttatgtgattaggacag

SEQ ID NO: 7349472 - DNA, 21 bp, Homo sapiens
acacactacacattcctagtt

SEQ ID NO: 7349473 - DNA, 22 bp, Homo sapiens
agcagaaatgatggtatgggac

SEQ ID NO: 7349474 - DNA, 22 bp, Homo sapiens
agcagaaagcttattttgactg

SEQ ID NO: 7349475 - DNA, 22 bp, Homo sapiens
agcagaaatagaagtcaatgat

SEQ ID NO: 7349476 - DNA, 22 bp, Homo sapiens
agcagaaacagccagtctggac

SEQ ID NO: 7349477 - DNA, 22 bp, Homo sapiens
agcagaaaattggaaatgacaa

SEQ ID NO: 7349478 - DNA, 22 bp, Homo sapiens
agcactttcctggcaaatgtgg

SEQ ID NO: 7349479 - DNA, 22 bp, Homo sapiens
agcagaaaactttcatgctctg

SEQ ID NO: 7349480 - DNA, 22 bp, Homo sapiens
agatttctgtcaccttctatgc

SEQ ID NO: 7349481 - DNA, 22 bp, Homo sapiens
agatttctgtcaccttctatgc

SEQ ID NO: 7349482 - DNA, 22 bp, Homo sapiens
agatttctgtggtcatgtaatg

SEQ ID NO: 7349483 - DNA, 22 bp, Homo sapiens
agatttcccaaatacttgttat

SEQ ID NO: 7349484 - DNA, 22 bp, Homo sapiens
agatttcccactccatgtattg

SEQ ID NO: 7349485 - DNA, 22 bp, Homo sapiens
agatttccctcttgtatttgca

SEQ ID NO: 7349486 - DNA, 22 bp, Homo sapiens
agatttcctgcactgcctttga

SEQ ID NO: 7349487 - DNA, 22 bp, Homo sapiens
agatttgaaacttgcttcataa

SEQ ID NO: 7349488 - DNA, 22 bp, Homo sapiens
agattttagtgtagaggacttg

SEQ ID NO: 7349489 - DNA, 22 bp, Homo sapiens
agattttatagataatttccca

SEQ ID NO: 7349490 - DNA, 22 bp, Homo sapiens
acacacatggtattgttcagaa

SEQ ID NO: 7349491 - DNA, 22 bp, Homo sapiens
acacacatggtattgttcagaa

SEQ ID NO: 7349492 - DNA, 22 bp, Homo sapiens
acacacatggtattgttcagaa

SEQ ID NO: 7349493 - DNA, 22 bp, Homo sapiens
acagacatggaccaagcactgt

SEQ ID NO: 7349494 - DNA, 22 bp, Homo sapiens
agccctgcacaggtctgtggct

SEQ ID NO: 7349495 - DNA, 22 bp, Homo sapiens
agccctgcacagttcgggagga

SEQ ID NO: 7349496 - DNA, 22 bp, Homo sapiens
agccctgcaggatgagggaggt

SEQ ID NO: 7349497 - DNA, 22 bp, Homo sapiens
agccctgcataaatcagttggt

SEQ ID NO: 7349498 - DNA, 22 bp, Homo sapiens
agccctgcaggaggtgggagag

SEQ ID NO: 7349499 - DNA, 22 bp, Homo sapiens
agccctgcatagaagggaacac

SEQ ID NO: 7349500 - DNA, 22 bp, Homo sapiens
agccctgccattctctggagct

SEQ ID NO: 7349501 - DNA, 16 bp, Homo sapiens
agccctgccgtgtact

SEQ ID NO: 7349502 - DNA, 22 bp, Homo sapiens
agccctgcctctccaatgccca

SEQ ID NO: 7349503 - DNA, 22 bp, Homo sapiens
agccctgccctgccatgtggca

SEQ ID NO: 7349504 - DNA, 22 bp, Homo sapiens
agccctgcgctcacgttctgca

SEQ ID NO: 7349505 - DNA, 22 bp, Homo sapiens
agccctgcgatcgtgatttctt

SEQ ID NO: 7349506 - DNA, 22 bp, Homo sapiens
agccctggggctggtcttggaa

SEQ ID NO: 7349507 - DNA, 22 bp, Homo sapiens
agccctggggctggtcttggaa

SEQ ID NO: 7349508 - DNA, 22 bp, Homo sapiens
agcctggccaggcctgcccagg

SEQ ID NO: 7349509 - DNA, 22 bp, Homo sapiens
agcctggccctgctgaactctg

SEQ ID NO: 7349510 - DNA, 22 bp, Homo sapiens
agccctgggttagggtgggagc

SEQ ID NO: 7349511 - DNA, 22 bp, Homo sapiens
agccctgggttagggtgggagc

SEQ ID NO: 7349512 - DNA, 22 bp, Homo sapiens
agccctggtagcctgctgccat

SEQ ID NO: 7349513 - DNA, 22 bp, Homo sapiens
agctcaggtctcaggaggtgtc

SEQ ID NO: 7349514 - DNA, 23 bp, Homo sapiens
agctccaggtgattgtaatgtgt

SEQ ID NO: 7349515 - DNA, 22 bp, Homo sapiens
agctccaggtcagtgcacccct

SEQ ID NO: 7349516 - DNA, 22 bp, Homo sapiens
agctccagaaaggtacacacag

SEQ ID NO: 7349517 - DNA, 22 bp, Homo sapiens
agctcaggctctgcagggacta

SEQ ID NO: 7349518 - DNA, 22 bp, Homo sapiens
agcctgtgacattgactatgaa

SEQ ID NO: 7349519 - DNA, 22 bp, Homo sapiens
agcctggctgtaacctcatggt

SEQ ID NO: 7349520 - DNA, 21 bp, Homo sapiens
agcctgttggtttactgctca

SEQ ID NO: 7349521 - DNA, 22 bp, Homo sapiens
agcctgtgtgctttggacaggg

SEQ ID NO: 7349522 - DNA, 22 bp, Homo sapiens
agcctgtgttgctctggcgata

SEQ ID NO: 7349523 - DNA, 23 bp, Homo sapiens
agcattctctccaacatttaaca

SEQ ID NO: 7349524 - DNA, 22 bp, Homo sapiens
agcattccacactgaagtctgc

SEQ ID NO: 7349525 - DNA, 22 bp, Homo sapiens
agcatctggcagaaagtcagaa

SEQ ID NO: 7349526 - DNA, 22 bp, Homo sapiens
agcattggtggccagagtgcct

SEQ ID NO: 7349527 - DNA, 22 bp, Homo sapiens
acagaacagagggttttagaat

SEQ ID NO: 7349528 - DNA, 22 bp, Homo sapiens
agccaggctactccttgctgac

SEQ ID NO: 7349529 - DNA, 20 bp, Homo sapiens
agccaggctcaagctccccc

SEQ ID NO: 7349530 - DNA, 22 bp, Homo sapiens
agccaggctaaatgagccatga

SEQ ID NO: 7349531 - DNA, 22 bp, Homo sapiens
agccaggctaaatgagccatga

SEQ ID NO: 7349532 - DNA, 22 bp, Homo sapiens
agccaggcgggtctttgctcct

SEQ ID NO: 7349533 - DNA, 22 bp, Homo sapiens
acagacatgctgtttgggtggt

SEQ ID NO: 7349534 - DNA, 22 bp, Homo sapiens
acagacagtatggtggggctga

SEQ ID NO: 7349535 - DNA, 22 bp, Homo sapiens
acagacagtaaatagtgtggct

SEQ ID NO: 7349536 - DNA, 21 bp, Homo sapiens
acagacagggccagtgtcccc

SEQ ID NO: 7349537 - DNA, 22 bp, Homo sapiens
acagacagggcacctgcctcct

SEQ ID NO: 7349538 - DNA, 22 bp, Homo sapiens
agcccaggttctaaagccaaac

SEQ ID NO: 7349539 - DNA, 22 bp, Homo sapiens
agcccaggtggagtgtgtgggg

SEQ ID NO: 7349540 - DNA, 22 bp, Homo sapiens
agcccaggtctcaaagtacagg

SEQ ID NO: 7349541 - DNA, 22 bp, Homo sapiens
agcccaggtctggcccagcctg

SEQ ID NO: 7349542 - DNA, 22 bp, Homo sapiens
agcccaggtgactcatacaccc

SEQ ID NO: 7349543 - DNA, 21 bp, Homo sapiens
acagaactgtatagtgataaa

SEQ ID NO: 7349544 - DNA, 22 bp, Homo sapiens
acagaactgtgatctcataaat

SEQ ID NO: 7349545 - DNA, 22 bp, Homo sapiens
acagaactgtgtgatgattaag

SEQ ID NO: 7349546 - DNA, 22 bp, Homo sapiens
agcccagctttcacccctctgg

SEQ ID NO: 7349547 - DNA, 22 bp, Homo sapiens
acagaacatggatttttgaagt

SEQ ID NO: 7349548 - DNA, 22 bp, Homo sapiens
acagaacatattgcttctctca

SEQ ID NO: 7349549 - DNA, 22 bp, Homo sapiens
acagaacaggctgagaaaaaca

SEQ ID NO: 7349550 - DNA, 22 bp, Homo sapiens
acagaacaggctgagaaaaaca

SEQ ID NO: 7349551 - DNA, 22 bp, Homo sapiens
acagaactgagaattctctatc

SEQ ID NO: 7349552 - DNA, 20 bp, Homo sapiens
acagaactgagaacagtctc

SEQ ID NO: 7349553 - DNA, 22 bp, Homo sapiens
acagaactgggaaatgcacata

SEQ ID NO: 7349554 - DNA, 22 bp, Homo sapiens
tcagttactcaacagaggtgga

SEQ ID NO: 7349555 - DNA, 22 bp, Homo sapiens
tcagttactcctttccttaggt

SEQ ID NO: 7349556 - DNA, 22 bp, Homo sapiens
tcagttacttgcttgtttgaaa

SEQ ID NO: 7349557 - DNA, 21 bp, Homo sapiens
tcagttactgagagagaagtg

SEQ ID NO: 7349558 - DNA, 22 bp, Homo sapiens
tcagttactctgatgtcctgtg

SEQ ID NO: 7349559 - DNA, 22 bp, Homo sapiens
tcagtgcttttgtcacatggtc

SEQ ID NO: 7349560 - DNA, 23 bp, Homo sapiens
tcagtgcttgggggtgacgcgcc

SEQ ID NO: 7349561 - DNA, 22 bp, Homo sapiens
tcagtgcttgcctctggaggag

SEQ ID NO: 7349562 - DNA, 22 bp, Homo sapiens
tcagtgcttttgtcacatggtc

SEQ ID NO: 7349563 - DNA, 22 bp, Homo sapiens
tcagtgcttgacagctctggga

SEQ ID NO: 7349564 - DNA, 22 bp, Homo sapiens
tcagtgcttgcctctggaggag

SEQ ID NO: 7349565 - DNA, 22 bp, Homo sapiens
tcagtgcttgacagctctggga

SEQ ID NO: 7349566 - DNA, 22 bp, Homo sapiens
tcagttttaaggtttgagaatt

SEQ ID NO: 7349567 - DNA, 19 bp, Homo sapiens
tcagttttagtcatcagtt

SEQ ID NO: 7349568 - DNA, 22 bp, Homo sapiens
tcagttttcatttcatgagcag

SEQ ID NO: 7349569 - DNA, 22 bp, Homo sapiens
tcagttttcatttcatgagcag

SEQ ID NO: 7349570 - DNA, 22 bp, Homo sapiens
tcagttttcaatttcatcagag

SEQ ID NO: 7349571 - DNA, 19 bp, Homo sapiens
tcagttttagtcatcagtt

SEQ ID NO: 7349572 - DNA, 22 bp, Homo sapiens
tcagttttcaatttcatcagag

SEQ ID NO: 7349573 - DNA, 22 bp, Homo sapiens
tcagtttcttctttagataaaa

SEQ ID NO: 7349574 - DNA, 22 bp, Homo sapiens
tcagtttctttactcatagaat

SEQ ID NO: 7349575 - DNA, 22 bp, Homo sapiens
tcagtttttgtttgccagatag

SEQ ID NO: 7349576 - DNA, 22 bp, Homo sapiens
tcagtttttgtttgccagatag

SEQ ID NO: 7349577 - DNA, 22 bp, Homo sapiens
tcagtttttctatactttgtag

SEQ ID NO: 7349578 - DNA, 22 bp, Homo sapiens
tcataaaaatagactctaaagt

SEQ ID NO: 7349579 - DNA, 22 bp, Homo sapiens
tcataaaacacaccaggtagtt

SEQ ID NO: 7349580 - DNA, 22 bp, Homo sapiens
tcagttttctcatctgtaattt

SEQ ID NO: 7349581 - DNA, 22 bp, Homo sapiens
tcagttttctcatctgtgaaat

SEQ ID NO: 7349582 - DNA, 22 bp, Homo sapiens
tcagttttctcatttatgagat

SEQ ID NO: 7349583 - DNA, 22 bp, Homo sapiens
tcagttttgattcctggttctc

SEQ ID NO: 7349584 - DNA, 22 bp, Homo sapiens
tcagttttgaaaacattgaatg

SEQ ID NO: 7349585 - DNA, 22 bp, Homo sapiens
tcagtttttacggtcacaggga

SEQ ID NO: 7349586 - DNA, 22 bp, Homo sapiens
tcagtttttaagagttatgcga

SEQ ID NO: 7349587 - DNA, 22 bp, Homo sapiens
tcagttttgtatgttgtaagtc

SEQ ID NO: 7349588 - DNA, 23 bp, Homo sapiens
tcagttttggctgttcagtgttg

SEQ ID NO: 7349589 - DNA, 22 bp, Homo sapiens
tcagtttttaaatgatataatt

SEQ ID NO: 7349590 - DNA, 22 bp, Homo sapiens
tcatctcagagaggtatgttag

SEQ ID NO: 7349591 - DNA, 22 bp, Homo sapiens
tcatctcagggcgacatcatgt

SEQ ID NO: 7349592 - DNA, 22 bp, Homo sapiens
tcatccctaaggacagctctgc

SEQ ID NO: 7349593 - DNA, 22 bp, Homo sapiens
tcatccatctttgatttcatag

SEQ ID NO: 7349594 - DNA, 20 bp, Homo sapiens
tcatatttttgccctgggcc

SEQ ID NO: 7349595 - DNA, 23 bp, Homo sapiens
tcatcaaacagctgctcaagaaa

SEQ ID NO: 7349596 - DNA, 22 bp, Homo sapiens
tcatccaaggattttattgcat

SEQ ID NO: 7349597 - DNA, 22 bp, Homo sapiens
tcatccagtaccatggaaggca

SEQ ID NO: 7349598 - DNA, 20 bp, Homo sapiens
tcataaagaggaaataaata

SEQ ID NO: 7349599 - DNA, 21 bp, Homo sapiens
tcagggcagctgctcttcaga

SEQ ID NO: 7349600 - DNA, 22 bp, Homo sapiens
tcaggggacagccagctggagg

SEQ ID NO: 7349601 - DNA, 22 bp, Homo sapiens
tcaggggacttaggagagaagt

SEQ ID NO: 7349602 - DNA, 22 bp, Homo sapiens
tcaggggcagccggggaagcca

SEQ ID NO: 7349603 - DNA, 21 bp, Homo sapiens
tcaggggctgtgttttccatc

SEQ ID NO: 7349604 - DNA, 22 bp, Homo sapiens
tcaggggcttgaggtgcatgtc

SEQ ID NO: 7349605 - DNA, 22 bp, Homo sapiens
tcaggggcttgaggtgcatgtc

SEQ ID NO: 7349606 - DNA, 22 bp, Homo sapiens
tcaggggctgtgcatttcccag

SEQ ID NO: 7349607 - DNA, 22 bp, Homo sapiens
tcaggggctgtgcatttcccag

SEQ ID NO: 7349608 - DNA, 22 bp, Homo sapiens
tcaggggcagctgtgctttgtg

SEQ ID NO: 7349609 - DNA, 22 bp, Homo sapiens
tcaggggcccttccctcagcag

SEQ ID NO: 7349610 - DNA, 22 bp, Homo sapiens
tcaggggctgtgcatttcccag

SEQ ID NO: 7349611 - DNA, 22 bp, Homo sapiens
tcagtgcattaataatatcagt

SEQ ID NO: 7349612 - DNA, 22 bp, Homo sapiens
tcaggtcctctgggtcccagcc

SEQ ID NO: 7349613 - DNA, 22 bp, Homo sapiens
tcagggggaggagactgccagt

SEQ ID NO: 7349614 - DNA, 22 bp, Homo sapiens
tcagggtgaaccaggcaggaat

SEQ ID NO: 7349615 - DNA, 22 bp, Homo sapiens
tcagggtgggaggacccttgag

SEQ ID NO: 7349616 - DNA, 22 bp, Homo sapiens
tcagggtgaaattgggtcctgg

SEQ ID NO: 7349617 - DNA, 22 bp, Homo sapiens
tcagggtgaaccaggcaggaat

SEQ ID NO: 7349618 - DNA, 22 bp, Homo sapiens
tcagggcacattctgcagtggc

SEQ ID NO: 7349619 - DNA, 22 bp, Homo sapiens
tcaggctgaggtcatctgcatc

SEQ ID NO: 7349620 - DNA, 22 bp, Homo sapiens
tcaggctgaccaggttttgctc

SEQ ID NO: 7349621 - DNA, 22 bp, Homo sapiens
tcaggctgagaaaatctggacc

SEQ ID NO: 7349622 - DNA, 22 bp, Homo sapiens
tcaggcctttgaacttggagtg

SEQ ID NO: 7349623 - DNA, 22 bp, Homo sapiens
tcaggcctttgaacttggagtg

SEQ ID NO: 7349624 - DNA, 22 bp, Homo sapiens
tcaggctgaaaggactccagtt

SEQ ID NO: 7349625 - DNA, 22 bp, Homo sapiens
tcaggctgaatcatcctagctt

SEQ ID NO: 7349626 - DNA, 22 bp, Homo sapiens
tcaggctgaaggaggcctatct

SEQ ID NO: 7349627 - DNA, 22 bp, Homo sapiens
tcaggcaaggctggtctcatac

SEQ ID NO: 7349628 - DNA, 22 bp, Homo sapiens
tcaggcaccctctattttcatc

SEQ ID NO: 7349629 - DNA, 22 bp, Homo sapiens
tcaggcaccccttgagtagggg

SEQ ID NO: 7349630 - DNA, 22 bp, Homo sapiens
tcaggaggtctgctgcggggtg

SEQ ID NO: 7349631 - DNA, 22 bp, Homo sapiens
tcaggaggtccgcccgggaggg

SEQ ID NO: 7349632 - DNA, 22 bp, Homo sapiens
tcaggagggtgacaggccctgg

SEQ ID NO: 7349633 - DNA, 22 bp, Homo sapiens
tcaggcaggaagcccctgcaca

SEQ ID NO: 7349634 - DNA, 22 bp, Homo sapiens
tcaggcaccttcctcttatctg

SEQ ID NO: 7349635 - DNA, 22 bp, Homo sapiens
tcaggcactgctttctgatatg

SEQ ID NO: 7349636 - DNA, 22 bp, Homo sapiens
tcaggcactggctgagtgatgg

SEQ ID NO: 7349637 - DNA, 22 bp, Homo sapiens
tcaggcaggtggctggctatgg

SEQ ID NO: 7349638 - DNA, 22 bp, Homo sapiens
tcaggaaatggaattcttgtgt

SEQ ID NO: 7349639 - DNA, 22 bp, Homo sapiens
tcaggaaagcctagaagagaac

SEQ ID NO: 7349640 - DNA, 22 bp, Homo sapiens
tcaggaggacagataaggatag

SEQ ID NO: 7349641 - DNA, 23 bp, Homo sapiens
tcagcctcttaggacttctcacc

SEQ ID NO: 7349642 - DNA, 23 bp, Homo sapiens
tcagcttcattgtcttctatggc

SEQ ID NO: 7349643 - DNA, 22 bp, Homo sapiens
tcagcttctcaaaatggcttag

SEQ ID NO: 7349644 - DNA, 22 bp, Homo sapiens
tcagcttgctaaaagggcatct

SEQ ID NO: 7349645 - DNA, 22 bp, Homo sapiens
tcagccagtgtgcacctggagt

SEQ ID NO: 7349646 - DNA, 22 bp, Homo sapiens
tcagccagttaagtcaagaaat

SEQ ID NO: 7349647 - DNA, 22 bp, Homo sapiens
tcagccagttaaggcttagaca

SEQ ID NO: 7349648 - DNA, 22 bp, Homo sapiens
tcagccagttgccccagttagt

SEQ ID NO: 7349649 - DNA, 22 bp, Homo sapiens
tcagccagtttgattctatttg

SEQ ID NO: 7349650 - DNA, 22 bp, Homo sapiens
tcagccagtttgtttattccgg

SEQ ID NO: 7349651 - DNA, 22 bp, Homo sapiens
tcagcccaccttcaggggagtt

SEQ ID NO: 7349652 - DNA, 22 bp, Homo sapiens
tcagcccaaccctgcacaagga

SEQ ID NO: 7349653 - DNA, 22 bp, Homo sapiens
tcagcctcctaatttcctgtga

SEQ ID NO: 7349654 - DNA, 22 bp, Homo sapiens
tcagcctctctgagtccagacc

SEQ ID NO: 7349655 - DNA, 22 bp, Homo sapiens
tcagcctccgaaagtgctggga

SEQ ID NO: 7349656 - DNA, 22 bp, Homo sapiens
tcagcctcaggtgttcagattt

SEQ ID NO: 7349657 - DNA, 22 bp, Homo sapiens
tcagcctcattttctgctctgt

SEQ ID NO: 7349658 - DNA, 22 bp, Homo sapiens
tcagcctcattttctgctctgt

SEQ ID NO: 7349659 - DNA, 22 bp, Homo sapiens
tcagagtgaccttacatggtct

SEQ ID NO: 7349660 - DNA, 22 bp, Homo sapiens
tcagagtgaggcccagcaatct

SEQ ID NO: 7349661 - DNA, 22 bp, Homo sapiens
tcagagtgaggcgtcaacatga

SEQ ID NO: 7349662 - DNA, 22 bp, Homo sapiens
tcagagtgaccttacatggtct

SEQ ID NO: 7349663 - DNA, 22 bp, Homo sapiens
tcagaggttacccatgggacag

SEQ ID NO: 7349664 - DNA, 23 bp, Homo sapiens
tcagagtagcaatttttctctcc

SEQ ID NO: 7349665 - DNA, 22 bp, Homo sapiens
tcagagtcattgcaagtagaag

SEQ ID NO: 7349666 - DNA, 22 bp, Homo sapiens
tcagccagggggagagaatgga

SEQ ID NO: 7349667 - DNA, 22 bp, Homo sapiens
tcagccaggtaatgtggagatg

SEQ ID NO: 7349668 - DNA, 22 bp, Homo sapiens
tcagccagtatttgagtgctca

SEQ ID NO: 7349669 - DNA, 22 bp, Homo sapiens
tcagccagtgccttgatcttgc

SEQ ID NO: 7349670 - DNA, 22 bp, Homo sapiens
tcagccagggctctggcctcag

SEQ ID NO: 7349671 - DNA, 22 bp, Homo sapiens
tcagccagggcagagcaggtga

SEQ ID NO: 7349672 - DNA, 22 bp, Homo sapiens
tcagagtgcagcgggaggctgg

SEQ ID NO: 7349673 - DNA, 22 bp, Homo sapiens
tcagagtgaggcgtcaacatga

SEQ ID NO: 7349674 - DNA, 22 bp, Homo sapiens
tcagccaggccaggcattcaca

SEQ ID NO: 7349675 - DNA, 22 bp, Homo sapiens
tcagagtgcagggagtagcagc

SEQ ID NO: 7349676 - DNA, 22 bp, Homo sapiens
tcagccaggccctaagagattg

SEQ ID NO: 7349677 - DNA, 22 bp, Homo sapiens
tcagaggtcagcagcttgccca

SEQ ID NO: 7349678 - DNA, 22 bp, Homo sapiens
tcagaggtgagcttcttgctaa

SEQ ID NO: 7349679 - DNA, 21 bp, Homo sapiens
tcagagggccctggaggctca

SEQ ID NO: 7349680 - DNA, 22 bp, Homo sapiens
tcagaggctttcaatgtgtttt

SEQ ID NO: 7349681 - DNA, 22 bp, Homo sapiens
tcactggggccatgtgagggac

SEQ ID NO: 7349682 - DNA, 17 bp, Homo sapiens
tcactgggcctgctccc

SEQ ID NO: 7349683 - DNA, 22 bp, Homo sapiens
tcactgggccctgaggtgggac

SEQ ID NO: 7349684 - DNA, 22 bp, Homo sapiens
tcactggagaaaagtaatgtat

SEQ ID NO: 7349685 - DNA, 22 bp, Homo sapiens
tcactggattctcttttgttcc

SEQ ID NO: 7349686 - DNA, 22 bp, Homo sapiens
tcactggattctcttttgttcc

SEQ ID NO: 7349687 - DNA, 22 bp, Homo sapiens
tcactggattagtttgaactgt

SEQ ID NO: 7349688 - DNA, 21 bp, Homo sapiens
tcactggaatacaattgattt

SEQ ID NO: 7349689 - DNA, 22 bp, Homo sapiens
tcacgttttactgagtgagata

SEQ ID NO: 7349690 - DNA, 22 bp, Homo sapiens
tcagaacagtgcctggcactaa

SEQ ID NO: 7349691 - DNA, 23 bp, Homo sapiens
tcagaacagttcttggtgcatag

SEQ ID NO: 7349692 - DNA, 22 bp, Homo sapiens
tcagaacatatattttgtgatg

SEQ ID NO: 7349693 - DNA, 22 bp, Homo sapiens
tcagaacatcctggtttaaaat

SEQ ID NO: 7349694 - DNA, 22 bp, Homo sapiens
tcactgtatttggaagggatgg

SEQ ID NO: 7349695 - DNA, 22 bp, Homo sapiens
tcactgtatttgctgatgcata

SEQ ID NO: 7349696 - DNA, 20 bp, Homo sapiens
tcactgtaacatttgggggg

SEQ ID NO: 7349697 - DNA, 22 bp, Homo sapiens
tcactgtaaactaggtcagtcc

SEQ ID NO: 7349698 - DNA, 22 bp, Homo sapiens
tcactgtaccttccatttcatt

SEQ ID NO: 7349699 - DNA, 22 bp, Homo sapiens
tcactgggtaggacatgctgat

SEQ ID NO: 7349700 - DNA, 22 bp, Homo sapiens
tcactggggcctttggtcagga

SEQ ID NO: 7349701 - DNA, 20 bp, Homo sapiens
tcacatctggcagctgatga

SEQ ID NO: 7349702 - DNA, 22 bp, Homo sapiens
tcacatcttggattacaatttt

SEQ ID NO: 7349703 - DNA, 22 bp, Homo sapiens
tcacatcttggattacaatttt

SEQ ID NO: 7349704 - DNA, 22 bp, Homo sapiens
tcacatgaagatccctcaattt

SEQ ID NO: 7349705 - DNA, 22 bp, Homo sapiens
tcacccaggtccaggctctggc

SEQ ID NO: 7349706 - DNA, 22 bp, Homo sapiens
tcacccagggactgtgatggaa

SEQ ID NO: 7349707 - DNA, 22 bp, Homo sapiens
tcacatgcagtcactgagcagg

SEQ ID NO: 7349708 - DNA, 22 bp, Homo sapiens
tcacggacctaagaggaagatt

SEQ ID NO: 7349709 - DNA, 22 bp, Homo sapiens
tcaccttgtgatctccctgcct

SEQ ID NO: 7349710 - DNA, 22 bp, Homo sapiens
tcaccctgtttctcttttgtct

SEQ ID NO: 7349711 - DNA, 22 bp, Homo sapiens
tcaccctgtgattgcaaagaaa

SEQ ID NO: 7349712 - DNA, 23 bp, Homo sapiens
tcagagaataattctgatagact

SEQ ID NO: 7349713 - DNA, 22 bp, Homo sapiens
tcagaacatgaaggttaatttg

SEQ ID NO: 7349714 - DNA, 22 bp, Homo sapiens
tcagaacatgtttgagtaagac

SEQ ID NO: 7349715 - DNA, 22 bp, Homo sapiens
tcagaacattaaggatttgaag

SEQ ID NO: 7349716 - DNA, 22 bp, Homo sapiens
tcagaacattctcattgactgc

SEQ ID NO: 7349717 - DNA, 22 bp, Homo sapiens
tcagaacatttgggactttggg

SEQ ID NO: 7349718 - DNA, 22 bp, Homo sapiens
tcagaactatagtagtttcatg

SEQ ID NO: 7349719 - DNA, 22 bp, Homo sapiens
tcagaactacatggacatgtta

SEQ ID NO: 7349720 - DNA, 22 bp, Homo sapiens
tcagaacatttaaaaagtggtt

SEQ ID NO: 7349721 - DNA, 22 bp, Homo sapiens
tcagaacattgacattcttatt

SEQ ID NO: 7349722 - DNA, 22 bp, Homo sapiens
tcagaactgctgctcctgcaaa

SEQ ID NO: 7349723 - DNA, 19 bp, Homo sapiens
tcagaactcagaatgtgta

SEQ ID NO: 7349724 - DNA, 21 bp, Homo sapiens
tcagaactggtgcagatgaat

SEQ ID NO: 7349725 - DNA, 22 bp, Homo sapiens
tcagaactggaagaggttctgc

SEQ ID NO: 7349726 - DNA, 22 bp, Homo sapiens
tcagaacttcagttttcttaat

SEQ ID NO: 7349727 - DNA, 22 bp, Homo sapiens
tcagaagaaggtatatttatac

SEQ ID NO: 7349728 - DNA, 22 bp, Homo sapiens
tcagaggacaagctccctggtg

SEQ ID NO: 7349729 - DNA, 23 bp, Homo sapiens
tcagagagctgttgagagctgcc

SEQ ID NO: 7349730 - DNA, 23 bp, Homo sapiens
tcagagagctgttgagagctgcc

SEQ ID NO: 7349731 - DNA, 22 bp, Homo sapiens
tcagaggaagccttggtgggag

SEQ ID NO: 7349732 - DNA, 22 bp, Homo sapiens
tcagagaggattttaataagtg

SEQ ID NO: 7349733 - DNA, 22 bp, Homo sapiens
tcagagagctggtgggcagagg

SEQ ID NO: 7349734 - DNA, 22 bp, Homo sapiens
tcagagagcctcaggcactgcc

SEQ ID NO: 7349735 - DNA, 18 bp, Homo sapiens
tcagagagcagctttatt

SEQ ID NO: 7349736 - DNA, 22 bp, Homo sapiens
tcagagagcctcaggcactgcc

SEQ ID NO: 7349737 - DNA, 22 bp, Homo sapiens
tcagagagcagaacttttttac

SEQ ID NO: 7349738 - DNA, 20 bp, Homo sapiens
tcagagagagggtgccactt

SEQ ID NO: 7349739 - DNA, 18 bp, Homo sapiens
tcagagagaatagtaatt

SEQ ID NO: 7349740 - DNA, 22 bp, Homo sapiens
tcagagagaaatagtttttgac

SEQ ID NO: 7349741 - DNA, 22 bp, Homo sapiens
tcagagacagttctggggcagg

SEQ ID NO: 7349742 - DNA, 22 bp, Homo sapiens
tcagaggccaaactgagcaggg

SEQ ID NO: 7349743 - DNA, 22 bp, Homo sapiens
tcagaggcagctgatgttctgt

SEQ ID NO: 7349744 - DNA, 22 bp, Homo sapiens
tcagaggcctgaaagaatttgg

SEQ ID NO: 7349745 - DNA, 22 bp, Homo sapiens
tcagaggccttggttatggtat

SEQ ID NO: 7349746 - DNA, 22 bp, Homo sapiens
tcagaggctgcatttttatcca

SEQ ID NO: 7349747 - DNA, 22 bp, Homo sapiens
tcagaggagaagttgggaaaat

SEQ ID NO: 7349748 - DNA, 19 bp, Homo sapiens
tcagaggatttggctatga

SEQ ID NO: 7349749 - DNA, 22 bp, Homo sapiens
tcagaggagaccaaggggaata

SEQ ID NO: 7349750 - DNA, 22 bp, Homo sapiens
tcaattctagtggagagagttt

SEQ ID NO: 7349751 - DNA, 22 bp, Homo sapiens
tcaattcagactgagaaatgat

SEQ ID NO: 7349752 - DNA, 22 bp, Homo sapiens
tcaattcaattgcatttctgtg

SEQ ID NO: 7349753 - DNA, 22 bp, Homo sapiens
tcaatgtctgtctatctattta

SEQ ID NO: 7349754 - DNA, 22 bp, Homo sapiens
tcaatgttcaagtatgacaatg

SEQ ID NO: 7349755 - DNA, 22 bp, Homo sapiens
tcaatgtcttctcaagtctttt

SEQ ID NO: 7349756 - DNA, 22 bp, Homo sapiens
tcaatgttcttggtatatcctt

SEQ ID NO: 7349757 - DNA, 22 bp, Homo sapiens
tcaatgttctgattcttttgca

SEQ ID NO: 7349758 - DNA, 22 bp, Homo sapiens
tcaatgtttgttcatgaaaata

SEQ ID NO: 7349759 - DNA, 22 bp, Homo sapiens
tcaatgtttggaaatcctttgt

SEQ ID NO: 7349760 - DNA, 22 bp, Homo sapiens
tcaattaagaggctaagttact

SEQ ID NO: 7349761 - DNA, 19 bp, Homo sapiens
tcaatgtctggccaatggt

SEQ ID NO: 7349762 - DNA, 22 bp, Homo sapiens
tcaatgtccgggccccattcca

SEQ ID NO: 7349763 - DNA, 22 bp, Homo sapiens
tcaatgtctctttctaaaatgt

SEQ ID NO: 7349764 - DNA, 22 bp, Homo sapiens
tcaatgtctgcggctagctgga

SEQ ID NO: 7349765 - DNA, 22 bp, Homo sapiens
tcaatgtcagctggtaggaaat

SEQ ID NO: 7349766 - DNA, 22 bp, Homo sapiens
tcaattacagcacagtactcca

SEQ ID NO: 7349767 - DNA, 23 bp, Homo sapiens
tcaattatcaatggaaagaagtt

SEQ ID NO: 7349768 - DNA, 22 bp, Homo sapiens
tcaattcttattggtgttctgc

SEQ ID NO: 7349769 - DNA, 22 bp, Homo sapiens
tcaattctggtcctcaggaact

SEQ ID NO: 7349770 - DNA, 22 bp, Homo sapiens
tcacacagggtcggaaagagtg

SEQ ID NO: 7349771 - DNA, 23 bp, Homo sapiens
tcacacagctggtcaggtacaga

SEQ ID NO: 7349772 - DNA, 18 bp, Homo sapiens
tcaaaatatttctgtgga

SEQ ID NO: 7349773 - DNA, 22 bp, Homo sapiens
tcaaaattttatttctcaagga

SEQ ID NO: 7349774 - DNA, 20 bp, Homo sapiens
tcaaaataggtgtgggcgga

SEQ ID NO: 7349775 - DNA, 22 bp, Homo sapiens
tcaatgatagtacaatcagcct

SEQ ID NO: 7349776 - DNA, 22 bp, Homo sapiens
tcaatgatagtacaatcagcct

SEQ ID NO: 7349777 - DNA, 22 bp, Homo sapiens
tcaatgatagacaagatctaag

SEQ ID NO: 7349778 - DNA, 22 bp, Homo sapiens
tcaatgattagagtttagtgtg

SEQ ID NO: 7349779 - DNA, 22 bp, Homo sapiens
tcaatgatatcagcaggatgtg

SEQ ID NO: 7349780 - DNA, 22 bp, Homo sapiens
tcaatgatgctgaaggtagcgt

SEQ ID NO: 7349781 - DNA, 21 bp, Homo sapiens
tcaatacaggtgcatgtgtct

SEQ ID NO: 7349782 - DNA, 22 bp, Homo sapiens
tcaatacttggcacactgcaca

SEQ ID NO: 7349783 - DNA, 22 bp, Homo sapiens
tcaatacttggcacactgcaca

SEQ ID NO: 7349784 - DNA, 22 bp, Homo sapiens
tcaatacttaagcttaattcta

SEQ ID NO: 7349785 - DNA, 22 bp, Homo sapiens
tcaatactaatcttgctggaag

SEQ ID NO: 7349786 - DNA, 22 bp, Homo sapiens
tcaatactaatcttgctggaag

SEQ ID NO: 7349787 - DNA, 22 bp, Homo sapiens
tcaatactatgattttgtacat

SEQ ID NO: 7349788 - DNA, 22 bp, Homo sapiens
tcaatactcacaaagagatttt

SEQ ID NO: 7349789 - DNA, 22 bp, Homo sapiens
tcacagacaccttggccacagt

SEQ ID NO: 7349790 - DNA, 22 bp, Homo sapiens
tcacagacacattaaacatgtg

SEQ ID NO: 7349791 - DNA, 22 bp, Homo sapiens
tcacagacacattaaacatgtg

SEQ ID NO: 7349792 - DNA, 22 bp, Homo sapiens
tcacagacacagggagaagcat

SEQ ID NO: 7349793 - DNA, 18 bp, Homo sapiens
tcacagacagctgtcttt

SEQ ID NO: 7349794 - DNA, 18 bp, Homo sapiens
tcacagacagctgtcttt

SEQ ID NO: 7349795 - DNA, 19 bp, Homo sapiens
tcacagacagagcaatcac

SEQ ID NO: 7349796 - DNA, 22 bp, Homo sapiens
tcacagacagaagggatgggat

SEQ ID NO: 7349797 - DNA, 22 bp, Homo sapiens
tcacagacagaagggatgggat

SEQ ID NO: 7349798 - DNA, 22 bp, Homo sapiens
tcacagacactgggttattgca

SEQ ID NO: 7349799 - DNA, 22 bp, Homo sapiens
tcacagacatggtgaggtaaca

SEQ ID NO: 7349800 - DNA, 22 bp, Homo sapiens
tcacagacatggtgaggtaaca

SEQ ID NO: 7349801 - DNA, 22 bp, Homo sapiens
tcacagacccttgctgagctct

SEQ ID NO: 7349802 - DNA, 22 bp, Homo sapiens
tcacagcaaatgctgcttctca

SEQ ID NO: 7349803 - DNA, 22 bp, Homo sapiens
tcacagcaaaagtgtgcagagc

SEQ ID NO: 7349804 - DNA, 22 bp, Homo sapiens
tcacagcaaatgctgcttctca

SEQ ID NO: 7349805 - DNA, 20 bp, Homo sapiens
tcacagatgaaagttcaaga

SEQ ID NO: 7349806 - DNA, 22 bp, Homo sapiens
tcacagcaaaagtgtgcagagc

SEQ ID NO: 7349807 - DNA, 22 bp, Homo sapiens
tcacagacaattgttttggtgt

SEQ ID NO: 7349808 - DNA, 22 bp, Homo sapiens
tcacacatgagtaaatacaggg

SEQ ID NO: 7349809 - DNA, 22 bp, Homo sapiens
tcacacatactcatgtgtgagt

SEQ ID NO: 7349810 - DNA, 20 bp, Homo sapiens
tcacacataagtgaacgcac

SEQ ID NO: 7349811 - DNA, 22 bp, Homo sapiens
tcacatcatggagaattatggg

SEQ ID NO: 7349812 - DNA, 22 bp, Homo sapiens
tcacatctgaaaaaatattgag

SEQ ID NO: 7349813 - DNA, 22 bp, Homo sapiens
tcacatctgattagtgactgat

SEQ ID NO: 7349814 - DNA, 17 bp, Homo sapiens
tcacatcacacaagcaa

SEQ ID NO: 7349815 - DNA, 22 bp, Homo sapiens
tcacatcacatgacagtaggcc

SEQ ID NO: 7349816 - DNA, 22 bp, Homo sapiens
tcacatcacatgagtgcaagga

SEQ ID NO: 7349817 - DNA, 22 bp, Homo sapiens
tcacagcaggcagatattgttg

SEQ ID NO: 7349818 - DNA, 22 bp, Homo sapiens
tcacagcaccaggatctctcca

SEQ ID NO: 7349819 - DNA, 22 bp, Homo sapiens
tcacagcacatggaccgagtcc

SEQ ID NO: 7349820 - DNA, 22 bp, Homo sapiens
tcacagcattgagtgtactaga

SEQ ID NO: 7349821 - DNA, 22 bp, Homo sapiens
tcacagcatttttagaaagatt

SEQ ID NO: 7349822 - DNA, 22 bp, Homo sapiens
tcacagcagtaaagaaaacact

SEQ ID NO: 7349823 - DNA, 19 bp, Homo sapiens
tcacagcatctgtctgaac

SEQ ID NO: 7349824 - DNA, 22 bp, Homo sapiens
tccgcgtgggaggggccggtgt

SEQ ID NO: 7349825 - DNA, 22 bp, Homo sapiens
tccggcggccggcctgagcccg

SEQ ID NO: 7349826 - DNA, 22 bp, Homo sapiens
tccgagggctggacgcaggggc

SEQ ID NO: 7349827 - DNA, 22 bp, Homo sapiens
tccgatgcttccagggccacct

SEQ ID NO: 7349828 - DNA, 22 bp, Homo sapiens
tccgcagaggaggagttgctgt

SEQ ID NO: 7349829 - DNA, 22 bp, Homo sapiens
tccgggtgcccacgtgccccta

SEQ ID NO: 7349830 - DNA, 22 bp, Homo sapiens
tcctcatctcggaacctgccac

SEQ ID NO: 7349831 - DNA, 22 bp, Homo sapiens
tcctccacactctggactgttg

SEQ ID NO: 7349832 - DNA, 22 bp, Homo sapiens
tcctccagaaactgaggcagaa

SEQ ID NO: 7349833 - DNA, 22 bp, Homo sapiens
tcctccactttgtctagcaaca

SEQ ID NO: 7349834 - DNA, 22 bp, Homo sapiens
tcctccagaaactgaggcagaa

SEQ ID NO: 7349835 - DNA, 22 bp, Homo sapiens
tcctccagcttctcttttgggg

SEQ ID NO: 7349836 - DNA, 23 bp, Homo sapiens
tcctcctgacacagcctgagtga

SEQ ID NO: 7349837 - DNA, 22 bp, Homo sapiens
tcctcctgcctttgcttcttgt

SEQ ID NO: 7349838 - DNA, 22 bp, Homo sapiens
tcctcctgctgttagtcttgaa

SEQ ID NO: 7349839 - DNA, 22 bp, Homo sapiens
tcctcctcctcacagtcacctg

SEQ ID NO: 7349840 - DNA, 22 bp, Homo sapiens
tcctcctctatcagacagtgcc

SEQ ID NO: 7349841 - DNA, 22 bp, Homo sapiens
tcctcccttggggtttcgttat

SEQ ID NO: 7349842 - DNA, 19 bp, Homo sapiens
tcctccctttggtgtcctg

SEQ ID NO: 7349843 - DNA, 22 bp, Homo sapiens
tcctcccttgactcctgctttt

SEQ ID NO: 7349844 - DNA, 22 bp, Homo sapiens
tcctcctcctcacagtcacctg

SEQ ID NO: 7349845 - DNA, 21 bp, Homo sapiens
tcctcctccactaggctagcc

SEQ ID NO: 7349846 - DNA, 22 bp, Homo sapiens
tcctcctcacgctgttgcttgt

SEQ ID NO: 7349847 - DNA, 22 bp, Homo sapiens
tcctccctaaatcctagactgt

SEQ ID NO: 7349848 - DNA, 22 bp, Homo sapiens
tcctccctgcactcagtgaagt

SEQ ID NO: 7349849 - DNA, 22 bp, Homo sapiens
tcctccctgggagcttctgagt

SEQ ID NO: 7349850 - DNA, 22 bp, Homo sapiens
tcctccctgggagcttctgagt

SEQ ID NO: 7349851 - DNA, 22 bp, Homo sapiens
tcctcccttctcactgggaagg

SEQ ID NO: 7349852 - DNA, 22 bp, Homo sapiens
tcctccctgtaccattcctctg

SEQ ID NO: 7349853 - DNA, 22 bp, Homo sapiens
tcctccctgagtggggacagct

SEQ ID NO: 7349854 - DNA, 21 bp, Homo sapiens
tcctccctgagctgtggggga

SEQ ID NO: 7349855 - DNA, 23 bp, Homo sapiens
tcctccctgacttctacagcaca

SEQ ID NO: 7349856 - DNA, 22 bp, Homo sapiens
tcctccctaactcatgatgagt

SEQ ID NO: 7349857 - DNA, 23 bp, Homo sapiens
tccctgggcccgtgccagcggtg

SEQ ID NO: 7349858 - DNA, 22 bp, Homo sapiens
tccctgggccacagctgtgagc

SEQ ID NO: 7349859 - DNA, 22 bp, Homo sapiens
tccctgggcatcacgttgcttc

SEQ ID NO: 7349860 - DNA, 22 bp, Homo sapiens
tccctgggcacaatctgctggc

SEQ ID NO: 7349861 - DNA, 22 bp, Homo sapiens
tccctgggcaagtttactcttc

SEQ ID NO: 7349862 - DNA, 22 bp, Homo sapiens
tccctgccagtcctggtctgaa

SEQ ID NO: 7349863 - DNA, 22 bp, Homo sapiens
tccctgccaatgattggagcaa

SEQ ID NO: 7349864 - DNA, 22 bp, Homo sapiens
tccctgccaatgattggagcaa

SEQ ID NO: 7349865 - DNA, 22 bp, Homo sapiens
tccctgatgtgggctgcgtgac

SEQ ID NO: 7349866 - DNA, 21 bp, Homo sapiens
tccctgagttctctgagcatc

SEQ ID NO: 7349867 - DNA, 23 bp, Homo sapiens
tccctgagctggagagactgcac

SEQ ID NO: 7349868 - DNA, 22 bp, Homo sapiens
tccctggggcagtggctcggag

SEQ ID NO: 7349869 - DNA, 22 bp, Homo sapiens
tccctgtctaatatgccatgaa

SEQ ID NO: 7349870 - DNA, 22 bp, Homo sapiens
tccctgtccaaagtcttcctat

SEQ ID NO: 7349871 - DNA, 22 bp, Homo sapiens
tccctgggcggacattctccca

SEQ ID NO: 7349872 - DNA, 22 bp, Homo sapiens
tccctgggcctcctgctatgca

SEQ ID NO: 7349873 - DNA, 22 bp, Homo sapiens
tccctgggcctatcttagctcc

SEQ ID NO: 7349874 - DNA, 22 bp, Homo sapiens
tccctggggatgttggcctgcc

SEQ ID NO: 7349875 - DNA, 22 bp, Homo sapiens
tccctggggaagggcaagcaag

SEQ ID NO: 7349876 - DNA, 22 bp, Homo sapiens
tccctgggcttctccagacttg

SEQ ID NO: 7349877 - DNA, 22 bp, Homo sapiens
tcccttgagagttggccaattg

SEQ ID NO: 7349878 - DNA, 22 bp, Homo sapiens
tcccttgaacgctggggctgga

SEQ ID NO: 7349879 - DNA, 23 bp, Homo sapiens
tccctgtgtacagcctgcatgag

SEQ ID NO: 7349880 - DNA, 22 bp, Homo sapiens
tccagggacagtatagaggatc

SEQ ID NO: 7349881 - DNA, 22 bp, Homo sapiens
tccaggaggcagggctgtgccc

SEQ ID NO: 7349882 - DNA, 22 bp, Homo sapiens
tccaggaggaggaaggctgcca

SEQ ID NO: 7349883 - DNA, 22 bp, Homo sapiens
tccaggccactgcagaggctct

SEQ ID NO: 7349884 - DNA, 19 bp, Homo sapiens
tccaggccattcccagagc

SEQ ID NO: 7349885 - DNA, 22 bp, Homo sapiens
tccaggcccactcagctgaaat

SEQ ID NO: 7349886 - DNA, 20 bp, Homo sapiens
tccagtggcctgaatctgga

SEQ ID NO: 7349887 - DNA, 22 bp, Homo sapiens
tccagtggtacatggagacact

SEQ ID NO: 7349888 - DNA, 22 bp, Homo sapiens
tccagtggcactggagactaga

SEQ ID NO: 7349889 - DNA, 22 bp, Homo sapiens
tccagtcctgggagcctttctg

SEQ ID NO: 7349890 - DNA, 22 bp, Homo sapiens
tccagggatggtaatgagcagt

SEQ ID NO: 7349891 - DNA, 20 bp, Homo sapiens
tccagggcaaactcatcacc

SEQ ID NO: 7349892 - DNA, 22 bp, Homo sapiens
tccagggagcaagtcaggccgg

SEQ ID NO: 7349893 - DNA, 22 bp, Homo sapiens
tccagggcagccgcgggtgcgc

SEQ ID NO: 7349894 - DNA, 22 bp, Homo sapiens
tccagggcaccagcgtccccct

SEQ ID NO: 7349895 - DNA, 20 bp, Homo sapiens
tccagggcaactagagtgtg

SEQ ID NO: 7349896 - DNA, 22 bp, Homo sapiens
tcccagaatggcccagctgccc

SEQ ID NO: 7349897 - DNA, 22 bp, Homo sapiens
tcccagaagtccagccatgggc

SEQ ID NO: 7349898 - DNA, 22 bp, Homo sapiens
tcccagaagtgaaatttctaga

SEQ ID NO: 7349899 - DNA, 22 bp, Homo sapiens
tcccactgtgaatccaaggcct

SEQ ID NO: 7349900 - DNA, 22 bp, Homo sapiens
tcccactgtgcctgttgtaatc

SEQ ID NO: 7349901 - DNA, 22 bp, Homo sapiens
tcccactgtctgtcttgctgca

SEQ ID NO: 7349902 - DNA, 22 bp, Homo sapiens
tcccactgtcttctcgtgctcg

SEQ ID NO: 7349903 - DNA, 21 bp, Homo sapiens
tcccactgccacagcttcagg

SEQ ID NO: 7349904 - DNA, 22 bp, Homo sapiens
tcccactgctttgctctgctca

SEQ ID NO: 7349905 - DNA, 21 bp, Homo sapiens
tcccactggcccagggctcca

SEQ ID NO: 7349906 - DNA, 20 bp, Homo sapiens
tcccactgggcctcagtttc

SEQ ID NO: 7349907 - DNA, 22 bp, Homo sapiens
tcccactggacgtctgtgctgg

SEQ ID NO: 7349908 - DNA, 21 bp, Homo sapiens
tccagttgagactgaagatct

SEQ ID NO: 7349909 - DNA, 22 bp, Homo sapiens
tcccactgagcccctgctggtg

SEQ ID NO: 7349910 - DNA, 22 bp, Homo sapiens
tccagtgtggaggtgaccaact

SEQ ID NO: 7349911 - DNA, 20 bp, Homo sapiens
tccagtgtctctctggtgga

SEQ ID NO: 7349912 - DNA, 22 bp, Homo sapiens
tcccagcctttcttttctgctg

SEQ ID NO: 7349913 - DNA, 22 bp, Homo sapiens
tcccaggaaaacactcgaggac

SEQ ID NO: 7349914 - DNA, 22 bp, Homo sapiens
tcccagcttagatttgctcatt

SEQ ID NO: 7349915 - DNA, 22 bp, Homo sapiens
tccaggacagcggcaggcagat

SEQ ID NO: 7349916 - DNA, 22 bp, Homo sapiens
tccaggacctgactgggcctgc

SEQ ID NO: 7349917 - DNA, 23 bp, Homo sapiens
tccaggagcatgctggctggcga

SEQ ID NO: 7349918 - DNA, 22 bp, Homo sapiens
tccaggagaaggccatccagcg

SEQ ID NO: 7349919 - DNA, 22 bp, Homo sapiens
tccagccttgccacttttctgt

SEQ ID NO: 7349920 - DNA, 22 bp, Homo sapiens
tccagccactcagcagggattg

SEQ ID NO: 7349921 - DNA, 22 bp, Homo sapiens
tccagccacgtattatctcact

SEQ ID NO: 7349922 - DNA, 20 bp, Homo sapiens
tccagccacttccgctggtc

SEQ ID NO: 7349923 - DNA, 22 bp, Homo sapiens
tccacagggcctttctggtgtg

SEQ ID NO: 7349924 - DNA, 22 bp, Homo sapiens
tccaccaggctccatgttcagt

SEQ ID NO: 7349925 - DNA, 22 bp, Homo sapiens
tccaccatgatttagcactggc

SEQ ID NO: 7349926 - DNA, 22 bp, Homo sapiens
tccaccatgtaacaagctctgt

SEQ ID NO: 7349927 - DNA, 19 bp, Homo sapiens
tccaccccagccagctctg

SEQ ID NO: 7349928 - DNA, 22 bp, Homo sapiens
tccactgtgcagctctgctgat

SEQ ID NO: 7349929 - DNA, 20 bp, Homo sapiens
tccacttactagctctgtga

SEQ ID NO: 7349930 - DNA, 22 bp, Homo sapiens
tccactgtggtcccttgctgcc

SEQ ID NO: 7349931 - DNA, 22 bp, Homo sapiens
tccactgctcattccacaggca

SEQ ID NO: 7349932 - DNA, 22 bp, Homo sapiens
tccagaaaattttacagtgcct

SEQ ID NO: 7349933 - DNA, 22 bp, Homo sapiens
tccacttcatccagggtcacca

SEQ ID NO: 7349934 - DNA, 22 bp, Homo sapiens
tccacttccacgtgtgcagaat

SEQ ID NO: 7349935 - DNA, 22 bp, Homo sapiens
tccacttctattgggtcttggt

SEQ ID NO: 7349936 - DNA, 22 bp, Homo sapiens
tccacgctgtgtgaccttgggc

SEQ ID NO: 7349937 - DNA, 22 bp, Homo sapiens
tccacgtgagcttcgtgtgcag

SEQ ID NO: 7349938 - DNA, 22 bp, Homo sapiens
tccactccttatgccagacggt

SEQ ID NO: 7349939 - DNA, 22 bp, Homo sapiens
tccactctaattactaccttct

SEQ ID NO: 7349940 - DNA, 22 bp, Homo sapiens
tccaccctgcttttgtctttga

SEQ ID NO: 7349941 - DNA, 22 bp, Homo sapiens
tccacagataaaaacagaggtt

SEQ ID NO: 7349942 - DNA, 22 bp, Homo sapiens
tccacagataaaaacagaggtt

SEQ ID NO: 7349943 - DNA, 22 bp, Homo sapiens
tccacagattaaaaacatactt

SEQ ID NO: 7349944 - DNA, 22 bp, Homo sapiens
tccacagatgcctttaggagta

SEQ ID NO: 7349945 - DNA, 22 bp, Homo sapiens
tccacagggatgcctgcggctt

SEQ ID NO: 7349946 - DNA, 22 bp, Homo sapiens
tccacaggctgaggcccttctg

SEQ ID NO: 7349947 - DNA, 22 bp, Homo sapiens
tccacagaatggaattctccgc

SEQ ID NO: 7349948 - DNA, 22 bp, Homo sapiens
tccacacacatttctatgtgca

SEQ ID NO: 7349949 - DNA, 22 bp, Homo sapiens
tccacagaccagtatctgcagc

SEQ ID NO: 7349950 - DNA, 22 bp, Homo sapiens
tccacagaatgtaagatccaca

SEQ ID NO: 7349951 - DNA, 22 bp, Homo sapiens
tccacagactattaagtgatct

SEQ ID NO: 7349952 - DNA, 22 bp, Homo sapiens
tccacagacgtgttattagttg

SEQ ID NO: 7349953 - DNA, 22 bp, Homo sapiens
tccacagaccagtatctgcagc

SEQ ID NO: 7349954 - DNA, 22 bp, Homo sapiens
tcatgtgtctgccagtgtttat

SEQ ID NO: 7349955 - DNA, 22 bp, Homo sapiens
tcatgtgtgtttcatgtatgga

SEQ ID NO: 7349956 - DNA, 22 bp, Homo sapiens
tcatgtttggagtttgctcact

SEQ ID NO: 7349957 - DNA, 22 bp, Homo sapiens
gttttatttccatgagagaccg

SEQ ID NO: 7349958 - DNA, 22 bp, Homo sapiens
gttttattggaacacagccatg

SEQ ID NO: 7349959 - DNA, 22 bp, Homo sapiens
gttttataggctgttgctatat

SEQ ID NO: 7349960 - DNA, 22 bp, Homo sapiens
gttttataattgcttcataaga

SEQ ID NO: 7349961 - DNA, 22 bp, Homo sapiens
gttttagtgtaacggagtgtga

SEQ ID NO: 7349962 - DNA, 22 bp, Homo sapiens
taaacagaattcaggcaagata

SEQ ID NO: 7349963 - DNA, 16 bp, Homo sapiens
taaacagcagacagtt

SEQ ID NO: 7349964 - DNA, 22 bp, Homo sapiens
taaacatcaggaatgaaaacct

SEQ ID NO: 7349965 - DNA, 22 bp, Homo sapiens
taaacatcagtacaaagactaa

SEQ ID NO: 7349966 - DNA, 22 bp, Homo sapiens
taaagaacacagggaatagcac

SEQ ID NO: 7349967 - DNA, 22 bp, Homo sapiens
taaacatgttgacatcttacct

SEQ ID NO: 7349968 - DNA, 22 bp, Homo sapiens
taaagacaaacccactagggtt

SEQ ID NO: 7349969 - DNA, 22 bp, Homo sapiens
taaagaataatacccatggagc

SEQ ID NO: 7349970 - DNA, 22 bp, Homo sapiens
taaagacaataggaaagttgtt

SEQ ID NO: 7349971 - DNA, 22 bp, Homo sapiens
taaagacaaatgacattacggc

SEQ ID NO: 7349972 - DNA, 22 bp, Homo sapiens
taaagacaatttcgagctgtag

SEQ ID NO: 7349973 - DNA, 22 bp, Homo sapiens
taaagacacccagggagggact

SEQ ID NO: 7349974 - DNA, 22 bp, Homo sapiens
taaagacactggttttaatcat

SEQ ID NO: 7349975 - DNA, 22 bp, Homo sapiens
taaagacactggttttaatcat

SEQ ID NO: 7349976 - DNA, 22 bp, Homo sapiens
taaataagttcttcattgtttg

SEQ ID NO: 7349977 - DNA, 17 bp, Homo sapiens
taaatacacaagggtat

SEQ ID NO: 7349978 - DNA, 21 bp, Homo sapiens
taaataataagttgctgagat

SEQ ID NO: 7349979 - DNA, 22 bp, Homo sapiens
taacacatagatattttaactt

SEQ ID NO: 7349980 - DNA, 21 bp, Homo sapiens
taacacattttggtactttgg

SEQ ID NO: 7349981 - DNA, 22 bp, Homo sapiens
taacaatagtgtttgctagtca

SEQ ID NO: 7349982 - DNA, 22 bp, Homo sapiens
taacaatgcaaaatgaatttag

SEQ ID NO: 7349983 - DNA, 22 bp, Homo sapiens
taacaatgcaaaatgaatttag

SEQ ID NO: 7349984 - DNA, 22 bp, Homo sapiens
taacacagacagccactagtaa

SEQ ID NO: 7349985 - DNA, 22 bp, Homo sapiens
taacacagacagccactagtaa

SEQ ID NO: 7349986 - DNA, 22 bp, Homo sapiens
taacacagagttttaaatgtgg

SEQ ID NO: 7349987 - DNA, 22 bp, Homo sapiens
taagatgggggaaagaaatagt

SEQ ID NO: 7349988 - DNA, 22 bp, Homo sapiens
taactgtttttgaaatatatct

SEQ ID NO: 7349989 - DNA, 22 bp, Homo sapiens
taacttctgaatagcaatagta

SEQ ID NO: 7349990 - DNA, 22 bp, Homo sapiens
taacttctctgctatcatagga

SEQ ID NO: 7349991 - DNA, 22 bp, Homo sapiens
gttataaaggtgataatggtca

SEQ ID NO: 7349992 - DNA, 22 bp, Homo sapiens
gttagtttgaacttgtctatgt

SEQ ID NO: 7349993 - DNA, 22 bp, Homo sapiens
gttataaatacctaataggatt

SEQ ID NO: 7349994 - DNA, 22 bp, Homo sapiens
gttaggaaggtatagttgtatt

SEQ ID NO: 7349995 - DNA, 22 bp, Homo sapiens
gttagagggctgccttttgttt

SEQ ID NO: 7349996 - DNA, 22 bp, Homo sapiens
gttagggatcaggaacaagagc

SEQ ID NO: 7349997 - DNA, 22 bp, Homo sapiens
gttagggagggtgcatatgtgt

SEQ ID NO: 7349998 - DNA, 22 bp, Homo sapiens
gttagggaagcgctgtgttctt

SEQ ID NO: 7349999 - DNA, 22 bp, Homo sapiens
gtgttagcagtggagtggacac

SEQ ID NO: 7350000 - DNA, 22 bp, Homo sapiens
gtgttattagagcattaatttt

SEQ ID NO: 7350001 - DNA, 22 bp, Homo sapiens
gttagagacatctctggtttct

SEQ ID NO: 7350002 - DNA, 22 bp, Homo sapiens
gtgtgtgttcaataaatttaag

SEQ ID NO: 7350003 - DNA, 22 bp, Homo sapiens
gtgtgtgttcaataaatttaag

SEQ ID NO: 7350004 - DNA, 22 bp, Homo sapiens
gtgtgtttcagaagccaggtgt

SEQ ID NO: 7350005 - DNA, 22 bp, Homo sapiens
gtgtgtttcaccctgacaccaa

SEQ ID NO: 7350006 - DNA, 22 bp, Homo sapiens
gtgtgtttagcattagcagggg

SEQ ID NO: 7350007 - DNA, 22 bp, Homo sapiens
gtgtgtgtgcctgcacacacac

SEQ ID NO: 7350008 - DNA, 22 bp, Homo sapiens
gtgtgtgtgcctgcacacacac

SEQ ID NO: 7350009 - DNA, 22 bp, Homo sapiens
gtgtgtgtgcatctcttttatt

SEQ ID NO: 7350010 - DNA, 22 bp, Homo sapiens
gtgtgtgtgtaaaaatccagag

SEQ ID NO: 7350011 - DNA, 22 bp, Homo sapiens
gtgtgtgtgtaaaaatccagag

SEQ ID NO: 7350012 - DNA, 22 bp, Homo sapiens
gtgttaaatttctaatttgtga

SEQ ID NO: 7350013 - DNA, 22 bp, Homo sapiens
gtgttaaatgcaatcacatgca

SEQ ID NO: 7350014 - DNA, 22 bp, Homo sapiens
gtgttaaatgcaatcacatgca

SEQ ID NO: 7350015 - DNA, 22 bp, Homo sapiens
gtgttaaacatgttcacagcat

SEQ ID NO: 7350016 - DNA, 22 bp, Homo sapiens
gtgttaaacatgttcacagcat

SEQ ID NO: 7350017 - DNA, 22 bp, Homo sapiens
gtgttaaaaatcccatgatatg

SEQ ID NO: 7350018 - DNA, 22 bp, Homo sapiens
gtgttaaaatgctttatagtag

SEQ ID NO: 7350019 - DNA, 22 bp, Homo sapiens
gtgttaaaaatcccatgatatg

SEQ ID NO: 7350020 - DNA, 16 bp, Homo sapiens
gtgttaagagctgttc

SEQ ID NO: 7350021 - DNA, 22 bp, Homo sapiens
gtgtgtgtatctgcctatcaca

SEQ ID NO: 7350022 - DNA, 22 bp, Homo sapiens
gtgtgtgtatctgcctatcaca

SEQ ID NO: 7350023 - DNA, 22 bp, Homo sapiens
gtgtgtgtgcatataacatata

SEQ ID NO: 7350024 - DNA, 22 bp, Homo sapiens
gtgtgtgtctccgcggccgtag

SEQ ID NO: 7350025 - DNA, 22 bp, Homo sapiens
gtgtgtgtctccgcggccgtag

SEQ ID NO: 7350026 - DNA, 22 bp, Homo sapiens
gtgtgtgtgcatctcttttatt

SEQ ID NO: 7350027 - DNA, 22 bp, Homo sapiens
gtgtgtgtgcatataacatata

SEQ ID NO: 7350028 - DNA, 22 bp, Homo sapiens
gtgtgtgtgcatataacatata

SEQ ID NO: 7350029 - DNA, 22 bp, Homo sapiens
gtttctcagtttggtctgcaga

SEQ ID NO: 7350030 - DNA, 22 bp, Homo sapiens
gtttctcatcagtttctgatat

SEQ ID NO: 7350031 - DNA, 22 bp, Homo sapiens
gtttctcatcagtttctgatat

SEQ ID NO: 7350032 - DNA, 23 bp, Homo sapiens
gttttacaggtgagaaaatggag

SEQ ID NO: 7350033 - DNA, 23 bp, Homo sapiens
gttttacaggtgagaaaatggag

SEQ ID NO: 7350034 - DNA, 22 bp, Homo sapiens
gtttcttaaatgtagcaggacc

SEQ ID NO: 7350035 - DNA, 22 bp, Homo sapiens
gtttctgttgctcagataatgc

SEQ ID NO: 7350036 - DNA, 22 bp, Homo sapiens
gtttcttagacagacattatct

SEQ ID NO: 7350037 - DNA, 22 bp, Homo sapiens
gtttcccatatctagggagagg

SEQ ID NO: 7350038 - DNA, 22 bp, Homo sapiens
gtttcctttctattgccttgat

SEQ ID NO: 7350039 - DNA, 22 bp, Homo sapiens
gtttcccagtctgcagagttct

SEQ ID NO: 7350040 - DNA, 22 bp, Homo sapiens
gtttatatgaacttcataccca

SEQ ID NO: 7350041 - DNA, 22 bp, Homo sapiens
gtttctaattggaactttgagg

SEQ ID NO: 7350042 - DNA, 22 bp, Homo sapiens
gtttctcaagcttgaatgcaca

SEQ ID NO: 7350043 - DNA, 22 bp, Homo sapiens
gtttctcaagcttgaatgcaca

SEQ ID NO: 7350044 - DNA, 22 bp, Homo sapiens
gtttctcacaaggctgcaatcc

SEQ ID NO: 7350045 - DNA, 22 bp, Homo sapiens
gtttctcagcatgtcagtacaa

SEQ ID NO: 7350046 - DNA, 22 bp, Homo sapiens
gttcctgggcctgcattcacca

SEQ ID NO: 7350047 - DNA, 22 bp, Homo sapiens
gttccacatcacactacttgat

SEQ ID NO: 7350048 - DNA, 22 bp, Homo sapiens
gttccacaaagattgtctctct

SEQ ID NO: 7350049 - DNA, 22 bp, Homo sapiens
gttccatatcacagcagacgaa

SEQ ID NO: 7350050 - DNA, 22 bp, Homo sapiens
gtttaggaaattgggtattaga

SEQ ID NO: 7350051 - DNA, 22 bp, Homo sapiens
gtttaggaaattgggtattaga

SEQ ID NO: 7350052 - DNA, 22 bp, Homo sapiens
gtttaggaggctaagtggtttg

SEQ ID NO: 7350053 - DNA, 22 bp, Homo sapiens
gtttagaaaatagtgaagcaag

SEQ ID NO: 7350054 - DNA, 22 bp, Homo sapiens
taatgaatgagaatataacaga

SEQ ID NO: 7350055 - DNA, 19 bp, Homo sapiens
taataagcaatatggaagt

SEQ ID NO: 7350056 - DNA, 22 bp, Homo sapiens
taatgaacatcttaatctgaaa

SEQ ID NO: 7350057 - DNA, 22 bp, Homo sapiens
taatgaggaaatagagggaatg

SEQ ID NO: 7350058 - DNA, 22 bp, Homo sapiens
taatgaggcatttgagtcacct

SEQ ID NO: 7350059 - DNA, 22 bp, Homo sapiens
taatgaggggaaccatctgtag

SEQ ID NO: 7350060 - DNA, 22 bp, Homo sapiens
taatgccacctacctgctttat

SEQ ID NO: 7350061 - DNA, 23 bp, Homo sapiens
taatgccagccctgcagttaagc

SEQ ID NO: 7350062 - DNA, 22 bp, Homo sapiens
taatgcagtaagcaatggtgaa

SEQ ID NO: 7350063 - DNA, 22 bp, Homo sapiens
taatgatgctagatttatctgg

SEQ ID NO: 7350064 - DNA, 22 bp, Homo sapiens
taatggagttggaattaataag

SEQ ID NO: 7350065 - DNA, 22 bp, Homo sapiens
taatggagccagaagatcttga

SEQ ID NO: 7350066 - DNA, 22 bp, Homo sapiens
taatttcaatagcttgcataat

SEQ ID NO: 7350067 - DNA, 22 bp, Homo sapiens
taatttcaccgttgctagaaat

SEQ ID NO: 7350068 - DNA, 22 bp, Homo sapiens
taatttcacagttcaacgcaca

SEQ ID NO: 7350069 - DNA, 22 bp, Homo sapiens
taatttcactgatatgaagtca

SEQ ID NO: 7350070 - DNA, 22 bp, Homo sapiens
taatttcaccgttgctagaaat

SEQ ID NO: 7350071 - DNA, 22 bp, Homo sapiens
taatttcagtgcaagctcacgg

SEQ ID NO: 7350072 - DNA, 22 bp, Homo sapiens
taatttcagtgcaagctcacgg

SEQ ID NO: 7350073 - DNA, 22 bp, Homo sapiens
taatttcagtgggctctgggct

SEQ ID NO: 7350074 - DNA, 22 bp, Homo sapiens
taatgccaggagggagttttta

SEQ ID NO: 7350075 - DNA, 22 bp, Homo sapiens
taagtttccagattgtaagtcc

SEQ ID NO: 7350076 - DNA, 22 bp, Homo sapiens
taagttttctggaataacttgg

SEQ ID NO: 7350077 - DNA, 22 bp, Homo sapiens
taataaatgaaagtgctggcat

SEQ ID NO: 7350078 - DNA, 22 bp, Homo sapiens
taataaatgaaagtgctggcat

SEQ ID NO: 7350079 - DNA, 18 bp, Homo sapiens
taagcaatgacattgcaa

SEQ ID NO: 7350080 - DNA, 22 bp, Homo sapiens
taagcataagatacatgagaca

SEQ ID NO: 7350081 - DNA, 22 bp, Homo sapiens
tacacatatgtgtgtatatgtg

SEQ ID NO: 7350082 - DNA, 22 bp, Homo sapiens
tacacatatgtgtgtatatgtg

SEQ ID NO: 7350083 - DNA, 22 bp, Homo sapiens
tacaatgttcctagcaggaaag

SEQ ID NO: 7350084 - DNA, 22 bp, Homo sapiens
tacaatgttaaggaaagagaga

SEQ ID NO: 7350085 - DNA, 17 bp, Homo sapiens
tacaatgtgattcaatc

SEQ ID NO: 7350086 - DNA, 22 bp, Homo sapiens
tacaatgtgtgcttcttgtcac

SEQ ID NO: 7350087 - DNA, 22 bp, Homo sapiens
tacaatgttggtaaagtatcat

SEQ ID NO: 7350088 - DNA, 22 bp, Homo sapiens
tacaatgttcgcattctctctg

SEQ ID NO: 7350089 - DNA, 22 bp, Homo sapiens
tacaatttagtggtgtgtggtt

SEQ ID NO: 7350090 - DNA, 22 bp, Homo sapiens
tacacaaaggcactctgttgtt

SEQ ID NO: 7350091 - DNA, 22 bp, Homo sapiens
tacacattacataatactatct

SEQ ID NO: 7350092 - DNA, 22 bp, Homo sapiens
tacacatttctcttagagacac

SEQ ID NO: 7350093 - DNA, 22 bp, Homo sapiens
tacacatgtttggcaagtatgt

SEQ ID NO: 7350094 - DNA, 22 bp, Homo sapiens
tacacatgtatttatgtgtaca

SEQ ID NO: 7350095 - DNA, 22 bp, Homo sapiens
tacactaagaacaaagatctgt

SEQ ID NO: 7350096 - DNA, 22 bp, Homo sapiens
taattttgtcacagtgacatgc

SEQ ID NO: 7350097 - DNA, 22 bp, Homo sapiens
taatttcttcatctctgcagct

SEQ ID NO: 7350098 - DNA, 22 bp, Homo sapiens
taatttcttcatctctgcagct

SEQ ID NO: 7350099 - DNA, 22 bp, Homo sapiens
taatttctggagggagaaagag

SEQ ID NO: 7350100 - DNA, 22 bp, Homo sapiens
taatttttccacgtacactggg

SEQ ID NO: 7350101 - DNA, 22 bp, Homo sapiens
taatttttccacgtacactggg

SEQ ID NO: 7350102 - DNA, 22 bp, Homo sapiens
tacaatgaccatattatgtaag

SEQ ID NO: 7350103 - DNA, 22 bp, Homo sapiens
tacaatgctgtgcatgtaatgg

SEQ ID NO: 7350104 - DNA, 22 bp, Homo sapiens
tacaatgtaattctgattatgt

SEQ ID NO: 7350105 - DNA, 22 bp, Homo sapiens
tacaatgtctctcacctgactt

SEQ ID NO: 7350106 - DNA, 19 bp, Homo sapiens
tactaaacatgcatattgg

SEQ ID NO: 7350107 - DNA, 22 bp, Homo sapiens
tacgcgaagaaggacctgatgg

SEQ ID NO: 7350108 - DNA, 22 bp, Homo sapiens
taccttgggctattatctttga

SEQ ID NO: 7350109 - DNA, 22 bp, Homo sapiens
taccttgggttgagttcattct

SEQ ID NO: 7350110 - DNA, 22 bp, Homo sapiens
tactgaatggggcagtaagaaa

SEQ ID NO: 7350111 - DNA, 22 bp, Homo sapiens
tactgacacaaagccaatccct

SEQ ID NO: 7350112 - DNA, 22 bp, Homo sapiens
taccattttgaggatggagaga

SEQ ID NO: 7350113 - DNA, 22 bp, Homo sapiens
tacctgcacagccagccatgtg

SEQ ID NO: 7350114 - DNA, 22 bp, Homo sapiens
taccttggaaatgctagagtaa

SEQ ID NO: 7350115 - DNA, 22 bp, Homo sapiens
tacctgttttaaagctaaaagg

SEQ ID NO: 7350116 - DNA, 22 bp, Homo sapiens
tacctgttgtcacgataacact

SEQ ID NO: 7350117 - DNA, 22 bp, Homo sapiens
tacctgttgatttatactgaaa

SEQ ID NO: 7350118 - DNA, 22 bp, Homo sapiens
tacttcatacctgctagaatgg

SEQ ID NO: 7350119 - DNA, 22 bp, Homo sapiens
tacttattgttgaactgaatca

SEQ ID NO: 7350120 - DNA, 19 bp, Homo sapiens
tacttattagaaatatggg

SEQ ID NO: 7350121 - DNA, 22 bp, Homo sapiens
tacttccagcagcctgcttgct

SEQ ID NO: 7350122 - DNA, 22 bp, Homo sapiens
tacttgagaatagtgaataatg

SEQ ID NO: 7350123 - DNA, 20 bp, Homo sapiens
tacttgaatgttgcagcagt

SEQ ID NO: 7350124 - DNA, 22 bp, Homo sapiens
tactgagtaccaagcattgtgt

SEQ ID NO: 7350125 - DNA, 22 bp, Homo sapiens
tactgaattgtaagatgatgcc

SEQ ID NO: 7350126 - DNA, 22 bp, Homo sapiens
tactgacactcggtacacgcag

SEQ ID NO: 7350127 - DNA, 22 bp, Homo sapiens
tactgaggctggcagccccttg

SEQ ID NO: 7350128 - DNA, 22 bp, Homo sapiens
tactggggtatgctcagatata

SEQ ID NO: 7350129 - DNA, 22 bp, Homo sapiens
tactggagagccttgtccacat

SEQ ID NO: 7350130 - DNA, 23 bp, Homo sapiens
tactggaaatttgacagatttga

SEQ ID NO: 7350131 - DNA, 22 bp, Homo sapiens
tacattagctcatctatttatt

SEQ ID NO: 7350132 - DNA, 22 bp, Homo sapiens
tacattcatggtgacttgtatg

SEQ ID NO: 7350133 - DNA, 22 bp, Homo sapiens
tacattcatggtgacttgtatg

SEQ ID NO: 7350134 - DNA, 22 bp, Homo sapiens
tacattcagaagaatggacacg

SEQ ID NO: 7350135 - DNA, 22 bp, Homo sapiens
tacattcagaagaatggacacg

SEQ ID NO: 7350136 - DNA, 22 bp, Homo sapiens
tacatacagtggatgctttagg

SEQ ID NO: 7350137 - DNA, 22 bp, Homo sapiens
tacatacagtggatgctttagg

SEQ ID NO: 7350138 - DNA, 22 bp, Homo sapiens
tacatacatattcatacaggtg

SEQ ID NO: 7350139 - DNA, 22 bp, Homo sapiens
tacatacatggtggaatggtta

SEQ ID NO: 7350140 - DNA, 22 bp, Homo sapiens
tacatgtttggtaaatgatggc

SEQ ID NO: 7350141 - DNA, 22 bp, Homo sapiens
tacatgtctgggttttgtttcc

SEQ ID NO: 7350142 - DNA, 22 bp, Homo sapiens
tacatacacaaatatactgttt

SEQ ID NO: 7350143 - DNA, 22 bp, Homo sapiens
tacatacaagcattcaatttta

SEQ ID NO: 7350144 - DNA, 22 bp, Homo sapiens
tacatacaagcattcaatttta

SEQ ID NO: 7350145 - DNA, 22 bp, Homo sapiens
tacatacagagatgctagttaa

SEQ ID NO: 7350146 - DNA, 22 bp, Homo sapiens
tacatacagagatgctagttaa

SEQ ID NO: 7350147 - DNA, 22 bp, Homo sapiens
tacatacagccaagtatgaagt

SEQ ID NO: 7350148 - DNA, 22 bp, Homo sapiens
tacatacacaaatgctgaatgg

SEQ ID NO: 7350149 - DNA, 22 bp, Homo sapiens
tacatacacaaatgctgaatgg

SEQ ID NO: 7350150 - DNA, 22 bp, Homo sapiens
tacagttacgctgagaaacgaa

SEQ ID NO: 7350151 - DNA, 22 bp, Homo sapiens
tacagttactgttatatgtgct

SEQ ID NO: 7350152 - DNA, 20 bp, Homo sapiens
tacaggaccttctttgtatc

SEQ ID NO: 7350153 - DNA, 22 bp, Homo sapiens
tacatacaagatgtgtttaaaa

SEQ ID NO: 7350154 - DNA, 22 bp, Homo sapiens
tacagtttttattcatgacaag

SEQ ID NO: 7350155 - DNA, 22 bp, Homo sapiens
tacagttttggtgatgatgatg

SEQ ID NO: 7350156 - DNA, 22 bp, Homo sapiens
tacagtttttcactgaagatgt

SEQ ID NO: 7350157 - DNA, 22 bp, Homo sapiens
tacagcttttcatatttgtgtt

SEQ ID NO: 7350158 - DNA, 22 bp, Homo sapiens
tacagcttgatgtttgtgtgtt

SEQ ID NO: 7350159 - DNA, 22 bp, Homo sapiens
tacagcagagtgggatgcatct

SEQ ID NO: 7350160 - DNA, 22 bp, Homo sapiens
tacactattttactgatacaaa

SEQ ID NO: 7350161 - DNA, 22 bp, Homo sapiens
tagaggaggtgattcttgagct

SEQ ID NO: 7350162 - DNA, 22 bp, Homo sapiens
tagaggagggctgttcttcagt

SEQ ID NO: 7350163 - DNA, 23 bp, Homo sapiens
tagaggaggatgtgatgcatatt

SEQ ID NO: 7350164 - DNA, 22 bp, Homo sapiens
tagaggaggcaaggccctccct

SEQ ID NO: 7350165 - DNA, 22 bp, Homo sapiens
tagaggagagttgctggatgga

SEQ ID NO: 7350166 - DNA, 22 bp, Homo sapiens
tagaggagcggcgagctgagct

SEQ ID NO: 7350167 - DNA, 22 bp, Homo sapiens
tagaggagcggcgagctgagct

SEQ ID NO: 7350168 - DNA, 22 bp, Homo sapiens
tagagcacagtttcagggtgta

SEQ ID NO: 7350169 - DNA, 23 bp, Homo sapiens
tagagcagccccgaggtgctgtc

SEQ ID NO: 7350170 - DNA, 22 bp, Homo sapiens
tagagcattaagtattgttgtt

SEQ ID NO: 7350171 - DNA, 22 bp, Homo sapiens
tagagcagttggcagctgtatt

SEQ ID NO: 7350172 - DNA, 22 bp, Homo sapiens
tagagctcattttaagcagaca

SEQ ID NO: 7350173 - DNA, 22 bp, Homo sapiens
tactttctgtccttctgttaaa

SEQ ID NO: 7350174 - DNA, 22 bp, Homo sapiens
tactttctaagacatacaactt

SEQ ID NO: 7350175 - DNA, 22 bp, Homo sapiens
tactttcatgggttttctttat

SEQ ID NO: 7350176 - DNA, 23 bp, Homo sapiens
tagaatcctctgagatggaatag

SEQ ID NO: 7350177 - DNA, 22 bp, Homo sapiens
tagaagctcaggaataggcata

SEQ ID NO: 7350178 - DNA, 22 bp, Homo sapiens
tagaagtgggaatataaaatat

SEQ ID NO: 7350179 - DNA, 22 bp, Homo sapiens
tagccatgtgtggaacacagcc

SEQ ID NO: 7350180 - DNA, 22 bp, Homo sapiens
tagccaaagaaggtatatttgt

SEQ ID NO: 7350181 - DNA, 22 bp, Homo sapiens
tagcattttagctgttttctct

SEQ ID NO: 7350182 - DNA, 22 bp, Homo sapiens
tagcatttattccagatttgga

SEQ ID NO: 7350183 - DNA, 17 bp, Homo sapiens
tagcatttatcttcctt

SEQ ID NO: 7350184 - DNA, 22 bp, Homo sapiens
tagcacctcaattttgcaaata

SEQ ID NO: 7350185 - DNA, 22 bp, Homo sapiens
tagcacctgcaggatgtgcaca

SEQ ID NO: 7350186 - DNA, 22 bp, Homo sapiens
tagcagaaactgttacagaagg

SEQ ID NO: 7350187 - DNA, 22 bp, Homo sapiens
tagattttttggagactctctg

SEQ ID NO: 7350188 - DNA, 22 bp, Homo sapiens
tagattttaggagattttactg

SEQ ID NO: 7350189 - DNA, 22 bp, Homo sapiens
tagattttacttctgtcattac

SEQ ID NO: 7350190 - DNA, 20 bp, Homo sapiens
tagatgtttcctgtcataaa

SEQ ID NO: 7350191 - DNA, 22 bp, Homo sapiens
tagatgttccacatatatatgt

SEQ ID NO: 7350192 - DNA, 22 bp, Homo sapiens
tagatgttccacatatatatgt

SEQ ID NO: 7350193 - DNA, 22 bp, Homo sapiens
tagatgttgaagtcatatttgg

SEQ ID NO: 7350194 - DNA, 22 bp, Homo sapiens
tagatgtatcttctcttatcgt

SEQ ID NO: 7350195 - DNA, 22 bp, Homo sapiens
tagcacaagaagtacacataga

SEQ ID NO: 7350196 - DNA, 22 bp, Homo sapiens
tagcacagcttcttgatgtcac

SEQ ID NO: 7350197 - DNA, 18 bp, Homo sapiens
tagcacagagcaggatgt

SEQ ID NO: 7350198 - DNA, 17 bp, Homo sapiens
tagcacagtgcctggta

SEQ ID NO: 7350199 - DNA, 22 bp, Homo sapiens
tagcacagttcactatgataca

SEQ ID NO: 7350200 - DNA, 22 bp, Homo sapiens
tagcacagggcatatgcggtgg

SEQ ID NO: 7350201 - DNA, 22 bp, Homo sapiens
taggctggaggaagcagtgcct

SEQ ID NO: 7350202 - DNA, 22 bp, Homo sapiens
tagtaaaagtttagttgaaagt

SEQ ID NO: 7350203 - DNA, 22 bp, Homo sapiens
taggttttcctaaaattctggt

SEQ ID NO: 7350204 - DNA, 22 bp, Homo sapiens
tagtaaaaagcaatggtgagta

SEQ ID NO: 7350205 - DNA, 22 bp, Homo sapiens
tagtagaatccaaaccaacagt

SEQ ID NO: 7350206 - DNA, 22 bp, Homo sapiens
tagtagaaaaatgttaatccct

SEQ ID NO: 7350207 - DNA, 22 bp, Homo sapiens
tagtatatctttagtacatagt

SEQ ID NO: 7350208 - DNA, 22 bp, Homo sapiens
tagtatagattgaagcagatca

SEQ ID NO: 7350209 - DNA, 22 bp, Homo sapiens
tagtattttagaaaaccatgaa

SEQ ID NO: 7350210 - DNA, 22 bp, Homo sapiens
tagtatttataatcatgcttaa

SEQ ID NO: 7350211 - DNA, 22 bp, Homo sapiens
tagtatttcctgtaagctatag

SEQ ID NO: 7350212 - DNA, 22 bp, Homo sapiens
tagtggatgttcagagatttga

SEQ ID NO: 7350213 - DNA, 22 bp, Homo sapiens
tagtggatgggtaaagtatttt

SEQ ID NO: 7350214 - DNA, 22 bp, Homo sapiens
tagtcctttccggctgctataa

SEQ ID NO: 7350215 - DNA, 23 bp, Homo sapiens
tagtgtatatcaacatttgtccc

SEQ ID NO: 7350216 - DNA, 22 bp, Homo sapiens
tagtgtaaataactgcctagac

SEQ ID NO: 7350217 - DNA, 22 bp, Homo sapiens
tagtgggtgatttgatgaggaa

SEQ ID NO: 7350218 - DNA, 20 bp, Homo sapiens
taggacaggcagccgagggg

SEQ ID NO: 7350219 - DNA, 22 bp, Homo sapiens
taggacagagttccctgatggc

SEQ ID NO: 7350220 - DNA, 21 bp, Homo sapiens
taggacagcccccctgccctc

SEQ ID NO: 7350221 - DNA, 22 bp, Homo sapiens
taggacagggacatctttttga

SEQ ID NO: 7350222 - DNA, 20 bp, Homo sapiens
taggacagggcctggcttct

SEQ ID NO: 7350223 - DNA, 22 bp, Homo sapiens
taggctcctgagtccacagcac

SEQ ID NO: 7350224 - DNA, 22 bp, Homo sapiens
taggacacattgaagtgaaggc

SEQ ID NO: 7350225 - DNA, 22 bp, Homo sapiens
taggacagagctggttacaatg

SEQ ID NO: 7350226 - DNA, 22 bp, Homo sapiens
taggaaggcctgtcactacttg

SEQ ID NO: 7350227 - DNA, 22 bp, Homo sapiens
taggaagggctcagggctcggt

SEQ ID NO: 7350228 - DNA, 22 bp, Homo sapiens
taggaagggaaaggcttcaact

SEQ ID NO: 7350229 - DNA, 22 bp, Homo sapiens
taggaaggtccatgtcttatct

SEQ ID NO: 7350230 - DNA, 22 bp, Homo sapiens
taggaaggaggccatcttggcg

SEQ ID NO: 7350231 - DNA, 22 bp, Homo sapiens
taggaaggaagagcctcagatt

SEQ ID NO: 7350232 - DNA, 22 bp, Homo sapiens
tagccatgttgttaaaagacaa

SEQ ID NO: 7350233 - DNA, 22 bp, Homo sapiens
taggaaataattcactctggct

SEQ ID NO: 7350234 - DNA, 22 bp, Homo sapiens
taggaaataaatacttatggtt

SEQ ID NO: 7350235 - DNA, 22 bp, Homo sapiens
taggaaagcagtagagccagga

SEQ ID NO: 7350236 - DNA, 22 bp, Homo sapiens
tatgcacattcacacaaaaatg

SEQ ID NO: 7350237 - DNA, 22 bp, Homo sapiens
tatgcacagttacaagaatatc

SEQ ID NO: 7350238 - DNA, 22 bp, Homo sapiens
tatctttgtatcaatctccatt

SEQ ID NO: 7350239 - DNA, 22 bp, Homo sapiens
tatctttgcaaatatctctaag

SEQ ID NO: 7350240 - DNA, 20 bp, Homo sapiens
tatgataattacaaaatagt

SEQ ID NO: 7350241 - DNA, 22 bp, Homo sapiens
tatgcatatgtgttcattggag

SEQ ID NO: 7350242 - DNA, 22 bp, Homo sapiens
tatgcatatatcacgtgcatgc

SEQ ID NO: 7350243 - DNA, 22 bp, Homo sapiens
tatgcattatacattaatttct

SEQ ID NO: 7350244 - DNA, 22 bp, Homo sapiens
tatgcatatagatgcacacaca

SEQ ID NO: 7350245 - DNA, 22 bp, Homo sapiens
tatgcatataaatgtgtgaatt

SEQ ID NO: 7350246 - DNA, 22 bp, Homo sapiens
tatgcatagtggaattagcaaa

SEQ ID NO: 7350247 - DNA, 22 bp, Homo sapiens
tatgcagtgtacgatgtttagt

SEQ ID NO: 7350248 - DNA, 22 bp, Homo sapiens
tatgcataattggataagtaga

SEQ ID NO: 7350249 - DNA, 22 bp, Homo sapiens
tatgcataattggataagtaga

SEQ ID NO: 7350250 - DNA, 22 bp, Homo sapiens
tatctgttgtccatgcagaaag

SEQ ID NO: 7350251 - DNA, 22 bp, Homo sapiens
tatctgttggctttggaaataa

SEQ ID NO: 7350252 - DNA, 19 bp, Homo sapiens
tatctttatgcagtggtgg

SEQ ID NO: 7350253 - DNA, 22 bp, Homo sapiens
tatctttaacttgcagtattta

SEQ ID NO: 7350254 - DNA, 22 bp, Homo sapiens
tatcttgagagacaacacagca

SEQ ID NO: 7350255 - DNA, 22 bp, Homo sapiens
tatctgttagctaatgaatgag

SEQ ID NO: 7350256 - DNA, 21 bp, Homo sapiens
tatcaaggcactttttaaaga

SEQ ID NO: 7350257 - DNA, 22 bp, Homo sapiens
tatcaatacatgttatcagtgt

SEQ ID NO: 7350258 - DNA, 22 bp, Homo sapiens
tatcaaggtcaacattgacagt

SEQ ID NO: 7350259 - DNA, 19 bp, Homo sapiens
tatatttgttgaataaaaa

SEQ ID NO: 7350260 - DNA, 22 bp, Homo sapiens
tatatttaattagttgctggat

SEQ ID NO: 7350261 - DNA, 22 bp, Homo sapiens
tatatttaatcctagagccatt

SEQ ID NO: 7350262 - DNA, 19 bp, Homo sapiens
tatatttgagtgtgcatgc

SEQ ID NO: 7350263 - DNA, 18 bp, Homo sapiens
tatatttcacacatattc

SEQ ID NO: 7350264 - DNA, 18 bp, Homo sapiens
tatatttcacacatattc

SEQ ID NO: 7350265 - DNA, 22 bp, Homo sapiens
tatatttgtgtgtgatttatga

SEQ ID NO: 7350266 - DNA, 22 bp, Homo sapiens
tatatttgctaaatgtgtgcaa

SEQ ID NO: 7350267 - DNA, 19 bp, Homo sapiens
tatatttgagtgtgcatgc

SEQ ID NO: 7350268 - DNA, 23 bp, Homo sapiens
tagtgtcatcctcagcttctgtt

SEQ ID NO: 7350269 - DNA, 22 bp, Homo sapiens
tagtgtcagggagtgataaatg

SEQ ID NO: 7350270 - DNA, 21 bp, Homo sapiens
tataccacagccatcaaatat

SEQ ID NO: 7350271 - DNA, 22 bp, Homo sapiens
tatactattattgtcagtttat

SEQ ID NO: 7350272 - DNA, 20 bp, Homo sapiens
tatactaacatatatctgtt

SEQ ID NO: 7350273 - DNA, 22 bp, Homo sapiens
tatacttatgctaaaaaatgtt

SEQ ID NO: 7350274 - DNA, 22 bp, Homo sapiens
tatactctgagaaacgtgtcac

SEQ ID NO: 7350275 - DNA, 22 bp, Homo sapiens
tatatgcaatgaggtgggagta

SEQ ID NO: 7350276 - DNA, 22 bp, Homo sapiens
tatatgcagtgtgtcattcaag

SEQ ID NO: 7350277 - DNA, 22 bp, Homo sapiens
tatatgcagattttcatcatcg

SEQ ID NO: 7350278 - DNA, 22 bp, Homo sapiens
tatatgcaattttttagtgcaa

SEQ ID NO: 7350279 - DNA, 22 bp, Homo sapiens
tatattaaagtgctttgcagtg

SEQ ID NO: 7350280 - DNA, 22 bp, Homo sapiens
tatattacctgcctgatctata

SEQ ID NO: 7350281 - DNA, 22 bp, Homo sapiens
tatattaacacccacttgcctc

SEQ ID NO: 7350282 - DNA, 22 bp, Homo sapiens
tatattatcataaaaccattca

SEQ ID NO: 7350283 - DNA, 22 bp, Homo sapiens
tatattataagccctttcagaa

SEQ ID NO: 7350284 - DNA, 22 bp, Homo sapiens
tatttcctgcatggtgatgtaa

SEQ ID NO: 7350285 - DNA, 22 bp, Homo sapiens
tatttcctgcatggtgatgtaa

SEQ ID NO: 7350286 - DNA, 22 bp, Homo sapiens
tatttctaagagatatctgtac

SEQ ID NO: 7350287 - DNA, 22 bp, Homo sapiens
tatttcagggagaataaatttg

SEQ ID NO: 7350288 - DNA, 22 bp, Homo sapiens
tatttggagtgatggaaatgtt

SEQ ID NO: 7350289 - DNA, 22 bp, Homo sapiens
tatttctaagctgtaagtctga

SEQ ID NO: 7350290 - DNA, 22 bp, Homo sapiens
tatttggatagacagggagatg

SEQ ID NO: 7350291 - DNA, 22 bp, Homo sapiens
tatttggcaaagaattttctgg

SEQ ID NO: 7350292 - DNA, 22 bp, Homo sapiens
tatttgtagaatggattaaggg

SEQ ID NO: 7350293 - DNA, 22 bp, Homo sapiens
tatttgtatttcatgcagtaaa

SEQ ID NO: 7350294 - DNA, 22 bp, Homo sapiens
tatttgtatgtgtgtacatata

SEQ ID NO: 7350295 - DNA, 22 bp, Homo sapiens
tattttcaccttctctggatat

SEQ ID NO: 7350296 - DNA, 22 bp, Homo sapiens
tattttcaccttctctggatat

SEQ ID NO: 7350297 - DNA, 22 bp, Homo sapiens
tatttgttgcgggaattgctat

SEQ ID NO: 7350298 - DNA, 22 bp, Homo sapiens
tattttcattctgtgtgactgt

SEQ ID NO: 7350299 - DNA, 22 bp, Homo sapiens
tatttgttccagagataaaaat

SEQ ID NO: 7350300 - DNA, 22 bp, Homo sapiens
tatttgttgagttgttatgtct

SEQ ID NO: 7350301 - DNA, 22 bp, Homo sapiens
tattgtacatttcaaaattgct

SEQ ID NO: 7350302 - DNA, 22 bp, Homo sapiens
tattgtacatttcaaagtagct

SEQ ID NO: 7350303 - DNA, 22 bp, Homo sapiens
tatttcagggagaataaatttg

SEQ ID NO: 7350304 - DNA, 22 bp, Homo sapiens
tatttcaggctatatttcttgt

SEQ ID NO: 7350305 - DNA, 22 bp, Homo sapiens
tatttcagcaagaagaatgtgg

SEQ ID NO: 7350306 - DNA, 22 bp, Homo sapiens
tatttcagagttgttttctgtc

SEQ ID NO: 7350307 - DNA, 22 bp, Homo sapiens
tatttcacctaaaagtgtcaaa

SEQ ID NO: 7350308 - DNA, 22 bp, Homo sapiens
tatttcacagcagctcatttaa

SEQ ID NO: 7350309 - DNA, 22 bp, Homo sapiens
tattgtactgaggaataaagct

SEQ ID NO: 7350310 - DNA, 22 bp, Homo sapiens
tatttcaagaacttctatccat

SEQ ID NO: 7350311 - DNA, 22 bp, Homo sapiens
tattgaggattgaggaaagcac

SEQ ID NO: 7350312 - DNA, 22 bp, Homo sapiens
tattgaggtgcttagctggggg

SEQ ID NO: 7350313 - DNA, 22 bp, Homo sapiens
tattcatattgtaaaagaagtg

SEQ ID NO: 7350314 - DNA, 22 bp, Homo sapiens
tattcagaaaataaattggatt

SEQ ID NO: 7350315 - DNA, 22 bp, Homo sapiens
tattcagtggaaaatgtgttga

SEQ ID NO: 7350316 - DNA, 22 bp, Homo sapiens
tattcatattgtaaaagaagtg

SEQ ID NO: 7350317 - DNA, 22 bp, Homo sapiens
tatgtttatactttgatgtact

SEQ ID NO: 7350318 - DNA, 22 bp, Homo sapiens
tatgtttatactttgatgtact

SEQ ID NO: 7350319 - DNA, 22 bp, Homo sapiens
tattcacaggcacgaaatattg

SEQ ID NO: 7350320 - DNA, 22 bp, Homo sapiens
tattcacaggcacgaaatattg

SEQ ID NO: 7350321 - DNA, 22 bp, Homo sapiens
tattcacaaaatgaggtcctca

SEQ ID NO: 7350322 - DNA, 22 bp, Homo sapiens
tattcacagttgatttacagtt

SEQ ID NO: 7350323 - DNA, 22 bp, Homo sapiens
tatgttcttggactaagttgtt

SEQ ID NO: 7350324 - DNA, 22 bp, Homo sapiens
tatgttctttacatctgtgcaa

SEQ ID NO: 7350325 - DNA, 22 bp, Homo sapiens
tatgtttaaatgtatgtgtatg

SEQ ID NO: 7350326 - DNA, 22 bp, Homo sapiens
tatgtttaaatgtatgtgtatg

SEQ ID NO: 7350327 - DNA, 19 bp, Homo sapiens
tatgttatgttgtttactc

SEQ ID NO: 7350328 - DNA, 22 bp, Homo sapiens
tatgcctacctccaaaatatat

SEQ ID NO: 7350329 - DNA, 22 bp, Homo sapiens
tatgcctgataactgtgtctct

SEQ ID NO: 7350330 - DNA, 22 bp, Homo sapiens
tatgcctggaacctttctcttt

SEQ ID NO: 7350331 - DNA, 22 bp, Homo sapiens
tatgctagatggaaaaatattg

SEQ ID NO: 7350332 - DNA, 22 bp, Homo sapiens
tatgctgaatttggtttgctat

SEQ ID NO: 7350333 - DNA, 22 bp, Homo sapiens
tatgctaaatatgttcacattg

SEQ ID NO: 7350334 - DNA, 22 bp, Homo sapiens
tatgctaattgttagtcacatg

SEQ ID NO: 7350335 - DNA, 22 bp, Homo sapiens
tatgctactagaaataaaatgg

SEQ ID NO: 7350336 - DNA, 19 bp, Homo sapiens
tatgtgtgtgtatttacat

SEQ ID NO: 7350337 - DNA, 22 bp, Homo sapiens
tatgctgtattctgtatgttag

SEQ ID NO: 7350338 - DNA, 22 bp, Homo sapiens
tatgcttattgtctcatccact

SEQ ID NO: 7350339 - DNA, 22 bp, Homo sapiens
tatgctttaacattaaacaaca

SEQ ID NO: 7350340 - DNA, 22 bp, Homo sapiens
tatgttaaatgtttgatgttta

SEQ ID NO: 7350341 - DNA, 17 bp, Homo sapiens
tatgtgtgtttgcagca

SEQ ID NO: 7350342 - DNA, 22 bp, Homo sapiens
tatgtgtgtttcagtggaaatg

SEQ ID NO: 7350343 - DNA, 22 bp, Homo sapiens
gtagcaatgttgaacactgcgt

SEQ ID NO: 7350344 - DNA, 22 bp, Homo sapiens
gtagaggctgaaatctgagggc

SEQ ID NO: 7350345 - DNA, 22 bp, Homo sapiens
gtagaggctcagagagccgcag

SEQ ID NO: 7350346 - DNA, 22 bp, Homo sapiens
gtagaggcagaaactgaaggac

SEQ ID NO: 7350347 - DNA, 22 bp, Homo sapiens
gtcaacagagacagagacactg

SEQ ID NO: 7350348 - DNA, 22 bp, Homo sapiens
gtcaaggcatctctagagcaat

SEQ ID NO: 7350349 - DNA, 22 bp, Homo sapiens
gtcaacagtattaggacatttg

SEQ ID NO: 7350350 - DNA, 22 bp, Homo sapiens
gtaatattcagctattgagttg

SEQ ID NO: 7350351 - DNA, 19 bp, Homo sapiens
gtaatatgtgctgagtcct

SEQ ID NO: 7350352 - DNA, 22 bp, Homo sapiens
gtaatagtctcaaactcctgga

SEQ ID NO: 7350353 - DNA, 22 bp, Homo sapiens
gtaaatcatggtcagaataaat

SEQ ID NO: 7350354 - DNA, 22 bp, Homo sapiens
gtaaattatttcaagatcatct

SEQ ID NO: 7350355 - DNA, 22 bp, Homo sapiens
gtaaattatttcaagatcatct

SEQ ID NO: 7350356 - DNA, 22 bp, Homo sapiens
ggtgggcacattcagtctctgt

SEQ ID NO: 7350357 - DNA, 21 bp, Homo sapiens
ggtgggcacaggagagcagag

SEQ ID NO: 7350358 - DNA, 21 bp, Homo sapiens
ggtgggcacaggagagcagag

SEQ ID NO: 7350359 - DNA, 22 bp, Homo sapiens
ggtgggcacccgagactggatc

SEQ ID NO: 7350360 - DNA, 22 bp, Homo sapiens
ggtgggcacccgagactggatc

SEQ ID NO: 7350361 - DNA, 22 bp, Homo sapiens
gtaaatcagtgtcattttagaa

SEQ ID NO: 7350362 - DNA, 22 bp, Homo sapiens
ggtgggcagctcttggcaggca

SEQ ID NO: 7350363 - DNA, 22 bp, Homo sapiens
ggtgggcagctcttggcaggca

SEQ ID NO: 7350364 - DNA, 22 bp, Homo sapiens
gtcctctgcttcatgccctgat

SEQ ID NO: 7350365 - DNA, 22 bp, Homo sapiens
gtctccggccgccctggtgctg

SEQ ID NO: 7350366 - DNA, 22 bp, Homo sapiens
gtcctcagtcagtttggtgggg

SEQ ID NO: 7350367 - DNA, 19 bp, Homo sapiens
gtcctctcaacaacccggg

SEQ ID NO: 7350368 - DNA, 22 bp, Homo sapiens
gtcctctgagggggctgcacgc

SEQ ID NO: 7350369 - DNA, 22 bp, Homo sapiens
gtcctcaggaaggctttctgac

SEQ ID NO: 7350370 - DNA, 22 bp, Homo sapiens
gtcctcaggaaagcagataaca

SEQ ID NO: 7350371 - DNA, 22 bp, Homo sapiens
gtcctcaggcttgagtgtttat

SEQ ID NO: 7350372 - DNA, 22 bp, Homo sapiens
gtcctcagggagtcccagtcat

SEQ ID NO: 7350373 - DNA, 22 bp, Homo sapiens
gtcctcagtaagagggcctctg

SEQ ID NO: 7350374 - DNA, 22 bp, Homo sapiens
gtcctcagggaatgtggcgggt

SEQ ID NO: 7350375 - DNA, 22 bp, Homo sapiens
gtcctcagaagcctgcttagct

SEQ ID NO: 7350376 - DNA, 22 bp, Homo sapiens
gtcctcagagtgggcaggtcct

SEQ ID NO: 7350377 - DNA, 22 bp, Homo sapiens
gtcctcagatgctgctgaaatg

SEQ ID NO: 7350378 - DNA, 22 bp, Homo sapiens
gtcctcagcaccagaactaggg

SEQ ID NO: 7350379 - DNA, 21 bp, Homo sapiens
gtcctcagctgatgggagctg

SEQ ID NO: 7350380 - DNA, 22 bp, Homo sapiens
gtcatttctgtttcttcagtgc

SEQ ID NO: 7350381 - DNA, 22 bp, Homo sapiens
gtcattgtgtggacatggagaa

SEQ ID NO: 7350382 - DNA, 22 bp, Homo sapiens
gtcattgggggccatctcagag

SEQ ID NO: 7350383 - DNA, 18 bp, Homo sapiens
gtcattgcaacatactgt

SEQ ID NO: 7350384 - DNA, 22 bp, Homo sapiens
gtcattgcagtggcaaatcaca

SEQ ID NO: 7350385 - DNA, 22 bp, Homo sapiens
gtcacagtatcatgtttgaatg

SEQ ID NO: 7350386 - DNA, 22 bp, Homo sapiens
gtcacaggtgtggaggtgctgg

SEQ ID NO: 7350387 - DNA, 22 bp, Homo sapiens
gtcacagtcaaggccatgggca

SEQ ID NO: 7350388 - DNA, 22 bp, Homo sapiens
gtcacagtgacagagatgttag

SEQ ID NO: 7350389 - DNA, 22 bp, Homo sapiens
gtcacagtgccctggtggtgtt

SEQ ID NO: 7350390 - DNA, 22 bp, Homo sapiens
gtcacagtgcctgaagctctga

SEQ ID NO: 7350391 - DNA, 22 bp, Homo sapiens
gtcacagtgcctgccactcaga

SEQ ID NO: 7350392 - DNA, 22 bp, Homo sapiens
gtcacagtgctcccaaagtttg

SEQ ID NO: 7350393 - DNA, 22 bp, Homo sapiens
gtcacagtggggtcacagtgtg

SEQ ID NO: 7350394 - DNA, 23 bp, Homo sapiens
gtcacagtgggtggtgcctacat

SEQ ID NO: 7350395 - DNA, 22 bp, Homo sapiens
gtcacagtgtatctcttcagct

SEQ ID NO: 7350396 - DNA, 22 bp, Homo sapiens
gtcacagtgtcctacaggttga

SEQ ID NO: 7350397 - DNA, 22 bp, Homo sapiens
gtcacattcatgcagaatcaaa

SEQ ID NO: 7350398 - DNA, 22 bp, Homo sapiens
gtcacattcatgcagaatcaaa

SEQ ID NO: 7350399 - DNA, 23 bp, Homo sapiens
gtcagggctggggtcagagtgac

SEQ ID NO: 7350400 - DNA, 22 bp, Homo sapiens
gtcagggctccactcaccctcc

SEQ ID NO: 7350401 - DNA, 22 bp, Homo sapiens
gtcataaagacagaaacattcc

SEQ ID NO: 7350402 - DNA, 22 bp, Homo sapiens
gtcattcaaactgtatcacttg

SEQ ID NO: 7350403 - DNA, 22 bp, Homo sapiens
gtcataaaaggaccacctattg

SEQ ID NO: 7350404 - DNA, 22 bp, Homo sapiens
gtcataaaatttgtggattaga

SEQ ID NO: 7350405 - DNA, 22 bp, Homo sapiens
gtcaggggatgtgctggtggcc

SEQ ID NO: 7350406 - DNA, 22 bp, Homo sapiens
gtcagtggtgcttaaagtttca

SEQ ID NO: 7350407 - DNA, 22 bp, Homo sapiens
gtctggggtgaggcccgggatt

SEQ ID NO: 7350408 - DNA, 22 bp, Homo sapiens
gtcttatttaaagagatcatac

SEQ ID NO: 7350409 - DNA, 22 bp, Homo sapiens
gtcttattatgaggttagactt

SEQ ID NO: 7350410 - DNA, 22 bp, Homo sapiens
gtcttattaaaatgcagtttct

SEQ ID NO: 7350411 - DNA, 22 bp, Homo sapiens
gtcttcctaatttgctattagg

SEQ ID NO: 7350412 - DNA, 22 bp, Homo sapiens
gtctctatcatagctgaaccct

SEQ ID NO: 7350413 - DNA, 22 bp, Homo sapiens
gtctctatcatagctgaaccct

SEQ ID NO: 7350414 - DNA, 22 bp, Homo sapiens
gtctcctggctgcagctaagac

SEQ ID NO: 7350415 - DNA, 22 bp, Homo sapiens
gtctcctgccacactcagtccc

SEQ ID NO: 7350416 - DNA, 22 bp, Homo sapiens
gtctcctgaggcatccattgaa

SEQ ID NO: 7350417 - DNA, 22 bp, Homo sapiens
gtctcctgagccttgactgcaa

SEQ ID NO: 7350418 - DNA, 22 bp, Homo sapiens
gtgataaaattcaaatagctct

SEQ ID NO: 7350419 - DNA, 22 bp, Homo sapiens
gtgagtcttaagcaccaccttt

SEQ ID NO: 7350420 - DNA, 22 bp, Homo sapiens
gtgatgtacttggaaaagtcct

SEQ ID NO: 7350421 - DNA, 22 bp, Homo sapiens
gtgatgagagaaccaggacctt

SEQ ID NO: 7350422 - DNA, 22 bp, Homo sapiens
gtgatacaggtgttctggatat

SEQ ID NO: 7350423 - DNA, 22 bp, Homo sapiens
gtgaggcagggaaagaggataa

SEQ ID NO: 7350424 - DNA, 22 bp, Homo sapiens
gtgaggcattgaagaccggaat

SEQ ID NO: 7350425 - DNA, 22 bp, Homo sapiens
gtgaggtcctaatagacatcga

SEQ ID NO: 7350426 - DNA, 22 bp, Homo sapiens
gtgaggtgactagcaggtgggg

SEQ ID NO: 7350427 - DNA, 22 bp, Homo sapiens
gtgaggtgactagcaggtgggg

SEQ ID NO: 7350428 - DNA, 22 bp, Homo sapiens
gtgaggtcctgagaggcttgtg

SEQ ID NO: 7350429 - DNA, 22 bp, Homo sapiens
gtgaggcagggaaagaggataa

SEQ ID NO: 7350430 - DNA, 22 bp, Homo sapiens
gtcttctttaacctactaaagc

SEQ ID NO: 7350431 - DNA, 22 bp, Homo sapiens
gtgcaatgaaactgttttgtgg

SEQ ID NO: 7350432 - DNA, 22 bp, Homo sapiens
gtgcacaatcttcatatggcgt

SEQ ID NO: 7350433 - DNA, 22 bp, Homo sapiens
gtgcaaattccactggaaagct

SEQ ID NO: 7350434 - DNA, 22 bp, Homo sapiens
gtgattgcccagcaccattgtt

SEQ ID NO: 7350435 - DNA, 22 bp, Homo sapiens
gtgatttcaggtttttcatact

SEQ ID NO: 7350436 - DNA, 22 bp, Homo sapiens
gtgatttcaggtttttcatact

SEQ ID NO: 7350437 - DNA, 22 bp, Homo sapiens
gtgatttctaatcatctgaatg

SEQ ID NO: 7350438 - DNA, 23 bp, Homo sapiens
gtgatttcagggaacagaatcag

SEQ ID NO: 7350439 - DNA, 22 bp, Homo sapiens
gtgatttcaaatatagagtgag

SEQ ID NO: 7350440 - DNA, 22 bp, Homo sapiens
gtgattcctattagtacatgca

SEQ ID NO: 7350441 - DNA, 19 bp, Homo sapiens
gtgatttctttccacaagc

SEQ ID NO: 7350442 - DNA, 22 bp, Homo sapiens
gtgcaaaaataattgtggtttt

SEQ ID NO: 7350443 - DNA, 22 bp, Homo sapiens
gtgcaaaagcagttggattttt

SEQ ID NO: 7350444 - DNA, 22 bp, Homo sapiens
gtgcaaaagcagttgtggtttt

SEQ ID NO: 7350445 - DNA, 22 bp, Homo sapiens
gtgcaaaaggcattgtggtttt

SEQ ID NO: 7350446 - DNA, 22 bp, Homo sapiens
gtgcaaaagtaaatgtggtttt

SEQ ID NO: 7350447 - DNA, 22 bp, Homo sapiens
gtgcaaaagtaactgtggtttt

SEQ ID NO: 7350448 - DNA, 22 bp, Homo sapiens
gtgcaaaagtaatggcagtttt

SEQ ID NO: 7350449 - DNA, 22 bp, Homo sapiens
gtgctgggccctgagaccaggg

SEQ ID NO: 7350450 - DNA, 22 bp, Homo sapiens
gtgctgggctccaccccagagg

SEQ ID NO: 7350451 - DNA, 22 bp, Homo sapiens
gtgctgggctccaccccagagg

SEQ ID NO: 7350452 - DNA, 23 bp, Homo sapiens
gtgctgtgagccccttggcctcc

SEQ ID NO: 7350453 - DNA, 22 bp, Homo sapiens
gtgccctgttcatttctctccc

SEQ ID NO: 7350454 - DNA, 21 bp, Homo sapiens
gtgccctgttcccacatgccc

SEQ ID NO: 7350455 - DNA, 22 bp, Homo sapiens
gtgccctggctcacagtgtctc

SEQ ID NO: 7350456 - DNA, 22 bp, Homo sapiens
gtgcctcagcaccgcctgcagc

SEQ ID NO: 7350457 - DNA, 22 bp, Homo sapiens
gtgcctcccgggaccatgcact

SEQ ID NO: 7350458 - DNA, 22 bp, Homo sapiens
gtgcctccatcagtgcctccaa

SEQ ID NO: 7350459 - DNA, 22 bp, Homo sapiens
gtgcctcccggggctcttcctt

SEQ ID NO: 7350460 - DNA, 22 bp, Homo sapiens
gggggccatcttcaaggatgtg

SEQ ID NO: 7350461 - DNA, 22 bp, Homo sapiens
gggggccagtgtctcttccttg

SEQ ID NO: 7350462 - DNA, 22 bp, Homo sapiens
gggggccttattcatctgccag

SEQ ID NO: 7350463 - DNA, 22 bp, Homo sapiens
gggggccttgttagtggatgga

SEQ ID NO: 7350464 - DNA, 22 bp, Homo sapiens
gggggagagacgagcggctctg

SEQ ID NO: 7350465 - DNA, 22 bp, Homo sapiens
gggggagagacgagcggctctg

SEQ ID NO: 7350466 - DNA, 20 bp, Homo sapiens
gggggccagcagcagacgcc

SEQ ID NO: 7350467 - DNA, 20 bp, Homo sapiens
gggggccagcagcagacgcc

SEQ ID NO: 7350468 - DNA, 22 bp, Homo sapiens
gggggccagtcatctcccaaga

SEQ ID NO: 7350469 - DNA, 22 bp, Homo sapiens
gggggcagtaaggatatggaaa

SEQ ID NO: 7350470 - DNA, 22 bp, Homo sapiens
gggtcagagcaagactggggtc

SEQ ID NO: 7350471 - DNA, 21 bp, Homo sapiens
gggtataaaatggtatctcat

SEQ ID NO: 7350472 - DNA, 22 bp, Homo sapiens
gggggcgggagacagcagtgac

SEQ ID NO: 7350473 - DNA, 22 bp, Homo sapiens
ggggcaggagcccttcttcagc

SEQ ID NO: 7350474 - DNA, 22 bp, Homo sapiens
ggggcaggagcccttcttcagc

SEQ ID NO: 7350475 - DNA, 22 bp, Homo sapiens
ggggcaggagcccttcttcagc

SEQ ID NO: 7350476 - DNA, 22 bp, Homo sapiens
ggggcagctcccgagggcagga

SEQ ID NO: 7350477 - DNA, 22 bp, Homo sapiens
ggggcttccagcgcccgccggt

SEQ ID NO: 7350478 - DNA, 22 bp, Homo sapiens
ggggcttttgcacgtgggaggc

SEQ ID NO: 7350479 - DNA, 22 bp, Homo sapiens
ggggcttctttctgccaccgac

SEQ ID NO: 7350480 - DNA, 22 bp, Homo sapiens
ggggcaggagcccttcttcagc

SEQ ID NO: 7350481 - DNA, 22 bp, Homo sapiens
ggggctggtggtggtttctcca

SEQ ID NO: 7350482 - DNA, 22 bp, Homo sapiens
ggggcaggaggtgttctctttt

SEQ ID NO: 7350483 - DNA, 22 bp, Homo sapiens
gggggactaactggatcctgga

SEQ ID NO: 7350484 - DNA, 21 bp, Homo sapiens
gggggaagaggagttgctagt

SEQ ID NO: 7350485 - DNA, 22 bp, Homo sapiens
gggggaagactgggctagtgat

SEQ ID NO: 7350486 - DNA, 22 bp, Homo sapiens
gggggaagactgggctagtgat

SEQ ID NO: 7350487 - DNA, 22 bp, Homo sapiens
ggggcagaaagcccacagagtg

SEQ ID NO: 7350488 - DNA, 22 bp, Homo sapiens
ggggcactttactgcctcatct

SEQ ID NO: 7350489 - DNA, 22 bp, Homo sapiens
ggggcagaaagcccacagagtg

SEQ ID NO: 7350490 - DNA, 22 bp, Homo sapiens
ggggcagaagtagtgcccctga

SEQ ID NO: 7350491 - DNA, 22 bp, Homo sapiens
ggggcacacttttggtagatat

SEQ ID NO: 7350492 - DNA, 22 bp, Homo sapiens
ggggcacacttttggtagatat

SEQ ID NO: 7350493 - DNA, 22 bp, Homo sapiens
ggggcacttggcacctctgcag

SEQ ID NO: 7350494 - DNA, 22 bp, Homo sapiens
ggggatggaatgtagtagtgat

SEQ ID NO: 7350495 - DNA, 22 bp, Homo sapiens
ggggatggattccgggtccctg

SEQ ID NO: 7350496 - DNA, 22 bp, Homo sapiens
ggggatggattccgggtccctg

SEQ ID NO: 7350497 - DNA, 22 bp, Homo sapiens
ggggatggattccgggtccctg

SEQ ID NO: 7350498 - DNA, 22 bp, Homo sapiens
ggggatggaggcgtgtggtcct

SEQ ID NO: 7350499 - DNA, 22 bp, Homo sapiens
ggggatggtagaccggtgacgt

SEQ ID NO: 7350500 - DNA, 22 bp, Homo sapiens
gggctgggaatggctaagtatg

SEQ ID NO: 7350501 - DNA, 22 bp, Homo sapiens
gggctgggaatggctaagtatg

SEQ ID NO: 7350502 - DNA, 22 bp, Homo sapiens
gggctgggatggcttgaagatt

SEQ ID NO: 7350503 - DNA, 22 bp, Homo sapiens
gggctgggcatggtgttccctc

SEQ ID NO: 7350504 - DNA, 22 bp, Homo sapiens
gggctgggattgcttgctgtga

SEQ ID NO: 7350505 - DNA, 22 bp, Homo sapiens
gggctgggattgcttgctgtga

SEQ ID NO: 7350506 - DNA, 22 bp, Homo sapiens
gggctgggatggcttgaagatt

SEQ ID NO: 7350507 - DNA, 22 bp, Homo sapiens
gggctgggcatggtgttccctc

SEQ ID NO: 7350508 - DNA, 22 bp, Homo sapiens
gggctgggcatggtgttccctc

SEQ ID NO: 7350509 - DNA, 22 bp, Homo sapiens
gggcatgacttttggagtggga

SEQ ID NO: 7350510 - DNA, 19 bp, Homo sapiens
gggcatcaaagtgctggtg

SEQ ID NO: 7350511 - DNA, 23 bp, Homo sapiens
gggcagttatgttgtccttggct

SEQ ID NO: 7350512 - DNA, 20 bp, Homo sapiens
gggcagttcaatgccactct

SEQ ID NO: 7350513 - DNA, 18 bp, Homo sapiens
gggcatcattcacaaagt

SEQ ID NO: 7350514 - DNA, 22 bp, Homo sapiens
gggcctcagctgccaacaggat

SEQ ID NO: 7350515 - DNA, 22 bp, Homo sapiens
gggcctcagctctgctctgcaa

SEQ ID NO: 7350516 - DNA, 22 bp, Homo sapiens
gggcctcaggccttgctctgtg

SEQ ID NO: 7350517 - DNA, 22 bp, Homo sapiens
gggcctcatgatggctcaggaa

SEQ ID NO: 7350518 - DNA, 22 bp, Homo sapiens
gggcctccggggtgagctgtgg

SEQ ID NO: 7350519 - DNA, 22 bp, Homo sapiens
gggcctccggggtgagctgtgg

SEQ ID NO: 7350520 - DNA, 22 bp, Homo sapiens
gggcctccgtgtgctggtgctc

SEQ ID NO: 7350521 - DNA, 22 bp, Homo sapiens
gggcctgccattgctgccccag

SEQ ID NO: 7350522 - DNA, 22 bp, Homo sapiens
gggcctggcatgcagccccgtt

SEQ ID NO: 7350523 - DNA, 21 bp, Homo sapiens
gggcctggctgcgcaggacgg

SEQ ID NO: 7350524 - DNA, 22 bp, Homo sapiens
gggcctggggtgacgtacccct

SEQ ID NO: 7350525 - DNA, 22 bp, Homo sapiens
gggcctggggacaccaccatga

SEQ ID NO: 7350526 - DNA, 22 bp, Homo sapiens
gggcctggggacaccaccatga

SEQ ID NO: 7350527 - DNA, 22 bp, Homo sapiens
gggctcctgcctcctggcacct

SEQ ID NO: 7350528 - DNA, 22 bp, Homo sapiens
gggctcctgcctcctggcacct

SEQ ID NO: 7350529 - DNA, 22 bp, Homo sapiens
gggctcctcctctgactgtggc

SEQ ID NO: 7350530 - DNA, 22 bp, Homo sapiens
gggctcctcctctgactgtggc

SEQ ID NO: 7350531 - DNA, 19 bp, Homo sapiens
gggctccttgggcctctct

SEQ ID NO: 7350532 - DNA, 19 bp, Homo sapiens
gggctccttgggcctctct

SEQ ID NO: 7350533 - DNA, 22 bp, Homo sapiens
gggctcggcatctgtggactct

SEQ ID NO: 7350534 - DNA, 22 bp, Homo sapiens
gggctctcccacaacgtgccag

SEQ ID NO: 7350535 - DNA, 21 bp, Homo sapiens
gggctctcctgaggccatgaa

SEQ ID NO: 7350536 - DNA, 22 bp, Homo sapiens
gggctctcgattagaccctggg

SEQ ID NO: 7350537 - DNA, 22 bp, Homo sapiens
gggctctcaaggcagggcccca

SEQ ID NO: 7350538 - DNA, 22 bp, Homo sapiens
gggctctctttttggcctgccc

SEQ ID NO: 7350539 - DNA, 22 bp, Homo sapiens
gggctctctttttggcctgccc

SEQ ID NO: 7350540 - DNA, 22 bp, Homo sapiens
gggctccagcccgggaccaggt

SEQ ID NO: 7350541 - DNA, 22 bp, Homo sapiens
gggctccagccaggtgtcccca

SEQ ID NO: 7350542 - DNA, 22 bp, Homo sapiens
gggctccagccagctccttgtg

SEQ ID NO: 7350543 - DNA, 22 bp, Homo sapiens
gggctccaaggaggccagcctg

SEQ ID NO: 7350544 - DNA, 17 bp, Homo sapiens
gggctcctcccctgggg

SEQ ID NO: 7350545 - DNA, 17 bp, Homo sapiens
gggctcctcccctgggg

SEQ ID NO: 7350546 - DNA, 22 bp, Homo sapiens
gggctccatcacaggctccatc

SEQ ID NO: 7350547 - DNA, 22 bp, Homo sapiens
gggctccatcacaggctccatc

SEQ ID NO: 7350548 - DNA, 22 bp, Homo sapiens
gggctccatcacaggctccatc

SEQ ID NO: 7350549 - DNA, 23 bp, Homo sapiens
gggctccagtctctgctcagttg

SEQ ID NO: 7350550 - DNA, 22 bp, Homo sapiens
gggctccagttgtccccaggat

SEQ ID NO: 7350551 - DNA, 22 bp, Homo sapiens
gggctccagttgtccccaggat

SEQ ID NO: 7350552 - DNA, 22 bp, Homo sapiens
gggctccaggagccctaagaga

SEQ ID NO: 7350553 - DNA, 22 bp, Homo sapiens
gggctccaggagccctaagaga

SEQ ID NO: 7350554 - DNA, 22 bp, Homo sapiens
ggtccagggggtagatatgtga

SEQ ID NO: 7350555 - DNA, 22 bp, Homo sapiens
ggtcagggctcttccagtggct

SEQ ID NO: 7350556 - DNA, 18 bp, Homo sapiens
ggtcaggggcggagagaa

SEQ ID NO: 7350557 - DNA, 18 bp, Homo sapiens
ggtcaggggcggagagaa

SEQ ID NO: 7350558 - DNA, 22 bp, Homo sapiens
ggtcaggggctgctctacagag

SEQ ID NO: 7350559 - DNA, 22 bp, Homo sapiens
ggtcaggggctgctctacagag

SEQ ID NO: 7350560 - DNA, 22 bp, Homo sapiens
ggtcagggggatctgtgaggta

SEQ ID NO: 7350561 - DNA, 21 bp, Homo sapiens
ggtcagggggtgcctccaggt

SEQ ID NO: 7350562 - DNA, 21 bp, Homo sapiens
ggtcagggggtgcctccaggt

SEQ ID NO: 7350563 - DNA, 21 bp, Homo sapiens
ggtcagggggtgcctccaggt

SEQ ID NO: 7350564 - DNA, 22 bp, Homo sapiens
ggtaggaagatagagcaaagtt

SEQ ID NO: 7350565 - DNA, 20 bp, Homo sapiens
ggtcagcctggggctccagg

SEQ ID NO: 7350566 - DNA, 20 bp, Homo sapiens
ggtcagccccacctggcagc

SEQ ID NO: 7350567 - DNA, 22 bp, Homo sapiens
gggtccagagttttcccgccct

SEQ ID NO: 7350568 - DNA, 22 bp, Homo sapiens
gggtccagagcctcagcccaga

SEQ ID NO: 7350569 - DNA, 22 bp, Homo sapiens
gggtccagacactccagaggaa

SEQ ID NO: 7350570 - DNA, 22 bp, Homo sapiens
gggtcagggctgcctgggctca

SEQ ID NO: 7350571 - DNA, 22 bp, Homo sapiens
gggtcaggctagcccagacttc

SEQ ID NO: 7350572 - DNA, 22 bp, Homo sapiens
gggtcaggcctcaaggtgggct

SEQ ID NO: 7350573 - DNA, 22 bp, Homo sapiens
gggtcaggcctcaaggtgggct

SEQ ID NO: 7350574 - DNA, 22 bp, Homo sapiens
gggtcaggaagaattctgccaa

SEQ ID NO: 7350575 - DNA, 22 bp, Homo sapiens
gggtcaggctcagcagggcagc

SEQ ID NO: 7350576 - DNA, 22 bp, Homo sapiens
gggtcaggctcagcagggcagc

SEQ ID NO: 7350577 - DNA, 22 bp, Homo sapiens
gggtcaggctagcccagacttc

SEQ ID NO: 7350578 - DNA, 22 bp, Homo sapiens
ggtacagacagggctgcctggg

SEQ ID NO: 7350579 - DNA, 20 bp, Homo sapiens
ggtgcaggtaacgctgtgct

SEQ ID NO: 7350580 - DNA, 20 bp, Homo sapiens
ggtgcaggtaacgctgtgct

SEQ ID NO: 7350581 - DNA, 20 bp, Homo sapiens
ggtgcaggtaacgctgtgct

SEQ ID NO: 7350582 - DNA, 22 bp, Homo sapiens
ggtgcagggagaggcaggcccc

SEQ ID NO: 7350583 - DNA, 22 bp, Homo sapiens
ggtgcagggagaggcaggcccc

SEQ ID NO: 7350584 - DNA, 22 bp, Homo sapiens
ggtgcaggcggtggggcaagta

SEQ ID NO: 7350585 - DNA, 22 bp, Homo sapiens
ggtgcagggagaggcaggcccc

SEQ ID NO: 7350586 - DNA, 22 bp, Homo sapiens
ggtgaaggcacaagagggcaag

SEQ ID NO: 7350587 - DNA, 22 bp, Homo sapiens
ggtgaaggcacaagagggcaag

SEQ ID NO: 7350588 - DNA, 22 bp, Homo sapiens
ggtgaagcgtatttgtggagct

SEQ ID NO: 7350589 - DNA, 22 bp, Homo sapiens
ggtcttctctatgagctggtct

SEQ ID NO: 7350590 - DNA, 22 bp, Homo sapiens
ggtcttgaaggacatccagtcc

SEQ ID NO: 7350591 - DNA, 22 bp, Homo sapiens
ggtgggaggcaggctgctccca

SEQ ID NO: 7350592 - DNA, 22 bp, Homo sapiens
ggtgggcaacatttggcctgag

SEQ ID NO: 7350593 - DNA, 22 bp, Homo sapiens
ggtgccagagtggcccaggggc

SEQ ID NO: 7350594 - DNA, 22 bp, Homo sapiens
ggtgccagatgaggcccgcgat

SEQ ID NO: 7350595 - DNA, 22 bp, Homo sapiens
ggtgccagcctagtgcagtggt

SEQ ID NO: 7350596 - DNA, 22 bp, Homo sapiens
ggtgccaggctgtagtcagggt

SEQ ID NO: 7350597 - DNA, 22 bp, Homo sapiens
ggtgcgggccgcctgcccttgg

SEQ ID NO: 7350598 - DNA, 22 bp, Homo sapiens
ggtgctattcctatacagcatt

SEQ ID NO: 7350599 - DNA, 22 bp, Homo sapiens
ggtgcctgtatttggggcacag

SEQ ID NO: 7350600 - DNA, 22 bp, Homo sapiens
ggcgggtgtaagtaggacagcg

SEQ ID NO: 7350601 - DNA, 18 bp, Homo sapiens
ggcgggtgttttattcac

SEQ ID NO: 7350602 - DNA, 19 bp, Homo sapiens
ggcgggtggactggagccc

SEQ ID NO: 7350603 - DNA, 22 bp, Homo sapiens
ggcgggtggcgaggcttctcgg

SEQ ID NO: 7350604 - DNA, 22 bp, Homo sapiens
ggcgggggtccaggagcctgca

SEQ ID NO: 7350605 - DNA, 22 bp, Homo sapiens
ggcgggggtccaggagcctgca

SEQ ID NO: 7350606 - DNA, 22 bp, Homo sapiens
ggcgggtgataggatgagcagg

SEQ ID NO: 7350607 - DNA, 22 bp, Homo sapiens
ggcggggtctgagcgccgcgcc

SEQ ID NO: 7350608 - DNA, 22 bp, Homo sapiens
ggcctggacaaatgcaccaagg

SEQ ID NO: 7350609 - DNA, 22 bp, Homo sapiens
ggcctgcctcacagtcagcacc

SEQ ID NO: 7350610 - DNA, 22 bp, Homo sapiens
ggccctgggatgctcagcagtg

SEQ ID NO: 7350611 - DNA, 22 bp, Homo sapiens
ggccctgggcagaggagtgggc

SEQ ID NO: 7350612 - DNA, 22 bp, Homo sapiens
ggcctcacccatcggtgccttt

SEQ ID NO: 7350613 - DNA, 23 bp, Homo sapiens
ggcctaacagaggcagggctgag

SEQ ID NO: 7350614 - DNA, 22 bp, Homo sapiens
ggccaggcactgtgtgagatat

SEQ ID NO: 7350615 - DNA, 22 bp, Homo sapiens
ggccaggccaagagggttggaa

SEQ ID NO: 7350616 - DNA, 22 bp, Homo sapiens
ggccctgctgagtggagtggag

SEQ ID NO: 7350617 - DNA, 22 bp, Homo sapiens
ggccctgctgaagccgggtcta

SEQ ID NO: 7350618 - DNA, 22 bp, Homo sapiens
ggccctgctcaggctgcgatga

SEQ ID NO: 7350619 - DNA, 22 bp, Homo sapiens
ggccaggagatggacaccacat

SEQ ID NO: 7350620 - DNA, 22 bp, Homo sapiens
ggccaggagcagaatcgcctgc

SEQ ID NO: 7350621 - DNA, 22 bp, Homo sapiens
ggccaggaggcaggggctcaat

SEQ ID NO: 7350622 - DNA, 22 bp, Homo sapiens
ggccaggagctgcacagggctc

SEQ ID NO: 7350623 - DNA, 22 bp, Homo sapiens
ggccaggagctgcacagggctc

SEQ ID NO: 7350624 - DNA, 22 bp, Homo sapiens
ggcagggtccacacctgggaaa

SEQ ID NO: 7350625 - DNA, 22 bp, Homo sapiens
ggcaggggtggccttcctttgg

SEQ ID NO: 7350626 - DNA, 22 bp, Homo sapiens
ggcaggggtgaggccactctga

SEQ ID NO: 7350627 - DNA, 18 bp, Homo sapiens
ggcaggggtgaaccacag

SEQ ID NO: 7350628 - DNA, 18 bp, Homo sapiens
ggcaggggtgaaccacag

SEQ ID NO: 7350629 - DNA, 22 bp, Homo sapiens
ggcaggagctctccagtttgcc

SEQ ID NO: 7350630 - DNA, 22 bp, Homo sapiens
ggcaggagaatggcgtgaactc

SEQ ID NO: 7350631 - DNA, 22 bp, Homo sapiens
ggcaggagaatggcgtgaactc

SEQ ID NO: 7350632 - DNA, 18 bp, Homo sapiens
ggcaggagcaagaatagg

SEQ ID NO: 7350633 - DNA, 22 bp, Homo sapiens
ggcaggtgacggggatgagtat

SEQ ID NO: 7350634 - DNA, 22 bp, Homo sapiens
ggcagtgggtggatctcaggga

SEQ ID NO: 7350635 - DNA, 17 bp, Homo sapiens
ggcaggtgacagacacc

SEQ ID NO: 7350636 - DNA, 22 bp, Homo sapiens
ggcaggtgacctggcctcccag

SEQ ID NO: 7350637 - DNA, 22 bp, Homo sapiens
ggcaggtagcctagaggaggtt

SEQ ID NO: 7350638 - DNA, 17 bp, Homo sapiens
ggcagggtgctgggtat

SEQ ID NO: 7350639 - DNA, 22 bp, Homo sapiens
ggcagggtggcagaggctcaga

SEQ ID NO: 7350640 - DNA, 22 bp, Homo sapiens
ggcagggtggccctccagtgag

SEQ ID NO: 7350641 - DNA, 22 bp, Homo sapiens
ggcagggtggccctccagtgag

SEQ ID NO: 7350642 - DNA, 22 bp, Homo sapiens
ggcaggtactggggagtgaaga

SEQ ID NO: 7350643 - DNA, 19 bp, Homo sapiens
ggcaggtagagggccagtc

SEQ ID NO: 7350644 - DNA, 22 bp, Homo sapiens
ggcaggtacagcaagaggacaa

SEQ ID NO: 7350645 - DNA, 21 bp, Homo sapiens
ggcatgagggcagtgagcaga

SEQ ID NO: 7350646 - DNA, 22 bp, Homo sapiens
ggcagtggtgggaggctcgctc

SEQ ID NO: 7350647 - DNA, 22 bp, Homo sapiens
ggcatccaaataccaagatgta

SEQ ID NO: 7350648 - DNA, 22 bp, Homo sapiens
ggccaggaacttttgggatggg

SEQ ID NO: 7350649 - DNA, 22 bp, Homo sapiens
ggccagcttctctgctgcctgt

SEQ ID NO: 7350650 - DNA, 19 bp, Homo sapiens
ggccagctgtctcctgcta

SEQ ID NO: 7350651 - DNA, 22 bp, Homo sapiens
ggccagctgtggggccgagcct

SEQ ID NO: 7350652 - DNA, 22 bp, Homo sapiens
ggcatgcatcaccacgccacgc

SEQ ID NO: 7350653 - DNA, 22 bp, Homo sapiens
ggcatgcaaagccccttacaga

SEQ ID NO: 7350654 - DNA, 22 bp, Homo sapiens
ggcatgagtaacgtgagtgagg

SEQ ID NO: 7350655 - DNA, 22 bp, Homo sapiens
ggcatgctcaggcttcttgctg

SEQ ID NO: 7350656 - DNA, 22 bp, Homo sapiens
ggcatgctgtaggcattcagta

SEQ ID NO: 7350657 - DNA, 22 bp, Homo sapiens
ggatgctgactttggagcatgg

SEQ ID NO: 7350658 - DNA, 18 bp, Homo sapiens
ggatgctgtgtgctcctt

SEQ ID NO: 7350659 - DNA, 22 bp, Homo sapiens
ggatgcaggaacacagcgacct

SEQ ID NO: 7350660 - DNA, 22 bp, Homo sapiens
ggatgaggtagatgaacaaggg

SEQ ID NO: 7350661 - DNA, 22 bp, Homo sapiens
ggatgcaggggcagcagagcct

SEQ ID NO: 7350662 - DNA, 22 bp, Homo sapiens
ggatggccttcttgctcaggaa

SEQ ID NO: 7350663 - DNA, 22 bp, Homo sapiens
ggatggccttcttgctcaggaa

SEQ ID NO: 7350664 - DNA, 22 bp, Homo sapiens
ggagcagagcatttcacagcct

SEQ ID NO: 7350665 - DNA, 22 bp, Homo sapiens
ggagcagagctcttcatctgca

SEQ ID NO: 7350666 - DNA, 22 bp, Homo sapiens
ggagttgattttggatatatta

SEQ ID NO: 7350667 - DNA, 22 bp, Homo sapiens
ggagttggaggctccagggaac

SEQ ID NO: 7350668 - DNA, 22 bp, Homo sapiens
ggagcagagctgggcttggctg

SEQ ID NO: 7350669 - DNA, 22 bp, Homo sapiens
ggagatggtggaagctggtgca

SEQ ID NO: 7350670 - DNA, 22 bp, Homo sapiens
ggagcaaatgccaagtgggagg

SEQ ID NO: 7350671 - DNA, 22 bp, Homo sapiens
ggagatggctggcaggtagatg

SEQ ID NO: 7350672 - DNA, 21 bp, Homo sapiens
ggagatgggtatcgcctgggc

SEQ ID NO: 7350673 - DNA, 22 bp, Homo sapiens
ggagatggcaagaagttattag

SEQ ID NO: 7350674 - DNA, 22 bp, Homo sapiens
ggatttcttccttcctcagaag

SEQ ID NO: 7350675 - DNA, 22 bp, Homo sapiens
ggcactgccccctgcccaggac

SEQ ID NO: 7350676 - DNA, 21 bp, Homo sapiens
ggcactgctgggccatctgct

SEQ ID NO: 7350677 - DNA, 21 bp, Homo sapiens
ggcagaagtagcatggacggg

SEQ ID NO: 7350678 - DNA, 22 bp, Homo sapiens
ggcagcagcaaggttggagctg

SEQ ID NO: 7350679 - DNA, 22 bp, Homo sapiens
ggcagcagtccatggcccaagg

SEQ ID NO: 7350680 - DNA, 22 bp, Homo sapiens
ggcagcagggtctagattgatg

SEQ ID NO: 7350681 - DNA, 22 bp, Homo sapiens
ggcagccagtagggccagcctg

SEQ ID NO: 7350682 - DNA, 22 bp, Homo sapiens
ggcagccatactcagacctggg

SEQ ID NO: 7350683 - DNA, 22 bp, Homo sapiens
ggcagctgtttgtcctcctgtt

SEQ ID NO: 7350684 - DNA, 22 bp, Homo sapiens
gggaggtgatggcaagcagcgg

SEQ ID NO: 7350685 - DNA, 22 bp, Homo sapiens
gggaggtgaaaggttgctgcag

SEQ ID NO: 7350686 - DNA, 22 bp, Homo sapiens
gggagggccaggctcacccagg

SEQ ID NO: 7350687 - DNA, 22 bp, Homo sapiens
gggagggatctgctaggcaatg

SEQ ID NO: 7350688 - DNA, 22 bp, Homo sapiens
gggagggattagttctgcctgg

SEQ ID NO: 7350689 - DNA, 21 bp, Homo sapiens
gggagggatggaaatgatgtt

SEQ ID NO: 7350690 - DNA, 22 bp, Homo sapiens
gggaggtgttctgccaacgcgg

SEQ ID NO: 7350691 - DNA, 22 bp, Homo sapiens
gggaggtgttctgccaacgcgg

SEQ ID NO: 7350692 - DNA, 22 bp, Homo sapiens
gggaggttctgttcgcacttga

SEQ ID NO: 7350693 - DNA, 22 bp, Homo sapiens
gggagggaggtgatgcttggct

SEQ ID NO: 7350694 - DNA, 22 bp, Homo sapiens
gggagggagaggacagttctat

SEQ ID NO: 7350695 - DNA, 16 bp, Homo sapiens
gggagggagttggtgg

SEQ ID NO: 7350696 - DNA, 22 bp, Homo sapiens
gggagggaggtgctggttcacg

SEQ ID NO: 7350697 - DNA, 22 bp, Homo sapiens
gggagggacacaaagagttccc

SEQ ID NO: 7350698 - DNA, 22 bp, Homo sapiens
gggagctggagttgtgttgcct

SEQ ID NO: 7350699 - DNA, 22 bp, Homo sapiens
gggcagtgacaaaggggatgaa

SEQ ID NO: 7350700 - DNA, 22 bp, Homo sapiens
gggcagtgacaaaggggatgaa

SEQ ID NO: 7350701 - DNA, 22 bp, Homo sapiens
gggcagtgacaaaggggatgaa

SEQ ID NO: 7350702 - DNA, 22 bp, Homo sapiens
gggcagtgttgctctcaaagtc

SEQ ID NO: 7350703 - DNA, 22 bp, Homo sapiens
gggcagtagcttcgtaggcatc

SEQ ID NO: 7350704 - DNA, 22 bp, Homo sapiens
gggcagtcacagtgctggagca

SEQ ID NO: 7350705 - DNA, 21 bp, Homo sapiens
gggcagtctggtggctatggc

SEQ ID NO: 7350706 - DNA, 21 bp, Homo sapiens
gggcagtctggtggctatggc

SEQ ID NO: 7350707 - DNA, 22 bp, Homo sapiens
gggcagtgaatattggtgggaa

SEQ ID NO: 7350708 - DNA, 22 bp, Homo sapiens
gggcagtgaatattggtgggaa

SEQ ID NO: 7350709 - DNA, 22 bp, Homo sapiens
gggcaggttggcatcccgggca

SEQ ID NO: 7350710 - DNA, 23 bp, Homo sapiens
gggcaggtttttataggcttcag

SEQ ID NO: 7350711 - DNA, 23 bp, Homo sapiens
gggcaggtttttataggcttcag

SEQ ID NO: 7350712 - DNA, 18 bp, Homo sapiens
gggcagtaagtgtggggt

SEQ ID NO: 7350713 - DNA, 22 bp, Homo sapiens
gggcaggttattggagtaggga

SEQ ID NO: 7350714 - DNA, 22 bp, Homo sapiens
gggcaggttattggagtaggga

SEQ ID NO: 7350715 - DNA, 18 bp, Homo sapiens
gggcactggggactggag

SEQ ID NO: 7350716 - DNA, 22 bp, Homo sapiens
gggcactggcagtcggggacgc

SEQ ID NO: 7350717 - DNA, 22 bp, Homo sapiens
gggcactgctttgctctgtcac

SEQ ID NO: 7350718 - DNA, 22 bp, Homo sapiens
gggcactggaaggctctcaggc

SEQ ID NO: 7350719 - DNA, 22 bp, Homo sapiens
gggcacagtctaaagttgggcc

SEQ ID NO: 7350720 - DNA, 22 bp, Homo sapiens
gggcacagtctaaagttgggcc

SEQ ID NO: 7350721 - DNA, 22 bp, Homo sapiens
gggcacaggagaaggatctggc

SEQ ID NO: 7350722 - DNA, 22 bp, Homo sapiens
gggcactgaatgccaagctagg

SEQ ID NO: 7350723 - DNA, 22 bp, Homo sapiens
gggcactcctgatcgggacttg

SEQ ID NO: 7350724 - DNA, 22 bp, Homo sapiens
gggaagtgtggtttctttacag

SEQ ID NO: 7350725 - DNA, 23 bp, Homo sapiens
gggaagtggggatttgaagtcat

SEQ ID NO: 7350726 - DNA, 22 bp, Homo sapiens
gggaagggctccttttattgca

SEQ ID NO: 7350727 - DNA, 22 bp, Homo sapiens
gggaagggtgttgtcttatctt

SEQ ID NO: 7350728 - DNA, 22 bp, Homo sapiens
gggaagggagggcctccagtca

SEQ ID NO: 7350729 - DNA, 22 bp, Homo sapiens
gggaagggagggcctccagtca

SEQ ID NO: 7350730 - DNA, 22 bp, Homo sapiens
gggaagtgaggagcccctctgc

SEQ ID NO: 7350731 - DNA, 23 bp, Homo sapiens
gggaagtgaggagcccctctgcc

SEQ ID NO: 7350732 - DNA, 22 bp, Homo sapiens
gggaagtgatggagccaggatt

SEQ ID NO: 7350733 - DNA, 22 bp, Homo sapiens
gggagctgaggagccccgtcgg

SEQ ID NO: 7350734 - DNA, 22 bp, Homo sapiens
gggagctgacctgcaggttccc

SEQ ID NO: 7350735 - DNA, 22 bp, Homo sapiens
gggagctgagctggaagagaat

SEQ ID NO: 7350736 - DNA, 22 bp, Homo sapiens
gggaagggagctgggtatttag

SEQ ID NO: 7350737 - DNA, 22 bp, Homo sapiens
gggaagggagggacctcagtct

SEQ ID NO: 7350738 - DNA, 22 bp, Homo sapiens
gggaaggctgcctgagggatgg

SEQ ID NO: 7350739 - DNA, 22 bp, Homo sapiens
gggaagggacttgtttaaggtc

SEQ ID NO: 7350740 - DNA, 22 bp, Homo sapiens
gggaaggccttgtcagcggatt

SEQ ID NO: 7350741 - DNA, 22 bp, Homo sapiens
gggaaggccttgtcagcggatt

SEQ ID NO: 7350742 - DNA, 22 bp, Homo sapiens
ggctccccaggtccaggagctg

SEQ ID NO: 7350743 - DNA, 22 bp, Homo sapiens
ggctccctcaccaccatcacat

SEQ ID NO: 7350744 - DNA, 22 bp, Homo sapiens
ggctccctggaaatcccgaggc

SEQ ID NO: 7350745 - DNA, 22 bp, Homo sapiens
ggctccctggaaatcccgaggc

SEQ ID NO: 7350746 - DNA, 22 bp, Homo sapiens
ggctccctgcctgtcctcagtc

SEQ ID NO: 7350747 - DNA, 23 bp, Homo sapiens
ggctccaggcctgacgggcgcgg

SEQ ID NO: 7350748 - DNA, 22 bp, Homo sapiens
ggctccagtttgtgccttcagc

SEQ ID NO: 7350749 - DNA, 22 bp, Homo sapiens
ggctccagtttgtgccttcagc

SEQ ID NO: 7350750 - DNA, 22 bp, Homo sapiens
ggctcccacccatagggcgagt

SEQ ID NO: 7350751 - DNA, 22 bp, Homo sapiens
ggctccatgcctagagcaggct

SEQ ID NO: 7350752 - DNA, 22 bp, Homo sapiens
ggctacagggcctggccaaggt

SEQ ID NO: 7350753 - DNA, 23 bp, Homo sapiens
ggctagagtggaggggaactgca

SEQ ID NO: 7350754 - DNA, 23 bp, Homo sapiens
ggctagagtggaggggaactgca

SEQ ID NO: 7350755 - DNA, 22 bp, Homo sapiens
ggctagcttagagtcatgctag

SEQ ID NO: 7350756 - DNA, 22 bp, Homo sapiens
ggctacagcggggtggagacgg

SEQ ID NO: 7350757 - DNA, 22 bp, Homo sapiens
ggctacactggctatgctggct

SEQ ID NO: 7350758 - DNA, 22 bp, Homo sapiens
ggcgtggggccttctgcccgct

SEQ ID NO: 7350759 - DNA, 22 bp, Homo sapiens
ggcgtgggaagtggggcttctg

SEQ ID NO: 7350760 - DNA, 22 bp, Homo sapiens
ggcgtgggcgaggtgctctatc

SEQ ID NO: 7350761 - DNA, 22 bp, Homo sapiens
ggcggtggcgtgaaggtggctg

SEQ ID NO: 7350762 - DNA, 22 bp, Homo sapiens
ggcggtggttgagaggacggcg

SEQ ID NO: 7350763 - DNA, 22 bp, Homo sapiens
ggctctggttgaccatgatggc

SEQ ID NO: 7350764 - DNA, 22 bp, Homo sapiens
ggctctggtgtgaagcagcctc

SEQ ID NO: 7350765 - DNA, 22 bp, Homo sapiens
ggctcttctacttcagatgggg

SEQ ID NO: 7350766 - DNA, 22 bp, Homo sapiens
ggctcctgaggaccaggcacag

SEQ ID NO: 7350767 - DNA, 22 bp, Homo sapiens
ggctcctgataggagaatgcgg

SEQ ID NO: 7350768 - DNA, 22 bp, Homo sapiens
ggctcctgagaatgggccatca

SEQ ID NO: 7350769 - DNA, 22 bp, Homo sapiens
ggctcctgaaagactatgggaa

SEQ ID NO: 7350770 - DNA, 22 bp, Homo sapiens
ggctcctccaagcaactctcag

SEQ ID NO: 7350771 - DNA, 22 bp, Homo sapiens
ggctctgggccagagttggctt

SEQ ID NO: 7350772 - DNA, 22 bp, Homo sapiens
ggctctggggttggcccatctc

SEQ ID NO: 7350773 - DNA, 22 bp, Homo sapiens
ggctgggtttgactcctggctt

SEQ ID NO: 7350774 - DNA, 22 bp, Homo sapiens
ggctgtgccctcacatggggca

SEQ ID NO: 7350775 - DNA, 23 bp, Homo sapiens
ggctgtgcagcctgcggcaaaag

SEQ ID NO: 7350776 - DNA, 22 bp, Homo sapiens
ggctggtggggaaagaggacca

SEQ ID NO: 7350777 - DNA, 22 bp, Homo sapiens
ggctgtgacccccacaggggtg

SEQ ID NO: 7350778 - DNA, 22 bp, Homo sapiens
ggctgtgacaaggctgcgggaa

SEQ ID NO: 7350779 - DNA, 21 bp, Homo sapiens
ggctgtgacgctgctccacag

SEQ ID NO: 7350780 - DNA, 22 bp, Homo sapiens
ggctgtgattggtggatgtgaa

SEQ ID NO: 7350781 - DNA, 22 bp, Homo sapiens
ggctgggtaccctgtttcccct

SEQ ID NO: 7350782 - DNA, 22 bp, Homo sapiens
ggctgggctgctgggtcagagc

SEQ ID NO: 7350783 - DNA, 22 bp, Homo sapiens
ggctggactttttgcaggtcat

SEQ ID NO: 7350784 - DNA, 19 bp, Homo sapiens
ggctggagaaaggaatcag

SEQ ID NO: 7350785 - DNA, 22 bp, Homo sapiens
ggctgagggtcccagaccctaa

SEQ ID NO: 7350786 - DNA, 22 bp, Homo sapiens
ggctgagggtatagctgtccca

SEQ ID NO: 7350787 - DNA, 22 bp, Homo sapiens
ggctgaggggcccagaggaaca

SEQ ID NO: 7350788 - DNA, 22 bp, Homo sapiens
ggctgagggccagggctagtct

SEQ ID NO: 7350789 - DNA, 22 bp, Homo sapiens
ggctgcttggacaccttaaatc

SEQ ID NO: 7350790 - DNA, 20 bp, Homo sapiens
ggctgctgtgggcagagagg

SEQ ID NO: 7350791 - DNA, 22 bp, Homo sapiens
ggctgctgtttcagagactgtt

SEQ ID NO: 7350792 - DNA, 20 bp, Homo sapiens
ggctgctgtgggcagagagg

SEQ ID NO: 7350793 - DNA, 20 bp, Homo sapiens
ggctgctgtgggcagagagg

SEQ ID NO: 7350794 - DNA, 20 bp, Homo sapiens
ggctgctgtgggcagagagg

SEQ ID NO: 7350795 - DNA, 22 bp, Homo sapiens
ggctgctgtttcagagactgtt

SEQ ID NO: 7350796 - DNA, 22 bp, Homo sapiens
ggctgctgtttcagagactgtt

SEQ ID NO: 7350797 - DNA, 18 bp, Homo sapiens
ggctgcttaaggagatcc

SEQ ID NO: 7350798 - DNA, 22 bp, Homo sapiens
ggctgctggggacgtgggagag

SEQ ID NO: 7350799 - DNA, 22 bp, Homo sapiens
ggctgctggggacgtgggagag

SEQ ID NO: 7350800 - DNA, 22 bp, Homo sapiens
ggagaggagctattgggggctc

SEQ ID NO: 7350801 - DNA, 22 bp, Homo sapiens
ggagaggagctattgggggctc

SEQ ID NO: 7350802 - DNA, 22 bp, Homo sapiens
ggagaggagctattgggggctc

SEQ ID NO: 7350803 - DNA, 22 bp, Homo sapiens
ggagaggcttccagagtcgtgc

SEQ ID NO: 7350804 - DNA, 19 bp, Homo sapiens
ggagaggctggagggatgc

SEQ ID NO: 7350805 - DNA, 19 bp, Homo sapiens
ggagaggctggagggatgc

SEQ ID NO: 7350806 - DNA, 19 bp, Homo sapiens
ggagaggctggagggatgc

SEQ ID NO: 7350807 - DNA, 22 bp, Homo sapiens
ggagagcttggagtgcgatttt

SEQ ID NO: 7350808 - DNA, 22 bp, Homo sapiens
ggagaggaaatgccagcacttc

SEQ ID NO: 7350809 - DNA, 22 bp, Homo sapiens
ggagaggaaatgccagcacttc

SEQ ID NO: 7350810 - DNA, 22 bp, Homo sapiens
ggagaggaaatgccagcacttc

SEQ ID NO: 7350811 - DNA, 22 bp, Homo sapiens
ggagaggacatggctcccacag

SEQ ID NO: 7350812 - DNA, 22 bp, Homo sapiens
ggactctgttttcctgatcact

SEQ ID NO: 7350813 - DNA, 22 bp, Homo sapiens
ggactctgttttcctgatcact

SEQ ID NO: 7350814 - DNA, 22 bp, Homo sapiens
ggactgcaacaggcttattcaa

SEQ ID NO: 7350815 - DNA, 22 bp, Homo sapiens
ggagagaggagcccactgctgt

SEQ ID NO: 7350816 - DNA, 22 bp, Homo sapiens
ggagagctggtagctggctcca

SEQ ID NO: 7350817 - DNA, 22 bp, Homo sapiens
ggactctggtatttcactcttg

SEQ ID NO: 7350818 - DNA, 22 bp, Homo sapiens
ggacggggagctggaaagggga

SEQ ID NO: 7350819 - DNA, 22 bp, Homo sapiens
ggacggggagctggaaagggga

SEQ ID NO: 7350820 - DNA, 22 bp, Homo sapiens
ggacctgccagaactcaggcta

SEQ ID NO: 7350821 - DNA, 22 bp, Homo sapiens
ggacgcagcgagggaagcagcc

SEQ ID NO: 7350822 - DNA, 22 bp, Homo sapiens
ggacgcagccgagggagcaggg

SEQ ID NO: 7350823 - DNA, 22 bp, Homo sapiens
ggacccaccaggccgggctcca

SEQ ID NO: 7350824 - DNA, 21 bp, Homo sapiens
ggacagaggagaaggcaccct

SEQ ID NO: 7350825 - DNA, 23 bp, Homo sapiens
ggacccacggtctttgaggctct

SEQ ID NO: 7350826 - DNA, 23 bp, Homo sapiens
ggacactgtgcagatgctagtgc

SEQ ID NO: 7350827 - DNA, 22 bp, Homo sapiens
ggacagagccctggtggcctaa

SEQ ID NO: 7350828 - DNA, 22 bp, Homo sapiens
ggacagagcagacgagcagcgg

SEQ ID NO: 7350829 - DNA, 22 bp, Homo sapiens
ggacagagcagacgagcagcgg

SEQ ID NO: 7350830 - DNA, 22 bp, Homo sapiens
ggacagagcagacgagcagcgg

SEQ ID NO: 7350831 - DNA, 22 bp, Homo sapiens
ggacagagcagacgagcagcgg

SEQ ID NO: 7350832 - DNA, 22 bp, Homo sapiens
ggacagagccctggtggcctaa

SEQ ID NO: 7350833 - DNA, 22 bp, Homo sapiens
ggacagacagtgtgagtgaggc

SEQ ID NO: 7350834 - DNA, 22 bp, Homo sapiens
ggacagagagtgaatatgacat

SEQ ID NO: 7350835 - DNA, 22 bp, Homo sapiens
ggaaaggctaacagtcatggaa

SEQ ID NO: 7350836 - DNA, 22 bp, Homo sapiens
ggaaagggagttttgcttatga

SEQ ID NO: 7350837 - DNA, 22 bp, Homo sapiens
ggaaagggcagaggccttggag

SEQ ID NO: 7350838 - DNA, 22 bp, Homo sapiens
ggaaagggcagaggccttggag

SEQ ID NO: 7350839 - DNA, 22 bp, Homo sapiens
ggaaaggggcctggatcttttg

SEQ ID NO: 7350840 - DNA, 22 bp, Homo sapiens
ggaaagggcatggccttttcac

SEQ ID NO: 7350841 - DNA, 22 bp, Homo sapiens
ggaaagtggtggtggaaagagg

SEQ ID NO: 7350842 - DNA, 22 bp, Homo sapiens
ggaaatattttgtctaatttgt

SEQ ID NO: 7350843 - DNA, 22 bp, Homo sapiens
ggaaatataagcagtttgtgtg

SEQ ID NO: 7350844 - DNA, 22 bp, Homo sapiens
ggaaatatcttgtactatgtga

SEQ ID NO: 7350845 - DNA, 22 bp, Homo sapiens
gcttcctccctgctgctcacta

SEQ ID NO: 7350846 - DNA, 22 bp, Homo sapiens
gcttcctccctgctgctcacta

SEQ ID NO: 7350847 - DNA, 22 bp, Homo sapiens
gcttccggagccaaaaggcccc

SEQ ID NO: 7350848 - DNA, 22 bp, Homo sapiens
gcttcctcaccttctcttgcat

SEQ ID NO: 7350849 - DNA, 19 bp, Homo sapiens
gcttcccaccagccagccc

SEQ ID NO: 7350850 - DNA, 18 bp, Homo sapiens
ggaaggaagaatgcattt

SEQ ID NO: 7350851 - DNA, 22 bp, Homo sapiens
ggaaggaaagcagcttggccct

SEQ ID NO: 7350852 - DNA, 22 bp, Homo sapiens
ggaaggaacaaaccctgtgtgg

SEQ ID NO: 7350853 - DNA, 22 bp, Homo sapiens
ggaaggaaattggggcagttgt

SEQ ID NO: 7350854 - DNA, 22 bp, Homo sapiens
ggaaggaagattctaactggag

SEQ ID NO: 7350855 - DNA, 22 bp, Homo sapiens
ggaaggaagaggaccgagctgg

SEQ ID NO: 7350856 - DNA, 22 bp, Homo sapiens
ggaaggaagtaaatgatgctat

SEQ ID NO: 7350857 - DNA, 22 bp, Homo sapiens
ggaagcaggaggctggggtaaa

SEQ ID NO: 7350858 - DNA, 21 bp, Homo sapiens
ggaagcagtggcggcaactcc

SEQ ID NO: 7350859 - DNA, 22 bp, Homo sapiens
ggaacagtagacgatctccttt

SEQ ID NO: 7350860 - DNA, 22 bp, Homo sapiens
gctgggtgtcacggggctcgtg

SEQ ID NO: 7350861 - DNA, 19 bp, Homo sapiens
gctgggtggggtccacagc

SEQ ID NO: 7350862 - DNA, 22 bp, Homo sapiens
gctgggaggatctctccctgtc

SEQ ID NO: 7350863 - DNA, 22 bp, Homo sapiens
gctggggctgggctgaggaaga

SEQ ID NO: 7350864 - DNA, 22 bp, Homo sapiens
gctggggtctgtgaggagggct

SEQ ID NO: 7350865 - DNA, 20 bp, Homo sapiens
gctgggggtgtgctgagtga

SEQ ID NO: 7350866 - DNA, 20 bp, Homo sapiens
gctgggggtgtgctgagtga

SEQ ID NO: 7350867 - DNA, 22 bp, Homo sapiens
gctgtgcattgagcctgagagt

SEQ ID NO: 7350868 - DNA, 22 bp, Homo sapiens
gctgtgatccttgagagaaggt

SEQ ID NO: 7350869 - DNA, 22 bp, Homo sapiens
gctggctcccattggtccttcc

SEQ ID NO: 7350870 - DNA, 22 bp, Homo sapiens
gctggcaatggtgtggtctggt

SEQ ID NO: 7350871 - DNA, 22 bp, Homo sapiens
gctggcacatggctcagggcct

SEQ ID NO: 7350872 - DNA, 22 bp, Homo sapiens
gctggcactgggaaggactgag

SEQ ID NO: 7350873 - DNA, 22 bp, Homo sapiens
gctgggacaggcttggccctgt

SEQ ID NO: 7350874 - DNA, 22 bp, Homo sapiens
gctgggaagaacaggagagaat

SEQ ID NO: 7350875 - DNA, 22 bp, Homo sapiens
gctggctctgatgggctccagg

SEQ ID NO: 7350876 - DNA, 22 bp, Homo sapiens
gcctggtgaaaggcagagagcg

SEQ ID NO: 7350877 - DNA, 22 bp, Homo sapiens
gcctggtgataagcagtgacct

SEQ ID NO: 7350878 - DNA, 22 bp, Homo sapiens
gcctggggcatgcagctgatac

SEQ ID NO: 7350879 - DNA, 22 bp, Homo sapiens
gcctggggccagcttgggctga

SEQ ID NO: 7350880 - DNA, 22 bp, Homo sapiens
gcctggggccagcttgggctga

SEQ ID NO: 7350881 - DNA, 22 bp, Homo sapiens
gcctggggaacttgatcctgtc

SEQ ID NO: 7350882 - DNA, 22 bp, Homo sapiens
gcctggggtcccttgttggcac

SEQ ID NO: 7350883 - DNA, 22 bp, Homo sapiens
gcctggggtctctgactcacag

SEQ ID NO: 7350884 - DNA, 22 bp, Homo sapiens
gcctggggtctctgactcacag

SEQ ID NO: 7350885 - DNA, 22 bp, Homo sapiens
gcctggggggcatgtcataata

SEQ ID NO: 7350886 - DNA, 22 bp, Homo sapiens
gcctggggggcatgtcataata

SEQ ID NO: 7350887 - DNA, 22 bp, Homo sapiens
gcctggggtcccttgttggcac

SEQ ID NO: 7350888 - DNA, 22 bp, Homo sapiens
gcctggtgtccagaggcgagtg

SEQ ID NO: 7350889 - DNA, 22 bp, Homo sapiens
gcctggtggtgtgctcaagtgg

SEQ ID NO: 7350890 - DNA, 22 bp, Homo sapiens
gccttcaggtgctgccaggcta

SEQ ID NO: 7350891 - DNA, 22 bp, Homo sapiens
gccttcaggagggttccagaca

SEQ ID NO: 7350892 - DNA, 22 bp, Homo sapiens
gcctggctgggctgaatgctta

SEQ ID NO: 7350893 - DNA, 22 bp, Homo sapiens
gcctggctgtctggcaaggttc

SEQ ID NO: 7350894 - DNA, 21 bp, Homo sapiens
gcctggcttcacaggcactga

SEQ ID NO: 7350895 - DNA, 22 bp, Homo sapiens
gcctggcttcccttggagcatt

SEQ ID NO: 7350896 - DNA, 22 bp, Homo sapiens
gcctggctgccggccttggcaa

SEQ ID NO: 7350897 - DNA, 18 bp, Homo sapiens
gcctggctgccaacccag

SEQ ID NO: 7350898 - DNA, 22 bp, Homo sapiens
gcctggctgctcagccactcac

SEQ ID NO: 7350899 - DNA, 22 bp, Homo sapiens
gcctggctgctggttctgagga

SEQ ID NO: 7350900 - DNA, 22 bp, Homo sapiens
gcctggctgcttagcctacttc

SEQ ID NO: 7350901 - DNA, 22 bp, Homo sapiens
gcctcaggcctatagctgctgt

SEQ ID NO: 7350902 - DNA, 22 bp, Homo sapiens
gcctcaggcctatagctgctgt

SEQ ID NO: 7350903 - DNA, 22 bp, Homo sapiens
gcctcagggataggatgagcat

SEQ ID NO: 7350904 - DNA, 22 bp, Homo sapiens
gcctcaggcctatagctgctgt

SEQ ID NO: 7350905 - DNA, 22 bp, Homo sapiens
gcctcaggccgccctgctgctc

SEQ ID NO: 7350906 - DNA, 22 bp, Homo sapiens
gcctcaggcctatagctgctgt

SEQ ID NO: 7350907 - DNA, 22 bp, Homo sapiens
gcctcaggccgccctgctgctc

SEQ ID NO: 7350908 - DNA, 21 bp, Homo sapiens
gcctggctagaagctcctagc

SEQ ID NO: 7350909 - DNA, 22 bp, Homo sapiens
gcctcagggggagaggccagct

SEQ ID NO: 7350910 - DNA, 22 bp, Homo sapiens
gcctcagggataggatgagcat

SEQ ID NO: 7350911 - DNA, 22 bp, Homo sapiens
gcgccctccacccacagcggct

SEQ ID NO: 7350912 - DNA, 22 bp, Homo sapiens
gcgcctgccaccatgccaggct

SEQ ID NO: 7350913 - DNA, 22 bp, Homo sapiens
gcgcgctgagtgtccgttgggg

SEQ ID NO: 7350914 - DNA, 22 bp, Homo sapiens
gcgaaaaatgtgtaaatatgtt

SEQ ID NO: 7350915 - DNA, 22 bp, Homo sapiens
gcgaatctcagctggtgctgcg

SEQ ID NO: 7350916 - DNA, 22 bp, Homo sapiens
gccttttgatctataactgtgt

SEQ ID NO: 7350917 - DNA, 22 bp, Homo sapiens
gccttttgaaatagaaatctga

SEQ ID NO: 7350918 - DNA, 22 bp, Homo sapiens
gccttgccaaggggcagcagag

SEQ ID NO: 7350919 - DNA, 22 bp, Homo sapiens
gccttgcaggaaggagggacag

SEQ ID NO: 7350920 - DNA, 22 bp, Homo sapiens
gccttctctgtgagctcctagg

SEQ ID NO: 7350921 - DNA, 17 bp, Homo sapiens
gccttctctgccctcac

SEQ ID NO: 7350922 - DNA, 22 bp, Homo sapiens
gcggcccgagcaggacgggtgg

SEQ ID NO: 7350923 - DNA, 22 bp, Homo sapiens
gcggcccgggtccccagcagca

SEQ ID NO: 7350924 - DNA, 22 bp, Homo sapiens
gcggcaggagtaaaggaggaag

SEQ ID NO: 7350925 - DNA, 22 bp, Homo sapiens
gcggcggagacagcaggaagcc

SEQ ID NO: 7350926 - DNA, 18 bp, Homo sapiens
gcgggcggtgcagtgggc

SEQ ID NO: 7350927 - DNA, 22 bp, Homo sapiens
gcgggcgggggttcccaggtct

SEQ ID NO: 7350928 - DNA, 18 bp, Homo sapiens
gcgggcggtgcagtgggc

SEQ ID NO: 7350929 - DNA, 22 bp, Homo sapiens
gcgggccggttcgatccgtatg

SEQ ID NO: 7350930 - DNA, 22 bp, Homo sapiens
gcgggccaccttggagagcgct

SEQ ID NO: 7350931 - DNA, 22 bp, Homo sapiens
gcggaggaaactgaggcaagag

SEQ ID NO: 7350932 - DNA, 22 bp, Homo sapiens
gcggaggaaactgaggcaagag

SEQ ID NO: 7350933 - DNA, 22 bp, Homo sapiens
gcggagggagataggccttgct

SEQ ID NO: 7350934 - DNA, 22 bp, Homo sapiens
gcggagggcgagcccgcggagc

SEQ ID NO: 7350935 - DNA, 22 bp, Homo sapiens
gcggaggtgaggaagtggggca

SEQ ID NO: 7350936 - DNA, 22 bp, Homo sapiens
gcggcagaggtgttgcgagcga

SEQ ID NO: 7350937 - DNA, 22 bp, Homo sapiens
gcgcgtcctccctcggctgctg

SEQ ID NO: 7350938 - DNA, 22 bp, Homo sapiens
gcgcggggtacacgcggtggcc

SEQ ID NO: 7350939 - DNA, 22 bp, Homo sapiens
gcgcggggtacacgcggtggcc

SEQ ID NO: 7350940 - DNA, 22 bp, Homo sapiens
gcgctctgtctcaggggtccag

SEQ ID NO: 7350941 - DNA, 22 bp, Homo sapiens
gcgctcctcccggccctggtgg

SEQ ID NO: 7350942 - DNA, 22 bp, Homo sapiens
gcgctgcctctgctctccccac

SEQ ID NO: 7350943 - DNA, 22 bp, Homo sapiens
gcgctgaggctggaggcgcacg

SEQ ID NO: 7350944 - DNA, 22 bp, Homo sapiens
gcgctgcgcctcctcttccgca

SEQ ID NO: 7350945 - DNA, 22 bp, Homo sapiens
gctcacagccggctggcagggg

SEQ ID NO: 7350946 - DNA, 22 bp, Homo sapiens
gctcacagaacttctcttccca

SEQ ID NO: 7350947 - DNA, 22 bp, Homo sapiens
gctcacagcccaggccagcgtg

SEQ ID NO: 7350948 - DNA, 22 bp, Homo sapiens
gctcacaggtctgtggctattg

SEQ ID NO: 7350949 - DNA, 23 bp, Homo sapiens
gctcacagggtgtaactcctagt

SEQ ID NO: 7350950 - DNA, 22 bp, Homo sapiens
gctcacaggtctgtggctattg

SEQ ID NO: 7350951 - DNA, 22 bp, Homo sapiens
gctcacagtacagtgctggctc

SEQ ID NO: 7350952 - DNA, 22 bp, Homo sapiens
gctcacagtctgctgagtgcag

SEQ ID NO: 7350953 - DNA, 22 bp, Homo sapiens
gctcacaggtctgtggctattg

SEQ ID NO: 7350954 - DNA, 22 bp, Homo sapiens
gctcacagttctatttttcatg

SEQ ID NO: 7350955 - DNA, 22 bp, Homo sapiens
gctcaggcccagcggctggtgt

SEQ ID NO: 7350956 - DNA, 23 bp, Homo sapiens
gctcaggcatcattcttcctggc

SEQ ID NO: 7350957 - DNA, 22 bp, Homo sapiens
gctcaagggatgggagtgggtg

SEQ ID NO: 7350958 - DNA, 22 bp, Homo sapiens
gctcaaggcaggcagacatgag

SEQ ID NO: 7350959 - DNA, 22 bp, Homo sapiens
gctcaagatgtggcctctgaag

SEQ ID NO: 7350960 - DNA, 20 bp, Homo sapiens
gctcaagagcccattctgaa

SEQ ID NO: 7350961 - DNA, 22 bp, Homo sapiens
gcggggggaggaacatcttgca

SEQ ID NO: 7350962 - DNA, 22 bp, Homo sapiens
gcggggggaggaacatcttgca

SEQ ID NO: 7350963 - DNA, 22 bp, Homo sapiens
gctatctttctgcaccataatt

SEQ ID NO: 7350964 - DNA, 22 bp, Homo sapiens
gctatcttcctcaatgtcagct

SEQ ID NO: 7350965 - DNA, 22 bp, Homo sapiens
gctatcttcatggaaatacagg

SEQ ID NO: 7350966 - DNA, 22 bp, Homo sapiens
gctatcttcatggaaatacagg

SEQ ID NO: 7350967 - DNA, 22 bp, Homo sapiens
gcggggcccccggccgagctct

SEQ ID NO: 7350968 - DNA, 22 bp, Homo sapiens
gcggggcccccggccgagctct

SEQ ID NO: 7350969 - DNA, 22 bp, Homo sapiens
gcggggccatgtccaacggcct

SEQ ID NO: 7350970 - DNA, 22 bp, Homo sapiens
gcggggccatgtccaacggcct

SEQ ID NO: 7350971 - DNA, 22 bp, Homo sapiens
gcggggcccggacccagcctct

SEQ ID NO: 7350972 - DNA, 22 bp, Homo sapiens
gcggggcccggacccagcctct

SEQ ID NO: 7350973 - DNA, 22 bp, Homo sapiens
gcggggcctgactctgacccgc

SEQ ID NO: 7350974 - DNA, 22 bp, Homo sapiens
gcggggcctgactctgacccgc

SEQ ID NO: 7350975 - DNA, 22 bp, Homo sapiens
gcgggggcagactgggcagttc

SEQ ID NO: 7350976 - DNA, 22 bp, Homo sapiens
gcgggggcagactgggcagttc

SEQ ID NO: 7350977 - DNA, 22 bp, Homo sapiens
gcggggcgtgctgctgctgagg

SEQ ID NO: 7350978 - DNA, 22 bp, Homo sapiens
gcggggctttgccatgctgttt

SEQ ID NO: 7350979 - DNA, 22 bp, Homo sapiens
gcgggggcggcgcagacctcag

SEQ ID NO: 7350980 - DNA, 22 bp, Homo sapiens
gctgcaggagctggagctgtgg

SEQ ID NO: 7350981 - DNA, 22 bp, Homo sapiens
gctgcaggttgggcaacagagt

SEQ ID NO: 7350982 - DNA, 22 bp, Homo sapiens
gctgcaggttgggcaacagagt

SEQ ID NO: 7350983 - DNA, 22 bp, Homo sapiens
gctgcagggggtgggcgtctcc

SEQ ID NO: 7350984 - DNA, 22 bp, Homo sapiens
gctgcagactgggaggcaggtg

SEQ ID NO: 7350985 - DNA, 22 bp, Homo sapiens
gctgccagtagttggagctcca

SEQ ID NO: 7350986 - DNA, 22 bp, Homo sapiens
gctgccagcccagcaaggtgtg

SEQ ID NO: 7350987 - DNA, 22 bp, Homo sapiens
gctgccagcgtcagacctgggg

SEQ ID NO: 7350988 - DNA, 22 bp, Homo sapiens
gctgccagctgcggcccacgcg

SEQ ID NO: 7350989 - DNA, 22 bp, Homo sapiens
gctgccagctgcggcccacgcg

SEQ ID NO: 7350990 - DNA, 22 bp, Homo sapiens
gctgatattttgaagggcaagg

SEQ ID NO: 7350991 - DNA, 22 bp, Homo sapiens
gctgatatgattgataaaggta

SEQ ID NO: 7350992 - DNA, 22 bp, Homo sapiens
gctgatataaaattacagagga

SEQ ID NO: 7350993 - DNA, 22 bp, Homo sapiens
gctgatctcccttttctcacag

SEQ ID NO: 7350994 - DNA, 22 bp, Homo sapiens
gctgatgagagagacaaatgct

SEQ ID NO: 7350995 - DNA, 23 bp, Homo sapiens
gctgatggagacttgtggcctcc

SEQ ID NO: 7350996 - DNA, 22 bp, Homo sapiens
gctgcacatggcagaggccttt

SEQ ID NO: 7350997 - DNA, 22 bp, Homo sapiens
gctgcaatggagtcaggctggt

SEQ ID NO: 7350998 - DNA, 22 bp, Homo sapiens
gctgaaggagcctggggtggga

SEQ ID NO: 7350999 - DNA, 19 bp, Homo sapiens
gctgaaggaggtgcctgca

SEQ ID NO: 7351000 - DNA, 22 bp, Homo sapiens
gctgaaggaggctctggtacta

SEQ ID NO: 7351001 - DNA, 22 bp, Homo sapiens
gctgaaggcccggaggacaggg

SEQ ID NO: 7351002 - DNA, 22 bp, Homo sapiens
gctgaagggagtgctgagtctg

SEQ ID NO: 7351003 - DNA, 19 bp, Homo sapiens
gctgaaggcgctcagaagc

SEQ ID NO: 7351004 - DNA, 20 bp, Homo sapiens
gctgaaggggtgggtttgtt

SEQ ID NO: 7351005 - DNA, 22 bp, Homo sapiens
gctgaaggtatgagttttatct

SEQ ID NO: 7351006 - DNA, 22 bp, Homo sapiens
gctgaaggtctctggagaggtc

SEQ ID NO: 7351007 - DNA, 22 bp, Homo sapiens
gctgaaggtctctggagaggtc

SEQ ID NO: 7351008 - DNA, 22 bp, Homo sapiens
gctgaaggtctctggagaggtc

SEQ ID NO: 7351009 - DNA, 21 bp, Homo sapiens
gctgaaggtgggttgtacagg

SEQ ID NO: 7351010 - DNA, 22 bp, Homo sapiens
gctgaaggtgtgtggagagagg

SEQ ID NO: 7351011 - DNA, 22 bp, Homo sapiens
gctgaaggtggttttcaagtat

SEQ ID NO: 7351012 - DNA, 18 bp, Homo sapiens
gctcctggttggaaagaa

SEQ ID NO: 7351013 - DNA, 22 bp, Homo sapiens
gctcctggtgctgtagagattt

SEQ ID NO: 7351014 - DNA, 21 bp, Homo sapiens
gctcctggtgctgcgtggcgc

SEQ ID NO: 7351015 - DNA, 22 bp, Homo sapiens
gctcctgtccttagccccagag

SEQ ID NO: 7351016 - DNA, 22 bp, Homo sapiens
gctcagggaaagagctcctgtc

SEQ ID NO: 7351017 - DNA, 21 bp, Homo sapiens
gctcaggctcttgacagagca

SEQ ID NO: 7351018 - DNA, 22 bp, Homo sapiens
gctcaggctggattgcagtggc

SEQ ID NO: 7351019 - DNA, 22 bp, Homo sapiens
gctcctggtgcaaagtttcttc

SEQ ID NO: 7351020 - DNA, 21 bp, Homo sapiens
gctcctggtgctgcgtggcgc

SEQ ID NO: 7351021 - DNA, 21 bp, Homo sapiens
gctcctggtgctgcgtggcgc

SEQ ID NO: 7351022 - DNA, 22 bp, Homo sapiens
gctcagggaaagagctcctgtc

SEQ ID NO: 7351023 - DNA, 22 bp, Homo sapiens
gctcagggaaagagctcctgtc

SEQ ID NO: 7351024 - DNA, 18 bp, Homo sapiens
gctcaggccctagtcagt

SEQ ID NO: 7351025 - DNA, 22 bp, Homo sapiens
gctcaggcctccagaggggcaa

SEQ ID NO: 7351026 - DNA, 22 bp, Homo sapiens
gctcaggcctggcccatgggac

SEQ ID NO: 7351027 - DNA, 21 bp, Homo sapiens
gctcaggctcaggttcaggtt

SEQ ID NO: 7351028 - DNA, 22 bp, Homo sapiens
gctcaggctctcccaggggaat

SEQ ID NO: 7351029 - DNA, 22 bp, Homo sapiens
gctctgctgaagccccttgcat

SEQ ID NO: 7351030 - DNA, 22 bp, Homo sapiens
gctctgctgaagccccttgcat

SEQ ID NO: 7351031 - DNA, 22 bp, Homo sapiens
gctctgctgacagctgggacag

SEQ ID NO: 7351032 - DNA, 22 bp, Homo sapiens
gctctgctgcttactagatggt

SEQ ID NO: 7351033 - DNA, 22 bp, Homo sapiens
gctctgctgagatatctgggag

SEQ ID NO: 7351034 - DNA, 22 bp, Homo sapiens
gctctggcactggcgcgggatg

SEQ ID NO: 7351035 - DNA, 18 bp, Homo sapiens
gctctgcccaggctgccc

SEQ ID NO: 7351036 - DNA, 22 bp, Homo sapiens
gctctgcccaggaccgtccttg

SEQ ID NO: 7351037 - DNA, 22 bp, Homo sapiens
gctctgcccagtgccctgagac

SEQ ID NO: 7351038 - DNA, 22 bp, Homo sapiens
gctctccagattcaggagggat

SEQ ID NO: 7351039 - DNA, 21 bp, Homo sapiens
gctctccagggccagcccagg

SEQ ID NO: 7351040 - DNA, 22 bp, Homo sapiens
gctctgccctgggccgttgtaa

SEQ ID NO: 7351041 - DNA, 17 bp, Homo sapiens
gctctgccccagcctct

SEQ ID NO: 7351042 - DNA, 22 bp, Homo sapiens
gctctgccccaggaactcagcc

SEQ ID NO: 7351043 - DNA, 22 bp, Homo sapiens
gctctgcctctttgctgcgtca

SEQ ID NO: 7351044 - DNA, 17 bp, Homo sapiens
gctctgcctctcccacc

SEQ ID NO: 7351045 - DNA, 22 bp, Homo sapiens
gctctgcctggtcgcgtgctgg

SEQ ID NO: 7351046 - DNA, 22 bp, Homo sapiens
gctctgcgattattgggccttt

SEQ ID NO: 7351047 - DNA, 22 bp, Homo sapiens
gagggtccccatgcagagctca

SEQ ID NO: 7351048 - DNA, 22 bp, Homo sapiens
gcaagacctatctagttgctgt

SEQ ID NO: 7351049 - DNA, 22 bp, Homo sapiens
gagggggaaagtccctggagtc

SEQ ID NO: 7351050 - DNA, 22 bp, Homo sapiens
gaggggctgtggagctctctgg

SEQ ID NO: 7351051 - DNA, 22 bp, Homo sapiens
gagggggaaagtccctggagtc

SEQ ID NO: 7351052 - DNA, 22 bp, Homo sapiens
gaggggctggggttgactccaa

SEQ ID NO: 7351053 - DNA, 22 bp, Homo sapiens
gaggggctggggttgactccaa

SEQ ID NO: 7351054 - DNA, 22 bp, Homo sapiens
gaggggctgggcagtccctgga

SEQ ID NO: 7351055 - DNA, 22 bp, Homo sapiens
gaggggctgggtagggcaaccc

SEQ ID NO: 7351056 - DNA, 22 bp, Homo sapiens
gagggggcgaacagaagcaagg

SEQ ID NO: 7351057 - DNA, 22 bp, Homo sapiens
gagggggagatgtgcacacact

SEQ ID NO: 7351058 - DNA, 22 bp, Homo sapiens
gaggggtcacatgggctggctt

SEQ ID NO: 7351059 - DNA, 22 bp, Homo sapiens
gaggggtcacatgggctggctt

SEQ ID NO: 7351060 - DNA, 22 bp, Homo sapiens
gaggggtgtggagccatcagtt

SEQ ID NO: 7351061 - DNA, 22 bp, Homo sapiens
gaggggtgtggagccatcagtt

SEQ ID NO: 7351062 - DNA, 22 bp, Homo sapiens
gaggggtgggctggaagttata

SEQ ID NO: 7351063 - DNA, 22 bp, Homo sapiens
gaggggtggccctggcgtgtac

SEQ ID NO: 7351064 - DNA, 22 bp, Homo sapiens
gcacagcagtggcataaacaat

SEQ ID NO: 7351065 - DNA, 22 bp, Homo sapiens
gcacagcatgaagagaggaagc

SEQ ID NO: 7351066 - DNA, 21 bp, Homo sapiens
gcacagcatgagtgttggcat

SEQ ID NO: 7351067 - DNA, 22 bp, Homo sapiens
gcacagccagcatctgagggat

SEQ ID NO: 7351068 - DNA, 22 bp, Homo sapiens
gcacagccctgagcgcatgtct

SEQ ID NO: 7351069 - DNA, 22 bp, Homo sapiens
gcacagcctgtccctgtcctgg

SEQ ID NO: 7351070 - DNA, 22 bp, Homo sapiens
gcagaggactcaatcaaggtat

SEQ ID NO: 7351071 - DNA, 22 bp, Homo sapiens
gcagaggactcaatcaaggtat

SEQ ID NO: 7351072 - DNA, 22 bp, Homo sapiens
gcagaggacagggatttagatt

SEQ ID NO: 7351073 - DNA, 22 bp, Homo sapiens
gcagaggacacaggagggcaag

SEQ ID NO: 7351074 - DNA, 22 bp, Homo sapiens
gcagaggacacaggagggcaag

SEQ ID NO: 7351075 - DNA, 22 bp, Homo sapiens
gcagaggacacaggagggcaag

SEQ ID NO: 7351076 - DNA, 22 bp, Homo sapiens
gcagaggagcaagctggacacc

SEQ ID NO: 7351077 - DNA, 22 bp, Homo sapiens
gcagaggagcaagctggacacc

SEQ ID NO: 7351078 - DNA, 22 bp, Homo sapiens
gcagaggagatgaagatacttt

SEQ ID NO: 7351079 - DNA, 22 bp, Homo sapiens
gcagaggagatgaagatacttt

SEQ ID NO: 7351080 - DNA, 22 bp, Homo sapiens
gcagagctgagcggctgcccgg

SEQ ID NO: 7351081 - DNA, 21 bp, Homo sapiens
gcacttggaaacttcaactag

SEQ ID NO: 7351082 - DNA, 21 bp, Homo sapiens
gcagaggaatggtatacataa

SEQ ID NO: 7351083 - DNA, 22 bp, Homo sapiens
gcacttaactggaaaagaattt

SEQ ID NO: 7351084 - DNA, 22 bp, Homo sapiens
gcacttcaccactgtcctggtt

SEQ ID NO: 7351085 - DNA, 22 bp, Homo sapiens
gcactgggaatgctgatgggct

SEQ ID NO: 7351086 - DNA, 22 bp, Homo sapiens
gcactgggaatgctgatgggct

SEQ ID NO: 7351087 - DNA, 22 bp, Homo sapiens
gcactgggagtctgtgggggtt

SEQ ID NO: 7351088 - DNA, 22 bp, Homo sapiens
gcactgggagctgcctgccggt

SEQ ID NO: 7351089 - DNA, 22 bp, Homo sapiens
gcactgggaatgtgagcagctg

SEQ ID NO: 7351090 - DNA, 16 bp, Homo sapiens
gcactgggatgtcttc

SEQ ID NO: 7351091 - DNA, 22 bp, Homo sapiens
gcactgggctccaggaaggagg

SEQ ID NO: 7351092 - DNA, 22 bp, Homo sapiens
gcactctgccaggtctcctgat

SEQ ID NO: 7351093 - DNA, 22 bp, Homo sapiens
gcactgaaaatgttggattcca

SEQ ID NO: 7351094 - DNA, 22 bp, Homo sapiens
gcactgaaattatatgcatttg

SEQ ID NO: 7351095 - DNA, 22 bp, Homo sapiens
gcactgagagctttattctaga

SEQ ID NO: 7351096 - DNA, 22 bp, Homo sapiens
gcactgagagctttattctaga

SEQ ID NO: 7351097 - DNA, 22 bp, Homo sapiens
gcactgagaactgttttctaga

SEQ ID NO: 7351098 - DNA, 22 bp, Homo sapiens
gcactgagatacatttctaagg

SEQ ID NO: 7351099 - DNA, 22 bp, Homo sapiens
gcactgaatgcttttactgtaa

SEQ ID NO: 7351100 - DNA, 22 bp, Homo sapiens
gcactgaatgccaaagtgtagg

SEQ ID NO: 7351101 - DNA, 20 bp, Homo sapiens
gcactgaaggttccagggga

SEQ ID NO: 7351102 - DNA, 22 bp, Homo sapiens
gcactgaactttaatcatttct

SEQ ID NO: 7351103 - DNA, 19 bp, Homo sapiens
gcactgaagagttggtcac

SEQ ID NO: 7351104 - DNA, 17 bp, Homo sapiens
gcactgaacaatcctgt

SEQ ID NO: 7351105 - DNA, 20 bp, Homo sapiens
gcactgaaattcaatgtttg

SEQ ID NO: 7351106 - DNA, 20 bp, Homo sapiens
gcactgaaattcaatgtttg

SEQ ID NO: 7351107 - DNA, 22 bp, Homo sapiens
gcactgagtctgtcatgctgca

SEQ ID NO: 7351108 - DNA, 22 bp, Homo sapiens
gcactgagtctgtcatgctgca

SEQ ID NO: 7351109 - DNA, 22 bp, Homo sapiens
gcactgaggaaggagggagtgg

SEQ ID NO: 7351110 - DNA, 18 bp, Homo sapiens
gcactgaggaaaacctct

SEQ ID NO: 7351111 - DNA, 23 bp, Homo sapiens
gcactgagctcactagtcccctg

SEQ ID NO: 7351112 - DNA, 22 bp, Homo sapiens
gcactgagcattgttatttcca

SEQ ID NO: 7351113 - DNA, 17 bp, Homo sapiens
gcactgagccacagttt

SEQ ID NO: 7351114 - DNA, 21 bp, Homo sapiens
gcactgagcatctcctctgcc

SEQ ID NO: 7351115 - DNA, 22 bp, Homo sapiens
gcactgggaatgagggcagctt

SEQ ID NO: 7351116 - DNA, 23 bp, Homo sapiens
gcactgccatgtgctctgcaggc

SEQ ID NO: 7351117 - DNA, 23 bp, Homo sapiens
gcagaggagcaagctggacacca

SEQ ID NO: 7351118 - DNA, 23 bp, Homo sapiens
gcagaggagcaagctggacacca

SEQ ID NO: 7351119 - DNA, 22 bp, Homo sapiens
gcagaggagcaagttgctacag

SEQ ID NO: 7351120 - DNA, 22 bp, Homo sapiens
gcagcagctgacagtgggtgcc

SEQ ID NO: 7351121 - DNA, 22 bp, Homo sapiens
gcagcagctctgaatgggcccc

SEQ ID NO: 7351122 - DNA, 22 bp, Homo sapiens
gcagcagctcagttctgggagg

SEQ ID NO: 7351123 - DNA, 22 bp, Homo sapiens
gcagcaggcacttaccgttgct

SEQ ID NO: 7351124 - DNA, 22 bp, Homo sapiens
gcagcaggtctgtcaatgtcat

SEQ ID NO: 7351125 - DNA, 22 bp, Homo sapiens
gcagcaggtctgtcaatgtcat

SEQ ID NO: 7351126 - DNA, 22 bp, Homo sapiens
gcagcaggagagtttgtcctgc

SEQ ID NO: 7351127 - DNA, 22 bp, Homo sapiens
gcagcaggcacggtctcgacat

SEQ ID NO: 7351128 - DNA, 22 bp, Homo sapiens
gcagcaggagagtttgtcctgc

SEQ ID NO: 7351129 - DNA, 22 bp, Homo sapiens
gcagcaggaatttaaatttata

SEQ ID NO: 7351130 - DNA, 22 bp, Homo sapiens
gcagccacactgttacagaatg

SEQ ID NO: 7351131 - DNA, 23 bp, Homo sapiens
gcagccaagagaccagggcaggc

SEQ ID NO: 7351132 - DNA, 22 bp, Homo sapiens
gcagcatgttgaaagggccaca

SEQ ID NO: 7351133 - DNA, 22 bp, Homo sapiens
gcagcatggagttgtggaatga

SEQ ID NO: 7351134 - DNA, 22 bp, Homo sapiens
gcaggagctgctctcctgacga

SEQ ID NO: 7351135 - DNA, 22 bp, Homo sapiens
gcaggagctggaaagtgatgtt

SEQ ID NO: 7351136 - DNA, 22 bp, Homo sapiens
gcagctggatttcaagagggag

SEQ ID NO: 7351137 - DNA, 22 bp, Homo sapiens
gcaggagctttgcttactgctg

SEQ ID NO: 7351138 - DNA, 22 bp, Homo sapiens
gcaggagctggaaagtgatgtt

SEQ ID NO: 7351139 - DNA, 22 bp, Homo sapiens
gcaggaggatcacttgagccca

SEQ ID NO: 7351140 - DNA, 22 bp, Homo sapiens
gcaggaggagcattaactgagc

SEQ ID NO: 7351141 - DNA, 22 bp, Homo sapiens
gcaggaggatcacttgagccca

SEQ ID NO: 7351142 - DNA, 22 bp, Homo sapiens
gcaggaggccaggtatgcttta

SEQ ID NO: 7351143 - DNA, 22 bp, Homo sapiens
gcaggaggttgagccaggactg

SEQ ID NO: 7351144 - DNA, 22 bp, Homo sapiens
gcaggaggttgagccaggactg

SEQ ID NO: 7351145 - DNA, 22 bp, Homo sapiens
gcaggaggttgagccaggactg

SEQ ID NO: 7351146 - DNA, 22 bp, Homo sapiens
gcagggcggcccagagcaggcc

SEQ ID NO: 7351147 - DNA, 22 bp, Homo sapiens
gcagggcgcgtttgagcgggct

SEQ ID NO: 7351148 - DNA, 22 bp, Homo sapiens
gcagggctaatggggcaagtag

SEQ ID NO: 7351149 - DNA, 22 bp, Homo sapiens
gcaggctgatgactggagttgg

SEQ ID NO: 7351150 - DNA, 20 bp, Homo sapiens
gcagggcgacacgggggagg

SEQ ID NO: 7351151 - DNA, 22 bp, Homo sapiens
gcagggccttggtcatcttttt

SEQ ID NO: 7351152 - DNA, 22 bp, Homo sapiens
gcagggccttagcagcggctgc

SEQ ID NO: 7351153 - DNA, 22 bp, Homo sapiens
gcaggctgccaccttctgagtt

SEQ ID NO: 7351154 - DNA, 22 bp, Homo sapiens
gcaggctgagagtccaagaagg

SEQ ID NO: 7351155 - DNA, 22 bp, Homo sapiens
gcaggctgagagtccaagaagg

SEQ ID NO: 7351156 - DNA, 22 bp, Homo sapiens
gcaggctgaaactcggggtcta

SEQ ID NO: 7351157 - DNA, 22 bp, Homo sapiens
gcaggctcgttggaagtcccct

SEQ ID NO: 7351158 - DNA, 22 bp, Homo sapiens
gcaggctgaaactcggggtcta

SEQ ID NO: 7351159 - DNA, 22 bp, Homo sapiens
gcaggctgatagaggattccat

SEQ ID NO: 7351160 - DNA, 22 bp, Homo sapiens
gcaggctgagttgggaaaccaa

SEQ ID NO: 7351161 - DNA, 22 bp, Homo sapiens
gcaggctgagtattaccctagt

SEQ ID NO: 7351162 - DNA, 19 bp, Homo sapiens
gcaggcctcttgggaatta

SEQ ID NO: 7351163 - DNA, 22 bp, Homo sapiens
gcaggctcaaaagctggtagga

SEQ ID NO: 7351164 - DNA, 22 bp, Homo sapiens
gcaggctccaactggaggagtt

SEQ ID NO: 7351165 - DNA, 22 bp, Homo sapiens
gcaggctcactctgtttggctc

SEQ ID NO: 7351166 - DNA, 22 bp, Homo sapiens
gcaggctcccttgcagagcagg

SEQ ID NO: 7351167 - DNA, 22 bp, Homo sapiens
gccctctggcagccttggctgg

SEQ ID NO: 7351168 - DNA, 22 bp, Homo sapiens
gcccatgcccctccttctggca

SEQ ID NO: 7351169 - DNA, 23 bp, Homo sapiens
gcccatgctgttgggcccgagca

SEQ ID NO: 7351170 - DNA, 22 bp, Homo sapiens
gcccagtgtctaggaggtgaac

SEQ ID NO: 7351171 - DNA, 19 bp, Homo sapiens
gcccaggggcccgatgctg

SEQ ID NO: 7351172 - DNA, 22 bp, Homo sapiens
gcccagggctgcaagtggacgc

SEQ ID NO: 7351173 - DNA, 22 bp, Homo sapiens
gcccaggggcagcgcatagtgg

SEQ ID NO: 7351174 - DNA, 22 bp, Homo sapiens
gcccaggctggagtgcagtggt

SEQ ID NO: 7351175 - DNA, 22 bp, Homo sapiens
gcccagggcagggcaagagtga

SEQ ID NO: 7351176 - DNA, 22 bp, Homo sapiens
gcccagggctgcaagtggacgc

SEQ ID NO: 7351177 - DNA, 22 bp, Homo sapiens
gcccagggcgatggtcggggcc

SEQ ID NO: 7351178 - DNA, 22 bp, Homo sapiens
gcccagggcagggcaagagtga

SEQ ID NO: 7351179 - DNA, 22 bp, Homo sapiens
gcctaagactgaggcttttgtc

SEQ ID NO: 7351180 - DNA, 22 bp, Homo sapiens
gcctaagattgtgttttcctga

SEQ ID NO: 7351181 - DNA, 22 bp, Homo sapiens
gcctcagctgttgcaggggccc

SEQ ID NO: 7351182 - DNA, 22 bp, Homo sapiens
gcctcaggactggcatactcat

SEQ ID NO: 7351183 - DNA, 22 bp, Homo sapiens
gcctcaggactggcatactcat

SEQ ID NO: 7351184 - DNA, 22 bp, Homo sapiens
gcctcaggactggcatactcat

SEQ ID NO: 7351185 - DNA, 22 bp, Homo sapiens
gcctcaggccgccctgctgctc

SEQ ID NO: 7351186 - DNA, 22 bp, Homo sapiens
gcctcagctcccagcccaggct

SEQ ID NO: 7351187 - DNA, 22 bp, Homo sapiens
gcctcagctgttgcaggggccc

SEQ ID NO: 7351188 - DNA, 20 bp, Homo sapiens
gcctcagccaacccatgggg

SEQ ID NO: 7351189 - DNA, 20 bp, Homo sapiens
gcctcagccaacccatgggg

SEQ ID NO: 7351190 - DNA, 22 bp, Homo sapiens
gcctcagccggcggacgccagg

SEQ ID NO: 7351191 - DNA, 22 bp, Homo sapiens
gcctcagctcccagcccaggct

SEQ ID NO: 7351192 - DNA, 22 bp, Homo sapiens
gccctgagctagtgtgggcagg

SEQ ID NO: 7351193 - DNA, 22 bp, Homo sapiens
gccctgagaagaagtcggaggg

SEQ ID NO: 7351194 - DNA, 22 bp, Homo sapiens
gccctgacactttgcagctgag

SEQ ID NO: 7351195 - DNA, 22 bp, Homo sapiens
gccctgaccttcactgactctc

SEQ ID NO: 7351196 - DNA, 19 bp, Homo sapiens
gccctgaccttggctgctc

SEQ ID NO: 7351197 - DNA, 22 bp, Homo sapiens
gccctgacactttgcagctgag

SEQ ID NO: 7351198 - DNA, 21 bp, Homo sapiens
gccaggaccagcagaccactt

SEQ ID NO: 7351199 - DNA, 22 bp, Homo sapiens
gccaggactcttcctagaaggt

SEQ ID NO: 7351200 - DNA, 22 bp, Homo sapiens
gccaggactagagggaggtgag

SEQ ID NO: 7351201 - DNA, 22 bp, Homo sapiens
gccaggacctcagatgcagggc

SEQ ID NO: 7351202 - DNA, 22 bp, Homo sapiens
gccaggacctcagatgcagggc

SEQ ID NO: 7351203 - DNA, 22 bp, Homo sapiens
gccaggacctcccagagctttc

SEQ ID NO: 7351204 - DNA, 22 bp, Homo sapiens
gccaggactgagaatgggagca

SEQ ID NO: 7351205 - DNA, 22 bp, Homo sapiens
gccaggagagctccttcaggtt

SEQ ID NO: 7351206 - DNA, 22 bp, Homo sapiens
gccaggagaaaaggcgaatgat

SEQ ID NO: 7351207 - DNA, 22 bp, Homo sapiens
gccaggtggtctggctccagag

SEQ ID NO: 7351208 - DNA, 22 bp, Homo sapiens
gccaggtgtcctcacagtgagg

SEQ ID NO: 7351209 - DNA, 22 bp, Homo sapiens
gccaggtggtctggctccagag

SEQ ID NO: 7351210 - DNA, 22 bp, Homo sapiens
gccaggcacagttctaggtgct

SEQ ID NO: 7351211 - DNA, 22 bp, Homo sapiens
gccaggcacagttctaggtgct

SEQ ID NO: 7351212 - DNA, 23 bp, Homo sapiens
gccaggcacatggtggacacgca

SEQ ID NO: 7351213 - DNA, 22 bp, Homo sapiens
gccaggcaaattaaggaatgca

SEQ ID NO: 7351214 - DNA, 22 bp, Homo sapiens
gcccagagagatgctgtagacc

SEQ ID NO: 7351215 - DNA, 22 bp, Homo sapiens
gcccagaagttgaggctgcagt

SEQ ID NO: 7351216 - DNA, 22 bp, Homo sapiens
gcccagaacagtgtcacatgtc

SEQ ID NO: 7351217 - DNA, 22 bp, Homo sapiens
gcccactgagtgactccctcag

SEQ ID NO: 7351218 - DNA, 22 bp, Homo sapiens
gcccactctggagcctgttccc

SEQ ID NO: 7351219 - DNA, 22 bp, Homo sapiens
gcccactctggagcctgttccc

SEQ ID NO: 7351220 - DNA, 22 bp, Homo sapiens
gcccactggctggagtgctggt

SEQ ID NO: 7351221 - DNA, 19 bp, Homo sapiens
gcccactgtctttgccaac

SEQ ID NO: 7351222 - DNA, 18 bp, Homo sapiens
gcccagaggtctgggccc

SEQ ID NO: 7351223 - DNA, 22 bp, Homo sapiens
gcccactctggagcctgttccc

SEQ ID NO: 7351224 - DNA, 22 bp, Homo sapiens
gcccacagtacgaggctcaggc

SEQ ID NO: 7351225 - DNA, 22 bp, Homo sapiens
gcccacaggtcctacctctttc

SEQ ID NO: 7351226 - DNA, 22 bp, Homo sapiens
gcccacagtacgaggctcaggc

SEQ ID NO: 7351227 - DNA, 22 bp, Homo sapiens
gccaggttgctgacgacgatct

SEQ ID NO: 7351228 - DNA, 22 bp, Homo sapiens
gccagcagtcctgctgtgtgcc

SEQ ID NO: 7351229 - DNA, 21 bp, Homo sapiens
gccagccatgcttgcctaggc

SEQ ID NO: 7351230 - DNA, 22 bp, Homo sapiens
gccagcccattaacccctgtcc

SEQ ID NO: 7351231 - DNA, 22 bp, Homo sapiens
gccagcccagctccaggggaaa

SEQ ID NO: 7351232 - DNA, 22 bp, Homo sapiens
gccagcaggttgtcaaggagct

SEQ ID NO: 7351233 - DNA, 22 bp, Homo sapiens
gccagaggaacgctgcgcgccc

SEQ ID NO: 7351234 - DNA, 22 bp, Homo sapiens
gccagaggcccaaggacagctg

SEQ ID NO: 7351235 - DNA, 23 bp, Homo sapiens
gccagaggaacgcagagctttct

SEQ ID NO: 7351236 - DNA, 22 bp, Homo sapiens
gccaagggtagtggaggcccct

SEQ ID NO: 7351237 - DNA, 22 bp, Homo sapiens
gcatttttgatcccactaggat

SEQ ID NO: 7351238 - DNA, 22 bp, Homo sapiens
gccaaaactcccatattttaat

SEQ ID NO: 7351239 - DNA, 17 bp, Homo sapiens
gcagtgaaaagagatca

SEQ ID NO: 7351240 - DNA, 22 bp, Homo sapiens
gcagtgaaacaataggatcaaa

SEQ ID NO: 7351241 - DNA, 19 bp, Homo sapiens
gcagtctgttgaagggcag

SEQ ID NO: 7351242 - DNA, 22 bp, Homo sapiens
gcagggctcagccgctcccacc

SEQ ID NO: 7351243 - DNA, 22 bp, Homo sapiens
gcagggctccactgtggccaag

SEQ ID NO: 7351244 - DNA, 22 bp, Homo sapiens
gcagggctccactgtggccaag

SEQ ID NO: 7351245 - DNA, 22 bp, Homo sapiens
gcagggctcattgccaggcatt

SEQ ID NO: 7351246 - DNA, 22 bp, Homo sapiens
gcagggctcattgccaggcatt

SEQ ID NO: 7351247 - DNA, 22 bp, Homo sapiens
gcagggctctgctgtagtccta

SEQ ID NO: 7351248 - DNA, 19 bp, Homo sapiens
gcagggctctcccagatgc

SEQ ID NO: 7351249 - DNA, 22 bp, Homo sapiens
gcagtcagtgttgactacatgc

SEQ ID NO: 7351250 - DNA, 22 bp, Homo sapiens
gcatgaggggggttaggaagtt

SEQ ID NO: 7351251 - DNA, 19 bp, Homo sapiens
gcatttcatttaaccatca

SEQ ID NO: 7351252 - DNA, 22 bp, Homo sapiens
gcatttggaattgtgtatagaa

SEQ ID NO: 7351253 - DNA, 22 bp, Homo sapiens
gcatttgaaatcctctgtgacg

SEQ ID NO: 7351254 - DNA, 22 bp, Homo sapiens
gcatttcttcctggtgtgagcc

SEQ ID NO: 7351255 - DNA, 18 bp, Homo sapiens
gcataatgtgtatattga

SEQ ID NO: 7351256 - DNA, 22 bp, Homo sapiens
gcataaatgttctttcagattt

SEQ ID NO: 7351257 - DNA, 22 bp, Homo sapiens
gcataaaggactataaggatca

SEQ ID NO: 7351258 - DNA, 19 bp, Homo sapiens
gcataaatacactattgtc

SEQ ID NO: 7351259 - DNA, 20 bp, Homo sapiens
gcatctccagggctgtctcc

SEQ ID NO: 7351260 - DNA, 22 bp, Homo sapiens
gcatccttgggcccagctcctg

SEQ ID NO: 7351261 - DNA, 22 bp, Homo sapiens
gcatccttttttcctgccctgc

SEQ ID NO: 7351262 - DNA, 22 bp, Homo sapiens
cctgcgggctggtaagaggctt

SEQ ID NO: 7351263 - DNA, 22 bp, Homo sapiens
cctgcgggctgtgctgaagcct

SEQ ID NO: 7351264 - DNA, 22 bp, Homo sapiens
cctgctatcattctaggcttcc

SEQ ID NO: 7351265 - DNA, 22 bp, Homo sapiens
cctgcgatccgggcttggtgct

SEQ ID NO: 7351266 - DNA, 22 bp, Homo sapiens
cctgctcagccccagctcaccc

SEQ ID NO: 7351267 - DNA, 22 bp, Homo sapiens
cctgctcacctgatgtggcaac

SEQ ID NO: 7351268 - DNA, 22 bp, Homo sapiens
cctgctcagctgtcctcacgct

SEQ ID NO: 7351269 - DNA, 23 bp, Homo sapiens
cctgctcaggcgtgtgccctgct

SEQ ID NO: 7351270 - DNA, 22 bp, Homo sapiens
tggttcctcaagcgctggcggc

SEQ ID NO: 7351271 - DNA, 17 bp, Homo sapiens
tggttccaaccatacgc

SEQ ID NO: 7351272 - DNA, 22 bp, Homo sapiens
tgttgcccaggttctctcctgc

SEQ ID NO: 7351273 - DNA, 22 bp, Homo sapiens
tgttggcactatctcatgtttt

SEQ ID NO: 7351274 - DNA, 23 bp, Homo sapiens
tgttgctgcctttctaggatcag

SEQ ID NO: 7351275 - DNA, 22 bp, Homo sapiens
tgttggaaaggccaggctgtgg

SEQ ID NO: 7351276 - DNA, 20 bp, Homo sapiens
tgttgattggtgtcatctca

SEQ ID NO: 7351277 - DNA, 22 bp, Homo sapiens
tgttgatttgtgggctgcaaaa

SEQ ID NO: 7351278 - DNA, 22 bp, Homo sapiens
tgttgattagtgtttagactta

SEQ ID NO: 7351279 - DNA, 17 bp, Homo sapiens
tgttccatttgaccacc

SEQ ID NO: 7351280 - DNA, 20 bp, Homo sapiens
tgttccatgactatttggat

SEQ ID NO: 7351281 - DNA, 22 bp, Homo sapiens
tgttccatgtctttgtaggact

SEQ ID NO: 7351282 - DNA, 22 bp, Homo sapiens
cctgctcctatctgggctcatt

SEQ ID NO: 7351283 - DNA, 22 bp, Homo sapiens
cctgctccatgctcaccatcag

SEQ ID NO: 7351284 - DNA, 22 bp, Homo sapiens
tgttttcatttgatgtaacaaa

SEQ ID NO: 7351285 - DNA, 22 bp, Homo sapiens
tgttttcatttgatgtaacaaa

SEQ ID NO: 7351286 - DNA, 22 bp, Homo sapiens
tgttttcatttgatgtaacaaa

SEQ ID NO: 7351287 - DNA, 21 bp, Homo sapiens
tgttttccaccttgaggcaag

SEQ ID NO: 7351288 - DNA, 17 bp, Homo sapiens
tgttttcattcattgct

SEQ ID NO: 7351289 - DNA, 22 bp, Homo sapiens
tgtttcttacgtttttagaggc

SEQ ID NO: 7351290 - DNA, 22 bp, Homo sapiens
tgtttcttacgtttttagaggc

SEQ ID NO: 7351291 - DNA, 23 bp, Homo sapiens
cctggggcacttgagtcctcatc

SEQ ID NO: 7351292 - DNA, 22 bp, Homo sapiens
cctggggccccgagccagaagc

SEQ ID NO: 7351293 - DNA, 22 bp, Homo sapiens
cctggggccccgagccagaagc

SEQ ID NO: 7351294 - DNA, 22 bp, Homo sapiens
cctggggctcaagatggcgccg

SEQ ID NO: 7351295 - DNA, 22 bp, Homo sapiens
cctggggctcaagatggcgccg

SEQ ID NO: 7351296 - DNA, 22 bp, Homo sapiens
tgtttctatctggatcaataga

SEQ ID NO: 7351297 - DNA, 22 bp, Homo sapiens
tgtttctaggtcaataattttt

SEQ ID NO: 7351298 - DNA, 22 bp, Homo sapiens
ttaaggaaacatttttccatag

SEQ ID NO: 7351299 - DNA, 22 bp, Homo sapiens
ttaatatgctgcttcttgaaaa

SEQ ID NO: 7351300 - DNA, 22 bp, Homo sapiens
ttaatagatttgattttaaagg

SEQ ID NO: 7351301 - DNA, 19 bp, Homo sapiens
cctgtacattattctcccc

SEQ ID NO: 7351302 - DNA, 22 bp, Homo sapiens
cctgtacattagctgtgaattg

SEQ ID NO: 7351303 - DNA, 22 bp, Homo sapiens
cctgtacatggccatctttacc

SEQ ID NO: 7351304 - DNA, 22 bp, Homo sapiens
cctgtacatctgctctcattgc

SEQ ID NO: 7351305 - DNA, 22 bp, Homo sapiens
cctgtacagtgaatgaatgtga

SEQ ID NO: 7351306 - DNA, 22 bp, Homo sapiens
cctgtacacggtctatgcctcc

SEQ ID NO: 7351307 - DNA, 22 bp, Homo sapiens
cctgtacacaattccgaggata

SEQ ID NO: 7351308 - DNA, 22 bp, Homo sapiens
cctgtacaagctcttggtgaca

SEQ ID NO: 7351309 - DNA, 22 bp, Homo sapiens
cctgtacaagagccatctggat

SEQ ID NO: 7351310 - DNA, 22 bp, Homo sapiens
ttaaaatgcagattatgactca

SEQ ID NO: 7351311 - DNA, 22 bp, Homo sapiens
ttaaaatctaaagcagttgtct

SEQ ID NO: 7351312 - DNA, 22 bp, Homo sapiens
cctgtggctggtcaggccagca

SEQ ID NO: 7351313 - DNA, 18 bp, Homo sapiens
cctgtggctcagcccaca

SEQ ID NO: 7351314 - DNA, 18 bp, Homo sapiens
cctgtggctcagcccaca

SEQ ID NO: 7351315 - DNA, 22 bp, Homo sapiens
cctgtggcgggggccagtgcct

SEQ ID NO: 7351316 - DNA, 22 bp, Homo sapiens
ttacaagtttctggcttcatcc

SEQ ID NO: 7351317 - DNA, 22 bp, Homo sapiens
ttacaagttcagattttctcat

SEQ ID NO: 7351318 - DNA, 23 bp, Homo sapiens
ttacaagttctgaaatttccttc

SEQ ID NO: 7351319 - DNA, 22 bp, Homo sapiens
ttacaataccacatcacctcat

SEQ ID NO: 7351320 - DNA, 22 bp, Homo sapiens
ttaatgatacctatgttaattt

SEQ ID NO: 7351321 - DNA, 22 bp, Homo sapiens
ttaatgatgaagtctggctgta

SEQ ID NO: 7351322 - DNA, 22 bp, Homo sapiens
cctgtgcttggccagagaggtt

SEQ ID NO: 7351323 - DNA, 22 bp, Homo sapiens
cctgtgctttaggcctcaaact

SEQ ID NO: 7351324 - DNA, 22 bp, Homo sapiens
ttatggcattcattggggcttt

SEQ ID NO: 7351325 - DNA, 22 bp, Homo sapiens
ttatggctaaatttcaatatta

SEQ ID NO: 7351326 - DNA, 22 bp, Homo sapiens
ttatggctaaggcttgtcaggt

SEQ ID NO: 7351327 - DNA, 22 bp, Homo sapiens
ttatggctagactagtttttga

SEQ ID NO: 7351328 - DNA, 22 bp, Homo sapiens
ttatggctaggatatgtgtgta

SEQ ID NO: 7351329 - DNA, 20 bp, Homo sapiens
ttatggctcctaccttgtga

SEQ ID NO: 7351330 - DNA, 22 bp, Homo sapiens
ttatggctgaataaattatggt

SEQ ID NO: 7351331 - DNA, 22 bp, Homo sapiens
ttatggctgggacaaaagcttc

SEQ ID NO: 7351332 - DNA, 18 bp, Homo sapiens
ttatggctgtgaaagagt

SEQ ID NO: 7351333 - DNA, 22 bp, Homo sapiens
ttatggcttaaatactacaggg

SEQ ID NO: 7351334 - DNA, 23 bp, Homo sapiens
ccttgtctggctggctggacttt

SEQ ID NO: 7351335 - DNA, 22 bp, Homo sapiens
ccttggggaatatccattcttc

SEQ ID NO: 7351336 - DNA, 22 bp, Homo sapiens
ccttgggagaaattgcagagtc

SEQ ID NO: 7351337 - DNA, 22 bp, Homo sapiens
ccttggggaactggacgtgctg

SEQ ID NO: 7351338 - DNA, 22 bp, Homo sapiens
ccttggctggaattactctggg

SEQ ID NO: 7351339 - DNA, 20 bp, Homo sapiens
ccttctctggaattgcctcc

SEQ ID NO: 7351340 - DNA, 22 bp, Homo sapiens
ttacagaagtattgagagatcc

SEQ ID NO: 7351341 - DNA, 20 bp, Homo sapiens
ttacagaaatgatgttattt

SEQ ID NO: 7351342 - DNA, 22 bp, Homo sapiens
ttacagaactgccctagttggc

SEQ ID NO: 7351343 - DNA, 20 bp, Homo sapiens
ttacagaaatgatgttattt

SEQ ID NO: 7351344 - DNA, 22 bp, Homo sapiens
ttacagaaaggaaggactgact

SEQ ID NO: 7351345 - DNA, 22 bp, Homo sapiens
ttaccgagaacatgactggaat

SEQ ID NO: 7351346 - DNA, 22 bp, Homo sapiens
ccttctgagtgtggacccctgt

SEQ ID NO: 7351347 - DNA, 22 bp, Homo sapiens
ccttctgagcttcaatttcagt

SEQ ID NO: 7351348 - DNA, 21 bp, Homo sapiens
ccttctcttgcttcagcttca

SEQ ID NO: 7351349 - DNA, 22 bp, Homo sapiens
ttatttttaaaagttcacacag

SEQ ID NO: 7351350 - DNA, 17 bp, Homo sapiens
ttattttttgggctgag

SEQ ID NO: 7351351 - DNA, 22 bp, Homo sapiens
cgcagaagaggttgtctagtcc

SEQ ID NO: 7351352 - DNA, 22 bp, Homo sapiens
cgcagagggcaggcagtgctgg

SEQ ID NO: 7351353 - DNA, 19 bp, Homo sapiens
cgcagagggcttctgagag

SEQ ID NO: 7351354 - DNA, 22 bp, Homo sapiens
cgcagagggagccgcgggctgc

SEQ ID NO: 7351355 - DNA, 22 bp, Homo sapiens
ttatttcattgatttctaagac

SEQ ID NO: 7351356 - DNA, 22 bp, Homo sapiens
ttatttttaaaagttcacacag

SEQ ID NO: 7351357 - DNA, 22 bp, Homo sapiens
cgcacattagaagtaactaatg

SEQ ID NO: 7351358 - DNA, 22 bp, Homo sapiens
cgatggttctggctgcttgtat

SEQ ID NO: 7351359 - DNA, 22 bp, Homo sapiens
cgagggctgtgttgctctcctt

SEQ ID NO: 7351360 - DNA, 17 bp, Homo sapiens
cgagggcttgctggctc

SEQ ID NO: 7351361 - DNA, 22 bp, Homo sapiens
ttatgtatggatggctgaaagt

SEQ ID NO: 7351362 - DNA, 19 bp, Homo sapiens
cctttgaatcaggacactt

SEQ ID NO: 7351363 - DNA, 22 bp, Homo sapiens
ttatgtatgaatatagtagaag

SEQ ID NO: 7351364 - DNA, 22 bp, Homo sapiens
ttatgtaatttgtttgctcttc

SEQ ID NO: 7351365 - DNA, 22 bp, Homo sapiens
ttatgggagcaattggggaggt

SEQ ID NO: 7351366 - DNA, 22 bp, Homo sapiens
ttatggcttgtgcaggatctag

SEQ ID NO: 7351367 - DNA, 22 bp, Homo sapiens
ttatggcttctgtgaagaattt

SEQ ID NO: 7351368 - DNA, 22 bp, Homo sapiens
ttatggcttgaaactctaagga

SEQ ID NO: 7351369 - DNA, 22 bp, Homo sapiens
ttatggcttttatcctctcttg

SEQ ID NO: 7351370 - DNA, 21 bp, Homo sapiens
ttcttcagtttaatataaaat

SEQ ID NO: 7351371 - DNA, 22 bp, Homo sapiens
ttcttcagtttggtaaatgtaa

SEQ ID NO: 7351372 - DNA, 22 bp, Homo sapiens
ttcttcagtgcccctctagtag

SEQ ID NO: 7351373 - DNA, 22 bp, Homo sapiens
ttcttcagtgtagcaactgtat

SEQ ID NO: 7351374 - DNA, 22 bp, Homo sapiens
ttcttcatgctgttgctgcttg

SEQ ID NO: 7351375 - DNA, 23 bp, Homo sapiens
ttgaaggagaaagctttcttggt

SEQ ID NO: 7351376 - DNA, 22 bp, Homo sapiens
ttgaaggaggctcctttttaaa

SEQ ID NO: 7351377 - DNA, 21 bp, Homo sapiens
ttgaaggatcacttctgtacc

SEQ ID NO: 7351378 - DNA, 22 bp, Homo sapiens
ttgaaggaggctcctttttaaa

SEQ ID NO: 7351379 - DNA, 22 bp, Homo sapiens
ttgaagtagtatcttaaggaca

SEQ ID NO: 7351380 - DNA, 22 bp, Homo sapiens
ttgaagtatagagtttaagaac

SEQ ID NO: 7351381 - DNA, 22 bp, Homo sapiens
ttgaaggacatcttgtttctag

SEQ ID NO: 7351382 - DNA, 22 bp, Homo sapiens
ttgaaggacatcttgtttctag

SEQ ID NO: 7351383 - DNA, 23 bp, Homo sapiens
ttgaaggagaaagctttcttggt

SEQ ID NO: 7351384 - DNA, 19 bp, Homo sapiens
ttgaagttacagtcatgcc

SEQ ID NO: 7351385 - DNA, 22 bp, Homo sapiens
ttgaatctcatcccaatgttgt

SEQ ID NO: 7351386 - DNA, 22 bp, Homo sapiens
ctcactgcaagctccacctctt

SEQ ID NO: 7351387 - DNA, 22 bp, Homo sapiens
ttgaataattaattacactcag

SEQ ID NO: 7351388 - DNA, 22 bp, Homo sapiens
ctcactgtctgtactagctgat

SEQ ID NO: 7351389 - DNA, 22 bp, Homo sapiens
ctcactgcaagttccacctacc

SEQ ID NO: 7351390 - DNA, 22 bp, Homo sapiens
ttcttaaagaggcaaaacacag

SEQ ID NO: 7351391 - DNA, 22 bp, Homo sapiens
ttcttcagcttctacctgcgtc

SEQ ID NO: 7351392 - DNA, 22 bp, Homo sapiens
ttcttcaggaagagcctggact

SEQ ID NO: 7351393 - DNA, 22 bp, Homo sapiens
ttcttcaggatacgtcatccag

SEQ ID NO: 7351394 - DNA, 21 bp, Homo sapiens
ttcttcaggccaatgctcatt

SEQ ID NO: 7351395 - DNA, 22 bp, Homo sapiens
ttcttcaggtggttttggtaac

SEQ ID NO: 7351396 - DNA, 22 bp, Homo sapiens
ttcttcagggaagcttgttaat

SEQ ID NO: 7351397 - DNA, 22 bp, Homo sapiens
ttcttcagtctaggcctttctt

SEQ ID NO: 7351398 - DNA, 22 bp, Homo sapiens
ttcttcagtgacaaaggcaaaa

SEQ ID NO: 7351399 - DNA, 22 bp, Homo sapiens
ttcttcagtcccactagccaca

SEQ ID NO: 7351400 - DNA, 22 bp, Homo sapiens
ttctgaagctcccttttgtagt

SEQ ID NO: 7351401 - DNA, 22 bp, Homo sapiens
ttctgaaaggcatgtcaggtag

SEQ ID NO: 7351402 - DNA, 22 bp, Homo sapiens
ttctgaaatgagatataaggta

SEQ ID NO: 7351403 - DNA, 22 bp, Homo sapiens
ttctgaaaccttcagtatgaag

SEQ ID NO: 7351404 - DNA, 22 bp, Homo sapiens
ttctgaaaattgggtcatactt

SEQ ID NO: 7351405 - DNA, 22 bp, Homo sapiens
ttgcacagtttgaagatgactc

SEQ ID NO: 7351406 - DNA, 22 bp, Homo sapiens
ttgcacagtttgaagatgactc

SEQ ID NO: 7351407 - DNA, 22 bp, Homo sapiens
ttgcacatctaataatgctaga

SEQ ID NO: 7351408 - DNA, 23 bp, Homo sapiens
ttgcacagtttcggaaactgagg

SEQ ID NO: 7351409 - DNA, 18 bp, Homo sapiens
ctcaggcctttccctgtg

SEQ ID NO: 7351410 - DNA, 22 bp, Homo sapiens
ctcaggcctgagtggcagtccc

SEQ ID NO: 7351411 - DNA, 22 bp, Homo sapiens
ttgcactccagtctgggaacaa

SEQ ID NO: 7351412 - DNA, 21 bp, Homo sapiens
ttgcaccatgataaattcaga

SEQ ID NO: 7351413 - DNA, 22 bp, Homo sapiens
ttgcacctgtctctgtgttggg

SEQ ID NO: 7351414 - DNA, 22 bp, Homo sapiens
ttgcacctcatttcatttgggc

SEQ ID NO: 7351415 - DNA, 22 bp, Homo sapiens
ttgcaccatttcacttccatta

SEQ ID NO: 7351416 - DNA, 22 bp, Homo sapiens
ttgcaccaaatgagttaaaatt

SEQ ID NO: 7351417 - DNA, 22 bp, Homo sapiens
ttgctgccttccgaatcctctc

SEQ ID NO: 7351418 - DNA, 23 bp, Homo sapiens
ttgctgcctgagccttcctctgg

SEQ ID NO: 7351419 - DNA, 22 bp, Homo sapiens
ttgctgctcccaagaggcagct

SEQ ID NO: 7351420 - DNA, 22 bp, Homo sapiens
ttgctgccttggagaagctcct

SEQ ID NO: 7351421 - DNA, 22 bp, Homo sapiens
ttgctgatttccccttgagtgt

SEQ ID NO: 7351422 - DNA, 21 bp, Homo sapiens
ttgctgccctccctttcctca

SEQ ID NO: 7351423 - DNA, 22 bp, Homo sapiens
ttgctgtagttcaatatgtggt

SEQ ID NO: 7351424 - DNA, 22 bp, Homo sapiens
ctcaggctccagacttccgtcc

SEQ ID NO: 7351425 - DNA, 22 bp, Homo sapiens
ttgctggtaaagtctttatcgg

SEQ ID NO: 7351426 - DNA, 22 bp, Homo sapiens
ttgctgggtcagaagccaggag

SEQ ID NO: 7351427 - DNA, 22 bp, Homo sapiens
ctcaggccattcttccagctgc

SEQ ID NO: 7351428 - DNA, 22 bp, Homo sapiens
ctcaggccattcttccagctgc

SEQ ID NO: 7351429 - DNA, 22 bp, Homo sapiens
ctcaggccaggtttctcccaca

SEQ ID NO: 7351430 - DNA, 22 bp, Homo sapiens
ctcaggccaataagctccagcc

SEQ ID NO: 7351431 - DNA, 22 bp, Homo sapiens
ctcaggccaggtttctcccaca

SEQ ID NO: 7351432 - DNA, 22 bp, Homo sapiens
ctcagccccaattctccccatt

SEQ ID NO: 7351433 - DNA, 22 bp, Homo sapiens
ctcagcccagcccaggaccagg

SEQ ID NO: 7351434 - DNA, 22 bp, Homo sapiens
ctcagccaggagagtgttcaca

SEQ ID NO: 7351435 - DNA, 22 bp, Homo sapiens
ttgcaaaaccatcctaagtaaa

SEQ ID NO: 7351436 - DNA, 22 bp, Homo sapiens
ttgcaaaagcaattgcagtttt

SEQ ID NO: 7351437 - DNA, 22 bp, Homo sapiens
ctcagaaacggagctgccattt

SEQ ID NO: 7351438 - DNA, 22 bp, Homo sapiens
cgggagcctctgggtcacactg

SEQ ID NO: 7351439 - DNA, 22 bp, Homo sapiens
cgggaaggtggaggttgcagtg

SEQ ID NO: 7351440 - DNA, 22 bp, Homo sapiens
ttccactcatgcaaaggtccca

SEQ ID NO: 7351441 - DNA, 22 bp, Homo sapiens
ttccactcctcctggtggggtg

SEQ ID NO: 7351442 - DNA, 22 bp, Homo sapiens
ttccactctacacactgctggc

SEQ ID NO: 7351443 - DNA, 22 bp, Homo sapiens
ttccactctactctggccagtc

SEQ ID NO: 7351444 - DNA, 22 bp, Homo sapiens
cggctgtgtcttcacaggagcc

SEQ ID NO: 7351445 - DNA, 22 bp, Homo sapiens
cggctgggttcggctgcaggcc

SEQ ID NO: 7351446 - DNA, 22 bp, Homo sapiens
cggctgggttcggctgcaggcc

SEQ ID NO: 7351447 - DNA, 22 bp, Homo sapiens
cggctgggtagaggtgccgggt

SEQ ID NO: 7351448 - DNA, 22 bp, Homo sapiens
cggctgggtagaggtgccgggt

SEQ ID NO: 7351449 - DNA, 22 bp, Homo sapiens
ttcagtttcagtcttgcaaaaa

SEQ ID NO: 7351450 - DNA, 23 bp, Homo sapiens
ttcagggcctcagaggtgaagct

SEQ ID NO: 7351451 - DNA, 22 bp, Homo sapiens
ttcagggccctgagagggcagt

SEQ ID NO: 7351452 - DNA, 22 bp, Homo sapiens
ttcagggccctgagagggcagt

SEQ ID NO: 7351453 - DNA, 20 bp, Homo sapiens
ttcagggctttggggacacc

SEQ ID NO: 7351454 - DNA, 22 bp, Homo sapiens
ttcagtttgctacaagcaacat

SEQ ID NO: 7351455 - DNA, 21 bp, Homo sapiens
ttcagtttcttcctcatctat

SEQ ID NO: 7351456 - DNA, 22 bp, Homo sapiens
ttccacttagtggaagggcatg

SEQ ID NO: 7351457 - DNA, 22 bp, Homo sapiens
ttccactctgtcccctgtggga

SEQ ID NO: 7351458 - DNA, 22 bp, Homo sapiens
ttccactcttctctggacttat

SEQ ID NO: 7351459 - DNA, 22 bp, Homo sapiens
ttccactctccagtcaatttca

SEQ ID NO: 7351460 - DNA, 22 bp, Homo sapiens
ttccactctatgatagaagggt

SEQ ID NO: 7351461 - DNA, 22 bp, Homo sapiens
ttccacttttctctctcatgcc

SEQ ID NO: 7351462 - DNA, 22 bp, Homo sapiens
cgtctctggcccggcccctggg

SEQ ID NO: 7351463 - DNA, 22 bp, Homo sapiens
cgtcctctagagggaagcactt

SEQ ID NO: 7351464 - DNA, 22 bp, Homo sapiens
cgtcctgctcggcgcgcctcgg

SEQ ID NO: 7351465 - DNA, 22 bp, Homo sapiens
ttcctctggaggctctaggaga

SEQ ID NO: 7351466 - DNA, 22 bp, Homo sapiens
ttcctctctcttgccagaatgt

SEQ ID NO: 7351467 - DNA, 22 bp, Homo sapiens
ttcctctctcttgccagaatgt

SEQ ID NO: 7351468 - DNA, 22 bp, Homo sapiens
ttcctctcgctctccggggccc

SEQ ID NO: 7351469 - DNA, 22 bp, Homo sapiens
ttcctctcgctctccggggccc

SEQ ID NO: 7351470 - DNA, 22 bp, Homo sapiens
ttcctctcaacatgcctgccgg

SEQ ID NO: 7351471 - DNA, 22 bp, Homo sapiens
ttcctctagcttctcactaaca

SEQ ID NO: 7351472 - DNA, 22 bp, Homo sapiens
ttcctctcaacatgcctgccgg

SEQ ID NO: 7351473 - DNA, 22 bp, Homo sapiens
ttcctccttgtcctagttactg

SEQ ID NO: 7351474 - DNA, 22 bp, Homo sapiens
ttcctccttcccattcctgggg

SEQ ID NO: 7351475 - DNA, 22 bp, Homo sapiens
ttcctccttgtcctagttactg

SEQ ID NO: 7351476 - DNA, 17 bp, Homo sapiens
ttcctctcacatttttt

SEQ ID NO: 7351477 - DNA, 17 bp, Homo sapiens
ttcctctcacatttttt

SEQ ID NO: 7351478 - DNA, 17 bp, Homo sapiens
ttcctctcacatttttt

SEQ ID NO: 7351479 - DNA, 22 bp, Homo sapiens
ttcctctcctcacatgagtcac

SEQ ID NO: 7351480 - DNA, 22 bp, Homo sapiens
ttcctctcctcacatgagtcac

SEQ ID NO: 7351481 - DNA, 22 bp, Homo sapiens
ttcctctcctcacatgagtcac

SEQ ID NO: 7351482 - DNA, 22 bp, Homo sapiens
ttcctctcctcccaccaggtga

SEQ ID NO: 7351483 - DNA, 22 bp, Homo sapiens
ttcctctcctcccaccaggtga

SEQ ID NO: 7351484 - DNA, 22 bp, Homo sapiens
cgtctggcttctccacggtaaa

SEQ ID NO: 7351485 - DNA, 22 bp, Homo sapiens
cgtctggcttctccacggtaaa

SEQ ID NO: 7351486 - DNA, 22 bp, Homo sapiens
cgtctggacgggaaggagaagt

SEQ ID NO: 7351487 - DNA, 22 bp, Homo sapiens
ttcctaaaagctgagtagagaa

SEQ ID NO: 7351488 - DNA, 22 bp, Homo sapiens
ttcctaacaaacttcagtgaat

SEQ ID NO: 7351489 - DNA, 22 bp, Homo sapiens
ttcctcctctgtaaaacgggca

SEQ ID NO: 7351490 - DNA, 22 bp, Homo sapiens
ttcctcctctgtaaaacgggca

SEQ ID NO: 7351491 - DNA, 22 bp, Homo sapiens
ttcctccttcccattcctgggg

SEQ ID NO: 7351492 - DNA, 21 bp, Homo sapiens
ttcctcctctggagaagaaga

SEQ ID NO: 7351493 - DNA, 17 bp, Homo sapiens
ttcctcctcaccatgtt

SEQ ID NO: 7351494 - DNA, 21 bp, Homo sapiens
ttcctcctctggagaagaaga

SEQ ID NO: 7351495 - DNA, 17 bp, Homo sapiens
ttcctcctcaccatgtt

SEQ ID NO: 7351496 - DNA, 22 bp, Homo sapiens
ttcctcctacgcttatcacttt

SEQ ID NO: 7351497 - DNA, 22 bp, Homo sapiens
ttcctcctacgcttatcacttt

SEQ ID NO: 7351498 - DNA, 22 bp, Homo sapiens
ctagtgtttattaacataattc

SEQ ID NO: 7351499 - DNA, 22 bp, Homo sapiens
ctagttgctctcctttaaacct

SEQ ID NO: 7351500 - DNA, 22 bp, Homo sapiens
ttctcctggggccgtgatgtga

SEQ ID NO: 7351501 - DNA, 22 bp, Homo sapiens
ttctcctgggaggggttgccca

SEQ ID NO: 7351502 - DNA, 21 bp, Homo sapiens
ttctcctgttttgcaccacag

SEQ ID NO: 7351503 - DNA, 22 bp, Homo sapiens
ttctccttgaaaagctgcatct

SEQ ID NO: 7351504 - DNA, 22 bp, Homo sapiens
ttctccttgttcccttcaattg

SEQ ID NO: 7351505 - DNA, 22 bp, Homo sapiens
ttctccttgttcccttcaattg

SEQ ID NO: 7351506 - DNA, 22 bp, Homo sapiens
ttctcctgcgcaggcccaggga

SEQ ID NO: 7351507 - DNA, 22 bp, Homo sapiens
ttctcctggagtgcttgttggg

SEQ ID NO: 7351508 - DNA, 22 bp, Homo sapiens
ttctcctgcccttggacttcca

SEQ ID NO: 7351509 - DNA, 22 bp, Homo sapiens
ttctcattctgactcagtgtag

SEQ ID NO: 7351510 - DNA, 22 bp, Homo sapiens
ttctatttttgtggaactgtag

SEQ ID NO: 7351511 - DNA, 22 bp, Homo sapiens
ttctcaggtgaggctgaggctg

SEQ ID NO: 7351512 - DNA, 22 bp, Homo sapiens
ttctcatagagacatgattata

SEQ ID NO: 7351513 - DNA, 22 bp, Homo sapiens
ctaactttatttgctaagtaga

SEQ ID NO: 7351514 - DNA, 22 bp, Homo sapiens
ctacagtgtcgtgtggtttctg

SEQ ID NO: 7351515 - DNA, 22 bp, Homo sapiens
ctacataaatttatcacagact

SEQ ID NO: 7351516 - DNA, 22 bp, Homo sapiens
ctacataaatatttatgtgtct

SEQ ID NO: 7351517 - DNA, 22 bp, Homo sapiens
ctacattaaattggcttactta

SEQ ID NO: 7351518 - DNA, 22 bp, Homo sapiens
ttctacatgagaaaatgtattt

SEQ ID NO: 7351519 - DNA, 22 bp, Homo sapiens
ttctacatcacttaacatgcta

SEQ ID NO: 7351520 - DNA, 22 bp, Homo sapiens
ttctacattgtgaagttcttta

SEQ ID NO: 7351521 - DNA, 22 bp, Homo sapiens
ttctacatgtcaagtctccaag

SEQ ID NO: 7351522 - DNA, 22 bp, Homo sapiens
ctgagggagaagtcacgggcag

SEQ ID NO: 7351523 - DNA, 22 bp, Homo sapiens
ctgagggagctgctggccttgg

SEQ ID NO: 7351524 - DNA, 22 bp, Homo sapiens
ctgagggagacagtgcggacta

SEQ ID NO: 7351525 - DNA, 22 bp, Homo sapiens
ctgagggagagaatggggcaaa

SEQ ID NO: 7351526 - DNA, 22 bp, Homo sapiens
ctgagggagagaatggggcaaa

SEQ ID NO: 7351527 - DNA, 22 bp, Homo sapiens
ctgagggatgggctgggccgcc

SEQ ID NO: 7351528 - DNA, 22 bp, Homo sapiens
ctgagggatgggctgggccgcc

SEQ ID NO: 7351529 - DNA, 22 bp, Homo sapiens
ctgagggcaccgacagagtgga

SEQ ID NO: 7351530 - DNA, 18 bp, Homo sapiens
ctgagggcagcccctggg

SEQ ID NO: 7351531 - DNA, 22 bp, Homo sapiens
ctgagctggttctcttgtgaaa

SEQ ID NO: 7351532 - DNA, 22 bp, Homo sapiens
ctgagctgtcaggaatggaaag

SEQ ID NO: 7351533 - DNA, 22 bp, Homo sapiens
ctgagctgtgctaagtgaaatg

SEQ ID NO: 7351534 - DNA, 22 bp, Homo sapiens
ctgaggaaagctgcagcggtac

SEQ ID NO: 7351535 - DNA, 22 bp, Homo sapiens
ctgaggaagaggtaccatttgt

SEQ ID NO: 7351536 - DNA, 22 bp, Homo sapiens
ctgaggaagacagcagctgtgt

SEQ ID NO: 7351537 - DNA, 22 bp, Homo sapiens
ctgagatcccaggcagggtggc

SEQ ID NO: 7351538 - DNA, 22 bp, Homo sapiens
ctgagatactgtggcgaatgca

SEQ ID NO: 7351539 - DNA, 22 bp, Homo sapiens
ctgagaggtaagcagcgcagtg

SEQ ID NO: 7351540 - DNA, 22 bp, Homo sapiens
ctgagaggtaagcagcgcagtg

SEQ ID NO: 7351541 - DNA, 20 bp, Homo sapiens
tttttctgggcttccatagc

SEQ ID NO: 7351542 - DNA, 22 bp, Homo sapiens
tttttctgtctcttacattgca

SEQ ID NO: 7351543 - DNA, 22 bp, Homo sapiens
tttttcttaaatgtgggttggc

SEQ ID NO: 7351544 - DNA, 22 bp, Homo sapiens
tttttcttgtgctggatctaat

SEQ ID NO: 7351545 - DNA, 22 bp, Homo sapiens
ctgaaactatggggaggggagc

SEQ ID NO: 7351546 - DNA, 22 bp, Homo sapiens
ctgaaactacagtaaggagaac

SEQ ID NO: 7351547 - DNA, 22 bp, Homo sapiens
ctgaaaatgttacacaggaaga

SEQ ID NO: 7351548 - DNA, 22 bp, Homo sapiens
ctgaaaatgttagtgatacgaa

SEQ ID NO: 7351549 - DNA, 19 bp, Homo sapiens
ctgaaacacagagagggct

SEQ ID NO: 7351550 - DNA, 22 bp, Homo sapiens
ctgaagcaaaggatcgagctaa

SEQ ID NO: 7351551 - DNA, 22 bp, Homo sapiens
ctgaaggacacgtgaggagcca

SEQ ID NO: 7351552 - DNA, 22 bp, Homo sapiens
ctgaaggatgtgtggtgggagt

SEQ ID NO: 7351553 - DNA, 18 bp, Homo sapiens
ctgaaggatccaggtgta

SEQ ID NO: 7351554 - DNA, 22 bp, Homo sapiens
ctgaaggattagagagcactta

SEQ ID NO: 7351555 - DNA, 22 bp, Homo sapiens
ctgaaggattcaaaatggcagg

SEQ ID NO: 7351556 - DNA, 22 bp, Homo sapiens
ctgaaggagcatagtcagtttt

SEQ ID NO: 7351557 - DNA, 22 bp, Homo sapiens
ctgaaggaggtagagtgacata

SEQ ID NO: 7351558 - DNA, 22 bp, Homo sapiens
ctgaaggagaaggccactgttc

SEQ ID NO: 7351559 - DNA, 22 bp, Homo sapiens
ctgaaggacttggtgatagttg

SEQ ID NO: 7351560 - DNA, 22 bp, Homo sapiens
ctgaagggtctggggctgtgcc

SEQ ID NO: 7351561 - DNA, 22 bp, Homo sapiens
ctgaagggggtttcactgagct

SEQ ID NO: 7351562 - DNA, 22 bp, Homo sapiens
ctgaagggggtttcactgagct

SEQ ID NO: 7351563 - DNA, 22 bp, Homo sapiens
ctgaaggcttgttgttttctta

SEQ ID NO: 7351564 - DNA, 22 bp, Homo sapiens
ctgaaggctgaggctgtgttgt

SEQ ID NO: 7351565 - DNA, 22 bp, Homo sapiens
ctgaaggcaccaggggtgccag

SEQ ID NO: 7351566 - DNA, 18 bp, Homo sapiens
ctgaaggcaccagggcag

SEQ ID NO: 7351567 - DNA, 22 bp, Homo sapiens
ctgaaggatttagttctttgct

SEQ ID NO: 7351568 - DNA, 22 bp, Homo sapiens
ctgaaggctaaaatggactgaa

SEQ ID NO: 7351569 - DNA, 22 bp, Homo sapiens
ctgaaggcatttttgctgattt

SEQ ID NO: 7351570 - DNA, 20 bp, Homo sapiens
ttttcctgtggtttgatatg

SEQ ID NO: 7351571 - DNA, 20 bp, Homo sapiens
ttttcctgtggtttgatatg

SEQ ID NO: 7351572 - DNA, 22 bp, Homo sapiens
ctctggagtcctgtatcactcc

SEQ ID NO: 7351573 - DNA, 22 bp, Homo sapiens
ctctggagtcctgtatcactcc

SEQ ID NO: 7351574 - DNA, 22 bp, Homo sapiens
ttttcctctgtatttgaaatgc

SEQ ID NO: 7351575 - DNA, 22 bp, Homo sapiens
ttttcctgcctgtctctagagg

SEQ ID NO: 7351576 - DNA, 22 bp, Homo sapiens
ctgcagtatcttaaaatttgta

SEQ ID NO: 7351577 - DNA, 22 bp, Homo sapiens
ctgcagtatcttaaaatttgta

SEQ ID NO: 7351578 - DNA, 22 bp, Homo sapiens
ctgcagtagtttttgactctag

SEQ ID NO: 7351579 - DNA, 22 bp, Homo sapiens
ctgcagtatctgctttgggtag

SEQ ID NO: 7351580 - DNA, 22 bp, Homo sapiens
ctgcagtagcacctgtggcttt

SEQ ID NO: 7351581 - DNA, 22 bp, Homo sapiens
ctgcagtgcctgccactgagcc

SEQ ID NO: 7351582 - DNA, 22 bp, Homo sapiens
ctgcagtgaggattcttaggtg

SEQ ID NO: 7351583 - DNA, 22 bp, Homo sapiens
ctgcaggggcctcgagcacagg

SEQ ID NO: 7351584 - DNA, 22 bp, Homo sapiens
ctgcaggggcctcgagcacagg

SEQ ID NO: 7351585 - DNA, 22 bp, Homo sapiens
ctgcagggtttttcaaggacaa

SEQ ID NO: 7351586 - DNA, 21 bp, Homo sapiens
ctgagggccgcagctgggctc

SEQ ID NO: 7351587 - DNA, 22 bp, Homo sapiens
ctgagggctggagctgaggcct

SEQ ID NO: 7351588 - DNA, 22 bp, Homo sapiens
ctgccctgggccaggaagcggc

SEQ ID NO: 7351589 - DNA, 22 bp, Homo sapiens
ctgcctctggcctcaggcccag

SEQ ID NO: 7351590 - DNA, 22 bp, Homo sapiens
ctgccctgcttgatgacagcga

SEQ ID NO: 7351591 - DNA, 22 bp, Homo sapiens
ctgccctgctctccgggatctt

SEQ ID NO: 7351592 - DNA, 20 bp, Homo sapiens
ctgccctgccctgggtcctg

SEQ ID NO: 7351593 - DNA, 22 bp, Homo sapiens
ctgccctgcagctccacggact

SEQ ID NO: 7351594 - DNA, 22 bp, Homo sapiens
ctgctgccctagacccagtcct

SEQ ID NO: 7351595 - DNA, 22 bp, Homo sapiens
ctgctgagccctggcacaggtg

SEQ ID NO: 7351596 - DNA, 22 bp, Homo sapiens
ctgctgagccgcacccaggagc

SEQ ID NO: 7351597 - DNA, 22 bp, Homo sapiens
ctgctgagccgcacccaggagc

SEQ ID NO: 7351598 - DNA, 20 bp, Homo sapiens
ctgctgccctgtcagcctct

SEQ ID NO: 7351599 - DNA, 22 bp, Homo sapiens
ctgctgccggcgagcctccctt

SEQ ID NO: 7351600 - DNA, 22 bp, Homo sapiens
ctgctgccggcgagcctccctt

SEQ ID NO: 7351601 - DNA, 22 bp, Homo sapiens
ctgctgagcatttgcagggaca

SEQ ID NO: 7351602 - DNA, 22 bp, Homo sapiens
ctgctctaggggcagggccctt

SEQ ID NO: 7351603 - DNA, 22 bp, Homo sapiens
ctgctcctgtgggccagtggcc

SEQ ID NO: 7351604 - DNA, 22 bp, Homo sapiens
ctgctcctgtccagcagggcca

SEQ ID NO: 7351605 - DNA, 22 bp, Homo sapiens
ctgctggaagtttgctgtggat

SEQ ID NO: 7351606 - DNA, 22 bp, Homo sapiens
ctgctggaaggtacacatcttg

SEQ ID NO: 7351607 - DNA, 22 bp, Homo sapiens
ctgctggaagtttgctgtggat

SEQ ID NO: 7351608 - DNA, 21 bp, Homo sapiens
ctgctgctggggtctgggcag

SEQ ID NO: 7351609 - DNA, 22 bp, Homo sapiens
ctgctgctgtaaggcagaatta

SEQ ID NO: 7351610 - DNA, 22 bp, Homo sapiens
ctgctgctgagaatgcctcagg

SEQ ID NO: 7351611 - DNA, 22 bp, Homo sapiens
ctgctgcctgattgcagacctc

SEQ ID NO: 7351612 - DNA, 22 bp, Homo sapiens
ctgctgcctgattgcagacctc

SEQ ID NO: 7351613 - DNA, 22 bp, Homo sapiens
ctgctcctggtcatcctccact

SEQ ID NO: 7351614 - DNA, 22 bp, Homo sapiens
ctgctcctggtcatcctccact

SEQ ID NO: 7351615 - DNA, 22 bp, Homo sapiens
ctgctcctgtccagcagggcca

SEQ ID NO: 7351616 - DNA, 19 bp, Homo sapiens
ctgctccctccttctggca

SEQ ID NO: 7351617 - DNA, 22 bp, Homo sapiens
ctgctccccagcctgcgccttt

SEQ ID NO: 7351618 - DNA, 22 bp, Homo sapiens
ctgctccaggatttcaggccag

SEQ ID NO: 7351619 - DNA, 22 bp, Homo sapiens
ctgctccagtagccccatgtgg

SEQ ID NO: 7351620 - DNA, 18 bp, Homo sapiens
ctgctccagtctggccag

SEQ ID NO: 7351621 - DNA, 22 bp, Homo sapiens
ctgctccacaccgtccatactc

SEQ ID NO: 7351622 - DNA, 22 bp, Homo sapiens
ctgctccacacctccatttcct

SEQ ID NO: 7351623 - DNA, 20 bp, Homo sapiens
ctgctccacccggctctcag

SEQ ID NO: 7351624 - DNA, 20 bp, Homo sapiens
ctgctccacccggctctcag

SEQ ID NO: 7351625 - DNA, 22 bp, Homo sapiens
ctgctccagacacctgcagggg

SEQ ID NO: 7351626 - DNA, 22 bp, Homo sapiens
ctgctccaggaacagagctgct

SEQ ID NO: 7351627 - DNA, 22 bp, Homo sapiens
ctgctccacctccgggtcaggc

SEQ ID NO: 7351628 - DNA, 22 bp, Homo sapiens
ctgctccaggaacagagctgct

SEQ ID NO: 7351629 - DNA, 23 bp, Homo sapiens
ctgctccaggacagcatggaggt

SEQ ID NO: 7351630 - DNA, 19 bp, Homo sapiens
ctgctccaggagctgggga

SEQ ID NO: 7351631 - DNA, 22 bp, Homo sapiens
ctgctccaggatttcaggccag

SEQ ID NO: 7351632 - DNA, 22 bp, Homo sapiens
ctgcggtgggctgggctgtccc

SEQ ID NO: 7351633 - DNA, 22 bp, Homo sapiens
ctgcgggctgtcaggcgtgcca

SEQ ID NO: 7351634 - DNA, 22 bp, Homo sapiens
ctgcctgcctggagacagatgg

SEQ ID NO: 7351635 - DNA, 22 bp, Homo sapiens
ctgcctgccacgttcagctgta

SEQ ID NO: 7351636 - DNA, 22 bp, Homo sapiens
ctgcctgcactgcctggctcca

SEQ ID NO: 7351637 - DNA, 23 bp, Homo sapiens
ctccctggcccttgggagacctg

SEQ ID NO: 7351638 - DNA, 22 bp, Homo sapiens
ctccctggtgtcccctccagga

SEQ ID NO: 7351639 - DNA, 22 bp, Homo sapiens
ctccggagagcagacgagggca

SEQ ID NO: 7351640 - DNA, 19 bp, Homo sapiens
ctcctcagtcccagaggtc

SEQ ID NO: 7351641 - DNA, 20 bp, Homo sapiens
ctcctcagttccatgggagg

SEQ ID NO: 7351642 - DNA, 22 bp, Homo sapiens
ctcctcagtcaggtctagggtc

SEQ ID NO: 7351643 - DNA, 19 bp, Homo sapiens
ctcctcagtcccagaggtc

SEQ ID NO: 7351644 - DNA, 21 bp, Homo sapiens
ctcctcaggaccagccacagg

SEQ ID NO: 7351645 - DNA, 22 bp, Homo sapiens
ctcctcagggctggttacatgg

SEQ ID NO: 7351646 - DNA, 22 bp, Homo sapiens
ctcctcagtcaggtctagggtc

SEQ ID NO: 7351647 - DNA, 22 bp, Homo sapiens
ctcctcagctgggaggagtccc

SEQ ID NO: 7351648 - DNA, 22 bp, Homo sapiens
ctcctcaggaagtagcatgtgt

SEQ ID NO: 7351649 - DNA, 21 bp, Homo sapiens
ctcctcaggaccagccacagg

SEQ ID NO: 7351650 - DNA, 22 bp, Homo sapiens
ttgtttaatgcctcatacatct

SEQ ID NO: 7351651 - DNA, 22 bp, Homo sapiens
ttgtttacactgcagaattggg

SEQ ID NO: 7351652 - DNA, 22 bp, Homo sapiens
ttgtttatggattgtagaaact

SEQ ID NO: 7351653 - DNA, 22 bp, Homo sapiens
ttgtttatgtgttgtctatggc

SEQ ID NO: 7351654 - DNA, 22 bp, Homo sapiens
ttgtttattagcaattatcctg

SEQ ID NO: 7351655 - DNA, 22 bp, Homo sapiens
ttgtttcagctgtatgctatgt

SEQ ID NO: 7351656 - DNA, 22 bp, Homo sapiens
ttgtttcagctgtatgctatgt

SEQ ID NO: 7351657 - DNA, 20 bp, Homo sapiens
ttgtttattatgttctgatc

SEQ ID NO: 7351658 - DNA, 22 bp, Homo sapiens
ttgtttcaaatatttcagaata

SEQ ID NO: 7351659 - DNA, 22 bp, Homo sapiens
ttgtttaatatcgtgaagtact

SEQ ID NO: 7351660 - DNA, 22 bp, Homo sapiens
ttgtttaatgcctcatacatct

SEQ ID NO: 7351661 - DNA, 22 bp, Homo sapiens
ctccccagcattctgacttcct

SEQ ID NO: 7351662 - DNA, 22 bp, Homo sapiens
ctcaggcttgggaggaggccca

SEQ ID NO: 7351663 - DNA, 22 bp, Homo sapiens
ctcaggctgccctgacagcccc

SEQ ID NO: 7351664 - DNA, 21 bp, Homo sapiens
ctcaggctggcagcaggctag

SEQ ID NO: 7351665 - DNA, 22 bp, Homo sapiens
ctcctgtcagaagcatcctgag

SEQ ID NO: 7351666 - DNA, 22 bp, Homo sapiens
tttcaaagtcaatatcattacc

SEQ ID NO: 7351667 - DNA, 22 bp, Homo sapiens
tttcaaagtaaggattttcatc

SEQ ID NO: 7351668 - DNA, 22 bp, Homo sapiens
ctcctgggctgtcggcgctctg

SEQ ID NO: 7351669 - DNA, 22 bp, Homo sapiens
ctcctgtcaataggctcctggc

SEQ ID NO: 7351670 - DNA, 22 bp, Homo sapiens
ctcctgtcaataggctcctggc

SEQ ID NO: 7351671 - DNA, 22 bp, Homo sapiens
tttcaaagttgggaattgtaat

SEQ ID NO: 7351672 - DNA, 22 bp, Homo sapiens
tttacaattggttttctctaat

SEQ ID NO: 7351673 - DNA, 20 bp, Homo sapiens
ctcctcagttccatgggagg

SEQ ID NO: 7351674 - DNA, 22 bp, Homo sapiens
ctcctcagttgtcccatggaga

SEQ ID NO: 7351675 - DNA, 22 bp, Homo sapiens
ctcctgcctgtgggactgagga

SEQ ID NO: 7351676 - DNA, 22 bp, Homo sapiens
tttacacagaggacactgggct

SEQ ID NO: 7351677 - DNA, 22 bp, Homo sapiens
tttatatgtgaaggtttgcaga

SEQ ID NO: 7351678 - DNA, 22 bp, Homo sapiens
tttatatggttgactatgagtt

SEQ ID NO: 7351679 - DNA, 22 bp, Homo sapiens
ctcctggaggctccaagggaga

SEQ ID NO: 7351680 - DNA, 22 bp, Homo sapiens
ctcctggacatggagcggagga

SEQ ID NO: 7351681 - DNA, 22 bp, Homo sapiens
ctctattctaatggattctggg

SEQ ID NO: 7351682 - DNA, 22 bp, Homo sapiens
ctctatgttatgcagaattaag

SEQ ID NO: 7351683 - DNA, 22 bp, Homo sapiens
tttctcagaatataaaattctc

SEQ ID NO: 7351684 - DNA, 22 bp, Homo sapiens
ctctagacaacttgctgtgggt

SEQ ID NO: 7351685 - DNA, 22 bp, Homo sapiens
ctctctggaattaaagcccaat

SEQ ID NO: 7351686 - DNA, 20 bp, Homo sapiens
ctctctggaaggtgggagcc

SEQ ID NO: 7351687 - DNA, 22 bp, Homo sapiens
ctctctggaattaaagcccaat

SEQ ID NO: 7351688 - DNA, 22 bp, Homo sapiens
ctctgagggctcgagggacgcg

SEQ ID NO: 7351689 - DNA, 22 bp, Homo sapiens
ctctgacagccttcattatgca

SEQ ID NO: 7351690 - DNA, 22 bp, Homo sapiens
tttctgatttgacttgaagtat

SEQ ID NO: 7351691 - DNA, 22 bp, Homo sapiens
tttctgattctcactttggcat

SEQ ID NO: 7351692 - DNA, 22 bp, Homo sapiens
tttctgatatactgtagaatcc

SEQ ID NO: 7351693 - DNA, 22 bp, Homo sapiens
tttctgattctcactttggcat

SEQ ID NO: 7351694 - DNA, 22 bp, Homo sapiens
tttctgatattcatttagaaga

SEQ ID NO: 7351695 - DNA, 20 bp, Homo sapiens
ctctgctttaggagagtcag

SEQ ID NO: 7351696 - DNA, 22 bp, Homo sapiens
tttgaagggcacgacaatagtt

SEQ ID NO: 7351697 - DNA, 22 bp, Homo sapiens
tttgaagggcacgacaatagtt

SEQ ID NO: 7351698 - DNA, 22 bp, Homo sapiens
tttgaagtcaaagattgattcc

SEQ ID NO: 7351699 - DNA, 22 bp, Homo sapiens
tttgaagtgtatgaaaatacag

SEQ ID NO: 7351700 - DNA, 22 bp, Homo sapiens
ctctggagcgctgcttcccgcg

SEQ ID NO: 7351701 - DNA, 22 bp, Homo sapiens
ctctggagcatttcacctacat

SEQ ID NO: 7351702 - DNA, 19 bp, Homo sapiens
ctctggagcagacactgga

SEQ ID NO: 7351703 - DNA, 22 bp, Homo sapiens
ctctggaattgacctgggaggg

SEQ ID NO: 7351704 - DNA, 22 bp, Homo sapiens
tttgaataaacggttaatgttc

SEQ ID NO: 7351705 - DNA, 22 bp, Homo sapiens
tttgaagttcccccatatcaga

SEQ ID NO: 7351706 - DNA, 22 bp, Homo sapiens
ctctggaattaaggaagcctgt

SEQ ID NO: 7351707 - DNA, 22 bp, Homo sapiens
ctctggaggtcaggtgtggtgg

SEQ ID NO: 7351708 - DNA, 22 bp, Homo sapiens
ctctggaggtggaggttgcagt

SEQ ID NO: 7351709 - DNA, 22 bp, Homo sapiens
ctctggaggttgagcccagcaa

SEQ ID NO: 7351710 - DNA, 19 bp, Homo sapiens
ctctggagtcattgctccc

SEQ ID NO: 7351711 - DNA, 22 bp, Homo sapiens
ctctggagtcaggcagccctgg

SEQ ID NO: 7351712 - DNA, 22 bp, Homo sapiens
ctctggagtaagagctatgaaa

SEQ ID NO: 7351713 - DNA, 21 bp, Homo sapiens
ctctggagtcaagagcttcca

SEQ ID NO: 7351714 - DNA, 22 bp, Homo sapiens
ctctggagggaggctgagctgg

SEQ ID NO: 7351715 - DNA, 19 bp, Homo sapiens
ctctggagggaccgccgtt

SEQ ID NO: 7351716 - DNA, 22 bp, Homo sapiens
ctctggaggcctaaggaagtgg

SEQ ID NO: 7351717 - DNA, 22 bp, Homo sapiens
ctctggaggcagcaccagccag

SEQ ID NO: 7351718 - DNA, 22 bp, Homo sapiens
ctctggaggccgttggccctta

SEQ ID NO: 7351719 - DNA, 21 bp, Homo sapiens
ctctggaggcaagggagagtg

SEQ ID NO: 7351720 - DNA, 22 bp, Homo sapiens
ctctggagcgctgcttcccgcg

SEQ ID NO: 7351721 - DNA, 22 bp, Homo sapiens
ctctgctgcccaggcctgctag

SEQ ID NO: 7351722 - DNA, 22 bp, Homo sapiens
ctctgctggccatgaagagaga

SEQ ID NO: 7351723 - DNA, 22 bp, Homo sapiens
ctctgctggcagcccccgggcc

SEQ ID NO: 7351724 - DNA, 22 bp, Homo sapiens
ctctgctgcccatgatggtata

SEQ ID NO: 7351725 - DNA, 20 bp, Homo sapiens
ctctgctgcccgccggctgc

SEQ ID NO: 7351726 - DNA, 20 bp, Homo sapiens
ctctgctgcgcatcccactt

SEQ ID NO: 7351727 - DNA, 20 bp, Homo sapiens
ctctgctgcgcatcccactt

SEQ ID NO: 7351728 - DNA, 22 bp, Homo sapiens
ctctgctgcttgccagtcattg

SEQ ID NO: 7351729 - DNA, 22 bp, Homo sapiens
ctctgctgctttgccagtggaa

SEQ ID NO: 7351730 - DNA, 21 bp, Homo sapiens
ctctgctgtctaccagctgtt

SEQ ID NO: 7351731 - DNA, 22 bp, Homo sapiens
ctctgctgggatgtaaagtctt

SEQ ID NO: 7351732 - DNA, 22 bp, Homo sapiens
ctctgctggtagctcattccat

SEQ ID NO: 7351733 - DNA, 22 bp, Homo sapiens
ctctgctggtgaccactgggcc

SEQ ID NO: 7351734 - DNA, 22 bp, Homo sapiens
ctctgctgtgccgccagggcct

SEQ ID NO: 7351735 - DNA, 22 bp, Homo sapiens
ctctgctgtctccagggcagtc

SEQ ID NO: 7351736 - DNA, 22 bp, Homo sapiens
ctctgcttggaacaggggtttg

SEQ ID NO: 7351737 - DNA, 22 bp, Homo sapiens
ctctgcttggaactggacagaa

SEQ ID NO: 7351738 - DNA, 22 bp, Homo sapiens
ctctgcttgtatcacatttgct

SEQ ID NO: 7351739 - DNA, 22 bp, Homo sapiens
ctctgcttctgagatggaagct

SEQ ID NO: 7351740 - DNA, 22 bp, Homo sapiens
ctctgcttcatccaccactggc

SEQ ID NO: 7351741 - DNA, 22 bp, Homo sapiens
ctctgctgttttgtatacaggc

SEQ ID NO: 7351742 - DNA, 22 bp, Homo sapiens
ctctgctgttcttatgtgtcct

SEQ ID NO: 7351743 - DNA, 22 bp, Homo sapiens
tttcttgaccactatgttgata

SEQ ID NO: 7351744 - DNA, 22 bp, Homo sapiens
tttcttatattctgtcattgtt

SEQ ID NO: 7351745 - DNA, 22 bp, Homo sapiens
tttcttatactatattgtcatc

SEQ ID NO: 7351746 - DNA, 22 bp, Homo sapiens
ctttgatctactcactaaacaa

SEQ ID NO: 7351747 - DNA, 22 bp, Homo sapiens
ctttaattaggaagtataatga

SEQ ID NO: 7351748 - DNA, 22 bp, Homo sapiens
ctttaacagttccattcaattt

SEQ ID NO: 7351749 - DNA, 22 bp, Homo sapiens
ctttaagagatcaccaatcaca

SEQ ID NO: 7351750 - DNA, 22 bp, Homo sapiens
ctttctcttcagcacccagccc

SEQ ID NO: 7351751 - DNA, 22 bp, Homo sapiens
ctttacaaatagggagggagtg

SEQ ID NO: 7351752 - DNA, 22 bp, Homo sapiens
ctttacaaagcaattttgtctc

SEQ ID NO: 7351753 - DNA, 22 bp, Homo sapiens
cttgttttcttctgcagtctat

SEQ ID NO: 7351754 - DNA, 21 bp, Homo sapiens
cttgttttgaaaggactggcc

SEQ ID NO: 7351755 - DNA, 22 bp, Homo sapiens
cttgttttgaaagcagtggcca

SEQ ID NO: 7351756 - DNA, 22 bp, Homo sapiens
cttgttttggaacagagtgaat

SEQ ID NO: 7351757 - DNA, 22 bp, Homo sapiens
cttgttttggctagtatgatgt

SEQ ID NO: 7351758 - DNA, 22 bp, Homo sapiens
cttgtttttaagagatgtttac

SEQ ID NO: 7351759 - DNA, 22 bp, Homo sapiens
cttgtgaaatgccagataatct

SEQ ID NO: 7351760 - DNA, 22 bp, Homo sapiens
cttgtgaaatgccagataatct

SEQ ID NO: 7351761 - DNA, 22 bp, Homo sapiens
cttgtgcttttatgaatgcaga

SEQ ID NO: 7351762 - DNA, 22 bp, Homo sapiens
cttgtgcttttatgaatgcaga

SEQ ID NO: 7351763 - DNA, 22 bp, Homo sapiens
cttctggagctcaccaacttcc

SEQ ID NO: 7351764 - DNA, 22 bp, Homo sapiens
cttctggaggacactggcccca

SEQ ID NO: 7351765 - DNA, 22 bp, Homo sapiens
cttctgaaacccccagtgtggg

SEQ ID NO: 7351766 - DNA, 22 bp, Homo sapiens
cttctcttggtagttcttgttg

SEQ ID NO: 7351767 - DNA, 22 bp, Homo sapiens
cttctgctgctgttcatggttg

SEQ ID NO: 7351768 - DNA, 22 bp, Homo sapiens
cttctgaatggctgtgtatgct

SEQ ID NO: 7351769 - DNA, 22 bp, Homo sapiens
cttttcttactcccgcaaggca

SEQ ID NO: 7351770 - DNA, 22 bp, Homo sapiens
cttttcttctcacggctgtcag

SEQ ID NO: 7351771 - DNA, 22 bp, Homo sapiens
cttttcttatgtggacgtacct

SEQ ID NO: 7351772 - DNA, 22 bp, Homo sapiens
cttttcttgtattggatgcccc

SEQ ID NO: 7351773 - DNA, 22 bp, Homo sapiens
cttttgatggagttcaagaagc

SEQ ID NO: 7351774 - DNA, 22 bp, Homo sapiens
cttttgatagttgctgagcagg

SEQ ID NO: 7351775 - DNA, 22 bp, Homo sapiens
ctttgattcagagagaattagc

SEQ ID NO: 7351776 - DNA, 22 bp, Homo sapiens
cttttcattgtttgtacatgca

SEQ ID NO: 7351777 - DNA, 22 bp, Homo sapiens
cttttccactgagcctcacaaa

SEQ ID NO: 7351778 - DNA, 18 bp, Homo sapiens
cttttcccctttggactc

SEQ ID NO: 7351779 - DNA, 22 bp, Homo sapiens
gaaacactcaatttagtaattc

SEQ ID NO: 7351780 - DNA, 22 bp, Homo sapiens
gaaacactatgccaagacaggg

SEQ ID NO: 7351781 - DNA, 22 bp, Homo sapiens
gaaacagcacgtttggagagat

SEQ ID NO: 7351782 - DNA, 22 bp, Homo sapiens
gaaacactggtaaagactgccg

SEQ ID NO: 7351783 - DNA, 22 bp, Homo sapiens
gaaacaatttttgttgtctaag

SEQ ID NO: 7351784 - DNA, 22 bp, Homo sapiens
gaaacacatgcagctccataga

SEQ ID NO: 7351785 - DNA, 22 bp, Homo sapiens
gaaagagaggggctgagatgca

SEQ ID NO: 7351786 - DNA, 22 bp, Homo sapiens
gaaagcatccgcctggaggtgg

SEQ ID NO: 7351787 - DNA, 22 bp, Homo sapiens
gaaagccatctggctgctggga

SEQ ID NO: 7351788 - DNA, 22 bp, Homo sapiens
gaaacaatacttgtcctcacta

SEQ ID NO: 7351789 - DNA, 22 bp, Homo sapiens
gaaacaatcatcatgtgatttg

SEQ ID NO: 7351790 - DNA, 22 bp, Homo sapiens
gaaacaatcatcatgtgatttg

SEQ ID NO: 7351791 - DNA, 22 bp, Homo sapiens
gaaaatttagaactgaacttct

SEQ ID NO: 7351792 - DNA, 22 bp, Homo sapiens
gaaaatttctgccacatgtgtg

SEQ ID NO: 7351793 - DNA, 22 bp, Homo sapiens
gaaaatttctgccacatgtgtg

SEQ ID NO: 7351794 - DNA, 22 bp, Homo sapiens
gaaaatagcagatagaccaatg

SEQ ID NO: 7351795 - DNA, 22 bp, Homo sapiens
gaaaattattgaaaatggctct

SEQ ID NO: 7351796 - DNA, 22 bp, Homo sapiens
gaaaatgtttgtccggagctga

SEQ ID NO: 7351797 - DNA, 21 bp, Homo sapiens
ctgtttcttgtgaagtgacac

SEQ ID NO: 7351798 - DNA, 22 bp, Homo sapiens
ctgtggaaggcctgtcctgaaa

SEQ ID NO: 7351799 - DNA, 22 bp, Homo sapiens
ctgtggaagagggtcaccagta

SEQ ID NO: 7351800 - DNA, 22 bp, Homo sapiens
ctgtggaagctgacacggtggt

SEQ ID NO: 7351801 - DNA, 22 bp, Homo sapiens
ctgtttaatgcaatgaaatgag

SEQ ID NO: 7351802 - DNA, 22 bp, Homo sapiens
ctgtggaagagggtcaccagta

SEQ ID NO: 7351803 - DNA, 22 bp, Homo sapiens
ctgtgctttcgagatgtgatct

SEQ ID NO: 7351804 - DNA, 22 bp, Homo sapiens
ctgtggaaaatgctttacatat

SEQ ID NO: 7351805 - DNA, 22 bp, Homo sapiens
ctgtgcttccaggatggcagct

SEQ ID NO: 7351806 - DNA, 22 bp, Homo sapiens
ctgtgcttccaggatggcagct

SEQ ID NO: 7351807 - DNA, 22 bp, Homo sapiens
ctgtgcttgtgttcattgttaa

SEQ ID NO: 7351808 - DNA, 22 bp, Homo sapiens
ctgtgcttgtgttcattgttaa

SEQ ID NO: 7351809 - DNA, 20 bp, Homo sapiens
cttaaacacagagatagatt

SEQ ID NO: 7351810 - DNA, 22 bp, Homo sapiens
cttaaacaggaaagagccaggt

SEQ ID NO: 7351811 - DNA, 22 bp, Homo sapiens
cttaaactgaaagctacaagat

SEQ ID NO: 7351812 - DNA, 22 bp, Homo sapiens
ctgtttgttggctattgacagt

SEQ ID NO: 7351813 - DNA, 22 bp, Homo sapiens
ctgttttaatggagactgatgt

SEQ ID NO: 7351814 - DNA, 22 bp, Homo sapiens
ctgttttatgaagggaatgaga

SEQ ID NO: 7351815 - DNA, 22 bp, Homo sapiens
ctgtttgtgattagcagtgggt

SEQ ID NO: 7351816 - DNA, 22 bp, Homo sapiens
ctgtttgtctctctcctgaccc

SEQ ID NO: 7351817 - DNA, 17 bp, Homo sapiens
ctgtttgttctgggagc

SEQ ID NO: 7351818 - DNA, 22 bp, Homo sapiens
ctgtttgtgatttctacgattt

SEQ ID NO: 7351819 - DNA, 22 bp, Homo sapiens
ctgtttgtccaacttgtcccga

SEQ ID NO: 7351820 - DNA, 22 bp, Homo sapiens
ctgtttgctggctatgaactcc

SEQ ID NO: 7351821 - DNA, 22 bp, Homo sapiens
cttaaattttcatctacaagaa

SEQ ID NO: 7351822 - DNA, 22 bp, Homo sapiens
cttaaatccatcatttctaatc

SEQ ID NO: 7351823 - DNA, 22 bp, Homo sapiens
cttaaagtctatcctttctaga

SEQ ID NO: 7351824 - DNA, 22 bp, Homo sapiens
cttaaagagtatttaatataat

SEQ ID NO: 7351825 - DNA, 22 bp, Homo sapiens
cttacaacttgtatgtgattgt

SEQ ID NO: 7351826 - DNA, 22 bp, Homo sapiens
cttagaaataatggtttcagtt

SEQ ID NO: 7351827 - DNA, 22 bp, Homo sapiens
cttaggaaagttggctgatttc

SEQ ID NO: 7351828 - DNA, 22 bp, Homo sapiens
cttagccctgagagttctgagc

SEQ ID NO: 7351829 - DNA, 22 bp, Homo sapiens
cttagccctgagagttctgagc

SEQ ID NO: 7351830 - DNA, 22 bp, Homo sapiens
cttcagttagtttcatgtgagc

SEQ ID NO: 7351831 - DNA, 22 bp, Homo sapiens
cttccaaaatttatatgttgaa

SEQ ID NO: 7351832 - DNA, 22 bp, Homo sapiens
cttccaaagcactttatggacc

SEQ ID NO: 7351833 - DNA, 22 bp, Homo sapiens
cttcatttggagaactgtgctt

SEQ ID NO: 7351834 - DNA, 22 bp, Homo sapiens
cttctagagtttctgatgcaac

SEQ ID NO: 7351835 - DNA, 22 bp, Homo sapiens
cttctatgaggagagacatgca

SEQ ID NO: 7351836 - DNA, 23 bp, Homo sapiens
cttctagagtcagctccaagttt

SEQ ID NO: 7351837 - DNA, 19 bp, Homo sapiens
cttctagaccttataccac

SEQ ID NO: 7351838 - DNA, 22 bp, Homo sapiens
cttctagaaccctctattcttt

SEQ ID NO: 7351839 - DNA, 21 bp, Homo sapiens
cttctcaggaccacactagga

SEQ ID NO: 7351840 - DNA, 22 bp, Homo sapiens
cttcgtttttagtagcaatgtt

SEQ ID NO: 7351841 - DNA, 20 bp, Homo sapiens
cttccaccagggccgctgat

SEQ ID NO: 7351842 - DNA, 22 bp, Homo sapiens
cttccaagttgctctgctgacc

SEQ ID NO: 7351843 - DNA, 22 bp, Homo sapiens
cttccaagtggggcacgtgcca

SEQ ID NO: 7351844 - DNA, 22 bp, Homo sapiens
cttccaagtggggcacgtgcca

SEQ ID NO: 7351845 - DNA, 22 bp, Homo sapiens
cttccaagtggggcacgtgcca

SEQ ID NO: 7351846 - DNA, 22 bp, Homo sapiens
ctggtctgggatgagggatgta

SEQ ID NO: 7351847 - DNA, 22 bp, Homo sapiens
ctggtctggctacccagcgaat

SEQ ID NO: 7351848 - DNA, 22 bp, Homo sapiens
ctggtctgggatgagggatgta

SEQ ID NO: 7351849 - DNA, 22 bp, Homo sapiens
ctggtctgcgggaaggcgtggg

SEQ ID NO: 7351850 - DNA, 22 bp, Homo sapiens
ctggtctgcgggaaggcgtggg

SEQ ID NO: 7351851 - DNA, 20 bp, Homo sapiens
ctggtctgccactcacagtt

SEQ ID NO: 7351852 - DNA, 22 bp, Homo sapiens
ctggtctgaggttgcccttgaa

SEQ ID NO: 7351853 - DNA, 22 bp, Homo sapiens
ctggtctgaaaaggaggcatgc

SEQ ID NO: 7351854 - DNA, 20 bp, Homo sapiens
ctggggagcctcgcggtggc

SEQ ID NO: 7351855 - DNA, 20 bp, Homo sapiens
ctggggagcctcgcggtggc

SEQ ID NO: 7351856 - DNA, 19 bp, Homo sapiens
ctgggcttgatgttgagtt

SEQ ID NO: 7351857 - DNA, 22 bp, Homo sapiens
ctggggaacaatttgccacact

SEQ ID NO: 7351858 - DNA, 22 bp, Homo sapiens
ctggggaacgcagcgagcagcg

SEQ ID NO: 7351859 - DNA, 22 bp, Homo sapiens
ctggggagaagcgactcggctg

SEQ ID NO: 7351860 - DNA, 22 bp, Homo sapiens
ctggggaaggcggtgactgcgc

SEQ ID NO: 7351861 - DNA, 22 bp, Homo sapiens
ctggggaatagagctggagacc

SEQ ID NO: 7351862 - DNA, 22 bp, Homo sapiens
ctggtgccattctgtggcctag

SEQ ID NO: 7351863 - DNA, 22 bp, Homo sapiens
ctgtacaaagtagctgctggga

SEQ ID NO: 7351864 - DNA, 22 bp, Homo sapiens
ctgtacagcaagttcaccttgg

SEQ ID NO: 7351865 - DNA, 22 bp, Homo sapiens
ctgtacataaaggaataggtgt

SEQ ID NO: 7351866 - DNA, 22 bp, Homo sapiens
ctgtacatatacatttttttcc

SEQ ID NO: 7351867 - DNA, 22 bp, Homo sapiens
ctgtacaagtccttcatcaggg

SEQ ID NO: 7351868 - DNA, 22 bp, Homo sapiens
ctgtacatcccaagatatttct

SEQ ID NO: 7351869 - DNA, 22 bp, Homo sapiens
ctgtacatatgtctccagagtg

SEQ ID NO: 7351870 - DNA, 20 bp, Homo sapiens
ctgtacatcaccaaggtgac

SEQ ID NO: 7351871 - DNA, 22 bp, Homo sapiens
ctgtacatcttaaatggaaaaa

SEQ ID NO: 7351872 - DNA, 22 bp, Homo sapiens
ctgtacatcccgagagccagta

SEQ ID NO: 7351873 - DNA, 22 bp, Homo sapiens
ctgtacatctctgaggacagta

SEQ ID NO: 7351874 - DNA, 22 bp, Homo sapiens
ctgtagcaagttattcaataaa

SEQ ID NO: 7351875 - DNA, 22 bp, Homo sapiens
ctgtctggtgtccctgtctaca

SEQ ID NO: 7351876 - DNA, 22 bp, Homo sapiens
ctgtctgtacaaatgtggggcc

SEQ ID NO: 7351877 - DNA, 19 bp, Homo sapiens
ctgtctggttcatgtgttc

SEQ ID NO: 7351878 - DNA, 22 bp, Homo sapiens
ctgtctggagttatgtaaatag

SEQ ID NO: 7351879 - DNA, 22 bp, Homo sapiens
ctgtctggaatttaagataaag

SEQ ID NO: 7351880 - DNA, 22 bp, Homo sapiens
ctgtctggaatgcagtacatag

SEQ ID NO: 7351881 - DNA, 22 bp, Homo sapiens
ctgtctggatataccttggcca

SEQ ID NO: 7351882 - DNA, 22 bp, Homo sapiens
ctgtctggatgtgagtcaccta

SEQ ID NO: 7351883 - DNA, 21 bp, Homo sapiens
ctgtctggccgcgggctccgc

SEQ ID NO: 7351884 - DNA, 22 bp, Homo sapiens
ctgtctggtcaacaactgagtg

SEQ ID NO: 7351885 - DNA, 22 bp, Homo sapiens
ctgtctgggtctacatcctctg

SEQ ID NO: 7351886 - DNA, 22 bp, Homo sapiens
ctgtctggccggcccagcttcc

SEQ ID NO: 7351887 - DNA, 18 bp, Homo sapiens
ctgtgccctgctcctact

SEQ ID NO: 7351888 - DNA, 22 bp, Homo sapiens
ctgtgccctggccaggcctctc

SEQ ID NO: 7351889 - DNA, 22 bp, Homo sapiens
ctgtgccctggccaggcctctc

SEQ ID NO: 7351890 - DNA, 22 bp, Homo sapiens
ctgtgccctgtggctggcacct

SEQ ID NO: 7351891 - DNA, 22 bp, Homo sapiens
ctgtgctctggcatcgctgcaa

SEQ ID NO: 7351892 - DNA, 22 bp, Homo sapiens
ctgtgctgaacaattctgcatt

SEQ ID NO: 7351893 - DNA, 22 bp, Homo sapiens
ctgtgctctggcatcgctgcaa

SEQ ID NO: 7351894 - DNA, 22 bp, Homo sapiens
ctgtgctgaggatgcagtttct

SEQ ID NO: 7351895 - DNA, 22 bp, Homo sapiens
ctgtgctgagtgatgtgactta

SEQ ID NO: 7351896 - DNA, 22 bp, Homo sapiens
ctgtgctgattcagcacaggcc

SEQ ID NO: 7351897 - DNA, 22 bp, Homo sapiens
ctgtgcttagccatcacattca

SEQ ID NO: 7351898 - DNA, 22 bp, Homo sapiens
ctgtgcttagccatcacattca

SEQ ID NO: 7351899 - DNA, 22 bp, Homo sapiens
ctgtgctgtcttgggagcctta

SEQ ID NO: 7351900 - DNA, 22 bp, Homo sapiens
ctgtgctggtccagggagctgg

SEQ ID NO: 7351901 - DNA, 22 bp, Homo sapiens
ctgtgctggtgaaacccacaga

SEQ ID NO: 7351902 - DNA, 22 bp, Homo sapiens
ctgtgctggtccagggagctgg

SEQ ID NO: 7351903 - DNA, 22 bp, Homo sapiens
ctgtgctgggtgtgcttatgat

SEQ ID NO: 7351904 - DNA, 22 bp, Homo sapiens
ctgtgctgggtccttcttttga

SEQ ID NO: 7351905 - DNA, 23 bp, Homo sapiens
ctgtgctgggtcccatcttgggc

SEQ ID NO: 7351906 - DNA, 22 bp, Homo sapiens
ctgtgctggcagcaatcaagga

SEQ ID NO: 7351907 - DNA, 22 bp, Homo sapiens
ctgtgctggcagacctggagtt

SEQ ID NO: 7351908 - DNA, 22 bp, Homo sapiens
ctgtgctggagatgggccagag

SEQ ID NO: 7351909 - DNA, 22 bp, Homo sapiens
ctgtgctggattctgaggctac

SEQ ID NO: 7351910 - DNA, 22 bp, Homo sapiens
ctgtgctgctagacctggattc

SEQ ID NO: 7351911 - DNA, 22 bp, Homo sapiens
ctgtgctgcagacgcagtagct

SEQ ID NO: 7351912 - DNA, 22 bp, Homo sapiens
ctgtgctggagatgggccagag

SEQ ID NO: 7351913 - DNA, 22 bp, Homo sapiens
ctgtcaggttggtctcagagct

SEQ ID NO: 7351914 - DNA, 22 bp, Homo sapiens
ctgtctgcaggatagtaccctc

SEQ ID NO: 7351915 - DNA, 22 bp, Homo sapiens
ctgtctgccctggccagagccc

SEQ ID NO: 7351916 - DNA, 22 bp, Homo sapiens
ctgtctgccctggccagagccc

SEQ ID NO: 7351917 - DNA, 22 bp, Homo sapiens
ctgtctgccaataatctatggc

SEQ ID NO: 7351918 - DNA, 22 bp, Homo sapiens
ctgtctgccctggccagagccc

SEQ ID NO: 7351919 - DNA, 22 bp, Homo sapiens
ctgtcagtaggctcccatcatt

SEQ ID NO: 7351920 - DNA, 22 bp, Homo sapiens
ctgtatatggcttactttatat

SEQ ID NO: 7351921 - DNA, 22 bp, Homo sapiens
ctgtatttgtcctctatttatt

SEQ ID NO: 7351922 - DNA, 22 bp, Homo sapiens
ctgtatttgtcctctatttatt

SEQ ID NO: 7351923 - DNA, 22 bp, Homo sapiens
ctgtattttcatgcctacgtac

SEQ ID NO: 7351924 - DNA, 22 bp, Homo sapiens
ctgtcacactaaaacaagaagt

SEQ ID NO: 7351925 - DNA, 22 bp, Homo sapiens
ctgggagcaagtcaggaaaggt

SEQ ID NO: 7351926 - DNA, 22 bp, Homo sapiens
ctgggagcaagtcaggaaaggt

SEQ ID NO: 7351927 - DNA, 22 bp, Homo sapiens
ctgggcactgcagcaggcatca

SEQ ID NO: 7351928 - DNA, 22 bp, Homo sapiens
ctgggcagaattttaggatggc

SEQ ID NO: 7351929 - DNA, 22 bp, Homo sapiens
ctgggcagagctaacacctgag

SEQ ID NO: 7351930 - DNA, 22 bp, Homo sapiens
ctgggcagcacatcatcgtatc

SEQ ID NO: 7351931 - DNA, 22 bp, Homo sapiens
ctgggcagagtccggaagatgg

SEQ ID NO: 7351932 - DNA, 22 bp, Homo sapiens
ctgggcagagtccggaagatgg

SEQ ID NO: 7351933 - DNA, 22 bp, Homo sapiens
ctgggcagcctcacacaatgtt

SEQ ID NO: 7351934 - DNA, 22 bp, Homo sapiens
ctgggcagctccataccaccca

SEQ ID NO: 7351935 - DNA, 22 bp, Homo sapiens
ctgggcagctaccaccactgct

SEQ ID NO: 7351936 - DNA, 22 bp, Homo sapiens
ctgggcagctgtatcagggagt

SEQ ID NO: 7351937 - DNA, 22 bp, Homo sapiens
ctgggcagctgtatcagggagt

SEQ ID NO: 7351938 - DNA, 22 bp, Homo sapiens
ctgggcgcgtcccctgaggcgg

SEQ ID NO: 7351939 - DNA, 22 bp, Homo sapiens
ctgggctagaaggaccaggatg

SEQ ID NO: 7351940 - DNA, 22 bp, Homo sapiens
ctgggagatatgaggatctgga

SEQ ID NO: 7351941 - DNA, 22 bp, Homo sapiens
ctgggagaggtggtgggaagta

SEQ ID NO: 7351942 - DNA, 22 bp, Homo sapiens
ctgggagatctgttgggactgg

SEQ ID NO: 7351943 - DNA, 22 bp, Homo sapiens
ctgggagatctcctgagggcag

SEQ ID NO: 7351944 - DNA, 22 bp, Homo sapiens
ctgggagattgaggccatggtg

SEQ ID NO: 7351945 - DNA, 22 bp, Homo sapiens
ctgcttatggagatgagtaaga

SEQ ID NO: 7351946 - DNA, 22 bp, Homo sapiens
ctgcttatggaattgtatactg

SEQ ID NO: 7351947 - DNA, 18 bp, Homo sapiens
ctgcttacaaaaataccc

SEQ ID NO: 7351948 - DNA, 22 bp, Homo sapiens
ctgcttaatttaatagttgcaa

SEQ ID NO: 7351949 - DNA, 22 bp, Homo sapiens
ctgcttaaaatgcagattctgt

SEQ ID NO: 7351950 - DNA, 22 bp, Homo sapiens
ctgctgtgttgccagtgtcacc

SEQ ID NO: 7351951 - DNA, 20 bp, Homo sapiens
ctgctgtgttattgtagaac

SEQ ID NO: 7351952 - DNA, 22 bp, Homo sapiens
ctgctgtgattgggagaaaccg

SEQ ID NO: 7351953 - DNA, 22 bp, Homo sapiens
ctgctgtgcagacagactctct

SEQ ID NO: 7351954 - DNA, 22 bp, Homo sapiens
ctgctgtgtggtgaaactcagt

SEQ ID NO: 7351955 - DNA, 22 bp, Homo sapiens
ctgggaagaaattgtgggaggc

SEQ ID NO: 7351956 - DNA, 22 bp, Homo sapiens
ctgggaagaagtgggctacatt

SEQ ID NO: 7351957 - DNA, 22 bp, Homo sapiens
gagggagccgccacagactggg

SEQ ID NO: 7351958 - DNA, 22 bp, Homo sapiens
gagggagagtgatggaccattg

SEQ ID NO: 7351959 - DNA, 22 bp, Homo sapiens
gagggaggcatcatgaatccag

SEQ ID NO: 7351960 - DNA, 22 bp, Homo sapiens
gagggagggaaagtttaacact

SEQ ID NO: 7351961 - DNA, 22 bp, Homo sapiens
gagggagggactagcattctct

SEQ ID NO: 7351962 - DNA, 22 bp, Homo sapiens
gagggagggactagcattctct

SEQ ID NO: 7351963 - DNA, 22 bp, Homo sapiens
gagggagggccaggtcccaacc

SEQ ID NO: 7351964 - DNA, 22 bp, Homo sapiens
gaggctgccaatgtgtgcatgt

SEQ ID NO: 7351965 - DNA, 22 bp, Homo sapiens
gaggctgcattcttcccactgc

SEQ ID NO: 7351966 - DNA, 22 bp, Homo sapiens
gaggctgcaggcaatgctgccc

SEQ ID NO: 7351967 - DNA, 22 bp, Homo sapiens
gaggctgcaggcaatgctgccc

SEQ ID NO: 7351968 - DNA, 22 bp, Homo sapiens
gaggctgcactggctaaaggct

SEQ ID NO: 7351969 - DNA, 22 bp, Homo sapiens
gagggaggggagctccaccctc

SEQ ID NO: 7351970 - DNA, 22 bp, Homo sapiens
gagggaggtgatactgaacgta

SEQ ID NO: 7351971 - DNA, 22 bp, Homo sapiens
gagggagtgccagagggccagc

SEQ ID NO: 7351972 - DNA, 18 bp, Homo sapiens
gagggagtagctgaggtt

SEQ ID NO: 7351973 - DNA, 22 bp, Homo sapiens
gagggctgctgccagatatgcc

SEQ ID NO: 7351974 - DNA, 22 bp, Homo sapiens
gagggctgcaatgagacagaga

SEQ ID NO: 7351975 - DNA, 22 bp, Homo sapiens
gagggctgcaatgagacagaga

SEQ ID NO: 7351976 - DNA, 22 bp, Homo sapiens
gagggctgatgttgccacctca

SEQ ID NO: 7351977 - DNA, 22 bp, Homo sapiens
gaggggctggctgtggtcccat

SEQ ID NO: 7351978 - DNA, 22 bp, Homo sapiens
gaggggctggcacgatggctgc

SEQ ID NO: 7351979 - DNA, 22 bp, Homo sapiens
gaggggctggcacgatggctgc

SEQ ID NO: 7351980 - DNA, 22 bp, Homo sapiens
gaggggctgccctggtgtcagg

SEQ ID NO: 7351981 - DNA, 22 bp, Homo sapiens
gaggggctctttaatagtaaca

SEQ ID NO: 7351982 - DNA, 22 bp, Homo sapiens
gagggctgctggaaaaatgcag

SEQ ID NO: 7351983 - DNA, 22 bp, Homo sapiens
gagggctggggcttaggcttag

SEQ ID NO: 7351984 - DNA, 22 bp, Homo sapiens
gagggctgtgaaggagcgggtt

SEQ ID NO: 7351985 - DNA, 22 bp, Homo sapiens
gagggctgtggggcatgaccag

SEQ ID NO: 7351986 - DNA, 22 bp, Homo sapiens
gaggcaggccctgaatgagtca

SEQ ID NO: 7351987 - DNA, 22 bp, Homo sapiens
gaggcagtgtcggtggcaggat

SEQ ID NO: 7351988 - DNA, 22 bp, Homo sapiens
gaggcataagtagaagagattg

SEQ ID NO: 7351989 - DNA, 22 bp, Homo sapiens
gaggctcacgacgggacgaact

SEQ ID NO: 7351990 - DNA, 22 bp, Homo sapiens
gaggagcccccactgggctcac

SEQ ID NO: 7351991 - DNA, 22 bp, Homo sapiens
gaggcagcttggggctgtgggt

SEQ ID NO: 7351992 - DNA, 22 bp, Homo sapiens
gaggcaggcactgttatcagca

SEQ ID NO: 7351993 - DNA, 22 bp, Homo sapiens
gaggcaggccctgaatgagtca

SEQ ID NO: 7351994 - DNA, 22 bp, Homo sapiens
gaggagcacatgaggctgaggg

SEQ ID NO: 7351995 - DNA, 22 bp, Homo sapiens
gaggagcacatgaggctgaggg

SEQ ID NO: 7351996 - DNA, 22 bp, Homo sapiens
gaggagcacatgaggctgaggg

SEQ ID NO: 7351997 - DNA, 22 bp, Homo sapiens
gaggagaggggctcccaagagc

SEQ ID NO: 7351998 - DNA, 22 bp, Homo sapiens
gaggagagcctgcactttgacc

SEQ ID NO: 7351999 - DNA, 22 bp, Homo sapiens
gaggagagatggtagattgggt

SEQ ID NO: 7352000 - DNA, 22 bp, Homo sapiens
gaggagagggctgcgggcccac

SEQ ID NO: 7352001 - DNA, 22 bp, Homo sapiens
gagagggctgcctggtgtgagg

SEQ ID NO: 7352002 - DNA, 22 bp, Homo sapiens
gagagggctgcctggtgtgagg

SEQ ID NO: 7352003 - DNA, 20 bp, Homo sapiens
gagcagtgagccagggaaag

SEQ ID NO: 7352004 - DNA, 22 bp, Homo sapiens
gagcaggcttgcagagaagggg

SEQ ID NO: 7352005 - DNA, 22 bp, Homo sapiens
gagcagtgatgggaggacgtca

SEQ ID NO: 7352006 - DNA, 22 bp, Homo sapiens
gagcaggctctgcctgtgtgtc

SEQ ID NO: 7352007 - DNA, 22 bp, Homo sapiens
gagagggtgcctggaagccagg

SEQ ID NO: 7352008 - DNA, 22 bp, Homo sapiens
gagcagtggtcacagggaggga

SEQ ID NO: 7352009 - DNA, 22 bp, Homo sapiens
gagcagtgggaaggaacagggt

SEQ ID NO: 7352010 - DNA, 22 bp, Homo sapiens
gagcagtggttgaacagaggca

SEQ ID NO: 7352011 - DNA, 22 bp, Homo sapiens
gagcatggcagctgagggcagg

SEQ ID NO: 7352012 - DNA, 22 bp, Homo sapiens
gagcatggcagctgagggcagg

SEQ ID NO: 7352013 - DNA, 18 bp, Homo sapiens
gagcatgggcagtgggga

SEQ ID NO: 7352014 - DNA, 21 bp, Homo sapiens
gagcatggcttacatcagcag

SEQ ID NO: 7352015 - DNA, 22 bp, Homo sapiens
gagcatggatagaaggtgggat

SEQ ID NO: 7352016 - DNA, 22 bp, Homo sapiens
gagcatgcccctcacaggaaca

SEQ ID NO: 7352017 - DNA, 22 bp, Homo sapiens
gagcatggatcatgtgctgggt

SEQ ID NO: 7352018 - DNA, 22 bp, Homo sapiens
gagcccagctgtccttggcaaa

SEQ ID NO: 7352019 - DNA, 22 bp, Homo sapiens
gagcccagcttgcacatggagc

SEQ ID NO: 7352020 - DNA, 22 bp, Homo sapiens
gagcccaggaagtggaggctga

SEQ ID NO: 7352021 - DNA, 22 bp, Homo sapiens
gagcccagctgcggccctcagc

SEQ ID NO: 7352022 - DNA, 22 bp, Homo sapiens
gagcatggttccataggttggt

SEQ ID NO: 7352023 - DNA, 22 bp, Homo sapiens
gagccatgagatagttggttcg

SEQ ID NO: 7352024 - DNA, 20 bp, Homo sapiens
gagcccaagtagggagaaat

SEQ ID NO: 7352025 - DNA, 22 bp, Homo sapiens
gagcccagggcaggcaaggcag

SEQ ID NO: 7352026 - DNA, 22 bp, Homo sapiens
gagcccagggcaggcaaggcag

SEQ ID NO: 7352027 - DNA, 22 bp, Homo sapiens
gagcccagggtgaaatagcagc

SEQ ID NO: 7352028 - DNA, 21 bp, Homo sapiens
gagcccaggcatctcattaat

SEQ ID NO: 7352029 - DNA, 22 bp, Homo sapiens
gagcccaggttctgcttccagc

SEQ ID NO: 7352030 - DNA, 22 bp, Homo sapiens
gagccctgagagttgtgaggcc

SEQ ID NO: 7352031 - DNA, 22 bp, Homo sapiens
gagccctgacactgagggagtt

SEQ ID NO: 7352032 - DNA, 22 bp, Homo sapiens
gagccctgaacaacagcaggaa

SEQ ID NO: 7352033 - DNA, 18 bp, Homo sapiens
gagccctgagtctgcaca

SEQ ID NO: 7352034 - DNA, 22 bp, Homo sapiens
gagccctgcttccaagggggca

SEQ ID NO: 7352035 - DNA, 22 bp, Homo sapiens
gagccctgctgggccttgtctc

SEQ ID NO: 7352036 - DNA, 22 bp, Homo sapiens
gagccctgcggagccccgaggc

SEQ ID NO: 7352037 - DNA, 22 bp, Homo sapiens
gagccctgtgaggaaagagggt

SEQ ID NO: 7352038 - DNA, 22 bp, Homo sapiens
gagctgagtatcccactgaagt

SEQ ID NO: 7352039 - DNA, 22 bp, Homo sapiens
gagctgagggtctaggagggtt

SEQ ID NO: 7352040 - DNA, 22 bp, Homo sapiens
gagctgcctacattgccaagag

SEQ ID NO: 7352041 - DNA, 22 bp, Homo sapiens
gaggaagaaagcataggtgggg

SEQ ID NO: 7352042 - DNA, 22 bp, Homo sapiens
gaggagagagggactgtctgca

SEQ ID NO: 7352043 - DNA, 22 bp, Homo sapiens
gagctgcctgtgtgccatgatg

SEQ ID NO: 7352044 - DNA, 22 bp, Homo sapiens
gaggaaagagtcaaatctgaag

SEQ ID NO: 7352045 - DNA, 22 bp, Homo sapiens
gaggaaagctggtttaaagtat

SEQ ID NO: 7352046 - DNA, 18 bp, Homo sapiens
gaggaaacaaggcagagg

SEQ ID NO: 7352047 - DNA, 22 bp, Homo sapiens
gaggaaagaaccccagtcaata

SEQ ID NO: 7352048 - DNA, 23 bp, Homo sapiens
gaagccacacaaaggtcgccaag

SEQ ID NO: 7352049 - DNA, 22 bp, Homo sapiens
gaagccaccctccttccagccc

SEQ ID NO: 7352050 - DNA, 22 bp, Homo sapiens
gaagccactatagatattctaa

SEQ ID NO: 7352051 - DNA, 22 bp, Homo sapiens
gaaggagccgagctcttcccca

SEQ ID NO: 7352052 - DNA, 16 bp, Homo sapiens
gaaggagattcagaaa

SEQ ID NO: 7352053 - DNA, 22 bp, Homo sapiens
gaaggcagggaatgtggtgcta

SEQ ID NO: 7352054 - DNA, 22 bp, Homo sapiens
gaaggcagggaatgtggtgcta

SEQ ID NO: 7352055 - DNA, 22 bp, Homo sapiens
gaaggcagggaatgtggtgcta

SEQ ID NO: 7352056 - DNA, 22 bp, Homo sapiens
gaaggcagggaatgtggtgcta

SEQ ID NO: 7352057 - DNA, 22 bp, Homo sapiens
gaaggcaccctccatcactcac

SEQ ID NO: 7352058 - DNA, 22 bp, Homo sapiens
gaaggcaaggagggaagccacc

SEQ ID NO: 7352059 - DNA, 22 bp, Homo sapiens
gaaggcaagtgagccaagagaa

SEQ ID NO: 7352060 - DNA, 22 bp, Homo sapiens
gaaggcaagtgctccttgggtc

SEQ ID NO: 7352061 - DNA, 20 bp, Homo sapiens
gaaggcaatggtttggcaca

SEQ ID NO: 7352062 - DNA, 18 bp, Homo sapiens
gaagggagctggaatgca

SEQ ID NO: 7352063 - DNA, 22 bp, Homo sapiens
gaagggagaaggttgggtgacg

SEQ ID NO: 7352064 - DNA, 22 bp, Homo sapiens
gaaggccatttttaggtagaat

SEQ ID NO: 7352065 - DNA, 22 bp, Homo sapiens
gaaggccagttttgagataggt

SEQ ID NO: 7352066 - DNA, 20 bp, Homo sapiens
gaagcagcttcatgtagaca

SEQ ID NO: 7352067 - DNA, 22 bp, Homo sapiens
gaagcagctttctggtgaggag

SEQ ID NO: 7352068 - DNA, 20 bp, Homo sapiens
gaaaggagtgtccctgtgag

SEQ ID NO: 7352069 - DNA, 22 bp, Homo sapiens
gaagcagccacggggagacaga

SEQ ID NO: 7352070 - DNA, 22 bp, Homo sapiens
gaagcagcgaagtggaagggac

SEQ ID NO: 7352071 - DNA, 22 bp, Homo sapiens
gaagcagctcagattgactgaa

SEQ ID NO: 7352072 - DNA, 22 bp, Homo sapiens
gaagcagctggtgagatggagc

SEQ ID NO: 7352073 - DNA, 22 bp, Homo sapiens
gaagcagctgccagagatgtct

SEQ ID NO: 7352074 - DNA, 22 bp, Homo sapiens
gaagcagctagcccactagtca

SEQ ID NO: 7352075 - DNA, 22 bp, Homo sapiens
gaagcagctaggatcttcattt

SEQ ID NO: 7352076 - DNA, 22 bp, Homo sapiens
gaaaggaaattgagggacgcat

SEQ ID NO: 7352077 - DNA, 22 bp, Homo sapiens
gaaaggaacttgtgagtgggag

SEQ ID NO: 7352078 - DNA, 22 bp, Homo sapiens
gaaaggagtcagtcttactgaa

SEQ ID NO: 7352079 - DNA, 18 bp, Homo sapiens
gaaaggagagacagtagg

SEQ ID NO: 7352080 - DNA, 22 bp, Homo sapiens
gaatgaagcaggtcacacagtt

SEQ ID NO: 7352081 - DNA, 22 bp, Homo sapiens
gaatgaaaaccttggctcaaat

SEQ ID NO: 7352082 - DNA, 22 bp, Homo sapiens
gaatgaaaaccttggctcaaat

SEQ ID NO: 7352083 - DNA, 22 bp, Homo sapiens
gaatgaaagatttgcattctat

SEQ ID NO: 7352084 - DNA, 22 bp, Homo sapiens
gaatgaaagatttgcattctat

SEQ ID NO: 7352085 - DNA, 22 bp, Homo sapiens
gaatgacattgagccataacat

SEQ ID NO: 7352086 - DNA, 22 bp, Homo sapiens
gaatgatatattagcagatttt

SEQ ID NO: 7352087 - DNA, 22 bp, Homo sapiens
gacactgttatggtgaggtaag

SEQ ID NO: 7352088 - DNA, 22 bp, Homo sapiens
gacactgtgctagctgggctta

SEQ ID NO: 7352089 - DNA, 22 bp, Homo sapiens
gacagacagagaatgggcttga

SEQ ID NO: 7352090 - DNA, 22 bp, Homo sapiens
gacagacaggagctcacaggca

SEQ ID NO: 7352091 - DNA, 22 bp, Homo sapiens
gacagacaaatgtttttaactt

SEQ ID NO: 7352092 - DNA, 22 bp, Homo sapiens
gacagaattttccatcatgtgg

SEQ ID NO: 7352093 - DNA, 22 bp, Homo sapiens
gacagacacctggggggttgct

SEQ ID NO: 7352094 - DNA, 22 bp, Homo sapiens
gaatctgcattttaacaagatc

SEQ ID NO: 7352095 - DNA, 22 bp, Homo sapiens
gaatatttgtaattactgttga

SEQ ID NO: 7352096 - DNA, 22 bp, Homo sapiens
gaaggtttgatccttatttata

SEQ ID NO: 7352097 - DNA, 22 bp, Homo sapiens
gaatatttgtaattactgttga

SEQ ID NO: 7352098 - DNA, 22 bp, Homo sapiens
gaaggtgtctggcccagagtct

SEQ ID NO: 7352099 - DNA, 22 bp, Homo sapiens
gaatccaggacggtcgtgggtt

SEQ ID NO: 7352100 - DNA, 22 bp, Homo sapiens
gaagggtgtgtgtgagggacac

SEQ ID NO: 7352101 - DNA, 22 bp, Homo sapiens
gaagggtgtgtgtgagggacac

SEQ ID NO: 7352102 - DNA, 22 bp, Homo sapiens
gaagggtgcatggagggaagtc

SEQ ID NO: 7352103 - DNA, 22 bp, Homo sapiens
gaagggggaaaatgacaacaga

SEQ ID NO: 7352104 - DNA, 22 bp, Homo sapiens
gaagggggagctcttcctaatt

SEQ ID NO: 7352105 - DNA, 22 bp, Homo sapiens
gaagggggttgcagtctagggt

SEQ ID NO: 7352106 - DNA, 22 bp, Homo sapiens
gaagggcttggctgggaggcca

SEQ ID NO: 7352107 - DNA, 22 bp, Homo sapiens
gaagggcttggctgggaggcca

SEQ ID NO: 7352108 - DNA, 22 bp, Homo sapiens
gaagggctttctgggagaagag

SEQ ID NO: 7352109 - DNA, 22 bp, Homo sapiens
gaagggctttctgggagaagag

SEQ ID NO: 7352110 - DNA, 22 bp, Homo sapiens
gaagggcttggctgggaggcca

SEQ ID NO: 7352111 - DNA, 22 bp, Homo sapiens
gaagggctttctgggagaagag

SEQ ID NO: 7352112 - DNA, 18 bp, Homo sapiens
gaagggagctggaatgca

SEQ ID NO: 7352113 - DNA, 19 bp, Homo sapiens
gaaggggaaggtgggtacc

SEQ ID NO: 7352114 - DNA, 22 bp, Homo sapiens
gacagagattgaatcaggaaat

SEQ ID NO: 7352115 - DNA, 22 bp, Homo sapiens
gacagagaggctgagcagtaca

SEQ ID NO: 7352116 - DNA, 22 bp, Homo sapiens
gacagagattgaatcaggaaat

SEQ ID NO: 7352117 - DNA, 22 bp, Homo sapiens
gacagagattgaatcaggaaat

SEQ ID NO: 7352118 - DNA, 22 bp, Homo sapiens
gacagagaggctgagcagtaca

SEQ ID NO: 7352119 - DNA, 20 bp, Homo sapiens
gacattgtaattaatgatga

SEQ ID NO: 7352120 - DNA, 22 bp, Homo sapiens
gacattgggtgtacaattggca

SEQ ID NO: 7352121 - DNA, 22 bp, Homo sapiens
gacattggctgttcattgggat

SEQ ID NO: 7352122 - DNA, 22 bp, Homo sapiens
gacattgacagtcctccttata

SEQ ID NO: 7352123 - DNA, 22 bp, Homo sapiens
gacattgagtatttcttttctc

SEQ ID NO: 7352124 - DNA, 22 bp, Homo sapiens
gacattctgtcaatgttgactc

SEQ ID NO: 7352125 - DNA, 22 bp, Homo sapiens
gacattctgtgactctgaacag

SEQ ID NO: 7352126 - DNA, 22 bp, Homo sapiens
gactcccaagcttggaggaagg

SEQ ID NO: 7352127 - DNA, 22 bp, Homo sapiens
gactccagggattggaagatgt

SEQ ID NO: 7352128 - DNA, 22 bp, Homo sapiens
gactgaggctcccctaggctca

SEQ ID NO: 7352129 - DNA, 22 bp, Homo sapiens
gactgagggacagggcagtgga

SEQ ID NO: 7352130 - DNA, 17 bp, Homo sapiens
gactgaggtaaggtgag

SEQ ID NO: 7352131 - DNA, 22 bp, Homo sapiens
gactgaggtattaagatggctt

SEQ ID NO: 7352132 - DNA, 22 bp, Homo sapiens
gactgaggtattaagatggctt

SEQ ID NO: 7352133 - DNA, 22 bp, Homo sapiens
gactgaggtattaagatggctt

SEQ ID NO: 7352134 - DNA, 22 bp, Homo sapiens
gactgaggcctttattgagaca

SEQ ID NO: 7352135 - DNA, 16 bp, Homo sapiens
gactgaggctcagaga

SEQ ID NO: 7352136 - DNA, 22 bp, Homo sapiens
gactcctcccgctcccatgccg

SEQ ID NO: 7352137 - DNA, 22 bp, Homo sapiens
gactcctctctaacccactgga

SEQ ID NO: 7352138 - DNA, 22 bp, Homo sapiens
gactctagattcatggtggagt

SEQ ID NO: 7352139 - DNA, 21 bp, Homo sapiens
gactctggggtcagctcaacc

SEQ ID NO: 7352140 - DNA, 22 bp, Homo sapiens
gactctggtgtcagaagtgccc

SEQ ID NO: 7352141 - DNA, 22 bp, Homo sapiens
gagacccaggggtctgctgccc

SEQ ID NO: 7352142 - DNA, 22 bp, Homo sapiens
gagagaaagcccctgcatccct

SEQ ID NO: 7352143 - DNA, 22 bp, Homo sapiens
gagagaaaacaagttctccatt

SEQ ID NO: 7352144 - DNA, 22 bp, Homo sapiens
gagagaaaaatgagcttcattg

SEQ ID NO: 7352145 - DNA, 22 bp, Homo sapiens
gagacttagagctccttgaggg

SEQ ID NO: 7352146 - DNA, 22 bp, Homo sapiens
gagacttaggcaagtcacttag

SEQ ID NO: 7352147 - DNA, 22 bp, Homo sapiens
gagagggcaaacttgtagctaa

SEQ ID NO: 7352148 - DNA, 18 bp, Homo sapiens
gagagggatccctcagga

SEQ ID NO: 7352149 - DNA, 22 bp, Homo sapiens
gagagaaccctaaatgagatat

SEQ ID NO: 7352150 - DNA, 22 bp, Homo sapiens
gagagaaatgtgcagtttgggc

SEQ ID NO: 7352151 - DNA, 22 bp, Homo sapiens
gagagaaaggcttgcaggctgt

SEQ ID NO: 7352152 - DNA, 22 bp, Homo sapiens
gagagggctctgtgtgggtact

SEQ ID NO: 7352153 - DNA, 22 bp, Homo sapiens
gagagggccgggggccagctcc

SEQ ID NO: 7352154 - DNA, 22 bp, Homo sapiens
gagagggccgggggccagctcc

SEQ ID NO: 7352155 - DNA, 21 bp, Homo sapiens
gagagggcattataggaagtg

SEQ ID NO: 7352156 - DNA, 22 bp, Homo sapiens
gagagggcaaggtagatgctac

SEQ ID NO: 7352157 - DNA, 22 bp, Homo sapiens
gagagggcaaacttgtagctaa

SEQ ID NO: 7352158 - DNA, 22 bp, Homo sapiens
gagaaagatgtaggctgggagg

SEQ ID NO: 7352159 - DNA, 22 bp, Homo sapiens
gagaaagctaataggaatccta

SEQ ID NO: 7352160 - DNA, 22 bp, Homo sapiens
gagaaagctaaataagttgatt

SEQ ID NO: 7352161 - DNA, 22 bp, Homo sapiens
gagaaagcttcagaaatggcct

SEQ ID NO: 7352162 - DNA, 22 bp, Homo sapiens
gagaaagctaataggaatccta

SEQ ID NO: 7352163 - DNA, 23 bp, Homo sapiens
gagaaagccggctatgatcctgg

SEQ ID NO: 7352164 - DNA, 18 bp, Homo sapiens
gagaaagcagggaatgtt

SEQ ID NO: 7352165 - DNA, 18 bp, Homo sapiens
gagaaagcagggaatgtt

SEQ ID NO: 7352166 - DNA, 19 bp, Homo sapiens
gagaaagcaggcacagcac

SEQ ID NO: 7352167 - DNA, 22 bp, Homo sapiens
gagaaagcttctttcccacagg

SEQ ID NO: 7352168 - DNA, 22 bp, Homo sapiens
gagaaaggcattcctatgcaaa

SEQ ID NO: 7352169 - DNA, 22 bp, Homo sapiens
gagaccaggaagtacagcagcc

SEQ ID NO: 7352170 - DNA, 22 bp, Homo sapiens
gagaaacaacacttgatgcctt

SEQ ID NO: 7352171 - DNA, 22 bp, Homo sapiens
gagaaacctgtaaggaaggaag

SEQ ID NO: 7352172 - DNA, 22 bp, Homo sapiens
gagaaacactgttagtttatta

SEQ ID NO: 7352173 - DNA, 22 bp, Homo sapiens
gagaaagacgtaggctgggagg

SEQ ID NO: 7352174 - DNA, 22 bp, Homo sapiens
gagaaacctgtaaggaaggaag

SEQ ID NO: 7352175 - DNA, 21 bp, Homo sapiens
cccttgcaaagtgctttccca

SEQ ID NO: 7352176 - DNA, 22 bp, Homo sapiens
cccttgcaagcaaggattagcc

SEQ ID NO: 7352177 - DNA, 22 bp, Homo sapiens
cccttgcatcccatgtgtggcc

SEQ ID NO: 7352178 - DNA, 22 bp, Homo sapiens
cccttgctgccacagctgccca

SEQ ID NO: 7352179 - DNA, 22 bp, Homo sapiens
cccttgaggtagactgaacacc

SEQ ID NO: 7352180 - DNA, 22 bp, Homo sapiens
ccctgggagaagttgagggctg

SEQ ID NO: 7352181 - DNA, 22 bp, Homo sapiens
ccctgggacccgctgcagaggc

SEQ ID NO: 7352182 - DNA, 22 bp, Homo sapiens
ccctggcttggcactctccact

SEQ ID NO: 7352183 - DNA, 22 bp, Homo sapiens
tggcagagaacacacatgattc

SEQ ID NO: 7352184 - DNA, 22 bp, Homo sapiens
ccctggctgctaccaggtagct

SEQ ID NO: 7352185 - DNA, 22 bp, Homo sapiens
ccctggaggtggaggttgcagg

SEQ ID NO: 7352186 - DNA, 22 bp, Homo sapiens
ccctggaggttgaggctgcagt

SEQ ID NO: 7352187 - DNA, 22 bp, Homo sapiens
ccctggagtagcactgggtcgc

SEQ ID NO: 7352188 - DNA, 22 bp, Homo sapiens
ccctggagtcctggcagttgat

SEQ ID NO: 7352189 - DNA, 21 bp, Homo sapiens
tggaggaataaagcacagaag

SEQ ID NO: 7352190 - DNA, 22 bp, Homo sapiens
tggaggaagtggctggccagaa

SEQ ID NO: 7352191 - DNA, 23 bp, Homo sapiens
tggaggaaacacatcagaagacc

SEQ ID NO: 7352192 - DNA, 19 bp, Homo sapiens
tggaggaagtatatttcat

SEQ ID NO: 7352193 - DNA, 23 bp, Homo sapiens
tggaggaaacacatcagaagacc

SEQ ID NO: 7352194 - DNA, 22 bp, Homo sapiens
tggaggaaaattactggggtct

SEQ ID NO: 7352195 - DNA, 22 bp, Homo sapiens
tggaggagaactccctggctac

SEQ ID NO: 7352196 - DNA, 22 bp, Homo sapiens
tggaggcatgacagtgtctgga

SEQ ID NO: 7352197 - DNA, 22 bp, Homo sapiens
tggagaattctatgttgagggg

SEQ ID NO: 7352198 - DNA, 22 bp, Homo sapiens
tggaaagaattcctatggttca

SEQ ID NO: 7352199 - DNA, 22 bp, Homo sapiens
tggacatgtaaaggctcaaggt

SEQ ID NO: 7352200 - DNA, 22 bp, Homo sapiens
tggacatgtcttctccaagaaa

SEQ ID NO: 7352201 - DNA, 22 bp, Homo sapiens
tggagataggctgaggcagggc

SEQ ID NO: 7352202 - DNA, 19 bp, Homo sapiens
tggagataagctgtcaata

SEQ ID NO: 7352203 - DNA, 22 bp, Homo sapiens
tggagataacagatgcaaacct

SEQ ID NO: 7352204 - DNA, 22 bp, Homo sapiens
tggagacctctacccatctcct

SEQ ID NO: 7352205 - DNA, 21 bp, Homo sapiens
tggagactctggttctttgtg

SEQ ID NO: 7352206 - DNA, 22 bp, Homo sapiens
tggaaactgggagttaaatgta

SEQ ID NO: 7352207 - DNA, 19 bp, Homo sapiens
tggaaactcctgatattag

SEQ ID NO: 7352208 - DNA, 22 bp, Homo sapiens
tggaaacctactgatacaggag

SEQ ID NO: 7352209 - DNA, 22 bp, Homo sapiens
ccctcctcaactctggcttcca

SEQ ID NO: 7352210 - DNA, 22 bp, Homo sapiens
ccctccctttgtctttatgaac

SEQ ID NO: 7352211 - DNA, 22 bp, Homo sapiens
ccctccctttgcagcagtgcat

SEQ ID NO: 7352212 - DNA, 22 bp, Homo sapiens
ccctcccttccaagttgaggac

SEQ ID NO: 7352213 - DNA, 22 bp, Homo sapiens
ccctccctgaagaagttactct

SEQ ID NO: 7352214 - DNA, 22 bp, Homo sapiens
ccctccctgtgtgcctcatttg

SEQ ID NO: 7352215 - DNA, 22 bp, Homo sapiens
ccctccctatgtagatgatgtt

SEQ ID NO: 7352216 - DNA, 22 bp, Homo sapiens
ccctccctctgctgggtgtaga

SEQ ID NO: 7352217 - DNA, 22 bp, Homo sapiens
ccctccatgacgtcttcagccg

SEQ ID NO: 7352218 - DNA, 22 bp, Homo sapiens
tgcttaaaaacagtatggtagt

SEQ ID NO: 7352219 - DNA, 22 bp, Homo sapiens
tgcttccctgctctgcacacct

SEQ ID NO: 7352220 - DNA, 22 bp, Homo sapiens
tgctgttatcacattttgtaaa

SEQ ID NO: 7352221 - DNA, 22 bp, Homo sapiens
tgctgtttcattttcctcatcc

SEQ ID NO: 7352222 - DNA, 22 bp, Homo sapiens
cccagttagttgcttccacatc

SEQ ID NO: 7352223 - DNA, 22 bp, Homo sapiens
tgctgggcactgtctaggtact

SEQ ID NO: 7352224 - DNA, 22 bp, Homo sapiens
cccagtgtctccaacatcagat

SEQ ID NO: 7352225 - DNA, 22 bp, Homo sapiens
cccagtgtcaccaacaggacac

SEQ ID NO: 7352226 - DNA, 22 bp, Homo sapiens
cccagtgtggttctttggagaa

SEQ ID NO: 7352227 - DNA, 22 bp, Homo sapiens
tgctgggggtgtctcaccaggc

SEQ ID NO: 7352228 - DNA, 22 bp, Homo sapiens
tgctgggggtagctctgcgtag

SEQ ID NO: 7352229 - DNA, 22 bp, Homo sapiens
tgctggggctctgaccactcca

SEQ ID NO: 7352230 - DNA, 22 bp, Homo sapiens
tgctgggggctttctggatacc

SEQ ID NO: 7352231 - DNA, 22 bp, Homo sapiens
ccccagctgagatttgaggaga

SEQ ID NO: 7352232 - DNA, 22 bp, Homo sapiens
ccccagctgcatacttgccaag

SEQ ID NO: 7352233 - DNA, 18 bp, Homo sapiens
tgctggggtagaatccac

SEQ ID NO: 7352234 - DNA, 22 bp, Homo sapiens
tgctgggggttcagatgagtaa

SEQ ID NO: 7352235 - DNA, 19 bp, Homo sapiens
tgctcaggccaaggagccc

SEQ ID NO: 7352236 - DNA, 22 bp, Homo sapiens
tgctcaggccctgggccatcct

SEQ ID NO: 7352237 - DNA, 22 bp, Homo sapiens
tgctcaggaggaggctgtgagg

SEQ ID NO: 7352238 - DNA, 22 bp, Homo sapiens
tgctcagcttcagaggatcccc

SEQ ID NO: 7352239 - DNA, 22 bp, Homo sapiens
tgctagaatttgcagaagcata

SEQ ID NO: 7352240 - DNA, 22 bp, Homo sapiens
tgctagaattaggttaaacaaa

SEQ ID NO: 7352241 - DNA, 22 bp, Homo sapiens
tgctagattttagtttggaatg

SEQ ID NO: 7352242 - DNA, 22 bp, Homo sapiens
tgctaggaatacacagagcaat

SEQ ID NO: 7352243 - DNA, 22 bp, Homo sapiens
tgctaggagaggcagcacagcg

SEQ ID NO: 7352244 - DNA, 22 bp, Homo sapiens
tgctaggggtcagcaccatatc

SEQ ID NO: 7352245 - DNA, 17 bp, Homo sapiens
tgctagggggagagtag

SEQ ID NO: 7352246 - DNA, 22 bp, Homo sapiens
tgcagggctaagtcagagcctg

SEQ ID NO: 7352247 - DNA, 22 bp, Homo sapiens
tgctcaggtgccttggctgctg

SEQ ID NO: 7352248 - DNA, 22 bp, Homo sapiens
tgctcagggagcttcctggtgg

SEQ ID NO: 7352249 - DNA, 22 bp, Homo sapiens
cccagtccaaaagtaggttcta

SEQ ID NO: 7352250 - DNA, 19 bp, Homo sapiens
cccagtctaggtcctagga

SEQ ID NO: 7352251 - DNA, 19 bp, Homo sapiens
cccagtccttgtcctgggc

SEQ ID NO: 7352252 - DNA, 19 bp, Homo sapiens
tgctctctggtgcttcatg

SEQ ID NO: 7352253 - DNA, 22 bp, Homo sapiens
tgctctgcaagcaggagcaaga

SEQ ID NO: 7352254 - DNA, 22 bp, Homo sapiens
cccagtggcccagcatgtggtg

SEQ ID NO: 7352255 - DNA, 22 bp, Homo sapiens
tgctctggaatagtcctaggca

SEQ ID NO: 7352256 - DNA, 22 bp, Homo sapiens
tgctctgcacatccctcacaaa

SEQ ID NO: 7352257 - DNA, 22 bp, Homo sapiens
tgctgcaggcagcccctctact

SEQ ID NO: 7352258 - DNA, 22 bp, Homo sapiens
tgctgccttgtgctgcctttca

SEQ ID NO: 7352259 - DNA, 22 bp, Homo sapiens
tgctgccttagaaatggctata

SEQ ID NO: 7352260 - DNA, 20 bp, Homo sapiens
tgctgcctgtttttgtgaat

SEQ ID NO: 7352261 - DNA, 22 bp, Homo sapiens
tgctgccttagcagccaggcaa

SEQ ID NO: 7352262 - DNA, 22 bp, Homo sapiens
tgctgccttagcagccaggcaa

SEQ ID NO: 7352263 - DNA, 22 bp, Homo sapiens
tgctgccttagcagccaggcaa

SEQ ID NO: 7352264 - DNA, 22 bp, Homo sapiens
cctgcagggaatcgaggcagaa

SEQ ID NO: 7352265 - DNA, 22 bp, Homo sapiens
cctgcagggtgctgccacagat

SEQ ID NO: 7352266 - DNA, 22 bp, Homo sapiens
cctgcagggtgctgccacagat

SEQ ID NO: 7352267 - DNA, 22 bp, Homo sapiens
cctgcaggtttcccccggacgg

SEQ ID NO: 7352268 - DNA, 22 bp, Homo sapiens
tgggtcagtttgggggccagcc

SEQ ID NO: 7352269 - DNA, 22 bp, Homo sapiens
cctgccactgtaggtgacagtt

SEQ ID NO: 7352270 - DNA, 22 bp, Homo sapiens
cctgcattaaatcctgttctgc

SEQ ID NO: 7352271 - DNA, 22 bp, Homo sapiens
cctgcatttttcccactctgtc

SEQ ID NO: 7352272 - DNA, 22 bp, Homo sapiens
cctgcatgtggtcagcactcct

SEQ ID NO: 7352273 - DNA, 22 bp, Homo sapiens
tgggtggaataaatcagttctg

SEQ ID NO: 7352274 - DNA, 22 bp, Homo sapiens
tgggtggagaagtggacctgct

SEQ ID NO: 7352275 - DNA, 22 bp, Homo sapiens
tgggtggagctccacaacctgt

SEQ ID NO: 7352276 - DNA, 22 bp, Homo sapiens
tgggtggagaagtggacctgct

SEQ ID NO: 7352277 - DNA, 22 bp, Homo sapiens
tgggtggattaggatagggtat

SEQ ID NO: 7352278 - DNA, 22 bp, Homo sapiens
tgggtgggagcaccctgtctgg

SEQ ID NO: 7352279 - DNA, 21 bp, Homo sapiens
tggtacaccttgcctgtcaga

SEQ ID NO: 7352280 - DNA, 22 bp, Homo sapiens
cctgcccttctttccccagcat

SEQ ID NO: 7352281 - DNA, 22 bp, Homo sapiens
cctgcctcaggactctgcatat

SEQ ID NO: 7352282 - DNA, 22 bp, Homo sapiens
cctgcctcaggactctgcatat

SEQ ID NO: 7352283 - DNA, 22 bp, Homo sapiens
tggtgggacatctgaggagagg

SEQ ID NO: 7352284 - DNA, 22 bp, Homo sapiens
cctgcctgcaaaatgggacaag

SEQ ID NO: 7352285 - DNA, 22 bp, Homo sapiens
cctgcctgattccaggatggct

SEQ ID NO: 7352286 - DNA, 22 bp, Homo sapiens
cctgcctcccagaggtcctcta

SEQ ID NO: 7352287 - DNA, 23 bp, Homo sapiens
cctgcagctgctggggctccacc

SEQ ID NO: 7352288 - DNA, 22 bp, Homo sapiens
tggggagagttacaaggaatct

SEQ ID NO: 7352289 - DNA, 22 bp, Homo sapiens
tggggagagaccggaatgtttc

SEQ ID NO: 7352290 - DNA, 22 bp, Homo sapiens
tggggagaggtatcattgagat

SEQ ID NO: 7352291 - DNA, 22 bp, Homo sapiens
tggggagagattgaggagtttt

SEQ ID NO: 7352292 - DNA, 17 bp, Homo sapiens
cctgatattcaagcagc

SEQ ID NO: 7352293 - DNA, 22 bp, Homo sapiens
cctgatattaagaaggagtgag

SEQ ID NO: 7352294 - DNA, 22 bp, Homo sapiens
cctgatatggtgtcatttaaac

SEQ ID NO: 7352295 - DNA, 22 bp, Homo sapiens
cctgataatgtaattgttaaat

SEQ ID NO: 7352296 - DNA, 22 bp, Homo sapiens
cctgataatattgacctacaga

SEQ ID NO: 7352297 - DNA, 22 bp, Homo sapiens
cctgataaaccctggaatttgt

SEQ ID NO: 7352298 - DNA, 22 bp, Homo sapiens
cctgataacacagatacaagat

SEQ ID NO: 7352299 - DNA, 21 bp, Homo sapiens
cctgagtgagacctggcccgt

SEQ ID NO: 7352300 - DNA, 22 bp, Homo sapiens
tgggctcatggcccagcactgg

SEQ ID NO: 7352301 - DNA, 22 bp, Homo sapiens
tgggctccgttgcctggggcag

SEQ ID NO: 7352302 - DNA, 22 bp, Homo sapiens
tgggctccggcggcctcaggct

SEQ ID NO: 7352303 - DNA, 22 bp, Homo sapiens
tgggctccagcacctgtgctct

SEQ ID NO: 7352304 - DNA, 23 bp, Homo sapiens
tgggcctggcctcccagtccagc

SEQ ID NO: 7352305 - DNA, 22 bp, Homo sapiens
tgggcaggcaagtgaatacctt

SEQ ID NO: 7352306 - DNA, 22 bp, Homo sapiens
tgggcaggatgcgttgattctt

SEQ ID NO: 7352307 - DNA, 22 bp, Homo sapiens
tgggcaggatgcgttgattctt

SEQ ID NO: 7352308 - DNA, 22 bp, Homo sapiens
tgggcaggataatatctcatgt

SEQ ID NO: 7352309 - DNA, 22 bp, Homo sapiens
tgggcaggatgcgttgattctt

SEQ ID NO: 7352310 - DNA, 22 bp, Homo sapiens
tgggcaggagagaagctaaaga

SEQ ID NO: 7352311 - DNA, 22 bp, Homo sapiens
tgggcaggagagaagctaaaga

SEQ ID NO: 7352312 - DNA, 22 bp, Homo sapiens
tgggcaggagagaagctaaaga

SEQ ID NO: 7352313 - DNA, 22 bp, Homo sapiens
tgggcaggataatatctcatgt

SEQ ID NO: 7352314 - DNA, 22 bp, Homo sapiens
tgggcaggataatatctcatgt

SEQ ID NO: 7352315 - DNA, 22 bp, Homo sapiens
tgggcaggcaagtgaatacctt

SEQ ID NO: 7352316 - DNA, 22 bp, Homo sapiens
tgggcaggcaagtgaatacctt

SEQ ID NO: 7352317 - DNA, 22 bp, Homo sapiens
tgggccgggcactgtactgggc

SEQ ID NO: 7352318 - DNA, 22 bp, Homo sapiens
cctccagggcagacggggagca

SEQ ID NO: 7352319 - DNA, 22 bp, Homo sapiens
cctccagctgcctcagtctctt

SEQ ID NO: 7352320 - DNA, 22 bp, Homo sapiens
cctccaggtgttacatatgact

SEQ ID NO: 7352321 - DNA, 22 bp, Homo sapiens
cctccaggtgttacatatgact

SEQ ID NO: 7352322 - DNA, 22 bp, Homo sapiens
cctcccacattgaggacatgct

SEQ ID NO: 7352323 - DNA, 22 bp, Homo sapiens
cctcccaccgtatctcagtggc

SEQ ID NO: 7352324 - DNA, 22 bp, Homo sapiens
cctcctctggtgctgccaaccc

SEQ ID NO: 7352325 - DNA, 22 bp, Homo sapiens
cctcctctggtgctgccaaccc

SEQ ID NO: 7352326 - DNA, 22 bp, Homo sapiens
cctcctgggacaggctggcaca

SEQ ID NO: 7352327 - DNA, 22 bp, Homo sapiens
cctcctgggactcattagcacc

SEQ ID NO: 7352328 - DNA, 23 bp, Homo sapiens
cctcctgggcacaggcctgatgg

SEQ ID NO: 7352329 - DNA, 22 bp, Homo sapiens
cctcctgggccttgctctgtga

SEQ ID NO: 7352330 - DNA, 22 bp, Homo sapiens
tgggagagcagagaaccctctt

SEQ ID NO: 7352331 - DNA, 22 bp, Homo sapiens
tgggagagcactgcagccccgg

SEQ ID NO: 7352332 - DNA, 22 bp, Homo sapiens
tgggagagcactgcagccccgg

SEQ ID NO: 7352333 - DNA, 21 bp, Homo sapiens
tgggcactgagggtgctgctc

SEQ ID NO: 7352334 - DNA, 22 bp, Homo sapiens
tgggcactgtagctggtgctgg

SEQ ID NO: 7352335 - DNA, 22 bp, Homo sapiens
tgggcagacgctgttggaaggc

SEQ ID NO: 7352336 - DNA, 22 bp, Homo sapiens
tgggcagacgggagcttgcctt

SEQ ID NO: 7352337 - DNA, 22 bp, Homo sapiens
tgggcagaattgtggtagttaa

SEQ ID NO: 7352338 - DNA, 22 bp, Homo sapiens
tgggcagacattgagtttgttc

SEQ ID NO: 7352339 - DNA, 22 bp, Homo sapiens
tgggcagacattgagtttgttc

SEQ ID NO: 7352340 - DNA, 22 bp, Homo sapiens
tgggcagaaggaagagccacct

SEQ ID NO: 7352341 - DNA, 22 bp, Homo sapiens
tgggcagaatgtgggatccaga

SEQ ID NO: 7352342 - DNA, 22 bp, Homo sapiens
tgggcagaattgtggtagttaa

SEQ ID NO: 7352343 - DNA, 22 bp, Homo sapiens
tgggcagaaatcagtatcagat

SEQ ID NO: 7352344 - DNA, 22 bp, Homo sapiens
tgggcagaaggaagagccacct

SEQ ID NO: 7352345 - DNA, 22 bp, Homo sapiens
tgggagagaattctggtgactg

SEQ ID NO: 7352346 - DNA, 22 bp, Homo sapiens
tgggagagaattctggtgactg

SEQ ID NO: 7352347 - DNA, 22 bp, Homo sapiens
tgggagagagaattcccagtgg

SEQ ID NO: 7352348 - DNA, 22 bp, Homo sapiens
tgggagagataggcttctggac

SEQ ID NO: 7352349 - DNA, 22 bp, Homo sapiens
tgggagagaataatcaataggt

SEQ ID NO: 7352350 - DNA, 22 bp, Homo sapiens
tgggacaggaggcctctggaga

SEQ ID NO: 7352351 - DNA, 22 bp, Homo sapiens
tgggacaggaggcctctggaga

SEQ ID NO: 7352352 - DNA, 22 bp, Homo sapiens
tgggacaggaggcctctggaga

SEQ ID NO: 7352353 - DNA, 22 bp, Homo sapiens
cctctcccagggagagcctgag

SEQ ID NO: 7352354 - DNA, 19 bp, Homo sapiens
cctctcccatgcttacctc

SEQ ID NO: 7352355 - DNA, 22 bp, Homo sapiens
tgggaaggcagtcactgtccta

SEQ ID NO: 7352356 - DNA, 22 bp, Homo sapiens
cctctccagcggcctcagggcc

SEQ ID NO: 7352357 - DNA, 22 bp, Homo sapiens
cctcctggtaattagcgaaagg

SEQ ID NO: 7352358 - DNA, 18 bp, Homo sapiens
ccatcaccctaactagtg

SEQ ID NO: 7352359 - DNA, 22 bp, Homo sapiens
ccatcagcatgggagcatgggc

SEQ ID NO: 7352360 - DNA, 22 bp, Homo sapiens
ccatatatgattgcctctttca

SEQ ID NO: 7352361 - DNA, 22 bp, Homo sapiens
ccatcagctccagtatcttctg

SEQ ID NO: 7352362 - DNA, 23 bp, Homo sapiens
ccatcaggcctccgtgtccagcc

SEQ ID NO: 7352363 - DNA, 22 bp, Homo sapiens
ccatagaactctgaggccagag

SEQ ID NO: 7352364 - DNA, 22 bp, Homo sapiens
tgaggctgagatatcagggagg

SEQ ID NO: 7352365 - DNA, 22 bp, Homo sapiens
tgaggctgagatatcagggagg

SEQ ID NO: 7352366 - DNA, 22 bp, Homo sapiens
tgaggctgagatatcagggagg

SEQ ID NO: 7352367 - DNA, 22 bp, Homo sapiens
tgaggcccagccgccctgagag

SEQ ID NO: 7352368 - DNA, 22 bp, Homo sapiens
tgaggctgaaactggcgataga

SEQ ID NO: 7352369 - DNA, 22 bp, Homo sapiens
tgaggctgacaaaagatgaggt

SEQ ID NO: 7352370 - DNA, 17 bp, Homo sapiens
tgaggccatggcaccat

SEQ ID NO: 7352371 - DNA, 22 bp, Homo sapiens
ccatccctcctccaccagctag

SEQ ID NO: 7352372 - DNA, 22 bp, Homo sapiens
ccatcccttctctggccagcag

SEQ ID NO: 7352373 - DNA, 22 bp, Homo sapiens
ccatcccttctctggccagcag

SEQ ID NO: 7352374 - DNA, 22 bp, Homo sapiens
tgagtccaagagccagtgggaa

SEQ ID NO: 7352375 - DNA, 22 bp, Homo sapiens
tgagtccaataggggcctggaa

SEQ ID NO: 7352376 - DNA, 22 bp, Homo sapiens
tgagtccagatgggccagcagg

SEQ ID NO: 7352377 - DNA, 22 bp, Homo sapiens
ccatcctgaatggtctcagcca

SEQ ID NO: 7352378 - DNA, 22 bp, Homo sapiens
tgagttttttcaacatatgaag

SEQ ID NO: 7352379 - DNA, 22 bp, Homo sapiens
tgagtccatgtggaggggaggt

SEQ ID NO: 7352380 - DNA, 22 bp, Homo sapiens
tgagtccattgatggatagtga

SEQ ID NO: 7352381 - DNA, 22 bp, Homo sapiens
tgagtctcgaaatgcaggaaag

SEQ ID NO: 7352382 - DNA, 22 bp, Homo sapiens
tgagtctccagcgaagtaggat

SEQ ID NO: 7352383 - DNA, 22 bp, Homo sapiens
ccagggctgcctggccgtgtgt

SEQ ID NO: 7352384 - DNA, 22 bp, Homo sapiens
ccagggctgctgggggagttga

SEQ ID NO: 7352385 - DNA, 22 bp, Homo sapiens
tgagcaggtgagtctagggcag

SEQ ID NO: 7352386 - DNA, 22 bp, Homo sapiens
tgagcagtaggtctgaatagtg

SEQ ID NO: 7352387 - DNA, 22 bp, Homo sapiens
tgagcaggtcaagactccagct

SEQ ID NO: 7352388 - DNA, 18 bp, Homo sapiens
tgagcaggggctgacctt

SEQ ID NO: 7352389 - DNA, 22 bp, Homo sapiens
ccaggtggcttctgcccgatgt

SEQ ID NO: 7352390 - DNA, 22 bp, Homo sapiens
ccaggtggaggtgtgaggtcct

SEQ ID NO: 7352391 - DNA, 22 bp, Homo sapiens
ccaggtggataaggtttctgga

SEQ ID NO: 7352392 - DNA, 22 bp, Homo sapiens
ccagtcagggcaggagcctggt

SEQ ID NO: 7352393 - DNA, 22 bp, Homo sapiens
ccagtcagagaaaatgtccact

SEQ ID NO: 7352394 - DNA, 22 bp, Homo sapiens
tgaggcagtgtgagataataaa

SEQ ID NO: 7352395 - DNA, 21 bp, Homo sapiens
ccagtgctacagctgcctgac

SEQ ID NO: 7352396 - DNA, 22 bp, Homo sapiens
ccagtgctcttaaaggtcataa

SEQ ID NO: 7352397 - DNA, 22 bp, Homo sapiens
ccagtgcttctttgctagctgg

SEQ ID NO: 7352398 - DNA, 22 bp, Homo sapiens
ccagtgcccagctgcccaggca

SEQ ID NO: 7352399 - DNA, 23 bp, Homo sapiens
tgagcccaggaggtcaaggctgc

SEQ ID NO: 7352400 - DNA, 22 bp, Homo sapiens
ccagtcccagctctgccatgct

SEQ ID NO: 7352401 - DNA, 22 bp, Homo sapiens
tgcacagatctggtggcaagga

SEQ ID NO: 7352402 - DNA, 22 bp, Homo sapiens
cccaaggccttcaagccagctc

SEQ ID NO: 7352403 - DNA, 19 bp, Homo sapiens
cccaaggccctgggcaggc

SEQ ID NO: 7352404 - DNA, 22 bp, Homo sapiens
cccaaggcatggcatggtggca

SEQ ID NO: 7352405 - DNA, 22 bp, Homo sapiens
cccaaggcatggcatggtggca

SEQ ID NO: 7352406 - DNA, 22 bp, Homo sapiens
cccaagccagaccctgaccctg

SEQ ID NO: 7352407 - DNA, 22 bp, Homo sapiens
tgatacacagatttacatcaat

SEQ ID NO: 7352408 - DNA, 22 bp, Homo sapiens
tgataatgttcgagaatgaaga

SEQ ID NO: 7352409 - DNA, 22 bp, Homo sapiens
tgataatattttgaatcataag

SEQ ID NO: 7352410 - DNA, 22 bp, Homo sapiens
tgcaatatttggcactgagatg

SEQ ID NO: 7352411 - DNA, 23 bp, Homo sapiens
tgcaatatgtcagtgcaaagtgg

SEQ ID NO: 7352412 - DNA, 21 bp, Homo sapiens
tgcaatatatatttgcctgaa

SEQ ID NO: 7352413 - DNA, 22 bp, Homo sapiens
tgcaataaggagtaatagtaaa

SEQ ID NO: 7352414 - DNA, 22 bp, Homo sapiens
tgcagagaaaccagtggaggac

SEQ ID NO: 7352415 - DNA, 22 bp, Homo sapiens
tgcactggtggtgagtgaggga

SEQ ID NO: 7352416 - DNA, 22 bp, Homo sapiens
cccagagctgagggggcacgtt

SEQ ID NO: 7352417 - DNA, 19 bp, Homo sapiens
cccagaggaatgcctggaa

SEQ ID NO: 7352418 - DNA, 23 bp, Homo sapiens
cccagaggagcagggcgtgagat

SEQ ID NO: 7352419 - DNA, 18 bp, Homo sapiens
cccagaggaatgcctgga

SEQ ID NO: 7352420 - DNA, 22 bp, Homo sapiens
cccagagctgggtgggcagcgg

SEQ ID NO: 7352421 - DNA, 22 bp, Homo sapiens
tgcaggaccttgatcctggact

SEQ ID NO: 7352422 - DNA, 22 bp, Homo sapiens
tgcaggaccggaaccatgggat

SEQ ID NO: 7352423 - DNA, 22 bp, Homo sapiens
tgcaggacagtttggaagagag

SEQ ID NO: 7352424 - DNA, 22 bp, Homo sapiens
tgcaggacattagttatgaatt

SEQ ID NO: 7352425 - DNA, 22 bp, Homo sapiens
tgcaggacccgggctgtggtca

SEQ ID NO: 7352426 - DNA, 22 bp, Homo sapiens
tgcaggacagtttggaagagag

SEQ ID NO: 7352427 - DNA, 22 bp, Homo sapiens
tgcaggacagtttggaagagag

SEQ ID NO: 7352428 - DNA, 22 bp, Homo sapiens
tgcaggactgaaggagggctgg

SEQ ID NO: 7352429 - DNA, 22 bp, Homo sapiens
tgcaggactggggagcggaagg

SEQ ID NO: 7352430 - DNA, 22 bp, Homo sapiens
tgcaggactgaaggagggctgg

SEQ ID NO: 7352431 - DNA, 23 bp, Homo sapiens
tgcaggactcaagaaagaaaggc

SEQ ID NO: 7352432 - DNA, 23 bp, Homo sapiens
tgcaggactcaagaaagaaaggc

SEQ ID NO: 7352433 - DNA, 23 bp, Homo sapiens
tgcaggactactcgagcactgct

SEQ ID NO: 7352434 - DNA, 22 bp, Homo sapiens
tgcaggactcaagggtagcagg

SEQ ID NO: 7352435 - DNA, 20 bp, Homo sapiens
tgcaggacagagcctgtgtg

SEQ ID NO: 7352436 - DNA, 22 bp, Homo sapiens
tgcagccaccacctctgctgaa

SEQ ID NO: 7352437 - DNA, 22 bp, Homo sapiens
tgcagccaattcattcattctt

SEQ ID NO: 7352438 - DNA, 23 bp, Homo sapiens
cccagaggagcagggcgtgagat

SEQ ID NO: 7352439 - DNA, 22 bp, Homo sapiens
cccagaggaggatctcggcccg

SEQ ID NO: 7352440 - DNA, 22 bp, Homo sapiens
tgcaggacttcaggactctgag

SEQ ID NO: 7352441 - DNA, 22 bp, Homo sapiens
tgcaggactttcagtgctcaaa

SEQ ID NO: 7352442 - DNA, 22 bp, Homo sapiens
tgcaggactttcagtgctcaaa

SEQ ID NO: 7352443 - DNA, 22 bp, Homo sapiens
cccagcagcctggatgttcttt

SEQ ID NO: 7352444 - DNA, 22 bp, Homo sapiens
cccagcagccagaatgaggagc

SEQ ID NO: 7352445 - DNA, 22 bp, Homo sapiens
cccagcaggaggaggttgcagt

SEQ ID NO: 7352446 - DNA, 22 bp, Homo sapiens
tgcagggccgctggaggtcatg

SEQ ID NO: 7352447 - DNA, 22 bp, Homo sapiens
tgcagggccttgggatgtgtcc

SEQ ID NO: 7352448 - DNA, 22 bp, Homo sapiens
tgaaatgagatagataatcagg

SEQ ID NO: 7352449 - DNA, 22 bp, Homo sapiens
tgaaatgagatagataatcagg

SEQ ID NO: 7352450 - DNA, 22 bp, Homo sapiens
tgaaatgatatctgataacaaa

SEQ ID NO: 7352451 - DNA, 22 bp, Homo sapiens
ccagggagggtcctgtggcttc

SEQ ID NO: 7352452 - DNA, 22 bp, Homo sapiens
ccagggcaattatttggagggt

SEQ ID NO: 7352453 - DNA, 22 bp, Homo sapiens
ccagggcaacgctgtctcagag

SEQ ID NO: 7352454 - DNA, 22 bp, Homo sapiens
ccagggcaataggaacactttt

SEQ ID NO: 7352455 - DNA, 22 bp, Homo sapiens
ccagggcacgttgggacagtac

SEQ ID NO: 7352456 - DNA, 22 bp, Homo sapiens
ccagggcacgttgggacagtac

SEQ ID NO: 7352457 - DNA, 22 bp, Homo sapiens
tgaaggtgtttatacctcagat

SEQ ID NO: 7352458 - DNA, 22 bp, Homo sapiens
tgaagtatacaggctctgctaa

SEQ ID NO: 7352459 - DNA, 22 bp, Homo sapiens
tgaagtatacggaaattgtgga

SEQ ID NO: 7352460 - DNA, 22 bp, Homo sapiens
tgaagtatccatcttgttctag

SEQ ID NO: 7352461 - DNA, 22 bp, Homo sapiens
tgaagtatggaatgtagaagtg

SEQ ID NO: 7352462 - DNA, 22 bp, Homo sapiens
tgaagtatcccaagatttacag

SEQ ID NO: 7352463 - DNA, 22 bp, Homo sapiens
tgaagtatctatggatataaga

SEQ ID NO: 7352464 - DNA, 22 bp, Homo sapiens
ccagggcagtgggagaaggtgc

SEQ ID NO: 7352465 - DNA, 22 bp, Homo sapiens
ccagggcagtgggagaaggtgc

SEQ ID NO: 7352466 - DNA, 22 bp, Homo sapiens
ccagggcatcctcacatcgcag

SEQ ID NO: 7352467 - DNA, 23 bp, Homo sapiens
ccagggcccctacaccactgtcc

SEQ ID NO: 7352468 - DNA, 22 bp, Homo sapiens
ccagggcctacagcttaagtcc

SEQ ID NO: 7352469 - DNA, 22 bp, Homo sapiens
ccagggcctcgtgttctgagtg

SEQ ID NO: 7352470 - DNA, 22 bp, Homo sapiens
ccagggctctatgagggtggag

SEQ ID NO: 7352471 - DNA, 22 bp, Homo sapiens
ccagggctccccagaagtaccc

SEQ ID NO: 7352472 - DNA, 22 bp, Homo sapiens
ccagggctgagactgtattggg

SEQ ID NO: 7352473 - DNA, 22 bp, Homo sapiens
tcttgcagaagaagctgccaag

SEQ ID NO: 7352474 - DNA, 22 bp, Homo sapiens
tgaaatgagagcacagaataaa

SEQ ID NO: 7352475 - DNA, 22 bp, Homo sapiens
tgaaatgagagcacagaataaa

SEQ ID NO: 7352476 - DNA, 22 bp, Homo sapiens
ccaggctgtggtttagatagag

SEQ ID NO: 7352477 - DNA, 22 bp, Homo sapiens
ccaggctgtggtttagatagag

SEQ ID NO: 7352478 - DNA, 22 bp, Homo sapiens
ccaggctgttttcaaacttggg

SEQ ID NO: 7352479 - DNA, 22 bp, Homo sapiens
ccaggctgttttcaaacttggg

SEQ ID NO: 7352480 - DNA, 22 bp, Homo sapiens
ccaggctgtgcttttcataaat

SEQ ID NO: 7352481 - DNA, 22 bp, Homo sapiens
ccaggctgtgcttttcataaat

SEQ ID NO: 7352482 - DNA, 22 bp, Homo sapiens
ccaggctgtaagagtgatgttg

SEQ ID NO: 7352483 - DNA, 21 bp, Homo sapiens
ccaggctgggagggcagttcc

SEQ ID NO: 7352484 - DNA, 22 bp, Homo sapiens
tgaaacaagatccacagacttg

SEQ ID NO: 7352485 - DNA, 18 bp, Homo sapiens
tgaaacaagaatggtgca

SEQ ID NO: 7352486 - DNA, 21 bp, Homo sapiens
tgaaacaatcagacagagtct

SEQ ID NO: 7352487 - DNA, 22 bp, Homo sapiens
tgaaacaagtttaagggatcta

SEQ ID NO: 7352488 - DNA, 22 bp, Homo sapiens
tgaaacaagggccatgggaaac

SEQ ID NO: 7352489 - DNA, 22 bp, Homo sapiens
tgaaacaaatttggaaaatcta

SEQ ID NO: 7352490 - DNA, 22 bp, Homo sapiens
tgaaacactttcaattacatat

SEQ ID NO: 7352491 - DNA, 21 bp, Homo sapiens
tgaaacactctttccatgaga

SEQ ID NO: 7352492 - DNA, 21 bp, Homo sapiens
ccaggctgggagggcagttcc

SEQ ID NO: 7352493 - DNA, 17 bp, Homo sapiens
tgaaacaccaagactgt

SEQ ID NO: 7352494 - DNA, 22 bp, Homo sapiens
tgaaacacaagcctggttagtg

SEQ ID NO: 7352495 - DNA, 22 bp, Homo sapiens
tgaaacaattagaatgtaatga

SEQ ID NO: 7352496 - DNA, 22 bp, Homo sapiens
tcttaatggcatgcaggtttca

SEQ ID NO: 7352497 - DNA, 20 bp, Homo sapiens
tcttacaatcgttacatcca

SEQ ID NO: 7352498 - DNA, 22 bp, Homo sapiens
ccaggcagagggatccccatcc

SEQ ID NO: 7352499 - DNA, 22 bp, Homo sapiens
ccaggcagagggaatagcaagt

SEQ ID NO: 7352500 - DNA, 22 bp, Homo sapiens
ccaggcagagtgctccagaaag

SEQ ID NO: 7352501 - DNA, 22 bp, Homo sapiens
ccaggcagatgggccggcttca

SEQ ID NO: 7352502 - DNA, 22 bp, Homo sapiens
ccaggaggctctgactggaccc

SEQ ID NO: 7352503 - DNA, 22 bp, Homo sapiens
ccaggaggcggaggttgcagtg

SEQ ID NO: 7352504 - DNA, 22 bp, Homo sapiens
ccaggaggcggaggttgcagcg

SEQ ID NO: 7352505 - DNA, 22 bp, Homo sapiens
ccaggcacttgtttgccaggca

SEQ ID NO: 7352506 - DNA, 22 bp, Homo sapiens
ccaggcagaatgaaacccctgt

SEQ ID NO: 7352507 - DNA, 22 bp, Homo sapiens
ccaggcacactgccctgccctt

SEQ ID NO: 7352508 - DNA, 22 bp, Homo sapiens
ccaggaggcttcgtccgtggag

SEQ ID NO: 7352509 - DNA, 22 bp, Homo sapiens
ccaggcaagtagaagctgtggt

SEQ ID NO: 7352510 - DNA, 22 bp, Homo sapiens
ccaggaggctcttgtccctggt

SEQ ID NO: 7352511 - DNA, 22 bp, Homo sapiens
ccaggaggcttcgtccgtggag

SEQ ID NO: 7352512 - DNA, 17 bp, Homo sapiens
tcttctcttccagtctt

SEQ ID NO: 7352513 - DNA, 22 bp, Homo sapiens
tcttctctgtggcctggtggtg

SEQ ID NO: 7352514 - DNA, 22 bp, Homo sapiens
tcttagaaatgaagttctttct

SEQ ID NO: 7352515 - DNA, 22 bp, Homo sapiens
tcttagaagtttatggcacgga

SEQ ID NO: 7352516 - DNA, 22 bp, Homo sapiens
tcttcctcaatgtaacaacccc

SEQ ID NO: 7352517 - DNA, 22 bp, Homo sapiens
tcttctctcatgtaggagggaa

SEQ ID NO: 7352518 - DNA, 22 bp, Homo sapiens
tcttctctcctgcttggcagaa

SEQ ID NO: 7352519 - DNA, 22 bp, Homo sapiens
ccaggcaggcgatggtgcagtg

SEQ ID NO: 7352520 - DNA, 22 bp, Homo sapiens
ccaggcaggcgatggtgcagtg

SEQ ID NO: 7352521 - DNA, 22 bp, Homo sapiens
ccaggcctcccttttccagcca

SEQ ID NO: 7352522 - DNA, 22 bp, Homo sapiens
ccaggcaggcgatggtgcagtg

SEQ ID NO: 7352523 - DNA, 22 bp, Homo sapiens
ccaggcagcctgctccattctg

SEQ ID NO: 7352524 - DNA, 22 bp, Homo sapiens
ccaggcagctctgatttatgtc

SEQ ID NO: 7352525 - DNA, 20 bp, Homo sapiens
tctgttattgcatgtacata

SEQ ID NO: 7352526 - DNA, 22 bp, Homo sapiens
tctgttattttcttgtgtggaa

SEQ ID NO: 7352527 - DNA, 22 bp, Homo sapiens
tctgttcagttgattagacaga

SEQ ID NO: 7352528 - DNA, 22 bp, Homo sapiens
tctgttcatagtagtgtatatg

SEQ ID NO: 7352529 - DNA, 22 bp, Homo sapiens
tctgttcatcatctggacacat

SEQ ID NO: 7352530 - DNA, 22 bp, Homo sapiens
tctgttcatctcatgggagaat

SEQ ID NO: 7352531 - DNA, 22 bp, Homo sapiens
tctgttcagacactttacatgt

SEQ ID NO: 7352532 - DNA, 17 bp, Homo sapiens
tctgttcaagtgagagg

SEQ ID NO: 7352533 - DNA, 22 bp, Homo sapiens
tctgttctaagcattctatgtg

SEQ ID NO: 7352534 - DNA, 22 bp, Homo sapiens
tctgttcatgaaatatcttttt

SEQ ID NO: 7352535 - DNA, 22 bp, Homo sapiens
tctgttcttcctacattcacat

SEQ ID NO: 7352536 - DNA, 22 bp, Homo sapiens
ccaggagccactcaggcccaca

SEQ ID NO: 7352537 - DNA, 22 bp, Homo sapiens
ccaggagcagccggcccacctg

SEQ ID NO: 7352538 - DNA, 22 bp, Homo sapiens
ccaggagcagccggcccacctg

SEQ ID NO: 7352539 - DNA, 22 bp, Homo sapiens
ccaggagcaggagctgcagctg

SEQ ID NO: 7352540 - DNA, 22 bp, Homo sapiens
tctgggccgctgcgttccatga

SEQ ID NO: 7352541 - DNA, 22 bp, Homo sapiens
tctgggcctcacctgctgctca

SEQ ID NO: 7352542 - DNA, 22 bp, Homo sapiens
tctgggcctatagaagtctacc

SEQ ID NO: 7352543 - DNA, 22 bp, Homo sapiens
tctgggaggctgggtcccgtcc

SEQ ID NO: 7352544 - DNA, 22 bp, Homo sapiens
tctgggcctcagtttcttcatc

SEQ ID NO: 7352545 - DNA, 22 bp, Homo sapiens
tctgggcctgtctcagagctgg

SEQ ID NO: 7352546 - DNA, 22 bp, Homo sapiens
tctgggctatatggtctctgct

SEQ ID NO: 7352547 - DNA, 20 bp, Homo sapiens
tcaaaggcaaaggtgggtgt

SEQ ID NO: 7352548 - DNA, 22 bp, Homo sapiens
tattccagttcaccttttcatc

SEQ ID NO: 7352549 - DNA, 22 bp, Homo sapiens
cagtctggcacagcacactgaa

SEQ ID NO: 7352550 - DNA, 22 bp, Homo sapiens
cagtctgggactgagctccacc

SEQ ID NO: 7352551 - DNA, 22 bp, Homo sapiens
cagtctgtaatgggttttaaaa

SEQ ID NO: 7352552 - DNA, 22 bp, Homo sapiens
cagtccctagtggagctcacag

SEQ ID NO: 7352553 - DNA, 22 bp, Homo sapiens
tcaaattttaacatgcattaga

SEQ ID NO: 7352554 - DNA, 22 bp, Homo sapiens
tcaaattagtggaataataatg

SEQ ID NO: 7352555 - DNA, 22 bp, Homo sapiens
tcactgcactccagcactcagg

SEQ ID NO: 7352556 - DNA, 22 bp, Homo sapiens
cagtggaggccttgggaccttt

SEQ ID NO: 7352557 - DNA, 22 bp, Homo sapiens
tcacatggcgagctttaaaata

SEQ ID NO: 7352558 - DNA, 22 bp, Homo sapiens
cagtggagaggcatgcttggca

SEQ ID NO: 7352559 - DNA, 19 bp, Homo sapiens
cagtggagattggaggagg

SEQ ID NO: 7352560 - DNA, 22 bp, Homo sapiens
cagtgcagaggtgcaagcatgt

SEQ ID NO: 7352561 - DNA, 22 bp, Homo sapiens
tcacacatgtaagggctttgga

SEQ ID NO: 7352562 - DNA, 16 bp, Homo sapiens
tcacacatttgttggt

SEQ ID NO: 7352563 - DNA, 22 bp, Homo sapiens
tcacacatttctcaagtgtagg

SEQ ID NO: 7352564 - DNA, 20 bp, Homo sapiens
cagggccacgctccaaggca

SEQ ID NO: 7352565 - DNA, 22 bp, Homo sapiens
cagggccaccgtgtttgctgct

SEQ ID NO: 7352566 - DNA, 22 bp, Homo sapiens
cagggccaccgtgtttgctgct

SEQ ID NO: 7352567 - DNA, 22 bp, Homo sapiens
cagggccaccctctgctgggtg

SEQ ID NO: 7352568 - DNA, 22 bp, Homo sapiens
cagggccaccctctgctgggtg

SEQ ID NO: 7352569 - DNA, 22 bp, Homo sapiens
cagggccacacggaagggaaca

SEQ ID NO: 7352570 - DNA, 21 bp, Homo sapiens
cagggccaatcctgacctcta

SEQ ID NO: 7352571 - DNA, 22 bp, Homo sapiens
cagggccaagctgcagcatctg

SEQ ID NO: 7352572 - DNA, 22 bp, Homo sapiens
cagggccaagttggtgcctttt

SEQ ID NO: 7352573 - DNA, 22 bp, Homo sapiens
cagggctgagtcatatagcctt

SEQ ID NO: 7352574 - DNA, 22 bp, Homo sapiens
cagggctgagtcatatagcctt

SEQ ID NO: 7352575 - DNA, 22 bp, Homo sapiens
cagggctgctggccgtgccctc

SEQ ID NO: 7352576 - DNA, 22 bp, Homo sapiens
cagggctggatcctccagactc

SEQ ID NO: 7352577 - DNA, 22 bp, Homo sapiens
tatatacaaggtaggtttaggt

SEQ ID NO: 7352578 - DNA, 22 bp, Homo sapiens
tatatacaaggtaggtttaggt

SEQ ID NO: 7352579 - DNA, 22 bp, Homo sapiens
tatataatttgtaaaagcacct

SEQ ID NO: 7352580 - DNA, 22 bp, Homo sapiens
tatattcaatgattagtatcag

SEQ ID NO: 7352581 - DNA, 22 bp, Homo sapiens
tatattcatattgttgtctctc

SEQ ID NO: 7352582 - DNA, 18 bp, Homo sapiens
tatatagagaaacccatt

SEQ ID NO: 7352583 - DNA, 22 bp, Homo sapiens
tatatatatgcacacacaccta

SEQ ID NO: 7352584 - DNA, 22 bp, Homo sapiens
tatatactatgcgattcctgcc

SEQ ID NO: 7352585 - DNA, 22 bp, Homo sapiens
tagttttagcagcaatgggatg

SEQ ID NO: 7352586 - DNA, 22 bp, Homo sapiens
tagtttcttcacctgtaaaatg

SEQ ID NO: 7352587 - DNA, 22 bp, Homo sapiens
tagtgtgtatggtaatgatgaa

SEQ ID NO: 7352588 - DNA, 22 bp, Homo sapiens
caggtggggcgccctcaggcag

SEQ ID NO: 7352589 - DNA, 22 bp, Homo sapiens
caggtggggcgccctcaggcag

SEQ ID NO: 7352590 - DNA, 22 bp, Homo sapiens
caggtggggagagtgtggagca

SEQ ID NO: 7352591 - DNA, 22 bp, Homo sapiens
caggtggggcagctgtgggagc

SEQ ID NO: 7352592 - DNA, 22 bp, Homo sapiens
caggtgggctgcctctccagct

SEQ ID NO: 7352593 - DNA, 22 bp, Homo sapiens
caggtgggctgcctctccagct

SEQ ID NO: 7352594 - DNA, 22 bp, Homo sapiens
caggtggcttattagggtcagt

SEQ ID NO: 7352595 - DNA, 22 bp, Homo sapiens
tatgtacatgatttcatttgct

SEQ ID NO: 7352596 - DNA, 22 bp, Homo sapiens
cagtaaaagatggaaatagaat

SEQ ID NO: 7352597 - DNA, 17 bp, Homo sapiens
tatctgtatgatggata

SEQ ID NO: 7352598 - DNA, 22 bp, Homo sapiens
tatgaactgctcttgtgttttg

SEQ ID NO: 7352599 - DNA, 22 bp, Homo sapiens
tatattgtagctgatgacaaat

SEQ ID NO: 7352600 - DNA, 22 bp, Homo sapiens
tatattgtagctgatgacaaat

SEQ ID NO: 7352601 - DNA, 22 bp, Homo sapiens
tatgatatgcactttatcagaa

SEQ ID NO: 7352602 - DNA, 22 bp, Homo sapiens
tatgatttgtagacatttgatt

SEQ ID NO: 7352603 - DNA, 22 bp, Homo sapiens
tatgattaatattcttaaaatt

SEQ ID NO: 7352604 - DNA, 22 bp, Homo sapiens
tatgatttgtagacatttgatt

SEQ ID NO: 7352605 - DNA, 22 bp, Homo sapiens
tagacagttaaactactggtgg

SEQ ID NO: 7352606 - DNA, 22 bp, Homo sapiens
cagggagaggcatcatagggaa

SEQ ID NO: 7352607 - DNA, 22 bp, Homo sapiens
cagggagaggctggtggagtaa

SEQ ID NO: 7352608 - DNA, 22 bp, Homo sapiens
cagggagaagtctggtcagtcc

SEQ ID NO: 7352609 - DNA, 22 bp, Homo sapiens
cagggagaaatctccaggaggt

SEQ ID NO: 7352610 - DNA, 22 bp, Homo sapiens
cagggagaggcatcatagggaa

SEQ ID NO: 7352611 - DNA, 22 bp, Homo sapiens
cagggagaggcatcatagggaa

SEQ ID NO: 7352612 - DNA, 22 bp, Homo sapiens
cagggacagcgggactctgaca

SEQ ID NO: 7352613 - DNA, 22 bp, Homo sapiens
cagggacagccttggggtggcg

SEQ ID NO: 7352614 - DNA, 22 bp, Homo sapiens
cagggacagccttggggtggcg

SEQ ID NO: 7352615 - DNA, 22 bp, Homo sapiens
tagaacagtataggctaaacat

SEQ ID NO: 7352616 - DNA, 22 bp, Homo sapiens
tagaaagcagtatctccatttt

SEQ ID NO: 7352617 - DNA, 22 bp, Homo sapiens
tagaaagcatgcaagtttgatg

SEQ ID NO: 7352618 - DNA, 22 bp, Homo sapiens
tagaaagcagttgtgggggctc

SEQ ID NO: 7352619 - DNA, 22 bp, Homo sapiens
tagaaagcatgcaagtttgatg

SEQ ID NO: 7352620 - DNA, 22 bp, Homo sapiens
tagaacaatgaatttctggagg

SEQ ID NO: 7352621 - DNA, 22 bp, Homo sapiens
tagaaagactgtccagatttca

SEQ ID NO: 7352622 - DNA, 22 bp, Homo sapiens
tagaaagacatgggccagcagc

SEQ ID NO: 7352623 - DNA, 22 bp, Homo sapiens
tagaaagcaaaatcctaccaag

SEQ ID NO: 7352624 - DNA, 22 bp, Homo sapiens
tagaaagcagaaaccatcagag

SEQ ID NO: 7352625 - DNA, 22 bp, Homo sapiens
tagaaacaagggagaggattct

SEQ ID NO: 7352626 - DNA, 22 bp, Homo sapiens
caggctgcagcagcagtggccc

SEQ ID NO: 7352627 - DNA, 20 bp, Homo sapiens
taccctggctatgcttctga

SEQ ID NO: 7352628 - DNA, 22 bp, Homo sapiens
taccctgggagcttagaagaat

SEQ ID NO: 7352629 - DNA, 22 bp, Homo sapiens
cagggaggatgggctgttttgc

SEQ ID NO: 7352630 - DNA, 23 bp, Homo sapiens
cagggaggagatactgtgtatct

SEQ ID NO: 7352631 - DNA, 22 bp, Homo sapiens
tagacattttaagacatatacc

SEQ ID NO: 7352632 - DNA, 23 bp, Homo sapiens
cagggaggagatactgtgtatct

SEQ ID NO: 7352633 - DNA, 22 bp, Homo sapiens
cagggagggaggaaaatttgct

SEQ ID NO: 7352634 - DNA, 22 bp, Homo sapiens
cagggagggacaattgtcacct

SEQ ID NO: 7352635 - DNA, 22 bp, Homo sapiens
cagggaggctgtcttatgcctg

SEQ ID NO: 7352636 - DNA, 22 bp, Homo sapiens
cagggatgaccagagggatgtg

SEQ ID NO: 7352637 - DNA, 22 bp, Homo sapiens
cagggatgaccagagggatgtg

SEQ ID NO: 7352638 - DNA, 22 bp, Homo sapiens
cagggatgagaaagctctctaa

SEQ ID NO: 7352639 - DNA, 22 bp, Homo sapiens
cagggatgctgcttaggcagtt

SEQ ID NO: 7352640 - DNA, 22 bp, Homo sapiens
tagcatgtcagtcgccacacgt

SEQ ID NO: 7352641 - DNA, 22 bp, Homo sapiens
cagggcaggacagatacattac

SEQ ID NO: 7352642 - DNA, 22 bp, Homo sapiens
tagcagtgttgccgttggctgc

SEQ ID NO: 7352643 - DNA, 22 bp, Homo sapiens
tagcagcacctacacgtcagag

SEQ ID NO: 7352644 - DNA, 22 bp, Homo sapiens
tagcagcaggggaaacagctgt

SEQ ID NO: 7352645 - DNA, 22 bp, Homo sapiens
cagggcagtgaagaacacacgt

SEQ ID NO: 7352646 - DNA, 22 bp, Homo sapiens
cagggcagtaccgccctctggc

SEQ ID NO: 7352647 - DNA, 22 bp, Homo sapiens
cagggcagttttacttctctct

SEQ ID NO: 7352648 - DNA, 22 bp, Homo sapiens
cagggcagttttacttctctct

SEQ ID NO: 7352649 - DNA, 22 bp, Homo sapiens
cagggccaagcccctttggctg

SEQ ID NO: 7352650 - DNA, 22 bp, Homo sapiens
cagggccaagctgcagcatctg

SEQ ID NO: 7352651 - DNA, 22 bp, Homo sapiens
tacactggccaaatgcctttgg

SEQ ID NO: 7352652 - DNA, 22 bp, Homo sapiens
tacactgtggtaaactcaaagt

SEQ ID NO: 7352653 - DNA, 22 bp, Homo sapiens
tacactgtgtaaaatgcacttt

SEQ ID NO: 7352654 - DNA, 22 bp, Homo sapiens
tacagagaactcatagaaagaa

SEQ ID NO: 7352655 - DNA, 22 bp, Homo sapiens
tacagagaactcatagaaagaa

SEQ ID NO: 7352656 - DNA, 22 bp, Homo sapiens
tacagagaataataggacaggt

SEQ ID NO: 7352657 - DNA, 22 bp, Homo sapiens
caggccaccagatacatgcccc

SEQ ID NO: 7352658 - DNA, 22 bp, Homo sapiens
caggccccattcctcttgggac

SEQ ID NO: 7352659 - DNA, 22 bp, Homo sapiens
caggccctgcactaggccctgg

SEQ ID NO: 7352660 - DNA, 22 bp, Homo sapiens
caggccctgcactaggccctgg

SEQ ID NO: 7352661 - DNA, 22 bp, Homo sapiens
caggccctcgtggtgagctggg

SEQ ID NO: 7352662 - DNA, 22 bp, Homo sapiens
caggccctcgcccgcagcgacc

SEQ ID NO: 7352663 - DNA, 22 bp, Homo sapiens
caggccctcctgtgatctgcct

SEQ ID NO: 7352664 - DNA, 22 bp, Homo sapiens
cagctctgcctctggggctgag

SEQ ID NO: 7352665 - DNA, 22 bp, Homo sapiens
gtggagaggaacccagctctgt

SEQ ID NO: 7352666 - DNA, 22 bp, Homo sapiens
cagctctgccacttcctagcta

SEQ ID NO: 7352667 - DNA, 20 bp, Homo sapiens
gtggagaggctggcgggact

SEQ ID NO: 7352668 - DNA, 20 bp, Homo sapiens
gtggagaggctggcgggact

SEQ ID NO: 7352669 - DNA, 20 bp, Homo sapiens
gtggagaggctggcgggact

SEQ ID NO: 7352670 - DNA, 22 bp, Homo sapiens
tacacagaacctggtgtacagt

SEQ ID NO: 7352671 - DNA, 22 bp, Homo sapiens
tacaatagggcttttgtttatg

SEQ ID NO: 7352672 - DNA, 22 bp, Homo sapiens
tacagtttaacactttggagaa

SEQ ID NO: 7352673 - DNA, 22 bp, Homo sapiens
tacagtttacatgagaggaagc

SEQ ID NO: 7352674 - DNA, 22 bp, Homo sapiens
tacagtttctgtccttgtggag

SEQ ID NO: 7352675 - DNA, 22 bp, Homo sapiens
tacagtttctcattatgctctc

SEQ ID NO: 7352676 - DNA, 22 bp, Homo sapiens
tacagtttagaaccatagatgg

SEQ ID NO: 7352677 - DNA, 22 bp, Homo sapiens
tacagtttccaagggcttgaag

SEQ ID NO: 7352678 - DNA, 22 bp, Homo sapiens
tacagtttcccagcagatgcaa

SEQ ID NO: 7352679 - DNA, 22 bp, Homo sapiens
caggctcccgctccactgggca

SEQ ID NO: 7352680 - DNA, 22 bp, Homo sapiens
caggctcccgaaatcacccatg

SEQ ID NO: 7352681 - DNA, 22 bp, Homo sapiens
caggctcccacaagctcccagc

SEQ ID NO: 7352682 - DNA, 22 bp, Homo sapiens
caggctcccaccctcctgcagc

SEQ ID NO: 7352683 - DNA, 22 bp, Homo sapiens
caggctcccaccctcctgcagc

SEQ ID NO: 7352684 - DNA, 22 bp, Homo sapiens
caggctccattaatcatcctgc

SEQ ID NO: 7352685 - DNA, 22 bp, Homo sapiens
caggctccagcttcctgctcag

SEQ ID NO: 7352686 - DNA, 22 bp, Homo sapiens
caggctccagcttcctgctcag

SEQ ID NO: 7352687 - DNA, 22 bp, Homo sapiens
tacagtttgtatggtcaggaat

SEQ ID NO: 7352688 - DNA, 22 bp, Homo sapiens
caggctccttcccagggatggt

SEQ ID NO: 7352689 - DNA, 22 bp, Homo sapiens
caggctcggaagtgctggcttt

SEQ ID NO: 7352690 - DNA, 21 bp, Homo sapiens
caggctctgctagaggagcct

SEQ ID NO: 7352691 - DNA, 21 bp, Homo sapiens
caggctctgctagaggagcct

SEQ ID NO: 7352692 - DNA, 20 bp, Homo sapiens
caggctccgcaggactaggg

SEQ ID NO: 7352693 - DNA, 22 bp, Homo sapiens
caggctcctcactcatgctccc

SEQ ID NO: 7352694 - DNA, 22 bp, Homo sapiens
caggctccttcccagggatggt

SEQ ID NO: 7352695 - DNA, 22 bp, Homo sapiens
caggctcctcactcatgctccc

SEQ ID NO: 7352696 - DNA, 22 bp, Homo sapiens
caggctccctgccagggccggc

SEQ ID NO: 7352697 - DNA, 20 bp, Homo sapiens
caggctccgcaggactaggg

SEQ ID NO: 7352698 - DNA, 22 bp, Homo sapiens
caggctccctgggcagtggcag

SEQ ID NO: 7352699 - DNA, 23 bp, Homo sapiens
caggctcccggaccaggatccgc

SEQ ID NO: 7352700 - DNA, 23 bp, Homo sapiens
caggctcccggaccaggatccgc

SEQ ID NO: 7352701 - DNA, 23 bp, Homo sapiens
caggctcccggaccaggatccgc

SEQ ID NO: 7352702 - DNA, 22 bp, Homo sapiens
caggctcccgctccactgggca

SEQ ID NO: 7352703 - DNA, 22 bp, Homo sapiens
caggctccctaagtcagcagcc

SEQ ID NO: 7352704 - DNA, 22 bp, Homo sapiens
caggcctgtgagttgaggcccc

SEQ ID NO: 7352705 - DNA, 22 bp, Homo sapiens
caggcctgtgagttgaggcccc

SEQ ID NO: 7352706 - DNA, 22 bp, Homo sapiens
caggcctgtgacaccgtgtctg

SEQ ID NO: 7352707 - DNA, 17 bp, Homo sapiens
caggccttgagccttta

SEQ ID NO: 7352708 - DNA, 22 bp, Homo sapiens
tacagcctcgaactcctgcatt

SEQ ID NO: 7352709 - DNA, 22 bp, Homo sapiens
tacagagagataagtgtaaaag

SEQ ID NO: 7352710 - DNA, 22 bp, Homo sapiens
tacagagactttatggcacaaa

SEQ ID NO: 7352711 - DNA, 22 bp, Homo sapiens
tacagagagaggggttaccagg

SEQ ID NO: 7352712 - DNA, 22 bp, Homo sapiens
tacagagacccacaagagactg

SEQ ID NO: 7352713 - DNA, 22 bp, Homo sapiens
tacagagacccacaagagactg

SEQ ID NO: 7352714 - DNA, 22 bp, Homo sapiens
tacagcagggcgctgtgatgaa

SEQ ID NO: 7352715 - DNA, 22 bp, Homo sapiens
tacagcatgtccttagcaaggc

SEQ ID NO: 7352716 - DNA, 20 bp, Homo sapiens
tacagagagctagctctctg

SEQ ID NO: 7352717 - DNA, 22 bp, Homo sapiens
tacagagagctccggacattca

SEQ ID NO: 7352718 - DNA, 22 bp, Homo sapiens
tacagagaggtgacccttgggc

SEQ ID NO: 7352719 - DNA, 22 bp, Homo sapiens
ccaagaggcagaatgcagagaa

SEQ ID NO: 7352720 - DNA, 22 bp, Homo sapiens
ccaagaatgataggtgtgagca

SEQ ID NO: 7352721 - DNA, 22 bp, Homo sapiens
ccaagaggttgaggctgcagtg

SEQ ID NO: 7352722 - DNA, 21 bp, Homo sapiens
tcctgccttagtccagagcag

SEQ ID NO: 7352723 - DNA, 22 bp, Homo sapiens
ccacagggcctttcctgctggc

SEQ ID NO: 7352724 - DNA, 22 bp, Homo sapiens
ccacagggataggaatggggct

SEQ ID NO: 7352725 - DNA, 22 bp, Homo sapiens
ccacaggctgctgcaggtcccg

SEQ ID NO: 7352726 - DNA, 22 bp, Homo sapiens
ccacaggcggagtggcgggcag

SEQ ID NO: 7352727 - DNA, 22 bp, Homo sapiens
ccacaggctgctgcaggtcccg

SEQ ID NO: 7352728 - DNA, 22 bp, Homo sapiens
tcctggcctgtctggagtagct

SEQ ID NO: 7352729 - DNA, 22 bp, Homo sapiens
tcctggccttagcgaggcggtc

SEQ ID NO: 7352730 - DNA, 22 bp, Homo sapiens
tcctggccttatccccaaactg

SEQ ID NO: 7352731 - DNA, 20 bp, Homo sapiens
tcctggccttctcgggcagt

SEQ ID NO: 7352732 - DNA, 21 bp, Homo sapiens
ccacaggggctcccctgtcag

SEQ ID NO: 7352733 - DNA, 22 bp, Homo sapiens
tcctggctaatgctgctgatgg

SEQ ID NO: 7352734 - DNA, 22 bp, Homo sapiens
tcctggctagttttgctgaaat

SEQ ID NO: 7352735 - DNA, 16 bp, Homo sapiens
tcctggcctttggaag

SEQ ID NO: 7352736 - DNA, 22 bp, Homo sapiens
tcctggccttgctcctgatgcc

SEQ ID NO: 7352737 - DNA, 22 bp, Homo sapiens
tcctggccttgcgtcttgggag

SEQ ID NO: 7352738 - DNA, 20 bp, Homo sapiens
tcctgaggcttcgccagtgt

SEQ ID NO: 7352739 - DNA, 22 bp, Homo sapiens
cattttgtgctagacactatgg

SEQ ID NO: 7352740 - DNA, 22 bp, Homo sapiens
cattttcatgagtttctgttca

SEQ ID NO: 7352741 - DNA, 22 bp, Homo sapiens
cattttcatgagtttctgttca

SEQ ID NO: 7352742 - DNA, 22 bp, Homo sapiens
cattttaagatgacctggtttc

SEQ ID NO: 7352743 - DNA, 19 bp, Homo sapiens
cattttaagcatccccagt

SEQ ID NO: 7352744 - DNA, 22 bp, Homo sapiens
catttctagggatcataaagta

SEQ ID NO: 7352745 - DNA, 21 bp, Homo sapiens
catttctattgatgagaaaag

SEQ ID NO: 7352746 - DNA, 22 bp, Homo sapiens
catttctatggcaatgggaaaa

SEQ ID NO: 7352747 - DNA, 22 bp, Homo sapiens
cattttcagcacccatctgaaa

SEQ ID NO: 7352748 - DNA, 22 bp, Homo sapiens
catttcaccttagagaattatt

SEQ ID NO: 7352749 - DNA, 22 bp, Homo sapiens
catttcaccttagagaattatt

SEQ ID NO: 7352750 - DNA, 22 bp, Homo sapiens
tccatatacaacttaatcttta

SEQ ID NO: 7352751 - DNA, 22 bp, Homo sapiens
tccataaaccagaaaatcaaga

SEQ ID NO: 7352752 - DNA, 22 bp, Homo sapiens
tccataagcaggttcttcctga

SEQ ID NO: 7352753 - DNA, 19 bp, Homo sapiens
tccataagcttgtgttcat

SEQ ID NO: 7352754 - DNA, 21 bp, Homo sapiens
tccataagagaccatctccta

SEQ ID NO: 7352755 - DNA, 23 bp, Homo sapiens
tccataatcccagaaagctcaga

SEQ ID NO: 7352756 - DNA, 22 bp, Homo sapiens
catttctagagtcccaagaggt

SEQ ID NO: 7352757 - DNA, 22 bp, Homo sapiens
catttccttcctgctgctcctc

SEQ ID NO: 7352758 - DNA, 22 bp, Homo sapiens
tctataaatgcagatatgtgtg

SEQ ID NO: 7352759 - DNA, 22 bp, Homo sapiens
tctatacaagtttcactttgac

SEQ ID NO: 7352760 - DNA, 21 bp, Homo sapiens
tctataatatgcaggtcatca

SEQ ID NO: 7352761 - DNA, 22 bp, Homo sapiens
tctcaggaagattagggctaag

SEQ ID NO: 7352762 - DNA, 22 bp, Homo sapiens
tctcagagagatgaaacttcca

SEQ ID NO: 7352763 - DNA, 22 bp, Homo sapiens
tctcagagacctgaactccctg

SEQ ID NO: 7352764 - DNA, 22 bp, Homo sapiens
tctcaggatctaatacatggta

SEQ ID NO: 7352765 - DNA, 22 bp, Homo sapiens
tctcaggagtagtgggatccat

SEQ ID NO: 7352766 - DNA, 23 bp, Homo sapiens
tctcaggacacacatgtctatca

SEQ ID NO: 7352767 - DNA, 20 bp, Homo sapiens
tctcaggccccagttttctt

SEQ ID NO: 7352768 - DNA, 22 bp, Homo sapiens
tctcaggcatctgtgtggcaca

SEQ ID NO: 7352769 - DNA, 22 bp, Homo sapiens
ccagagaggccttggcaagaca

SEQ ID NO: 7352770 - DNA, 18 bp, Homo sapiens
ccacccatctctgccttt

SEQ ID NO: 7352771 - DNA, 22 bp, Homo sapiens
ccaccccaaatgaagacctctc

SEQ ID NO: 7352772 - DNA, 22 bp, Homo sapiens
ccacccctgggtgcagggagcg

SEQ ID NO: 7352773 - DNA, 19 bp, Homo sapiens
ccacccctttgctgggccc

SEQ ID NO: 7352774 - DNA, 22 bp, Homo sapiens
ccaccctgagccgcaagagcag

SEQ ID NO: 7352775 - DNA, 22 bp, Homo sapiens
ccaccctggacaggcctctgag

SEQ ID NO: 7352776 - DNA, 22 bp, Homo sapiens
ccaccctggacaggcctctgag

SEQ ID NO: 7352777 - DNA, 20 bp, Homo sapiens
ccaccctgctaagaatacac

SEQ ID NO: 7352778 - DNA, 22 bp, Homo sapiens
ccaccctgccttgggccagtga

SEQ ID NO: 7352779 - DNA, 22 bp, Homo sapiens
ccaccctgaggaatggtccggc

SEQ ID NO: 7352780 - DNA, 22 bp, Homo sapiens
tcctgtttctcctgcaaaatcc

SEQ ID NO: 7352781 - DNA, 22 bp, Homo sapiens
tcctgtttcaacccttacactg

SEQ ID NO: 7352782 - DNA, 22 bp, Homo sapiens
tctagaaagccaaattaggaat

SEQ ID NO: 7352783 - DNA, 22 bp, Homo sapiens
tctagaaagtttgtactgattt

SEQ ID NO: 7352784 - DNA, 22 bp, Homo sapiens
ccagaggctgggttcacctcag

SEQ ID NO: 7352785 - DNA, 22 bp, Homo sapiens
ccagagcagggcagcagggctc

SEQ ID NO: 7352786 - DNA, 22 bp, Homo sapiens
ccagagccagagaggtgcctgc

SEQ ID NO: 7352787 - DNA, 19 bp, Homo sapiens
ccagagcccgccagatggg

SEQ ID NO: 7352788 - DNA, 22 bp, Homo sapiens
ccagagcccctgagcttccctg

SEQ ID NO: 7352789 - DNA, 22 bp, Homo sapiens
ccagagcccagggtcatgcagg

SEQ ID NO: 7352790 - DNA, 22 bp, Homo sapiens
ccagagccggctccctcagctt

SEQ ID NO: 7352791 - DNA, 22 bp, Homo sapiens
ccagagccggctccctcagctt

SEQ ID NO: 7352792 - DNA, 22 bp, Homo sapiens
ccagagggccctggtctcagct

SEQ ID NO: 7352793 - DNA, 22 bp, Homo sapiens
ccagaggggctgagcaggtcac

SEQ ID NO: 7352794 - DNA, 18 bp, Homo sapiens
ccagagggtgcgtcagct

SEQ ID NO: 7352795 - DNA, 22 bp, Homo sapiens
ccagaggtcccctgccaggagg

SEQ ID NO: 7352796 - DNA, 20 bp, Homo sapiens
ccagagggtagggccgcccc

SEQ ID NO: 7352797 - DNA, 22 bp, Homo sapiens
ccagaggtcctgtgatgctgca

SEQ ID NO: 7352798 - DNA, 22 bp, Homo sapiens
ccagaggtgaacaggaggctgt

SEQ ID NO: 7352799 - DNA, 22 bp, Homo sapiens
ccagaggtctcctgcacgggat

SEQ ID NO: 7352800 - DNA, 22 bp, Homo sapiens
ccagcaccttgatcttggagtt

SEQ ID NO: 7352801 - DNA, 22 bp, Homo sapiens
ccagatgtccctctcaggtttg

SEQ ID NO: 7352802 - DNA, 23 bp, Homo sapiens
tctctgtacagatgaggacacac

SEQ ID NO: 7352803 - DNA, 22 bp, Homo sapiens
tcacttcacacccactatcatg

SEQ ID NO: 7352804 - DNA, 22 bp, Homo sapiens
tcactgttttgcctgcacttcc

SEQ ID NO: 7352805 - DNA, 22 bp, Homo sapiens
cagtgtataaactttaacatag

SEQ ID NO: 7352806 - DNA, 22 bp, Homo sapiens
cagtgtctacagtggctggagg

SEQ ID NO: 7352807 - DNA, 22 bp, Homo sapiens
tcaggaggcaagtaggtattga

SEQ ID NO: 7352808 - DNA, 22 bp, Homo sapiens
tcaggaggccggcaggatttga

SEQ ID NO: 7352809 - DNA, 22 bp, Homo sapiens
tcaggaggccaccaggacctgt

SEQ ID NO: 7352810 - DNA, 22 bp, Homo sapiens
tcaggaggcgtctcgctggggc

SEQ ID NO: 7352811 - DNA, 22 bp, Homo sapiens
catcaaaattagacattgttga

SEQ ID NO: 7352812 - DNA, 22 bp, Homo sapiens
tcaggcagagctgtggagctct

SEQ ID NO: 7352813 - DNA, 22 bp, Homo sapiens
tcaggctgcagtggcaaaagac

SEQ ID NO: 7352814 - DNA, 22 bp, Homo sapiens
tcaggctgatttcttttgaggg

SEQ ID NO: 7352815 - DNA, 22 bp, Homo sapiens
tcaggctgcagctgtcagcagc

SEQ ID NO: 7352816 - DNA, 20 bp, Homo sapiens
catcaacaccttgtcagcct

SEQ ID NO: 7352817 - DNA, 18 bp, Homo sapiens
tcaggctgccctgtgtct

SEQ ID NO: 7352818 - DNA, 22 bp, Homo sapiens
tcaggctgcccgttcagggctc

SEQ ID NO: 7352819 - DNA, 22 bp, Homo sapiens
tcaggctgcatctgtaagggtg

SEQ ID NO: 7352820 - DNA, 22 bp, Homo sapiens
tcaggctgcctatcagactgtg

SEQ ID NO: 7352821 - DNA, 19 bp, Homo sapiens
tcataaggagagaggaaat

SEQ ID NO: 7352822 - DNA, 22 bp, Homo sapiens
tcagtttcctggttttaatatt

SEQ ID NO: 7352823 - DNA, 22 bp, Homo sapiens
catcgtgtctaggtgtgcagca

SEQ ID NO: 7352824 - DNA, 22 bp, Homo sapiens
tcagtgtgtagtaaattgtagg

SEQ ID NO: 7352825 - DNA, 22 bp, Homo sapiens
tcatcaaagtcaaagaatgact

SEQ ID NO: 7352826 - DNA, 22 bp, Homo sapiens
tcatcaaagtcaaagaatgact

SEQ ID NO: 7352827 - DNA, 22 bp, Homo sapiens
tcatcaaagtcaaagaatgact

SEQ ID NO: 7352828 - DNA, 22 bp, Homo sapiens
tcataatacaaagagttctgca

SEQ ID NO: 7352829 - DNA, 22 bp, Homo sapiens
tcatacaactaagagtttcaga

SEQ ID NO: 7352830 - DNA, 22 bp, Homo sapiens
tcatacacattcttattacttt

SEQ ID NO: 7352831 - DNA, 20 bp, Homo sapiens
tcatacacatgagcatgcag

SEQ ID NO: 7352832 - DNA, 22 bp, Homo sapiens
tcatacacaagagcatgtaaca

SEQ ID NO: 7352833 - DNA, 22 bp, Homo sapiens
catcagcactatgattaaagta

SEQ ID NO: 7352834 - DNA, 22 bp, Homo sapiens
catcagcaggcaacactcttgg

SEQ ID NO: 7352835 - DNA, 22 bp, Homo sapiens
catcagcagtcacatgatgctg

SEQ ID NO: 7352836 - DNA, 22 bp, Homo sapiens
catcagcaggcaacactcttgg

SEQ ID NO: 7352837 - DNA, 22 bp, Homo sapiens
catcagctgagggtgagcagaa

SEQ ID NO: 7352838 - DNA, 22 bp, Homo sapiens
catcagctgagggtgagcagaa

SEQ ID NO: 7352839 - DNA, 22 bp, Homo sapiens
catcagctcttcattcttgatt

SEQ ID NO: 7352840 - DNA, 22 bp, Homo sapiens
catcagctaaacttagtgaaat

SEQ ID NO: 7352841 - DNA, 22 bp, Homo sapiens
catcagcctggaaggcagcctg

SEQ ID NO: 7352842 - DNA, 22 bp, Homo sapiens
catcagtgaaagtgaatgttct

SEQ ID NO: 7352843 - DNA, 22 bp, Homo sapiens
catcagtgcccttggggatgcc

SEQ ID NO: 7352844 - DNA, 20 bp, Homo sapiens
catcagtgcctgacaggtcc

SEQ ID NO: 7352845 - DNA, 22 bp, Homo sapiens
catcagtgagccccttgatgag

SEQ ID NO: 7352846 - DNA, 22 bp, Homo sapiens
catcagtgtctctctggtactt

SEQ ID NO: 7352847 - DNA, 22 bp, Homo sapiens
catcagtgtggcagttcactgt

SEQ ID NO: 7352848 - DNA, 22 bp, Homo sapiens
catcagtggtaactgaatggtt

SEQ ID NO: 7352849 - DNA, 22 bp, Homo sapiens
catcagtgtgttgccttgctca

SEQ ID NO: 7352850 - DNA, 22 bp, Homo sapiens
catcagtgttcactattccttc

SEQ ID NO: 7352851 - DNA, 22 bp, Homo sapiens
catcataaaattgagataactg

SEQ ID NO: 7352852 - DNA, 22 bp, Homo sapiens
catcatatatttctacaagtgc

SEQ ID NO: 7352853 - DNA, 22 bp, Homo sapiens
tcagtgtgattaggctatctga

SEQ ID NO: 7352854 - DNA, 22 bp, Homo sapiens
tcagtgtgaattcattttagat

SEQ ID NO: 7352855 - DNA, 23 bp, Homo sapiens
tcagtgtgcaagaatggagaagc

SEQ ID NO: 7352856 - DNA, 20 bp, Homo sapiens
tcagtgtggcggggacctca

SEQ ID NO: 7352857 - DNA, 22 bp, Homo sapiens
tccaagacaagcacattcctgc

SEQ ID NO: 7352858 - DNA, 22 bp, Homo sapiens
tccaagaagtttcgttaaatgt

SEQ ID NO: 7352859 - DNA, 22 bp, Homo sapiens
catgctactgaacaagtccatg

SEQ ID NO: 7352860 - DNA, 22 bp, Homo sapiens
catgctccaaaaacaagagaat

SEQ ID NO: 7352861 - DNA, 22 bp, Homo sapiens
catgccacatggacttcaaacc

SEQ ID NO: 7352862 - DNA, 22 bp, Homo sapiens
catgccaacaacaagcaatgag

SEQ ID NO: 7352863 - DNA, 22 bp, Homo sapiens
catgctgtgtggttagaactgt

SEQ ID NO: 7352864 - DNA, 22 bp, Homo sapiens
catgctgtactctgtgtcagaa

SEQ ID NO: 7352865 - DNA, 19 bp, Homo sapiens
catgctgacctgctgtggt

SEQ ID NO: 7352866 - DNA, 19 bp, Homo sapiens
catgctgacctgctgtggt

SEQ ID NO: 7352867 - DNA, 20 bp, Homo sapiens
catggtggaggagcagggcc

SEQ ID NO: 7352868 - DNA, 22 bp, Homo sapiens
catggtgggtgtagtttccgcc

SEQ ID NO: 7352869 - DNA, 22 bp, Homo sapiens
catgggctctctgagctccagg

SEQ ID NO: 7352870 - DNA, 22 bp, Homo sapiens
catgtaaaacactcagaacagt

SEQ ID NO: 7352871 - DNA, 22 bp, Homo sapiens
catggttttgagcctattatgc

SEQ ID NO: 7352872 - DNA, 21 bp, Homo sapiens
cattacaagatttccaatttg

SEQ ID NO: 7352873 - DNA, 22 bp, Homo sapiens
tccagggcaggtgctgggctct

SEQ ID NO: 7352874 - DNA, 22 bp, Homo sapiens
tccagggcaggtgctgggctct

SEQ ID NO: 7352875 - DNA, 22 bp, Homo sapiens
tccagggcagtgactacagcgg

SEQ ID NO: 7352876 - DNA, 17 bp, Homo sapiens
tccagggtttatgaaat

SEQ ID NO: 7352877 - DNA, 22 bp, Homo sapiens
tccagggttgtgggcttcagca

SEQ ID NO: 7352878 - DNA, 20 bp, Homo sapiens
tccagggtagatgaattctg

SEQ ID NO: 7352879 - DNA, 22 bp, Homo sapiens
tccaggggtaccggccaggcag

SEQ ID NO: 7352880 - DNA, 22 bp, Homo sapiens
tccaggggtgatttttgacttg

SEQ ID NO: 7352881 - DNA, 22 bp, Homo sapiens
tccaggggctgtcttggaatct

SEQ ID NO: 7352882 - DNA, 22 bp, Homo sapiens
tccaggggtaccggccaggcag

SEQ ID NO: 7352883 - DNA, 22 bp, Homo sapiens
tccagggcatgctcagactcag

SEQ ID NO: 7352884 - DNA, 22 bp, Homo sapiens
tccagggcatgctcagactcag

SEQ ID NO: 7352885 - DNA, 23 bp, Homo sapiens
tccagggcagtggctgggtctgc

SEQ ID NO: 7352886 - DNA, 22 bp, Homo sapiens
tccagggcatccacgcgtgggg

SEQ ID NO: 7352887 - DNA, 22 bp, Homo sapiens
tccagggccaagtcatggaacc

SEQ ID NO: 7352888 - DNA, 22 bp, Homo sapiens
tccaggggacactgtttctcca

SEQ ID NO: 7352889 - DNA, 22 bp, Homo sapiens
tccagggcatggggagagagtg

SEQ ID NO: 7352890 - DNA, 22 bp, Homo sapiens
tccaggggagtgctacgcacag

SEQ ID NO: 7352891 - DNA, 22 bp, Homo sapiens
tccaggggagtgctacgcacag

SEQ ID NO: 7352892 - DNA, 22 bp, Homo sapiens
tccaggggagactagacccaca

SEQ ID NO: 7352893 - DNA, 21 bp, Homo sapiens
tccaggggccagcacccaagc

SEQ ID NO: 7352894 - DNA, 19 bp, Homo sapiens
tccaggggctccacctcct

SEQ ID NO: 7352895 - DNA, 22 bp, Homo sapiens
catgtggattcctgcttagaaa

SEQ ID NO: 7352896 - DNA, 22 bp, Homo sapiens
catgtgctgtagcagagaggaa

SEQ ID NO: 7352897 - DNA, 22 bp, Homo sapiens
catgtgtatgcattcatacata

SEQ ID NO: 7352898 - DNA, 22 bp, Homo sapiens
catgtgtagtgaaataagcagt

SEQ ID NO: 7352899 - DNA, 22 bp, Homo sapiens
catgtgtagtgaaataagcagt

SEQ ID NO: 7352900 - DNA, 22 bp, Homo sapiens
catgtgtagaccgtgacctcat

SEQ ID NO: 7352901 - DNA, 22 bp, Homo sapiens
catgtgtaggtataacttgtga

SEQ ID NO: 7352902 - DNA, 22 bp, Homo sapiens
tccaggcttgagaccaggctct

SEQ ID NO: 7352903 - DNA, 22 bp, Homo sapiens
ttttggtgaatttaagtgctgt

SEQ ID NO: 7352904 - DNA, 22 bp, Homo sapiens
ttttccagatggatactagaat

SEQ ID NO: 7352905 - DNA, 22 bp, Homo sapiens
ttttcctatatgcaaagaatgc

SEQ ID NO: 7352906 - DNA, 22 bp, Homo sapiens
ttttcctatatgcaaagaatgc

SEQ ID NO: 7352907 - DNA, 22 bp, Homo sapiens
ttttcctactgataaacagtta

SEQ ID NO: 7352908 - DNA, 22 bp, Homo sapiens
ttttcctagtaggcctattaga

SEQ ID NO: 7352909 - DNA, 22 bp, Homo sapiens
ttttcctctgcaataaaagcag

SEQ ID NO: 7352910 - DNA, 22 bp, Homo sapiens
ttttcctctgagctttgaataa

SEQ ID NO: 7352911 - DNA, 22 bp, Homo sapiens
ttttcctcaggaatgctaagct

SEQ ID NO: 7352912 - DNA, 22 bp, Homo sapiens
ttttgtatcctccctttcactg

SEQ ID NO: 7352913 - DNA, 22 bp, Homo sapiens
tttttgtatagaaatgaactaa

SEQ ID NO: 7352914 - DNA, 22 bp, Homo sapiens
ttttgtgttgccatgttaagca

SEQ ID NO: 7352915 - DNA, 23 bp, Homo sapiens
ttttgtgtgacttaatatctctt

SEQ ID NO: 7352916 - DNA, 22 bp, Homo sapiens
tttttgttctgattatactggt

SEQ ID NO: 7352917 - DNA, 22 bp, Homo sapiens
ttttttccagcttctagaggcc

SEQ ID NO: 7352918 - DNA, 22 bp, Homo sapiens
ttttagaagtgcctatcctatg

SEQ ID NO: 7352919 - DNA, 22 bp, Homo sapiens
ttttattggtaatgataaaagt

SEQ ID NO: 7352920 - DNA, 22 bp, Homo sapiens
ttttacattgggaaatgcctct

SEQ ID NO: 7352921 - DNA, 22 bp, Homo sapiens
ttttagaaggaatgctatggtg

SEQ ID NO: 7352922 - DNA, 22 bp, Homo sapiens
ttttcacaagggtccaactagt

SEQ ID NO: 7352923 - DNA, 22 bp, Homo sapiens
ttttattgtcaatgaagacaga

SEQ ID NO: 7352924 - DNA, 22 bp, Homo sapiens
ttttacaagctgagtcgttaaa

SEQ ID NO: 7352925 - DNA, 22 bp, Homo sapiens
ttttacaggtcataggtatagt

SEQ ID NO: 7352926 - DNA, 22 bp, Homo sapiens
tttgtctaattgcaaggcaagt

SEQ ID NO: 7352927 - DNA, 22 bp, Homo sapiens
tttgtcttaaatcttgttactg

SEQ ID NO: 7352928 - DNA, 22 bp, Homo sapiens
tttgtcttccccctttaatcag

SEQ ID NO: 7352929 - DNA, 22 bp, Homo sapiens
tttgtgcaggtgtgtcagatcg

SEQ ID NO: 7352930 - DNA, 22 bp, Homo sapiens
tttgtgcaagacatgctaagag

SEQ ID NO: 7352931 - DNA, 22 bp, Homo sapiens
tttgaagactactgggagtgaa

SEQ ID NO: 7352932 - DNA, 22 bp, Homo sapiens
tttgacagcataatcctacacc

SEQ ID NO: 7352933 - DNA, 22 bp, Homo sapiens
tttgacagcatatcctcatatt

SEQ ID NO: 7352934 - DNA, 23 bp, Homo sapiens
tttgacagcgtggtttctgtggg

SEQ ID NO: 7352935 - DNA, 22 bp, Homo sapiens
tttgacagtgttggggcaggct

SEQ ID NO: 7352936 - DNA, 22 bp, Homo sapiens
tttgacagtgctattaagaaac

SEQ ID NO: 7352937 - DNA, 22 bp, Homo sapiens
tttgacagtgctgctaaaatgc

SEQ ID NO: 7352938 - DNA, 22 bp, Homo sapiens
tttgacagtgacgcctgtatga

SEQ ID NO: 7352939 - DNA, 22 bp, Homo sapiens
tttgacagtgatgatatataca

SEQ ID NO: 7352940 - DNA, 22 bp, Homo sapiens
tttgacagcttgttacaaagtt

SEQ ID NO: 7352941 - DNA, 21 bp, Homo sapiens
tttgacagctcagagggcatt

SEQ ID NO: 7352942 - DNA, 22 bp, Homo sapiens
tttgacagcttgcagtgagacc

SEQ ID NO: 7352943 - DNA, 22 bp, Homo sapiens
tttgacaggaattctctctagg

SEQ ID NO: 7352944 - DNA, 22 bp, Homo sapiens
tttgacaggactaacatatggc

SEQ ID NO: 7352945 - DNA, 22 bp, Homo sapiens
tttgacaggaggtggctactca

SEQ ID NO: 7352946 - DNA, 22 bp, Homo sapiens
tttgacagggtgatgaggtggt

SEQ ID NO: 7352947 - DNA, 22 bp, Homo sapiens
tttgacagtaataaagcacaag

SEQ ID NO: 7352948 - DNA, 22 bp, Homo sapiens
tttgacagtactctgtaggatc

SEQ ID NO: 7352949 - DNA, 22 bp, Homo sapiens
tttgacagtcccctgatgtttg

SEQ ID NO: 7352950 - DNA, 22 bp, Homo sapiens
tttgagaaggtgacaaattcta

SEQ ID NO: 7352951 - DNA, 19 bp, Homo sapiens
tttgagaagttattatcta

SEQ ID NO: 7352952 - DNA, 17 bp, Homo sapiens
tttctagattatcctct

SEQ ID NO: 7352953 - DNA, 22 bp, Homo sapiens
tttctagagttcatcatggtaa

SEQ ID NO: 7352954 - DNA, 22 bp, Homo sapiens
tttctagatattccttgaagtg

SEQ ID NO: 7352955 - DNA, 22 bp, Homo sapiens
tttctagatcaaacttttatat

SEQ ID NO: 7352956 - DNA, 22 bp, Homo sapiens
tttctagagataactcaaccat

SEQ ID NO: 7352957 - DNA, 22 bp, Homo sapiens
tttgaaatatgaggcattatga

SEQ ID NO: 7352958 - DNA, 22 bp, Homo sapiens
tttctattgatctaataaacat

SEQ ID NO: 7352959 - DNA, 21 bp, Homo sapiens
tttgaaagtgggtgattcttt

SEQ ID NO: 7352960 - DNA, 22 bp, Homo sapiens
tttgtcatcccttttgaaactg

SEQ ID NO: 7352961 - DNA, 22 bp, Homo sapiens
tttggctacttgatattctgaa

SEQ ID NO: 7352962 - DNA, 22 bp, Homo sapiens
tttggctaggttaagactggga

SEQ ID NO: 7352963 - DNA, 21 bp, Homo sapiens
tttgagaattggtcagagtgc

SEQ ID NO: 7352964 - DNA, 22 bp, Homo sapiens
tttgagatctcaatgaggacta

SEQ ID NO: 7352965 - DNA, 22 bp, Homo sapiens
tttgagatagtctagagtaact

SEQ ID NO: 7352966 - DNA, 22 bp, Homo sapiens
tttgagatagtctagagtaact

SEQ ID NO: 7352967 - DNA, 22 bp, Homo sapiens
tttgagattccttagctcagag

SEQ ID NO: 7352968 - DNA, 22 bp, Homo sapiens
tttgagcagcagatgcacttag

SEQ ID NO: 7352969 - DNA, 22 bp, Homo sapiens
tttgagcagcagatgcacttag

SEQ ID NO: 7352970 - DNA, 22 bp, Homo sapiens
tttgagattccttagctcagag

SEQ ID NO: 7352971 - DNA, 22 bp, Homo sapiens
tttgagcagaagggtgacatgc

SEQ ID NO: 7352972 - DNA, 22 bp, Homo sapiens
tttgcagtttgttcagctcttt

SEQ ID NO: 7352973 - DNA, 22 bp, Homo sapiens
tttgcagtttcattgctgaaat

SEQ ID NO: 7352974 - DNA, 18 bp, Homo sapiens
tttgcatggtaacattga

SEQ ID NO: 7352975 - DNA, 22 bp, Homo sapiens
tttgcattacttgactttagtt

SEQ ID NO: 7352976 - DNA, 22 bp, Homo sapiens
tttgcattagtttagatttcaa

SEQ ID NO: 7352977 - DNA, 22 bp, Homo sapiens
tttgcattatatttatagaaga

SEQ ID NO: 7352978 - DNA, 22 bp, Homo sapiens
tttgcattatctcacttatata

SEQ ID NO: 7352979 - DNA, 22 bp, Homo sapiens
tttgcattcctgcctgcattca

SEQ ID NO: 7352980 - DNA, 22 bp, Homo sapiens
tttgcatttgtttagaacctga

SEQ ID NO: 7352981 - DNA, 21 bp, Homo sapiens
tttgcattttacatgtgggga

SEQ ID NO: 7352982 - DNA, 22 bp, Homo sapiens
tttgctgaactaaaattctgaa

SEQ ID NO: 7352983 - DNA, 22 bp, Homo sapiens
tttgcatttgttcaagtattga

SEQ ID NO: 7352984 - DNA, 22 bp, Homo sapiens
tttgcatttccagagtagcaga

SEQ ID NO: 7352985 - DNA, 22 bp, Homo sapiens
tttgcatttataagttggtgga

SEQ ID NO: 7352986 - DNA, 22 bp, Homo sapiens
tttgcatttataagttggtgga

SEQ ID NO: 7352987 - DNA, 22 bp, Homo sapiens
tttgcatttctaatgagctccg

SEQ ID NO: 7352988 - DNA, 22 bp, Homo sapiens
tttgcatttctaatgagctccg

SEQ ID NO: 7352989 - DNA, 22 bp, Homo sapiens
tttgcatttgcaaataatgaaa

SEQ ID NO: 7352990 - DNA, 22 bp, Homo sapiens
tttgcatttctcgtaaggaaac

SEQ ID NO: 7352991 - DNA, 22 bp, Homo sapiens
tttgcattgtttcaaaagtgaa

SEQ ID NO: 7352992 - DNA, 22 bp, Homo sapiens
tttgcattgcctctgacttatg

SEQ ID NO: 7352993 - DNA, 22 bp, Homo sapiens
tttgcattgtaatatttagttc

SEQ ID NO: 7352994 - DNA, 22 bp, Homo sapiens
tttgcattgcattaagtattct

SEQ ID NO: 7352995 - DNA, 22 bp, Homo sapiens
tttgcattgcagtggtttacag

SEQ ID NO: 7352996 - DNA, 22 bp, Homo sapiens
tttgcattgcatacaaggaact

SEQ ID NO: 7352997 - DNA, 22 bp, Homo sapiens
tttgcattctagaaaaatttct

SEQ ID NO: 7352998 - DNA, 22 bp, Homo sapiens
tttgctgtgaatccattactgt

SEQ ID NO: 7352999 - DNA, 22 bp, Homo sapiens
tttgctgtgaatccattactgt

SEQ ID NO: 7353000 - DNA, 22 bp, Homo sapiens
tttgctgtgggatatccatgtg

SEQ ID NO: 7353001 - DNA, 22 bp, Homo sapiens
tttgctgtgggatatccatgtg

SEQ ID NO: 7353002 - DNA, 21 bp, Homo sapiens
tttgcttcaattccagaagct

SEQ ID NO: 7353003 - DNA, 21 bp, Homo sapiens
tttgcttcaattccagaagct

SEQ ID NO: 7353004 - DNA, 21 bp, Homo sapiens
ttttttcttgcgtgaggcctg

SEQ ID NO: 7353005 - DNA, 22 bp, Homo sapiens
tttattgtctatgaactgcttg

SEQ ID NO: 7353006 - DNA, 22 bp, Homo sapiens
tttatgagcaatgctgagggga

SEQ ID NO: 7353007 - DNA, 22 bp, Homo sapiens
tttatgtagttacggactatca

SEQ ID NO: 7353008 - DNA, 22 bp, Homo sapiens
tttagcattggagtctgggcta

SEQ ID NO: 7353009 - DNA, 22 bp, Homo sapiens
tttagcgtagctgacagctaat

SEQ ID NO: 7353010 - DNA, 22 bp, Homo sapiens
tttatctttaggactttgcaga

SEQ ID NO: 7353011 - DNA, 22 bp, Homo sapiens
tttagtgcttaggaaatgggga

SEQ ID NO: 7353012 - DNA, 22 bp, Homo sapiens
tttagtgctttgctattcatgg

SEQ ID NO: 7353013 - DNA, 22 bp, Homo sapiens
tttaagaagttatgttataaat

SEQ ID NO: 7353014 - DNA, 22 bp, Homo sapiens
tttaacatgttcaagaaacata

SEQ ID NO: 7353015 - DNA, 22 bp, Homo sapiens
ttgttgtttccaggatactgtg

SEQ ID NO: 7353016 - DNA, 22 bp, Homo sapiens
ttgtttaaaagaaatcatagaa

SEQ ID NO: 7353017 - DNA, 22 bp, Homo sapiens
ttgtttaaaagaaatcatagaa

SEQ ID NO: 7353018 - DNA, 22 bp, Homo sapiens
ttgttgctgctcaacctctata

SEQ ID NO: 7353019 - DNA, 22 bp, Homo sapiens
ttgttggtggaattgatgctag

SEQ ID NO: 7353020 - DNA, 21 bp, Homo sapiens
ttgttcttccagaagcaaagt

SEQ ID NO: 7353021 - DNA, 22 bp, Homo sapiens
ttgttgatgtggacgtctggaa

SEQ ID NO: 7353022 - DNA, 22 bp, Homo sapiens
tttacagatctgttgatttgtt

SEQ ID NO: 7353023 - DNA, 22 bp, Homo sapiens
tttacagaatgttgaatttggg

SEQ ID NO: 7353024 - DNA, 22 bp, Homo sapiens
tttacagaagagaaggatgctt

SEQ ID NO: 7353025 - DNA, 22 bp, Homo sapiens
tttacagaatgtcaatttctat

SEQ ID NO: 7353026 - DNA, 22 bp, Homo sapiens
tttacaagtttacagaatgatg

SEQ ID NO: 7353027 - DNA, 19 bp, Homo sapiens
tttacaagttctttgtatg

SEQ ID NO: 7353028 - DNA, 22 bp, Homo sapiens
tttacaagtttacagaatgatg

SEQ ID NO: 7353029 - DNA, 20 bp, Homo sapiens
tttaagaagtttctgaggaa

SEQ ID NO: 7353030 - DNA, 22 bp, Homo sapiens
tttaagagcatttgcaatttat

SEQ ID NO: 7353031 - DNA, 22 bp, Homo sapiens
tttaagagctagtatgtcattt

SEQ ID NO: 7353032 - DNA, 22 bp, Homo sapiens
tttaagatcatttgtattatcc

SEQ ID NO: 7353033 - DNA, 22 bp, Homo sapiens
tttaagatcatttgtattatcc

SEQ ID NO: 7353034 - DNA, 22 bp, Homo sapiens
tttcaagtggggacatttgaga

SEQ ID NO: 7353035 - DNA, 22 bp, Homo sapiens
tttcaagttgtttatatccaga

SEQ ID NO: 7353036 - DNA, 22 bp, Homo sapiens
tttcaatcaccataaagcaact

SEQ ID NO: 7353037 - DNA, 22 bp, Homo sapiens
tttcaatgacacaaaagagaaa

SEQ ID NO: 7353038 - DNA, 22 bp, Homo sapiens
tttcacaactgcttatttgaga

SEQ ID NO: 7353039 - DNA, 22 bp, Homo sapiens
tttcacaagacagctactgttg

SEQ ID NO: 7353040 - DNA, 22 bp, Homo sapiens
tttcacaagacagctactgttg

SEQ ID NO: 7353041 - DNA, 22 bp, Homo sapiens
tttcacaagtaaagtcctaagt

SEQ ID NO: 7353042 - DNA, 22 bp, Homo sapiens
tttcacaagtttcaggattctg

SEQ ID NO: 7353043 - DNA, 22 bp, Homo sapiens
tttcacaagtttcaggattctg

SEQ ID NO: 7353044 - DNA, 22 bp, Homo sapiens
tttcacaactgcttatttgaga

SEQ ID NO: 7353045 - DNA, 22 bp, Homo sapiens
tttcacaactgcttatttgaga

SEQ ID NO: 7353046 - DNA, 18 bp, Homo sapiens
tttcacaacctccagagg

SEQ ID NO: 7353047 - DNA, 19 bp, Homo sapiens
tttcaatggcttagagaaa

SEQ ID NO: 7353048 - DNA, 20 bp, Homo sapiens
tttcaagtcagcaattctca

SEQ ID NO: 7353049 - DNA, 20 bp, Homo sapiens
tttcaagtcagcaattctca

SEQ ID NO: 7353050 - DNA, 21 bp, Homo sapiens
tttatttatataggacacatg

SEQ ID NO: 7353051 - DNA, 23 bp, Homo sapiens
tttatttatttaggctgagggat

SEQ ID NO: 7353052 - DNA, 22 bp, Homo sapiens
tttcacatcatgggatggaagc

SEQ ID NO: 7353053 - DNA, 22 bp, Homo sapiens
tttcacatcccgcgcgccctta

SEQ ID NO: 7353054 - DNA, 22 bp, Homo sapiens
tttcacatggtactgcctgttt

SEQ ID NO: 7353055 - DNA, 22 bp, Homo sapiens
tttcacatgtggaatgccaggt

SEQ ID NO: 7353056 - DNA, 22 bp, Homo sapiens
tttcacatgtgctgttgtcaat

SEQ ID NO: 7353057 - DNA, 22 bp, Homo sapiens
tttcacatgtgctgttgtcaat

SEQ ID NO: 7353058 - DNA, 22 bp, Homo sapiens
tttcacatatggttgttgattg

SEQ ID NO: 7353059 - DNA, 22 bp, Homo sapiens
tttcacatcagaggtagattag

SEQ ID NO: 7353060 - DNA, 22 bp, Homo sapiens
tttcacatcagaggtagattag

SEQ ID NO: 7353061 - DNA, 22 bp, Homo sapiens
tttcacaggagtcctttctata

SEQ ID NO: 7353062 - DNA, 22 bp, Homo sapiens
tttcacaggagtcctttctata

SEQ ID NO: 7353063 - DNA, 22 bp, Homo sapiens
tttcacaggatgctgttttata

SEQ ID NO: 7353064 - DNA, 23 bp, Homo sapiens
tttcacagcttttattctgcatc

SEQ ID NO: 7353065 - DNA, 22 bp, Homo sapiens
tttcacaatcaaatggtgaaat

SEQ ID NO: 7353066 - DNA, 20 bp, Homo sapiens
tttcacaatgaacatgtctc

SEQ ID NO: 7353067 - DNA, 20 bp, Homo sapiens
tttcagtggtttgtgcctag

SEQ ID NO: 7353068 - DNA, 22 bp, Homo sapiens
tttcagtgggtttatttcatgt

SEQ ID NO: 7353069 - DNA, 22 bp, Homo sapiens
tttcagtgtaaggtttccagga

SEQ ID NO: 7353070 - DNA, 22 bp, Homo sapiens
tttcacatttgttttaagaagt

SEQ ID NO: 7353071 - DNA, 22 bp, Homo sapiens
tttcacatttgttttaagaagt

SEQ ID NO: 7353072 - DNA, 23 bp, Homo sapiens
tttcacatttactgttagatggc

SEQ ID NO: 7353073 - DNA, 22 bp, Homo sapiens
tttcacattcttctgaatctac

SEQ ID NO: 7353074 - DNA, 22 bp, Homo sapiens
tttcacattcagatatagactt

SEQ ID NO: 7353075 - DNA, 22 bp, Homo sapiens
tttcacattcagatatagactt

SEQ ID NO: 7353076 - DNA, 22 bp, Homo sapiens
tttcccaaagcctggggtgagt

SEQ ID NO: 7353077 - DNA, 22 bp, Homo sapiens
tttccatattctgcgtctgcca

SEQ ID NO: 7353078 - DNA, 22 bp, Homo sapiens
tttccatatttggtctttggga

SEQ ID NO: 7353079 - DNA, 22 bp, Homo sapiens
tttccagtgggccccttgaaat

SEQ ID NO: 7353080 - DNA, 22 bp, Homo sapiens
tttccatattctgcgtctgcca

SEQ ID NO: 7353081 - DNA, 21 bp, Homo sapiens
tttcccagcagagatagctgg

SEQ ID NO: 7353082 - DNA, 19 bp, Homo sapiens
tttctaagctaaatgcttc

SEQ ID NO: 7353083 - DNA, 22 bp, Homo sapiens
tttctaagatgtggtttcaagg

SEQ ID NO: 7353084 - DNA, 22 bp, Homo sapiens
tttctaagaaagtaatggttat

SEQ ID NO: 7353085 - DNA, 22 bp, Homo sapiens
tttctaaagggtagatttggcc

SEQ ID NO: 7353086 - DNA, 22 bp, Homo sapiens
tttcgtttgcttatataataga

SEQ ID NO: 7353087 - DNA, 22 bp, Homo sapiens
tttcgtttgcttatataataga

SEQ ID NO: 7353088 - DNA, 22 bp, Homo sapiens
tttccagtgaaattttgaatgt

SEQ ID NO: 7353089 - DNA, 22 bp, Homo sapiens
tttccagtcaccactagatcag

SEQ ID NO: 7353090 - DNA, 22 bp, Homo sapiens
tttccagtgaaattttgaatgt

SEQ ID NO: 7353091 - DNA, 22 bp, Homo sapiens
tttcatatgggcattggcaata

SEQ ID NO: 7353092 - DNA, 23 bp, Homo sapiens
tttcatatggtgtggatgaagaa

SEQ ID NO: 7353093 - DNA, 23 bp, Homo sapiens
tttcatcagttgatctggacagc

SEQ ID NO: 7353094 - DNA, 22 bp, Homo sapiens
tttcatcaccccaaatctatgg

SEQ ID NO: 7353095 - DNA, 22 bp, Homo sapiens
tttcatcaccccaaatctatgg

SEQ ID NO: 7353096 - DNA, 22 bp, Homo sapiens
tttcataatatccagagatttt

SEQ ID NO: 7353097 - DNA, 22 bp, Homo sapiens
tttcataatactgtacatgaaa

SEQ ID NO: 7353098 - DNA, 22 bp, Homo sapiens
tttcataatactgtacatgaaa

SEQ ID NO: 7353099 - DNA, 22 bp, Homo sapiens
tttcataatactgtacatgaaa

SEQ ID NO: 7353100 - DNA, 22 bp, Homo sapiens
ttgcctgctacggtcttcactg

SEQ ID NO: 7353101 - DNA, 22 bp, Homo sapiens
ttgcctgtttgagagctgtgtt

SEQ ID NO: 7353102 - DNA, 22 bp, Homo sapiens
ttgctattttgagagtcatagt

SEQ ID NO: 7353103 - DNA, 22 bp, Homo sapiens
ttgcttcagtcagtgctgccca

SEQ ID NO: 7353104 - DNA, 22 bp, Homo sapiens
ttgctttatgtgtatgacttga

SEQ ID NO: 7353105 - DNA, 22 bp, Homo sapiens
ttggcagactgacaatctgttt

SEQ ID NO: 7353106 - DNA, 22 bp, Homo sapiens
ttggcacagccacttctgctgc

SEQ ID NO: 7353107 - DNA, 22 bp, Homo sapiens
ttggcacagctccatggctttg

SEQ ID NO: 7353108 - DNA, 22 bp, Homo sapiens
ttggcacagtaatctctcttca

SEQ ID NO: 7353109 - DNA, 22 bp, Homo sapiens
ttggaggatgcaatgagggagt

SEQ ID NO: 7353110 - DNA, 22 bp, Homo sapiens
ttggaagacattaaagagagtg

SEQ ID NO: 7353111 - DNA, 22 bp, Homo sapiens
ttggaatcctgagatgagaatt

SEQ ID NO: 7353112 - DNA, 22 bp, Homo sapiens
ttggccgtttcactgggcagtt

SEQ ID NO: 7353113 - DNA, 22 bp, Homo sapiens
ttggcagatgaacacaactgga

SEQ ID NO: 7353114 - DNA, 22 bp, Homo sapiens
ttggcccagcatgcgggtctgt

SEQ ID NO: 7353115 - DNA, 22 bp, Homo sapiens
ttggctcaggacccctgtgact

SEQ ID NO: 7353116 - DNA, 22 bp, Homo sapiens
ttggctgtcactgtcagttcag

SEQ ID NO: 7353117 - DNA, 22 bp, Homo sapiens
ttgggctcaggagtttgagacc

SEQ ID NO: 7353118 - DNA, 22 bp, Homo sapiens
ttggggcagttattctgtgccc

SEQ ID NO: 7353119 - DNA, 22 bp, Homo sapiens
ttggggaggttgccacattcca

SEQ ID NO: 7353120 - DNA, 22 bp, Homo sapiens
ttggctgtgaaagcttctcaaa

SEQ ID NO: 7353121 - DNA, 22 bp, Homo sapiens
ttggctgttttatctcctggtg

SEQ ID NO: 7353122 - DNA, 23 bp, Homo sapiens
ttgggaaatagttaagacatgag

SEQ ID NO: 7353123 - DNA, 22 bp, Homo sapiens
ttgtatgtttctgtgcacatga

SEQ ID NO: 7353124 - DNA, 22 bp, Homo sapiens
ttgtataagaagttggcagata

SEQ ID NO: 7353125 - DNA, 22 bp, Homo sapiens
ttgtagaaaattagatgcatgg

SEQ ID NO: 7353126 - DNA, 22 bp, Homo sapiens
ttgtagatgtgtttttatctca

SEQ ID NO: 7353127 - DNA, 22 bp, Homo sapiens
ttgtagatggcttatttctgtg

SEQ ID NO: 7353128 - DNA, 22 bp, Homo sapiens
ttgtagatataaattttattgt

SEQ ID NO: 7353129 - DNA, 22 bp, Homo sapiens
ttgttctatggggtgaagtcta

SEQ ID NO: 7353130 - DNA, 22 bp, Homo sapiens
ttgttcaggaggggaatgtgag

SEQ ID NO: 7353131 - DNA, 22 bp, Homo sapiens
ttgtggaagccctatgagagac

SEQ ID NO: 7353132 - DNA, 22 bp, Homo sapiens
ttgtgctgtgagaatgctcatt

SEQ ID NO: 7353133 - DNA, 22 bp, Homo sapiens
ttgtgctgtatcatatttgtat

SEQ ID NO: 7353134 - DNA, 22 bp, Homo sapiens
ttgtgctgcgtaggacgtggac

SEQ ID NO: 7353135 - DNA, 22 bp, Homo sapiens
ttgtgctgctgacttaagatat

SEQ ID NO: 7353136 - DNA, 22 bp, Homo sapiens
ttgtgctgagcttctagctgtg

SEQ ID NO: 7353137 - DNA, 22 bp, Homo sapiens
ttgtgctgactgcgcccagctc

SEQ ID NO: 7353138 - DNA, 22 bp, Homo sapiens
ttgtgctcctgtgagaatctag

SEQ ID NO: 7353139 - DNA, 22 bp, Homo sapiens
ttgtgctcctatgagaatctaa

SEQ ID NO: 7353140 - DNA, 22 bp, Homo sapiens
ttgtgctaagcaatttgcttaa

SEQ ID NO: 7353141 - DNA, 19 bp, Homo sapiens
ttgtgagctgaagaacagg

SEQ ID NO: 7353142 - DNA, 22 bp, Homo sapiens
ttgtgagcattttggtgagctt

SEQ ID NO: 7353143 - DNA, 22 bp, Homo sapiens
ttgtgagcatgtttacttgatt

SEQ ID NO: 7353144 - DNA, 22 bp, Homo sapiens
ttgtgagcatgtgcagcctctg

SEQ ID NO: 7353145 - DNA, 22 bp, Homo sapiens
ttgtgagtagtgccgcaataaa

SEQ ID NO: 7353146 - DNA, 22 bp, Homo sapiens
ttgtgagcaggctgcacaaacc

SEQ ID NO: 7353147 - DNA, 22 bp, Homo sapiens
ttgtgagcaccagaggttgttc

SEQ ID NO: 7353148 - DNA, 22 bp, Homo sapiens
ttcatagtgacatgcattctgg

SEQ ID NO: 7353149 - DNA, 21 bp, Homo sapiens
ttcatcagccagaaatcaagc

SEQ ID NO: 7353150 - DNA, 22 bp, Homo sapiens
ttcagacaggcagctgggctgg

SEQ ID NO: 7353151 - DNA, 22 bp, Homo sapiens
ttcagacagttttcagattcat

SEQ ID NO: 7353152 - DNA, 22 bp, Homo sapiens
ttcagacatgcaggctgaggct

SEQ ID NO: 7353153 - DNA, 22 bp, Homo sapiens
ttcagaagtgctttcacactct

SEQ ID NO: 7353154 - DNA, 22 bp, Homo sapiens
ttcactgtgaactcatattcag

SEQ ID NO: 7353155 - DNA, 22 bp, Homo sapiens
ttcaagtatgagaaaggggact

SEQ ID NO: 7353156 - DNA, 22 bp, Homo sapiens
ttcactgtactttggcaatgct

SEQ ID NO: 7353157 - DNA, 22 bp, Homo sapiens
ttcaatgagcccggggccatag

SEQ ID NO: 7353158 - DNA, 22 bp, Homo sapiens
ttcaatgaggatagaactggat

SEQ ID NO: 7353159 - DNA, 17 bp, Homo sapiens
ttcaatgattaatgcat

SEQ ID NO: 7353160 - DNA, 22 bp, Homo sapiens
ttcaatgatttttagggatcat

SEQ ID NO: 7353161 - DNA, 21 bp, Homo sapiens
ttcaatgaaaacaaagtgagg

SEQ ID NO: 7353162 - DNA, 22 bp, Homo sapiens
ttcaatgagcccaagaacgtga

SEQ ID NO: 7353163 - DNA, 22 bp, Homo sapiens
ttcaatatgatattagctgtgg

SEQ ID NO: 7353164 - DNA, 22 bp, Homo sapiens
ttcaatcattccaacactttaa

SEQ ID NO: 7353165 - DNA, 22 bp, Homo sapiens
ttccaagagctgctggggtaag

SEQ ID NO: 7353166 - DNA, 22 bp, Homo sapiens
ttccaagagcctttcttctaga

SEQ ID NO: 7353167 - DNA, 22 bp, Homo sapiens
ttccaagacttggccagcaggg

SEQ ID NO: 7353168 - DNA, 22 bp, Homo sapiens
ttccaaggagaacactctgtag

SEQ ID NO: 7353169 - DNA, 22 bp, Homo sapiens
ttccaaggagagctcgacctca

SEQ ID NO: 7353170 - DNA, 22 bp, Homo sapiens
ttccaaggagtgaacttcaaat

SEQ ID NO: 7353171 - DNA, 22 bp, Homo sapiens
ttccaaggattgaaatgtagtc

SEQ ID NO: 7353172 - DNA, 17 bp, Homo sapiens
ttccaaggagcatttga

SEQ ID NO: 7353173 - DNA, 22 bp, Homo sapiens
ttccaaggcatgttctcaagta

SEQ ID NO: 7353174 - DNA, 22 bp, Homo sapiens
ttccaaggccagacagggcagt

SEQ ID NO: 7353175 - DNA, 19 bp, Homo sapiens
ttccaaggcatttctttgc

SEQ ID NO: 7353176 - DNA, 22 bp, Homo sapiens
ttccaaggcaacagcctaggct

SEQ ID NO: 7353177 - DNA, 22 bp, Homo sapiens
ttccaaggcatgttctcaagta

SEQ ID NO: 7353178 - DNA, 22 bp, Homo sapiens
ttccaaggcagttttctctctg

SEQ ID NO: 7353179 - DNA, 22 bp, Homo sapiens
ttccaaggcagttttctctctg

SEQ ID NO: 7353180 - DNA, 22 bp, Homo sapiens
ttccaaggccaggccctgaggt

SEQ ID NO: 7353181 - DNA, 22 bp, Homo sapiens
ttccaaggcccagcagagagga

SEQ ID NO: 7353182 - DNA, 22 bp, Homo sapiens
ttccaaggctaggttgtaaagg

SEQ ID NO: 7353183 - DNA, 22 bp, Homo sapiens
ttccaaggcgcgccggcgccac

SEQ ID NO: 7353184 - DNA, 22 bp, Homo sapiens
ttccaaggcgatggcgcagaac

SEQ ID NO: 7353185 - DNA, 22 bp, Homo sapiens
ttccaagaaacaagtgatgcag

SEQ ID NO: 7353186 - DNA, 22 bp, Homo sapiens
ttcatcaggcatcatgctcaag

SEQ ID NO: 7353187 - DNA, 22 bp, Homo sapiens
ttccaattgcagatcagataca

SEQ ID NO: 7353188 - DNA, 21 bp, Homo sapiens
ttccagttttaattaaattgt

SEQ ID NO: 7353189 - DNA, 22 bp, Homo sapiens
ttccataaaggtgatagtatac

SEQ ID NO: 7353190 - DNA, 18 bp, Homo sapiens
ttccataatgtatgtaac

SEQ ID NO: 7353191 - DNA, 22 bp, Homo sapiens
ttccataattaagtggagagaa

SEQ ID NO: 7353192 - DNA, 22 bp, Homo sapiens
ttccataatgagattcccagcc

SEQ ID NO: 7353193 - DNA, 18 bp, Homo sapiens
ttccataatgtatgtaac

SEQ ID NO: 7353194 - DNA, 22 bp, Homo sapiens
ttccataactgaccgaatgcat

SEQ ID NO: 7353195 - DNA, 22 bp, Homo sapiens
ttccataataacctgagagaaa

SEQ ID NO: 7353196 - DNA, 22 bp, Homo sapiens
ttccataataggcttaagtgaa

SEQ ID NO: 7353197 - DNA, 22 bp, Homo sapiens
ttccataatcaccttattcttt

SEQ ID NO: 7353198 - DNA, 22 bp, Homo sapiens
ttccaagtgttgagattagagg

SEQ ID NO: 7353199 - DNA, 22 bp, Homo sapiens
ttccaagtgtcagatcagattt

SEQ ID NO: 7353200 - DNA, 23 bp, Homo sapiens
ttccaaggggatgtctccaagtg

SEQ ID NO: 7353201 - DNA, 20 bp, Homo sapiens
ttccaaggtctatgcttctt

SEQ ID NO: 7353202 - DNA, 22 bp, Homo sapiens
ttccaaggtgttctgctggttt

SEQ ID NO: 7353203 - DNA, 22 bp, Homo sapiens
ttccaaggtgggactggggtgc

SEQ ID NO: 7353204 - DNA, 22 bp, Homo sapiens
ttccaaggtttctccagcctcc

SEQ ID NO: 7353205 - DNA, 22 bp, Homo sapiens
ttccaaggttagtttttagggt

SEQ ID NO: 7353206 - DNA, 22 bp, Homo sapiens
ttccaaggttactggtggttta

SEQ ID NO: 7353207 - DNA, 22 bp, Homo sapiens
ttccaaggctgtaaaattggtt

SEQ ID NO: 7353208 - DNA, 22 bp, Homo sapiens
ttccaaggctctcttcccacaa

SEQ ID NO: 7353209 - DNA, 22 bp, Homo sapiens
ttccaaggctgctatttgtttc

SEQ ID NO: 7353210 - DNA, 22 bp, Homo sapiens
ttccaagggaatgtttatgagt

SEQ ID NO: 7353211 - DNA, 22 bp, Homo sapiens
ttccaaggctgtcctcactttg

SEQ ID NO: 7353212 - DNA, 22 bp, Homo sapiens
ttccaaggctgtcctcactttg

SEQ ID NO: 7353213 - DNA, 23 bp, Homo sapiens
ttccaaggggatgtctccaagtg

SEQ ID NO: 7353214 - DNA, 23 bp, Homo sapiens
ttccaaggggatgtctccaagtg

SEQ ID NO: 7353215 - DNA, 22 bp, Homo sapiens
ttccccttataagtctggcttc

SEQ ID NO: 7353216 - DNA, 22 bp, Homo sapiens
ttccccttatcaccagcctgtc

SEQ ID NO: 7353217 - DNA, 22 bp, Homo sapiens
ttccccttgataagcagggttg

SEQ ID NO: 7353218 - DNA, 22 bp, Homo sapiens
ttcccctttttgtgtgcagctg

SEQ ID NO: 7353219 - DNA, 22 bp, Homo sapiens
ttccccttgcactatcaccctg

SEQ ID NO: 7353220 - DNA, 22 bp, Homo sapiens
ttccccttgggctgtggaggag

SEQ ID NO: 7353221 - DNA, 22 bp, Homo sapiens
ttccccttgcactatcaccctg

SEQ ID NO: 7353222 - DNA, 22 bp, Homo sapiens
ttccccttgataatgcagtaag

SEQ ID NO: 7353223 - DNA, 22 bp, Homo sapiens
ttccccaggctggagtgcagtg

SEQ ID NO: 7353224 - DNA, 22 bp, Homo sapiens
ttcccaggaagcctctccaagc

SEQ ID NO: 7353225 - DNA, 22 bp, Homo sapiens
ttccatgaaagtgaaatggagc

SEQ ID NO: 7353226 - DNA, 22 bp, Homo sapiens
ttccatatttgtgtggcaaaag

SEQ ID NO: 7353227 - DNA, 22 bp, Homo sapiens
ttccatcacatcactgaagaca

SEQ ID NO: 7353228 - DNA, 22 bp, Homo sapiens
ttccattgtttctgtcttcact

SEQ ID NO: 7353229 - DNA, 22 bp, Homo sapiens
ttatttgttttctgagaagtat

SEQ ID NO: 7353230 - DNA, 22 bp, Homo sapiens
ttatttatatctctgcagttta

SEQ ID NO: 7353231 - DNA, 22 bp, Homo sapiens
ttatttatatctctgcagttta

SEQ ID NO: 7353232 - DNA, 22 bp, Homo sapiens
ttattgttagtgagactgtaga

SEQ ID NO: 7353233 - DNA, 22 bp, Homo sapiens
ttatgtttgagtatatgactca

SEQ ID NO: 7353234 - DNA, 22 bp, Homo sapiens
ttatgtttgagtatatgactca

SEQ ID NO: 7353235 - DNA, 22 bp, Homo sapiens
ttatgttgggaaaagtcagatt

SEQ ID NO: 7353236 - DNA, 22 bp, Homo sapiens
ttattgtttgggtataatttga

SEQ ID NO: 7353237 - DNA, 22 bp, Homo sapiens
ttatttaatgtgatctgaagag

SEQ ID NO: 7353238 - DNA, 22 bp, Homo sapiens
ttcaaggaagaagtggctttga

SEQ ID NO: 7353239 - DNA, 22 bp, Homo sapiens
ttcaaggagattggagtctact

SEQ ID NO: 7353240 - DNA, 17 bp, Homo sapiens
ttcaagatattgaaatg

SEQ ID NO: 7353241 - DNA, 22 bp, Homo sapiens
ttcaaacaactcatttatgcaa

SEQ ID NO: 7353242 - DNA, 22 bp, Homo sapiens
ttcaaaattgttctaagctctg

SEQ ID NO: 7353243 - DNA, 22 bp, Homo sapiens
ttcaaaatccgggaggcgcccc

SEQ ID NO: 7353244 - DNA, 22 bp, Homo sapiens
ttcaaaatgcacaaagggctag

SEQ ID NO: 7353245 - DNA, 21 bp, Homo sapiens
ttcaaaatggtgtgtttgtct

SEQ ID NO: 7353246 - DNA, 21 bp, Homo sapiens
ttcaaaatggtgtgtttgtct

SEQ ID NO: 7353247 - DNA, 22 bp, Homo sapiens
ttattttctcctcagaaagtgg

SEQ ID NO: 7353248 - DNA, 22 bp, Homo sapiens
ttattttgagagaatgtgtgct

SEQ ID NO: 7353249 - DNA, 22 bp, Homo sapiens
ttataattctggcataggctgt

SEQ ID NO: 7353250 - DNA, 22 bp, Homo sapiens
ttatacacgtttatggagctac

SEQ ID NO: 7353251 - DNA, 22 bp, Homo sapiens
ttatacactgcagaaccagcat

SEQ ID NO: 7353252 - DNA, 22 bp, Homo sapiens
ttatgcaaggacttattacagt

SEQ ID NO: 7353253 - DNA, 22 bp, Homo sapiens
ttatgcagagttgagaggaatg

SEQ ID NO: 7353254 - DNA, 20 bp, Homo sapiens
ttatgcaagcatcaatattg

SEQ ID NO: 7353255 - DNA, 21 bp, Homo sapiens
ttagttctaccacttgcattc

SEQ ID NO: 7353256 - DNA, 22 bp, Homo sapiens
ttatgctgttaggaaaatcaaa

SEQ ID NO: 7353257 - DNA, 22 bp, Homo sapiens
ttatgcatatagcagatacgag

SEQ ID NO: 7353258 - DNA, 22 bp, Homo sapiens
ttatgcagtcgacatctgatca

SEQ ID NO: 7353259 - DNA, 22 bp, Homo sapiens
ttatgcatgagataaaaattgg

SEQ ID NO: 7353260 - DNA, 22 bp, Homo sapiens
ttatgcagatggcatgaggagg

SEQ ID NO: 7353261 - DNA, 22 bp, Homo sapiens
ttatgcagcaaagtgcttgaaa

SEQ ID NO: 7353262 - DNA, 22 bp, Homo sapiens
ttatgctaaatgaatcaagtca

SEQ ID NO: 7353263 - DNA, 22 bp, Homo sapiens
ttatgtgtgtacatgcatatgt

SEQ ID NO: 7353264 - DNA, 22 bp, Homo sapiens
ttatgtgtataattacaggaag

SEQ ID NO: 7353265 - DNA, 22 bp, Homo sapiens
ttatgtgtgtacatgcatatgt

SEQ ID NO: 7353266 - DNA, 20 bp, Homo sapiens
ttatgtgtacctgtgctccc

SEQ ID NO: 7353267 - DNA, 22 bp, Homo sapiens
ttatggaataacctttctgaaa

SEQ ID NO: 7353268 - DNA, 22 bp, Homo sapiens
ttatggcatattcctcattgta

SEQ ID NO: 7353269 - DNA, 22 bp, Homo sapiens
ttagtgtacttagtgctctaag

SEQ ID NO: 7353270 - DNA, 22 bp, Homo sapiens
tcctctggctctttccctagga

SEQ ID NO: 7353271 - DNA, 22 bp, Homo sapiens
tcctctggatataagcctcacc

SEQ ID NO: 7353272 - DNA, 19 bp, Homo sapiens
tcctccttacttcctcttg

SEQ ID NO: 7353273 - DNA, 20 bp, Homo sapiens
tcctccttgcagagcccaga

SEQ ID NO: 7353274 - DNA, 22 bp, Homo sapiens
tcctcctgtttctcaggcctgg

SEQ ID NO: 7353275 - DNA, 22 bp, Homo sapiens
tcctctccagcaaactggctat

SEQ ID NO: 7353276 - DNA, 22 bp, Homo sapiens
tcctctcagtgtggttgtggga

SEQ ID NO: 7353277 - DNA, 23 bp, Homo sapiens
tcctcgtgcctatgagcagtgcc

SEQ ID NO: 7353278 - DNA, 21 bp, Homo sapiens
tcctctactgagccatgcaga

SEQ ID NO: 7353279 - DNA, 23 bp, Homo sapiens
tcctcgcaggagggagatgatgc

SEQ ID NO: 7353280 - DNA, 22 bp, Homo sapiens
tcctcctttccccgctggagcc

SEQ ID NO: 7353281 - DNA, 22 bp, Homo sapiens
ttctgataacaaacaccaattt

SEQ ID NO: 7353282 - DNA, 22 bp, Homo sapiens
ttctgattgctgatgaggccca

SEQ ID NO: 7353283 - DNA, 22 bp, Homo sapiens
ttctgattgctgatgaggccca

SEQ ID NO: 7353284 - DNA, 22 bp, Homo sapiens
ttctggagcttggcttgtatgt

SEQ ID NO: 7353285 - DNA, 22 bp, Homo sapiens
ttctggaggacaactgttttca

SEQ ID NO: 7353286 - DNA, 22 bp, Homo sapiens
ttctggaggagaaagggtgggc

SEQ ID NO: 7353287 - DNA, 22 bp, Homo sapiens
ttctggaggccagctgccacct

SEQ ID NO: 7353288 - DNA, 22 bp, Homo sapiens
ttctggaggccccttccttctc

SEQ ID NO: 7353289 - DNA, 22 bp, Homo sapiens
ttctggaggcgggcgacctcgc

SEQ ID NO: 7353290 - DNA, 20 bp, Homo sapiens
ttctggaggctacaagtctg

SEQ ID NO: 7353291 - DNA, 22 bp, Homo sapiens
ttctcctctgttaccttgcaaa

SEQ ID NO: 7353292 - DNA, 17 bp, Homo sapiens
ttctcctctgtgtcctt

SEQ ID NO: 7353293 - DNA, 22 bp, Homo sapiens
ttctccatttaacttccttatg

SEQ ID NO: 7353294 - DNA, 22 bp, Homo sapiens
ttctccagtttctcccttcagt

SEQ ID NO: 7353295 - DNA, 22 bp, Homo sapiens
ttctcttctgttcagtgcccaa

SEQ ID NO: 7353296 - DNA, 22 bp, Homo sapiens
ttctcacaggctggaatgatga

SEQ ID NO: 7353297 - DNA, 22 bp, Homo sapiens
ttctcacagtacctaacatgta

SEQ ID NO: 7353298 - DNA, 22 bp, Homo sapiens
ttctcactatgtatgtagattg

SEQ ID NO: 7353299 - DNA, 22 bp, Homo sapiens
ttctcagaaaagcaagctttct

SEQ ID NO: 7353300 - DNA, 22 bp, Homo sapiens
ttctcagaaaatgtagagaaaa

SEQ ID NO: 7353301 - DNA, 22 bp, Homo sapiens
ttctcagaattgactgggagca

SEQ ID NO: 7353302 - DNA, 22 bp, Homo sapiens
ttctatgattcatttagaagtt

SEQ ID NO: 7353303 - DNA, 22 bp, Homo sapiens
ttctccagcacattttctttga

SEQ ID NO: 7353304 - DNA, 22 bp, Homo sapiens
ttctcagagcactgctgacaaa

SEQ ID NO: 7353305 - DNA, 22 bp, Homo sapiens
ttctcagagctcactgtagtaa

SEQ ID NO: 7353306 - DNA, 22 bp, Homo sapiens
ttctcagaggagtcgggagctg

SEQ ID NO: 7353307 - DNA, 22 bp, Homo sapiens
ttctcagaggctgctaagtgca

SEQ ID NO: 7353308 - DNA, 21 bp, Homo sapiens
ttctcagagtctattacagtt

SEQ ID NO: 7353309 - DNA, 22 bp, Homo sapiens
ttctcagatatttactgagcat

SEQ ID NO: 7353310 - DNA, 22 bp, Homo sapiens
ttctcagatccatcagaagtcc

SEQ ID NO: 7353311 - DNA, 22 bp, Homo sapiens
ttcctttagtgtcatatacttt

SEQ ID NO: 7353312 - DNA, 20 bp, Homo sapiens
ttcgctgggagtggccaggc

SEQ ID NO: 7353313 - DNA, 22 bp, Homo sapiens
ttccctctccaggagccctgag

SEQ ID NO: 7353314 - DNA, 22 bp, Homo sapiens
ttctaaaataagtttatctggt

SEQ ID NO: 7353315 - DNA, 22 bp, Homo sapiens
ttctaaaataagtttatctggt

SEQ ID NO: 7353316 - DNA, 22 bp, Homo sapiens
ttctaaactgaagtattttaaa

SEQ ID NO: 7353317 - DNA, 22 bp, Homo sapiens
ttcgtttagtccacaaatgcat

SEQ ID NO: 7353318 - DNA, 22 bp, Homo sapiens
ttctttgggctcagagagggag

SEQ ID NO: 7353319 - DNA, 22 bp, Homo sapiens
ttctttgaaatactgttttgcc

SEQ ID NO: 7353320 - DNA, 22 bp, Homo sapiens
ttctggagttcaggtccctaaa

SEQ ID NO: 7353321 - DNA, 22 bp, Homo sapiens
ttctggagttgtgacctcaggg

SEQ ID NO: 7353322 - DNA, 22 bp, Homo sapiens
ttctggagtttgaagatcaggt

SEQ ID NO: 7353323 - DNA, 22 bp, Homo sapiens
ttctggaggttattaggagtct

SEQ ID NO: 7353324 - DNA, 19 bp, Homo sapiens
ttctggaggttaccctgag

SEQ ID NO: 7353325 - DNA, 22 bp, Homo sapiens
ttctggaggtgtgaccattagc

SEQ ID NO: 7353326 - DNA, 22 bp, Homo sapiens
ttctggaggctctaagggacaa

SEQ ID NO: 7353327 - DNA, 22 bp, Homo sapiens
ttctggaggctccagggaagaa

SEQ ID NO: 7353328 - DNA, 22 bp, Homo sapiens
ttctggagggcatgctgctgcc

SEQ ID NO: 7353329 - DNA, 22 bp, Homo sapiens
ttctggagggcctgatcacaca

SEQ ID NO: 7353330 - DNA, 22 bp, Homo sapiens
ttctggagtattcctggcacct

SEQ ID NO: 7353331 - DNA, 22 bp, Homo sapiens
ttctggagtattcctggcagcc

SEQ ID NO: 7353332 - DNA, 22 bp, Homo sapiens
ttctggagtcattggggctgat

SEQ ID NO: 7353333 - DNA, 22 bp, Homo sapiens
ttctggagtcccacagccaggg

SEQ ID NO: 7353334 - DNA, 22 bp, Homo sapiens
ttctggagtcttcaattttaga

SEQ ID NO: 7353335 - DNA, 22 bp, Homo sapiens
ttctggagtgataaaacaccac

SEQ ID NO: 7353336 - DNA, 22 bp, Homo sapiens
ttctggagtgtattgggtctgc

SEQ ID NO: 7353337 - DNA, 22 bp, Homo sapiens
ttctggagtgtggaccgctgtt

SEQ ID NO: 7353338 - DNA, 22 bp, Homo sapiens
ttcttctcagggtcccacatgg

SEQ ID NO: 7353339 - DNA, 22 bp, Homo sapiens
ttcttcagagagtagaagcaag

SEQ ID NO: 7353340 - DNA, 22 bp, Homo sapiens
ttcttcagatcctacaagtctg

SEQ ID NO: 7353341 - DNA, 22 bp, Homo sapiens
ttcttcagatggtgagacctcc

SEQ ID NO: 7353342 - DNA, 22 bp, Homo sapiens
ttcttcctcacactctcaccca

SEQ ID NO: 7353343 - DNA, 22 bp, Homo sapiens
ttcttcagcctaccttgacctc

SEQ ID NO: 7353344 - DNA, 23 bp, Homo sapiens
ttcttcagccttatagccctggg

SEQ ID NO: 7353345 - DNA, 22 bp, Homo sapiens
ttcttcagcccatatcttccag

SEQ ID NO: 7353346 - DNA, 22 bp, Homo sapiens
ttcttcagactccctctttaag

SEQ ID NO: 7353347 - DNA, 22 bp, Homo sapiens
ttgaaacagtagctcatagacc

SEQ ID NO: 7353348 - DNA, 22 bp, Homo sapiens
ttgaaacagtagctcatagacc

SEQ ID NO: 7353349 - DNA, 22 bp, Homo sapiens
ttgaaaatggtaagcatgatat

SEQ ID NO: 7353350 - DNA, 22 bp, Homo sapiens
ttgaaacagacaagtaaatgtc

SEQ ID NO: 7353351 - DNA, 22 bp, Homo sapiens
ttgaaaatggtaagcatgatat

SEQ ID NO: 7353352 - DNA, 22 bp, Homo sapiens
ttgaaaatggtaagcatgatat

SEQ ID NO: 7353353 - DNA, 19 bp, Homo sapiens
ttgaaaatatggatctgag

SEQ ID NO: 7353354 - DNA, 20 bp, Homo sapiens
ttgaaaatgcattgtgcagt

SEQ ID NO: 7353355 - DNA, 22 bp, Homo sapiens
ttgaaaatatcacaggagcagc

SEQ ID NO: 7353356 - DNA, 22 bp, Homo sapiens
ttgaaaacatttatattagaat

SEQ ID NO: 7353357 - DNA, 22 bp, Homo sapiens
ttgaaaacatttatattagaat

SEQ ID NO: 7353358 - DNA, 22 bp, Homo sapiens
ttgaaaaccgtgggaggctgaa

SEQ ID NO: 7353359 - DNA, 22 bp, Homo sapiens
ttgaaaaaattggtagaggatg

SEQ ID NO: 7353360 - DNA, 22 bp, Homo sapiens
ttgaaaaaattggtagaggatg

SEQ ID NO: 7353361 - DNA, 22 bp, Homo sapiens
ttgaaagatatgttaatctttc

SEQ ID NO: 7353362 - DNA, 22 bp, Homo sapiens
ttgacattttgtcatattgaca

SEQ ID NO: 7353363 - DNA, 22 bp, Homo sapiens
ttgaccactgaatggttctgaa

SEQ ID NO: 7353364 - DNA, 22 bp, Homo sapiens
ttgagaaacctggcagtagaga

SEQ ID NO: 7353365 - DNA, 22 bp, Homo sapiens
ttgaaacattacctgtatttcc

SEQ ID NO: 7353366 - DNA, 22 bp, Homo sapiens
ttgaaacattacctgtatttcc

SEQ ID NO: 7353367 - DNA, 22 bp, Homo sapiens
ttgaaactttagtaaactaagg

SEQ ID NO: 7353368 - DNA, 22 bp, Homo sapiens
ttgaaagacattatttatatat

SEQ ID NO: 7353369 - DNA, 22 bp, Homo sapiens
ttgagggtctggatctgctgct

SEQ ID NO: 7353370 - DNA, 22 bp, Homo sapiens
ttgagggagcctgggagccatg

SEQ ID NO: 7353371 - DNA, 18 bp, Homo sapiens
ttgagggaggggcagagt

SEQ ID NO: 7353372 - DNA, 22 bp, Homo sapiens
ttgagggagcctgggagccatg

SEQ ID NO: 7353373 - DNA, 18 bp, Homo sapiens
ttgagggaggggcagagt

SEQ ID NO: 7353374 - DNA, 22 bp, Homo sapiens
ttgagggatttacagaggtggg

SEQ ID NO: 7353375 - DNA, 19 bp, Homo sapiens
ttgaggggccaggggagat

SEQ ID NO: 7353376 - DNA, 22 bp, Homo sapiens
ttgagggatttacagaggtggg

SEQ ID NO: 7353377 - DNA, 22 bp, Homo sapiens
ttgagatagatctcatcttccc

SEQ ID NO: 7353378 - DNA, 22 bp, Homo sapiens
ttgagagttttcaatagattgg

SEQ ID NO: 7353379 - DNA, 22 bp, Homo sapiens
ttgagatacattgggaaatgcc

SEQ ID NO: 7353380 - DNA, 22 bp, Homo sapiens
ttgagagtctatcaaatagctt

SEQ ID NO: 7353381 - DNA, 22 bp, Homo sapiens
ttgagataggtggaatctcttt

SEQ ID NO: 7353382 - DNA, 22 bp, Homo sapiens
ttgagataggtggaatctcttt

SEQ ID NO: 7353383 - DNA, 22 bp, Homo sapiens
ttgagggaaataactgatgctt

SEQ ID NO: 7353384 - DNA, 22 bp, Homo sapiens
ttgagggagaaagccgaggtgt

SEQ ID NO: 7353385 - DNA, 22 bp, Homo sapiens
ttgagggagaaagctgaggtgt

SEQ ID NO: 7353386 - DNA, 22 bp, Homo sapiens
ttgagaaataagcatgtctaga

SEQ ID NO: 7353387 - DNA, 19 bp, Homo sapiens
ttgagaaagttgatttggg

SEQ ID NO: 7353388 - DNA, 22 bp, Homo sapiens
ttgagactcctggtgtagaata

SEQ ID NO: 7353389 - DNA, 22 bp, Homo sapiens
ttgagaagcacagggcctgtgc

SEQ ID NO: 7353390 - DNA, 22 bp, Homo sapiens
attcttcaccatggataatttg

SEQ ID NO: 7353391 - DNA, 22 bp, Homo sapiens
attcttcaccatggataatttg

SEQ ID NO: 7353392 - DNA, 22 bp, Homo sapiens
attcttcactgtttcagaatga

SEQ ID NO: 7353393 - DNA, 22 bp, Homo sapiens
attcttcacctgagtcagtcta

SEQ ID NO: 7353394 - DNA, 22 bp, Homo sapiens
attcttcacaaatatatagaag

SEQ ID NO: 7353395 - DNA, 22 bp, Homo sapiens
attcttaattgccatgctgtat

SEQ ID NO: 7353396 - DNA, 22 bp, Homo sapiens
attcttaattccaaagactgag

SEQ ID NO: 7353397 - DNA, 22 bp, Homo sapiens
attcttattaaatagccagaag

SEQ ID NO: 7353398 - DNA, 20 bp, Homo sapiens
attctcacatggctccgggc

SEQ ID NO: 7353399 - DNA, 22 bp, Homo sapiens
attctgtgtgtactgagatggg

SEQ ID NO: 7353400 - DNA, 22 bp, Homo sapiens
attctatctctatatttctgca

SEQ ID NO: 7353401 - DNA, 22 bp, Homo sapiens
attctattttttaagaagtagt

SEQ ID NO: 7353402 - DNA, 22 bp, Homo sapiens
attctcaaacaagtggtttgat

SEQ ID NO: 7353403 - DNA, 22 bp, Homo sapiens
attcttcagatcagcagggcct

SEQ ID NO: 7353404 - DNA, 22 bp, Homo sapiens
attgaacagaaaaactcagaga

SEQ ID NO: 7353405 - DNA, 22 bp, Homo sapiens
attgaagggcattagtcatcag

SEQ ID NO: 7353406 - DNA, 22 bp, Homo sapiens
attgaagacttggtatccgtgg

SEQ ID NO: 7353407 - DNA, 22 bp, Homo sapiens
attgacagtgttaaagttgcct

SEQ ID NO: 7353408 - DNA, 22 bp, Homo sapiens
attgacagtggtgttctgggga

SEQ ID NO: 7353409 - DNA, 22 bp, Homo sapiens
attgacagtggctagtgcccag

SEQ ID NO: 7353410 - DNA, 22 bp, Homo sapiens
attgacaggagagcttggagtg

SEQ ID NO: 7353411 - DNA, 22 bp, Homo sapiens
attgacaggtctttgggagtat

SEQ ID NO: 7353412 - DNA, 22 bp, Homo sapiens
attgctggatgagctcttggat

SEQ ID NO: 7353413 - DNA, 22 bp, Homo sapiens
attgacagagctttcaccatga

SEQ ID NO: 7353414 - DNA, 22 bp, Homo sapiens
attgacagcaggggctgtcact

SEQ ID NO: 7353415 - DNA, 20 bp, Homo sapiens
attgacagaaagtgttcacc

SEQ ID NO: 7353416 - DNA, 22 bp, Homo sapiens
attgacagaaaattggatggca

SEQ ID NO: 7353417 - DNA, 22 bp, Homo sapiens
attgacagaaaagatgttggat

SEQ ID NO: 7353418 - DNA, 22 bp, Homo sapiens
attgacagaaaagatgttggat

SEQ ID NO: 7353419 - DNA, 22 bp, Homo sapiens
attgacaaatctgaacatacgg

SEQ ID NO: 7353420 - DNA, 22 bp, Homo sapiens
attcctaaagtaatacactaga

SEQ ID NO: 7353421 - DNA, 22 bp, Homo sapiens
attcctaaggaaggctggcaag

SEQ ID NO: 7353422 - DNA, 22 bp, Homo sapiens
gcagcaggcatggccgccctgg

SEQ ID NO: 7353423 - DNA, 22 bp, Homo sapiens
attcctgactgttagagtttgc

SEQ ID NO: 7353424 - DNA, 22 bp, Homo sapiens
attcctgactgctagtcattca

SEQ ID NO: 7353425 - DNA, 22 bp, Homo sapiens
attcctgagacttatctgtttc

SEQ ID NO: 7353426 - DNA, 23 bp, Homo sapiens
attcctgaggctccttatgcacc

SEQ ID NO: 7353427 - DNA, 22 bp, Homo sapiens
attcctgattaacgacctttca

SEQ ID NO: 7353428 - DNA, 22 bp, Homo sapiens
attctactgcttggaatatctt

SEQ ID NO: 7353429 - DNA, 22 bp, Homo sapiens
attctactttgtgtaattatct

SEQ ID NO: 7353430 - DNA, 22 bp, Homo sapiens
attctactcattgatctatata

SEQ ID NO: 7353431 - DNA, 22 bp, Homo sapiens
attctacacaacatgatgatgg

SEQ ID NO: 7353432 - DNA, 22 bp, Homo sapiens
gcagcagggagcaggggtgtca

SEQ ID NO: 7353433 - DNA, 22 bp, Homo sapiens
attcagttagtagatttggtca

SEQ ID NO: 7353434 - DNA, 22 bp, Homo sapiens
attcagttccttgtgattgtag

SEQ ID NO: 7353435 - DNA, 22 bp, Homo sapiens
gcagagctggaactggtactca

SEQ ID NO: 7353436 - DNA, 18 bp, Homo sapiens
gcagagctgggattccca

SEQ ID NO: 7353437 - DNA, 22 bp, Homo sapiens
gcagagctgttaatggagctga

SEQ ID NO: 7353438 - DNA, 22 bp, Homo sapiens
gcagagctgtctaagtcacttc

SEQ ID NO: 7353439 - DNA, 20 bp, Homo sapiens
attagagctacatggctaca

SEQ ID NO: 7353440 - DNA, 22 bp, Homo sapiens
attattaaagctacatcaagga

SEQ ID NO: 7353441 - DNA, 22 bp, Homo sapiens
attattaaagctacatcaagga

SEQ ID NO: 7353442 - DNA, 22 bp, Homo sapiens
attagagcagtaattgtggcag

SEQ ID NO: 7353443 - DNA, 23 bp, Homo sapiens
attagacactttgggttgtcttc

SEQ ID NO: 7353444 - DNA, 22 bp, Homo sapiens
attagacatcatatgattcagc

SEQ ID NO: 7353445 - DNA, 22 bp, Homo sapiens
gcaataaaatgtaatgattggg

SEQ ID NO: 7353446 - DNA, 22 bp, Homo sapiens
attagaagcgtgaatcctttca

SEQ ID NO: 7353447 - DNA, 22 bp, Homo sapiens
attagaagatagtgatttctgc

SEQ ID NO: 7353448 - DNA, 22 bp, Homo sapiens
attaatatacactgttagcatg

SEQ ID NO: 7353449 - DNA, 22 bp, Homo sapiens
gatgatggacaaagcattggtg

SEQ ID NO: 7353450 - DNA, 22 bp, Homo sapiens
gatgatcatctgtaaagttaga

SEQ ID NO: 7353451 - DNA, 22 bp, Homo sapiens
gatgatcatctgtaaagttaga

SEQ ID NO: 7353452 - DNA, 22 bp, Homo sapiens
attaattttacctttgtaaaca

SEQ ID NO: 7353453 - DNA, 22 bp, Homo sapiens
attaatcatttctgcattatct

SEQ ID NO: 7353454 - DNA, 22 bp, Homo sapiens
attaatgacgcagataataatt

SEQ ID NO: 7353455 - DNA, 22 bp, Homo sapiens
attacaagtagactaactttca

SEQ ID NO: 7353456 - DNA, 22 bp, Homo sapiens
attacaacaagaaaagggtaag

SEQ ID NO: 7353457 - DNA, 22 bp, Homo sapiens
attacaataaggtttatttgta

SEQ ID NO: 7353458 - DNA, 22 bp, Homo sapiens
atgtgtgtgtatatacacacat

SEQ ID NO: 7353459 - DNA, 22 bp, Homo sapiens
atgtgtgtgtatatacacacat

SEQ ID NO: 7353460 - DNA, 22 bp, Homo sapiens
atgtgtgtgtgcgcgcgcagga

SEQ ID NO: 7353461 - DNA, 22 bp, Homo sapiens
atgtgtgtgtgcgcgcgcagga

SEQ ID NO: 7353462 - DNA, 22 bp, Homo sapiens
atgtgtgtgtttaatcctcaaa

SEQ ID NO: 7353463 - DNA, 22 bp, Homo sapiens
atgtgtgtgtttaatcctcaaa

SEQ ID NO: 7353464 - DNA, 22 bp, Homo sapiens
atgtgttttggtggatcattca

SEQ ID NO: 7353465 - DNA, 22 bp, Homo sapiens
atgtgttttggtaatttctgct

SEQ ID NO: 7353466 - DNA, 22 bp, Homo sapiens
atgtgtttttattctggcatgt

SEQ ID NO: 7353467 - DNA, 22 bp, Homo sapiens
atgttaaaaaccagtacagttg

SEQ ID NO: 7353468 - DNA, 20 bp, Homo sapiens
atgtttctctgtcgtgattt

SEQ ID NO: 7353469 - DNA, 22 bp, Homo sapiens
atgtgtttgtcctgcagaaata

SEQ ID NO: 7353470 - DNA, 22 bp, Homo sapiens
atgtgtttgtcctgcagaaata

SEQ ID NO: 7353471 - DNA, 22 bp, Homo sapiens
atgtgtttgtacctttaaatat

SEQ ID NO: 7353472 - DNA, 22 bp, Homo sapiens
atgtgtttataattactcaatc

SEQ ID NO: 7353473 - DNA, 22 bp, Homo sapiens
atgtgtttataattactcaatc

SEQ ID NO: 7353474 - DNA, 22 bp, Homo sapiens
atgtgtttggttatatggtatt

SEQ ID NO: 7353475 - DNA, 22 bp, Homo sapiens
atgttttctagagtttaaaatc

SEQ ID NO: 7353476 - DNA, 22 bp, Homo sapiens
atgttttcaaagtaaacttgta

SEQ ID NO: 7353477 - DNA, 22 bp, Homo sapiens
atgttttattaccaacttgtac

SEQ ID NO: 7353478 - DNA, 22 bp, Homo sapiens
atgttttatattttgcagcagt

SEQ ID NO: 7353479 - DNA, 22 bp, Homo sapiens
atgttttatattttgcagcagt

SEQ ID NO: 7353480 - DNA, 22 bp, Homo sapiens
atgtttctgaagtttacagata

SEQ ID NO: 7353481 - DNA, 20 bp, Homo sapiens
atgttttataaaagaacggg

SEQ ID NO: 7353482 - DNA, 22 bp, Homo sapiens
atgttttatgttccactcaagg

SEQ ID NO: 7353483 - DNA, 22 bp, Homo sapiens
atgttttatgcttcagatgagg

SEQ ID NO: 7353484 - DNA, 22 bp, Homo sapiens
attaaatgttccttaaattata

SEQ ID NO: 7353485 - DNA, 22 bp, Homo sapiens
attaaatggtggtcattcattt

SEQ ID NO: 7353486 - DNA, 22 bp, Homo sapiens
attaaacaatgtaaagttcttg

SEQ ID NO: 7353487 - DNA, 22 bp, Homo sapiens
gatgaggcaagccagaggactg

SEQ ID NO: 7353488 - DNA, 22 bp, Homo sapiens
attaaatgttggcatattttgt

SEQ ID NO: 7353489 - DNA, 22 bp, Homo sapiens
gatgagtgaggacagggtggca

SEQ ID NO: 7353490 - DNA, 22 bp, Homo sapiens
gatgaggctgtagagggtggca

SEQ ID NO: 7353491 - DNA, 22 bp, Homo sapiens
gccaggcattctagaagtagtg

SEQ ID NO: 7353492 - DNA, 22 bp, Homo sapiens
gccaggcatttgttaggtgctg

SEQ ID NO: 7353493 - DNA, 22 bp, Homo sapiens
gccaggccactcccgggtcctg

SEQ ID NO: 7353494 - DNA, 22 bp, Homo sapiens
gccaggcctgcaagtgctggtg

SEQ ID NO: 7353495 - DNA, 21 bp, Homo sapiens
atttcagaaatattggtggga

SEQ ID NO: 7353496 - DNA, 22 bp, Homo sapiens
atttcacaaaccatcctgattt

SEQ ID NO: 7353497 - DNA, 21 bp, Homo sapiens
atttcagagcacacaagtaaa

SEQ ID NO: 7353498 - DNA, 22 bp, Homo sapiens
atttcagtgttggttagcaagc

SEQ ID NO: 7353499 - DNA, 20 bp, Homo sapiens
atttcaggttgtgttctgtt

SEQ ID NO: 7353500 - DNA, 22 bp, Homo sapiens
atttcagtagtccttacttgta

SEQ ID NO: 7353501 - DNA, 22 bp, Homo sapiens
atttcaggatagcctagttttg

SEQ ID NO: 7353502 - DNA, 22 bp, Homo sapiens
atttcaggccaccagatgtctt

SEQ ID NO: 7353503 - DNA, 22 bp, Homo sapiens
atttcagggagtcatttacaca

SEQ ID NO: 7353504 - DNA, 22 bp, Homo sapiens
atttcagggtaaaaagtgttca

SEQ ID NO: 7353505 - DNA, 22 bp, Homo sapiens
atttcaggagcagtttcagtgg

SEQ ID NO: 7353506 - DNA, 22 bp, Homo sapiens
atttcaggaatctgtatgaaag

SEQ ID NO: 7353507 - DNA, 22 bp, Homo sapiens
atttcagcagcccatgtttgga

SEQ ID NO: 7353508 - DNA, 22 bp, Homo sapiens
atttcatctctggaacataact

SEQ ID NO: 7353509 - DNA, 22 bp, Homo sapiens
atttcatgcagaaggaagttgg

SEQ ID NO: 7353510 - DNA, 22 bp, Homo sapiens
atttcatgaatgctgctgttga

SEQ ID NO: 7353511 - DNA, 22 bp, Homo sapiens
atttcatgagctaatggatctc

SEQ ID NO: 7353512 - DNA, 22 bp, Homo sapiens
atttcatgtgaagaagagataa

SEQ ID NO: 7353513 - DNA, 22 bp, Homo sapiens
atttcctagcctctcttgcagt

SEQ ID NO: 7353514 - DNA, 22 bp, Homo sapiens
atttccttgcaagtttctgtaa

SEQ ID NO: 7353515 - DNA, 22 bp, Homo sapiens
atttcgatagacctaacaattg

SEQ ID NO: 7353516 - DNA, 22 bp, Homo sapiens
atttctacagtacacatgcatt

SEQ ID NO: 7353517 - DNA, 22 bp, Homo sapiens
atttctcaaaggaatagagtga

SEQ ID NO: 7353518 - DNA, 22 bp, Homo sapiens
atttctcaaaggaatagagtga

SEQ ID NO: 7353519 - DNA, 22 bp, Homo sapiens
atttctataggaggacagtatt

SEQ ID NO: 7353520 - DNA, 21 bp, Homo sapiens
attggcacaccttttattgga

SEQ ID NO: 7353521 - DNA, 22 bp, Homo sapiens
atttaatttggagagagaaacc

SEQ ID NO: 7353522 - DNA, 22 bp, Homo sapiens
atttaatttggagagagaaacc

SEQ ID NO: 7353523 - DNA, 22 bp, Homo sapiens
atttaattttctcaacagtgct

SEQ ID NO: 7353524 - DNA, 22 bp, Homo sapiens
atttaattttctcaacagtgct

SEQ ID NO: 7353525 - DNA, 22 bp, Homo sapiens
attggaaaatatggtttctgga

SEQ ID NO: 7353526 - DNA, 22 bp, Homo sapiens
attggacttagaaataaagtta

SEQ ID NO: 7353527 - DNA, 22 bp, Homo sapiens
attgcttactaatcatcttcag

SEQ ID NO: 7353528 - DNA, 22 bp, Homo sapiens
atttactagggctgtttaagta

SEQ ID NO: 7353529 - DNA, 22 bp, Homo sapiens
atttactactgctatctagaag

SEQ ID NO: 7353530 - DNA, 22 bp, Homo sapiens
atttactactgctatctagaag

SEQ ID NO: 7353531 - DNA, 22 bp, Homo sapiens
atttactgaggtaaataaactg

SEQ ID NO: 7353532 - DNA, 22 bp, Homo sapiens
atttactgagcagctaccatgt

SEQ ID NO: 7353533 - DNA, 22 bp, Homo sapiens
atttactgaagggtaggttgtt

SEQ ID NO: 7353534 - DNA, 22 bp, Homo sapiens
atttactttgctgagatccatc

SEQ ID NO: 7353535 - DNA, 22 bp, Homo sapiens
atttactggaaaaactatgagc

SEQ ID NO: 7353536 - DNA, 22 bp, Homo sapiens
atttactggaaaaactatgagc

SEQ ID NO: 7353537 - DNA, 22 bp, Homo sapiens
caaaaccaagaacattcatttc

SEQ ID NO: 7353538 - DNA, 22 bp, Homo sapiens
gcctgtgactcgtcttgggcca

SEQ ID NO: 7353539 - DNA, 22 bp, Homo sapiens
gcctgggagtgcacagtgaggt

SEQ ID NO: 7353540 - DNA, 22 bp, Homo sapiens
gcgaggaggggtgctgggcccc

SEQ ID NO: 7353541 - DNA, 22 bp, Homo sapiens
gcgagggcacgcggttgaaggc

SEQ ID NO: 7353542 - DNA, 22 bp, Homo sapiens
gcgagggcacgcggttgaaggc

SEQ ID NO: 7353543 - DNA, 22 bp, Homo sapiens
gcgcacacgcgtgtgactcatc

SEQ ID NO: 7353544 - DNA, 22 bp, Homo sapiens
gcgcactgggcgcacgcgtagg

SEQ ID NO: 7353545 - DNA, 22 bp, Homo sapiens
gcgcagagccctcttctgtgga

SEQ ID NO: 7353546 - DNA, 22 bp, Homo sapiens
gcgcaggacgcccagttgcctt

SEQ ID NO: 7353547 - DNA, 22 bp, Homo sapiens
gcgcagagtagcagagtgctga

SEQ ID NO: 7353548 - DNA, 22 bp, Homo sapiens
gcgcagagtgaagatctccgtg

SEQ ID NO: 7353549 - DNA, 22 bp, Homo sapiens
caaaccattaagcatgttgagt

SEQ ID NO: 7353550 - DNA, 22 bp, Homo sapiens
gctcaggaaaacagtctagtaa

SEQ ID NO: 7353551 - DNA, 22 bp, Homo sapiens
gctcaggaaacagcagggcttg

SEQ ID NO: 7353552 - DNA, 22 bp, Homo sapiens
gctcaggaaacagcagggcttg

SEQ ID NO: 7353553 - DNA, 22 bp, Homo sapiens
gctcaggaaatagtttagtgtt

SEQ ID NO: 7353554 - DNA, 22 bp, Homo sapiens
gctcaggacccaggtgtgacct

SEQ ID NO: 7353555 - DNA, 22 bp, Homo sapiens
gctcaggaaggctcaaccagga

SEQ ID NO: 7353556 - DNA, 22 bp, Homo sapiens
gctcaggaccgaggggtgggaa

SEQ ID NO: 7353557 - DNA, 22 bp, Homo sapiens
gctcaggcaaatttctggtgaa

SEQ ID NO: 7353558 - DNA, 22 bp, Homo sapiens
gctcaggcaggagtgcagtggc

SEQ ID NO: 7353559 - DNA, 22 bp, Homo sapiens
gctcaggagctcttggtggcgc

SEQ ID NO: 7353560 - DNA, 22 bp, Homo sapiens
gctcaggactggaggagcgggg

SEQ ID NO: 7353561 - DNA, 22 bp, Homo sapiens
gctcaggagctgacagcctcaa

SEQ ID NO: 7353562 - DNA, 22 bp, Homo sapiens
gctcaggatcagccacctcttt

SEQ ID NO: 7353563 - DNA, 22 bp, Homo sapiens
gctcaggatcccaggggtgtgc

SEQ ID NO: 7353564 - DNA, 22 bp, Homo sapiens
gctcaggatttcatccatgtgt

SEQ ID NO: 7353565 - DNA, 22 bp, Homo sapiens
gcctctctctacccagtatgat

SEQ ID NO: 7353566 - DNA, 22 bp, Homo sapiens
gcctgctggatgtggccaggcc

SEQ ID NO: 7353567 - DNA, 22 bp, Homo sapiens
gcctgctggaggagcctcaggg

SEQ ID NO: 7353568 - DNA, 22 bp, Homo sapiens
gcctggagctactggacactga

SEQ ID NO: 7353569 - DNA, 22 bp, Homo sapiens
gcctggagctcggctgagggcg

SEQ ID NO: 7353570 - DNA, 22 bp, Homo sapiens
gcctgggagatgcgttgtggcc

SEQ ID NO: 7353571 - DNA, 22 bp, Homo sapiens
gcctgggagcacatcggggtcc

SEQ ID NO: 7353572 - DNA, 22 bp, Homo sapiens
atttctcagtgtacattatgtt

SEQ ID NO: 7353573 - DNA, 22 bp, Homo sapiens
atttctcagtgtacattatgtt

SEQ ID NO: 7353574 - DNA, 22 bp, Homo sapiens
atttctcagtgaaatgacaggc

SEQ ID NO: 7353575 - DNA, 22 bp, Homo sapiens
atttctcagtaggtgcacagtg

SEQ ID NO: 7353576 - DNA, 22 bp, Homo sapiens
gcctcactgcagccccaggaag

SEQ ID NO: 7353577 - DNA, 22 bp, Homo sapiens
atttctcagaccagagaggtgt

SEQ ID NO: 7353578 - DNA, 22 bp, Homo sapiens
atttctcagcacttcctatctc

SEQ ID NO: 7353579 - DNA, 22 bp, Homo sapiens
atttctcagcacttcctatctc

SEQ ID NO: 7353580 - DNA, 22 bp, Homo sapiens
atttctcagtaatctcagcaat

SEQ ID NO: 7353581 - DNA, 22 bp, Homo sapiens
atttctcaagtaaatgagtcat

SEQ ID NO: 7353582 - DNA, 22 bp, Homo sapiens
atttctcacaaagttgcttatc

SEQ ID NO: 7353583 - DNA, 22 bp, Homo sapiens
atttctcacaaagttgcttatc

SEQ ID NO: 7353584 - DNA, 22 bp, Homo sapiens
atttctcactcacagtccatgt

SEQ ID NO: 7353585 - DNA, 22 bp, Homo sapiens
atttctcactgagcagataaaa

SEQ ID NO: 7353586 - DNA, 22 bp, Homo sapiens
gcctctcctggagaaggcaggg

SEQ ID NO: 7353587 - DNA, 22 bp, Homo sapiens
gcctctccgagccactgcctct

SEQ ID NO: 7353588 - DNA, 22 bp, Homo sapiens
gcctctcctcttaataccatta

SEQ ID NO: 7353589 - DNA, 21 bp, Homo sapiens
gcctctccaaatcctgccttc

SEQ ID NO: 7353590 - DNA, 22 bp, Homo sapiens
gcctccccaaagtgctgacagc

SEQ ID NO: 7353591 - DNA, 22 bp, Homo sapiens
gcctccccaagcagcagggatt

SEQ ID NO: 7353592 - DNA, 22 bp, Homo sapiens
atgtcttttatgattacgggat

SEQ ID NO: 7353593 - DNA, 22 bp, Homo sapiens
atgtctttggctttgacatggc

SEQ ID NO: 7353594 - DNA, 22 bp, Homo sapiens
atgtctttgccatagttcatat

SEQ ID NO: 7353595 - DNA, 22 bp, Homo sapiens
gaggctgccccttcctcagctg

SEQ ID NO: 7353596 - DNA, 21 bp, Homo sapiens
atgtgaaaccttccacgctga

SEQ ID NO: 7353597 - DNA, 22 bp, Homo sapiens
gaggctgcggggaggagcctgc

SEQ ID NO: 7353598 - DNA, 19 bp, Homo sapiens
atgtctgggtaacagctgc

SEQ ID NO: 7353599 - DNA, 22 bp, Homo sapiens
atgtctggaggtcatctggtta

SEQ ID NO: 7353600 - DNA, 22 bp, Homo sapiens
atgtctggctaaaatccctggt

SEQ ID NO: 7353601 - DNA, 22 bp, Homo sapiens
gaggcctgggcaagggggtctg

SEQ ID NO: 7353602 - DNA, 22 bp, Homo sapiens
atgtctttattaatatcatgcc

SEQ ID NO: 7353603 - DNA, 22 bp, Homo sapiens
atgtctggtggtcgatgctaca

SEQ ID NO: 7353604 - DNA, 22 bp, Homo sapiens
gaggggagaggcttatggatca

SEQ ID NO: 7353605 - DNA, 22 bp, Homo sapiens
gaggggagcatgatctagattg

SEQ ID NO: 7353606 - DNA, 16 bp, Homo sapiens
gaggggagcagtaggc

SEQ ID NO: 7353607 - DNA, 22 bp, Homo sapiens
atgtgtgtatatatagtcattt

SEQ ID NO: 7353608 - DNA, 22 bp, Homo sapiens
atgtgtgtatatatagtcattt

SEQ ID NO: 7353609 - DNA, 22 bp, Homo sapiens
atgtgtgtatatatagtcattt

SEQ ID NO: 7353610 - DNA, 22 bp, Homo sapiens
atgtgtgtgcatttctctccct

SEQ ID NO: 7353611 - DNA, 22 bp, Homo sapiens
atgtgtgtgcatttctctccct

SEQ ID NO: 7353612 - DNA, 22 bp, Homo sapiens
atgtgtgtgatgggcgccgcca

SEQ ID NO: 7353613 - DNA, 22 bp, Homo sapiens
atgtgtgtgatgggcgccgcca

SEQ ID NO: 7353614 - DNA, 22 bp, Homo sapiens
atgtgtgtatgtgcctatatct

SEQ ID NO: 7353615 - DNA, 22 bp, Homo sapiens
atgtgtgtatgtgcctatatct

SEQ ID NO: 7353616 - DNA, 22 bp, Homo sapiens
atgtgtatttccatcgatcagc

SEQ ID NO: 7353617 - DNA, 22 bp, Homo sapiens
atgtgtatttccatcgatcagc

SEQ ID NO: 7353618 - DNA, 22 bp, Homo sapiens
atgtgtatttatttggggctta

SEQ ID NO: 7353619 - DNA, 22 bp, Homo sapiens
atgtgtattgagcacctactgc

SEQ ID NO: 7353620 - DNA, 22 bp, Homo sapiens
atgtgtattagttagtttaatg

SEQ ID NO: 7353621 - DNA, 22 bp, Homo sapiens
atgtgtattttgtactattggg

SEQ ID NO: 7353622 - DNA, 22 bp, Homo sapiens
atgtgtcaattttcaaatgctt

SEQ ID NO: 7353623 - DNA, 22 bp, Homo sapiens
atgtgtattttgtactattggg

SEQ ID NO: 7353624 - DNA, 22 bp, Homo sapiens
atgtgtattttgtactattggg

SEQ ID NO: 7353625 - DNA, 22 bp, Homo sapiens
atgtgtattaccctttcattcc

SEQ ID NO: 7353626 - DNA, 22 bp, Homo sapiens
atgtgtatgtgtatacacacag

SEQ ID NO: 7353627 - DNA, 22 bp, Homo sapiens
atgtgtatgcatgcactaagat

SEQ ID NO: 7353628 - DNA, 22 bp, Homo sapiens
atgtgtatgtgtatacacacag

SEQ ID NO: 7353629 - DNA, 22 bp, Homo sapiens
atgtgtattacctcgattgtga

SEQ ID NO: 7353630 - DNA, 22 bp, Homo sapiens
atgtgtatgatacctttgctga

SEQ ID NO: 7353631 - DNA, 22 bp, Homo sapiens
atgtgtatgatacctttgctga

SEQ ID NO: 7353632 - DNA, 22 bp, Homo sapiens
atgtgtatgcatgcactaagat

SEQ ID NO: 7353633 - DNA, 22 bp, Homo sapiens
atgtgtatgtcttattcaaaga

SEQ ID NO: 7353634 - DNA, 22 bp, Homo sapiens
gaggctgctgttagccctgggc

SEQ ID NO: 7353635 - DNA, 22 bp, Homo sapiens
atggggctctgcggctgctccc

SEQ ID NO: 7353636 - DNA, 22 bp, Homo sapiens
atggggctgggattctcctcgg

SEQ ID NO: 7353637 - DNA, 22 bp, Homo sapiens
atggtaaaagatatactgtgca

SEQ ID NO: 7353638 - DNA, 22 bp, Homo sapiens
atggtaaaagatatactgtgca

SEQ ID NO: 7353639 - DNA, 22 bp, Homo sapiens
atggctggatttgatccatggg

SEQ ID NO: 7353640 - DNA, 22 bp, Homo sapiens
atggggctctgcggctgctccc

SEQ ID NO: 7353641 - DNA, 22 bp, Homo sapiens
atggtacaaaatgtataaagtc

SEQ ID NO: 7353642 - DNA, 22 bp, Homo sapiens
gagctgggctggcttcctccct

SEQ ID NO: 7353643 - DNA, 22 bp, Homo sapiens
atgtacatctttataacaagct

SEQ ID NO: 7353644 - DNA, 21 bp, Homo sapiens
gagctgggcgaggctccgggg

SEQ ID NO: 7353645 - DNA, 22 bp, Homo sapiens
gagctgggcctgcgagtgctgc

SEQ ID NO: 7353646 - DNA, 22 bp, Homo sapiens
atggtcacagagcttaattaat

SEQ ID NO: 7353647 - DNA, 22 bp, Homo sapiens
atggtcatatgctaattcagga

SEQ ID NO: 7353648 - DNA, 22 bp, Homo sapiens
gaggagctgggctgagagggtc

SEQ ID NO: 7353649 - DNA, 22 bp, Homo sapiens
gaggccaggagtgctgtaagtt

SEQ ID NO: 7353650 - DNA, 22 bp, Homo sapiens
gaggagctgcccgtgtgtctgc

SEQ ID NO: 7353651 - DNA, 22 bp, Homo sapiens
atgtacattattcgagtgatgg

SEQ ID NO: 7353652 - DNA, 22 bp, Homo sapiens
atgtacatgtttaagtgaagga

SEQ ID NO: 7353653 - DNA, 21 bp, Homo sapiens
atgtacattcggcaacagata

SEQ ID NO: 7353654 - DNA, 22 bp, Homo sapiens
atgtacatgtgaatttaggcaa

SEQ ID NO: 7353655 - DNA, 18 bp, Homo sapiens
atgtacatgtactcacac

SEQ ID NO: 7353656 - DNA, 22 bp, Homo sapiens
atgtacattctaagtatgtgta

SEQ ID NO: 7353657 - DNA, 22 bp, Homo sapiens
atgtacatttagatcatttctg

SEQ ID NO: 7353658 - DNA, 22 bp, Homo sapiens
atgtacatttagatcatttctg

SEQ ID NO: 7353659 - DNA, 22 bp, Homo sapiens
atgtacattcttctcaccgaag

SEQ ID NO: 7353660 - DNA, 22 bp, Homo sapiens
atgtacattttcctaatgtttt

SEQ ID NO: 7353661 - DNA, 19 bp, Homo sapiens
atgtacccagtgtcaatcc

SEQ ID NO: 7353662 - DNA, 19 bp, Homo sapiens
atgtacccagtgtcaatcc

SEQ ID NO: 7353663 - DNA, 18 bp, Homo sapiens
atgtacatttgctaaagc

SEQ ID NO: 7353664 - DNA, 18 bp, Homo sapiens
atgtacatttgctaaagc

SEQ ID NO: 7353665 - DNA, 22 bp, Homo sapiens
atgtacatttgtagtaatatca

SEQ ID NO: 7353666 - DNA, 20 bp, Homo sapiens
atggcagtccgtgttcaggg

SEQ ID NO: 7353667 - DNA, 22 bp, Homo sapiens
atggcagggcacagctctagtt

SEQ ID NO: 7353668 - DNA, 22 bp, Homo sapiens
atggcagagggattgaacagct

SEQ ID NO: 7353669 - DNA, 22 bp, Homo sapiens
gagagctgtccggctgagcagc

SEQ ID NO: 7353670 - DNA, 22 bp, Homo sapiens
gagaggaactcccagtgcctgg

SEQ ID NO: 7353671 - DNA, 22 bp, Homo sapiens
gagaggaagccagggggtgttg

SEQ ID NO: 7353672 - DNA, 22 bp, Homo sapiens
atggccagtctattcatggtta

SEQ ID NO: 7353673 - DNA, 22 bp, Homo sapiens
atggccagcaaggtagggcaat

SEQ ID NO: 7353674 - DNA, 22 bp, Homo sapiens
gagccagcgccttgcctctggg

SEQ ID NO: 7353675 - DNA, 22 bp, Homo sapiens
gagccagcgccttgcctctggg

SEQ ID NO: 7353676 - DNA, 22 bp, Homo sapiens
atggccagtgtttccctcagtt

SEQ ID NO: 7353677 - DNA, 22 bp, Homo sapiens
atggcccaagtgccctgacctg

SEQ ID NO: 7353678 - DNA, 22 bp, Homo sapiens
atggccctatcacctttgcttc

SEQ ID NO: 7353679 - DNA, 22 bp, Homo sapiens
gagcagtgactggagcatgaga

SEQ ID NO: 7353680 - DNA, 22 bp, Homo sapiens
gagccagccttcttctgaggtc

SEQ ID NO: 7353681 - DNA, 22 bp, Homo sapiens
gacagaggcaagaccagaagcc

SEQ ID NO: 7353682 - DNA, 23 bp, Homo sapiens
gacagagtgagaccttgtcttac

SEQ ID NO: 7353683 - DNA, 22 bp, Homo sapiens
gacagatgtgggtgacagcagc

SEQ ID NO: 7353684 - DNA, 22 bp, Homo sapiens
atgccactgcgctccagcctgg

SEQ ID NO: 7353685 - DNA, 22 bp, Homo sapiens
atgccactgcgctccagcctgg

SEQ ID NO: 7353686 - DNA, 22 bp, Homo sapiens
atgccactgtactcaacaatag

SEQ ID NO: 7353687 - DNA, 22 bp, Homo sapiens
atgccactgcgctctagcctgg

SEQ ID NO: 7353688 - DNA, 22 bp, Homo sapiens
atgccactgcgctctagcctgg

SEQ ID NO: 7353689 - DNA, 22 bp, Homo sapiens
atggaaatgatggaacattaaa

SEQ ID NO: 7353690 - DNA, 22 bp, Homo sapiens
atgccacttcattccagcctcg

SEQ ID NO: 7353691 - DNA, 22 bp, Homo sapiens
atgccacttcattccagcctcg

SEQ ID NO: 7353692 - DNA, 22 bp, Homo sapiens
atggaacatgaattaatatggt

SEQ ID NO: 7353693 - DNA, 22 bp, Homo sapiens
atggaagaaagagacaatttga

SEQ ID NO: 7353694 - DNA, 22 bp, Homo sapiens
atggaagggacagaagggcaag

SEQ ID NO: 7353695 - DNA, 22 bp, Homo sapiens
atggactcactaattcctccac

SEQ ID NO: 7353696 - DNA, 22 bp, Homo sapiens
atggactctggaggagatagag

SEQ ID NO: 7353697 - DNA, 20 bp, Homo sapiens
atggaggaagggcaagagaa

SEQ ID NO: 7353698 - DNA, 22 bp, Homo sapiens
gagaaataggcaatggtatcta

SEQ ID NO: 7353699 - DNA, 22 bp, Homo sapiens
gagaaatgagtgattcactttt

SEQ ID NO: 7353700 - DNA, 22 bp, Homo sapiens
atggagcacacgccatcacata

SEQ ID NO: 7353701 - DNA, 20 bp, Homo sapiens
atggaggaagggcaagagaa

SEQ ID NO: 7353702 - DNA, 20 bp, Homo sapiens
atggaggaagggcaagagaa

SEQ ID NO: 7353703 - DNA, 22 bp, Homo sapiens
cttgttattggaaatgtcatgc

SEQ ID NO: 7353704 - DNA, 22 bp, Homo sapiens
atgaaaagcataaacgctgaag

SEQ ID NO: 7353705 - DNA, 22 bp, Homo sapiens
atgaaaagggagtgatatttgt

SEQ ID NO: 7353706 - DNA, 22 bp, Homo sapiens
atgaaatatcttgaagaaattc

SEQ ID NO: 7353707 - DNA, 22 bp, Homo sapiens
atgaaacatgagaaatggagag

SEQ ID NO: 7353708 - DNA, 22 bp, Homo sapiens
cttgttgcaaacattcactcca

SEQ ID NO: 7353709 - DNA, 22 bp, Homo sapiens
cttgttgctaacatatgcttct

SEQ ID NO: 7353710 - DNA, 22 bp, Homo sapiens
atgaaaacggaccagagctatt

SEQ ID NO: 7353711 - DNA, 22 bp, Homo sapiens
atgaaaacggaccagagctatt

SEQ ID NO: 7353712 - DNA, 22 bp, Homo sapiens
atgaaaacagcctcctgtgata

SEQ ID NO: 7353713 - DNA, 22 bp, Homo sapiens
atgaaaactttagcctcattag

SEQ ID NO: 7353714 - DNA, 22 bp, Homo sapiens
atgaaaactttagcctcattag

SEQ ID NO: 7353715 - DNA, 22 bp, Homo sapiens
atcttttatgagcgttctgaca

SEQ ID NO: 7353716 - DNA, 22 bp, Homo sapiens
atcttggactacagaagagagg

SEQ ID NO: 7353717 - DNA, 22 bp, Homo sapiens
atgaaatatcttgaagaaattc

SEQ ID NO: 7353718 - DNA, 22 bp, Homo sapiens
atgaaatgtgaatgcttttcat

SEQ ID NO: 7353719 - DNA, 22 bp, Homo sapiens
cttttattttgaattaagggct

SEQ ID NO: 7353720 - DNA, 22 bp, Homo sapiens
cttttcatgagtctgttatggg

SEQ ID NO: 7353721 - DNA, 22 bp, Homo sapiens
atgaaattaatcaacacataca

SEQ ID NO: 7353722 - DNA, 22 bp, Homo sapiens
atctagaagtggcatgaattac

SEQ ID NO: 7353723 - DNA, 22 bp, Homo sapiens
atctagattaggtataagagct

SEQ ID NO: 7353724 - DNA, 23 bp, Homo sapiens
cttgcctggcctctctgcccaga

SEQ ID NO: 7353725 - DNA, 22 bp, Homo sapiens
cttgctgctctggagtcatgcc

SEQ ID NO: 7353726 - DNA, 22 bp, Homo sapiens
cttggtgcccagcaggtggctg

SEQ ID NO: 7353727 - DNA, 16 bp, Homo sapiens
cttggtgttggcagag

SEQ ID NO: 7353728 - DNA, 22 bp, Homo sapiens
cttgtaaaatatccagttaagg

SEQ ID NO: 7353729 - DNA, 22 bp, Homo sapiens
cttgtaaaaggtacattatgct

SEQ ID NO: 7353730 - DNA, 22 bp, Homo sapiens
cttgtaaatgcagattctgatt

SEQ ID NO: 7353731 - DNA, 22 bp, Homo sapiens
atcttctgggcagtgaaaattg

SEQ ID NO: 7353732 - DNA, 22 bp, Homo sapiens
cttggtcatttcttgtcctgtt

SEQ ID NO: 7353733 - DNA, 22 bp, Homo sapiens
cttggtacctgccctgggcctt

SEQ ID NO: 7353734 - DNA, 20 bp, Homo sapiens
gaaagattgtaagaggcaga

SEQ ID NO: 7353735 - DNA, 22 bp, Homo sapiens
gaaagcacaggctcaggaacag

SEQ ID NO: 7353736 - DNA, 21 bp, Homo sapiens
gaaagcacagaaaggactctt

SEQ ID NO: 7353737 - DNA, 22 bp, Homo sapiens
gaaagcacagttcatgagacaa

SEQ ID NO: 7353738 - DNA, 22 bp, Homo sapiens
gaaagcacagttctgaccatgt

SEQ ID NO: 7353739 - DNA, 22 bp, Homo sapiens
gaaagcacatactataaatcac

SEQ ID NO: 7353740 - DNA, 22 bp, Homo sapiens
gaaagcacccaagatttccttc

SEQ ID NO: 7353741 - DNA, 22 bp, Homo sapiens
gaaagcacgatagtagcaaaag

SEQ ID NO: 7353742 - DNA, 22 bp, Homo sapiens
atgaggcagctgctggagaacg

SEQ ID NO: 7353743 - DNA, 22 bp, Homo sapiens
atgaggcaggaaaggcgtatct

SEQ ID NO: 7353744 - DNA, 22 bp, Homo sapiens
atgaggcagctggctttctccc

SEQ ID NO: 7353745 - DNA, 22 bp, Homo sapiens
atgaggcaggagtgcagtggca

SEQ ID NO: 7353746 - DNA, 22 bp, Homo sapiens
atgaggcaggagtgcagtggca

SEQ ID NO: 7353747 - DNA, 22 bp, Homo sapiens
atgaggcaggaaaggcgtatct

SEQ ID NO: 7353748 - DNA, 22 bp, Homo sapiens
atgaggcaggagcggggaccct

SEQ ID NO: 7353749 - DNA, 22 bp, Homo sapiens
atgaggcaggtggaggctgcca

SEQ ID NO: 7353750 - DNA, 22 bp, Homo sapiens
atgaggcaggatattaactttt

SEQ ID NO: 7353751 - DNA, 22 bp, Homo sapiens
atgaggcaggattaagctatca

SEQ ID NO: 7353752 - DNA, 22 bp, Homo sapiens
atgaggcagtacacacaaagcc

SEQ ID NO: 7353753 - DNA, 22 bp, Homo sapiens
atgaagcaattagaaacttgaa

SEQ ID NO: 7353754 - DNA, 22 bp, Homo sapiens
atgaggcagcacatgggattgt

SEQ ID NO: 7353755 - DNA, 22 bp, Homo sapiens
atgaggcagcccttcccttctc

SEQ ID NO: 7353756 - DNA, 22 bp, Homo sapiens
atgaggcagcacatgggattgt

SEQ ID NO: 7353757 - DNA, 22 bp, Homo sapiens
atgaggcagctgacagctgttc

SEQ ID NO: 7353758 - DNA, 22 bp, Homo sapiens
atgaggcagatgttgcatgagg

SEQ ID NO: 7353759 - DNA, 22 bp, Homo sapiens
atgaggcagatgttgcatgagg

SEQ ID NO: 7353760 - DNA, 22 bp, Homo sapiens
atgaggcagagggctgtgccag

SEQ ID NO: 7353761 - DNA, 22 bp, Homo sapiens
atgaggcagagggctgtgccag

SEQ ID NO: 7353762 - DNA, 22 bp, Homo sapiens
atgaggaacagacttgctggat

SEQ ID NO: 7353763 - DNA, 22 bp, Homo sapiens
atgaggtttgagcctcttgacc

SEQ ID NO: 7353764 - DNA, 22 bp, Homo sapiens
atgaggttcagtgtttatttcc

SEQ ID NO: 7353765 - DNA, 22 bp, Homo sapiens
atgaggtttaggttcctcctct

SEQ ID NO: 7353766 - DNA, 22 bp, Homo sapiens
atgagtaaaaccactatttaca

SEQ ID NO: 7353767 - DNA, 22 bp, Homo sapiens
atgagtaagataggcaatgtgt

SEQ ID NO: 7353768 - DNA, 22 bp, Homo sapiens
atgagtaagaccataatttttg

SEQ ID NO: 7353769 - DNA, 22 bp, Homo sapiens
atgattttttctaacacagtcg

SEQ ID NO: 7353770 - DNA, 20 bp, Homo sapiens
atgattttgcactaacttca

SEQ ID NO: 7353771 - DNA, 22 bp, Homo sapiens
atgattttttctaacacagtcg

SEQ ID NO: 7353772 - DNA, 22 bp, Homo sapiens
atgcaaaagtaattgcaatttt

SEQ ID NO: 7353773 - DNA, 20 bp, Homo sapiens
atgagtttaaacattcagag

SEQ ID NO: 7353774 - DNA, 22 bp, Homo sapiens
atgagttgaagctacaagaggc

SEQ ID NO: 7353775 - DNA, 22 bp, Homo sapiens
atgagttttgggggatgttaga

SEQ ID NO: 7353776 - DNA, 22 bp, Homo sapiens
atgcaggacataagcatcgaca

SEQ ID NO: 7353777 - DNA, 22 bp, Homo sapiens
atgcaggaagtcggggagcggg

SEQ ID NO: 7353778 - DNA, 22 bp, Homo sapiens
atgcaggaagtcggggagcggg

SEQ ID NO: 7353779 - DNA, 23 bp, Homo sapiens
atgcatcatgaaaactagagagc

SEQ ID NO: 7353780 - DNA, 22 bp, Homo sapiens
atgcatttatgtgtgtacattg

SEQ ID NO: 7353781 - DNA, 22 bp, Homo sapiens
atgcattatcaattgatgtagg

SEQ ID NO: 7353782 - DNA, 22 bp, Homo sapiens
atgcaaataaacagtctagttg

SEQ ID NO: 7353783 - DNA, 22 bp, Homo sapiens
atgcaaatattaatggtatgac

SEQ ID NO: 7353784 - DNA, 22 bp, Homo sapiens
atgcaaatgaacatgttgctag

SEQ ID NO: 7353785 - DNA, 22 bp, Homo sapiens
atgcaaatcttaagtatgtgtg

SEQ ID NO: 7353786 - DNA, 22 bp, Homo sapiens
atgcaaaagtagttgcagtttt

SEQ ID NO: 7353787 - DNA, 22 bp, Homo sapiens
atgcaaaattaccattctgttc

SEQ ID NO: 7353788 - DNA, 22 bp, Homo sapiens
atgcagaagaaaccatggcttc

SEQ ID NO: 7353789 - DNA, 22 bp, Homo sapiens
atgcagaaagcggcaaacaggt

SEQ ID NO: 7353790 - DNA, 22 bp, Homo sapiens
atgcagaagcagaacttacaca

SEQ ID NO: 7353791 - DNA, 22 bp, Homo sapiens
atgcagaaggagccatgcttgc

SEQ ID NO: 7353792 - DNA, 22 bp, Homo sapiens
atgcagaagactgaaaagctga

SEQ ID NO: 7353793 - DNA, 22 bp, Homo sapiens
atgcagaatgagttcacgatct

SEQ ID NO: 7353794 - DNA, 22 bp, Homo sapiens
atgcagaattgctaagtatctg

SEQ ID NO: 7353795 - DNA, 22 bp, Homo sapiens
cacaaaatctttctcgattatt

SEQ ID NO: 7353796 - DNA, 22 bp, Homo sapiens
cacaaaatatcaagcactttta

SEQ ID NO: 7353797 - DNA, 23 bp, Homo sapiens
cacaaaggttccattctctcacc

SEQ ID NO: 7353798 - DNA, 22 bp, Homo sapiens
cacaaaggagaatgtcagcata

SEQ ID NO: 7353799 - DNA, 22 bp, Homo sapiens
cacaaacctgccagccctgccc

SEQ ID NO: 7353800 - DNA, 22 bp, Homo sapiens
cacaaaccttctgcagcctgta

SEQ ID NO: 7353801 - DNA, 22 bp, Homo sapiens
cacaatactatttttaggtctt

SEQ ID NO: 7353802 - DNA, 22 bp, Homo sapiens
cacaataaatgtttgctgatga

SEQ ID NO: 7353803 - DNA, 22 bp, Homo sapiens
cacaatgtggtttgtcatcttt

SEQ ID NO: 7353804 - DNA, 22 bp, Homo sapiens
cacaattagcagctctttattt

SEQ ID NO: 7353805 - DNA, 22 bp, Homo sapiens
ggaaaaggccacagggacacat

SEQ ID NO: 7353806 - DNA, 22 bp, Homo sapiens
cacaactttccttgactgtaag

SEQ ID NO: 7353807 - DNA, 22 bp, Homo sapiens
cacaactttaggaaccacattc

SEQ ID NO: 7353808 - DNA, 22 bp, Homo sapiens
cacaccagatggcagcgtggga

SEQ ID NO: 7353809 - DNA, 22 bp, Homo sapiens
cacaccagatggcagcgtggga

SEQ ID NO: 7353810 - DNA, 19 bp, Homo sapiens
cacacccatgcttgccaag

SEQ ID NO: 7353811 - DNA, 22 bp, Homo sapiens
cacaatttcagttgcatgcaac

SEQ ID NO: 7353812 - DNA, 22 bp, Homo sapiens
cacaattgtatcagaaaatagt

SEQ ID NO: 7353813 - DNA, 18 bp, Homo sapiens
cacaatttacagatgaca

SEQ ID NO: 7353814 - DNA, 22 bp, Homo sapiens
cacaatttggacttcactggtt

SEQ ID NO: 7353815 - DNA, 22 bp, Homo sapiens
cacaatttgtattttgcatcca

SEQ ID NO: 7353816 - DNA, 22 bp, Homo sapiens
cacacattagagccaatgtcag

SEQ ID NO: 7353817 - DNA, 22 bp, Homo sapiens
cacaatttgttttatcagtatt

SEQ ID NO: 7353818 - DNA, 22 bp, Homo sapiens
gcttctcctcccgctcccaggc

SEQ ID NO: 7353819 - DNA, 22 bp, Homo sapiens
gctgtggccgggcccaggccgc

SEQ ID NO: 7353820 - DNA, 20 bp, Homo sapiens
gctgtggccgtgccagactc

SEQ ID NO: 7353821 - DNA, 22 bp, Homo sapiens
gctgtggcctccagcactcccc

SEQ ID NO: 7353822 - DNA, 22 bp, Homo sapiens
gctgtggcctggcgcagagctg

SEQ ID NO: 7353823 - DNA, 22 bp, Homo sapiens
gcttggccagcagccgggatgc

SEQ ID NO: 7353824 - DNA, 22 bp, Homo sapiens
gcttggctttgtcttgttcact

SEQ ID NO: 7353825 - DNA, 23 bp, Homo sapiens
gctgtacaggaaccagtttggag

SEQ ID NO: 7353826 - DNA, 22 bp, Homo sapiens
gctgtacaaggcctctgccatc

SEQ ID NO: 7353827 - DNA, 22 bp, Homo sapiens
gctgtacaaattccacaagaga

SEQ ID NO: 7353828 - DNA, 22 bp, Homo sapiens
gctgtctcgcctgacactggct

SEQ ID NO: 7353829 - DNA, 22 bp, Homo sapiens
caaggaggaagatgcaggggac

SEQ ID NO: 7353830 - DNA, 22 bp, Homo sapiens
caaggattaatagaatgaatca

SEQ ID NO: 7353831 - DNA, 22 bp, Homo sapiens
caaggcaagtcatatgggcaag

SEQ ID NO: 7353832 - DNA, 22 bp, Homo sapiens
caaggcaatctcatggcttctt

SEQ ID NO: 7353833 - DNA, 19 bp, Homo sapiens
gctgtctgatgctgaggtc

SEQ ID NO: 7353834 - DNA, 22 bp, Homo sapiens
gctgtgctgtttccacctctct

SEQ ID NO: 7353835 - DNA, 22 bp, Homo sapiens
gctgtgctgtttccacctctct

SEQ ID NO: 7353836 - DNA, 22 bp, Homo sapiens
gctgctggcatctagggggtgg

SEQ ID NO: 7353837 - DNA, 22 bp, Homo sapiens
gctgctggcactggagtgagcc

SEQ ID NO: 7353838 - DNA, 22 bp, Homo sapiens
gctgctggagagcgagactgtt

SEQ ID NO: 7353839 - DNA, 22 bp, Homo sapiens
gctgccttgaacatcctaagta

SEQ ID NO: 7353840 - DNA, 22 bp, Homo sapiens
caagatgaatgatgaagtgtgt

SEQ ID NO: 7353841 - DNA, 22 bp, Homo sapiens
caagatgaagtgaagattagaa

SEQ ID NO: 7353842 - DNA, 22 bp, Homo sapiens
caagatcaatcaatactcctta

SEQ ID NO: 7353843 - DNA, 22 bp, Homo sapiens
caagataatttattctgagttt

SEQ ID NO: 7353844 - DNA, 22 bp, Homo sapiens
caagaggattattaataaataa

SEQ ID NO: 7353845 - DNA, 22 bp, Homo sapiens
caagaggagcaggcaggtgtgc

SEQ ID NO: 7353846 - DNA, 22 bp, Homo sapiens
caagaggagcaggcaggtgtgc

SEQ ID NO: 7353847 - DNA, 22 bp, Homo sapiens
caagagctggagaggcagtcta

SEQ ID NO: 7353848 - DNA, 22 bp, Homo sapiens
caaggagagtaattgaatgaga

SEQ ID NO: 7353849 - DNA, 22 bp, Homo sapiens
caaggagagtaattgaatgaga

SEQ ID NO: 7353850 - DNA, 22 bp, Homo sapiens
caaggagataaaatgttgagct

SEQ ID NO: 7353851 - DNA, 22 bp, Homo sapiens
caaggagataaaatgttgagct

SEQ ID NO: 7353852 - DNA, 21 bp, Homo sapiens
caaggacaggttgcagggcaa

SEQ ID NO: 7353853 - DNA, 21 bp, Homo sapiens
caaggacaggttgcagggcaa

SEQ ID NO: 7353854 - DNA, 22 bp, Homo sapiens
caaggagaaaacggcttctgaa

SEQ ID NO: 7353855 - DNA, 22 bp, Homo sapiens
caaggacccaaatcttgttctt

SEQ ID NO: 7353856 - DNA, 22 bp, Homo sapiens
caaggagaaaacggcttctgaa

SEQ ID NO: 7353857 - DNA, 22 bp, Homo sapiens
caaggacagcgtcaggtgcaac

SEQ ID NO: 7353858 - DNA, 22 bp, Homo sapiens
caaggacagcgtcaggtgcaac

SEQ ID NO: 7353859 - DNA, 22 bp, Homo sapiens
caaggacaacttcatattgtgg

SEQ ID NO: 7353860 - DNA, 22 bp, Homo sapiens
caaggacactccctgctgggca

SEQ ID NO: 7353861 - DNA, 22 bp, Homo sapiens
caagatgatccctgaaggcagc

SEQ ID NO: 7353862 - DNA, 22 bp, Homo sapiens
caagatggagaagcagcaaggg

SEQ ID NO: 7353863 - DNA, 19 bp, Homo sapiens
caacagtactggtttgtcc

SEQ ID NO: 7353864 - DNA, 22 bp, Homo sapiens
caacagtatagcttttgactgc

SEQ ID NO: 7353865 - DNA, 21 bp, Homo sapiens
gctgccaccgcgtgctccagg

SEQ ID NO: 7353866 - DNA, 23 bp, Homo sapiens
gctgccacagggctcaggcaggt

SEQ ID NO: 7353867 - DNA, 22 bp, Homo sapiens
gctgcaggtttgtctagtctgg

SEQ ID NO: 7353868 - DNA, 22 bp, Homo sapiens
gctgcagctcgccttccggcct

SEQ ID NO: 7353869 - DNA, 22 bp, Homo sapiens
gctgcatgacagacaggcctgg

SEQ ID NO: 7353870 - DNA, 22 bp, Homo sapiens
gctgcagtgagccaagatcgtg

SEQ ID NO: 7353871 - DNA, 22 bp, Homo sapiens
caacatttcaaggtctttagga

SEQ ID NO: 7353872 - DNA, 22 bp, Homo sapiens
caacatttgagtaaagaaatgg

SEQ ID NO: 7353873 - DNA, 22 bp, Homo sapiens
caacatttgtgatgagcaaact

SEQ ID NO: 7353874 - DNA, 22 bp, Homo sapiens
caacatataatatttgagttct

SEQ ID NO: 7353875 - DNA, 22 bp, Homo sapiens
caacatatataaggatttacta

SEQ ID NO: 7353876 - DNA, 19 bp, Homo sapiens
gctcctggatgacctgtgg

SEQ ID NO: 7353877 - DNA, 18 bp, Homo sapiens
gctcctggagtctgactc

SEQ ID NO: 7353878 - DNA, 18 bp, Homo sapiens
gctcctggagtctgactc

SEQ ID NO: 7353879 - DNA, 22 bp, Homo sapiens
gctcctggagagattgagaaag

SEQ ID NO: 7353880 - DNA, 22 bp, Homo sapiens
gctgaggtggaggaaggagacc

SEQ ID NO: 7353881 - DNA, 18 bp, Homo sapiens
gctcctggaccaggtcac

SEQ ID NO: 7353882 - DNA, 22 bp, Homo sapiens
gctcctgcaggacccaggagac

SEQ ID NO: 7353883 - DNA, 22 bp, Homo sapiens
gctcctgcaggacccaggagac

SEQ ID NO: 7353884 - DNA, 17 bp, Homo sapiens
gctcctgcaggtcagga

SEQ ID NO: 7353885 - DNA, 22 bp, Homo sapiens
gctcctcttatttcatcagggc

SEQ ID NO: 7353886 - DNA, 22 bp, Homo sapiens
caaagtatatttcatagtctca

SEQ ID NO: 7353887 - DNA, 22 bp, Homo sapiens
ggagggagtcagctgattagaa

SEQ ID NO: 7353888 - DNA, 22 bp, Homo sapiens
ggatccttaactatcacagtga

SEQ ID NO: 7353889 - DNA, 22 bp, Homo sapiens
ggatccttctttgacctcacag

SEQ ID NO: 7353890 - DNA, 22 bp, Homo sapiens
ggagggaggttagattcaagct

SEQ ID NO: 7353891 - DNA, 22 bp, Homo sapiens
ggatgggaacttggtagggcat

SEQ ID NO: 7353892 - DNA, 23 bp, Homo sapiens
ggatgggcaagcctagtgcctac

SEQ ID NO: 7353893 - DNA, 22 bp, Homo sapiens
ggagggagcagagaacccaacc

SEQ ID NO: 7353894 - DNA, 22 bp, Homo sapiens
ggaggcggaggctgcagtgagc

SEQ ID NO: 7353895 - DNA, 22 bp, Homo sapiens
ggagggagggctagaccaaaga

SEQ ID NO: 7353896 - DNA, 22 bp, Homo sapiens
ggagggagcatccccttgctga

SEQ ID NO: 7353897 - DNA, 22 bp, Homo sapiens
ggagggagcatccccttgctga

SEQ ID NO: 7353898 - DNA, 23 bp, Homo sapiens
cacagggagggaaactctttcag

SEQ ID NO: 7353899 - DNA, 22 bp, Homo sapiens
cacagggagaggaacagcgcag

SEQ ID NO: 7353900 - DNA, 22 bp, Homo sapiens
ggatgtctgtcattatgctttc

SEQ ID NO: 7353901 - DNA, 18 bp, Homo sapiens
ggatgtgaaccagagata

SEQ ID NO: 7353902 - DNA, 22 bp, Homo sapiens
ggatgggcagacaggacggcac

SEQ ID NO: 7353903 - DNA, 22 bp, Homo sapiens
ggatgggcagacaggacggcac

SEQ ID NO: 7353904 - DNA, 22 bp, Homo sapiens
ggatgggcccgggacggcgctg

SEQ ID NO: 7353905 - DNA, 22 bp, Homo sapiens
cacactgactggaatcaaggat

SEQ ID NO: 7353906 - DNA, 22 bp, Homo sapiens
cacactagcacttcagaggttc

SEQ ID NO: 7353907 - DNA, 22 bp, Homo sapiens
cacagctgttttctccaggcag

SEQ ID NO: 7353908 - DNA, 22 bp, Homo sapiens
cacagctgtcagctgacctagg

SEQ ID NO: 7353909 - DNA, 22 bp, Homo sapiens
ggaggcggaagttgcagtgagc

SEQ ID NO: 7353910 - DNA, 20 bp, Homo sapiens
ggaggcgctgggctcgcgct

SEQ ID NO: 7353911 - DNA, 20 bp, Homo sapiens
ggaggcgctgggctcgcgct

SEQ ID NO: 7353912 - DNA, 22 bp, Homo sapiens
ggaggcgcggctcggctgtgcc

SEQ ID NO: 7353913 - DNA, 22 bp, Homo sapiens
ggaggcgcggctcggctgtgcc

SEQ ID NO: 7353914 - DNA, 22 bp, Homo sapiens
ggaggcggagcttgcagtgagc

SEQ ID NO: 7353915 - DNA, 22 bp, Homo sapiens
ggaggcggacacaggtagtgtt

SEQ ID NO: 7353916 - DNA, 22 bp, Homo sapiens
ggaggcggacacaggtagtgtt

SEQ ID NO: 7353917 - DNA, 22 bp, Homo sapiens
cacagtgtagttaatgtgacat

SEQ ID NO: 7353918 - DNA, 22 bp, Homo sapiens
cacagtgtagactaataataga

SEQ ID NO: 7353919 - DNA, 22 bp, Homo sapiens
cacagtgtagactaataataga

SEQ ID NO: 7353920 - DNA, 22 bp, Homo sapiens
cacagtgtggcaaatttcaact

SEQ ID NO: 7353921 - DNA, 22 bp, Homo sapiens
ggcagatggaagaggctgggtc

SEQ ID NO: 7353922 - DNA, 22 bp, Homo sapiens
ggcagcagtggctgctattgtc

SEQ ID NO: 7353923 - DNA, 22 bp, Homo sapiens
ggcagcagttacaaatgtgcag

SEQ ID NO: 7353924 - DNA, 20 bp, Homo sapiens
ggcagccaatcagcgtgccg

SEQ ID NO: 7353925 - DNA, 22 bp, Homo sapiens
ggcagcatctctggcagcagct

SEQ ID NO: 7353926 - DNA, 22 bp, Homo sapiens
ggcagagctctggactgagaac

SEQ ID NO: 7353927 - DNA, 22 bp, Homo sapiens
ggcagagccttctggagctcgc

SEQ ID NO: 7353928 - DNA, 17 bp, Homo sapiens
ggcagagctgacagggc

SEQ ID NO: 7353929 - DNA, 22 bp, Homo sapiens
cacagtggaaacagctaagcct

SEQ ID NO: 7353930 - DNA, 22 bp, Homo sapiens
cacagtggaagtccaggatccc

SEQ ID NO: 7353931 - DNA, 22 bp, Homo sapiens
cacagtgcgaaagaaacccagc

SEQ ID NO: 7353932 - DNA, 22 bp, Homo sapiens
cacagtgctcaaacacaagtgc

SEQ ID NO: 7353933 - DNA, 22 bp, Homo sapiens
cacagtgctttacatgttttct

SEQ ID NO: 7353934 - DNA, 22 bp, Homo sapiens
cacagtgctcaaacacaagtgc

SEQ ID NO: 7353935 - DNA, 22 bp, Homo sapiens
cacagtgctcgggttttatgtc

SEQ ID NO: 7353936 - DNA, 16 bp, Homo sapiens
cacagtgctgctgctc

SEQ ID NO: 7353937 - DNA, 16 bp, Homo sapiens
cacagtgctgctgctc

SEQ ID NO: 7353938 - DNA, 22 bp, Homo sapiens
ggcacaggagtcacagcatttc

SEQ ID NO: 7353939 - DNA, 22 bp, Homo sapiens
ggcacacaaaggcagcatttga

SEQ ID NO: 7353940 - DNA, 22 bp, Homo sapiens
ggcacaggagctagtcaaagcc

SEQ ID NO: 7353941 - DNA, 22 bp, Homo sapiens
ggcacagggagaggcggatttt

SEQ ID NO: 7353942 - DNA, 22 bp, Homo sapiens
ggcacagggagccgcagttgca

SEQ ID NO: 7353943 - DNA, 22 bp, Homo sapiens
cacagggcaggccccaggcctc

SEQ ID NO: 7353944 - DNA, 22 bp, Homo sapiens
cacagggcagagggtccgtggc

SEQ ID NO: 7353945 - DNA, 22 bp, Homo sapiens
cacagggcagagacctgggtgc

SEQ ID NO: 7353946 - DNA, 22 bp, Homo sapiens
cacagggcagagggtccgtggc

SEQ ID NO: 7353947 - DNA, 22 bp, Homo sapiens
ggcacagggaggccctggtgtg

SEQ ID NO: 7353948 - DNA, 22 bp, Homo sapiens
ggcacagggagccgcagttgca

SEQ ID NO: 7353949 - DNA, 22 bp, Homo sapiens
ggcacagggggctgaggactag

SEQ ID NO: 7353950 - DNA, 22 bp, Homo sapiens
ggcacagggtgatgttgcagtt

SEQ ID NO: 7353951 - DNA, 22 bp, Homo sapiens
ggcacagggtgatgttgcagtt

SEQ ID NO: 7353952 - DNA, 22 bp, Homo sapiens
ggcacagtccctggcacagagt

SEQ ID NO: 7353953 - DNA, 22 bp, Homo sapiens
ggcactggcctggggccaagag

SEQ ID NO: 7353954 - DNA, 22 bp, Homo sapiens
ggcactgcttcctgagcctgag

SEQ ID NO: 7353955 - DNA, 22 bp, Homo sapiens
ggcactgctgtaggcagtgagg

SEQ ID NO: 7353956 - DNA, 18 bp, Homo sapiens
ggcactgctgttcccctt

SEQ ID NO: 7353957 - DNA, 22 bp, Homo sapiens
ggcactgggaatgcagtgatga

SEQ ID NO: 7353958 - DNA, 22 bp, Homo sapiens
ggcactgggcaccggctgaggg

SEQ ID NO: 7353959 - DNA, 22 bp, Homo sapiens
ggcagtgttctggttgtcagga

SEQ ID NO: 7353960 - DNA, 22 bp, Homo sapiens
ggcagtgttccagaccttcacc

SEQ ID NO: 7353961 - DNA, 22 bp, Homo sapiens
cacccagcacagagggaggcga

SEQ ID NO: 7353962 - DNA, 22 bp, Homo sapiens
cacccagagcctgagagggata

SEQ ID NO: 7353963 - DNA, 22 bp, Homo sapiens
cacccacattccatcactctgc

SEQ ID NO: 7353964 - DNA, 22 bp, Homo sapiens
caccatcagcagcaggtgtcaa

SEQ ID NO: 7353965 - DNA, 22 bp, Homo sapiens
caccccacatcaggcttctcca

SEQ ID NO: 7353966 - DNA, 22 bp, Homo sapiens
ggcatagatttctttaggttta

SEQ ID NO: 7353967 - DNA, 17 bp, Homo sapiens
caccctggctagtctga

SEQ ID NO: 7353968 - DNA, 20 bp, Homo sapiens
cactgaagacttcttgctca

SEQ ID NO: 7353969 - DNA, 22 bp, Homo sapiens
caccctgaggccacccagacct

SEQ ID NO: 7353970 - DNA, 22 bp, Homo sapiens
caccctggaaagaaggtctggg

SEQ ID NO: 7353971 - DNA, 22 bp, Homo sapiens
caccctggaaagaaggtctggg

SEQ ID NO: 7353972 - DNA, 22 bp, Homo sapiens
cacccctcgccactgcccttgt

SEQ ID NO: 7353973 - DNA, 22 bp, Homo sapiens
cacccccaggagctccagggac

SEQ ID NO: 7353974 - DNA, 22 bp, Homo sapiens
cacccccacctgtgggctcctg

SEQ ID NO: 7353975 - DNA, 22 bp, Homo sapiens
cacccccagcagggaaaggagg

SEQ ID NO: 7353976 - DNA, 20 bp, Homo sapiens
caccctcccagcacctatgc

SEQ ID NO: 7353977 - DNA, 22 bp, Homo sapiens
cactgaagatgcgactagtgct

SEQ ID NO: 7353978 - DNA, 22 bp, Homo sapiens
cactgaagatgcgactagtgct

SEQ ID NO: 7353979 - DNA, 22 bp, Homo sapiens
cactgaagcctgggagtaagac

SEQ ID NO: 7353980 - DNA, 22 bp, Homo sapiens
cactgaagcctgggagtaagac

SEQ ID NO: 7353981 - DNA, 22 bp, Homo sapiens
cactgaagccactggaagagga

SEQ ID NO: 7353982 - DNA, 22 bp, Homo sapiens
cactgaaggaaggactactgca

SEQ ID NO: 7353983 - DNA, 22 bp, Homo sapiens
cactgaagctttcattctcttg

SEQ ID NO: 7353984 - DNA, 22 bp, Homo sapiens
cactgaatctcaaggggagggt

SEQ ID NO: 7353985 - DNA, 22 bp, Homo sapiens
cactgaaggtaggaccaaggct

SEQ ID NO: 7353986 - DNA, 22 bp, Homo sapiens
cactgaaggctgcagctcagcc

SEQ ID NO: 7353987 - DNA, 22 bp, Homo sapiens
cactgaaggacagtaggaaggg

SEQ ID NO: 7353988 - DNA, 22 bp, Homo sapiens
cactgaaggctaggattagatg

SEQ ID NO: 7353989 - DNA, 23 bp, Homo sapiens
ggcctcctggtctaggctagact

SEQ ID NO: 7353990 - DNA, 22 bp, Homo sapiens
ggcctcgcggcttctggtggct

SEQ ID NO: 7353991 - DNA, 22 bp, Homo sapiens
ggcctcgcggcttctggtggct

SEQ ID NO: 7353992 - DNA, 22 bp, Homo sapiens
ggcctcgcggcttctggtggct

SEQ ID NO: 7353993 - DNA, 22 bp, Homo sapiens
ggcctcgcggcttctggtggct

SEQ ID NO: 7353994 - DNA, 22 bp, Homo sapiens
ggcctctcatgcccagagccaa

SEQ ID NO: 7353995 - DNA, 22 bp, Homo sapiens
ggcctctctagcatccagcctg

SEQ ID NO: 7353996 - DNA, 22 bp, Homo sapiens
cactgcactccatcctgggaaa

SEQ ID NO: 7353997 - DNA, 23 bp, Homo sapiens
cactgcagcgtggtctggcagga

SEQ ID NO: 7353998 - DNA, 22 bp, Homo sapiens
ggctagggagacagagggcatg

SEQ ID NO: 7353999 - DNA, 22 bp, Homo sapiens
ggctagggactcctcctcaggg

SEQ ID NO: 7354000 - DNA, 22 bp, Homo sapiens
ggctagggatctagaccaggac

SEQ ID NO: 7354001 - DNA, 19 bp, Homo sapiens
ggctcaagcatccaggtag

SEQ ID NO: 7354002 - DNA, 22 bp, Homo sapiens
ggctatggaaatggcaggacat

SEQ ID NO: 7354003 - DNA, 22 bp, Homo sapiens
ggctatgggaagatggcagggg

SEQ ID NO: 7354004 - DNA, 22 bp, Homo sapiens
ggctatgggaagatggcagggg

SEQ ID NO: 7354005 - DNA, 22 bp, Homo sapiens
cactgcctggaaggagagacat

SEQ ID NO: 7354006 - DNA, 22 bp, Homo sapiens
cactggaaccaagacccagggc

SEQ ID NO: 7354007 - DNA, 20 bp, Homo sapiens
cactggaaagcaggcgactc

SEQ ID NO: 7354008 - DNA, 22 bp, Homo sapiens
cactggaaccatccacatagtg

SEQ ID NO: 7354009 - DNA, 18 bp, Homo sapiens
cactggacctcatgagag

SEQ ID NO: 7354010 - DNA, 22 bp, Homo sapiens
cactggaatgttgaggagacaa

SEQ ID NO: 7354011 - DNA, 22 bp, Homo sapiens
cactggcatctaagggtggtag

SEQ ID NO: 7354012 - DNA, 22 bp, Homo sapiens
ggttgctctttggaccctgctg

SEQ ID NO: 7354013 - DNA, 22 bp, Homo sapiens
gtaaaatctttcctatttgcct

SEQ ID NO: 7354014 - DNA, 22 bp, Homo sapiens
ggtgtgctaagagcactttcaa

SEQ ID NO: 7354015 - DNA, 22 bp, Homo sapiens
ggtgtgcttgggcttcgcaggg

SEQ ID NO: 7354016 - DNA, 22 bp, Homo sapiens
cagcaatagtgtgtttgtttca

SEQ ID NO: 7354017 - DNA, 22 bp, Homo sapiens
cagcaatatacacagtctatgg

SEQ ID NO: 7354018 - DNA, 22 bp, Homo sapiens
cagcaataactcaaagccattt

SEQ ID NO: 7354019 - DNA, 22 bp, Homo sapiens
cagcaataaggtaagcttctcc

SEQ ID NO: 7354020 - DNA, 22 bp, Homo sapiens
cagcaataagccaggttagaca

SEQ ID NO: 7354021 - DNA, 22 bp, Homo sapiens
cagcaataaggtaagcttctcc

SEQ ID NO: 7354022 - DNA, 19 bp, Homo sapiens
cagcaataatgccagatgg

SEQ ID NO: 7354023 - DNA, 22 bp, Homo sapiens
cagcaataatgtctacaaatct

SEQ ID NO: 7354024 - DNA, 22 bp, Homo sapiens
ggtgggtcttgtggggcagctt

SEQ ID NO: 7354025 - DNA, 22 bp, Homo sapiens
ggtgggtcttgcggggcagctt

SEQ ID NO: 7354026 - DNA, 22 bp, Homo sapiens
ggtgggtcttgcggggcagctt

SEQ ID NO: 7354027 - DNA, 22 bp, Homo sapiens
ggtgggtcttgtggggcagctt

SEQ ID NO: 7354028 - DNA, 21 bp, Homo sapiens
ggtggggtacctaaggtagct

SEQ ID NO: 7354029 - DNA, 22 bp, Homo sapiens
ggtgggggagacttggtcaaga

SEQ ID NO: 7354030 - DNA, 22 bp, Homo sapiens
ggtggggtcacgacagagggaa

SEQ ID NO: 7354031 - DNA, 22 bp, Homo sapiens
gggtgggactctttggcctgag

SEQ ID NO: 7354032 - DNA, 20 bp, Homo sapiens
gggtgggagagtctgagggt

SEQ ID NO: 7354033 - DNA, 20 bp, Homo sapiens
gggtgggagagtctgagggt

SEQ ID NO: 7354034 - DNA, 22 bp, Homo sapiens
ggtgggacaggtaggagtggct

SEQ ID NO: 7354035 - DNA, 22 bp, Homo sapiens
ggtggggctaggacctcaggat

SEQ ID NO: 7354036 - DNA, 22 bp, Homo sapiens
gtatgaaagcatcattcctgct

SEQ ID NO: 7354037 - DNA, 22 bp, Homo sapiens
gtatgcataattgtgtattcat

SEQ ID NO: 7354038 - DNA, 22 bp, Homo sapiens
gtatgaagtaagatattgttca

SEQ ID NO: 7354039 - DNA, 22 bp, Homo sapiens
gtatctttgtcttcatgttgga

SEQ ID NO: 7354040 - DNA, 22 bp, Homo sapiens
gtatgaaaattgtaaagttctt

SEQ ID NO: 7354041 - DNA, 22 bp, Homo sapiens
gtatgcatgcatgtgtatgtac

SEQ ID NO: 7354042 - DNA, 22 bp, Homo sapiens
gtatgcatttggcatattgtcc

SEQ ID NO: 7354043 - DNA, 22 bp, Homo sapiens
cagcagcctccactcgccccac

SEQ ID NO: 7354044 - DNA, 22 bp, Homo sapiens
cagcagcctcttgtgcctgtgg

SEQ ID NO: 7354045 - DNA, 22 bp, Homo sapiens
cagcaggacatggaggagtaaa

SEQ ID NO: 7354046 - DNA, 22 bp, Homo sapiens
cagcagcctggagggggccacg

SEQ ID NO: 7354047 - DNA, 22 bp, Homo sapiens
gtatttcttgtacttccttgtc

SEQ ID NO: 7354048 - DNA, 22 bp, Homo sapiens
gtatttctttatctggtcagaa

SEQ ID NO: 7354049 - DNA, 22 bp, Homo sapiens
gtatttctggttaaatgtgcta

SEQ ID NO: 7354050 - DNA, 22 bp, Homo sapiens
gtatttcttccacggtggattt

SEQ ID NO: 7354051 - DNA, 22 bp, Homo sapiens
gtatttcttggaaatcctttta

SEQ ID NO: 7354052 - DNA, 22 bp, Homo sapiens
gtatttctagaaaatgcagatt

SEQ ID NO: 7354053 - DNA, 22 bp, Homo sapiens
gtatttctagaaaatgcagatt

SEQ ID NO: 7354054 - DNA, 22 bp, Homo sapiens
gtatttctagaaccaaaagcca

SEQ ID NO: 7354055 - DNA, 22 bp, Homo sapiens
cagcaggcggcccgcgggcccg

SEQ ID NO: 7354056 - DNA, 22 bp, Homo sapiens
cagcaggcaggtgggccaagtc

SEQ ID NO: 7354057 - DNA, 22 bp, Homo sapiens
cagcaggatatggtggagagag

SEQ ID NO: 7354058 - DNA, 22 bp, Homo sapiens
cagcaggatttgaaaggaagag

SEQ ID NO: 7354059 - DNA, 22 bp, Homo sapiens
cagcaggcagccatttcactgt

SEQ ID NO: 7354060 - DNA, 19 bp, Homo sapiens
gtatatttatatggctgta

SEQ ID NO: 7354061 - DNA, 19 bp, Homo sapiens
gtatatttatatggctgta

SEQ ID NO: 7354062 - DNA, 22 bp, Homo sapiens
gtatattttgatcaccctctat

SEQ ID NO: 7354063 - DNA, 22 bp, Homo sapiens
gtatattttgatcaccctctat

SEQ ID NO: 7354064 - DNA, 22 bp, Homo sapiens
gtatcctcacctatacaatgga

SEQ ID NO: 7354065 - DNA, 22 bp, Homo sapiens
gtatcctcagcaatcaacaaca

SEQ ID NO: 7354066 - DNA, 22 bp, Homo sapiens
gtatcctccccgctggccttca

SEQ ID NO: 7354067 - DNA, 22 bp, Homo sapiens
gtatctttccacatcttcagta

SEQ ID NO: 7354068 - DNA, 22 bp, Homo sapiens
gtatctttatccctcgttggag

SEQ ID NO: 7354069 - DNA, 22 bp, Homo sapiens
cagcagcacctattatagtgtt

SEQ ID NO: 7354070 - DNA, 22 bp, Homo sapiens
cagcagcaaggtgagggtggag

SEQ ID NO: 7354071 - DNA, 22 bp, Homo sapiens
cagcagagtatggcactcaact

SEQ ID NO: 7354072 - DNA, 22 bp, Homo sapiens
cagcagagtaattctcacctct

SEQ ID NO: 7354073 - DNA, 22 bp, Homo sapiens
cagcagcaaatctagaagagga

SEQ ID NO: 7354074 - DNA, 22 bp, Homo sapiens
cagccacgtagcccttggccgt

SEQ ID NO: 7354075 - DNA, 22 bp, Homo sapiens
cagccaccatacagcagaagct

SEQ ID NO: 7354076 - DNA, 22 bp, Homo sapiens
cagccacgtagcccttggccgt

SEQ ID NO: 7354077 - DNA, 22 bp, Homo sapiens
cagccaaatgagtcataaatgt

SEQ ID NO: 7354078 - DNA, 22 bp, Homo sapiens
cagccactgtggtctagctgca

SEQ ID NO: 7354079 - DNA, 22 bp, Homo sapiens
cagccactggtgccaggctgtt

SEQ ID NO: 7354080 - DNA, 22 bp, Homo sapiens
gtattttaagtgactactaggt

SEQ ID NO: 7354081 - DNA, 22 bp, Homo sapiens
cagcatttggaggagaggcttt

SEQ ID NO: 7354082 - DNA, 22 bp, Homo sapiens
cagcatttatcttgtagcagga

SEQ ID NO: 7354083 - DNA, 22 bp, Homo sapiens
cagcatgcctgggctgcctgcc

SEQ ID NO: 7354084 - DNA, 22 bp, Homo sapiens
cagcattctactttgtgaactg

SEQ ID NO: 7354085 - DNA, 22 bp, Homo sapiens
cagcattgatcccaggctgtgg

SEQ ID NO: 7354086 - DNA, 22 bp, Homo sapiens
cagcccagagccagttcccgct

SEQ ID NO: 7354087 - DNA, 22 bp, Homo sapiens
cagcccagcactaagtagattt

SEQ ID NO: 7354088 - DNA, 22 bp, Homo sapiens
cagcccagcagactgttaccac

SEQ ID NO: 7354089 - DNA, 22 bp, Homo sapiens
cagcccagcagtcttagcctgc

SEQ ID NO: 7354090 - DNA, 22 bp, Homo sapiens
cagcccagcagggtctggccct

SEQ ID NO: 7354091 - DNA, 21 bp, Homo sapiens
cagcccagcccattgacagtg

SEQ ID NO: 7354092 - DNA, 22 bp, Homo sapiens
ggggaaaggccatggcaagaac

SEQ ID NO: 7354093 - DNA, 23 bp, Homo sapiens
ggggaaagaccatgcttgaggac

SEQ ID NO: 7354094 - DNA, 22 bp, Homo sapiens
gggctttttacattgaacattt

SEQ ID NO: 7354095 - DNA, 22 bp, Homo sapiens
gggctgtgtatcagttatctat

SEQ ID NO: 7354096 - DNA, 22 bp, Homo sapiens
gggctgtgtactatgaggaggg

SEQ ID NO: 7354097 - DNA, 22 bp, Homo sapiens
gggctgtgtactatgaggaggg

SEQ ID NO: 7354098 - DNA, 22 bp, Homo sapiens
cagagctgcgctttttcctggt

SEQ ID NO: 7354099 - DNA, 22 bp, Homo sapiens
cagagctgcgctttttcctggt

SEQ ID NO: 7354100 - DNA, 22 bp, Homo sapiens
cagagctgcagattgaaggcat

SEQ ID NO: 7354101 - DNA, 22 bp, Homo sapiens
cagagctgctcatggtggccag

SEQ ID NO: 7354102 - DNA, 22 bp, Homo sapiens
cagagctgcgctttttcctggt

SEQ ID NO: 7354103 - DNA, 19 bp, Homo sapiens
cagagctgctggcctcgtc

SEQ ID NO: 7354104 - DNA, 19 bp, Homo sapiens
cagagctgctggcctcgtc

SEQ ID NO: 7354105 - DNA, 22 bp, Homo sapiens
cagagctgctcatggtggccag

SEQ ID NO: 7354106 - DNA, 22 bp, Homo sapiens
gggcgagggcgaaagcgagagc

SEQ ID NO: 7354107 - DNA, 22 bp, Homo sapiens
gggcgcagccaatcctggccct

SEQ ID NO: 7354108 - DNA, 22 bp, Homo sapiens
cagagcctggcgatgtcatgga

SEQ ID NO: 7354109 - DNA, 22 bp, Homo sapiens
cagagctgacccaaggattgaa

SEQ ID NO: 7354110 - DNA, 22 bp, Homo sapiens
cagagctgacccaaggattgaa

SEQ ID NO: 7354111 - DNA, 21 bp, Homo sapiens
cagagctgaagggtgtagtgt

SEQ ID NO: 7354112 - DNA, 22 bp, Homo sapiens
cagagctgcagattgaaggcat

SEQ ID NO: 7354113 - DNA, 22 bp, Homo sapiens
cagagctgcagattgaaggcat

SEQ ID NO: 7354114 - DNA, 22 bp, Homo sapiens
cagagctgcaaatgcccctccg

SEQ ID NO: 7354115 - DNA, 23 bp, Homo sapiens
cagagctgattaaacttaatctc

SEQ ID NO: 7354116 - DNA, 22 bp, Homo sapiens
cagagctgagtcttcaaggttg

SEQ ID NO: 7354117 - DNA, 22 bp, Homo sapiens
cagagctgattggatccagaga

SEQ ID NO: 7354118 - DNA, 22 bp, Homo sapiens
cagagctgattggatccagaga

SEQ ID NO: 7354119 - DNA, 22 bp, Homo sapiens
cagagctgagtcttcaaggttg

SEQ ID NO: 7354120 - DNA, 22 bp, Homo sapiens
gggcagagaaatggacagttgg

SEQ ID NO: 7354121 - DNA, 22 bp, Homo sapiens
gggcagaatttgtagatgacat

SEQ ID NO: 7354122 - DNA, 22 bp, Homo sapiens
gggcactgtgctaggtgctgag

SEQ ID NO: 7354123 - DNA, 22 bp, Homo sapiens
gggcacagaagtctaagacatc

SEQ ID NO: 7354124 - DNA, 22 bp, Homo sapiens
gggcacagagggtcttgaagaa

SEQ ID NO: 7354125 - DNA, 21 bp, Homo sapiens
gggcgaggcctgatgtggctc

SEQ ID NO: 7354126 - DNA, 21 bp, Homo sapiens
gggcgaggcctgatgtggctc

SEQ ID NO: 7354127 - DNA, 22 bp, Homo sapiens
gggcgaggactgactctgggca

SEQ ID NO: 7354128 - DNA, 21 bp, Homo sapiens
gggcgaggcctgatgtggctc

SEQ ID NO: 7354129 - DNA, 22 bp, Homo sapiens
gggcgaggactgactctgggca

SEQ ID NO: 7354130 - DNA, 22 bp, Homo sapiens
gggcgagggcgaaagcgagagc

SEQ ID NO: 7354131 - DNA, 22 bp, Homo sapiens
gggccttctagttagccccaat

SEQ ID NO: 7354132 - DNA, 22 bp, Homo sapiens
gggccttcagccttggactgag

SEQ ID NO: 7354133 - DNA, 22 bp, Homo sapiens
gggccttccgactcccaaggcc

SEQ ID NO: 7354134 - DNA, 22 bp, Homo sapiens
cagagcccctcagctctctccc

SEQ ID NO: 7354135 - DNA, 22 bp, Homo sapiens
cagagcccctcagctctctccc

SEQ ID NO: 7354136 - DNA, 22 bp, Homo sapiens
cagagcccctcgtctccaccac

SEQ ID NO: 7354137 - DNA, 22 bp, Homo sapiens
cagagccctagtcctgatggcc

SEQ ID NO: 7354138 - DNA, 22 bp, Homo sapiens
cagaggccacctgtggccactg

SEQ ID NO: 7354139 - DNA, 22 bp, Homo sapiens
cagagctgtcatttgccagtga

SEQ ID NO: 7354140 - DNA, 22 bp, Homo sapiens
cagagctgtcatttgccagtga

SEQ ID NO: 7354141 - DNA, 22 bp, Homo sapiens
cagagctgtatttatctttcca

SEQ ID NO: 7354142 - DNA, 22 bp, Homo sapiens
cagagctgtatttatctttcca

SEQ ID NO: 7354143 - DNA, 22 bp, Homo sapiens
cagagctggtgttacaagtcca

SEQ ID NO: 7354144 - DNA, 20 bp, Homo sapiens
ggggaagaaaaggatgtgat

SEQ ID NO: 7354145 - DNA, 20 bp, Homo sapiens
ggggaagaaaaggatgtgat

SEQ ID NO: 7354146 - DNA, 22 bp, Homo sapiens
cagagctggtaagtggtagagg

SEQ ID NO: 7354147 - DNA, 22 bp, Homo sapiens
cagagctggtgtgtcctggcat

SEQ ID NO: 7354148 - DNA, 21 bp, Homo sapiens
cagaggcctcatgctctgtgc

SEQ ID NO: 7354149 - DNA, 22 bp, Homo sapiens
cagaggcctcacttccagccag

SEQ ID NO: 7354150 - DNA, 21 bp, Homo sapiens
cagaggcctatcacagactcc

SEQ ID NO: 7354151 - DNA, 22 bp, Homo sapiens
cagaggcctatccagtgtccat

SEQ ID NO: 7354152 - DNA, 22 bp, Homo sapiens
cagaggccccagaactagctct

SEQ ID NO: 7354153 - DNA, 19 bp, Homo sapiens
cagaggccagaagcacagg

SEQ ID NO: 7354154 - DNA, 22 bp, Homo sapiens
cagaggccaggctgcctgactg

SEQ ID NO: 7354155 - DNA, 22 bp, Homo sapiens
cagaggccagggggctcacaaa

SEQ ID NO: 7354156 - DNA, 22 bp, Homo sapiens
cagaggccagtggacaagggcc

SEQ ID NO: 7354157 - DNA, 22 bp, Homo sapiens
cagaggccatatttcttcactc

SEQ ID NO: 7354158 - DNA, 22 bp, Homo sapiens
cagaggcccagtgagagggctg

SEQ ID NO: 7354159 - DNA, 22 bp, Homo sapiens
cagaggtgtacagagggaggcc

SEQ ID NO: 7354160 - DNA, 23 bp, Homo sapiens
cagaggtgtcagtgcccagtgtc

SEQ ID NO: 7354161 - DNA, 22 bp, Homo sapiens
cagaggtgttggtgaatggaga

SEQ ID NO: 7354162 - DNA, 22 bp, Homo sapiens
cagaggtttgatcgagtaggtc

SEQ ID NO: 7354163 - DNA, 22 bp, Homo sapiens
cagaggctggcggccgccccga

SEQ ID NO: 7354164 - DNA, 22 bp, Homo sapiens
gggtgctgaggaagacagcagg

SEQ ID NO: 7354165 - DNA, 22 bp, Homo sapiens
cagaggctggatggacttgcct

SEQ ID NO: 7354166 - DNA, 22 bp, Homo sapiens
gggtgctcttgggaaacgtagt

SEQ ID NO: 7354167 - DNA, 22 bp, Homo sapiens
gggtgctgactggggcctgaaa

SEQ ID NO: 7354168 - DNA, 22 bp, Homo sapiens
gggtgcctgcctcaggcagtgt

SEQ ID NO: 7354169 - DNA, 22 bp, Homo sapiens
gggtgcctgagttagggcagaa

SEQ ID NO: 7354170 - DNA, 22 bp, Homo sapiens
gggtgctcatggataaggcgaa

SEQ ID NO: 7354171 - DNA, 22 bp, Homo sapiens
gggtgctcctggcggcctcttt

SEQ ID NO: 7354172 - DNA, 22 bp, Homo sapiens
gggtgcctacatgtcctccatg

SEQ ID NO: 7354173 - DNA, 22 bp, Homo sapiens
cagaggccttcaatactcattt

SEQ ID NO: 7354174 - DNA, 22 bp, Homo sapiens
cagaggcctggcttggacacct

SEQ ID NO: 7354175 - DNA, 22 bp, Homo sapiens
cagaggccttgtcttctttgct

SEQ ID NO: 7354176 - DNA, 22 bp, Homo sapiens
gggtgcagggtctccagcagct

SEQ ID NO: 7354177 - DNA, 22 bp, Homo sapiens
gggtgcagggtctccagcagct

SEQ ID NO: 7354178 - DNA, 22 bp, Homo sapiens
gggtgcaggggaccctagggac

SEQ ID NO: 7354179 - DNA, 22 bp, Homo sapiens
gggtgcaggggaccctagggac

SEQ ID NO: 7354180 - DNA, 22 bp, Homo sapiens
cagacaggaagttcagaagaaa

SEQ ID NO: 7354181 - DNA, 22 bp, Homo sapiens
cagaataaaaactcctatgtct

SEQ ID NO: 7354182 - DNA, 22 bp, Homo sapiens
cagaagttgccacatgaccctt

SEQ ID NO: 7354183 - DNA, 22 bp, Homo sapiens
gggagcaggacataatagcaat

SEQ ID NO: 7354184 - DNA, 22 bp, Homo sapiens
cagacaggcaggtgctgctttg

SEQ ID NO: 7354185 - DNA, 22 bp, Homo sapiens
cagacaggcaggtgagagctcc

SEQ ID NO: 7354186 - DNA, 22 bp, Homo sapiens
cagacaggagactggatcatgg

SEQ ID NO: 7354187 - DNA, 22 bp, Homo sapiens
gggagggtctgagagctgcacc

SEQ ID NO: 7354188 - DNA, 22 bp, Homo sapiens
gggaggggttgcatgtttgagt

SEQ ID NO: 7354189 - DNA, 22 bp, Homo sapiens
gggaggggttgcatgtttgagt

SEQ ID NO: 7354190 - DNA, 22 bp, Homo sapiens
gggagggtctgccatgctccct

SEQ ID NO: 7354191 - DNA, 22 bp, Homo sapiens
gggaggtcctaaaggggaccag

SEQ ID NO: 7354192 - DNA, 22 bp, Homo sapiens
gggaggtcagggtgcctgctgg

SEQ ID NO: 7354193 - DNA, 22 bp, Homo sapiens
gggagggccaggctcacccagg

SEQ ID NO: 7354194 - DNA, 22 bp, Homo sapiens
gggagggccaggctcacccagg

SEQ ID NO: 7354195 - DNA, 22 bp, Homo sapiens
gggagcaggagcctgcctgcca

SEQ ID NO: 7354196 - DNA, 20 bp, Homo sapiens
gggaggcattggtccctcac

SEQ ID NO: 7354197 - DNA, 22 bp, Homo sapiens
gggaggggttgcatgtttgagt

SEQ ID NO: 7354198 - DNA, 22 bp, Homo sapiens
gggagggcttggacccagatgt

SEQ ID NO: 7354199 - DNA, 22 bp, Homo sapiens
gggagggccagtgctctctaga

SEQ ID NO: 7354200 - DNA, 22 bp, Homo sapiens
gggagggccagtgctctctaga

SEQ ID NO: 7354201 - DNA, 22 bp, Homo sapiens
gggcaaggcagaagagttggag

SEQ ID NO: 7354202 - DNA, 20 bp, Homo sapiens
gggcaaggaaacagccccca

SEQ ID NO: 7354203 - DNA, 22 bp, Homo sapiens
gggcaatgctatgaagagctaa

SEQ ID NO: 7354204 - DNA, 22 bp, Homo sapiens
gggcacaccttgtctgagcaca

SEQ ID NO: 7354205 - DNA, 22 bp, Homo sapiens
gggcaatgtggcaaaaccctgt

SEQ ID NO: 7354206 - DNA, 17 bp, Homo sapiens
cagacaggctgtcaccc

SEQ ID NO: 7354207 - DNA, 17 bp, Homo sapiens
cagacaggctgtcaccc

SEQ ID NO: 7354208 - DNA, 22 bp, Homo sapiens
cagacagggccctgtgatggta

SEQ ID NO: 7354209 - DNA, 22 bp, Homo sapiens
gggcaagcagtgaggacagcac

SEQ ID NO: 7354210 - DNA, 22 bp, Homo sapiens
gggatgagagtagggtgtgaaa

SEQ ID NO: 7354211 - DNA, 22 bp, Homo sapiens
gggaaggacattctgggctcag

SEQ ID NO: 7354212 - DNA, 22 bp, Homo sapiens
gggaaggacacagccatgactg

SEQ ID NO: 7354213 - DNA, 22 bp, Homo sapiens
gggaaggaaagttattagcaga

SEQ ID NO: 7354214 - DNA, 22 bp, Homo sapiens
gggaaggaaatcttgcttgtga

SEQ ID NO: 7354215 - DNA, 22 bp, Homo sapiens
gggaaaggatcagtgggaggct

SEQ ID NO: 7354216 - DNA, 18 bp, Homo sapiens
gggaagccgggaagccgg

SEQ ID NO: 7354217 - DNA, 23 bp, Homo sapiens
gggaaaggatatgatcctagggg

SEQ ID NO: 7354218 - DNA, 22 bp, Homo sapiens
gggaaggagcctgcttgctaga

SEQ ID NO: 7354219 - DNA, 22 bp, Homo sapiens
gggaaggaggtggcttgaagtg

SEQ ID NO: 7354220 - DNA, 22 bp, Homo sapiens
gggaaggaggtggacctgcccc

SEQ ID NO: 7354221 - DNA, 22 bp, Homo sapiens
gggactggatagatgtgggtga

SEQ ID NO: 7354222 - DNA, 22 bp, Homo sapiens
gggactggcacagggctgggag

SEQ ID NO: 7354223 - DNA, 22 bp, Homo sapiens
gggactggagtagaggccggtg

SEQ ID NO: 7354224 - DNA, 22 bp, Homo sapiens
gggactggatagatgtgggtga

SEQ ID NO: 7354225 - DNA, 22 bp, Homo sapiens
gggactggcacagggctgggag

SEQ ID NO: 7354226 - DNA, 22 bp, Homo sapiens
gggactgggagatcctcctggc

SEQ ID NO: 7354227 - DNA, 22 bp, Homo sapiens
gggactggccagggtttggaat

SEQ ID NO: 7354228 - DNA, 22 bp, Homo sapiens
gggactggcacagggctgggag

SEQ ID NO: 7354229 - DNA, 19 bp, Homo sapiens
gggactggaggatgtggag

SEQ ID NO: 7354230 - DNA, 22 bp, Homo sapiens
gggactggagtagaggccggtg

SEQ ID NO: 7354231 - DNA, 19 bp, Homo sapiens
gggactggaggatgtggag

SEQ ID NO: 7354232 - DNA, 22 bp, Homo sapiens
gggactcctttaaggagggtga

SEQ ID NO: 7354233 - DNA, 22 bp, Homo sapiens
gggactggaactactggtgcag

SEQ ID NO: 7354234 - DNA, 22 bp, Homo sapiens
gggactggaactactggtgcag

SEQ ID NO: 7354235 - DNA, 22 bp, Homo sapiens
gggacagacccatgggccaggt

SEQ ID NO: 7354236 - DNA, 22 bp, Homo sapiens
gggacagaaggaagtgagcaca

SEQ ID NO: 7354237 - DNA, 22 bp, Homo sapiens
gggactccataagcacatggat

SEQ ID NO: 7354238 - DNA, 22 bp, Homo sapiens
gggactcctgcatttcaagtcc

SEQ ID NO: 7354239 - DNA, 22 bp, Homo sapiens
gggacagaaggaagtgagcaca

SEQ ID NO: 7354240 - DNA, 22 bp, Homo sapiens
cagaagcagtgagagatgtgca

SEQ ID NO: 7354241 - DNA, 22 bp, Homo sapiens
cagaagcagtgagagatgtgca

SEQ ID NO: 7354242 - DNA, 22 bp, Homo sapiens
cagaaggcctgaatctttgttc

SEQ ID NO: 7354243 - DNA, 22 bp, Homo sapiens
gggaaagaccctgagtcttatt

SEQ ID NO: 7354244 - DNA, 22 bp, Homo sapiens
gggaaagacttattttgacttc

SEQ ID NO: 7354245 - DNA, 22 bp, Homo sapiens
cagaaggtgaaggcagaacctt

SEQ ID NO: 7354246 - DNA, 22 bp, Homo sapiens
gggaaaatattaagcaggactt

SEQ ID NO: 7354247 - DNA, 22 bp, Homo sapiens
atatgtattttaacgtgtaagg

SEQ ID NO: 7354248 - DNA, 22 bp, Homo sapiens
atatgtatgtacgcacatattc

SEQ ID NO: 7354249 - DNA, 22 bp, Homo sapiens
atatggctgtgtttatagccat

SEQ ID NO: 7354250 - DNA, 22 bp, Homo sapiens
atatggctgttgcacatctaag

SEQ ID NO: 7354251 - DNA, 22 bp, Homo sapiens
atatggctgttgcacatctaag

SEQ ID NO: 7354252 - DNA, 22 bp, Homo sapiens
atatggctgttggtagccaaca

SEQ ID NO: 7354253 - DNA, 22 bp, Homo sapiens
atatggcttttctgtagtagtt

SEQ ID NO: 7354254 - DNA, 22 bp, Homo sapiens
atatggctgtttcactagctga

SEQ ID NO: 7354255 - DNA, 23 bp, Homo sapiens
atatggctgttgtgtgttaacat

SEQ ID NO: 7354256 - DNA, 22 bp, Homo sapiens
atatggcttatttatagagcaa

SEQ ID NO: 7354257 - DNA, 22 bp, Homo sapiens
atatggcttgtagcatgaataa

SEQ ID NO: 7354258 - DNA, 22 bp, Homo sapiens
atatggtaagagtatatttact

SEQ ID NO: 7354259 - DNA, 22 bp, Homo sapiens
atatgtgtaaatgcatttgttt

SEQ ID NO: 7354260 - DNA, 22 bp, Homo sapiens
atatgtgtaaatgcatttgttt

SEQ ID NO: 7354261 - DNA, 22 bp, Homo sapiens
atatgtgtacgtgcagtatata

SEQ ID NO: 7354262 - DNA, 22 bp, Homo sapiens
atatgtcgctacatcattagat

SEQ ID NO: 7354263 - DNA, 22 bp, Homo sapiens
atatgtcataattgtgtctgta

SEQ ID NO: 7354264 - DNA, 22 bp, Homo sapiens
atatgtgtgcacatatgtattt

SEQ ID NO: 7354265 - DNA, 22 bp, Homo sapiens
atatgtgtgcacatatgtattt

SEQ ID NO: 7354266 - DNA, 22 bp, Homo sapiens
atatgtgtgtatttcttactag

SEQ ID NO: 7354267 - DNA, 18 bp, Homo sapiens
atatgttaattaggtagg

SEQ ID NO: 7354268 - DNA, 20 bp, Homo sapiens
atatgtgtacgtgtatacat

SEQ ID NO: 7354269 - DNA, 20 bp, Homo sapiens
atatgtgtacgtgtatacat

SEQ ID NO: 7354270 - DNA, 22 bp, Homo sapiens
atatgtgtatggatttctatct

SEQ ID NO: 7354271 - DNA, 22 bp, Homo sapiens
atatgtgtatggatttctatct

SEQ ID NO: 7354272 - DNA, 22 bp, Homo sapiens
atatgtgtcgtgctactgccca

SEQ ID NO: 7354273 - DNA, 22 bp, Homo sapiens
atatgtgtgatgcatggactaa

SEQ ID NO: 7354274 - DNA, 22 bp, Homo sapiens
atatgtttttggaaagaacaca

SEQ ID NO: 7354275 - DNA, 22 bp, Homo sapiens
atatgtttttcacaggtttaag

SEQ ID NO: 7354276 - DNA, 22 bp, Homo sapiens
atatttctctcagacatggaag

SEQ ID NO: 7354277 - DNA, 22 bp, Homo sapiens
atatttctccaaatgttttcaa

SEQ ID NO: 7354278 - DNA, 22 bp, Homo sapiens
atatttagcaacatccttggcc

SEQ ID NO: 7354279 - DNA, 22 bp, Homo sapiens
atatgttgagcaagcatgatta

SEQ ID NO: 7354280 - DNA, 22 bp, Homo sapiens
atatgttgagcaagcatgatta

SEQ ID NO: 7354281 - DNA, 22 bp, Homo sapiens
atatttgtagtgggtaagaagt

SEQ ID NO: 7354282 - DNA, 22 bp, Homo sapiens
atatttgcaggaaactagtttt

SEQ ID NO: 7354283 - DNA, 20 bp, Homo sapiens
atatttcttaagaactttca

SEQ ID NO: 7354284 - DNA, 20 bp, Homo sapiens
atatttcttaagaactttca

SEQ ID NO: 7354285 - DNA, 22 bp, Homo sapiens
atatttctgggggtgtgtttct

SEQ ID NO: 7354286 - DNA, 22 bp, Homo sapiens
atatatgcatgtgtacttatgt

SEQ ID NO: 7354287 - DNA, 22 bp, Homo sapiens
atatatattgcccaggctggtt

SEQ ID NO: 7354288 - DNA, 22 bp, Homo sapiens
atatatattgcccaggctggtt

SEQ ID NO: 7354289 - DNA, 22 bp, Homo sapiens
atatgacagcggattcacatat

SEQ ID NO: 7354290 - DNA, 22 bp, Homo sapiens
atatgacagaatgtgtgtgtat

SEQ ID NO: 7354291 - DNA, 20 bp, Homo sapiens
atatggctccgttcagtcgg

SEQ ID NO: 7354292 - DNA, 22 bp, Homo sapiens
atatggctctggctctgccttg

SEQ ID NO: 7354293 - DNA, 20 bp, Homo sapiens
atatggctgtgtgttgggag

SEQ ID NO: 7354294 - DNA, 22 bp, Homo sapiens
atatggctcttccaaactgaga

SEQ ID NO: 7354295 - DNA, 22 bp, Homo sapiens
atatggctggagcctctgcctt

SEQ ID NO: 7354296 - DNA, 21 bp, Homo sapiens
atatggctcagagctggtact

SEQ ID NO: 7354297 - DNA, 22 bp, Homo sapiens
atatggctaggttactaaactg

SEQ ID NO: 7354298 - DNA, 22 bp, Homo sapiens
ctgggcagtggtggcccttccc

SEQ ID NO: 7354299 - DNA, 22 bp, Homo sapiens
ctgggcagtggtggcccttccc

SEQ ID NO: 7354300 - DNA, 22 bp, Homo sapiens
ctgggcagtggtggcccttccc

SEQ ID NO: 7354301 - DNA, 22 bp, Homo sapiens
ctgggcagtggtggcatctttg

SEQ ID NO: 7354302 - DNA, 22 bp, Homo sapiens
ctgggcagtgggcaagttgtat

SEQ ID NO: 7354303 - DNA, 22 bp, Homo sapiens
ctgggcagtggtggcatctttg

SEQ ID NO: 7354304 - DNA, 22 bp, Homo sapiens
ctgggcaggatacttcatggga

SEQ ID NO: 7354305 - DNA, 22 bp, Homo sapiens
ctgggcaggtatacaaaaaatg

SEQ ID NO: 7354306 - DNA, 22 bp, Homo sapiens
ctgggcagtatgaatattcaaa

SEQ ID NO: 7354307 - DNA, 20 bp, Homo sapiens
ctgggcaggtgtttgatctc

SEQ ID NO: 7354308 - DNA, 22 bp, Homo sapiens
ctgggcagtgcagctatagaac

SEQ ID NO: 7354309 - DNA, 22 bp, Homo sapiens
ctgggcaggagggctctatgga

SEQ ID NO: 7354310 - DNA, 22 bp, Homo sapiens
ctgggcaggatacttcatggga

SEQ ID NO: 7354311 - DNA, 22 bp, Homo sapiens
atatatacaactagattaaaag

SEQ ID NO: 7354312 - DNA, 22 bp, Homo sapiens
atatataatacttgctgtgggc

SEQ ID NO: 7354313 - DNA, 22 bp, Homo sapiens
atataagttagtggtcatgttt

SEQ ID NO: 7354314 - DNA, 22 bp, Homo sapiens
atataactcttgttcttatagt

SEQ ID NO: 7354315 - DNA, 22 bp, Homo sapiens
ctggcttgaagttatgcaccag

SEQ ID NO: 7354316 - DNA, 22 bp, Homo sapiens
ctgggaagcatggtgatggtat

SEQ ID NO: 7354317 - DNA, 22 bp, Homo sapiens
ctgggaagccacagggtgtggg

SEQ ID NO: 7354318 - DNA, 22 bp, Homo sapiens
ctgggaaggggaaggtcctctc

SEQ ID NO: 7354319 - DNA, 22 bp, Homo sapiens
atatatattgcccaggctggtt

SEQ ID NO: 7354320 - DNA, 22 bp, Homo sapiens
atatatatgctgatggctgcca

SEQ ID NO: 7354321 - DNA, 22 bp, Homo sapiens
atatatatgctgatggctgcca

SEQ ID NO: 7354322 - DNA, 19 bp, Homo sapiens
ctgggaggtgttcagagaa

SEQ ID NO: 7354323 - DNA, 22 bp, Homo sapiens
ctgggagacaagagagggctga

SEQ ID NO: 7354324 - DNA, 22 bp, Homo sapiens
atatatactttgacacattctg

SEQ ID NO: 7354325 - DNA, 22 bp, Homo sapiens
atatatatcgagttcatgtctc

SEQ ID NO: 7354326 - DNA, 18 bp, Homo sapiens
atcatgctgaattaaaga

SEQ ID NO: 7354327 - DNA, 22 bp, Homo sapiens
ctgtgatgatggaaactttctt

SEQ ID NO: 7354328 - DNA, 22 bp, Homo sapiens
ctgtgcagcttggcttcaggcc

SEQ ID NO: 7354329 - DNA, 22 bp, Homo sapiens
ctgtgcagctggcttcctggaa

SEQ ID NO: 7354330 - DNA, 22 bp, Homo sapiens
ctgtcttttcttctcattgatg

SEQ ID NO: 7354331 - DNA, 22 bp, Homo sapiens
ctgtctttggtcctgtctgtta

SEQ ID NO: 7354332 - DNA, 22 bp, Homo sapiens
ctgtctctgtcttaactcccag

SEQ ID NO: 7354333 - DNA, 22 bp, Homo sapiens
ctgtctctgttgcctgtaggtg

SEQ ID NO: 7354334 - DNA, 22 bp, Homo sapiens
ctgtctttggtcctgtctgtta

SEQ ID NO: 7354335 - DNA, 22 bp, Homo sapiens
ctgtcctccggccacctacagt

SEQ ID NO: 7354336 - DNA, 22 bp, Homo sapiens
ctgtcctctgtcctcagcagga

SEQ ID NO: 7354337 - DNA, 22 bp, Homo sapiens
ctgtcctccagacgacagtccc

SEQ ID NO: 7354338 - DNA, 22 bp, Homo sapiens
ctgtcctcaccttggcaggggg

SEQ ID NO: 7354339 - DNA, 22 bp, Homo sapiens
atcacagttactcaaataatga

SEQ ID NO: 7354340 - DNA, 22 bp, Homo sapiens
atcacagttactcaaataatga

SEQ ID NO: 7354341 - DNA, 22 bp, Homo sapiens
atcacagtgtagaccttttaaa

SEQ ID NO: 7354342 - DNA, 22 bp, Homo sapiens
atcacagtggcagggatttggg

SEQ ID NO: 7354343 - DNA, 22 bp, Homo sapiens
atcacagtggctacctctggat

SEQ ID NO: 7354344 - DNA, 22 bp, Homo sapiens
atcacagtgccttcgtaaattt

SEQ ID NO: 7354345 - DNA, 22 bp, Homo sapiens
atcacagtgccttcgtaaattt

SEQ ID NO: 7354346 - DNA, 22 bp, Homo sapiens
atcacagtgctaggctgaggga

SEQ ID NO: 7354347 - DNA, 22 bp, Homo sapiens
atcacagtctttttcttaagta

SEQ ID NO: 7354348 - DNA, 22 bp, Homo sapiens
atcacatctcaccactgcaacc

SEQ ID NO: 7354349 - DNA, 22 bp, Homo sapiens
atcacagtttacaaacctgctg

SEQ ID NO: 7354350 - DNA, 22 bp, Homo sapiens
atcacagttttaccatttggta

SEQ ID NO: 7354351 - DNA, 22 bp, Homo sapiens
atcacagttttgtgccttgtgg

SEQ ID NO: 7354352 - DNA, 22 bp, Homo sapiens
ctgtccagtcagaacgtcatta

SEQ ID NO: 7354353 - DNA, 22 bp, Homo sapiens
ctgtccgccgacttggccaggc

SEQ ID NO: 7354354 - DNA, 22 bp, Homo sapiens
ctgtcctcaacccatccttctc

SEQ ID NO: 7354355 - DNA, 22 bp, Homo sapiens
ctgtcctcaacccatccttctc

SEQ ID NO: 7354356 - DNA, 22 bp, Homo sapiens
atccaccctgtggtggctttct

SEQ ID NO: 7354357 - DNA, 22 bp, Homo sapiens
atccacatttaggtctctaaaa

SEQ ID NO: 7354358 - DNA, 22 bp, Homo sapiens
atccccttatcccaggctgagc

SEQ ID NO: 7354359 - DNA, 22 bp, Homo sapiens
atccccttatcccaggctgagc

SEQ ID NO: 7354360 - DNA, 22 bp, Homo sapiens
atccccttcacaccctctgcat

SEQ ID NO: 7354361 - DNA, 22 bp, Homo sapiens
atcctctatgatatgtatgggt

SEQ ID NO: 7354362 - DNA, 22 bp, Homo sapiens
atcctcagcatctagcatgaag

SEQ ID NO: 7354363 - DNA, 22 bp, Homo sapiens
atcctcagtgtttctgacatct

SEQ ID NO: 7354364 - DNA, 20 bp, Homo sapiens
atcctctcctgattaattca

SEQ ID NO: 7354365 - DNA, 23 bp, Homo sapiens
atcctctctccatcccactgtgc

SEQ ID NO: 7354366 - DNA, 22 bp, Homo sapiens
atcctctctcccataccagtct

SEQ ID NO: 7354367 - DNA, 22 bp, Homo sapiens
atcctctctgtgacagggaacg

SEQ ID NO: 7354368 - DNA, 22 bp, Homo sapiens
atcctctctgttttcgtgtatg

SEQ ID NO: 7354369 - DNA, 22 bp, Homo sapiens
atcctcacatttgggcaggtga

SEQ ID NO: 7354370 - DNA, 22 bp, Homo sapiens
atcctcagacctcagcaaagcc

SEQ ID NO: 7354371 - DNA, 22 bp, Homo sapiens
atcctcagagaacgaacacaat

SEQ ID NO: 7354372 - DNA, 22 bp, Homo sapiens
atcctcagacttcacgttccat

SEQ ID NO: 7354373 - DNA, 22 bp, Homo sapiens
atcctaaattgagagctctaat

SEQ ID NO: 7354374 - DNA, 22 bp, Homo sapiens
atcctaaaattgttcaatttct

SEQ ID NO: 7354375 - DNA, 22 bp, Homo sapiens
atcctaaagaaatatttattaa

SEQ ID NO: 7354376 - DNA, 22 bp, Homo sapiens
atcccttgtgctcagcctcttg

SEQ ID NO: 7354377 - DNA, 22 bp, Homo sapiens
atccggggttcattttcactga

SEQ ID NO: 7354378 - DNA, 22 bp, Homo sapiens
atcctaaaattgttcaatttct

SEQ ID NO: 7354379 - DNA, 22 bp, Homo sapiens
atccaaatatattttattcact

SEQ ID NO: 7354380 - DNA, 22 bp, Homo sapiens
atccaaatcatgtcagaagaac

SEQ ID NO: 7354381 - DNA, 22 bp, Homo sapiens
atccacaagaccccttttcact

SEQ ID NO: 7354382 - DNA, 22 bp, Homo sapiens
atccaaggggaaagacgtctgg

SEQ ID NO: 7354383 - DNA, 22 bp, Homo sapiens
atccaacaggacaaagaaagga

SEQ ID NO: 7354384 - DNA, 22 bp, Homo sapiens
atccaacaggacaaagaaagga

SEQ ID NO: 7354385 - DNA, 22 bp, Homo sapiens
atccaagaatttgcactcctaa

SEQ ID NO: 7354386 - DNA, 22 bp, Homo sapiens
atccaagcagaatcacgtgaga

SEQ ID NO: 7354387 - DNA, 22 bp, Homo sapiens
atccaagcttcaccctaggatg

SEQ ID NO: 7354388 - DNA, 22 bp, Homo sapiens
atccaaggcgcaagatggcgct

SEQ ID NO: 7354389 - DNA, 22 bp, Homo sapiens
atcattttgtgacaatgcctgt

SEQ ID NO: 7354390 - DNA, 22 bp, Homo sapiens
ctgtggagcagggcagggtcac

SEQ ID NO: 7354391 - DNA, 22 bp, Homo sapiens
ctgtggagtggggagtactggt

SEQ ID NO: 7354392 - DNA, 22 bp, Homo sapiens
agttgggacatgttctttcccc

SEQ ID NO: 7354393 - DNA, 22 bp, Homo sapiens
ctgaggcaggagaattgctgga

SEQ ID NO: 7354394 - DNA, 22 bp, Homo sapiens
ctgaggcaggcagatcacttga

SEQ ID NO: 7354395 - DNA, 22 bp, Homo sapiens
ctgaggcaggggcagctggaga

SEQ ID NO: 7354396 - DNA, 22 bp, Homo sapiens
ctgaggcaggggcagctggaga

SEQ ID NO: 7354397 - DNA, 22 bp, Homo sapiens
ctgaggcaggatggcctggctg

SEQ ID NO: 7354398 - DNA, 22 bp, Homo sapiens
ctgaggcaggagagttgcttga

SEQ ID NO: 7354399 - DNA, 21 bp, Homo sapiens
ctgaggcatgcaggcctgggc

SEQ ID NO: 7354400 - DNA, 22 bp, Homo sapiens
ctgaggcatcatggagaacagt

SEQ ID NO: 7354401 - DNA, 22 bp, Homo sapiens
ctgaggcagtttaatttttgaa

SEQ ID NO: 7354402 - DNA, 22 bp, Homo sapiens
ctgaggcatgaatgtgggcttt

SEQ ID NO: 7354403 - DNA, 22 bp, Homo sapiens
ctgaggcttgtcctctcagctt

SEQ ID NO: 7354404 - DNA, 22 bp, Homo sapiens
ctgaggggtatccaaggggtaa

SEQ ID NO: 7354405 - DNA, 22 bp, Homo sapiens
ctgaggggtatccaaggggtaa

SEQ ID NO: 7354406 - DNA, 22 bp, Homo sapiens
ctgagggaacttgggcaagtct

SEQ ID NO: 7354407 - DNA, 22 bp, Homo sapiens
ctgaggggtatccaaggggtaa

SEQ ID NO: 7354408 - DNA, 22 bp, Homo sapiens
ctgagggaacttgggcaagtct

SEQ ID NO: 7354409 - DNA, 22 bp, Homo sapiens
agtttggaaaatgagacaagga

SEQ ID NO: 7354410 - DNA, 22 bp, Homo sapiens
agtttgctgatgaagaaaattt

SEQ ID NO: 7354411 - DNA, 22 bp, Homo sapiens
agtttgctcagaaatttgaaat

SEQ ID NO: 7354412 - DNA, 22 bp, Homo sapiens
agtttgtaagttcattatgagt

SEQ ID NO: 7354413 - DNA, 22 bp, Homo sapiens
ctgcagcctccaccttttgggt

SEQ ID NO: 7354414 - DNA, 22 bp, Homo sapiens
agtttaattggaggcgtggctc

SEQ ID NO: 7354415 - DNA, 22 bp, Homo sapiens
agtttaatcctccagcccaact

SEQ ID NO: 7354416 - DNA, 22 bp, Homo sapiens
ctgcagagcaagttctctgttg

SEQ ID NO: 7354417 - DNA, 22 bp, Homo sapiens
agtttaatatccttcaactttc

SEQ ID NO: 7354418 - DNA, 22 bp, Homo sapiens
agtttaagctggttataggcaa

SEQ ID NO: 7354419 - DNA, 22 bp, Homo sapiens
agtttgtatcaatttgctttat

SEQ ID NO: 7354420 - DNA, 21 bp, Homo sapiens
ctgccaggatagcatgcaggc

SEQ ID NO: 7354421 - DNA, 22 bp, Homo sapiens
ctgccaggcctcatcccagcca

SEQ ID NO: 7354422 - DNA, 20 bp, Homo sapiens
ataaaataactgccacaaga

SEQ ID NO: 7354423 - DNA, 20 bp, Homo sapiens
ataaaataactgccacaaga

SEQ ID NO: 7354424 - DNA, 22 bp, Homo sapiens
ataaatagtgtgtcataaagtc

SEQ ID NO: 7354425 - DNA, 17 bp, Homo sapiens
ataaaggcaagtattat

SEQ ID NO: 7354426 - DNA, 22 bp, Homo sapiens
ctgcccagaatcactcactcga

SEQ ID NO: 7354427 - DNA, 19 bp, Homo sapiens
ctgctcaggtcagtctgtc

SEQ ID NO: 7354428 - DNA, 22 bp, Homo sapiens
ctgctccaagccagccctgcag

SEQ ID NO: 7354429 - DNA, 22 bp, Homo sapiens
ctgcccagaagcttagagctta

SEQ ID NO: 7354430 - DNA, 22 bp, Homo sapiens
ctgcccacagttctctgccatg

SEQ ID NO: 7354431 - DNA, 22 bp, Homo sapiens
ctgcccaccgtgtgcacgtgcg

SEQ ID NO: 7354432 - DNA, 22 bp, Homo sapiens
ctgcccaccccgaggcaggaag

SEQ ID NO: 7354433 - DNA, 22 bp, Homo sapiens
ataatacatggttgatcttttc

SEQ ID NO: 7354434 - DNA, 22 bp, Homo sapiens
ataatacatggttgatcttttc

SEQ ID NO: 7354435 - DNA, 22 bp, Homo sapiens
ctgctctggcgtactcggcatc

SEQ ID NO: 7354436 - DNA, 22 bp, Homo sapiens
ctgctctggctgtgtacttcag

SEQ ID NO: 7354437 - DNA, 22 bp, Homo sapiens
ctgctctgctgatcagtgtctc

SEQ ID NO: 7354438 - DNA, 22 bp, Homo sapiens
ctgctctgcagcttggactccc

SEQ ID NO: 7354439 - DNA, 22 bp, Homo sapiens
ctgctctgcagcttggactccc

SEQ ID NO: 7354440 - DNA, 22 bp, Homo sapiens
ctgctctgagaggctcttccta

SEQ ID NO: 7354441 - DNA, 22 bp, Homo sapiens
atacaagtgatataattgtttc

SEQ ID NO: 7354442 - DNA, 22 bp, Homo sapiens
atacaagactcagcacagacgg

SEQ ID NO: 7354443 - DNA, 22 bp, Homo sapiens
ataatattgagtcaggacctga

SEQ ID NO: 7354444 - DNA, 22 bp, Homo sapiens
ataatatttgcattactgtgat

SEQ ID NO: 7354445 - DNA, 22 bp, Homo sapiens
ctgctgtgtgaccatggacagg

SEQ ID NO: 7354446 - DNA, 22 bp, Homo sapiens
ctgcttctccctgagatagtgt

SEQ ID NO: 7354447 - DNA, 18 bp, Homo sapiens
ctgcttctgtctgccagt

SEQ ID NO: 7354448 - DNA, 22 bp, Homo sapiens
ctgcttctgggatgatggagta

SEQ ID NO: 7354449 - DNA, 22 bp, Homo sapiens
atacagagcagtaatagaggag

SEQ ID NO: 7354450 - DNA, 22 bp, Homo sapiens
atacagatcccacagcatgtga

SEQ ID NO: 7354451 - DNA, 22 bp, Homo sapiens
atacagagaaggggtagaggat

SEQ ID NO: 7354452 - DNA, 22 bp, Homo sapiens
atacagaattcactacagtttc

SEQ ID NO: 7354453 - DNA, 22 bp, Homo sapiens
atacagatgcttgctcgtgact

SEQ ID NO: 7354454 - DNA, 22 bp, Homo sapiens
ctggagggagattcaaaggagg

SEQ ID NO: 7354455 - DNA, 22 bp, Homo sapiens
ctggaggaaaacaactgcagac

SEQ ID NO: 7354456 - DNA, 22 bp, Homo sapiens
ctggagggaggaggctgctatt

SEQ ID NO: 7354457 - DNA, 22 bp, Homo sapiens
ctggagggaggaggctgctatt

SEQ ID NO: 7354458 - DNA, 22 bp, Homo sapiens
ctggagggagttaggacccgga

SEQ ID NO: 7354459 - DNA, 22 bp, Homo sapiens
atacaagtggccacttgaattc

SEQ ID NO: 7354460 - DNA, 22 bp, Homo sapiens
atacaagttaatgagaatgaca

SEQ ID NO: 7354461 - DNA, 22 bp, Homo sapiens
ctggagcccaggcctggtgtct

SEQ ID NO: 7354462 - DNA, 22 bp, Homo sapiens
ctggagccccaggctgtgcaga

SEQ ID NO: 7354463 - DNA, 22 bp, Homo sapiens
ctggagccccaggctgtgcaga

SEQ ID NO: 7354464 - DNA, 22 bp, Homo sapiens
atactttctgaccaattaattg

SEQ ID NO: 7354465 - DNA, 22 bp, Homo sapiens
ctggcagcggtttgcagcctgg

SEQ ID NO: 7354466 - DNA, 22 bp, Homo sapiens
atacttctctgaggtaggtaaa

SEQ ID NO: 7354467 - DNA, 22 bp, Homo sapiens
atacttctttagcatattgaac

SEQ ID NO: 7354468 - DNA, 22 bp, Homo sapiens
atacttctcatgggctctgagc

SEQ ID NO: 7354469 - DNA, 22 bp, Homo sapiens
ctggagtgcaatgaacaaggtc

SEQ ID NO: 7354470 - DNA, 22 bp, Homo sapiens
atacttcatgcttcatgtctgt

SEQ ID NO: 7354471 - DNA, 22 bp, Homo sapiens
atacttcaacatatcagtcaga

SEQ ID NO: 7354472 - DNA, 22 bp, Homo sapiens
ctggagggctgcagcgaggctg

SEQ ID NO: 7354473 - DNA, 22 bp, Homo sapiens
ctggagggatgtagggtgtatt

SEQ ID NO: 7354474 - DNA, 22 bp, Homo sapiens
ctggagggctgcagcgaggctg

SEQ ID NO: 7354475 - DNA, 22 bp, Homo sapiens
ctggagggctgcagcgaggctg

SEQ ID NO: 7354476 - DNA, 22 bp, Homo sapiens
ctctggtttctgacctgaattt

SEQ ID NO: 7354477 - DNA, 21 bp, Homo sapiens
ctctggtttgcattggattat

SEQ ID NO: 7354478 - DNA, 22 bp, Homo sapiens
agtgggagaatgaataagggcc

SEQ ID NO: 7354479 - DNA, 22 bp, Homo sapiens
ctctgtagaaagagcccaggtg

SEQ ID NO: 7354480 - DNA, 22 bp, Homo sapiens
ctctgtacaggagacatctcta

SEQ ID NO: 7354481 - DNA, 19 bp, Homo sapiens
ctctggagaacaatagtgc

SEQ ID NO: 7354482 - DNA, 17 bp, Homo sapiens
ctctggaattggtgaag

SEQ ID NO: 7354483 - DNA, 22 bp, Homo sapiens
ctctgctgccaccagaaccact

SEQ ID NO: 7354484 - DNA, 22 bp, Homo sapiens
ctctgctgccaccagaaccact

SEQ ID NO: 7354485 - DNA, 22 bp, Homo sapiens
ctctggagaacgctatggatct

SEQ ID NO: 7354486 - DNA, 19 bp, Homo sapiens
ctctggagaacaatagtgc

SEQ ID NO: 7354487 - DNA, 22 bp, Homo sapiens
ctctggagaactccttgtgtct

SEQ ID NO: 7354488 - DNA, 22 bp, Homo sapiens
ctctggagaggttcccatggga

SEQ ID NO: 7354489 - DNA, 22 bp, Homo sapiens
ctctggagatggttctcaattg

SEQ ID NO: 7354490 - DNA, 23 bp, Homo sapiens
ctctggagatcctctgcctgggt

SEQ ID NO: 7354491 - DNA, 22 bp, Homo sapiens
ctctggagcaccgggctatcca

SEQ ID NO: 7354492 - DNA, 22 bp, Homo sapiens
agtggtctctaaatgtttaaat

SEQ ID NO: 7354493 - DNA, 22 bp, Homo sapiens
ctctgtctatcccattctgtgc

SEQ ID NO: 7354494 - DNA, 22 bp, Homo sapiens
ctctgtctatcccattctgtgc

SEQ ID NO: 7354495 - DNA, 22 bp, Homo sapiens
ctctgtctatcccattctgtgc

SEQ ID NO: 7354496 - DNA, 22 bp, Homo sapiens
ctctgtcccagacccacctctc

SEQ ID NO: 7354497 - DNA, 22 bp, Homo sapiens
ctctgtcctatgcttgatagaa

SEQ ID NO: 7354498 - DNA, 21 bp, Homo sapiens
agtggtctttttcacccagtg

SEQ ID NO: 7354499 - DNA, 22 bp, Homo sapiens
ctcttgaagcaggggccagttc

SEQ ID NO: 7354500 - DNA, 22 bp, Homo sapiens
ctcttgggatacactgccatag

SEQ ID NO: 7354501 - DNA, 22 bp, Homo sapiens
agtgctggattacaggcgtgag

SEQ ID NO: 7354502 - DNA, 22 bp, Homo sapiens
agtgctggattacaggcgtgag

SEQ ID NO: 7354503 - DNA, 22 bp, Homo sapiens
agtgctggattacaggcgtgag

SEQ ID NO: 7354504 - DNA, 22 bp, Homo sapiens
agtgctggagggaggcaggttc

SEQ ID NO: 7354505 - DNA, 22 bp, Homo sapiens
ctccagagagaaaggaggccgc

SEQ ID NO: 7354506 - DNA, 22 bp, Homo sapiens
agtgctataaaggtagaccaca

SEQ ID NO: 7354507 - DNA, 22 bp, Homo sapiens
ctctccattccctacagttttc

SEQ ID NO: 7354508 - DNA, 22 bp, Homo sapiens
agtgctgggctatctactgcta

SEQ ID NO: 7354509 - DNA, 22 bp, Homo sapiens
agtgctgggtactgttcccatt

SEQ ID NO: 7354510 - DNA, 22 bp, Homo sapiens
agtgctgggattgcaggcatga

SEQ ID NO: 7354511 - DNA, 22 bp, Homo sapiens
agtgctgggattacaggcataa

SEQ ID NO: 7354512 - DNA, 22 bp, Homo sapiens
agtgctggcccatagctgctgg

SEQ ID NO: 7354513 - DNA, 22 bp, Homo sapiens
ctcagatcatcagaaacaatgt

SEQ ID NO: 7354514 - DNA, 22 bp, Homo sapiens
ctcagcaacacggcctattaag

SEQ ID NO: 7354515 - DNA, 22 bp, Homo sapiens
ctcagcaacagcgacttaaggg

SEQ ID NO: 7354516 - DNA, 22 bp, Homo sapiens
ctcagcaacccacacacggtct

SEQ ID NO: 7354517 - DNA, 22 bp, Homo sapiens
ctcagcaagacccccaccgtgt

SEQ ID NO: 7354518 - DNA, 22 bp, Homo sapiens
ctcagcaaccctagaacatttg

SEQ ID NO: 7354519 - DNA, 19 bp, Homo sapiens
ctcagcaagatagaaatgg

SEQ ID NO: 7354520 - DNA, 22 bp, Homo sapiens
ctcagcaagattaagcagcttg

SEQ ID NO: 7354521 - DNA, 22 bp, Homo sapiens
ctcagcaattacctgtgtctct

SEQ ID NO: 7354522 - DNA, 22 bp, Homo sapiens
ctcagagtccatagtttacagt

SEQ ID NO: 7354523 - DNA, 22 bp, Homo sapiens
ctcagagtctgcatttctgtca

SEQ ID NO: 7354524 - DNA, 22 bp, Homo sapiens
ctcagagtcccttccctcgtgg

SEQ ID NO: 7354525 - DNA, 22 bp, Homo sapiens
ctcagagtctgcatttctgtca

SEQ ID NO: 7354526 - DNA, 22 bp, Homo sapiens
ctcagagtccccagtgggtttg

SEQ ID NO: 7354527 - DNA, 22 bp, Homo sapiens
ctcagagtccccagtgggtttg

SEQ ID NO: 7354528 - DNA, 22 bp, Homo sapiens
ctcagagtccccacatctgggt

SEQ ID NO: 7354529 - DNA, 22 bp, Homo sapiens
ctcagagtggggctccctgagg

SEQ ID NO: 7354530 - DNA, 22 bp, Homo sapiens
ctcagagttctcctgggaggtg

SEQ ID NO: 7354531 - DNA, 17 bp, Homo sapiens
ctcagagttgctttgtc

SEQ ID NO: 7354532 - DNA, 17 bp, Homo sapiens
ctcagagttgctttgtc

SEQ ID NO: 7354533 - DNA, 22 bp, Homo sapiens
ctcagacatctgaaatgggtta

SEQ ID NO: 7354534 - DNA, 22 bp, Homo sapiens
ctcagacccccagagctgctaa

SEQ ID NO: 7354535 - DNA, 22 bp, Homo sapiens
ctcagactagcctgtaccgaca

SEQ ID NO: 7354536 - DNA, 22 bp, Homo sapiens
ctcagactggtgggtaaaacct

SEQ ID NO: 7354537 - DNA, 22 bp, Homo sapiens
ctcagagaaaaggagcaagggt

SEQ ID NO: 7354538 - DNA, 22 bp, Homo sapiens
ctcagaaattacaaaagggaca

SEQ ID NO: 7354539 - DNA, 22 bp, Homo sapiens
ctcagaatctgccaagttcagg

SEQ ID NO: 7354540 - DNA, 22 bp, Homo sapiens
ctcagaattacatcccatttta

SEQ ID NO: 7354541 - DNA, 22 bp, Homo sapiens
ctcagaatctgccaagttcagg

SEQ ID NO: 7354542 - DNA, 22 bp, Homo sapiens
agtcccagagaggtcggggcca

SEQ ID NO: 7354543 - DNA, 22 bp, Homo sapiens
agtcccagatgacccagctact

SEQ ID NO: 7354544 - DNA, 22 bp, Homo sapiens
agtcccagatctccattcggtc

SEQ ID NO: 7354545 - DNA, 22 bp, Homo sapiens
cgggtggagacagagggcataa

SEQ ID NO: 7354546 - DNA, 22 bp, Homo sapiens
cgggtggagacagagggcataa

SEQ ID NO: 7354547 - DNA, 22 bp, Homo sapiens
cggggtgggaatagacctgtct

SEQ ID NO: 7354548 - DNA, 22 bp, Homo sapiens
cggggtgggaatagacctgtct

SEQ ID NO: 7354549 - DNA, 22 bp, Homo sapiens
cggggtgggaatagacctgtct

SEQ ID NO: 7354550 - DNA, 22 bp, Homo sapiens
cggggtggcactctaaatagaa

SEQ ID NO: 7354551 - DNA, 22 bp, Homo sapiens
cggggtggcactctaaatagaa

SEQ ID NO: 7354552 - DNA, 22 bp, Homo sapiens
cggggtggcactctaaatagaa

SEQ ID NO: 7354553 - DNA, 22 bp, Homo sapiens
cggggtccgggcagtaggctgc

SEQ ID NO: 7354554 - DNA, 22 bp, Homo sapiens
cgggggagttgaggcacatggg

SEQ ID NO: 7354555 - DNA, 22 bp, Homo sapiens
cgggggagttgaggcacatggg

SEQ ID NO: 7354556 - DNA, 22 bp, Homo sapiens
agtatgaatctctttattctgc

SEQ ID NO: 7354557 - DNA, 22 bp, Homo sapiens
agtatgaatacagattttctct

SEQ ID NO: 7354558 - DNA, 22 bp, Homo sapiens
agtatgaagaatacatagatga

SEQ ID NO: 7354559 - DNA, 22 bp, Homo sapiens
agtatcatgttggaattaatca

SEQ ID NO: 7354560 - DNA, 22 bp, Homo sapiens
ctcaacatatgactttggtggg

SEQ ID NO: 7354561 - DNA, 22 bp, Homo sapiens
ctcaaatgtttccacttctgct

SEQ ID NO: 7354562 - DNA, 22 bp, Homo sapiens
ctcaacacgtcctcgagaagcg

SEQ ID NO: 7354563 - DNA, 22 bp, Homo sapiens
ctcaagaaggatgagctattgc

SEQ ID NO: 7354564 - DNA, 22 bp, Homo sapiens
ctcaaatagaactgatctataa

SEQ ID NO: 7354565 - DNA, 22 bp, Homo sapiens
ctatttatgtgctattttgtat

SEQ ID NO: 7354566 - DNA, 22 bp, Homo sapiens
ctatttatgtccaagtgtttta

SEQ ID NO: 7354567 - DNA, 21 bp, Homo sapiens
ctcaaaattctttctgttgga

SEQ ID NO: 7354568 - DNA, 17 bp, Homo sapiens
agtgaaatttacattgc

SEQ ID NO: 7354569 - DNA, 22 bp, Homo sapiens
ctcagtggtcggcacagtttgt

SEQ ID NO: 7354570 - DNA, 22 bp, Homo sapiens
ctccactctggggtgggtgaga

SEQ ID NO: 7354571 - DNA, 22 bp, Homo sapiens
ctccagagagaaaggaggccgc

SEQ ID NO: 7354572 - DNA, 22 bp, Homo sapiens
ctccactcaggtgcttaagttg

SEQ ID NO: 7354573 - DNA, 22 bp, Homo sapiens
ctccactcaccgaggcagagca

SEQ ID NO: 7354574 - DNA, 22 bp, Homo sapiens
ctccactcaccagatgccagga

SEQ ID NO: 7354575 - DNA, 22 bp, Homo sapiens
agtgacagggaaaatgacactg

SEQ ID NO: 7354576 - DNA, 22 bp, Homo sapiens
agtgacagctgggaaggtgaaa

SEQ ID NO: 7354577 - DNA, 21 bp, Homo sapiens
agtgacagaggaaggtgcata

SEQ ID NO: 7354578 - DNA, 22 bp, Homo sapiens
agtctcagagtacctgagggac

SEQ ID NO: 7354579 - DNA, 22 bp, Homo sapiens
agtctcagcaagcatggctagt

SEQ ID NO: 7354580 - DNA, 18 bp, Homo sapiens
agtctcagcggaggagta

SEQ ID NO: 7354581 - DNA, 22 bp, Homo sapiens
agtctcagccacacagacctat

SEQ ID NO: 7354582 - DNA, 22 bp, Homo sapiens
agtctcagctacttgggaggct

SEQ ID NO: 7354583 - DNA, 22 bp, Homo sapiens
ctcagctccctccacccagacc

SEQ ID NO: 7354584 - DNA, 20 bp, Homo sapiens
ctcagctcttcagggcaagt

SEQ ID NO: 7354585 - DNA, 22 bp, Homo sapiens
ctcagccccaatttgccctctt

SEQ ID NO: 7354586 - DNA, 22 bp, Homo sapiens
ctcagcacattcctaagggatg

SEQ ID NO: 7354587 - DNA, 22 bp, Homo sapiens
ctcagccctccccggggaataa

SEQ ID NO: 7354588 - DNA, 22 bp, Homo sapiens
ctcagctagtaacgtacatgtc

SEQ ID NO: 7354589 - DNA, 22 bp, Homo sapiens
ctcagctcattgtggatccggt

SEQ ID NO: 7354590 - DNA, 22 bp, Homo sapiens
ctcagctccagccctcagcagc

SEQ ID NO: 7354591 - DNA, 22 bp, Homo sapiens
ctcagggacaaggggagacccc

SEQ ID NO: 7354592 - DNA, 21 bp, Homo sapiens
ctcaggcatttgaggagagtc

SEQ ID NO: 7354593 - DNA, 22 bp, Homo sapiens
agtctccttggcctcaatgcct

SEQ ID NO: 7354594 - DNA, 22 bp, Homo sapiens
agtctccttaaatatttcccag

SEQ ID NO: 7354595 - DNA, 23 bp, Homo sapiens
agtctcagctggaaacatgtgtc

SEQ ID NO: 7354596 - DNA, 22 bp, Homo sapiens
agtctcaggcagaggaaggcta

SEQ ID NO: 7354597 - DNA, 22 bp, Homo sapiens
agtctcagggccacccggggaa

SEQ ID NO: 7354598 - DNA, 19 bp, Homo sapiens
agtctcagtgtacagaggc

SEQ ID NO: 7354599 - DNA, 22 bp, Homo sapiens
cggccctggcggaggcgggaga

SEQ ID NO: 7354600 - DNA, 22 bp, Homo sapiens
cggccctgctgagcttgtctgg

SEQ ID NO: 7354601 - DNA, 22 bp, Homo sapiens
cggccctgaccagaccttagtt

SEQ ID NO: 7354602 - DNA, 22 bp, Homo sapiens
cggccgcagcagtgtcggccca

SEQ ID NO: 7354603 - DNA, 20 bp, Homo sapiens
agtaggggaatgcaagagca

SEQ ID NO: 7354604 - DNA, 22 bp, Homo sapiens
agtatatatgaggaaccacaaa

SEQ ID NO: 7354605 - DNA, 22 bp, Homo sapiens
agtatatttgttaagattattc

SEQ ID NO: 7354606 - DNA, 22 bp, Homo sapiens
agtatatttgttaagattattc

SEQ ID NO: 7354607 - DNA, 22 bp, Homo sapiens
cggccaggcacagtggcccacg

SEQ ID NO: 7354608 - DNA, 22 bp, Homo sapiens
cggaggttgaggctgcagtgag

SEQ ID NO: 7354609 - DNA, 22 bp, Homo sapiens
cggaggggtttgaacagaggag

SEQ ID NO: 7354610 - DNA, 22 bp, Homo sapiens
cggaggggtttgaacagaggag

SEQ ID NO: 7354611 - DNA, 22 bp, Homo sapiens
cggaggggtttgaacagaggag

SEQ ID NO: 7354612 - DNA, 22 bp, Homo sapiens
cggaggggatacattttctgaa

SEQ ID NO: 7354613 - DNA, 22 bp, Homo sapiens
cggaggggatacattttctgaa

SEQ ID NO: 7354614 - DNA, 22 bp, Homo sapiens
cggaggggatacattttctgaa

SEQ ID NO: 7354615 - DNA, 22 bp, Homo sapiens
cggagcgctgggggactctgca

SEQ ID NO: 7354616 - DNA, 22 bp, Homo sapiens
cggagcagaaggcgccgccggc

SEQ ID NO: 7354617 - DNA, 22 bp, Homo sapiens
cggagcgctgggggactctgca

SEQ ID NO: 7354618 - DNA, 22 bp, Homo sapiens
cggagaggtgggggcagcatct

SEQ ID NO: 7354619 - DNA, 22 bp, Homo sapiens
cggagatatttaaggttctctc

SEQ ID NO: 7354620 - DNA, 22 bp, Homo sapiens
cgaggaggaaacgcggagaact

SEQ ID NO: 7354621 - DNA, 22 bp, Homo sapiens
cgaggaggaaacgcggagaact

SEQ ID NO: 7354622 - DNA, 22 bp, Homo sapiens
cgaggcaggcaggcggaggata

SEQ ID NO: 7354623 - DNA, 22 bp, Homo sapiens
cctttgtaagatgtgaagactg

SEQ ID NO: 7354624 - DNA, 22 bp, Homo sapiens
ccttttaagggagactagagat

SEQ ID NO: 7354625 - DNA, 22 bp, Homo sapiens
aggtgctgttaacatatgaggt

SEQ ID NO: 7354626 - DNA, 22 bp, Homo sapiens
aggtgctgttggcagcgggcag

SEQ ID NO: 7354627 - DNA, 22 bp, Homo sapiens
aggtgctgttggcagcgggcag

SEQ ID NO: 7354628 - DNA, 22 bp, Homo sapiens
aggtgctgggcagcagtcattg

SEQ ID NO: 7354629 - DNA, 21 bp, Homo sapiens
aggtgctggcgccccaggaga

SEQ ID NO: 7354630 - DNA, 22 bp, Homo sapiens
aggtgctggcgccccaggagac

SEQ ID NO: 7354631 - DNA, 22 bp, Homo sapiens
aggtgctggcgccccaggagac

SEQ ID NO: 7354632 - DNA, 22 bp, Homo sapiens
aggtgctggcgccccaggagac

SEQ ID NO: 7354633 - DNA, 21 bp, Homo sapiens
aggtgctggcgccccaggaga

SEQ ID NO: 7354634 - DNA, 22 bp, Homo sapiens
aggtgctgaactggtgaggtct

SEQ ID NO: 7354635 - DNA, 17 bp, Homo sapiens
aggtgctggagcatcag

SEQ ID NO: 7354636 - DNA, 22 bp, Homo sapiens
aggtgctctaggtatctacttt

SEQ ID NO: 7354637 - DNA, 19 bp, Homo sapiens
cctgggacttaggctgggt

SEQ ID NO: 7354638 - DNA, 22 bp, Homo sapiens
aggtggctgtattcagctgtaa

SEQ ID NO: 7354639 - DNA, 22 bp, Homo sapiens
aggtggctgcctccccgcgcgg

SEQ ID NO: 7354640 - DNA, 22 bp, Homo sapiens
aggtgggaacccagcagggccc

SEQ ID NO: 7354641 - DNA, 22 bp, Homo sapiens
ccttctctctgaagaccccaaa

SEQ ID NO: 7354642 - DNA, 21 bp, Homo sapiens
aggtggggctgcacctctgct

SEQ ID NO: 7354643 - DNA, 22 bp, Homo sapiens
ccttggccctagcctcaggcaa

SEQ ID NO: 7354644 - DNA, 22 bp, Homo sapiens
ccttggccctagcctcaggcaa

SEQ ID NO: 7354645 - DNA, 22 bp, Homo sapiens
ccttgctcatcccccagtgcct

SEQ ID NO: 7354646 - DNA, 22 bp, Homo sapiens
cctggctcttcagaggttccta

SEQ ID NO: 7354647 - DNA, 22 bp, Homo sapiens
cctggctcttcagaggttccta

SEQ ID NO: 7354648 - DNA, 22 bp, Homo sapiens
cctggccaatctagggctgtta

SEQ ID NO: 7354649 - DNA, 21 bp, Homo sapiens
cctggccaatctgatagggtt

SEQ ID NO: 7354650 - DNA, 20 bp, Homo sapiens
cctggccaatgagataggaa

SEQ ID NO: 7354651 - DNA, 22 bp, Homo sapiens
cctggccagaggcgtgcctgtg

SEQ ID NO: 7354652 - DNA, 22 bp, Homo sapiens
cctggccactcaggtgtggggc

SEQ ID NO: 7354653 - DNA, 22 bp, Homo sapiens
cctggaccaaacactggcctgg

SEQ ID NO: 7354654 - DNA, 22 bp, Homo sapiens
cctggaccaaacactggcctgg

SEQ ID NO: 7354655 - DNA, 22 bp, Homo sapiens
cctggacctgcagcatcagcat

SEQ ID NO: 7354656 - DNA, 22 bp, Homo sapiens
cctggcacataatagtggctca

SEQ ID NO: 7354657 - DNA, 22 bp, Homo sapiens
cctggaaagattgcagttgctg

SEQ ID NO: 7354658 - DNA, 22 bp, Homo sapiens
cctgctctccatacactttcta

SEQ ID NO: 7354659 - DNA, 22 bp, Homo sapiens
cctctctctcctgcacacacac

SEQ ID NO: 7354660 - DNA, 22 bp, Homo sapiens
cctctctccaattttcacctca

SEQ ID NO: 7354661 - DNA, 22 bp, Homo sapiens
cctctgcatgtgcagtaccgag

SEQ ID NO: 7354662 - DNA, 22 bp, Homo sapiens
cctctgagtcctttgggctctc

SEQ ID NO: 7354663 - DNA, 22 bp, Homo sapiens
cctctgagtgctttgagggaga

SEQ ID NO: 7354664 - DNA, 22 bp, Homo sapiens
cctctgagttggcctgtcttgt

SEQ ID NO: 7354665 - DNA, 22 bp, Homo sapiens
cctctgccacctcccacgaggc

SEQ ID NO: 7354666 - DNA, 22 bp, Homo sapiens
cctctgccacctcccacgaggc

SEQ ID NO: 7354667 - DNA, 22 bp, Homo sapiens
cctgcccagcttcccgagtgca

SEQ ID NO: 7354668 - DNA, 22 bp, Homo sapiens
cctgcccctcaaggcctggtgc

SEQ ID NO: 7354669 - DNA, 22 bp, Homo sapiens
agggtctctacgcactagaggg

SEQ ID NO: 7354670 - DNA, 22 bp, Homo sapiens
agggtctgaccaccagtaggga

SEQ ID NO: 7354671 - DNA, 22 bp, Homo sapiens
agggtctgactgaatggaaaag

SEQ ID NO: 7354672 - DNA, 20 bp, Homo sapiens
agggtctgatgtggtggccc

SEQ ID NO: 7354673 - DNA, 20 bp, Homo sapiens
agggtctgctgggtaggaca

SEQ ID NO: 7354674 - DNA, 20 bp, Homo sapiens
agggtctggccctgttcctt

SEQ ID NO: 7354675 - DNA, 22 bp, Homo sapiens
agggtctttatagaggtactta

SEQ ID NO: 7354676 - DNA, 22 bp, Homo sapiens
agggtctttcctgggagccagc

SEQ ID NO: 7354677 - DNA, 22 bp, Homo sapiens
agggtctgttgtttgttctgga

SEQ ID NO: 7354678 - DNA, 22 bp, Homo sapiens
agggtctgtgcaagaacacgcc

SEQ ID NO: 7354679 - DNA, 22 bp, Homo sapiens
agggtctgtgcaagaacacgcc

SEQ ID NO: 7354680 - DNA, 22 bp, Homo sapiens
agggtctgtggatgcatctggg

SEQ ID NO: 7354681 - DNA, 22 bp, Homo sapiens
agggtcctgggtgcagttgctt

SEQ ID NO: 7354682 - DNA, 21 bp, Homo sapiens
agggtcctacagggctcagga

SEQ ID NO: 7354683 - DNA, 22 bp, Homo sapiens
agggtctcagagcctgagaacc

SEQ ID NO: 7354684 - DNA, 22 bp, Homo sapiens
agggtcaggttaagggagtcat

SEQ ID NO: 7354685 - DNA, 17 bp, Homo sapiens
agggtcaggtgaagttc

SEQ ID NO: 7354686 - DNA, 22 bp, Homo sapiens
agggtcagctggctgtcagggg

SEQ ID NO: 7354687 - DNA, 22 bp, Homo sapiens
agggtcagagtcaggtgcagta

SEQ ID NO: 7354688 - DNA, 22 bp, Homo sapiens
agggtcagagtcaggtgcagta

SEQ ID NO: 7354689 - DNA, 20 bp, Homo sapiens
agggtcagagagcgtgagtg

SEQ ID NO: 7354690 - DNA, 20 bp, Homo sapiens
agggtcagagagcgtgagtg

SEQ ID NO: 7354691 - DNA, 22 bp, Homo sapiens
agggagaggttgaaacctcagt

SEQ ID NO: 7354692 - DNA, 22 bp, Homo sapiens
agggagaggctgaactatccta

SEQ ID NO: 7354693 - DNA, 22 bp, Homo sapiens
agggagaaggtttagctgtgag

SEQ ID NO: 7354694 - DNA, 22 bp, Homo sapiens
agggaaggtagaggtcaccggc

SEQ ID NO: 7354695 - DNA, 19 bp, Homo sapiens
agggaatccggctgaggga

SEQ ID NO: 7354696 - DNA, 23 bp, Homo sapiens
agggaagggggcttattccacag

SEQ ID NO: 7354697 - DNA, 22 bp, Homo sapiens
agggaaggcttttgacatttcc

SEQ ID NO: 7354698 - DNA, 19 bp, Homo sapiens
agggaaggattctgtcatt

SEQ ID NO: 7354699 - DNA, 22 bp, Homo sapiens
agggaaggaggttagaacccac

SEQ ID NO: 7354700 - DNA, 22 bp, Homo sapiens
agggaagaagctggtagtaggt

SEQ ID NO: 7354701 - DNA, 22 bp, Homo sapiens
agggaagaagctggtagtaggt

SEQ ID NO: 7354702 - DNA, 22 bp, Homo sapiens
agggaaggaaaagctgtcgctt

SEQ ID NO: 7354703 - DNA, 22 bp, Homo sapiens
aggcttcaaggacagcagccac

SEQ ID NO: 7354704 - DNA, 22 bp, Homo sapiens
ccccaggtggatggctcgcata

SEQ ID NO: 7354705 - DNA, 22 bp, Homo sapiens
ccccattctggccagcccagct

SEQ ID NO: 7354706 - DNA, 22 bp, Homo sapiens
ccccagggtcagtgtgtggagg

SEQ ID NO: 7354707 - DNA, 22 bp, Homo sapiens
ccccagcagactcagggcaggt

SEQ ID NO: 7354708 - DNA, 22 bp, Homo sapiens
agggagagtagatatcaggtgt

SEQ ID NO: 7354709 - DNA, 22 bp, Homo sapiens
agggagcagcagccacaggatg

SEQ ID NO: 7354710 - DNA, 22 bp, Homo sapiens
agggagcagcagccacaggatg

SEQ ID NO: 7354711 - DNA, 22 bp, Homo sapiens
agggagagtttgatgtttcctc

SEQ ID NO: 7354712 - DNA, 22 bp, Homo sapiens
agggagcattgtgacatatcac

SEQ ID NO: 7354713 - DNA, 22 bp, Homo sapiens
agggagcatgggtgaagcaggc

SEQ ID NO: 7354714 - DNA, 22 bp, Homo sapiens
agggagcatgggtgaagcaggc

SEQ ID NO: 7354715 - DNA, 22 bp, Homo sapiens
ccatgcaacagaatccagattt

SEQ ID NO: 7354716 - DNA, 22 bp, Homo sapiens
ccatgagaagttagactagcca

SEQ ID NO: 7354717 - DNA, 22 bp, Homo sapiens
ccatgagacagcaactgaaagt

SEQ ID NO: 7354718 - DNA, 22 bp, Homo sapiens
ccatctccactgtccctgtcaa

SEQ ID NO: 7354719 - DNA, 22 bp, Homo sapiens
ccagtttttccagtgctttctg

SEQ ID NO: 7354720 - DNA, 22 bp, Homo sapiens
ccataatattaaatgcttttgt

SEQ ID NO: 7354721 - DNA, 22 bp, Homo sapiens
ccataaggagccagacattcca

SEQ ID NO: 7354722 - DNA, 22 bp, Homo sapiens
ccataaggttgaaaactgtaca

SEQ ID NO: 7354723 - DNA, 22 bp, Homo sapiens
ccataaggtttggggccatgca

SEQ ID NO: 7354724 - DNA, 22 bp, Homo sapiens
ccatctccaaataccatcacat

SEQ ID NO: 7354725 - DNA, 22 bp, Homo sapiens
ccatctccactgtccctgtcaa

SEQ ID NO: 7354726 - DNA, 22 bp, Homo sapiens
cccagcagttgttggtgcacat

SEQ ID NO: 7354727 - DNA, 22 bp, Homo sapiens
cccagcagtgacccagtgatac

SEQ ID NO: 7354728 - DNA, 22 bp, Homo sapiens
cccagcactcagcaggctcata

SEQ ID NO: 7354729 - DNA, 22 bp, Homo sapiens
aggctgtgttctggttcttagc

SEQ ID NO: 7354730 - DNA, 22 bp, Homo sapiens
aggctgtgttctggttcttagc

SEQ ID NO: 7354731 - DNA, 22 bp, Homo sapiens
aggctgtgtggatgagtcttac

SEQ ID NO: 7354732 - DNA, 22 bp, Homo sapiens
aggctgtgtcctcattttatat

SEQ ID NO: 7354733 - DNA, 22 bp, Homo sapiens
aggctgtgtttcccctggagct

SEQ ID NO: 7354734 - DNA, 22 bp, Homo sapiens
aggctgtgtttcttgcgttttc

SEQ ID NO: 7354735 - DNA, 22 bp, Homo sapiens
aggctgtgtttcccctggagct

SEQ ID NO: 7354736 - DNA, 22 bp, Homo sapiens
cccagctctggaaggtggggga

SEQ ID NO: 7354737 - DNA, 22 bp, Homo sapiens
aggctgtggtgctgaaggaggg

SEQ ID NO: 7354738 - DNA, 22 bp, Homo sapiens
cccagcctctgtttgctcctct

SEQ ID NO: 7354739 - DNA, 22 bp, Homo sapiens
cccagcctgatctcggccagct

SEQ ID NO: 7354740 - DNA, 22 bp, Homo sapiens
cccagcctggtgcactgtgggg

SEQ ID NO: 7354741 - DNA, 22 bp, Homo sapiens
cccagctccttgtttgcatctc

SEQ ID NO: 7354742 - DNA, 22 bp, Homo sapiens
cccagctcgccgccgatgtgcg

SEQ ID NO: 7354743 - DNA, 22 bp, Homo sapiens
cccagctctaggagtggtggca

SEQ ID NO: 7354744 - DNA, 22 bp, Homo sapiens
cccagctccttggatgggcagg

SEQ ID NO: 7354745 - DNA, 22 bp, Homo sapiens
cccagctccttggatgggcagg

SEQ ID NO: 7354746 - DNA, 22 bp, Homo sapiens
cccagcctctggattctgccct

SEQ ID NO: 7354747 - DNA, 18 bp, Homo sapiens
cccagcctctcctttcta

SEQ ID NO: 7354748 - DNA, 22 bp, Homo sapiens
cccagcctctggattctgccct

SEQ ID NO: 7354749 - DNA, 22 bp, Homo sapiens
cccagcctctgggctcacccaa

SEQ ID NO: 7354750 - DNA, 22 bp, Homo sapiens
cccagcctctgggttctgccgg

SEQ ID NO: 7354751 - DNA, 22 bp, Homo sapiens
cccagcctctgggttctgccgg

SEQ ID NO: 7354752 - DNA, 22 bp, Homo sapiens
cccagcctctgtttgctcctct

SEQ ID NO: 7354753 - DNA, 22 bp, Homo sapiens
cccagcctctgtttgctcctct

SEQ ID NO: 7354754 - DNA, 22 bp, Homo sapiens
agggaggaccaatgtgtggtta

SEQ ID NO: 7354755 - DNA, 22 bp, Homo sapiens
agggcagagggtgcctcacctg

SEQ ID NO: 7354756 - DNA, 22 bp, Homo sapiens
agggcagcattgcctttctcca

SEQ ID NO: 7354757 - DNA, 22 bp, Homo sapiens
agggccagccccaccctctctg

SEQ ID NO: 7354758 - DNA, 22 bp, Homo sapiens
agggccagccccaccctctctg

SEQ ID NO: 7354759 - DNA, 22 bp, Homo sapiens
agggccagagtctgtgtagata

SEQ ID NO: 7354760 - DNA, 22 bp, Homo sapiens
agggccagagtctgtgtagata

SEQ ID NO: 7354761 - DNA, 22 bp, Homo sapiens
agggcagctctcacctctggcc

SEQ ID NO: 7354762 - DNA, 22 bp, Homo sapiens
agggcagcctgagtgctggccc

SEQ ID NO: 7354763 - DNA, 22 bp, Homo sapiens
agggcagctaaggtgctgactg

SEQ ID NO: 7354764 - DNA, 22 bp, Homo sapiens
ccctggggagcaggcgaaggag

SEQ ID NO: 7354765 - DNA, 22 bp, Homo sapiens
ccctggcccctcactccgaggc

SEQ ID NO: 7354766 - DNA, 22 bp, Homo sapiens
ccctgggatggattggcaggaa

SEQ ID NO: 7354767 - DNA, 22 bp, Homo sapiens
agggccagggaaacgatcagca

SEQ ID NO: 7354768 - DNA, 22 bp, Homo sapiens
agggccaggctcccatgtcagg

SEQ ID NO: 7354769 - DNA, 22 bp, Homo sapiens
agggccaggctcccatgtcagg

SEQ ID NO: 7354770 - DNA, 22 bp, Homo sapiens
agggccagctagagccctcgcc

SEQ ID NO: 7354771 - DNA, 22 bp, Homo sapiens
agggccagccgacttccagcct

SEQ ID NO: 7354772 - DNA, 18 bp, Homo sapiens
agggccagctgtgagtag

SEQ ID NO: 7354773 - DNA, 22 bp, Homo sapiens
agggccagctgatgagaatgag

SEQ ID NO: 7354774 - DNA, 22 bp, Homo sapiens
agggccagctgcagaattagca

SEQ ID NO: 7354775 - DNA, 22 bp, Homo sapiens
agggccagctgatgagaatgag

SEQ ID NO: 7354776 - DNA, 18 bp, Homo sapiens
agggccagctgtgagtag

SEQ ID NO: 7354777 - DNA, 22 bp, Homo sapiens
agggccaggatcacagccaaga

SEQ ID NO: 7354778 - DNA, 22 bp, Homo sapiens
agggccaggaacacctgaaggg

SEQ ID NO: 7354779 - DNA, 19 bp, Homo sapiens
agggccaggattctggaac

SEQ ID NO: 7354780 - DNA, 22 bp, Homo sapiens
ccctggggctgagggatggccg

SEQ ID NO: 7354781 - DNA, 19 bp, Homo sapiens
ccctgggggtttctggtac

SEQ ID NO: 7354782 - DNA, 22 bp, Homo sapiens
ccctgttttaagttgatattga

SEQ ID NO: 7354783 - DNA, 22 bp, Homo sapiens
cctcagagaaaggtatggctga

SEQ ID NO: 7354784 - DNA, 22 bp, Homo sapiens
cctcagagaaatgtctattcaa

SEQ ID NO: 7354785 - DNA, 22 bp, Homo sapiens
cctcagacccctgctgagcttc

SEQ ID NO: 7354786 - DNA, 22 bp, Homo sapiens
cctcagagactgcatcttccct

SEQ ID NO: 7354787 - DNA, 22 bp, Homo sapiens
cctcccatggagctctgtccat

SEQ ID NO: 7354788 - DNA, 22 bp, Homo sapiens
cctcccagtgcctccagagcag

SEQ ID NO: 7354789 - DNA, 22 bp, Homo sapiens
cctcccagtgcctccagagcag

SEQ ID NO: 7354790 - DNA, 22 bp, Homo sapiens
cctctctccaagggaaatccta

SEQ ID NO: 7354791 - DNA, 22 bp, Homo sapiens
cctctccttgcacccgtcccgc

SEQ ID NO: 7354792 - DNA, 22 bp, Homo sapiens
cctctccttgcacccgtcccgc

SEQ ID NO: 7354793 - DNA, 22 bp, Homo sapiens
cctcgcggcactcgggccggat

SEQ ID NO: 7354794 - DNA, 20 bp, Homo sapiens
cctccaggcacacccatgtg

SEQ ID NO: 7354795 - DNA, 22 bp, Homo sapiens
cctccaggccttgcaggttaac

SEQ ID NO: 7354796 - DNA, 21 bp, Homo sapiens
cctccaggagcagagccctga

SEQ ID NO: 7354797 - DNA, 22 bp, Homo sapiens
cctccaggaggaaatggaacac

SEQ ID NO: 7354798 - DNA, 22 bp, Homo sapiens
cctccaggataagtcagggcct

SEQ ID NO: 7354799 - DNA, 22 bp, Homo sapiens
cctccaggaggaaatggaacac

SEQ ID NO: 7354800 - DNA, 22 bp, Homo sapiens
cctccaggaacttgagagacac

SEQ ID NO: 7354801 - DNA, 22 bp, Homo sapiens
aggctccattttcctgcagctg

SEQ ID NO: 7354802 - DNA, 22 bp, Homo sapiens
aggctccattttcctgcagctg

SEQ ID NO: 7354803 - DNA, 22 bp, Homo sapiens
aggctccattcatgtgaaggca

SEQ ID NO: 7354804 - DNA, 22 bp, Homo sapiens
ccaggctctatccctccttctt

SEQ ID NO: 7354805 - DNA, 22 bp, Homo sapiens
ccaggctctgagaggaatgtga

SEQ ID NO: 7354806 - DNA, 22 bp, Homo sapiens
ccaggctctgagcctcactctt

SEQ ID NO: 7354807 - DNA, 22 bp, Homo sapiens
aggctccagtctcctctggcag

SEQ ID NO: 7354808 - DNA, 22 bp, Homo sapiens
aggctccataccatctccggag

SEQ ID NO: 7354809 - DNA, 22 bp, Homo sapiens
aggctccatggttctccctcag

SEQ ID NO: 7354810 - DNA, 22 bp, Homo sapiens
aggctccatgctaagcgatatg

SEQ ID NO: 7354811 - DNA, 22 bp, Homo sapiens
ccaggcccgttcccttctccag

SEQ ID NO: 7354812 - DNA, 22 bp, Homo sapiens
ccaggcccgttcccttctccag

SEQ ID NO: 7354813 - DNA, 22 bp, Homo sapiens
ccaggcccttgcaagtcccacc

SEQ ID NO: 7354814 - DNA, 22 bp, Homo sapiens
aggcctcacacaacagatgcat

SEQ ID NO: 7354815 - DNA, 22 bp, Homo sapiens
aggcctcacacaacagatgcat

SEQ ID NO: 7354816 - DNA, 22 bp, Homo sapiens
aggcctcagtgatcatcatcag

SEQ ID NO: 7354817 - DNA, 17 bp, Homo sapiens
aggcctccctccaggcc

SEQ ID NO: 7354818 - DNA, 21 bp, Homo sapiens
aggcctccctgttgacagggc

SEQ ID NO: 7354819 - DNA, 22 bp, Homo sapiens
aggcctcatgtcaaagcagcaa

SEQ ID NO: 7354820 - DNA, 22 bp, Homo sapiens
aggcctcagtttgtcatctgta

SEQ ID NO: 7354821 - DNA, 22 bp, Homo sapiens
aggcctcatagtagacctgccc

SEQ ID NO: 7354822 - DNA, 22 bp, Homo sapiens
ccaggccaaattcagtcagcag

SEQ ID NO: 7354823 - DNA, 21 bp, Homo sapiens
ccaggcatgactgcagagagc

SEQ ID NO: 7354824 - DNA, 22 bp, Homo sapiens
ccaggcatcacgggcatgtggc

SEQ ID NO: 7354825 - DNA, 21 bp, Homo sapiens
ccaggcatgactgcagagagc

SEQ ID NO: 7354826 - DNA, 22 bp, Homo sapiens
ccaggcatcacgggcatgtggc

SEQ ID NO: 7354827 - DNA, 22 bp, Homo sapiens
ccaggcacttcatcattagggt

SEQ ID NO: 7354828 - DNA, 23 bp, Homo sapiens
ccaggcagtagctattgaagtga

SEQ ID NO: 7354829 - DNA, 22 bp, Homo sapiens
ccaggcagggctcaaggaacct

SEQ ID NO: 7354830 - DNA, 22 bp, Homo sapiens
ccagttacaagtgattcttggt

SEQ ID NO: 7354831 - DNA, 22 bp, Homo sapiens
ccagttactaacacctttggct

SEQ ID NO: 7354832 - DNA, 23 bp, Homo sapiens
ccagtgattgcctggaaggaggt

SEQ ID NO: 7354833 - DNA, 22 bp, Homo sapiens
aggctgagcctgggcgtggtgg

SEQ ID NO: 7354834 - DNA, 22 bp, Homo sapiens
aggctccttgttcatcatccat

SEQ ID NO: 7354835 - DNA, 19 bp, Homo sapiens
aggctctgagctcctggag

SEQ ID NO: 7354836 - DNA, 22 bp, Homo sapiens
aggctctgagtagagctgccag

SEQ ID NO: 7354837 - DNA, 22 bp, Homo sapiens
aggctctgagtagagctgccag

SEQ ID NO: 7354838 - DNA, 22 bp, Homo sapiens
aggctctgatcaggtggctgtg

SEQ ID NO: 7354839 - DNA, 22 bp, Homo sapiens
aggctctgatgcaagcccaggg

SEQ ID NO: 7354840 - DNA, 22 bp, Homo sapiens
aggctctgcagaccccagctgt

SEQ ID NO: 7354841 - DNA, 22 bp, Homo sapiens
aggctctgcagaccccagctgt

SEQ ID NO: 7354842 - DNA, 22 bp, Homo sapiens
aggctctgcagtgctggaggac

SEQ ID NO: 7354843 - DNA, 22 bp, Homo sapiens
aggctctgcatccaggctttat

SEQ ID NO: 7354844 - DNA, 22 bp, Homo sapiens
aggctctgcagtgctggaggac

SEQ ID NO: 7354845 - DNA, 22 bp, Homo sapiens
aggctctgcagtgctggaggac

SEQ ID NO: 7354846 - DNA, 22 bp, Homo sapiens
aggctctgccaattccttcctc

SEQ ID NO: 7354847 - DNA, 20 bp, Homo sapiens
aggctctgcctgcaggccca

SEQ ID NO: 7354848 - DNA, 22 bp, Homo sapiens
aggcagtggagctggaataggc

SEQ ID NO: 7354849 - DNA, 22 bp, Homo sapiens
aggcagtggctgagaccagggg

SEQ ID NO: 7354850 - DNA, 22 bp, Homo sapiens
aggcagtctatctctggagcct

SEQ ID NO: 7354851 - DNA, 22 bp, Homo sapiens
aggcagtgatgagtcatgaata

SEQ ID NO: 7354852 - DNA, 22 bp, Homo sapiens
aggcagtgagtgtgacttcaca

SEQ ID NO: 7354853 - DNA, 22 bp, Homo sapiens
aggcagtgctcaagacagcagc

SEQ ID NO: 7354854 - DNA, 22 bp, Homo sapiens
aggcagtgcctggaccccagct

SEQ ID NO: 7354855 - DNA, 22 bp, Homo sapiens
aggcagcccacaggacacagga

SEQ ID NO: 7354856 - DNA, 22 bp, Homo sapiens
aggcagcctatggggagctcag

SEQ ID NO: 7354857 - DNA, 22 bp, Homo sapiens
aggcagtggctgagaccagggg

SEQ ID NO: 7354858 - DNA, 23 bp, Homo sapiens
aggcagtgggggccactttgctt

SEQ ID NO: 7354859 - DNA, 23 bp, Homo sapiens
aggcagtggtggtaacatgtcaa

SEQ ID NO: 7354860 - DNA, 22 bp, Homo sapiens
aggcagttggtcattgctcttt

SEQ ID NO: 7354861 - DNA, 22 bp, Homo sapiens
aggcatctgagtttgcaagctt

SEQ ID NO: 7354862 - DNA, 20 bp, Homo sapiens
aggcatctgagtcacatctt

SEQ ID NO: 7354863 - DNA, 22 bp, Homo sapiens
aggcatctgctgcccttctgga

SEQ ID NO: 7354864 - DNA, 22 bp, Homo sapiens
aggcatggcatggggcagatgt

SEQ ID NO: 7354865 - DNA, 21 bp, Homo sapiens
ccactgctcttccctagggcc

SEQ ID NO: 7354866 - DNA, 22 bp, Homo sapiens
ccactggagatgtcagacaggt

SEQ ID NO: 7354867 - DNA, 22 bp, Homo sapiens
ccactggcatccagctgccatc

SEQ ID NO: 7354868 - DNA, 22 bp, Homo sapiens
ccactggctgtcagcaggactc

SEQ ID NO: 7354869 - DNA, 22 bp, Homo sapiens
ccactggcagttggctagcctt

SEQ ID NO: 7354870 - DNA, 22 bp, Homo sapiens
aggccaatcctgggtgcattga

SEQ ID NO: 7354871 - DNA, 22 bp, Homo sapiens
aggccagctgccacccggtccg

SEQ ID NO: 7354872 - DNA, 22 bp, Homo sapiens
aggccagctctacccttggact

SEQ ID NO: 7354873 - DNA, 22 bp, Homo sapiens
aggccagcctcaggcagggacc

SEQ ID NO: 7354874 - DNA, 23 bp, Homo sapiens
aggccagcgcagacaccgagcac

SEQ ID NO: 7354875 - DNA, 18 bp, Homo sapiens
aggcccgttgtgtggaat

SEQ ID NO: 7354876 - DNA, 22 bp, Homo sapiens
aggccctgaagtcggcccctca

SEQ ID NO: 7354877 - DNA, 22 bp, Homo sapiens
aggccctgggttagggcccact

SEQ ID NO: 7354878 - DNA, 22 bp, Homo sapiens
aggccgaggcgggcggatcacc

SEQ ID NO: 7354879 - DNA, 22 bp, Homo sapiens
aggccggcgcttcccaggaggc

SEQ ID NO: 7354880 - DNA, 22 bp, Homo sapiens
aggccgtgtgagcatgtgtgag

SEQ ID NO: 7354881 - DNA, 20 bp, Homo sapiens
aggccccaggtggacactag

SEQ ID NO: 7354882 - DNA, 22 bp, Homo sapiens
aggccccaaagcagtgcaagta

SEQ ID NO: 7354883 - DNA, 22 bp, Homo sapiens
aggccccaaagcagtgcaagta

SEQ ID NO: 7354884 - DNA, 22 bp, Homo sapiens
aggcccatagtagctctgggca

SEQ ID NO: 7354885 - DNA, 22 bp, Homo sapiens
aggccagcttctaccctctgtt

SEQ ID NO: 7354886 - DNA, 22 bp, Homo sapiens
aggccagcttccagaggggcag

SEQ ID NO: 7354887 - DNA, 22 bp, Homo sapiens
aggccaggatagcatggatcag

SEQ ID NO: 7354888 - DNA, 22 bp, Homo sapiens
aggagaggcatcaagaaaatcg

SEQ ID NO: 7354889 - DNA, 22 bp, Homo sapiens
aggagaggcatcaagaaaatcg

SEQ ID NO: 7354890 - DNA, 22 bp, Homo sapiens
aggagaggcatcaagaaaatcg

SEQ ID NO: 7354891 - DNA, 22 bp, Homo sapiens
aggagaggctctaactctgtgt

SEQ ID NO: 7354892 - DNA, 22 bp, Homo sapiens
aggagaggctctaactctgtgt

SEQ ID NO: 7354893 - DNA, 22 bp, Homo sapiens
aggagaggcatcaagaaaatcg

SEQ ID NO: 7354894 - DNA, 22 bp, Homo sapiens
aggagagaggttttaaatgggg

SEQ ID NO: 7354895 - DNA, 22 bp, Homo sapiens
aggagagagctgagctttgctg

SEQ ID NO: 7354896 - DNA, 22 bp, Homo sapiens
aggagagaattactgggtgtca

SEQ ID NO: 7354897 - DNA, 22 bp, Homo sapiens
aggagcctggctggcccacagg

SEQ ID NO: 7354898 - DNA, 22 bp, Homo sapiens
aggagcctggctggcccacagg

SEQ ID NO: 7354899 - DNA, 22 bp, Homo sapiens
aggagccatgagcaggaggcaa

SEQ ID NO: 7354900 - DNA, 22 bp, Homo sapiens
aggagatagtcaaagcttcttg

SEQ ID NO: 7354901 - DNA, 22 bp, Homo sapiens
aggagataagaggctggtgtgg

SEQ ID NO: 7354902 - DNA, 22 bp, Homo sapiens
aggagagggtggcattaagttt

SEQ ID NO: 7354903 - DNA, 22 bp, Homo sapiens
aggagaggtctcccttccccag

SEQ ID NO: 7354904 - DNA, 22 bp, Homo sapiens
aggagaggtctcccttccccag

SEQ ID NO: 7354905 - DNA, 22 bp, Homo sapiens
aggagagtaccattgggccgca

SEQ ID NO: 7354906 - DNA, 22 bp, Homo sapiens
aggagagttcacactggtcaga

SEQ ID NO: 7354907 - DNA, 22 bp, Homo sapiens
aggagagtcttgagtcactggt

SEQ ID NO: 7354908 - DNA, 22 bp, Homo sapiens
aggaggaggctggagtacaccc

SEQ ID NO: 7354909 - DNA, 22 bp, Homo sapiens
aggaggactctctgagccagcc

SEQ ID NO: 7354910 - DNA, 17 bp, Homo sapiens
aggaggatcagagagta

SEQ ID NO: 7354911 - DNA, 22 bp, Homo sapiens
aggagctgtgaatgggaggggt

SEQ ID NO: 7354912 - DNA, 20 bp, Homo sapiens
aggagctgaattagagggtt

SEQ ID NO: 7354913 - DNA, 20 bp, Homo sapiens
aggagctgaattagagggtt

SEQ ID NO: 7354914 - DNA, 20 bp, Homo sapiens
aggaaggaagtttgcatgga

SEQ ID NO: 7354915 - DNA, 22 bp, Homo sapiens
aggaaggactccatggtccgtc

SEQ ID NO: 7354916 - DNA, 22 bp, Homo sapiens
aggaaggactgcagcatttggt

SEQ ID NO: 7354917 - DNA, 22 bp, Homo sapiens
aggaaggaagagacaccatttg

SEQ ID NO: 7354918 - DNA, 20 bp, Homo sapiens
aggaaggaagtttgcatgga

SEQ ID NO: 7354919 - DNA, 19 bp, Homo sapiens
aggaaggaacctgagtctg

SEQ ID NO: 7354920 - DNA, 22 bp, Homo sapiens
aggaagctggggtgttcttcat

SEQ ID NO: 7354921 - DNA, 22 bp, Homo sapiens
cagtcctgcccaggctgacaga

SEQ ID NO: 7354922 - DNA, 22 bp, Homo sapiens
cagtcctgaggaagagctgctg

SEQ ID NO: 7354923 - DNA, 22 bp, Homo sapiens
cagtcctgaggaagagctgctg

SEQ ID NO: 7354924 - DNA, 22 bp, Homo sapiens
cagtcctgagctcctgggctga

SEQ ID NO: 7354925 - DNA, 22 bp, Homo sapiens
cagtcctgggcacagccctggg

SEQ ID NO: 7354926 - DNA, 20 bp, Homo sapiens
cagtcctgccccttggggac

SEQ ID NO: 7354927 - DNA, 21 bp, Homo sapiens
aggagaaacacaggtcagccc

SEQ ID NO: 7354928 - DNA, 21 bp, Homo sapiens
aggacaggaactggctgaata

SEQ ID NO: 7354929 - DNA, 21 bp, Homo sapiens
aggacaggaactggctgaata

SEQ ID NO: 7354930 - DNA, 18 bp, Homo sapiens
aggagaaagggaccaggg

SEQ ID NO: 7354931 - DNA, 22 bp, Homo sapiens
aggagaaagactggacagccaa

SEQ ID NO: 7354932 - DNA, 20 bp, Homo sapiens
aggagaaattcgggacacct

SEQ ID NO: 7354933 - DNA, 22 bp, Homo sapiens
aggagaaatccatcgagaatgg

SEQ ID NO: 7354934 - DNA, 22 bp, Homo sapiens
aggacagcatatgggaaccagt

SEQ ID NO: 7354935 - DNA, 22 bp, Homo sapiens
aggacagcccttgagagcacat

SEQ ID NO: 7354936 - DNA, 21 bp, Homo sapiens
aggacaggaactggctgaata

SEQ ID NO: 7354937 - DNA, 22 bp, Homo sapiens
cagtctctgccacttctaagct

SEQ ID NO: 7354938 - DNA, 22 bp, Homo sapiens
cagtctctctccttgcaggcgt

SEQ ID NO: 7354939 - DNA, 23 bp, Homo sapiens
aggagaagagatttccacatgca

SEQ ID NO: 7354940 - DNA, 19 bp, Homo sapiens
aggagaagactctctcccc

SEQ ID NO: 7354941 - DNA, 17 bp, Homo sapiens
catctttaaaatcctga

SEQ ID NO: 7354942 - DNA, 22 bp, Homo sapiens
catctttaaaatgggaacaaca

SEQ ID NO: 7354943 - DNA, 22 bp, Homo sapiens
catgaaacatcagagatttctc

SEQ ID NO: 7354944 - DNA, 22 bp, Homo sapiens
catgaaatattagtaactgttt

SEQ ID NO: 7354945 - DNA, 22 bp, Homo sapiens
catgaaatgtgttaatctcttg

SEQ ID NO: 7354946 - DNA, 22 bp, Homo sapiens
catgaaatctgagtatgtttcc

SEQ ID NO: 7354947 - DNA, 22 bp, Homo sapiens
catgaaatgttagaattagaca

SEQ ID NO: 7354948 - DNA, 22 bp, Homo sapiens
catgaaatgttagaattagaca

SEQ ID NO: 7354949 - DNA, 22 bp, Homo sapiens
catgaaatgttagaattagaca

SEQ ID NO: 7354950 - DNA, 22 bp, Homo sapiens
aggaggtgcgtggtgatcccct

SEQ ID NO: 7354951 - DNA, 22 bp, Homo sapiens
catgcacactgcaacaaggact

SEQ ID NO: 7354952 - DNA, 22 bp, Homo sapiens
catgcacttacctgaaattcaa

SEQ ID NO: 7354953 - DNA, 22 bp, Homo sapiens
catgcacagtgatatctgaaga

SEQ ID NO: 7354954 - DNA, 22 bp, Homo sapiens
catgcacagtgatatctgaaga

SEQ ID NO: 7354955 - DNA, 22 bp, Homo sapiens
aggaggtgctagagaagatgtt

SEQ ID NO: 7354956 - DNA, 22 bp, Homo sapiens
aggaggtggcctgagcgtgccc

SEQ ID NO: 7354957 - DNA, 22 bp, Homo sapiens
aggaggtggcctgagcgtgccc

SEQ ID NO: 7354958 - DNA, 22 bp, Homo sapiens
catgcaggcacccagagcccac

SEQ ID NO: 7354959 - DNA, 22 bp, Homo sapiens
catgcactttgatggagagcgt

SEQ ID NO: 7354960 - DNA, 22 bp, Homo sapiens
catgcctgtaatcccagcactt

SEQ ID NO: 7354961 - DNA, 22 bp, Homo sapiens
aggcacaggaatgtcatccagt

SEQ ID NO: 7354962 - DNA, 22 bp, Homo sapiens
aggcacagcctcccttcacatg

SEQ ID NO: 7354963 - DNA, 22 bp, Homo sapiens
aggcacagcctcccttcacatg

SEQ ID NO: 7354964 - DNA, 22 bp, Homo sapiens
aggcaattgtttgtgtaatagg

SEQ ID NO: 7354965 - DNA, 22 bp, Homo sapiens
aggcaatttggaatctgtactc

SEQ ID NO: 7354966 - DNA, 22 bp, Homo sapiens
aggcaattagtcttttgttatt

SEQ ID NO: 7354967 - DNA, 22 bp, Homo sapiens
aggcaatggggcttcaggcagg

SEQ ID NO: 7354968 - DNA, 19 bp, Homo sapiens
aggcagaggcttggctagc

SEQ ID NO: 7354969 - DNA, 22 bp, Homo sapiens
aggcagcagaaaacaaatggtt

SEQ ID NO: 7354970 - DNA, 21 bp, Homo sapiens
cattcctcccctgacgtcagc

SEQ ID NO: 7354971 - DNA, 21 bp, Homo sapiens
cattcctcggctcatagagga

SEQ ID NO: 7354972 - DNA, 22 bp, Homo sapiens
catggcggtcaggatgtaggtg

SEQ ID NO: 7354973 - DNA, 22 bp, Homo sapiens
cattatgtgggaaaatgttctt

SEQ ID NO: 7354974 - DNA, 22 bp, Homo sapiens
cattatgtgagtgattaattca

SEQ ID NO: 7354975 - DNA, 22 bp, Homo sapiens
cattatgtgcgtacatgtatct

SEQ ID NO: 7354976 - DNA, 22 bp, Homo sapiens
cattattaattcagcacatgct

SEQ ID NO: 7354977 - DNA, 22 bp, Homo sapiens
cattatgaatggagtttgaggt

SEQ ID NO: 7354978 - DNA, 22 bp, Homo sapiens
aggcagcagtcatgaggaaaga

SEQ ID NO: 7354979 - DNA, 19 bp, Homo sapiens
aggcagcattctggggctt

SEQ ID NO: 7354980 - DNA, 22 bp, Homo sapiens
aggcagccagatggcagcctgc

SEQ ID NO: 7354981 - DNA, 22 bp, Homo sapiens
aggcagccacatgagctcctga

SEQ ID NO: 7354982 - DNA, 22 bp, Homo sapiens
catttacagtgagagtttttac

SEQ ID NO: 7354983 - DNA, 22 bp, Homo sapiens
aggcagcagaggttgaggaaag

SEQ ID NO: 7354984 - DNA, 18 bp, Homo sapiens
aggcagcagcatcttctc

SEQ ID NO: 7354985 - DNA, 22 bp, Homo sapiens
agcttgttagggcagtggtcgc

SEQ ID NO: 7354986 - DNA, 22 bp, Homo sapiens
cagggccagcccactagcgagg

SEQ ID NO: 7354987 - DNA, 22 bp, Homo sapiens
cagggccagcccgacgtggtgc

SEQ ID NO: 7354988 - DNA, 22 bp, Homo sapiens
cagggccagccgcagcatccac

SEQ ID NO: 7354989 - DNA, 22 bp, Homo sapiens
cagggccagagagggctggctg

SEQ ID NO: 7354990 - DNA, 22 bp, Homo sapiens
cagggccagccatcctgctggg

SEQ ID NO: 7354991 - DNA, 22 bp, Homo sapiens
aggaaagctcccagtagggctc

SEQ ID NO: 7354992 - DNA, 22 bp, Homo sapiens
aggaaatgggaatagatggtat

SEQ ID NO: 7354993 - DNA, 22 bp, Homo sapiens
aggaaaggggtaggtgtggacg

SEQ ID NO: 7354994 - DNA, 22 bp, Homo sapiens
cagggccagcgtctcgggctat

SEQ ID NO: 7354995 - DNA, 22 bp, Homo sapiens
cagggccagcgcccaggcccag

SEQ ID NO: 7354996 - DNA, 22 bp, Homo sapiens
aggaaattgtctttttccttgt

SEQ ID NO: 7354997 - DNA, 22 bp, Homo sapiens
aggaagctcagagaagtctttt

SEQ ID NO: 7354998 - DNA, 22 bp, Homo sapiens
aggaacctaagagcctgcagtc

SEQ ID NO: 7354999 - DNA, 23 bp, Homo sapiens
aggaaccttagaattcactgcca

SEQ ID NO: 7355000 - DNA, 19 bp, Homo sapiens
aggaaccttcattgctccc

SEQ ID NO: 7355001 - DNA, 22 bp, Homo sapiens
agcttaaagtatttaaatttca

SEQ ID NO: 7355002 - DNA, 22 bp, Homo sapiens
agcttacagttcaatgacaaag

SEQ ID NO: 7355003 - DNA, 18 bp, Homo sapiens
agcttgcctcaagctttt

SEQ ID NO: 7355004 - DNA, 22 bp, Homo sapiens
agcttgccagtcatatctgttt

SEQ ID NO: 7355005 - DNA, 22 bp, Homo sapiens
agcttgccagttgaagatcttc

SEQ ID NO: 7355006 - DNA, 20 bp, Homo sapiens
agcttgcccctgtctttgcc

SEQ ID NO: 7355007 - DNA, 22 bp, Homo sapiens
agcttgcctgtttcctagggct

SEQ ID NO: 7355008 - DNA, 22 bp, Homo sapiens
agcttgcctccccctcttagga

SEQ ID NO: 7355009 - DNA, 22 bp, Homo sapiens
agcttgcctcttaatcacctca

SEQ ID NO: 7355010 - DNA, 20 bp, Homo sapiens
agctgtttacatggatttct

SEQ ID NO: 7355011 - DNA, 22 bp, Homo sapiens
agctgttttcctggttagagac

SEQ ID NO: 7355012 - DNA, 22 bp, Homo sapiens
agctgttttactggttgtataa

SEQ ID NO: 7355013 - DNA, 22 bp, Homo sapiens
agctgtgtggtgtctgacagct

SEQ ID NO: 7355014 - DNA, 23 bp, Homo sapiens
agctgtgtggccttgggcaagtt

SEQ ID NO: 7355015 - DNA, 22 bp, Homo sapiens
agctgtgttattagaaacctgc

SEQ ID NO: 7355016 - DNA, 22 bp, Homo sapiens
agctgtgttctggttgattcac

SEQ ID NO: 7355017 - DNA, 22 bp, Homo sapiens
agctgtgtcctgaagacactgc

SEQ ID NO: 7355018 - DNA, 22 bp, Homo sapiens
agctgtgtgcatttgggtctca

SEQ ID NO: 7355019 - DNA, 22 bp, Homo sapiens
agctgtgtgactctaagcaagt

SEQ ID NO: 7355020 - DNA, 22 bp, Homo sapiens
caggcctgggttcaaatccctt

SEQ ID NO: 7355021 - DNA, 22 bp, Homo sapiens
caggccggtgattctggatgta

SEQ ID NO: 7355022 - DNA, 22 bp, Homo sapiens
caggcctcaggggctcaggctg

SEQ ID NO: 7355023 - DNA, 22 bp, Homo sapiens
caggcctcaccagcggagctgc

SEQ ID NO: 7355024 - DNA, 22 bp, Homo sapiens
caggcctcaggggctcaggctg

SEQ ID NO: 7355025 - DNA, 21 bp, Homo sapiens
caggccccaggcctggggtgc

SEQ ID NO: 7355026 - DNA, 22 bp, Homo sapiens
caggaggttgtaagagcaggcc

SEQ ID NO: 7355027 - DNA, 22 bp, Homo sapiens
caggaggtgccctctagtggca

SEQ ID NO: 7355028 - DNA, 22 bp, Homo sapiens
caggaggtgacttccaggggtt

SEQ ID NO: 7355029 - DNA, 22 bp, Homo sapiens
caggaggtgaaggagaaccagt

SEQ ID NO: 7355030 - DNA, 22 bp, Homo sapiens
caggagggtgtggaaaactggg

SEQ ID NO: 7355031 - DNA, 22 bp, Homo sapiens
agctggcctccgggtgcctggg

SEQ ID NO: 7355032 - DNA, 22 bp, Homo sapiens
agctggcttgcatgctaaggag

SEQ ID NO: 7355033 - DNA, 22 bp, Homo sapiens
caggacacttgttcttctctgc

SEQ ID NO: 7355034 - DNA, 22 bp, Homo sapiens
caggacagaaataaggaatata

SEQ ID NO: 7355035 - DNA, 22 bp, Homo sapiens
caggacagacagaatgcctaac

SEQ ID NO: 7355036 - DNA, 22 bp, Homo sapiens
caggacagaccaagatcgtgct

SEQ ID NO: 7355037 - DNA, 19 bp, Homo sapiens
caggacagacttcaaagcc

SEQ ID NO: 7355038 - DNA, 22 bp, Homo sapiens
caggacagaccaagatcgtgct

SEQ ID NO: 7355039 - DNA, 21 bp, Homo sapiens
caggaaaagcggaagtctagc

SEQ ID NO: 7355040 - DNA, 22 bp, Homo sapiens
agctgctgagagtctgccgggc

SEQ ID NO: 7355041 - DNA, 22 bp, Homo sapiens
agctgaggctctgagagggaag

SEQ ID NO: 7355042 - DNA, 23 bp, Homo sapiens
agctgaggctgtgggtgtcagag

SEQ ID NO: 7355043 - DNA, 23 bp, Homo sapiens
agctgaggctgtgggtgtcagag

SEQ ID NO: 7355044 - DNA, 22 bp, Homo sapiens
agctgaggctctgagagggaag

SEQ ID NO: 7355045 - DNA, 22 bp, Homo sapiens
agctgaggcctgatttcgccgt

SEQ ID NO: 7355046 - DNA, 22 bp, Homo sapiens
agctgaggcatgatgctatcag

SEQ ID NO: 7355047 - DNA, 22 bp, Homo sapiens
cagcttgcacacatattagacg

SEQ ID NO: 7355048 - DNA, 22 bp, Homo sapiens
agctgcaggttcagcattccac

SEQ ID NO: 7355049 - DNA, 22 bp, Homo sapiens
cagctcctgggccatctcctag

SEQ ID NO: 7355050 - DNA, 22 bp, Homo sapiens
agctctgctactctgtggggtg

SEQ ID NO: 7355051 - DNA, 22 bp, Homo sapiens
cagctctactgggcaccattcg

SEQ ID NO: 7355052 - DNA, 22 bp, Homo sapiens
cagcttctggcgtggagcctga

SEQ ID NO: 7355053 - DNA, 22 bp, Homo sapiens
atggacagtactgagtggacta

SEQ ID NO: 7355054 - DNA, 22 bp, Homo sapiens
agactctgataagcaactcttg

SEQ ID NO: 7355055 - DNA, 22 bp, Homo sapiens
agactctgaagtcattgcatga

SEQ ID NO: 7355056 - DNA, 22 bp, Homo sapiens
agacggattacctgaggtcagg

SEQ ID NO: 7355057 - DNA, 22 bp, Homo sapiens
atgcaggggcagcagagcctgg

SEQ ID NO: 7355058 - DNA, 22 bp, Homo sapiens
atgcagggattaaatgactgcc

SEQ ID NO: 7355059 - DNA, 22 bp, Homo sapiens
atggaaagggaagcaaggaaca

SEQ ID NO: 7355060 - DNA, 22 bp, Homo sapiens
atggaaaggctgtggaaactta

SEQ ID NO: 7355061 - DNA, 22 bp, Homo sapiens
atggaaagctaagccatttacc

SEQ ID NO: 7355062 - DNA, 22 bp, Homo sapiens
atggaaaggctgtggaaactta

SEQ ID NO: 7355063 - DNA, 22 bp, Homo sapiens
atggaaagccagtgttccatca

SEQ ID NO: 7355064 - DNA, 22 bp, Homo sapiens
atggaaatacagccagagcaga

SEQ ID NO: 7355065 - DNA, 22 bp, Homo sapiens
atggaaagtgcatggaagtcat

SEQ ID NO: 7355066 - DNA, 22 bp, Homo sapiens
atggaaagtgcatggaagtcat

SEQ ID NO: 7355067 - DNA, 22 bp, Homo sapiens
atggacagtgctgcttcagagg

SEQ ID NO: 7355068 - DNA, 22 bp, Homo sapiens
atggacagtactgagtggacta

SEQ ID NO: 7355069 - DNA, 22 bp, Homo sapiens
atggataacccagttcatttct

SEQ ID NO: 7355070 - DNA, 22 bp, Homo sapiens
atggctggctttacttgctttg

SEQ ID NO: 7355071 - DNA, 22 bp, Homo sapiens
atggctggctgagcctggttat

SEQ ID NO: 7355072 - DNA, 21 bp, Homo sapiens
atggctggtggctcagcctcc

SEQ ID NO: 7355073 - DNA, 22 bp, Homo sapiens
atggtttgtgtggcccagatga

SEQ ID NO: 7355074 - DNA, 22 bp, Homo sapiens
atggtttgtaacccaatactcc

SEQ ID NO: 7355075 - DNA, 22 bp, Homo sapiens
atgtacacacaagtttgcacgc

SEQ ID NO: 7355076 - DNA, 22 bp, Homo sapiens
atgtaaacaaagatcttcctgc

SEQ ID NO: 7355077 - DNA, 22 bp, Homo sapiens
atgtaaacactcactgtgcccc

SEQ ID NO: 7355078 - DNA, 22 bp, Homo sapiens
atgggaggcagcagagcccagc

SEQ ID NO: 7355079 - DNA, 22 bp, Homo sapiens
atggctgtaaattcagagatgg

SEQ ID NO: 7355080 - DNA, 22 bp, Homo sapiens
atggctgtccagtttctagaga

SEQ ID NO: 7355081 - DNA, 22 bp, Homo sapiens
atggctgtagtcatctgaaggc

SEQ ID NO: 7355082 - DNA, 22 bp, Homo sapiens
atggctgtgtgactgagttcta

SEQ ID NO: 7355083 - DNA, 22 bp, Homo sapiens
atggctgtgcagagattgggaa

SEQ ID NO: 7355084 - DNA, 22 bp, Homo sapiens
atggctgtgttagatgctaagt

SEQ ID NO: 7355085 - DNA, 22 bp, Homo sapiens
atggctgtgagacaaagagctg

SEQ ID NO: 7355086 - DNA, 22 bp, Homo sapiens
atggctgtgagcaggcagcttc

SEQ ID NO: 7355087 - DNA, 22 bp, Homo sapiens
atggctgtgaaggtcacaccct

SEQ ID NO: 7355088 - DNA, 22 bp, Homo sapiens
atggctgtgaaatggtaggtgg

SEQ ID NO: 7355089 - DNA, 19 bp, Homo sapiens
atggctgtgttccagtaaa

SEQ ID NO: 7355090 - DNA, 22 bp, Homo sapiens
atgtcaaatgctgcaaactcat

SEQ ID NO: 7355091 - DNA, 21 bp, Homo sapiens
atgtcaaatgctttattttat

SEQ ID NO: 7355092 - DNA, 22 bp, Homo sapiens
atgtacatactgcattttcaaa

SEQ ID NO: 7355093 - DNA, 22 bp, Homo sapiens
atgtccaatttcagagtctcat

SEQ ID NO: 7355094 - DNA, 22 bp, Homo sapiens
atgtacagccacttcacagtta

SEQ ID NO: 7355095 - DNA, 22 bp, Homo sapiens
atgtacataaaatgtataatga

SEQ ID NO: 7355096 - DNA, 22 bp, Homo sapiens
atgtacataaaatgtataatga

SEQ ID NO: 7355097 - DNA, 22 bp, Homo sapiens
atgtctgtacgagttacaatgg

SEQ ID NO: 7355098 - DNA, 22 bp, Homo sapiens
atgtctgtacgagttacaatgg

SEQ ID NO: 7355099 - DNA, 19 bp, Homo sapiens
atgtctgttgaatttcata

SEQ ID NO: 7355100 - DNA, 22 bp, Homo sapiens
atgtctgtggcattatatgttt

SEQ ID NO: 7355101 - DNA, 22 bp, Homo sapiens
agacaggtagcaggacagatat

SEQ ID NO: 7355102 - DNA, 22 bp, Homo sapiens
agacagtaataaaataggtaag

SEQ ID NO: 7355103 - DNA, 22 bp, Homo sapiens
atgcaggatgcagaggggcccg

SEQ ID NO: 7355104 - DNA, 22 bp, Homo sapiens
atgcaggatgtcaacgcatcct

SEQ ID NO: 7355105 - DNA, 21 bp, Homo sapiens
atgcaggctgctcagaagcaa

SEQ ID NO: 7355106 - DNA, 22 bp, Homo sapiens
agacacagtttgggatgggttg

SEQ ID NO: 7355107 - DNA, 22 bp, Homo sapiens
agacacagtgttgaaggctagt

SEQ ID NO: 7355108 - DNA, 23 bp, Homo sapiens
agacacataggagcagctattgg

SEQ ID NO: 7355109 - DNA, 19 bp, Homo sapiens
agacacatcacatttctcc

SEQ ID NO: 7355110 - DNA, 22 bp, Homo sapiens
agacacattttacattaactgt

SEQ ID NO: 7355111 - DNA, 22 bp, Homo sapiens
agaatgttttcatgagaatgaa

SEQ ID NO: 7355112 - DNA, 22 bp, Homo sapiens
agaattagtcacaattatagga

SEQ ID NO: 7355113 - DNA, 22 bp, Homo sapiens
agaattcagaatgcatttctaa

SEQ ID NO: 7355114 - DNA, 22 bp, Homo sapiens
agaattagaggccatgtacttg

SEQ ID NO: 7355115 - DNA, 22 bp, Homo sapiens
agaattaggtaagttcatctga

SEQ ID NO: 7355116 - DNA, 21 bp, Homo sapiens
agaattaaattggatttgtgt

SEQ ID NO: 7355117 - DNA, 19 bp, Homo sapiens
agacacacttacgtggaat

SEQ ID NO: 7355118 - DNA, 22 bp, Homo sapiens
agacacagaacacaaaagcata

SEQ ID NO: 7355119 - DNA, 22 bp, Homo sapiens
agaatacaccacaggccgaaat

SEQ ID NO: 7355120 - DNA, 23 bp, Homo sapiens
agaatacaggctttgtataggca

SEQ ID NO: 7355121 - DNA, 22 bp, Homo sapiens
agaatacagtatgcaaaaagat

SEQ ID NO: 7355122 - DNA, 22 bp, Homo sapiens
agaagagaactgccaaacactt

SEQ ID NO: 7355123 - DNA, 22 bp, Homo sapiens
agaagagaaatagtgccactgt

SEQ ID NO: 7355124 - DNA, 19 bp, Homo sapiens
atctttagcaactttcaaa

SEQ ID NO: 7355125 - DNA, 22 bp, Homo sapiens
agaagcacaccagtagacaggg

SEQ ID NO: 7355126 - DNA, 22 bp, Homo sapiens
attctgtagggcttgctgacac

SEQ ID NO: 7355127 - DNA, 21 bp, Homo sapiens
agagggagagtggcccttcca

SEQ ID NO: 7355128 - DNA, 22 bp, Homo sapiens
attcagctgactttgattcatt

SEQ ID NO: 7355129 - DNA, 22 bp, Homo sapiens
agagggataatatgtattgtaa

SEQ ID NO: 7355130 - DNA, 22 bp, Homo sapiens
agagggagtgaaatggaataga

SEQ ID NO: 7355131 - DNA, 22 bp, Homo sapiens
agagggatggccccgtaactca

SEQ ID NO: 7355132 - DNA, 22 bp, Homo sapiens
agagggagctttatttttctgt

SEQ ID NO: 7355133 - DNA, 23 bp, Homo sapiens
agagggagatgtttttctcaaga

SEQ ID NO: 7355134 - DNA, 22 bp, Homo sapiens
agagggagcccagtcatagctg

SEQ ID NO: 7355135 - DNA, 22 bp, Homo sapiens
agagggtcaaccaggagcgtca

SEQ ID NO: 7355136 - DNA, 22 bp, Homo sapiens
agagggtatgagtggggctaaa

SEQ ID NO: 7355137 - DNA, 22 bp, Homo sapiens
agagggtcaaccaggagcgtca

SEQ ID NO: 7355138 - DNA, 22 bp, Homo sapiens
agaggggctcatatcctgtcat

SEQ ID NO: 7355139 - DNA, 22 bp, Homo sapiens
agaggggctcaagcagtggtct

SEQ ID NO: 7355140 - DNA, 22 bp, Homo sapiens
agaggggctcaagcagtggtct

SEQ ID NO: 7355141 - DNA, 23 bp, Homo sapiens
agagggtgcaacatggggatcta

SEQ ID NO: 7355142 - DNA, 23 bp, Homo sapiens
agagggtgcaacatggggatcta

SEQ ID NO: 7355143 - DNA, 22 bp, Homo sapiens
attatacattttgtgtagagat

SEQ ID NO: 7355144 - DNA, 22 bp, Homo sapiens
attcacacatactcatgtgtga

SEQ ID NO: 7355145 - DNA, 22 bp, Homo sapiens
attcacaattagaagtagataa

SEQ ID NO: 7355146 - DNA, 22 bp, Homo sapiens
attcacaattagaagtagataa

SEQ ID NO: 7355147 - DNA, 22 bp, Homo sapiens
attcagcatgcaattaggtaat

SEQ ID NO: 7355148 - DNA, 22 bp, Homo sapiens
attcagcattcatttccaactt

SEQ ID NO: 7355149 - DNA, 19 bp, Homo sapiens
attcagcattctgcacttc

SEQ ID NO: 7355150 - DNA, 22 bp, Homo sapiens
attcagcaaacatttattgtgt

SEQ ID NO: 7355151 - DNA, 22 bp, Homo sapiens
attcagcaagctatgggacagg

SEQ ID NO: 7355152 - DNA, 22 bp, Homo sapiens
attcagcacatctttgtacagc

SEQ ID NO: 7355153 - DNA, 22 bp, Homo sapiens
attcagattcctaggtttcatt

SEQ ID NO: 7355154 - DNA, 22 bp, Homo sapiens
attcagatcatatttatagctt

SEQ ID NO: 7355155 - DNA, 22 bp, Homo sapiens
attcacagtatggacgaaatga

SEQ ID NO: 7355156 - DNA, 20 bp, Homo sapiens
atgttaaatagcatttagag

SEQ ID NO: 7355157 - DNA, 20 bp, Homo sapiens
atgttaaatagcatttagag

SEQ ID NO: 7355158 - DNA, 22 bp, Homo sapiens
atgttaaatagccatttgtttg

SEQ ID NO: 7355159 - DNA, 22 bp, Homo sapiens
atgttaaatggtttattattaa

SEQ ID NO: 7355160 - DNA, 22 bp, Homo sapiens
atgttacaaatcctacaggtag

SEQ ID NO: 7355161 - DNA, 17 bp, Homo sapiens
atgttaatttcacattt

SEQ ID NO: 7355162 - DNA, 22 bp, Homo sapiens
atgttaagttactgaaatgaga

SEQ ID NO: 7355163 - DNA, 22 bp, Homo sapiens
atgttacaatccaacaaaatta

SEQ ID NO: 7355164 - DNA, 22 bp, Homo sapiens
atgtttctgagtgtatatacat

SEQ ID NO: 7355165 - DNA, 22 bp, Homo sapiens
atgtttgactgagtttggcaga

SEQ ID NO: 7355166 - DNA, 23 bp, Homo sapiens
atgtttgcagtaacccatcctgg

SEQ ID NO: 7355167 - DNA, 23 bp, Homo sapiens
atgtttgcagtaacccatcctgg

SEQ ID NO: 7355168 - DNA, 22 bp, Homo sapiens
atgtttgcattcttattatcgt

SEQ ID NO: 7355169 - DNA, 22 bp, Homo sapiens
atgtttgctattgttctagtgg

SEQ ID NO: 7355170 - DNA, 22 bp, Homo sapiens
atgtgtgtacacacgtgactct

SEQ ID NO: 7355171 - DNA, 22 bp, Homo sapiens
atgttaaataatcccttaaagc

SEQ ID NO: 7355172 - DNA, 22 bp, Homo sapiens
atgttaaataatcccttaaagc

SEQ ID NO: 7355173 - DNA, 22 bp, Homo sapiens
atgttaaagatggtgggaaatt

SEQ ID NO: 7355174 - DNA, 22 bp, Homo sapiens
atgtgtgtacacacgtgactct

SEQ ID NO: 7355175 - DNA, 22 bp, Homo sapiens
atgtgtgtaaacaagtataatt

SEQ ID NO: 7355176 - DNA, 22 bp, Homo sapiens
atgtgtgtaaacaagtataatt

SEQ ID NO: 7355177 - DNA, 22 bp, Homo sapiens
atgtgtgcatgttagagagagt

SEQ ID NO: 7355178 - DNA, 22 bp, Homo sapiens
atgtgtctttgagactctgcta

SEQ ID NO: 7355179 - DNA, 22 bp, Homo sapiens
atgtgtatgagtgtgcttcttt

SEQ ID NO: 7355180 - DNA, 22 bp, Homo sapiens
atgtgtatccatctgtctattt

SEQ ID NO: 7355181 - DNA, 22 bp, Homo sapiens
atgtgtatctaaggtgttctat

SEQ ID NO: 7355182 - DNA, 22 bp, Homo sapiens
attataaacctttgagggtggg

SEQ ID NO: 7355183 - DNA, 22 bp, Homo sapiens
attagcaatcacgcagtcattt

SEQ ID NO: 7355184 - DNA, 22 bp, Homo sapiens
attagcatgccaagcttttaga

SEQ ID NO: 7355185 - DNA, 22 bp, Homo sapiens
attaaacaatgtaaagttcttg

SEQ ID NO: 7355186 - DNA, 22 bp, Homo sapiens
atgttttaccctttgcacaaac

SEQ ID NO: 7355187 - DNA, 22 bp, Homo sapiens
atgttttaccctttgcacaaac

SEQ ID NO: 7355188 - DNA, 22 bp, Homo sapiens
attaaacaatgtaaagttcttg

SEQ ID NO: 7355189 - DNA, 22 bp, Homo sapiens
atgtttgttgaacatctactgc

SEQ ID NO: 7355190 - DNA, 22 bp, Homo sapiens
atgtttgttgaacatctactgc

SEQ ID NO: 7355191 - DNA, 22 bp, Homo sapiens
atgtttgtgtttgctatgcggt

SEQ ID NO: 7355192 - DNA, 22 bp, Homo sapiens
atgtttgtgtttcccattcagg

SEQ ID NO: 7355193 - DNA, 22 bp, Homo sapiens
atgtttgttgatcatttatgaa

SEQ ID NO: 7355194 - DNA, 22 bp, Homo sapiens
atgtttgttgaatgaagaaagg

SEQ ID NO: 7355195 - DNA, 22 bp, Homo sapiens
atgtttgtccctgacatcctct

SEQ ID NO: 7355196 - DNA, 22 bp, Homo sapiens
atgtttgtgggataaacaaatg

SEQ ID NO: 7355197 - DNA, 22 bp, Homo sapiens
atgtttgtgggataaacaaatg

SEQ ID NO: 7355198 - DNA, 22 bp, Homo sapiens
atgtttgtgttacactctgcag

SEQ ID NO: 7355199 - DNA, 22 bp, Homo sapiens
atgtttgtaggtaagtgacact

SEQ ID NO: 7355200 - DNA, 22 bp, Homo sapiens
atgtttgtcaggattgtaatta

SEQ ID NO: 7355201 - DNA, 22 bp, Homo sapiens
atgtttgtcaggattgtaatta

SEQ ID NO: 7355202 - DNA, 22 bp, Homo sapiens
agatgaagatatctgcaggggc

SEQ ID NO: 7355203 - DNA, 22 bp, Homo sapiens
agatgaagatatctgcaggggc

SEQ ID NO: 7355204 - DNA, 22 bp, Homo sapiens
agatgaagactcaggagcaggt

SEQ ID NO: 7355205 - DNA, 23 bp, Homo sapiens
agatgaaagcttcccatcacagt

SEQ ID NO: 7355206 - DNA, 22 bp, Homo sapiens
agatgaaatttgtgttgagttg

SEQ ID NO: 7355207 - DNA, 22 bp, Homo sapiens
agatgaattgatgttggacaga

SEQ ID NO: 7355208 - DNA, 22 bp, Homo sapiens
atttcattgaagttaattcttc

SEQ ID NO: 7355209 - DNA, 22 bp, Homo sapiens
agatgaaaatacgtgactttaa

SEQ ID NO: 7355210 - DNA, 22 bp, Homo sapiens
agatgaaagatttttatagaga

SEQ ID NO: 7355211 - DNA, 18 bp, Homo sapiens
agatgaaagcaaatgaca

SEQ ID NO: 7355212 - DNA, 22 bp, Homo sapiens
agatgtaccaggtattacagga

SEQ ID NO: 7355213 - DNA, 22 bp, Homo sapiens
atttgcttgtgctatgaaagtt

SEQ ID NO: 7355214 - DNA, 22 bp, Homo sapiens
atttgctggtgaatgtatagct

SEQ ID NO: 7355215 - DNA, 22 bp, Homo sapiens
atttgctggtgaatgtatagct

SEQ ID NO: 7355216 - DNA, 22 bp, Homo sapiens
agcaaacagtgtgctaagaaat

SEQ ID NO: 7355217 - DNA, 22 bp, Homo sapiens
agatttcagatgctcggcagtt

SEQ ID NO: 7355218 - DNA, 22 bp, Homo sapiens
agatttcacatgctgctctatt

SEQ ID NO: 7355219 - DNA, 22 bp, Homo sapiens
atttgctttcaggtataaaagg

SEQ ID NO: 7355220 - DNA, 22 bp, Homo sapiens
atttgctttaaggtataaaagg

SEQ ID NO: 7355221 - DNA, 22 bp, Homo sapiens
agatttccatctttttcatgtg

SEQ ID NO: 7355222 - DNA, 22 bp, Homo sapiens
agatttcaggttggggcagaag

SEQ ID NO: 7355223 - DNA, 22 bp, Homo sapiens
agcaaaataaggtaatttattg

SEQ ID NO: 7355224 - DNA, 23 bp, Homo sapiens
atttaatgctgagttgaatgtta

SEQ ID NO: 7355225 - DNA, 22 bp, Homo sapiens
atttaagggatttggagaccaa

SEQ ID NO: 7355226 - DNA, 22 bp, Homo sapiens
atttaataccacttggtgcttt

SEQ ID NO: 7355227 - DNA, 22 bp, Homo sapiens
atttaatgggtagacattgtta

SEQ ID NO: 7355228 - DNA, 22 bp, Homo sapiens
atttaacaagacagagaactgg

SEQ ID NO: 7355229 - DNA, 22 bp, Homo sapiens
attgttaataactattacattg

SEQ ID NO: 7355230 - DNA, 22 bp, Homo sapiens
attcttcattgttgattcatgt

SEQ ID NO: 7355231 - DNA, 23 bp, Homo sapiens
attcttcattatcttctagaaaa

SEQ ID NO: 7355232 - DNA, 22 bp, Homo sapiens
attcttcatacagacaagtcct

SEQ ID NO: 7355233 - DNA, 22 bp, Homo sapiens
agaggtagaggttgcagtgagc

SEQ ID NO: 7355234 - DNA, 22 bp, Homo sapiens
agagggtgggcacgtgatggat

SEQ ID NO: 7355235 - DNA, 22 bp, Homo sapiens
atttagtgaaacccataaagca

SEQ ID NO: 7355236 - DNA, 22 bp, Homo sapiens
atttagtgaccagcactagaaa

SEQ ID NO: 7355237 - DNA, 22 bp, Homo sapiens
atttagtgtatcaatgtgatat

SEQ ID NO: 7355238 - DNA, 22 bp, Homo sapiens
atttagtgtattctaatatgtg

SEQ ID NO: 7355239 - DNA, 22 bp, Homo sapiens
atttagtgtgtattgctattat

SEQ ID NO: 7355240 - DNA, 22 bp, Homo sapiens
agagtggcttctttgacatgct

SEQ ID NO: 7355241 - DNA, 22 bp, Homo sapiens
agagtgggcctagctgtaaaag

SEQ ID NO: 7355242 - DNA, 17 bp, Homo sapiens
atttagcaagtagacag

SEQ ID NO: 7355243 - DNA, 22 bp, Homo sapiens
atttagcaaaaaatgatgaagc

SEQ ID NO: 7355244 - DNA, 22 bp, Homo sapiens
caatgaaagcaactgcctataa

SEQ ID NO: 7355245 - DNA, 22 bp, Homo sapiens
caatgaaaatgaggactcctgt

SEQ ID NO: 7355246 - DNA, 22 bp, Homo sapiens
caactcctccccagcatgccaa

SEQ ID NO: 7355247 - DNA, 22 bp, Homo sapiens
caactcctggctgttaggcaca

SEQ ID NO: 7355248 - DNA, 22 bp, Homo sapiens
caactgagaaatattgctgacg

SEQ ID NO: 7355249 - DNA, 22 bp, Homo sapiens
agcagaatctgggagcagcagt

SEQ ID NO: 7355250 - DNA, 22 bp, Homo sapiens
agcagaatgtgtgtgacaagta

SEQ ID NO: 7355251 - DNA, 22 bp, Homo sapiens
caactcatgtccaactttcttt

SEQ ID NO: 7355252 - DNA, 22 bp, Homo sapiens
caacttcttggcttcctaatgg

SEQ ID NO: 7355253 - DNA, 22 bp, Homo sapiens
agcagcaatggaaagcaacaca

SEQ ID NO: 7355254 - DNA, 22 bp, Homo sapiens
agcagcagaagggagacccagg

SEQ ID NO: 7355255 - DNA, 22 bp, Homo sapiens
agcagcagaagggagacccagg

SEQ ID NO: 7355256 - DNA, 22 bp, Homo sapiens
agcagcagaaagttgatggcag

SEQ ID NO: 7355257 - DNA, 22 bp, Homo sapiens
agcagcacccagagccatgtct

SEQ ID NO: 7355258 - DNA, 22 bp, Homo sapiens
agcacaaaaacattcccagagt

SEQ ID NO: 7355259 - DNA, 23 bp, Homo sapiens
agcacagactagaaaggtctttc

SEQ ID NO: 7355260 - DNA, 22 bp, Homo sapiens
attttctatgttgtaattgtta

SEQ ID NO: 7355261 - DNA, 22 bp, Homo sapiens
agcacagagaagatttcaatta

SEQ ID NO: 7355262 - DNA, 22 bp, Homo sapiens
agcacagagattatttacaaga

SEQ ID NO: 7355263 - DNA, 22 bp, Homo sapiens
agcacagagttgcagagagcgt

SEQ ID NO: 7355264 - DNA, 22 bp, Homo sapiens
agcacagagctaggagtggagg

SEQ ID NO: 7355265 - DNA, 22 bp, Homo sapiens
agcacagatttgtcaacataga

SEQ ID NO: 7355266 - DNA, 22 bp, Homo sapiens
caaatgtttcttatctattgtt

SEQ ID NO: 7355267 - DNA, 22 bp, Homo sapiens
caaatgttgctgtaatgtttgt

SEQ ID NO: 7355268 - DNA, 22 bp, Homo sapiens
caaatgttgctgtaatgtttgt

SEQ ID NO: 7355269 - DNA, 22 bp, Homo sapiens
caaatgttgactaagagggttt

SEQ ID NO: 7355270 - DNA, 22 bp, Homo sapiens
caaatgttaagacaggatcaag

SEQ ID NO: 7355271 - DNA, 22 bp, Homo sapiens
caaatgttagtgcccatccctc

SEQ ID NO: 7355272 - DNA, 22 bp, Homo sapiens
caaatgttattcattcttgttt

SEQ ID NO: 7355273 - DNA, 22 bp, Homo sapiens
caaatgtttggtggcattttgt

SEQ ID NO: 7355274 - DNA, 22 bp, Homo sapiens
caaatgtttttattctacaaca

SEQ ID NO: 7355275 - DNA, 22 bp, Homo sapiens
caaatgttttttagtataagta

SEQ ID NO: 7355276 - DNA, 22 bp, Homo sapiens
caaatgtttgcatcacagggca

SEQ ID NO: 7355277 - DNA, 22 bp, Homo sapiens
caaatgtttcttgaacaccaac

SEQ ID NO: 7355278 - DNA, 22 bp, Homo sapiens
caaatgtttcttgaacaccaac

SEQ ID NO: 7355279 - DNA, 22 bp, Homo sapiens
caaattaatgtgtctcaaaata

SEQ ID NO: 7355280 - DNA, 22 bp, Homo sapiens
caaatgatagagccgattatca

SEQ ID NO: 7355281 - DNA, 22 bp, Homo sapiens
agcacagctgctgaatgataca

SEQ ID NO: 7355282 - DNA, 22 bp, Homo sapiens
agcacagctggaaaataaatca

SEQ ID NO: 7355283 - DNA, 22 bp, Homo sapiens
caaatgttaaatgtgttaagac

SEQ ID NO: 7355284 - DNA, 22 bp, Homo sapiens
caaatgttaagacaggatcaag

SEQ ID NO: 7355285 - DNA, 22 bp, Homo sapiens
caaatgcatagaaagatgaaac

SEQ ID NO: 7355286 - DNA, 22 bp, Homo sapiens
caaatgcaaaatataaccctgt

SEQ ID NO: 7355287 - DNA, 22 bp, Homo sapiens
agcataaaggcactagaaagag

SEQ ID NO: 7355288 - DNA, 22 bp, Homo sapiens
agcataaaggcactagaaagag

SEQ ID NO: 7355289 - DNA, 22 bp, Homo sapiens
agcataaactcagggacacaca

SEQ ID NO: 7355290 - DNA, 22 bp, Homo sapiens
agcataaaataaatagtttgca

SEQ ID NO: 7355291 - DNA, 22 bp, Homo sapiens
caccagggacaatgctaggggt

SEQ ID NO: 7355292 - DNA, 22 bp, Homo sapiens
caccagggacaatgctaggggt

SEQ ID NO: 7355293 - DNA, 22 bp, Homo sapiens
agcaggtgccaggtgtacccgc

SEQ ID NO: 7355294 - DNA, 22 bp, Homo sapiens
agcaggtgcgttacttcactct

SEQ ID NO: 7355295 - DNA, 22 bp, Homo sapiens
cacatcagggctgcttgggggt

SEQ ID NO: 7355296 - DNA, 22 bp, Homo sapiens
cacagtcaatgtagaaatatga

SEQ ID NO: 7355297 - DNA, 22 bp, Homo sapiens
cacagtcacatatctatgtgtg

SEQ ID NO: 7355298 - DNA, 22 bp, Homo sapiens
cacagtcaatgtagaaatatga

SEQ ID NO: 7355299 - DNA, 22 bp, Homo sapiens
agcagggcagtgcttcagctct

SEQ ID NO: 7355300 - DNA, 22 bp, Homo sapiens
agcagggcctgagtgacctaac

SEQ ID NO: 7355301 - DNA, 19 bp, Homo sapiens
cacagggcaggtctcatgt

SEQ ID NO: 7355302 - DNA, 22 bp, Homo sapiens
cacagggcagtgctgcccactc

SEQ ID NO: 7355303 - DNA, 22 bp, Homo sapiens
cacagggcagtgctgcccactc

SEQ ID NO: 7355304 - DNA, 22 bp, Homo sapiens
cacaggctgcccgcagctggga

SEQ ID NO: 7355305 - DNA, 22 bp, Homo sapiens
cacagggccttgtgtgactgca

SEQ ID NO: 7355306 - DNA, 22 bp, Homo sapiens
cacagggccactttcccagtaa

SEQ ID NO: 7355307 - DNA, 22 bp, Homo sapiens
cacagggctttgatggctgagt

SEQ ID NO: 7355308 - DNA, 22 bp, Homo sapiens
cacagggcttctcatggggtgc

SEQ ID NO: 7355309 - DNA, 22 bp, Homo sapiens
cacagtacttaattctctaaat

SEQ ID NO: 7355310 - DNA, 22 bp, Homo sapiens
agcaggagacatgggggtggtg

SEQ ID NO: 7355311 - DNA, 22 bp, Homo sapiens
cacaggaggttaggaagtggtc

SEQ ID NO: 7355312 - DNA, 22 bp, Homo sapiens
cacaggagggagcgggcagcca

SEQ ID NO: 7355313 - DNA, 22 bp, Homo sapiens
cacaggaggaggccagagcgta

SEQ ID NO: 7355314 - DNA, 22 bp, Homo sapiens
cacaggaggaggccagagcgta

SEQ ID NO: 7355315 - DNA, 22 bp, Homo sapiens
caatgacatggataatcatatt

SEQ ID NO: 7355316 - DNA, 22 bp, Homo sapiens
cacaggagctgtggggcagtgt

SEQ ID NO: 7355317 - DNA, 22 bp, Homo sapiens
cacaggaaggccttctcacaat

SEQ ID NO: 7355318 - DNA, 22 bp, Homo sapiens
cagaacttgctggacagcagat

SEQ ID NO: 7355319 - DNA, 22 bp, Homo sapiens
cagaagctggtacaaggcctag

SEQ ID NO: 7355320 - DNA, 17 bp, Homo sapiens
cagaaggaagcatggca

SEQ ID NO: 7355321 - DNA, 22 bp, Homo sapiens
agccaggatggtctcgatcggc

SEQ ID NO: 7355322 - DNA, 22 bp, Homo sapiens
cagacagacagccgtggccacc

SEQ ID NO: 7355323 - DNA, 22 bp, Homo sapiens
cagacagacagccgtggccacc

SEQ ID NO: 7355324 - DNA, 22 bp, Homo sapiens
agccaggcagggctctcgctct

SEQ ID NO: 7355325 - DNA, 22 bp, Homo sapiens
agccaggcagggctctcgctct

SEQ ID NO: 7355326 - DNA, 22 bp, Homo sapiens
cactctgtgattgcagcattcc

SEQ ID NO: 7355327 - DNA, 22 bp, Homo sapiens
cactgaaatattaatatcttat

SEQ ID NO: 7355328 - DNA, 22 bp, Homo sapiens
cactgaaaggcaatgctgacag

SEQ ID NO: 7355329 - DNA, 22 bp, Homo sapiens
agccacacctgtcctgccagct

SEQ ID NO: 7355330 - DNA, 22 bp, Homo sapiens
agccacacctgtcctgccagct

SEQ ID NO: 7355331 - DNA, 22 bp, Homo sapiens
agccacacctgtcctgccagct

SEQ ID NO: 7355332 - DNA, 22 bp, Homo sapiens
agccacacagcttaatgacaga

SEQ ID NO: 7355333 - DNA, 22 bp, Homo sapiens
agccacacttgccaggggaagg

SEQ ID NO: 7355334 - DNA, 22 bp, Homo sapiens
agccacagagagggagctgcaa

SEQ ID NO: 7355335 - DNA, 23 bp, Homo sapiens
agccacagccagagctatctcca

SEQ ID NO: 7355336 - DNA, 22 bp, Homo sapiens
agccacagcccacaggactctt

SEQ ID NO: 7355337 - DNA, 22 bp, Homo sapiens
agccacagcccacaggactctt

SEQ ID NO: 7355338 - DNA, 22 bp, Homo sapiens
cagaaccaggaactgatggaga

SEQ ID NO: 7355339 - DNA, 22 bp, Homo sapiens
cagaaatgacaaagtaagagga

SEQ ID NO: 7355340 - DNA, 23 bp, Homo sapiens
cagaaatctgaaatctagaaatg

SEQ ID NO: 7355341 - DNA, 22 bp, Homo sapiens
agccacagcgaacctctcttcc

SEQ ID NO: 7355342 - DNA, 22 bp, Homo sapiens
cagagatgggtcgcagagatgg

SEQ ID NO: 7355343 - DNA, 22 bp, Homo sapiens
cagagcaacaccctttacatcg

SEQ ID NO: 7355344 - DNA, 22 bp, Homo sapiens
cagagatggggccagctgctcc

SEQ ID NO: 7355345 - DNA, 22 bp, Homo sapiens
cagagagggcggccctggcttc

SEQ ID NO: 7355346 - DNA, 22 bp, Homo sapiens
cagacagacctgcaagggcaca

SEQ ID NO: 7355347 - DNA, 22 bp, Homo sapiens
cagacagaggctgtatgagggc

SEQ ID NO: 7355348 - DNA, 22 bp, Homo sapiens
cagacagaggctgtatgagggc

SEQ ID NO: 7355349 - DNA, 18 bp, Homo sapiens
agccaggtggaatggaac

SEQ ID NO: 7355350 - DNA, 22 bp, Homo sapiens
cagagctggagggaaccctggc

SEQ ID NO: 7355351 - DNA, 22 bp, Homo sapiens
cagagctggagcttgaatggag

SEQ ID NO: 7355352 - DNA, 22 bp, Homo sapiens
agcccagctttgaaccatatca

SEQ ID NO: 7355353 - DNA, 17 bp, Homo sapiens
agcccccactcccaagt

SEQ ID NO: 7355354 - DNA, 23 bp, Homo sapiens
cagagctggctcagagctgcctg

SEQ ID NO: 7355355 - DNA, 23 bp, Homo sapiens
cagagctggctcagagctgcctg

SEQ ID NO: 7355356 - DNA, 19 bp, Homo sapiens
agcccccagacagcaggcc

SEQ ID NO: 7355357 - DNA, 22 bp, Homo sapiens
agccccttccagttctcagatc

SEQ ID NO: 7355358 - DNA, 22 bp, Homo sapiens
cagagctggcctgtgatttttg

SEQ ID NO: 7355359 - DNA, 22 bp, Homo sapiens
cagagctggagggaaccctggc

SEQ ID NO: 7355360 - DNA, 23 bp, Homo sapiens
cagagctggctcagagctgcctg

SEQ ID NO: 7355361 - DNA, 22 bp, Homo sapiens
cagagctggcggtgagaagaca

SEQ ID NO: 7355362 - DNA, 22 bp, Homo sapiens
agcccggcttccccggttgcta

SEQ ID NO: 7355363 - DNA, 22 bp, Homo sapiens
agcccgcatctcgctaaagata

SEQ ID NO: 7355364 - DNA, 22 bp, Homo sapiens
agccccttgctgccctctagag

SEQ ID NO: 7355365 - DNA, 22 bp, Homo sapiens
agcctcagcacgcagctctgtg

SEQ ID NO: 7355366 - DNA, 22 bp, Homo sapiens
cagcacagggcttgagaggtgt

SEQ ID NO: 7355367 - DNA, 22 bp, Homo sapiens
cagcacagggcttgagaggtgt

SEQ ID NO: 7355368 - DNA, 22 bp, Homo sapiens
cagcacagctggctctggaagc

SEQ ID NO: 7355369 - DNA, 22 bp, Homo sapiens
cagcacaggaagtgggccttca

SEQ ID NO: 7355370 - DNA, 22 bp, Homo sapiens
cagcacaggcccctctctccca

SEQ ID NO: 7355371 - DNA, 22 bp, Homo sapiens
cagaggctcagatggccctggc

SEQ ID NO: 7355372 - DNA, 22 bp, Homo sapiens
cagaggctcaccagcctttcac

SEQ ID NO: 7355373 - DNA, 22 bp, Homo sapiens
cagaggctcagatggccctggc

SEQ ID NO: 7355374 - DNA, 22 bp, Homo sapiens
cagcacagcacagcggtgactc

SEQ ID NO: 7355375 - DNA, 22 bp, Homo sapiens
cagcacagctgaggggctgtct

SEQ ID NO: 7355376 - DNA, 20 bp, Homo sapiens
cagcacagagcttggctcta

SEQ ID NO: 7355377 - DNA, 22 bp, Homo sapiens
cagaggctaagatgagtgggtg

SEQ ID NO: 7355378 - DNA, 22 bp, Homo sapiens
cagaggctaagatgagtgggtg

SEQ ID NO: 7355379 - DNA, 18 bp, Homo sapiens
agccctccaggtgattct

SEQ ID NO: 7355380 - DNA, 22 bp, Homo sapiens
agccctcctcacatcagcgtcc

SEQ ID NO: 7355381 - DNA, 22 bp, Homo sapiens
cagaggcgaggcagctgaacct

SEQ ID NO: 7355382 - DNA, 22 bp, Homo sapiens
agccttcagtaagggcttagca

SEQ ID NO: 7355383 - DNA, 22 bp, Homo sapiens
agccttcagtaaatccactgtg

SEQ ID NO: 7355384 - DNA, 22 bp, Homo sapiens
cagcagcagtgttctagaatct

SEQ ID NO: 7355385 - DNA, 22 bp, Homo sapiens
cagcagcatgaattcgagccac

SEQ ID NO: 7355386 - DNA, 22 bp, Homo sapiens
cagcagcagccccaggaaggtt

SEQ ID NO: 7355387 - DNA, 22 bp, Homo sapiens
cagcagcagtggctgcagaaca

SEQ ID NO: 7355388 - DNA, 22 bp, Homo sapiens
cagcagcaggcgcacggccgtc

SEQ ID NO: 7355389 - DNA, 22 bp, Homo sapiens
cagcagcagcttagtggtcccc

SEQ ID NO: 7355390 - DNA, 22 bp, Homo sapiens
cagcagagggagccattgaaat

SEQ ID NO: 7355391 - DNA, 22 bp, Homo sapiens
agcctccatcccatgcacaaag

SEQ ID NO: 7355392 - DNA, 22 bp, Homo sapiens
agcctccacagatgcaaagggc

SEQ ID NO: 7355393 - DNA, 22 bp, Homo sapiens
cagccctgggagttggggccga

SEQ ID NO: 7355394 - DNA, 22 bp, Homo sapiens
cagccctggcgcccccagatct

SEQ ID NO: 7355395 - DNA, 22 bp, Homo sapiens
cagccctgggagttggggccga

SEQ ID NO: 7355396 - DNA, 22 bp, Homo sapiens
cagccctgggtccctgccctgg

SEQ ID NO: 7355397 - DNA, 20 bp, Homo sapiens
agctcctcatcactggaggt

SEQ ID NO: 7355398 - DNA, 22 bp, Homo sapiens
agctcctcctgagtgtctggga

SEQ ID NO: 7355399 - DNA, 20 bp, Homo sapiens
agctcctctgcccattcttc

SEQ ID NO: 7355400 - DNA, 20 bp, Homo sapiens
agctcctctgcccattcttc

SEQ ID NO: 7355401 - DNA, 22 bp, Homo sapiens
cagccctggcgcccccagatct

SEQ ID NO: 7355402 - DNA, 22 bp, Homo sapiens
cagccagagaggaaggaatgca

SEQ ID NO: 7355403 - DNA, 22 bp, Homo sapiens
cagccagctgaatgtaccatga

SEQ ID NO: 7355404 - DNA, 23 bp, Homo sapiens
agctccagggaacaggcagtagg

SEQ ID NO: 7355405 - DNA, 23 bp, Homo sapiens
agctccagggaacaggcagtagg

SEQ ID NO: 7355406 - DNA, 22 bp, Homo sapiens
cagccagctggcactgtgagta

SEQ ID NO: 7355407 - DNA, 22 bp, Homo sapiens
agctccccacgtctctgtcttt

SEQ ID NO: 7355408 - DNA, 22 bp, Homo sapiens
agctccctgagatgccacagca

SEQ ID NO: 7355409 - DNA, 22 bp, Homo sapiens
cagcaggagcagtcagactcct

SEQ ID NO: 7355410 - DNA, 22 bp, Homo sapiens
cagcaggaggcatggcttccct

SEQ ID NO: 7355411 - DNA, 23 bp, Homo sapiens
agccttggaggttgaggctgcag

SEQ ID NO: 7355412 - DNA, 22 bp, Homo sapiens
agctcaagttttcaaatattat

SEQ ID NO: 7355413 - DNA, 22 bp, Homo sapiens
agctcacagcctagcactgtga

SEQ ID NO: 7355414 - DNA, 22 bp, Homo sapiens
agctcacagcctagcactgtga

SEQ ID NO: 7355415 - DNA, 22 bp, Homo sapiens
cagcaggataggtttctttgga

SEQ ID NO: 7355416 - DNA, 22 bp, Homo sapiens
agctcagaactgcagacatgtg

SEQ ID NO: 7355417 - DNA, 22 bp, Homo sapiens
agctcagaagggaggaaatgag

SEQ ID NO: 7355418 - DNA, 22 bp, Homo sapiens
agctcagaacctcctcatccca

SEQ ID NO: 7355419 - DNA, 22 bp, Homo sapiens
agctcagaaatgccagtaggta

SEQ ID NO: 7355420 - DNA, 22 bp, Homo sapiens
agctcacagcctagcactgtga

SEQ ID NO: 7355421 - DNA, 22 bp, Homo sapiens
agaaacatattcagtgagtaat

SEQ ID NO: 7355422 - DNA, 22 bp, Homo sapiens
agaaacatcattggaacacaag

SEQ ID NO: 7355423 - DNA, 22 bp, Homo sapiens
agaaacatcctgctttccattt

SEQ ID NO: 7355424 - DNA, 22 bp, Homo sapiens
agaaacatcattgtttggtatt

SEQ ID NO: 7355425 - DNA, 22 bp, Homo sapiens
agaaacagcattagcatcaatt

SEQ ID NO: 7355426 - DNA, 22 bp, Homo sapiens
atcacaaaggctgcttcatgat

SEQ ID NO: 7355427 - DNA, 20 bp, Homo sapiens
agaaacatttcttgagaact

SEQ ID NO: 7355428 - DNA, 22 bp, Homo sapiens
agaaacatcgcttagtcctcat

SEQ ID NO: 7355429 - DNA, 22 bp, Homo sapiens
agaaacatttagattatatgtc

SEQ ID NO: 7355430 - DNA, 21 bp, Homo sapiens
agaaacatgatcaaaggaacc

SEQ ID NO: 7355431 - DNA, 22 bp, Homo sapiens
atcactgaaatactgaaattac

SEQ ID NO: 7355432 - DNA, 22 bp, Homo sapiens
atcactgatacctttattttca

SEQ ID NO: 7355433 - DNA, 22 bp, Homo sapiens
atcactgaagaatgggagagga

SEQ ID NO: 7355434 - DNA, 21 bp, Homo sapiens
atcactgaatgccttcaagga

SEQ ID NO: 7355435 - DNA, 22 bp, Homo sapiens
atcactgaatgcaaagctggga

SEQ ID NO: 7355436 - DNA, 22 bp, Homo sapiens
atcactgagcttcagtgctggc

SEQ ID NO: 7355437 - DNA, 22 bp, Homo sapiens
atcagatatttaagttatcaac

SEQ ID NO: 7355438 - DNA, 22 bp, Homo sapiens
atcactgatgaagttagaccta

SEQ ID NO: 7355439 - DNA, 22 bp, Homo sapiens
atcactgattcattgtggtgat

SEQ ID NO: 7355440 - DNA, 22 bp, Homo sapiens
atcactgttatctagaagcaca

SEQ ID NO: 7355441 - DNA, 22 bp, Homo sapiens
atcatttatgccccaattagat

SEQ ID NO: 7355442 - DNA, 22 bp, Homo sapiens
atcatttacaaactcagcattg

SEQ ID NO: 7355443 - DNA, 22 bp, Homo sapiens
atcattgaatataagtgctatt

SEQ ID NO: 7355444 - DNA, 22 bp, Homo sapiens
atcatttaaaacaagtctctat

SEQ ID NO: 7355445 - DNA, 21 bp, Homo sapiens
atcattgcagagcacattaaa

SEQ ID NO: 7355446 - DNA, 22 bp, Homo sapiens
atcagcaagtcctgttaattct

SEQ ID NO: 7355447 - DNA, 22 bp, Homo sapiens
atcagcaagtcctgttaattct

SEQ ID NO: 7355448 - DNA, 19 bp, Homo sapiens
atcagcaaggtaggatgtg

SEQ ID NO: 7355449 - DNA, 22 bp, Homo sapiens
atcagcaaggcaatcactgcag

SEQ ID NO: 7355450 - DNA, 19 bp, Homo sapiens
atcagcaaggtaggatgtg

SEQ ID NO: 7355451 - DNA, 22 bp, Homo sapiens
atcattctgatggtcaatgcta

SEQ ID NO: 7355452 - DNA, 22 bp, Homo sapiens
atcagcaaaaatgccttcagaa

SEQ ID NO: 7355453 - DNA, 21 bp, Homo sapiens
atcagcaaatgcctgtctccc

SEQ ID NO: 7355454 - DNA, 22 bp, Homo sapiens
atcagcaaaaatgccttcagaa

SEQ ID NO: 7355455 - DNA, 21 bp, Homo sapiens
atcagcaaatgcctgtctccc

SEQ ID NO: 7355456 - DNA, 20 bp, Homo sapiens
atcagcaactgccactcagt

SEQ ID NO: 7355457 - DNA, 20 bp, Homo sapiens
atcagcaactgccactcagt

SEQ ID NO: 7355458 - DNA, 22 bp, Homo sapiens
atcagcaagactaggggaatac

SEQ ID NO: 7355459 - DNA, 22 bp, Homo sapiens
atcagcaagatgtaatttctat

SEQ ID NO: 7355460 - DNA, 22 bp, Homo sapiens
atcagcaagactaggggaatac

SEQ ID NO: 7355461 - DNA, 22 bp, Homo sapiens
atcagcaagatgtaatttctat

SEQ ID NO: 7355462 - DNA, 22 bp, Homo sapiens
atcagcaagattgtgtcttgta

SEQ ID NO: 7355463 - DNA, 22 bp, Homo sapiens
atcagcaagattgtgtcttgta

SEQ ID NO: 7355464 - DNA, 22 bp, Homo sapiens
atcagcaagcatggttaggtgt

SEQ ID NO: 7355465 - DNA, 22 bp, Homo sapiens
atcagcaagcatttattgagtg

SEQ ID NO: 7355466 - DNA, 22 bp, Homo sapiens
atcagcaagcatggttaggtgt

SEQ ID NO: 7355467 - DNA, 22 bp, Homo sapiens
atcagcaagcatttattgagtg

SEQ ID NO: 7355468 - DNA, 22 bp, Homo sapiens
atcagcaaggcaatcactgcag

SEQ ID NO: 7355469 - DNA, 23 bp, Homo sapiens
atccagcctgggggtttaaccac

SEQ ID NO: 7355470 - DNA, 22 bp, Homo sapiens
atccagacacctactgctactt

SEQ ID NO: 7355471 - DNA, 16 bp, Homo sapiens
atccagacagcacagg

SEQ ID NO: 7355472 - DNA, 22 bp, Homo sapiens
atccagacagtctggtgccaga

SEQ ID NO: 7355473 - DNA, 22 bp, Homo sapiens
atccagagactggggctgggat

SEQ ID NO: 7355474 - DNA, 22 bp, Homo sapiens
atcatttgtgcatagtaacaga

SEQ ID NO: 7355475 - DNA, 22 bp, Homo sapiens
atcatttgtgcatagtaacaga

SEQ ID NO: 7355476 - DNA, 22 bp, Homo sapiens
atcattttatggctgagaggac

SEQ ID NO: 7355477 - DNA, 22 bp, Homo sapiens
atccactctaagatctgtggtg

SEQ ID NO: 7355478 - DNA, 22 bp, Homo sapiens
atccactctcccattcatgcat

SEQ ID NO: 7355479 - DNA, 22 bp, Homo sapiens
atcatttgcctcaagtgaaagt

SEQ ID NO: 7355480 - DNA, 22 bp, Homo sapiens
acttgggatggtggccagagcg

SEQ ID NO: 7355481 - DNA, 22 bp, Homo sapiens
acttggtctaactagtgcttct

SEQ ID NO: 7355482 - DNA, 22 bp, Homo sapiens
acttggtcttcaaatgcatgat

SEQ ID NO: 7355483 - DNA, 22 bp, Homo sapiens
atataattgttctgaagtgttt

SEQ ID NO: 7355484 - DNA, 22 bp, Homo sapiens
atataatttagaaggggaaaca

SEQ ID NO: 7355485 - DNA, 22 bp, Homo sapiens
atatacacagagcttatggtga

SEQ ID NO: 7355486 - DNA, 22 bp, Homo sapiens
atatacacatctttttaaatat

SEQ ID NO: 7355487 - DNA, 22 bp, Homo sapiens
atataatttttggttagctcaa

SEQ ID NO: 7355488 - DNA, 22 bp, Homo sapiens
atatacacatgtgtatacattt

SEQ ID NO: 7355489 - DNA, 21 bp, Homo sapiens
actttgggcactttcctgccc

SEQ ID NO: 7355490 - DNA, 22 bp, Homo sapiens
atatatttactctcctgttgca

SEQ ID NO: 7355491 - DNA, 22 bp, Homo sapiens
atatatttactctcctgttgca

SEQ ID NO: 7355492 - DNA, 22 bp, Homo sapiens
atatatttgagaatattcatga

SEQ ID NO: 7355493 - DNA, 22 bp, Homo sapiens
atatatttgagaatattcatga

SEQ ID NO: 7355494 - DNA, 22 bp, Homo sapiens
atatatttgagaatattcatga

SEQ ID NO: 7355495 - DNA, 22 bp, Homo sapiens
atatatttgagaatattcatga

SEQ ID NO: 7355496 - DNA, 22 bp, Homo sapiens
atatattttgaatagcctctgt

SEQ ID NO: 7355497 - DNA, 22 bp, Homo sapiens
atatattttgaatagcctctgt

SEQ ID NO: 7355498 - DNA, 22 bp, Homo sapiens
atatccagcagcaggtgagtat

SEQ ID NO: 7355499 - DNA, 22 bp, Homo sapiens
atatccatagtaaaagtcatta

SEQ ID NO: 7355500 - DNA, 22 bp, Homo sapiens
atatcttctttattttgtgagg

SEQ ID NO: 7355501 - DNA, 22 bp, Homo sapiens
atatctcattaccttgctgttc

SEQ ID NO: 7355502 - DNA, 22 bp, Homo sapiens
atatctcaatacagctgtttta

SEQ ID NO: 7355503 - DNA, 22 bp, Homo sapiens
atatgaaaatgttttagctgta

SEQ ID NO: 7355504 - DNA, 22 bp, Homo sapiens
atatgaaaagaagtcaccattg

SEQ ID NO: 7355505 - DNA, 22 bp, Homo sapiens
atatcttttagagcaagcttgt

SEQ ID NO: 7355506 - DNA, 22 bp, Homo sapiens
agaaaatttaaagagacacaca

SEQ ID NO: 7355507 - DNA, 22 bp, Homo sapiens
agaaaattagattttactgtgt

SEQ ID NO: 7355508 - DNA, 22 bp, Homo sapiens
agaaaatttattcatgttagtt

SEQ ID NO: 7355509 - DNA, 22 bp, Homo sapiens
agaaacaacttgtttctcttgc

SEQ ID NO: 7355510 - DNA, 22 bp, Homo sapiens
agaaaatttaaagagacacaca

SEQ ID NO: 7355511 - DNA, 22 bp, Homo sapiens
agaaaatttattcatgttagtt

SEQ ID NO: 7355512 - DNA, 22 bp, Homo sapiens
agaaacaaggtgtaggttgacc

SEQ ID NO: 7355513 - DNA, 22 bp, Homo sapiens
agaaacaaggtgtaggttgacc

SEQ ID NO: 7355514 - DNA, 22 bp, Homo sapiens
agaaacagaagggaaagctttt

SEQ ID NO: 7355515 - DNA, 22 bp, Homo sapiens
agtttcctgggagattcttaca

SEQ ID NO: 7355516 - DNA, 22 bp, Homo sapiens
agtttccttggattcaatttgg

SEQ ID NO: 7355517 - DNA, 22 bp, Homo sapiens
actgtgtattcctatatagtaa

SEQ ID NO: 7355518 - DNA, 22 bp, Homo sapiens
actgtgtatgatatgtactggg

SEQ ID NO: 7355519 - DNA, 22 bp, Homo sapiens
actgtgactgagcattcacatg

SEQ ID NO: 7355520 - DNA, 22 bp, Homo sapiens
actgtgactgagcattcacatg

SEQ ID NO: 7355521 - DNA, 22 bp, Homo sapiens
actgtgactgtgtcttctgggc

SEQ ID NO: 7355522 - DNA, 22 bp, Homo sapiens
actgtgaacggactgaagccca

SEQ ID NO: 7355523 - DNA, 22 bp, Homo sapiens
actgtgaacggactgaagccca

SEQ ID NO: 7355524 - DNA, 22 bp, Homo sapiens
actgtaaagaggtgtatcttta

SEQ ID NO: 7355525 - DNA, 22 bp, Homo sapiens
actgtaaaacaggtttcatcat

SEQ ID NO: 7355526 - DNA, 22 bp, Homo sapiens
actgtaaaatgagatatgtata

SEQ ID NO: 7355527 - DNA, 22 bp, Homo sapiens
agtttacttgaatgatgaattc

SEQ ID NO: 7355528 - DNA, 18 bp, Homo sapiens
agttgctagatgctgtag

SEQ ID NO: 7355529 - DNA, 22 bp, Homo sapiens
agtttacagatgctacaggagc

SEQ ID NO: 7355530 - DNA, 22 bp, Homo sapiens
actggcagctgtaggatgcatg

SEQ ID NO: 7355531 - DNA, 22 bp, Homo sapiens
actggcaggctgctggccggcg

SEQ ID NO: 7355532 - DNA, 22 bp, Homo sapiens
actgtgtggaaatttgtgaggg

SEQ ID NO: 7355533 - DNA, 19 bp, Homo sapiens
actgtgtggaagtgtgatt

SEQ ID NO: 7355534 - DNA, 22 bp, Homo sapiens
actgtgtattctaatgactaaa

SEQ ID NO: 7355535 - DNA, 22 bp, Homo sapiens
actgtgtcctatttccttgaca

SEQ ID NO: 7355536 - DNA, 22 bp, Homo sapiens
actgtgtgaaacatcaatgtgt

SEQ ID NO: 7355537 - DNA, 22 bp, Homo sapiens
actgtgttcaattaaaaagctt

SEQ ID NO: 7355538 - DNA, 22 bp, Homo sapiens
actgtgttaaatacagagatgg

SEQ ID NO: 7355539 - DNA, 22 bp, Homo sapiens
actgtgttaaatacagagatgg

SEQ ID NO: 7355540 - DNA, 22 bp, Homo sapiens
actgtgttgccttcccccagcc

SEQ ID NO: 7355541 - DNA, 22 bp, Homo sapiens
actgtgttcctctttggtatcc

SEQ ID NO: 7355542 - DNA, 22 bp, Homo sapiens
actgtgttcacacttacaaatg

SEQ ID NO: 7355543 - DNA, 22 bp, Homo sapiens
actgtgttgtctcaacctgacc

SEQ ID NO: 7355544 - DNA, 22 bp, Homo sapiens
actgtgtttcacctgagtatgg

SEQ ID NO: 7355545 - DNA, 22 bp, Homo sapiens
actgttaaagtaattaattgtc

SEQ ID NO: 7355546 - DNA, 22 bp, Homo sapiens
actgtgttttcctgctgaggca

SEQ ID NO: 7355547 - DNA, 22 bp, Homo sapiens
actgtgtttggcaatagggcct

SEQ ID NO: 7355548 - DNA, 22 bp, Homo sapiens
actgtgtttctgaaacaagagg

SEQ ID NO: 7355549 - DNA, 22 bp, Homo sapiens
actgttaacggtatgatgctcg

SEQ ID NO: 7355550 - DNA, 21 bp, Homo sapiens
actgttaagacgtagctgggg

SEQ ID NO: 7355551 - DNA, 22 bp, Homo sapiens
actgttaattcaatcaacaggt

SEQ ID NO: 7355552 - DNA, 22 bp, Homo sapiens
actgttaagtatgaagtaaggc

SEQ ID NO: 7355553 - DNA, 22 bp, Homo sapiens
actgttatagttcacttttccc

SEQ ID NO: 7355554 - DNA, 22 bp, Homo sapiens
actgttatagttcacttttccc

SEQ ID NO: 7355555 - DNA, 18 bp, Homo sapiens
actgttatctgataaggc

SEQ ID NO: 7355556 - DNA, 22 bp, Homo sapiens
actgttatgatttacacagtcc

SEQ ID NO: 7355557 - DNA, 22 bp, Homo sapiens
actgttatgatttacacagtcc

SEQ ID NO: 7355558 - DNA, 22 bp, Homo sapiens
actgttatgatttacacagtcc

SEQ ID NO: 7355559 - DNA, 22 bp, Homo sapiens
actgttatgggtgtcagcttaa

SEQ ID NO: 7355560 - DNA, 22 bp, Homo sapiens
actgttatgttattacccatgt

SEQ ID NO: 7355561 - DNA, 22 bp, Homo sapiens
acttcagaaaatgttgaatgtt

SEQ ID NO: 7355562 - DNA, 22 bp, Homo sapiens
acttcacaaagagatcatctaa

SEQ ID NO: 7355563 - DNA, 22 bp, Homo sapiens
acttcacaaagagatcatctaa

SEQ ID NO: 7355564 - DNA, 22 bp, Homo sapiens
acttcacacagcaaatttatct

SEQ ID NO: 7355565 - DNA, 22 bp, Homo sapiens
acttggaaccgaggacctttat

SEQ ID NO: 7355566 - DNA, 20 bp, Homo sapiens
acttggaactcatttttctt

SEQ ID NO: 7355567 - DNA, 22 bp, Homo sapiens
acttggaatattgcgtttttgc

SEQ ID NO: 7355568 - DNA, 22 bp, Homo sapiens
acttggaatctgtttccctaga

SEQ ID NO: 7355569 - DNA, 22 bp, Homo sapiens
acttgggaaaggaagaattgca

SEQ ID NO: 7355570 - DNA, 22 bp, Homo sapiens
acttcatgttgtttacaactta

SEQ ID NO: 7355571 - DNA, 22 bp, Homo sapiens
acttcatgttgctcttggctat

SEQ ID NO: 7355572 - DNA, 22 bp, Homo sapiens
acttcatgtactgttcaaggcc

SEQ ID NO: 7355573 - DNA, 22 bp, Homo sapiens
acttgcagatggtatggaatgt

SEQ ID NO: 7355574 - DNA, 22 bp, Homo sapiens
acttgcagaaacttcaattctg

SEQ ID NO: 7355575 - DNA, 22 bp, Homo sapiens
acttgcaggatcctctgcctga

SEQ ID NO: 7355576 - DNA, 22 bp, Homo sapiens
acttgcaggtgtctggagttag

SEQ ID NO: 7355577 - DNA, 22 bp, Homo sapiens
acttccagaattagaatttaag

SEQ ID NO: 7355578 - DNA, 22 bp, Homo sapiens
acttccaagtgacattcatatc

SEQ ID NO: 7355579 - DNA, 22 bp, Homo sapiens
acctgtgttttccctcagtttc

SEQ ID NO: 7355580 - DNA, 22 bp, Homo sapiens
acctggacctgccacctatgag

SEQ ID NO: 7355581 - DNA, 22 bp, Homo sapiens
acctggacacctgctgtcatct

SEQ ID NO: 7355582 - DNA, 22 bp, Homo sapiens
acctggacttgaatcctgactt

SEQ ID NO: 7355583 - DNA, 22 bp, Homo sapiens
acctccctgggttatcggggca

SEQ ID NO: 7355584 - DNA, 22 bp, Homo sapiens
acctccctgcctcttggcgtca

SEQ ID NO: 7355585 - DNA, 22 bp, Homo sapiens
acctccctggccttctgattcc

SEQ ID NO: 7355586 - DNA, 22 bp, Homo sapiens
agggttaattggtgtcctgagg

SEQ ID NO: 7355587 - DNA, 22 bp, Homo sapiens
agggtggggtgctacatcttta

SEQ ID NO: 7355588 - DNA, 20 bp, Homo sapiens
agggtggggacgttctgact

SEQ ID NO: 7355589 - DNA, 22 bp, Homo sapiens
acctccctccatctggacacta

SEQ ID NO: 7355590 - DNA, 22 bp, Homo sapiens
acctccctaagggtccagctta

SEQ ID NO: 7355591 - DNA, 22 bp, Homo sapiens
acctccctaacccttttggctc

SEQ ID NO: 7355592 - DNA, 22 bp, Homo sapiens
acctccctcgccgtccactctg

SEQ ID NO: 7355593 - DNA, 20 bp, Homo sapiens
acctccctctgtgggtggga

SEQ ID NO: 7355594 - DNA, 21 bp, Homo sapiens
acctccctcgagcaaccagca

SEQ ID NO: 7355595 - DNA, 22 bp, Homo sapiens
acctccctcgccgtccactctg

SEQ ID NO: 7355596 - DNA, 22 bp, Homo sapiens
agggctttcggcactctgaggg

SEQ ID NO: 7355597 - DNA, 22 bp, Homo sapiens
agggctttcggcactctgaggg

SEQ ID NO: 7355598 - DNA, 22 bp, Homo sapiens
agggctttacttctcagttcta

SEQ ID NO: 7355599 - DNA, 22 bp, Homo sapiens
agggctttaatgattattttct

SEQ ID NO: 7355600 - DNA, 22 bp, Homo sapiens
agggctttaatgattattttct

SEQ ID NO: 7355601 - DNA, 22 bp, Homo sapiens
agggtgggctagactcttcccc

SEQ ID NO: 7355602 - DNA, 22 bp, Homo sapiens
agggctgtgtccctaggggagc

SEQ ID NO: 7355603 - DNA, 22 bp, Homo sapiens
agggctgtcagactgaggaggc

SEQ ID NO: 7355604 - DNA, 22 bp, Homo sapiens
agggctgtcagactgaggaggc

SEQ ID NO: 7355605 - DNA, 22 bp, Homo sapiens
accctcagagtaggcactgctg

SEQ ID NO: 7355606 - DNA, 22 bp, Homo sapiens
acgtgtgtatgagtgtacatat

SEQ ID NO: 7355607 - DNA, 22 bp, Homo sapiens
acgggctgggacggggaagctc

SEQ ID NO: 7355608 - DNA, 22 bp, Homo sapiens
acgtgttcaatttccatctgac

SEQ ID NO: 7355609 - DNA, 22 bp, Homo sapiens
acgttttctagagaatatgcag

SEQ ID NO: 7355610 - DNA, 22 bp, Homo sapiens
acgttttcagtgactgtgcttc

SEQ ID NO: 7355611 - DNA, 22 bp, Homo sapiens
acgttttcagccttaatgtaga

SEQ ID NO: 7355612 - DNA, 19 bp, Homo sapiens
actaaaaatgatgtttgag

SEQ ID NO: 7355613 - DNA, 22 bp, Homo sapiens
actaaaaactactgccaatagc

SEQ ID NO: 7355614 - DNA, 22 bp, Homo sapiens
actaaaacatagccagtcagtg

SEQ ID NO: 7355615 - DNA, 22 bp, Homo sapiens
acgggccttctcttcaggcgag

SEQ ID NO: 7355616 - DNA, 22 bp, Homo sapiens
acctgtttagaaagcttatgag

SEQ ID NO: 7355617 - DNA, 22 bp, Homo sapiens
acctgtttctctctgagttact

SEQ ID NO: 7355618 - DNA, 22 bp, Homo sapiens
acctgttttagtctttaatcat

SEQ ID NO: 7355619 - DNA, 22 bp, Homo sapiens
acctgtttgtgtttggactgca

SEQ ID NO: 7355620 - DNA, 22 bp, Homo sapiens
accttagatttggcttactatg

SEQ ID NO: 7355621 - DNA, 18 bp, Homo sapiens
actatgctgaataaatgg

SEQ ID NO: 7355622 - DNA, 22 bp, Homo sapiens
actatgctcattgttaatattt

SEQ ID NO: 7355623 - DNA, 22 bp, Homo sapiens
actattagcatatcatgaatgg

SEQ ID NO: 7355624 - DNA, 19 bp, Homo sapiens
actcagggaaaggagaatt

SEQ ID NO: 7355625 - DNA, 22 bp, Homo sapiens
actcatttaaacatttactgaa

SEQ ID NO: 7355626 - DNA, 22 bp, Homo sapiens
actcatttaaacatttactgaa

SEQ ID NO: 7355627 - DNA, 22 bp, Homo sapiens
actcattaaataggatgatttt

SEQ ID NO: 7355628 - DNA, 22 bp, Homo sapiens
actcaaaagaccagagagctga

SEQ ID NO: 7355629 - DNA, 22 bp, Homo sapiens
actatttctagatgctctgata

SEQ ID NO: 7355630 - DNA, 18 bp, Homo sapiens
actattgaggtattcttg

SEQ ID NO: 7355631 - DNA, 22 bp, Homo sapiens
actattgtgtagtagaagcatc

SEQ ID NO: 7355632 - DNA, 20 bp, Homo sapiens
actcaaatcacctgcctcaa

SEQ ID NO: 7355633 - DNA, 22 bp, Homo sapiens
actccacatttgaacacagttc

SEQ ID NO: 7355634 - DNA, 22 bp, Homo sapiens
actcattttataacactgtagt

SEQ ID NO: 7355635 - DNA, 22 bp, Homo sapiens
actcatttgcatgatgtgctat

SEQ ID NO: 7355636 - DNA, 20 bp, Homo sapiens
actcatttccagcatctgat

SEQ ID NO: 7355637 - DNA, 22 bp, Homo sapiens
actcatttgacactttaaactg

SEQ ID NO: 7355638 - DNA, 22 bp, Homo sapiens
actccagggaggtgagtgtgcg

SEQ ID NO: 7355639 - DNA, 22 bp, Homo sapiens
actccaggcatctgcttctgct

SEQ ID NO: 7355640 - DNA, 22 bp, Homo sapiens
actccaggaaacttaggggaaa

SEQ ID NO: 7355641 - DNA, 22 bp, Homo sapiens
actccagacacagacactatga

SEQ ID NO: 7355642 - DNA, 22 bp, Homo sapiens
actccagagctcacatgtctaa

SEQ ID NO: 7355643 - DNA, 22 bp, Homo sapiens
actccagaggcagctgtgctga

SEQ ID NO: 7355644 - DNA, 22 bp, Homo sapiens
actccagatgataagggacagt

SEQ ID NO: 7355645 - DNA, 22 bp, Homo sapiens
agtctctgggcatggttgtgac

SEQ ID NO: 7355646 - DNA, 22 bp, Homo sapiens
agtctctgctggttgtgcctat

SEQ ID NO: 7355647 - DNA, 22 bp, Homo sapiens
agtctctgcatgatgcagcaca

SEQ ID NO: 7355648 - DNA, 22 bp, Homo sapiens
agtctctgcatgcctgctgtgc

SEQ ID NO: 7355649 - DNA, 22 bp, Homo sapiens
agtctcttaaagacagtgttga

SEQ ID NO: 7355650 - DNA, 22 bp, Homo sapiens
agtctctgttccagggcttcag

SEQ ID NO: 7355651 - DNA, 22 bp, Homo sapiens
agtctctgtcgtagatcagcgt

SEQ ID NO: 7355652 - DNA, 20 bp, Homo sapiens
agtctctgtagtgcctgaga

SEQ ID NO: 7355653 - DNA, 22 bp, Homo sapiens
agtcgtctgaactgtctgcttt

SEQ ID NO: 7355654 - DNA, 22 bp, Homo sapiens
agtctacaacgcaagcaacatg

SEQ ID NO: 7355655 - DNA, 19 bp, Homo sapiens
agtctctgaggcctaagtt

SEQ ID NO: 7355656 - DNA, 22 bp, Homo sapiens
actccagggctgaacgaggccc

SEQ ID NO: 7355657 - DNA, 22 bp, Homo sapiens
actgaacagcctttcaaactta

SEQ ID NO: 7355658 - DNA, 22 bp, Homo sapiens
actgaaggtctcagcaaggatg

SEQ ID NO: 7355659 - DNA, 22 bp, Homo sapiens
actgaagggtaatgtgggagcc

SEQ ID NO: 7355660 - DNA, 22 bp, Homo sapiens
actgaagggtaatgtgggagcc

SEQ ID NO: 7355661 - DNA, 22 bp, Homo sapiens
actgaaggctttcccaaggtca

SEQ ID NO: 7355662 - DNA, 22 bp, Homo sapiens
actgaaggcttaactctttcat

SEQ ID NO: 7355663 - DNA, 22 bp, Homo sapiens
actgaaggctttcccaaggtca

SEQ ID NO: 7355664 - DNA, 22 bp, Homo sapiens
actgaaggaagcgggcaggggt

SEQ ID NO: 7355665 - DNA, 22 bp, Homo sapiens
actgaaggaagcgggcaggggt

SEQ ID NO: 7355666 - DNA, 22 bp, Homo sapiens
actgaaggaaacttttgtgttt

SEQ ID NO: 7355667 - DNA, 22 bp, Homo sapiens
actgaaggaaagcctttgcatg

SEQ ID NO: 7355668 - DNA, 22 bp, Homo sapiens
actgaaggaaacttttgtgttt

SEQ ID NO: 7355669 - DNA, 22 bp, Homo sapiens
actgaaagataaatcagttagc

SEQ ID NO: 7355670 - DNA, 22 bp, Homo sapiens
agtctcttaattttttctaagt

SEQ ID NO: 7355671 - DNA, 22 bp, Homo sapiens
agtctcttgctagaatcagcca

SEQ ID NO: 7355672 - DNA, 22 bp, Homo sapiens
agtctggatttagaggtgggcc

SEQ ID NO: 7355673 - DNA, 22 bp, Homo sapiens
agtctggattttctacccttct

SEQ ID NO: 7355674 - DNA, 20 bp, Homo sapiens
actgcttctttctctgacct

SEQ ID NO: 7355675 - DNA, 22 bp, Homo sapiens
actgcttcctggatggccagca

SEQ ID NO: 7355676 - DNA, 22 bp, Homo sapiens
actgctccaccctggggcccag

SEQ ID NO: 7355677 - DNA, 22 bp, Homo sapiens
actgctcacgcattacttgagc

SEQ ID NO: 7355678 - DNA, 22 bp, Homo sapiens
actgctgagcacacaagagtgt

SEQ ID NO: 7355679 - DNA, 22 bp, Homo sapiens
agtggctgctggagtggagatg

SEQ ID NO: 7355680 - DNA, 22 bp, Homo sapiens
actggcagaggatagcactaat

SEQ ID NO: 7355681 - DNA, 22 bp, Homo sapiens
actggcagaacgtgatgcgggt

SEQ ID NO: 7355682 - DNA, 22 bp, Homo sapiens
actgcaacctccgcctgccagg

SEQ ID NO: 7355683 - DNA, 22 bp, Homo sapiens
actgcaacctccgcctgccagg

SEQ ID NO: 7355684 - DNA, 22 bp, Homo sapiens
actgcacagatgaagctgtaaa

SEQ ID NO: 7355685 - DNA, 22 bp, Homo sapiens
actgcaacctccacctcctggg

SEQ ID NO: 7355686 - DNA, 22 bp, Homo sapiens
actgcaacacctcctgggttca

SEQ ID NO: 7355687 - DNA, 22 bp, Homo sapiens
actgcaacctccacctcctggg

SEQ ID NO: 7355688 - DNA, 22 bp, Homo sapiens
actgaaggtctcagcaaggatg

SEQ ID NO: 7355689 - DNA, 22 bp, Homo sapiens
actgattgcattcatagggttt

SEQ ID NO: 7355690 - DNA, 23 bp, Homo sapiens
actgattaggcattacctggaag

SEQ ID NO: 7355691 - DNA, 23 bp, Homo sapiens
actgattaacatgtgtgatattc

SEQ ID NO: 7355692 - DNA, 22 bp, Homo sapiens
actgaggtaattgtgaggatta

SEQ ID NO: 7355693 - DNA, 23 bp, Homo sapiens
actgaggtactgaggttgtgaca

SEQ ID NO: 7355694 - DNA, 22 bp, Homo sapiens
actgatgaaaggtaagactcca

SEQ ID NO: 7355695 - DNA, 22 bp, Homo sapiens
aggcgcagggtttggacccagg

SEQ ID NO: 7355696 - DNA, 22 bp, Homo sapiens
aggcgcagacatacagggtctg

SEQ ID NO: 7355697 - DNA, 22 bp, Homo sapiens
aggctagctaatgagtactgtg

SEQ ID NO: 7355698 - DNA, 22 bp, Homo sapiens
aggctagctgtttcagggctag

SEQ ID NO: 7355699 - DNA, 22 bp, Homo sapiens
aggctagctttggctcagtaaa

SEQ ID NO: 7355700 - DNA, 22 bp, Homo sapiens
aggcgcagaaggccaggggcct

SEQ ID NO: 7355701 - DNA, 22 bp, Homo sapiens
aggcgcagaaggccaggggcct

SEQ ID NO: 7355702 - DNA, 22 bp, Homo sapiens
aggccttcctcggagacaggga

SEQ ID NO: 7355703 - DNA, 22 bp, Homo sapiens
acatttaagttaaaacctcagt

SEQ ID NO: 7355704 - DNA, 22 bp, Homo sapiens
acatttaaccctcaggtttctg

SEQ ID NO: 7355705 - DNA, 22 bp, Homo sapiens
acatttaaccaaactgtttaat

SEQ ID NO: 7355706 - DNA, 22 bp, Homo sapiens
acattgtgcctgtgatattaca

SEQ ID NO: 7355707 - DNA, 22 bp, Homo sapiens
acatttaccctggaacattgga

SEQ ID NO: 7355708 - DNA, 22 bp, Homo sapiens
acatttatataactcactagga

SEQ ID NO: 7355709 - DNA, 22 bp, Homo sapiens
acatttattactcaggttgttg

SEQ ID NO: 7355710 - DNA, 22 bp, Homo sapiens
acatttattactcaggttgttg

SEQ ID NO: 7355711 - DNA, 22 bp, Homo sapiens
acatttcactgttcacagcagg

SEQ ID NO: 7355712 - DNA, 22 bp, Homo sapiens
acatttattttggcacggcaca

SEQ ID NO: 7355713 - DNA, 22 bp, Homo sapiens
acatgaggaaacaagggtatat

SEQ ID NO: 7355714 - DNA, 22 bp, Homo sapiens
acatgaggtaagggatgttaag

SEQ ID NO: 7355715 - DNA, 22 bp, Homo sapiens
acatgaggaactcaggagtcac

SEQ ID NO: 7355716 - DNA, 23 bp, Homo sapiens
acatgatacacaattagcaaacc

SEQ ID NO: 7355717 - DNA, 22 bp, Homo sapiens
acatgatattaatgtcttattt

SEQ ID NO: 7355718 - DNA, 22 bp, Homo sapiens
acatgcacccagggcattgctt

SEQ ID NO: 7355719 - DNA, 22 bp, Homo sapiens
acatgcacccagttacactctc

SEQ ID NO: 7355720 - DNA, 22 bp, Homo sapiens
acatgcaatattgagactttct

SEQ ID NO: 7355721 - DNA, 19 bp, Homo sapiens
acatgcaaggcacctgcag

SEQ ID NO: 7355722 - DNA, 19 bp, Homo sapiens
acatgcaaggcacctgcag

SEQ ID NO: 7355723 - DNA, 22 bp, Homo sapiens
acatgcaagcccctgaacacat

SEQ ID NO: 7355724 - DNA, 22 bp, Homo sapiens
acatgcaagcccctgaacacat

SEQ ID NO: 7355725 - DNA, 23 bp, Homo sapiens
acatgcaaaaatcacagtctcct

SEQ ID NO: 7355726 - DNA, 23 bp, Homo sapiens
acatgcaaaaatcacagtctcct

SEQ ID NO: 7355727 - DNA, 22 bp, Homo sapiens
acatgcaaaaatatatttatga

SEQ ID NO: 7355728 - DNA, 22 bp, Homo sapiens
acatgcaaaaatatatttatga

SEQ ID NO: 7355729 - DNA, 22 bp, Homo sapiens
acatgcaacaaagtacctgcaa

SEQ ID NO: 7355730 - DNA, 22 bp, Homo sapiens
acatgcaaatgtgcatgcatgt

SEQ ID NO: 7355731 - DNA, 22 bp, Homo sapiens
acatgcaaagggatgcaattat

SEQ ID NO: 7355732 - DNA, 22 bp, Homo sapiens
acatgcaaagggatgcaattat

SEQ ID NO: 7355733 - DNA, 22 bp, Homo sapiens
acatgaaatgcagcctgtaacc

SEQ ID NO: 7355734 - DNA, 22 bp, Homo sapiens
acatgaaatgcagcctgtaacc

SEQ ID NO: 7355735 - DNA, 22 bp, Homo sapiens
aggcaggcactccggaagtgtc

SEQ ID NO: 7355736 - DNA, 22 bp, Homo sapiens
aggcaggcagggctcactgtct

SEQ ID NO: 7355737 - DNA, 17 bp, Homo sapiens
aggcaggcagagcggga

SEQ ID NO: 7355738 - DNA, 22 bp, Homo sapiens
acatggaagataaaaatactca

SEQ ID NO: 7355739 - DNA, 21 bp, Homo sapiens
acatggaagagaaattaacca

SEQ ID NO: 7355740 - DNA, 22 bp, Homo sapiens
acatggaaaactaactgctttt

SEQ ID NO: 7355741 - DNA, 22 bp, Homo sapiens
aggccctgttatgagccactgt

SEQ ID NO: 7355742 - DNA, 22 bp, Homo sapiens
aggccctgttgtagcattttgg

SEQ ID NO: 7355743 - DNA, 22 bp, Homo sapiens
acatggagaccagatggaagta

SEQ ID NO: 7355744 - DNA, 21 bp, Homo sapiens
acatggactgtgaatggggac

SEQ ID NO: 7355745 - DNA, 22 bp, Homo sapiens
acatggcaaaagggactttaca

SEQ ID NO: 7355746 - DNA, 22 bp, Homo sapiens
acatggcattcactcccacagg

SEQ ID NO: 7355747 - DNA, 20 bp, Homo sapiens
aggccctgccagggacggag

SEQ ID NO: 7355748 - DNA, 22 bp, Homo sapiens
acatgcagggctttttgcctct

SEQ ID NO: 7355749 - DNA, 22 bp, Homo sapiens
acatgcacggcaccatcttctg

SEQ ID NO: 7355750 - DNA, 22 bp, Homo sapiens
acatgcactctcactgtgctct

SEQ ID NO: 7355751 - DNA, 20 bp, Homo sapiens
aggccctgtgcatcttgttt

SEQ ID NO: 7355752 - DNA, 22 bp, Homo sapiens
aggccctgtccatggtgctgaa

SEQ ID NO: 7355753 - DNA, 22 bp, Homo sapiens
aggccctggtcaggtctggctg

SEQ ID NO: 7355754 - DNA, 22 bp, Homo sapiens
aggccctgtaaggtgtggagat

SEQ ID NO: 7355755 - DNA, 20 bp, Homo sapiens
accaggccccgggccctgca

SEQ ID NO: 7355756 - DNA, 22 bp, Homo sapiens
accaggcccaccgcatgctcct

SEQ ID NO: 7355757 - DNA, 22 bp, Homo sapiens
accaggcccaccgcatgctcct

SEQ ID NO: 7355758 - DNA, 22 bp, Homo sapiens
agggaatgtagcaagatgccaa

SEQ ID NO: 7355759 - DNA, 22 bp, Homo sapiens
agggacacgaggtcctgctggg

SEQ ID NO: 7355760 - DNA, 21 bp, Homo sapiens
agggacacacaggatggggct

SEQ ID NO: 7355761 - DNA, 22 bp, Homo sapiens
agggaagaggaccagagtctct

SEQ ID NO: 7355762 - DNA, 22 bp, Homo sapiens
agggaagcaatattagatatca

SEQ ID NO: 7355763 - DNA, 22 bp, Homo sapiens
agggaagcttgttactgagaag

SEQ ID NO: 7355764 - DNA, 22 bp, Homo sapiens
agggaagccaagccttagagaa

SEQ ID NO: 7355765 - DNA, 20 bp, Homo sapiens
aggctggcactcctggccag

SEQ ID NO: 7355766 - DNA, 22 bp, Homo sapiens
aggctggcaaggcagatgtgtg

SEQ ID NO: 7355767 - DNA, 22 bp, Homo sapiens
agggaagagcttgcaagaaacc

SEQ ID NO: 7355768 - DNA, 22 bp, Homo sapiens
agggaagaggaccagagtctct

SEQ ID NO: 7355769 - DNA, 19 bp, Homo sapiens
accaaaggagtggggtata

SEQ ID NO: 7355770 - DNA, 22 bp, Homo sapiens
acattttttagagtcccacatt

SEQ ID NO: 7355771 - DNA, 22 bp, Homo sapiens
accaaaaagatatgttgaagcc

SEQ ID NO: 7355772 - DNA, 22 bp, Homo sapiens
accaaaaagatatgttgaagcc

SEQ ID NO: 7355773 - DNA, 22 bp, Homo sapiens
accaaaaattgtggggctgaat

SEQ ID NO: 7355774 - DNA, 22 bp, Homo sapiens
acatttgtcttctttcagatta

SEQ ID NO: 7355775 - DNA, 22 bp, Homo sapiens
acatttgtgcaacgtatccaca

SEQ ID NO: 7355776 - DNA, 22 bp, Homo sapiens
accatcagagcacagtccgtgc

SEQ ID NO: 7355777 - DNA, 22 bp, Homo sapiens
accatcagtcacatgtagagaa

SEQ ID NO: 7355778 - DNA, 22 bp, Homo sapiens
accatcagtactggatgctgac

SEQ ID NO: 7355779 - DNA, 22 bp, Homo sapiens
accatttaaggaaaatgtatca

SEQ ID NO: 7355780 - DNA, 22 bp, Homo sapiens
agggcatgaagcagtggacagc

SEQ ID NO: 7355781 - DNA, 23 bp, Homo sapiens
agggcatgaagcagaggacgtgg

SEQ ID NO: 7355782 - DNA, 23 bp, Homo sapiens
agggcatgaagcagaggacgtgg

SEQ ID NO: 7355783 - DNA, 22 bp, Homo sapiens
agggcatgaagcagtggacagc

SEQ ID NO: 7355784 - DNA, 22 bp, Homo sapiens
agggcatgaaatgggcagaagc

SEQ ID NO: 7355785 - DNA, 22 bp, Homo sapiens
agggcatgaaatgggcagaagc

SEQ ID NO: 7355786 - DNA, 22 bp, Homo sapiens
agggcatgaaatgggcagaagc

SEQ ID NO: 7355787 - DNA, 22 bp, Homo sapiens
agggcagttcagccacaggctc

SEQ ID NO: 7355788 - DNA, 22 bp, Homo sapiens
agggcatctagttccctctctt

SEQ ID NO: 7355789 - DNA, 22 bp, Homo sapiens
accatttgactctctaaggata

SEQ ID NO: 7355790 - DNA, 20 bp, Homo sapiens
agggcagcttgaggagccgg

SEQ ID NO: 7355791 - DNA, 22 bp, Homo sapiens
acccgggaggcaggagtcatag

SEQ ID NO: 7355792 - DNA, 22 bp, Homo sapiens
accctagacattgaactagggt

SEQ ID NO: 7355793 - DNA, 22 bp, Homo sapiens
accctcagacagctgtggccag

SEQ ID NO: 7355794 - DNA, 22 bp, Homo sapiens
acccgatgttggtgctctagta

SEQ ID NO: 7355795 - DNA, 22 bp, Homo sapiens
acccaggcctgagagacaggag

SEQ ID NO: 7355796 - DNA, 22 bp, Homo sapiens
acccaggcgggagtgcagtgtc

SEQ ID NO: 7355797 - DNA, 22 bp, Homo sapiens
acccaggctagagtgcagtggt

SEQ ID NO: 7355798 - DNA, 18 bp, Homo sapiens
acccaggctcatggtcct

SEQ ID NO: 7355799 - DNA, 22 bp, Homo sapiens
acccaggctagggtgcagtggc

SEQ ID NO: 7355800 - DNA, 22 bp, Homo sapiens
agggcctgggaagaggaaccct

SEQ ID NO: 7355801 - DNA, 22 bp, Homo sapiens
acccaggctggagtgcagtgac

SEQ ID NO: 7355802 - DNA, 22 bp, Homo sapiens
acagctcctactgaagccatgt

SEQ ID NO: 7355803 - DNA, 22 bp, Homo sapiens
acagctcctggggctttaatgg

SEQ ID NO: 7355804 - DNA, 22 bp, Homo sapiens
acagctacatggaatttcattt

SEQ ID NO: 7355805 - DNA, 21 bp, Homo sapiens
acagccttgtgatggagacag

SEQ ID NO: 7355806 - DNA, 22 bp, Homo sapiens
acagctaggtcttcagcacttt

SEQ ID NO: 7355807 - DNA, 22 bp, Homo sapiens
acagctcctaacaaaggctctc

SEQ ID NO: 7355808 - DNA, 22 bp, Homo sapiens
acagctgcacttgaagcaggtt

SEQ ID NO: 7355809 - DNA, 19 bp, Homo sapiens
agctggggcggtgtgtgtt

SEQ ID NO: 7355810 - DNA, 23 bp, Homo sapiens
agctgggcaaggatccgggctcc

SEQ ID NO: 7355811 - DNA, 22 bp, Homo sapiens
agctgggggtagtgagaaataa

SEQ ID NO: 7355812 - DNA, 22 bp, Homo sapiens
agctggggctgtggttgtgatt

SEQ ID NO: 7355813 - DNA, 22 bp, Homo sapiens
agctggggctgcagagaacagg

SEQ ID NO: 7355814 - DNA, 22 bp, Homo sapiens
agctgggggttggataagggta

SEQ ID NO: 7355815 - DNA, 22 bp, Homo sapiens
agctggggttgcacacattttg

SEQ ID NO: 7355816 - DNA, 21 bp, Homo sapiens
acagcagacaggcttaggacc

SEQ ID NO: 7355817 - DNA, 22 bp, Homo sapiens
acagcacaggagttgaatgggc

SEQ ID NO: 7355818 - DNA, 22 bp, Homo sapiens
acagcacttattcagcacagtg

SEQ ID NO: 7355819 - DNA, 22 bp, Homo sapiens
agctgcctgggcttgtacacct

SEQ ID NO: 7355820 - DNA, 22 bp, Homo sapiens
agctgctatgaacattcacata

SEQ ID NO: 7355821 - DNA, 22 bp, Homo sapiens
agctgctatgacaacaccagcc

SEQ ID NO: 7355822 - DNA, 23 bp, Homo sapiens
acagccttctggggcttctgggc

SEQ ID NO: 7355823 - DNA, 22 bp, Homo sapiens
acagccttgatattaattgtct

SEQ ID NO: 7355824 - DNA, 22 bp, Homo sapiens
acagccttgtagcatcttagcc

SEQ ID NO: 7355825 - DNA, 18 bp, Homo sapiens
acaggctgtgggaatggt

SEQ ID NO: 7355826 - DNA, 22 bp, Homo sapiens
acaggctgtacttctaatcatc

SEQ ID NO: 7355827 - DNA, 22 bp, Homo sapiens
acaggctggtttgtaaaagatg

SEQ ID NO: 7355828 - DNA, 22 bp, Homo sapiens
aggaatgatagtaaaagagaat

SEQ ID NO: 7355829 - DNA, 22 bp, Homo sapiens
acaggctggtggtcctggccat

SEQ ID NO: 7355830 - DNA, 22 bp, Homo sapiens
acaggctggtggtcctggccat

SEQ ID NO: 7355831 - DNA, 22 bp, Homo sapiens
acaggctggtggtcctggccat

SEQ ID NO: 7355832 - DNA, 22 bp, Homo sapiens
acaggctgggcgcttcctgcgg

SEQ ID NO: 7355833 - DNA, 22 bp, Homo sapiens
acaggctgggcgcttcctgcgg

SEQ ID NO: 7355834 - DNA, 22 bp, Homo sapiens
acaggctgctgggctccgtgct

SEQ ID NO: 7355835 - DNA, 22 bp, Homo sapiens
acaggctgctgggctccgtgct

SEQ ID NO: 7355836 - DNA, 22 bp, Homo sapiens
acaggctgctgggctccgtgct

SEQ ID NO: 7355837 - DNA, 22 bp, Homo sapiens
acaggctggaggaggaccaaga

SEQ ID NO: 7355838 - DNA, 22 bp, Homo sapiens
acaggctgcctaccaagtatca

SEQ ID NO: 7355839 - DNA, 22 bp, Homo sapiens
acaggctgctgagccatttgct

SEQ ID NO: 7355840 - DNA, 22 bp, Homo sapiens
acaggctgcccgctccccacct

SEQ ID NO: 7355841 - DNA, 21 bp, Homo sapiens
acaggctctggggatgctggg

SEQ ID NO: 7355842 - DNA, 22 bp, Homo sapiens
acaggcctgacacacagagggc

SEQ ID NO: 7355843 - DNA, 22 bp, Homo sapiens
acagcttagccagtcaagctct

SEQ ID NO: 7355844 - DNA, 22 bp, Homo sapiens
acagcttaatcagtatgagcct

SEQ ID NO: 7355845 - DNA, 22 bp, Homo sapiens
acagctgtgacttagagaagtt

SEQ ID NO: 7355846 - DNA, 22 bp, Homo sapiens
aggcagcatgctctgcttctac

SEQ ID NO: 7355847 - DNA, 22 bp, Homo sapiens
acagtttgccctgacattctcc

SEQ ID NO: 7355848 - DNA, 22 bp, Homo sapiens
acagtttggttgctacagtaaa

SEQ ID NO: 7355849 - DNA, 22 bp, Homo sapiens
acagtttggcgtgattgatagt

SEQ ID NO: 7355850 - DNA, 22 bp, Homo sapiens
aggcagcatgggccccagctcc

SEQ ID NO: 7355851 - DNA, 22 bp, Homo sapiens
aggcagcatgggcccagagtcc

SEQ ID NO: 7355852 - DNA, 22 bp, Homo sapiens
aggcaggattgctgacaacaat

SEQ ID NO: 7355853 - DNA, 22 bp, Homo sapiens
aggcaggcaaccacctgggaag

SEQ ID NO: 7355854 - DNA, 21 bp, Homo sapiens
acagttttaaggagcacatgg

SEQ ID NO: 7355855 - DNA, 22 bp, Homo sapiens
acagtttgttccttttcattgc

SEQ ID NO: 7355856 - DNA, 22 bp, Homo sapiens
acagtgcaaaccctcgggaaag

SEQ ID NO: 7355857 - DNA, 22 bp, Homo sapiens
acagtgattattagttggtggt

SEQ ID NO: 7355858 - DNA, 22 bp, Homo sapiens
acagttacatcacttactgaca

SEQ ID NO: 7355859 - DNA, 22 bp, Homo sapiens
acagttacattccagcaacatc

SEQ ID NO: 7355860 - DNA, 22 bp, Homo sapiens
acagttacattaaacaaaagga

SEQ ID NO: 7355861 - DNA, 22 bp, Homo sapiens
acagttacatgattcttgtgag

SEQ ID NO: 7355862 - DNA, 22 bp, Homo sapiens
acagttactcatagaagcactt

SEQ ID NO: 7355863 - DNA, 22 bp, Homo sapiens
acagttaccacttagcagttac

SEQ ID NO: 7355864 - DNA, 22 bp, Homo sapiens
acagttattttcccagcattta

SEQ ID NO: 7355865 - DNA, 22 bp, Homo sapiens
acagttcaagcaagtttctgtt

SEQ ID NO: 7355866 - DNA, 22 bp, Homo sapiens
acagttatctttgaaatagaga

SEQ ID NO: 7355867 - DNA, 22 bp, Homo sapiens
acagttatatacatgtagctgt

SEQ ID NO: 7355868 - DNA, 22 bp, Homo sapiens
acagtgaggacagggactgtgt

SEQ ID NO: 7355869 - DNA, 22 bp, Homo sapiens
aggagtcaggaattatttatga

SEQ ID NO: 7355870 - DNA, 22 bp, Homo sapiens
acagtacaagcaatgcattttt

SEQ ID NO: 7355871 - DNA, 22 bp, Homo sapiens
acagtacaagcaatgcattttt

SEQ ID NO: 7355872 - DNA, 22 bp, Homo sapiens
acagtacaagcatgatacataa

SEQ ID NO: 7355873 - DNA, 21 bp, Homo sapiens
aggaggaacccgtggctgggc

SEQ ID NO: 7355874 - DNA, 22 bp, Homo sapiens
acaggtggtaaaatggactgtc

SEQ ID NO: 7355875 - DNA, 22 bp, Homo sapiens
acagggtggggatggtgagctt

SEQ ID NO: 7355876 - DNA, 22 bp, Homo sapiens
acagggtggggatggtgagctt

SEQ ID NO: 7355877 - DNA, 22 bp, Homo sapiens
acagggtggggatggtgagctt

SEQ ID NO: 7355878 - DNA, 22 bp, Homo sapiens
acagatgtaccttagtgatggg

SEQ ID NO: 7355879 - DNA, 22 bp, Homo sapiens
agctcccagagtcctctgccca

SEQ ID NO: 7355880 - DNA, 22 bp, Homo sapiens
acagcaattgtatgcatagcat

SEQ ID NO: 7355881 - DNA, 22 bp, Homo sapiens
agctcctgcttgacagaagagg

SEQ ID NO: 7355882 - DNA, 22 bp, Homo sapiens
agctcctgcgcacggtgcacac

SEQ ID NO: 7355883 - DNA, 22 bp, Homo sapiens
acagcacaggagttgaatgggc

SEQ ID NO: 7355884 - DNA, 22 bp, Homo sapiens
agctcctgccaacactgatggg

SEQ ID NO: 7355885 - DNA, 22 bp, Homo sapiens
agctcctgcccaggaaggctct

SEQ ID NO: 7355886 - DNA, 17 bp, Homo sapiens
agctcctgcccatggct

SEQ ID NO: 7355887 - DNA, 22 bp, Homo sapiens
agctcctgcgcacggtgcacac

SEQ ID NO: 7355888 - DNA, 17 bp, Homo sapiens
acagatgctgataagaa

SEQ ID NO: 7355889 - DNA, 22 bp, Homo sapiens
acagatgagttaaagcagagtg

SEQ ID NO: 7355890 - DNA, 22 bp, Homo sapiens
acagatgaggctggcgagggca

SEQ ID NO: 7355891 - DNA, 22 bp, Homo sapiens
acagatgagttaaagcagagtg

SEQ ID NO: 7355892 - DNA, 22 bp, Homo sapiens
acagatgagttagaataggcag

SEQ ID NO: 7355893 - DNA, 22 bp, Homo sapiens
acagagcctccaggagtgctgg

SEQ ID NO: 7355894 - DNA, 22 bp, Homo sapiens
acagatatttggggaaagacgt

SEQ ID NO: 7355895 - DNA, 22 bp, Homo sapiens
acagagcatttgggacagagag

SEQ ID NO: 7355896 - DNA, 21 bp, Homo sapiens
acagagccgggcacaaagctg

SEQ ID NO: 7355897 - DNA, 22 bp, Homo sapiens
agcctctgactgtcagcaaggt

SEQ ID NO: 7355898 - DNA, 22 bp, Homo sapiens
agcctctgactgtcagcaaggt

SEQ ID NO: 7355899 - DNA, 22 bp, Homo sapiens
agcctcctgtagccctcaccca

SEQ ID NO: 7355900 - DNA, 22 bp, Homo sapiens
agcctctcagagtgctgggatt

SEQ ID NO: 7355901 - DNA, 22 bp, Homo sapiens
agcctctctgatgtgacagcta

SEQ ID NO: 7355902 - DNA, 22 bp, Homo sapiens
acagagagaaacaatcagcagc

SEQ ID NO: 7355903 - DNA, 22 bp, Homo sapiens
acagagagaaacaatcagcagc

SEQ ID NO: 7355904 - DNA, 22 bp, Homo sapiens
acagagagaggcccgaggctgc

SEQ ID NO: 7355905 - DNA, 22 bp, Homo sapiens
acagagagctgtgattgagtta

SEQ ID NO: 7355906 - DNA, 22 bp, Homo sapiens
acagagagaattgggtttacag

SEQ ID NO: 7355907 - DNA, 22 bp, Homo sapiens
acagactgtgagtatgcatagt

SEQ ID NO: 7355908 - DNA, 22 bp, Homo sapiens
acagactgtcatgacactatat

SEQ ID NO: 7355909 - DNA, 23 bp, Homo sapiens
acagacattccataatgtacacc

SEQ ID NO: 7355910 - DNA, 22 bp, Homo sapiens
agccagggtctctcgctctgtt

SEQ ID NO: 7355911 - DNA, 22 bp, Homo sapiens
agccagggtctctcgctctgtt

SEQ ID NO: 7355912 - DNA, 22 bp, Homo sapiens
acagacagaggctccatgagga

SEQ ID NO: 7355913 - DNA, 22 bp, Homo sapiens
acagacagattttgtctgatgt

SEQ ID NO: 7355914 - DNA, 22 bp, Homo sapiens
agccagggggacgctttctggc

SEQ ID NO: 7355915 - DNA, 22 bp, Homo sapiens
acagaaagataggcacaaggtc

SEQ ID NO: 7355916 - DNA, 20 bp, Homo sapiens
acagaaagagagaatgtcag

SEQ ID NO: 7355917 - DNA, 22 bp, Homo sapiens
acagaattaatgaaaattacaa

SEQ ID NO: 7355918 - DNA, 22 bp, Homo sapiens
acagacaagtagttcagacaag

SEQ ID NO: 7355919 - DNA, 22 bp, Homo sapiens
acactttatcaatattcaaaaa

SEQ ID NO: 7355920 - DNA, 22 bp, Homo sapiens
acacagaggctccagagataga

SEQ ID NO: 7355921 - DNA, 22 bp, Homo sapiens
acacagaggcatgacagtggct

SEQ ID NO: 7355922 - DNA, 22 bp, Homo sapiens
acacagagtttgacacatggga

SEQ ID NO: 7355923 - DNA, 22 bp, Homo sapiens
acacagagttattatgtgaact

SEQ ID NO: 7355924 - DNA, 22 bp, Homo sapiens
acacagagtatttagaaggggt

SEQ ID NO: 7355925 - DNA, 22 bp, Homo sapiens
acacagagtccttactgaggta

SEQ ID NO: 7355926 - DNA, 22 bp, Homo sapiens
acacagataatgctcatatagg

SEQ ID NO: 7355927 - DNA, 22 bp, Homo sapiens
acacagatattgtacttgatcc

SEQ ID NO: 7355928 - DNA, 22 bp, Homo sapiens
acacagatgcattacacatcta

SEQ ID NO: 7355929 - DNA, 17 bp, Homo sapiens
acaatgcagtctctagt

SEQ ID NO: 7355930 - DNA, 22 bp, Homo sapiens
acaatgcaccagcatcttcacc

SEQ ID NO: 7355931 - DNA, 21 bp, Homo sapiens
acaatgcatggaactcatggc

SEQ ID NO: 7355932 - DNA, 22 bp, Homo sapiens
agcagaactgatgagacttgag

SEQ ID NO: 7355933 - DNA, 22 bp, Homo sapiens
agcagataggacatttcattct

SEQ ID NO: 7355934 - DNA, 22 bp, Homo sapiens
agcagcaaaagagaatagtttg

SEQ ID NO: 7355935 - DNA, 22 bp, Homo sapiens
agcagattggttaagcacatta

SEQ ID NO: 7355936 - DNA, 22 bp, Homo sapiens
acacagaagatctcttaatgct

SEQ ID NO: 7355937 - DNA, 22 bp, Homo sapiens
acacattaggcagtgcttaaat

SEQ ID NO: 7355938 - DNA, 22 bp, Homo sapiens
acactataagacagatacagca

SEQ ID NO: 7355939 - DNA, 22 bp, Homo sapiens
acactagctattaacttcacat

SEQ ID NO: 7355940 - DNA, 22 bp, Homo sapiens
acacccaggaataaggactggg

SEQ ID NO: 7355941 - DNA, 22 bp, Homo sapiens
acactctgtaatgtcacactcc

SEQ ID NO: 7355942 - DNA, 22 bp, Homo sapiens
acactatttaaatctaacctgt

SEQ ID NO: 7355943 - DNA, 22 bp, Homo sapiens
acactatacttccattgctggt

SEQ ID NO: 7355944 - DNA, 22 bp, Homo sapiens
acactgaaagaagccagcttgt

SEQ ID NO: 7355945 - DNA, 22 bp, Homo sapiens
acactgagctgagcattcttgt

SEQ ID NO: 7355946 - DNA, 22 bp, Homo sapiens
acactgaatgctgtttagaaat

SEQ ID NO: 7355947 - DNA, 22 bp, Homo sapiens
acactttagaaaaaagaatggt

SEQ ID NO: 7355948 - DNA, 22 bp, Homo sapiens
acactttacagcttcctttgca

SEQ ID NO: 7355949 - DNA, 22 bp, Homo sapiens
acactttactcttacaccattg

SEQ ID NO: 7355950 - DNA, 21 bp, Homo sapiens
acactgagtgaattagcacat

SEQ ID NO: 7355951 - DNA, 22 bp, Homo sapiens
acactgagtgagaaaaggaaat

SEQ ID NO: 7355952 - DNA, 22 bp, Homo sapiens
acacatgtgattctaagacagc

SEQ ID NO: 7355953 - DNA, 20 bp, Homo sapiens
acacatgtcaagctaaaggc

SEQ ID NO: 7355954 - DNA, 22 bp, Homo sapiens
acacatgtacagattagtattt

SEQ ID NO: 7355955 - DNA, 22 bp, Homo sapiens
acacatgtttacagtcttcagt

SEQ ID NO: 7355956 - DNA, 19 bp, Homo sapiens
acacatgtgtgttatgtgc

SEQ ID NO: 7355957 - DNA, 22 bp, Homo sapiens
acacatgtgtctgcatgcagtg

SEQ ID NO: 7355958 - DNA, 22 bp, Homo sapiens
acacattaaaacgtctacaatg

SEQ ID NO: 7355959 - DNA, 22 bp, Homo sapiens
acacatgtttgtgtagtcagtt

SEQ ID NO: 7355960 - DNA, 18 bp, Homo sapiens
acacaggctgacagcacc

SEQ ID NO: 7355961 - DNA, 22 bp, Homo sapiens
acacagggatatttcaggtggt

SEQ ID NO: 7355962 - DNA, 22 bp, Homo sapiens
acacagggaggaggtgctgtgc

SEQ ID NO: 7355963 - DNA, 17 bp, Homo sapiens
acacagggagagggagc

SEQ ID NO: 7355964 - DNA, 17 bp, Homo sapiens
acacagggagagggagc

SEQ ID NO: 7355965 - DNA, 19 bp, Homo sapiens
acacagggatcagagggtt

SEQ ID NO: 7355966 - DNA, 19 bp, Homo sapiens
acacagggatcagagggtt

SEQ ID NO: 7355967 - DNA, 19 bp, Homo sapiens
acacagggatcagagggtt

SEQ ID NO: 7355968 - DNA, 22 bp, Homo sapiens
acacagggcagagagctggctc

SEQ ID NO: 7355969 - DNA, 22 bp, Homo sapiens
acacagggcagagagctggctc

SEQ ID NO: 7355970 - DNA, 19 bp, Homo sapiens
acacatgtaacagtttttc

SEQ ID NO: 7355971 - DNA, 19 bp, Homo sapiens
acacatgtaacagtttttc

SEQ ID NO: 7355972 - DNA, 22 bp, Homo sapiens
acacatcttagactgaaatatg

SEQ ID NO: 7355973 - DNA, 22 bp, Homo sapiens
agagacaggatatctgctcatg

SEQ ID NO: 7355974 - DNA, 22 bp, Homo sapiens
agagcaggtggcaactctggga

SEQ ID NO: 7355975 - DNA, 22 bp, Homo sapiens
agagccagttaagcacttacag

SEQ ID NO: 7355976 - DNA, 22 bp, Homo sapiens
agagccagttacaactgtggag

SEQ ID NO: 7355977 - DNA, 22 bp, Homo sapiens
aattctgatccagaacctgtca

SEQ ID NO: 7355978 - DNA, 22 bp, Homo sapiens
aattctgatccagaacctgtca

SEQ ID NO: 7355979 - DNA, 22 bp, Homo sapiens
aattctgatgaataaatcatcc

SEQ ID NO: 7355980 - DNA, 22 bp, Homo sapiens
agagcctggacctgggctctga

SEQ ID NO: 7355981 - DNA, 18 bp, Homo sapiens
agagacagcagcaaaaga

SEQ ID NO: 7355982 - DNA, 22 bp, Homo sapiens
agagacagatctgagggacctc

SEQ ID NO: 7355983 - DNA, 22 bp, Homo sapiens
aatgttttaaaagagattgaga

SEQ ID NO: 7355984 - DNA, 22 bp, Homo sapiens
aatgtttgtgcataaatatgtt

SEQ ID NO: 7355985 - DNA, 22 bp, Homo sapiens
aatgtttgtcatcacacagata

SEQ ID NO: 7355986 - DNA, 22 bp, Homo sapiens
agacctcaataccaggcaccac

SEQ ID NO: 7355987 - DNA, 18 bp, Homo sapiens
aatgtttgtcctctctaa

SEQ ID NO: 7355988 - DNA, 22 bp, Homo sapiens
aatgtttgtcatcacacagata

SEQ ID NO: 7355989 - DNA, 22 bp, Homo sapiens
aatgttttttggtctgatgaat

SEQ ID NO: 7355990 - DNA, 22 bp, Homo sapiens
agaccctgttagttccagtctt

SEQ ID NO: 7355991 - DNA, 22 bp, Homo sapiens
aatgtgtaaaaggttttcttca

SEQ ID NO: 7355992 - DNA, 21 bp, Homo sapiens
aatgtggtacattacatgcat

SEQ ID NO: 7355993 - DNA, 22 bp, Homo sapiens
aatgtgggggtgagctgtatat

SEQ ID NO: 7355994 - DNA, 22 bp, Homo sapiens
aatgtgggtgttaatagtgcct

SEQ ID NO: 7355995 - DNA, 22 bp, Homo sapiens
aatgtggggaagccatggctga

SEQ ID NO: 7355996 - DNA, 22 bp, Homo sapiens
agaccctctccatgcccactgc

SEQ ID NO: 7355997 - DNA, 20 bp, Homo sapiens
agaccctctggactgggccc

SEQ ID NO: 7355998 - DNA, 20 bp, Homo sapiens
aatgggcagtgtgtgagata

SEQ ID NO: 7355999 - DNA, 22 bp, Homo sapiens
aatgggcatttggggttgagaa

SEQ ID NO: 7356000 - DNA, 22 bp, Homo sapiens
aatggaggtgtctggcctggta

SEQ ID NO: 7356001 - DNA, 22 bp, Homo sapiens
aatggcacccgtaataccaaag

SEQ ID NO: 7356002 - DNA, 22 bp, Homo sapiens
aatggagaccctaaggaagagg

SEQ ID NO: 7356003 - DNA, 22 bp, Homo sapiens
aatggagaggctgtgagtgaga

SEQ ID NO: 7356004 - DNA, 22 bp, Homo sapiens
agacaatgtcaaggtgatcatc

SEQ ID NO: 7356005 - DNA, 22 bp, Homo sapiens
agacaattgttctaagtaaaaa

SEQ ID NO: 7356006 - DNA, 22 bp, Homo sapiens
agacaatgtttggtctacactt

SEQ ID NO: 7356007 - DNA, 19 bp, Homo sapiens
agacaatggggttggcagt

SEQ ID NO: 7356008 - DNA, 22 bp, Homo sapiens
agacaatggctaagtaacctgt

SEQ ID NO: 7356009 - DNA, 22 bp, Homo sapiens
agacaatggagggaaatacttc

SEQ ID NO: 7356010 - DNA, 21 bp, Homo sapiens
agacaatgctgtaaaattcag

SEQ ID NO: 7356011 - DNA, 22 bp, Homo sapiens
agacaatatgtatattaagaat

SEQ ID NO: 7356012 - DNA, 22 bp, Homo sapiens
agaagcagactctgaggcaagg

SEQ ID NO: 7356013 - DNA, 22 bp, Homo sapiens
agaagcagaaggaagcagggcc

SEQ ID NO: 7356014 - DNA, 22 bp, Homo sapiens
agaagcagcaagcccttcaaag

SEQ ID NO: 7356015 - DNA, 23 bp, Homo sapiens
agaagcagcttctggagtatcgg

SEQ ID NO: 7356016 - DNA, 20 bp, Homo sapiens
agacaaaatgacttcatgca

SEQ ID NO: 7356017 - DNA, 22 bp, Homo sapiens
aatgtgaatcttcctttttgat

SEQ ID NO: 7356018 - DNA, 22 bp, Homo sapiens
aatgtaaaatatcttgtacttg

SEQ ID NO: 7356019 - DNA, 23 bp, Homo sapiens
aatgtgctgtattcatttctgga

SEQ ID NO: 7356020 - DNA, 22 bp, Homo sapiens
aatgtgctgtcaacatttcgaa

SEQ ID NO: 7356021 - DNA, 22 bp, Homo sapiens
aatgtgctccactccaggctgc

SEQ ID NO: 7356022 - DNA, 22 bp, Homo sapiens
aatgtgctggtaactgctttgc

SEQ ID NO: 7356023 - DNA, 19 bp, Homo sapiens
aatgtgcttgggagactgc

SEQ ID NO: 7356024 - DNA, 22 bp, Homo sapiens
aatgtgctttgttcagccattt

SEQ ID NO: 7356025 - DNA, 22 bp, Homo sapiens
aatgtgcttctggctgtggtca

SEQ ID NO: 7356026 - DNA, 22 bp, Homo sapiens
aatgtgctccaattgtctactt

SEQ ID NO: 7356027 - DNA, 22 bp, Homo sapiens
aatgtgaggccttggtagttat

SEQ ID NO: 7356028 - DNA, 22 bp, Homo sapiens
aatggtggatgtctgttctgac

SEQ ID NO: 7356029 - DNA, 22 bp, Homo sapiens
aatggtttcaaacacactaagt

SEQ ID NO: 7356030 - DNA, 22 bp, Homo sapiens
aatggtttagttaagactgagt

SEQ ID NO: 7356031 - DNA, 22 bp, Homo sapiens
aatggtttatggggaccgcaaa

SEQ ID NO: 7356032 - DNA, 22 bp, Homo sapiens
aatgggctgaatttcatgaaat

SEQ ID NO: 7356033 - DNA, 23 bp, Homo sapiens
aatgggtgcaactatccatgaca

SEQ ID NO: 7356034 - DNA, 20 bp, Homo sapiens
aatgggctttgatgagtgtg

SEQ ID NO: 7356035 - DNA, 22 bp, Homo sapiens
aattctgttactaatgtgatgt

SEQ ID NO: 7356036 - DNA, 22 bp, Homo sapiens
agaggctctgccgcctcaggta

SEQ ID NO: 7356037 - DNA, 22 bp, Homo sapiens
agaggctctggtgggagttggt

SEQ ID NO: 7356038 - DNA, 22 bp, Homo sapiens
agaggctctttgagctgggaga

SEQ ID NO: 7356039 - DNA, 22 bp, Homo sapiens
aattgcttcattaacatttagg

SEQ ID NO: 7356040 - DNA, 22 bp, Homo sapiens
aattgcttactgtttttcacct

SEQ ID NO: 7356041 - DNA, 22 bp, Homo sapiens
aattgcttagttgcaactatgc

SEQ ID NO: 7356042 - DNA, 22 bp, Homo sapiens
agaggggctcatatcctgtcat

SEQ ID NO: 7356043 - DNA, 22 bp, Homo sapiens
agagggggaaaatagaggtgtt

SEQ ID NO: 7356044 - DNA, 22 bp, Homo sapiens
agagggggaaaatagaggtgtt

SEQ ID NO: 7356045 - DNA, 22 bp, Homo sapiens
agagggggcagcggaccagtga

SEQ ID NO: 7356046 - DNA, 22 bp, Homo sapiens
agagggggaaaatagaggtgtt

SEQ ID NO: 7356047 - DNA, 22 bp, Homo sapiens
agagggggtgtcagcactgcag

SEQ ID NO: 7356048 - DNA, 22 bp, Homo sapiens
agagggggcagcggaccagtga

SEQ ID NO: 7356049 - DNA, 22 bp, Homo sapiens
agagggggcagcggaccagtga

SEQ ID NO: 7356050 - DNA, 22 bp, Homo sapiens
agagggggtgttccagaagcat

SEQ ID NO: 7356051 - DNA, 22 bp, Homo sapiens
agagggggtgtcagcactgcag

SEQ ID NO: 7356052 - DNA, 22 bp, Homo sapiens
agagggggtgttccagaagcat

SEQ ID NO: 7356053 - DNA, 22 bp, Homo sapiens
agagggggtgttccagaagcat

SEQ ID NO: 7356054 - DNA, 22 bp, Homo sapiens
agagggggtgttccagaagcat

SEQ ID NO: 7356055 - DNA, 18 bp, Homo sapiens
acaaaggatcatgaggga

SEQ ID NO: 7356056 - DNA, 22 bp, Homo sapiens
agaggctgtgcccaccaggcaa

SEQ ID NO: 7356057 - DNA, 22 bp, Homo sapiens
agaggctgtgcccaccaggcaa

SEQ ID NO: 7356058 - DNA, 22 bp, Homo sapiens
acaagagattatctacagatga

SEQ ID NO: 7356059 - DNA, 22 bp, Homo sapiens
acaagagattatctacagatga

SEQ ID NO: 7356060 - DNA, 22 bp, Homo sapiens
acaagataaggtgtcagtgtgt

SEQ ID NO: 7356061 - DNA, 22 bp, Homo sapiens
acaacgtatgatctgaaagtat

SEQ ID NO: 7356062 - DNA, 22 bp, Homo sapiens
agataactggtttacattattg

SEQ ID NO: 7356063 - DNA, 22 bp, Homo sapiens
acaacaaagacacttgaaatga

SEQ ID NO: 7356064 - DNA, 22 bp, Homo sapiens
acaacacatgtgtatatgtgtg

SEQ ID NO: 7356065 - DNA, 17 bp, Homo sapiens
acaacagaaatgtattc

SEQ ID NO: 7356066 - DNA, 22 bp, Homo sapiens
agataaattcctaagatttcag

SEQ ID NO: 7356067 - DNA, 22 bp, Homo sapiens
acaatgaaaaaatttactgtgg

SEQ ID NO: 7356068 - DNA, 22 bp, Homo sapiens
acaatgaaaggtattctgaact

SEQ ID NO: 7356069 - DNA, 22 bp, Homo sapiens
acaatgaacacacaaggaattc

SEQ ID NO: 7356070 - DNA, 22 bp, Homo sapiens
acaatgaacgctttttaactgt

SEQ ID NO: 7356071 - DNA, 22 bp, Homo sapiens
acaatgaaccaaatttaccaat

SEQ ID NO: 7356072 - DNA, 22 bp, Homo sapiens
acaatgaaccaaatttaccaat

SEQ ID NO: 7356073 - DNA, 22 bp, Homo sapiens
acaatgcaataggagctagaaa

SEQ ID NO: 7356074 - DNA, 22 bp, Homo sapiens
acaatgaagggagacacttgct

SEQ ID NO: 7356075 - DNA, 22 bp, Homo sapiens
acaatgaatatcatgaagtact

SEQ ID NO: 7356076 - DNA, 22 bp, Homo sapiens
acaatgaatatcatgaagtact

SEQ ID NO: 7356077 - DNA, 22 bp, Homo sapiens
acaagcatgggctttgacatca

SEQ ID NO: 7356078 - DNA, 22 bp, Homo sapiens
acaagcagtaaaggccacagtc

SEQ ID NO: 7356079 - DNA, 23 bp, Homo sapiens
acaagcagcccagtgctctgcct

SEQ ID NO: 7356080 - DNA, 22 bp, Homo sapiens
aatcataattcaaataagctta

SEQ ID NO: 7356081 - DNA, 22 bp, Homo sapiens
aatcagttgttcactctgaaaa

SEQ ID NO: 7356082 - DNA, 22 bp, Homo sapiens
aatcagtttcttggcaagttta

SEQ ID NO: 7356083 - DNA, 22 bp, Homo sapiens
aatcagttgtccaaagttcaca

SEQ ID NO: 7356084 - DNA, 22 bp, Homo sapiens
aatcagttagaaggaagagaat

SEQ ID NO: 7356085 - DNA, 22 bp, Homo sapiens
aatcagttagggtgttaatgag

SEQ ID NO: 7356086 - DNA, 22 bp, Homo sapiens
aatcagttctacatcttatcca

SEQ ID NO: 7356087 - DNA, 19 bp, Homo sapiens
aatcaggctgaagtgtgtt

SEQ ID NO: 7356088 - DNA, 22 bp, Homo sapiens
aatcaggccatggagaagagat

SEQ ID NO: 7356089 - DNA, 22 bp, Homo sapiens
aatcaggcgtcaggaaagatag

SEQ ID NO: 7356090 - DNA, 22 bp, Homo sapiens
aatcagtgcaaaggagagggta

SEQ ID NO: 7356091 - DNA, 22 bp, Homo sapiens
aatcagtggttcccagcccagg

SEQ ID NO: 7356092 - DNA, 22 bp, Homo sapiens
aatcagtgtggtgacttgtctg

SEQ ID NO: 7356093 - DNA, 22 bp, Homo sapiens
aatcagtgtgtaaagtggctgc

SEQ ID NO: 7356094 - DNA, 22 bp, Homo sapiens
aatcagttaaatattgagtaca

SEQ ID NO: 7356095 - DNA, 22 bp, Homo sapiens
aatcagaaattctacatcacaa

SEQ ID NO: 7356096 - DNA, 22 bp, Homo sapiens
aatcagaatcagttgacacagc

SEQ ID NO: 7356097 - DNA, 22 bp, Homo sapiens
agaaatgacacacatgagacat

SEQ ID NO: 7356098 - DNA, 22 bp, Homo sapiens
agaaatgacacacatgagacat

SEQ ID NO: 7356099 - DNA, 22 bp, Homo sapiens
agaaattatgcagtagttttat

SEQ ID NO: 7356100 - DNA, 22 bp, Homo sapiens
agaaattattagtgaatagtct

SEQ ID NO: 7356101 - DNA, 22 bp, Homo sapiens
agaaattattagtgaatagtct

SEQ ID NO: 7356102 - DNA, 22 bp, Homo sapiens
agaaattattagtgaatagtct

SEQ ID NO: 7356103 - DNA, 22 bp, Homo sapiens
agaacaatgaggtatggatgga

SEQ ID NO: 7356104 - DNA, 20 bp, Homo sapiens
agaacaagtactaaaggaga

SEQ ID NO: 7356105 - DNA, 22 bp, Homo sapiens
agaacaatgcgtattttactcc

SEQ ID NO: 7356106 - DNA, 22 bp, Homo sapiens
agaacaatgttaaattattaag

SEQ ID NO: 7356107 - DNA, 22 bp, Homo sapiens
agaagcagaaactgggcttgtg

SEQ ID NO: 7356108 - DNA, 22 bp, Homo sapiens
agaagcagaaactgggcttgtg

SEQ ID NO: 7356109 - DNA, 22 bp, Homo sapiens
agaagcagaaaagggcactttt

SEQ ID NO: 7356110 - DNA, 22 bp, Homo sapiens
aatgatttcccctacacagaag

SEQ ID NO: 7356111 - DNA, 22 bp, Homo sapiens
aatgatttcccctacacagaag

SEQ ID NO: 7356112 - DNA, 22 bp, Homo sapiens
aatgcaaacagcccagaatcca

SEQ ID NO: 7356113 - DNA, 22 bp, Homo sapiens
aatgatggtcatggcaactttt

SEQ ID NO: 7356114 - DNA, 22 bp, Homo sapiens
aatgatggtattgatgagctaa

SEQ ID NO: 7356115 - DNA, 22 bp, Homo sapiens
aatgatggatttagacaagctg

SEQ ID NO: 7356116 - DNA, 22 bp, Homo sapiens
aatgatgggaaggagaaaagca

SEQ ID NO: 7356117 - DNA, 22 bp, Homo sapiens
aatgatggttaaacactggagg

SEQ ID NO: 7356118 - DNA, 22 bp, Homo sapiens
aatgatggtttcatcacttgaa

SEQ ID NO: 7356119 - DNA, 22 bp, Homo sapiens
aatgattactgatcgcatagga

SEQ ID NO: 7356120 - DNA, 22 bp, Homo sapiens
actttatgtttgatatctatgg

SEQ ID NO: 7356121 - DNA, 22 bp, Homo sapiens
actttcttaggctgtataaatg

SEQ ID NO: 7356122 - DNA, 22 bp, Homo sapiens
actttcttaggctgtataaatg

SEQ ID NO: 7356123 - DNA, 22 bp, Homo sapiens
actttcttggtcccatgtttga

SEQ ID NO: 7356124 - DNA, 22 bp, Homo sapiens
actttcttcttatgcattaagg

SEQ ID NO: 7356125 - DNA, 22 bp, Homo sapiens
actttcttctactacttggaga

SEQ ID NO: 7356126 - DNA, 22 bp, Homo sapiens
aatatagtgttagctcatttga

SEQ ID NO: 7356127 - DNA, 22 bp, Homo sapiens
aatatagttctggtattgttaa

SEQ ID NO: 7356128 - DNA, 22 bp, Homo sapiens
aatactgcctgtgaggtaactc

SEQ ID NO: 7356129 - DNA, 22 bp, Homo sapiens
aatactgagatcccacaaagca

SEQ ID NO: 7356130 - DNA, 22 bp, Homo sapiens
aatactctagggcagtgcttct

SEQ ID NO: 7356131 - DNA, 22 bp, Homo sapiens
aatactgaattagttgagacaa

SEQ ID NO: 7356132 - DNA, 22 bp, Homo sapiens
aatactagctgcatttaaaggt

SEQ ID NO: 7356133 - DNA, 20 bp, Homo sapiens
aatactaaacacaaagcagt

SEQ ID NO: 7356134 - DNA, 22 bp, Homo sapiens
aatactagttaaatgaatgaat

SEQ ID NO: 7356135 - DNA, 22 bp, Homo sapiens
aatactatgtagccaaaataat

SEQ ID NO: 7356136 - DNA, 22 bp, Homo sapiens
actggcccttgattgcatcagc

SEQ ID NO: 7356137 - DNA, 22 bp, Homo sapiens
actggctcagagttcctagaga

SEQ ID NO: 7356138 - DNA, 22 bp, Homo sapiens
actggccctggctgctaggctg

SEQ ID NO: 7356139 - DNA, 21 bp, Homo sapiens
actggccctgccttacaaata

SEQ ID NO: 7356140 - DNA, 22 bp, Homo sapiens
actggcccgggagcagaggcct

SEQ ID NO: 7356141 - DNA, 22 bp, Homo sapiens
aatacagaggaaacatttaata

SEQ ID NO: 7356142 - DNA, 22 bp, Homo sapiens
aataccttccaacatcaagaca

SEQ ID NO: 7356143 - DNA, 22 bp, Homo sapiens
aataccttccacagtgaccttg

SEQ ID NO: 7356144 - DNA, 22 bp, Homo sapiens
aataccacctcattctggaggc

SEQ ID NO: 7356145 - DNA, 22 bp, Homo sapiens
actggaggcccctcccagtgaa

SEQ ID NO: 7356146 - DNA, 22 bp, Homo sapiens
actggaggattcctggaaggcg

SEQ ID NO: 7356147 - DNA, 19 bp, Homo sapiens
actggagcctgatggagga

SEQ ID NO: 7356148 - DNA, 22 bp, Homo sapiens
actggagcttctaaggaggagt

SEQ ID NO: 7356149 - DNA, 22 bp, Homo sapiens
actggaggattcctggaaggcg

SEQ ID NO: 7356150 - DNA, 22 bp, Homo sapiens
actggaggggaaaatggtagta

SEQ ID NO: 7356151 - DNA, 22 bp, Homo sapiens
actggaggcccctcccagtgaa

SEQ ID NO: 7356152 - DNA, 22 bp, Homo sapiens
actggaggcccctcccagtgaa

SEQ ID NO: 7356153 - DNA, 22 bp, Homo sapiens
actggaggggaaaatggtagta

SEQ ID NO: 7356154 - DNA, 22 bp, Homo sapiens
actggagtcagggaaaaagtgt

SEQ ID NO: 7356155 - DNA, 22 bp, Homo sapiens
actggacaggttcatggtttta

SEQ ID NO: 7356156 - DNA, 22 bp, Homo sapiens
actggactccccaagggccagg

SEQ ID NO: 7356157 - DNA, 22 bp, Homo sapiens
actgcgggaacccgcggccggc

SEQ ID NO: 7356158 - DNA, 22 bp, Homo sapiens
actgcactccagcctgggtaac

SEQ ID NO: 7356159 - DNA, 22 bp, Homo sapiens
actgatattaaacacaatttaa

SEQ ID NO: 7356160 - DNA, 21 bp, Homo sapiens
actgatattaaccttataaca

SEQ ID NO: 7356161 - DNA, 21 bp, Homo sapiens
actgaggttagatgccttgcc

SEQ ID NO: 7356162 - DNA, 22 bp, Homo sapiens
actgaggttattgcaataaaat

SEQ ID NO: 7356163 - DNA, 22 bp, Homo sapiens
actgaggttgaaatagtgatgt

SEQ ID NO: 7356164 - DNA, 22 bp, Homo sapiens
actgaggttgtagtaggaattc

SEQ ID NO: 7356165 - DNA, 22 bp, Homo sapiens
actgaggtttacttgaaggaga

SEQ ID NO: 7356166 - DNA, 22 bp, Homo sapiens
actgaggtttcattttatcgct

SEQ ID NO: 7356167 - DNA, 22 bp, Homo sapiens
actgaggtttttagtgttaaat

SEQ ID NO: 7356168 - DNA, 22 bp, Homo sapiens
actgagtatcacttcttatttt

SEQ ID NO: 7356169 - DNA, 22 bp, Homo sapiens
actctgcttccacttttgctaa

SEQ ID NO: 7356170 - DNA, 22 bp, Homo sapiens
actctgctggctgcagggcagc

SEQ ID NO: 7356171 - DNA, 22 bp, Homo sapiens
actgaggtggggtctgcttgga

SEQ ID NO: 7356172 - DNA, 20 bp, Homo sapiens
actgaggttagataacaggt

SEQ ID NO: 7356173 - DNA, 22 bp, Homo sapiens
actgaggtctatcatgagccag

SEQ ID NO: 7356174 - DNA, 22 bp, Homo sapiens
actgaggtctcaggtggggaag

SEQ ID NO: 7356175 - DNA, 22 bp, Homo sapiens
actgaggtcatgcatagtttct

SEQ ID NO: 7356176 - DNA, 22 bp, Homo sapiens
actgaggtataattgacataac

SEQ ID NO: 7356177 - DNA, 22 bp, Homo sapiens
actgaggtcaggggtatgtgat

SEQ ID NO: 7356178 - DNA, 22 bp, Homo sapiens
actgaggtagggcacacctagg

SEQ ID NO: 7356179 - DNA, 22 bp, Homo sapiens
acgtgaactgtttttggagatt

SEQ ID NO: 7356180 - DNA, 22 bp, Homo sapiens
acgtagcactgagagatgcagg

SEQ ID NO: 7356181 - DNA, 22 bp, Homo sapiens
acctactaattgagataatagg

SEQ ID NO: 7356182 - DNA, 22 bp, Homo sapiens
aagtctcagaaaactagtgtgg

SEQ ID NO: 7356183 - DNA, 22 bp, Homo sapiens
acgtggagccacagatggagca

SEQ ID NO: 7356184 - DNA, 22 bp, Homo sapiens
acgtggagagaatagggcacca

SEQ ID NO: 7356185 - DNA, 22 bp, Homo sapiens
actacacagggatgtgactacc

SEQ ID NO: 7356186 - DNA, 22 bp, Homo sapiens
actctcagagggtggcagcaat

SEQ ID NO: 7356187 - DNA, 22 bp, Homo sapiens
actctcagggctccagggaaag

SEQ ID NO: 7356188 - DNA, 22 bp, Homo sapiens
actctccacccactcactctgt

SEQ ID NO: 7356189 - DNA, 20 bp, Homo sapiens
actctaactctttacaacag

SEQ ID NO: 7356190 - DNA, 22 bp, Homo sapiens
actctaactaattaataaagcc

SEQ ID NO: 7356191 - DNA, 22 bp, Homo sapiens
actcagagaaacagcagggtgt

SEQ ID NO: 7356192 - DNA, 22 bp, Homo sapiens
actacagaagtcttattagaga

SEQ ID NO: 7356193 - DNA, 22 bp, Homo sapiens
actcactcttaatcagactccc

SEQ ID NO: 7356194 - DNA, 22 bp, Homo sapiens
actcaccacagagcagggaacc

SEQ ID NO: 7356195 - DNA, 22 bp, Homo sapiens
actcagaaccatttactctgag

SEQ ID NO: 7356196 - DNA, 22 bp, Homo sapiens
acatagaacctggcacatagta

SEQ ID NO: 7356197 - DNA, 22 bp, Homo sapiens
acatagaacctggcacatagta

SEQ ID NO: 7356198 - DNA, 22 bp, Homo sapiens
acatatgaggtgttattctatg

SEQ ID NO: 7356199 - DNA, 22 bp, Homo sapiens
acatatgaggtgttattctatg

SEQ ID NO: 7356200 - DNA, 22 bp, Homo sapiens
aaggaggacacccaggactggg

SEQ ID NO: 7356201 - DNA, 22 bp, Homo sapiens
aaggaggagattagtgtttagg

SEQ ID NO: 7356202 - DNA, 22 bp, Homo sapiens
aaggaggaatttcagggtgaat

SEQ ID NO: 7356203 - DNA, 22 bp, Homo sapiens
aaggaggaataaagaggtggtg

SEQ ID NO: 7356204 - DNA, 22 bp, Homo sapiens
aaggcagagggctggatcagag

SEQ ID NO: 7356205 - DNA, 22 bp, Homo sapiens
aaggcagagtctatcttggaag

SEQ ID NO: 7356206 - DNA, 22 bp, Homo sapiens
aaggcagagattagcagaatga

SEQ ID NO: 7356207 - DNA, 22 bp, Homo sapiens
acatatgagtactatacagtgc

SEQ ID NO: 7356208 - DNA, 22 bp, Homo sapiens
acatatgagtactatacagtgc

SEQ ID NO: 7356209 - DNA, 22 bp, Homo sapiens
acatatgtgttgtacatgcatg

SEQ ID NO: 7356210 - DNA, 22 bp, Homo sapiens
acatatgtgttgtacatgcatg

SEQ ID NO: 7356211 - DNA, 19 bp, Homo sapiens
acatatgtggatatacatg

SEQ ID NO: 7356212 - DNA, 17 bp, Homo sapiens
acagtgtctatgaaatg

SEQ ID NO: 7356213 - DNA, 22 bp, Homo sapiens
acagtctttctacattctgtgc

SEQ ID NO: 7356214 - DNA, 22 bp, Homo sapiens
aaggacaggctaacctgacatt

SEQ ID NO: 7356215 - DNA, 22 bp, Homo sapiens
aaggagacatttgcagagcacc

SEQ ID NO: 7356216 - DNA, 22 bp, Homo sapiens
aaggagagagctttgctggaac

SEQ ID NO: 7356217 - DNA, 22 bp, Homo sapiens
aaggagagtacaggagttggta

SEQ ID NO: 7356218 - DNA, 22 bp, Homo sapiens
aaggagagagctttgctggaac

SEQ ID NO: 7356219 - DNA, 22 bp, Homo sapiens
aaggagaggttgtccgtgttgt

SEQ ID NO: 7356220 - DNA, 22 bp, Homo sapiens
aaggagagtacaggagttggta

SEQ ID NO: 7356221 - DNA, 22 bp, Homo sapiens
aagctaagtggaagtcttatca

SEQ ID NO: 7356222 - DNA, 22 bp, Homo sapiens
aagcgcccatgcctgagagcgt

SEQ ID NO: 7356223 - DNA, 22 bp, Homo sapiens
aagcgccatggttcctgcgcag

SEQ ID NO: 7356224 - DNA, 20 bp, Homo sapiens
aagctagcaaaagccacaaa

SEQ ID NO: 7356225 - DNA, 22 bp, Homo sapiens
aagcatttttgaaatggtagga

SEQ ID NO: 7356226 - DNA, 22 bp, Homo sapiens
aagcgccatggttcctgcgcag

SEQ ID NO: 7356227 - DNA, 22 bp, Homo sapiens
aagcctttctctctgggaagga

SEQ ID NO: 7356228 - DNA, 22 bp, Homo sapiens
aagcatttttcacagcaacagc

SEQ ID NO: 7356229 - DNA, 22 bp, Homo sapiens
aagcattttagtaatgaacttg

SEQ ID NO: 7356230 - DNA, 22 bp, Homo sapiens
acagccttctctattggcctca

SEQ ID NO: 7356231 - DNA, 20 bp, Homo sapiens
aagctctgcttcatgtggtc

SEQ ID NO: 7356232 - DNA, 22 bp, Homo sapiens
acagggaaagggacagcagcag

SEQ ID NO: 7356233 - DNA, 22 bp, Homo sapiens
acagggaacaggaatatacaaa

SEQ ID NO: 7356234 - DNA, 22 bp, Homo sapiens
acattttacaccaagacttctt

SEQ ID NO: 7356235 - DNA, 22 bp, Homo sapiens
acattttaatatgcttagtgtg

SEQ ID NO: 7356236 - DNA, 22 bp, Homo sapiens
acatttgtttctctagagtagg

SEQ ID NO: 7356237 - DNA, 22 bp, Homo sapiens
acatttgtttctctagagtagg

SEQ ID NO: 7356238 - DNA, 22 bp, Homo sapiens
acatttgttgccattcatggag

SEQ ID NO: 7356239 - DNA, 22 bp, Homo sapiens
acatttgttcagggctgaggaa

SEQ ID NO: 7356240 - DNA, 22 bp, Homo sapiens
acatttgttgccattcatggag

SEQ ID NO: 7356241 - DNA, 20 bp, Homo sapiens
acatttgtggatctgagaga

SEQ ID NO: 7356242 - DNA, 20 bp, Homo sapiens
acatttgtggatctgagaga

SEQ ID NO: 7356243 - DNA, 22 bp, Homo sapiens
acatttgtgcacatgtgcatgg

SEQ ID NO: 7356244 - DNA, 19 bp, Homo sapiens
acccagagccctttgcagg

SEQ ID NO: 7356245 - DNA, 22 bp, Homo sapiens
acccagagctgggcttggcaaa

SEQ ID NO: 7356246 - DNA, 22 bp, Homo sapiens
acccagagtcatggcacttagc

SEQ ID NO: 7356247 - DNA, 22 bp, Homo sapiens
acccaggatagagtgctgcagt

SEQ ID NO: 7356248 - DNA, 22 bp, Homo sapiens
acccaggaggtggaggctgcag

SEQ ID NO: 7356249 - DNA, 22 bp, Homo sapiens
acccaggaggcaaggttgcagt

SEQ ID NO: 7356250 - DNA, 22 bp, Homo sapiens
acccaggaggcagaggttgcag

SEQ ID NO: 7356251 - DNA, 22 bp, Homo sapiens
accctgagccgccaggaaggcc

SEQ ID NO: 7356252 - DNA, 22 bp, Homo sapiens
accctgccaaggatggccccga

SEQ ID NO: 7356253 - DNA, 22 bp, Homo sapiens
accgagttagccaggatggtct

SEQ ID NO: 7356254 - DNA, 22 bp, Homo sapiens
accctgccctctccagctcagg

SEQ ID NO: 7356255 - DNA, 20 bp, Homo sapiens
accctgccaggcatgtgaat

SEQ ID NO: 7356256 - DNA, 22 bp, Homo sapiens
accctgccgtgggctgcttgtg

SEQ ID NO: 7356257 - DNA, 22 bp, Homo sapiens
aaggctctgcaaaacctccaag

SEQ ID NO: 7356258 - DNA, 22 bp, Homo sapiens
aaggcctttgccccgatacagg

SEQ ID NO: 7356259 - DNA, 22 bp, Homo sapiens
aaggctatgatctttttcatga

SEQ ID NO: 7356260 - DNA, 22 bp, Homo sapiens
aaggctatattcattattctct

SEQ ID NO: 7356261 - DNA, 22 bp, Homo sapiens
aaggctcagggtttaagtttct

SEQ ID NO: 7356262 - DNA, 22 bp, Homo sapiens
aaggccttgcctgacagcacca

SEQ ID NO: 7356263 - DNA, 20 bp, Homo sapiens
aaggcagagtgggttggagc

SEQ ID NO: 7356264 - DNA, 20 bp, Homo sapiens
aaggcagagtgggttggagc

SEQ ID NO: 7356265 - DNA, 22 bp, Homo sapiens
aaggcctccgccaatggcagag

SEQ ID NO: 7356266 - DNA, 22 bp, Homo sapiens
aaggcctcatgtaatcaggccc

SEQ ID NO: 7356267 - DNA, 22 bp, Homo sapiens
aaggcccttggaaaatgcagta

SEQ ID NO: 7356268 - DNA, 21 bp, Homo sapiens
aaggctggagatgcaggtctg

SEQ ID NO: 7356269 - DNA, 22 bp, Homo sapiens
acatttaaatatgccttatatt

SEQ ID NO: 7356270 - DNA, 22 bp, Homo sapiens
acatttaaatacctatgtttct

SEQ ID NO: 7356271 - DNA, 22 bp, Homo sapiens
acatttaaatacctatgtttct

SEQ ID NO: 7356272 - DNA, 22 bp, Homo sapiens
acattgttgtttgcagcacagg

SEQ ID NO: 7356273 - DNA, 22 bp, Homo sapiens
acattgttgtgcaattatagtt

SEQ ID NO: 7356274 - DNA, 22 bp, Homo sapiens
acatttctgcatctcagagcta

SEQ ID NO: 7356275 - DNA, 22 bp, Homo sapiens
acatttgtgcacatgtgcatgg

SEQ ID NO: 7356276 - DNA, 22 bp, Homo sapiens
acatttctggagtttctcaaca

SEQ ID NO: 7356277 - DNA, 22 bp, Homo sapiens
aagatgcatgctgaagctggct

SEQ ID NO: 7356278 - DNA, 22 bp, Homo sapiens
aagatgacagatgcttagagtc

SEQ ID NO: 7356279 - DNA, 22 bp, Homo sapiens
aagatgacagatgcttagagtc

SEQ ID NO: 7356280 - DNA, 22 bp, Homo sapiens
aagatgactatttatctgtaag

SEQ ID NO: 7356281 - DNA, 22 bp, Homo sapiens
aagatggcaggaatcataagct

SEQ ID NO: 7356282 - DNA, 22 bp, Homo sapiens
aagatgtatcagttaagtcttc

SEQ ID NO: 7356283 - DNA, 22 bp, Homo sapiens
aagatgtgatggtagcttttac

SEQ ID NO: 7356284 - DNA, 22 bp, Homo sapiens
aagcaataagccagatttggat

SEQ ID NO: 7356285 - DNA, 22 bp, Homo sapiens
aagcaatagcaacaactttaca

SEQ ID NO: 7356286 - DNA, 22 bp, Homo sapiens
aagcaatagcaacaactttaca

SEQ ID NO: 7356287 - DNA, 22 bp, Homo sapiens
aagcaagttctcatcatttata

SEQ ID NO: 7356288 - DNA, 22 bp, Homo sapiens
aagcaagtaggtatttgacaaa

SEQ ID NO: 7356289 - DNA, 22 bp, Homo sapiens
aagcaagtacaatagcaagtac

SEQ ID NO: 7356290 - DNA, 22 bp, Homo sapiens
aagcaaggccggaaggaaactc

SEQ ID NO: 7356291 - DNA, 19 bp, Homo sapiens
aagcaagctttgagtgggt

SEQ ID NO: 7356292 - DNA, 22 bp, Homo sapiens
aagcaagagttggagtgatgtt

SEQ ID NO: 7356293 - DNA, 22 bp, Homo sapiens
aagcaagcccaggctcagtcaa

SEQ ID NO: 7356294 - DNA, 22 bp, Homo sapiens
aagatgtgtgattaagctctga

SEQ ID NO: 7356295 - DNA, 22 bp, Homo sapiens
aagcaagagttggagtgatgtt

SEQ ID NO: 7356296 - DNA, 22 bp, Homo sapiens
aagcaagaggaaatgtggacct

SEQ ID NO: 7356297 - DNA, 22 bp, Homo sapiens
aagcaagacagaagttactgcc

SEQ ID NO: 7356298 - DNA, 22 bp, Homo sapiens
aagatatagatggtggtataaa

SEQ ID NO: 7356299 - DNA, 22 bp, Homo sapiens
acacatttattacatgcatgtg

SEQ ID NO: 7356300 - DNA, 22 bp, Homo sapiens
acacattgcagacatctcatta

SEQ ID NO: 7356301 - DNA, 22 bp, Homo sapiens
acacattgtcatttccatacta

SEQ ID NO: 7356302 - DNA, 22 bp, Homo sapiens
acacattatgagcagttgtctt

SEQ ID NO: 7356303 - DNA, 22 bp, Homo sapiens
acacatgataagaaagtttaaa

SEQ ID NO: 7356304 - DNA, 22 bp, Homo sapiens
acacatgcacaacagttctttc

SEQ ID NO: 7356305 - DNA, 22 bp, Homo sapiens
acacatgcataagccttccctt

SEQ ID NO: 7356306 - DNA, 22 bp, Homo sapiens
acacatgagaaacatcagttgt

SEQ ID NO: 7356307 - DNA, 22 bp, Homo sapiens
acacatgagaaacatcagttgt

SEQ ID NO: 7356308 - DNA, 22 bp, Homo sapiens
acacatgaaagacattaaggtg

SEQ ID NO: 7356309 - DNA, 22 bp, Homo sapiens
acacatgaaataatattatgca

SEQ ID NO: 7356310 - DNA, 19 bp, Homo sapiens
aagagcagggaaagaattg

SEQ ID NO: 7356311 - DNA, 22 bp, Homo sapiens
aagcaattggttttagtaaaat

SEQ ID NO: 7356312 - DNA, 22 bp, Homo sapiens
aagcacaatttaggactgaaat

SEQ ID NO: 7356313 - DNA, 22 bp, Homo sapiens
aagcacaatgaacatcttagat

SEQ ID NO: 7356314 - DNA, 22 bp, Homo sapiens
aagcaatagggtaatctactca

SEQ ID NO: 7356315 - DNA, 22 bp, Homo sapiens
aagcaatatactgatatgatta

SEQ ID NO: 7356316 - DNA, 22 bp, Homo sapiens
aagcaatagggtaatctactca

SEQ ID NO: 7356317 - DNA, 20 bp, Homo sapiens
aagcaatatagtgcaaatgt

SEQ ID NO: 7356318 - DNA, 22 bp, Homo sapiens
aagcagagcctgagacagggat

SEQ ID NO: 7356319 - DNA, 22 bp, Homo sapiens
aagcagaatttaatagaaaggt

SEQ ID NO: 7356320 - DNA, 22 bp, Homo sapiens
aagcagaatttcccactagttg

SEQ ID NO: 7356321 - DNA, 21 bp, Homo sapiens
aagcagacctgagcacagaac

SEQ ID NO: 7356322 - DNA, 18 bp, Homo sapiens
aagcagacagcagacagt

SEQ ID NO: 7356323 - DNA, 22 bp, Homo sapiens
aagcagaagttgatctaccata

SEQ ID NO: 7356324 - DNA, 22 bp, Homo sapiens
aagcagaaggggaataatattt

SEQ ID NO: 7356325 - DNA, 22 bp, Homo sapiens
acagcaaaagacaagaacttaa

SEQ ID NO: 7356326 - DNA, 22 bp, Homo sapiens
acagcaaaagacaagaacttaa

SEQ ID NO: 7356327 - DNA, 22 bp, Homo sapiens
acagcagagcaccagggccact

SEQ ID NO: 7356328 - DNA, 22 bp, Homo sapiens
acagcagagcaccagggccact

SEQ ID NO: 7356329 - DNA, 21 bp, Homo sapiens
acagcagagatcaagactaag

SEQ ID NO: 7356330 - DNA, 22 bp, Homo sapiens
acagcagagaactttagagggt

SEQ ID NO: 7356331 - DNA, 22 bp, Homo sapiens
acagcagactttctacagctca

SEQ ID NO: 7356332 - DNA, 22 bp, Homo sapiens
acagccagggcattgtcgccga

SEQ ID NO: 7356333 - DNA, 22 bp, Homo sapiens
acagccagggtctcaggaggcg

SEQ ID NO: 7356334 - DNA, 22 bp, Homo sapiens
aagagacagagccatgtttcta

SEQ ID NO: 7356335 - DNA, 22 bp, Homo sapiens
aagagacaatgtcttttggata

SEQ ID NO: 7356336 - DNA, 22 bp, Homo sapiens
aagagacaatgacacttgggag

SEQ ID NO: 7356337 - DNA, 22 bp, Homo sapiens
aagagagaacacagcttgggca

SEQ ID NO: 7356338 - DNA, 19 bp, Homo sapiens
acaatgttgttggacactc

SEQ ID NO: 7356339 - DNA, 22 bp, Homo sapiens
acaatgtttctctttagtcatt

SEQ ID NO: 7356340 - DNA, 22 bp, Homo sapiens
acaatgttttgaaacatctagg

SEQ ID NO: 7356341 - DNA, 21 bp, Homo sapiens
aagagacatttctcatcagca

SEQ ID NO: 7356342 - DNA, 20 bp, Homo sapiens
acacaaagcaatggagtaca

SEQ ID NO: 7356343 - DNA, 22 bp, Homo sapiens
aagagcagattcctagtggagc

SEQ ID NO: 7356344 - DNA, 22 bp, Homo sapiens
aattttaatcagtggtgctgag

SEQ ID NO: 7356345 - DNA, 22 bp, Homo sapiens
aattttaagcatatgactggtt

SEQ ID NO: 7356346 - DNA, 22 bp, Homo sapiens
aatttcagcttaagttgtttgg

SEQ ID NO: 7356347 - DNA, 22 bp, Homo sapiens
aatttcagatgtcataaatata

SEQ ID NO: 7356348 - DNA, 22 bp, Homo sapiens
aatttcagaactatctgggagt

SEQ ID NO: 7356349 - DNA, 22 bp, Homo sapiens
aatttcagaccatttgcaatta

SEQ ID NO: 7356350 - DNA, 22 bp, Homo sapiens
aatttcagatattaaagaatga

SEQ ID NO: 7356351 - DNA, 22 bp, Homo sapiens
aagagaagaaagtgtctacaca

SEQ ID NO: 7356352 - DNA, 22 bp, Homo sapiens
aagagaagaaagtgtctacaca

SEQ ID NO: 7356353 - DNA, 22 bp, Homo sapiens
aagacccacaaggctgaatgtt

SEQ ID NO: 7356354 - DNA, 22 bp, Homo sapiens
aagaaaagaaacctgaggcttt

SEQ ID NO: 7356355 - DNA, 22 bp, Homo sapiens
aagaaaacatgatctaatttaa

SEQ ID NO: 7356356 - DNA, 22 bp, Homo sapiens
aagaaaagatgtttggttttca

SEQ ID NO: 7356357 - DNA, 22 bp, Homo sapiens
aagaaaaggtaaccgcttatct

SEQ ID NO: 7356358 - DNA, 22 bp, Homo sapiens
aagaaaatcagttctggtcagt

SEQ ID NO: 7356359 - DNA, 22 bp, Homo sapiens
aagaaactgttgcgtgacagcg

SEQ ID NO: 7356360 - DNA, 22 bp, Homo sapiens
aactggtcctcaaattttgatg

SEQ ID NO: 7356361 - DNA, 22 bp, Homo sapiens
aatgggaaaagagtatgattta

SEQ ID NO: 7356362 - DNA, 22 bp, Homo sapiens
aatttcacctgcactacatcgc

SEQ ID NO: 7356363 - DNA, 22 bp, Homo sapiens
aatttcactgataaagactcca

SEQ ID NO: 7356364 - DNA, 22 bp, Homo sapiens
aatttcactggaaaagataatt

SEQ ID NO: 7356365 - DNA, 22 bp, Homo sapiens
aatttcactgtggagcacattt

SEQ ID NO: 7356366 - DNA, 22 bp, Homo sapiens
aatttcactgtggagcacattt

SEQ ID NO: 7356367 - DNA, 22 bp, Homo sapiens
aatttcactgtggagcacattt

SEQ ID NO: 7356368 - DNA, 17 bp, Homo sapiens
aagaacactcaatagca

SEQ ID NO: 7356369 - DNA, 22 bp, Homo sapiens
aagaacaactgctttaaaagca

SEQ ID NO: 7356370 - DNA, 22 bp, Homo sapiens
aattctgaaagattccttattc

SEQ ID NO: 7356371 - DNA, 22 bp, Homo sapiens
aattctaaatgtaatttagaat

SEQ ID NO: 7356372 - DNA, 22 bp, Homo sapiens
aattctagcattgtgaaaatat

SEQ ID NO: 7356373 - DNA, 22 bp, Homo sapiens
aattcacaatgtgtagtcatgc

SEQ ID NO: 7356374 - DNA, 21 bp, Homo sapiens
aagaaagataattaaggaccc

SEQ ID NO: 7356375 - DNA, 22 bp, Homo sapiens
aattcacaatgtgtagtcatgc

SEQ ID NO: 7356376 - DNA, 20 bp, Homo sapiens
aatacatgagcacactttca

SEQ ID NO: 7356377 - DNA, 22 bp, Homo sapiens
aacatctgggccctgattttgg

SEQ ID NO: 7356378 - DNA, 22 bp, Homo sapiens
aacatctgatcgaacagtgcca

SEQ ID NO: 7356379 - DNA, 22 bp, Homo sapiens
aatagacattatttctctatga

SEQ ID NO: 7356380 - DNA, 22 bp, Homo sapiens
aatagagtcagttctacattct

SEQ ID NO: 7356381 - DNA, 22 bp, Homo sapiens
aacatgtgtctggctagattgt

SEQ ID NO: 7356382 - DNA, 22 bp, Homo sapiens
aacagctaccttctcactgtgc

SEQ ID NO: 7356383 - DNA, 22 bp, Homo sapiens
aacagctagaattctactggct

SEQ ID NO: 7356384 - DNA, 22 bp, Homo sapiens
aacatcagaatatccatgttgg

SEQ ID NO: 7356385 - DNA, 22 bp, Homo sapiens
aacatcacaatttcatttatgc

SEQ ID NO: 7356386 - DNA, 22 bp, Homo sapiens
aacagcttcatcacatggcata

SEQ ID NO: 7356387 - DNA, 22 bp, Homo sapiens
aacagcttactcaatggtgatt

SEQ ID NO: 7356388 - DNA, 22 bp, Homo sapiens
aacatatctacggatacgatta

SEQ ID NO: 7356389 - DNA, 22 bp, Homo sapiens
aacatatttggctgatattccc

SEQ ID NO: 7356390 - DNA, 22 bp, Homo sapiens
aacatatcataggatgtcattg

SEQ ID NO: 7356391 - DNA, 22 bp, Homo sapiens
aacataaatttgaagtggcaaa

SEQ ID NO: 7356392 - DNA, 23 bp, Homo sapiens
aatgacagtgtgtgattgaagaa

SEQ ID NO: 7356393 - DNA, 22 bp, Homo sapiens
aactacttgactgacagattca

SEQ ID NO: 7356394 - DNA, 20 bp, Homo sapiens
aactactctgggttgtcttt

SEQ ID NO: 7356395 - DNA, 19 bp, Homo sapiens
aactagaaaggttttgaga

SEQ ID NO: 7356396 - DNA, 22 bp, Homo sapiens
aactagaacctgcattttaaca

SEQ ID NO: 7356397 - DNA, 23 bp, Homo sapiens
aatgacaggcaatgtaattgtgt

SEQ ID NO: 7356398 - DNA, 22 bp, Homo sapiens
aatgacagccctctagtctggg

SEQ ID NO: 7356399 - DNA, 22 bp, Homo sapiens
aatggctctgatgttgttgtga

SEQ ID NO: 7356400 - DNA, 22 bp, Homo sapiens
aatggctgccagggcaggaggt

SEQ ID NO: 7356401 - DNA, 22 bp, Homo sapiens
aatggcttcatgtctgtggaaa

SEQ ID NO: 7356402 - DNA, 22 bp, Homo sapiens
aatgaatgttttaaggcataaa

SEQ ID NO: 7356403 - DNA, 22 bp, Homo sapiens
aacgataaccccgagatcaaag

SEQ ID NO: 7356404 - DNA, 22 bp, Homo sapiens
aacctgttttggttgcatttca

SEQ ID NO: 7356405 - DNA, 22 bp, Homo sapiens
aacctctttgtgaatgtcatga

SEQ ID NO: 7356406 - DNA, 22 bp, Homo sapiens
aacctagggcatgaggatggtt

SEQ ID NO: 7356407 - DNA, 22 bp, Homo sapiens
aaccctgattttacaaatgtct

SEQ ID NO: 7356408 - DNA, 22 bp, Homo sapiens
aaccctgattttacaaatgtct

SEQ ID NO: 7356409 - DNA, 22 bp, Homo sapiens
aaccctggccctggaataggca

SEQ ID NO: 7356410 - DNA, 22 bp, Homo sapiens
aaggctgggtaacctgtccact

SEQ ID NO: 7356411 - DNA, 22 bp, Homo sapiens
aaggctgggtttgggatgtgat

SEQ ID NO: 7356412 - DNA, 22 bp, Homo sapiens
aaggcagccagatcctttgggt

SEQ ID NO: 7356413 - DNA, 22 bp, Homo sapiens
aaggcacttaacgtgggaggat

SEQ ID NO: 7356414 - DNA, 22 bp, Homo sapiens
aaggaagactcgcaggtctatg

SEQ ID NO: 7356415 - DNA, 22 bp, Homo sapiens
aaggaagacacagatgaagtga

SEQ ID NO: 7356416 - DNA, 22 bp, Homo sapiens
aaatgcattaagtcagaacaat

SEQ ID NO: 7356417 - DNA, 22 bp, Homo sapiens
aaatgcattaagtcagaacaat

SEQ ID NO: 7356418 - DNA, 22 bp, Homo sapiens
aaatgcattaagtcagaacaat

SEQ ID NO: 7356419 - DNA, 22 bp, Homo sapiens
aaatgcattctgttttcactag

SEQ ID NO: 7356420 - DNA, 22 bp, Homo sapiens
aaatgcattctgttttcactag

SEQ ID NO: 7356421 - DNA, 22 bp, Homo sapiens
aaatgcatgtatgtaatatgct

SEQ ID NO: 7356422 - DNA, 22 bp, Homo sapiens
aaatgcatgtatgtaatatgct

SEQ ID NO: 7356423 - DNA, 22 bp, Homo sapiens
aaatgcatttcactaatgtttc

SEQ ID NO: 7356424 - DNA, 22 bp, Homo sapiens
aaatgcatttcactaatgtttc

SEQ ID NO: 7356425 - DNA, 22 bp, Homo sapiens
aaatgcatttcactaatgtttc

SEQ ID NO: 7356426 - DNA, 22 bp, Homo sapiens
aaatgcattggtttctacttgt

SEQ ID NO: 7356427 - DNA, 22 bp, Homo sapiens
aaatgcattggtttctacttgt

SEQ ID NO: 7356428 - DNA, 22 bp, Homo sapiens
aaatgcatttttaattagaccc

SEQ ID NO: 7356429 - DNA, 22 bp, Homo sapiens
aaatgcatttttaattagaccc

SEQ ID NO: 7356430 - DNA, 22 bp, Homo sapiens
aaggaaagacaggacggaattc

SEQ ID NO: 7356431 - DNA, 22 bp, Homo sapiens
aaatgtcaaggtgatagatgca

SEQ ID NO: 7356432 - DNA, 22 bp, Homo sapiens
aaggaagagtctagaacaggca

SEQ ID NO: 7356433 - DNA, 22 bp, Homo sapiens
aaggaagagtctagaacaggca

SEQ ID NO: 7356434 - DNA, 22 bp, Homo sapiens
aaggaagagtctagaacaggca

SEQ ID NO: 7356435 - DNA, 22 bp, Homo sapiens
aaatgtcagaggaacatattga

SEQ ID NO: 7356436 - DNA, 22 bp, Homo sapiens
aaatgtcagaggaacatattga

SEQ ID NO: 7356437 - DNA, 22 bp, Homo sapiens
aaatgtcaggtggtggatggct

SEQ ID NO: 7356438 - DNA, 22 bp, Homo sapiens
aaatgtcatatttaagtaggaa

SEQ ID NO: 7356439 - DNA, 22 bp, Homo sapiens
aaatgtctactcctgtgtttat

SEQ ID NO: 7356440 - DNA, 22 bp, Homo sapiens
aaatgtccttagagaaaagtca

SEQ ID NO: 7356441 - DNA, 22 bp, Homo sapiens
aaatgtccattgaatggatgag

SEQ ID NO: 7356442 - DNA, 22 bp, Homo sapiens
aaatgtcagaaaacatggagtg

SEQ ID NO: 7356443 - DNA, 22 bp, Homo sapiens
aaatgtcagaagctttacttct

SEQ ID NO: 7356444 - DNA, 22 bp, Homo sapiens
aaatgtcagagctggaaggggc

SEQ ID NO: 7356445 - DNA, 22 bp, Homo sapiens
aacagaacccgagtgtgaatct

SEQ ID NO: 7356446 - DNA, 22 bp, Homo sapiens
aacagaactgttgttctggagg

SEQ ID NO: 7356447 - DNA, 22 bp, Homo sapiens
aacagacagaaaaatgtgatct

SEQ ID NO: 7356448 - DNA, 22 bp, Homo sapiens
aacagactccattacctggctt

SEQ ID NO: 7356449 - DNA, 22 bp, Homo sapiens
aacagagctctgctctcagatt

SEQ ID NO: 7356450 - DNA, 22 bp, Homo sapiens
aacagagcattctgcactacaa

SEQ ID NO: 7356451 - DNA, 22 bp, Homo sapiens
aacagagatcttaattcctgta

SEQ ID NO: 7356452 - DNA, 22 bp, Homo sapiens
aacagagaggccacctcagcag

SEQ ID NO: 7356453 - DNA, 22 bp, Homo sapiens
aacactttcttccttgctcagg

SEQ ID NO: 7356454 - DNA, 22 bp, Homo sapiens
aacactttcttccttgctcagg

SEQ ID NO: 7356455 - DNA, 22 bp, Homo sapiens
aacactttgggcatggccttcc

SEQ ID NO: 7356456 - DNA, 22 bp, Homo sapiens
aacactttttcctcctgtctgg

SEQ ID NO: 7356457 - DNA, 22 bp, Homo sapiens
aacacagttttccaaaatagag

SEQ ID NO: 7356458 - DNA, 22 bp, Homo sapiens
aacactgtatcagtcttcaata

SEQ ID NO: 7356459 - DNA, 22 bp, Homo sapiens
aacactgtatcagtcttcaata

SEQ ID NO: 7356460 - DNA, 22 bp, Homo sapiens
aacacagtcctgctcacttatt

SEQ ID NO: 7356461 - DNA, 20 bp, Homo sapiens
aacacagataccaaaggttg

SEQ ID NO: 7356462 - DNA, 22 bp, Homo sapiens
aacacagaagtgccaagagcca

SEQ ID NO: 7356463 - DNA, 22 bp, Homo sapiens
aacacaatcttccagtttgctg

SEQ ID NO: 7356464 - DNA, 22 bp, Homo sapiens
aacacaatcttccagtttgctg

SEQ ID NO: 7356465 - DNA, 22 bp, Homo sapiens
aacacagagtatttgaagcatt

SEQ ID NO: 7356466 - DNA, 22 bp, Homo sapiens
aaggctggtcagatgtggtgaa

SEQ ID NO: 7356467 - DNA, 22 bp, Homo sapiens
aaatttctaagtcaagaagaac

SEQ ID NO: 7356468 - DNA, 22 bp, Homo sapiens
aaggctggttccatccctggtg

SEQ ID NO: 7356469 - DNA, 22 bp, Homo sapiens
aaatttctggaagtgtcagagt

SEQ ID NO: 7356470 - DNA, 22 bp, Homo sapiens
aacaatgtcctgtgagatgata

SEQ ID NO: 7356471 - DNA, 22 bp, Homo sapiens
aacaatgtaatctactctgctc

SEQ ID NO: 7356472 - DNA, 22 bp, Homo sapiens
aacaatgtgaagtgctgttcag

SEQ ID NO: 7356473 - DNA, 22 bp, Homo sapiens
aaatttgtcaacttcatatgtt

SEQ ID NO: 7356474 - DNA, 22 bp, Homo sapiens
aaatttgtcaacttcatatgtt

SEQ ID NO: 7356475 - DNA, 22 bp, Homo sapiens
aaatttcttgaggctctctagc

SEQ ID NO: 7356476 - DNA, 22 bp, Homo sapiens
aaaaggaggacatggttacaga

SEQ ID NO: 7356477 - DNA, 21 bp, Homo sapiens
aaaatgtttccttgttggtta

SEQ ID NO: 7356478 - DNA, 21 bp, Homo sapiens
aaaatgtttccttgttggtta

SEQ ID NO: 7356479 - DNA, 18 bp, Homo sapiens
aaaatgttcccccattaa

SEQ ID NO: 7356480 - DNA, 22 bp, Homo sapiens
aaaatgttcaagcatgctggtt

SEQ ID NO: 7356481 - DNA, 22 bp, Homo sapiens
aaaactgaggtttcctgaagaa

SEQ ID NO: 7356482 - DNA, 22 bp, Homo sapiens
aaaactgaggtttcctgaagaa

SEQ ID NO: 7356483 - DNA, 22 bp, Homo sapiens
aaaattaagtgtctgggaagcc

SEQ ID NO: 7356484 - DNA, 22 bp, Homo sapiens
aaaattcatggcttgggaaaag

SEQ ID NO: 7356485 - DNA, 22 bp, Homo sapiens
aaaaaggctaagcatcttgtgc

SEQ ID NO: 7356486 - DNA, 22 bp, Homo sapiens
aaaaggaggtcactttattcct

SEQ ID NO: 7356487 - DNA, 22 bp, Homo sapiens
aaaaatacttcacttctgggtg

SEQ ID NO: 7356488 - DNA, 22 bp, Homo sapiens
aaaaggcagtgcaagagagggt

SEQ ID NO: 7356489 - DNA, 22 bp, Homo sapiens
aaaactgaaatacgatccaatg

SEQ ID NO: 7356490 - DNA, 22 bp, Homo sapiens
aaaactctgcagttagtttcta

SEQ ID NO: 7356491 - DNA, 22 bp, Homo sapiens
aaaactacatttgacattttgt

SEQ ID NO: 7356492 - DNA, 22 bp, Homo sapiens
aaacacaagaggcagggtacag

SEQ ID NO: 7356493 - DNA, 22 bp, Homo sapiens
aaacactcatgtgttactctcc

SEQ ID NO: 7356494 - DNA, 22 bp, Homo sapiens
aaacacattttaggaaaatcta

SEQ ID NO: 7356495 - DNA, 22 bp, Homo sapiens
aaacacattttaggaaaatcta

SEQ ID NO: 7356496 - DNA, 22 bp, Homo sapiens
aaaatgtgcagtttttaagctg

SEQ ID NO: 7356497 - DNA, 22 bp, Homo sapiens
aaaattgaagtgatcaggaact

SEQ ID NO: 7356498 - DNA, 22 bp, Homo sapiens
aaaattgagagtcttgtgcaag

SEQ ID NO: 7356499 - DNA, 22 bp, Homo sapiens
aaaattgagagtcttgtgcaag

SEQ ID NO: 7356500 - DNA, 22 bp, Homo sapiens
aaaattgaggctcatgttaaat

SEQ ID NO: 7356501 - DNA, 22 bp, Homo sapiens
aaaattgaggctcatgttaaat

SEQ ID NO: 7356502 - DNA, 22 bp, Homo sapiens
aaaattggacgtagctactcca

SEQ ID NO: 7356503 - DNA, 22 bp, Homo sapiens
aaacagtattatcaatatattt

SEQ ID NO: 7356504 - DNA, 22 bp, Homo sapiens
aaacagtagaagtgtattttat

SEQ ID NO: 7356505 - DNA, 22 bp, Homo sapiens
aaacagtaagttctagtattat

SEQ ID NO: 7356506 - DNA, 22 bp, Homo sapiens
aaacagtactcgatttttgtag

SEQ ID NO: 7356507 - DNA, 22 bp, Homo sapiens
aaaatatgaagttgtcagtatg

SEQ ID NO: 7356508 - DNA, 22 bp, Homo sapiens
aaaatatgaagttgtcagtatg

SEQ ID NO: 7356509 - DNA, 22 bp, Homo sapiens
aaacagtcaaaggcctaagcta

SEQ ID NO: 7356510 - DNA, 20 bp, Homo sapiens
aaaatatgtataactcttct

SEQ ID NO: 7356511 - DNA, 22 bp, Homo sapiens
aaacatgcattcaagaaaatct

SEQ ID NO: 7356512 - DNA, 22 bp, Homo sapiens
aaacatgtagtgcatgaggatc

SEQ ID NO: 7356513 - DNA, 22 bp, Homo sapiens
aaacatgttttctgaatatttt

SEQ ID NO: 7356514 - DNA, 22 bp, Homo sapiens
aaacattcactctcaattttag

SEQ ID NO: 7356515 - DNA, 22 bp, Homo sapiens
aaacattccatttctatgtaag

SEQ ID NO: 7356516 - DNA, 20 bp, Homo sapiens
aaacattcatgtacaagtga

SEQ ID NO: 7356517 - DNA, 22 bp, Homo sapiens
aaactgtatatttatggcatgt

SEQ ID NO: 7356518 - DNA, 22 bp, Homo sapiens
aaactgtaaatactagtaagtg

SEQ ID NO: 7356519 - DNA, 22 bp, Homo sapiens
aaactgtaagagaataaactac

SEQ ID NO: 7356520 - DNA, 22 bp, Homo sapiens
aaacattgtaattttagcatgg

SEQ ID NO: 7356521 - DNA, 22 bp, Homo sapiens
aaacattgatgggaagtttaat

SEQ ID NO: 7356522 - DNA, 22 bp, Homo sapiens
aaacattgacctcatcctggca

SEQ ID NO: 7356523 - DNA, 22 bp, Homo sapiens
aaacactgtgggacatcttact

SEQ ID NO: 7356524 - DNA, 22 bp, Homo sapiens
aaacagataagggacaatttca

SEQ ID NO: 7356525 - DNA, 22 bp, Homo sapiens
aaacagataagggacaatttca

SEQ ID NO: 7356526 - DNA, 22 bp, Homo sapiens
aaacagagtttggtaaatagcc

SEQ ID NO: 7356527 - DNA, 20 bp, Homo sapiens
aaagccactggcaagagact

SEQ ID NO: 7356528 - DNA, 22 bp, Homo sapiens
aaacactgaagacctatctggt

SEQ ID NO: 7356529 - DNA, 22 bp, Homo sapiens
aaacactgaagacctatctggt

SEQ ID NO: 7356530 - DNA, 20 bp, Homo sapiens
aaagccactggcaagagact

SEQ ID NO: 7356531 - DNA, 22 bp, Homo sapiens
aaacagcaggaacatcttgcca

SEQ ID NO: 7356532 - DNA, 22 bp, Homo sapiens
aaacagctacttctgtataatg

SEQ ID NO: 7356533 - DNA, 22 bp, Homo sapiens
aaacagatgagttataatagcc

SEQ ID NO: 7356534 - DNA, 22 bp, Homo sapiens
aaacagcagctgtttaatttgc

SEQ ID NO: 7356535 - DNA, 22 bp, Homo sapiens
aaacatgatgtcatatatgcca

SEQ ID NO: 7356536 - DNA, 21 bp, Homo sapiens
aaacatctctgcttttgtgtc

SEQ ID NO: 7356537 - DNA, 22 bp, Homo sapiens
aaacagctgcagtacacggcct

SEQ ID NO: 7356538 - DNA, 22 bp, Homo sapiens
aaagagaacttttacccaagaa

SEQ ID NO: 7356539 - DNA, 21 bp, Homo sapiens
aaagatgtttcatctgagaaa

SEQ ID NO: 7356540 - DNA, 22 bp, Homo sapiens
aaagagatgtgccaaatagcct

SEQ ID NO: 7356541 - DNA, 22 bp, Homo sapiens
aaagagacaccaaagactctag

SEQ ID NO: 7356542 - DNA, 22 bp, Homo sapiens
aaagatcagtctgaagcaacat

SEQ ID NO: 7356543 - DNA, 23 bp, Homo sapiens
aaagactgctgagaattttagga

SEQ ID NO: 7356544 - DNA, 22 bp, Homo sapiens
aaagacttgggtgaagtaattt

SEQ ID NO: 7356545 - DNA, 22 bp, Homo sapiens
aaagaacagatgtgtggtgcat

SEQ ID NO: 7356546 - DNA, 22 bp, Homo sapiens
aaactttggtatgtagcaaaac

SEQ ID NO: 7356547 - DNA, 22 bp, Homo sapiens
aaactgtgaagcaagtacaagg

SEQ ID NO: 7356548 - DNA, 22 bp, Homo sapiens
aaagaaacctatcagccacatg

SEQ ID NO: 7356549 - DNA, 22 bp, Homo sapiens
aaagaaacctatcagccacatg

SEQ ID NO: 7356550 - DNA, 22 bp, Homo sapiens
aaacttttttaggttcataggc

SEQ ID NO: 7356551 - DNA, 22 bp, Homo sapiens
aaactttttattctaatgtcta

SEQ ID NO: 7356552 - DNA, 22 bp, Homo sapiens
aaagaaatacctttctcagctt

SEQ ID NO: 7356553 - DNA, 22 bp, Homo sapiens
aaagaacaaattagctgtttta

SEQ ID NO: 7356554 - DNA, 23 bp, Homo sapiens
aaatacctgaattagatattatc

SEQ ID NO: 7356555 - DNA, 22 bp, Homo sapiens
aaatactgctgctattcctttt

SEQ ID NO: 7356556 - DNA, 19 bp, Homo sapiens
aaatactgaagttgttcat

SEQ ID NO: 7356557 - DNA, 19 bp, Homo sapiens
aaatactgaagttgttcat

SEQ ID NO: 7356558 - DNA, 22 bp, Homo sapiens
aaatactattgaccaggtctct

SEQ ID NO: 7356559 - DNA, 22 bp, Homo sapiens
aaatactgctgctattcctttt

SEQ ID NO: 7356560 - DNA, 22 bp, Homo sapiens
aaatactggcaagtgctaattc

SEQ ID NO: 7356561 - DNA, 22 bp, Homo sapiens
aaatactggcaagtgctaattc

SEQ ID NO: 7356562 - DNA, 22 bp, Homo sapiens
aaatactggttttggagatgct

SEQ ID NO: 7356563 - DNA, 22 bp, Homo sapiens
aaatactggttttggagatgct

SEQ ID NO: 7356564 - DNA, 22 bp, Homo sapiens
aaatactgggctcaaaagggtt

SEQ ID NO: 7356565 - DNA, 22 bp, Homo sapiens
aaatactgggctcaaaagggtt

SEQ ID NO: 7356566 - DNA, 21 bp, Homo sapiens
aaatactgggcagtgacttga

SEQ ID NO: 7356567 - DNA, 21 bp, Homo sapiens
aaatactgggcagtgacttga

SEQ ID NO: 7356568 - DNA, 22 bp, Homo sapiens
aagaggaggatgctttacagct

SEQ ID NO: 7356569 - DNA, 22 bp, Homo sapiens
aagaggaggattgatgtgggag

SEQ ID NO: 7356570 - DNA, 18 bp, Homo sapiens
aagaggaggagcaggttg

SEQ ID NO: 7356571 - DNA, 22 bp, Homo sapiens
aagagggctgcaatcttattgc

SEQ ID NO: 7356572 - DNA, 22 bp, Homo sapiens
aagagggctgcaatcttattgc

SEQ ID NO: 7356573 - DNA, 22 bp, Homo sapiens
aagagggcagcacaggtgggtc

SEQ ID NO: 7356574 - DNA, 22 bp, Homo sapiens
aagagggcagcacaggtgggtc

SEQ ID NO: 7356575 - DNA, 22 bp, Homo sapiens
aaagttttagaactaggaagca

SEQ ID NO: 7356576 - DNA, 22 bp, Homo sapiens
aaagtttgagtgatttgacaca

SEQ ID NO: 7356577 - DNA, 22 bp, Homo sapiens
aagactgtatgagacaatataa

SEQ ID NO: 7356578 - DNA, 22 bp, Homo sapiens
aagacctattttaggatatgaa

SEQ ID NO: 7356579 - DNA, 23 bp, Homo sapiens
aaagtgacttttataccactaac

SEQ ID NO: 7356580 - DNA, 22 bp, Homo sapiens
aaatgcatgtagaataatagag

SEQ ID NO: 7356581 - DNA, 22 bp, Homo sapiens
aaatgcatggtaaatgattgcc

SEQ ID NO: 7356582 - DNA, 22 bp, Homo sapiens
aaatgcatggctgttttaaagc

SEQ ID NO: 7356583 - DNA, 22 bp, Homo sapiens
aaatgcatggctgttttaaagc

SEQ ID NO: 7356584 - DNA, 22 bp, Homo sapiens
aagcctcaccttttagaagcta

SEQ ID NO: 7356585 - DNA, 22 bp, Homo sapiens
aagcctccttattaaaggatat

SEQ ID NO: 7356586 - DNA, 22 bp, Homo sapiens
aaatctggccccttgcctattt

SEQ ID NO: 7356587 - DNA, 22 bp, Homo sapiens
aaatctggccccttgcctattt

SEQ ID NO: 7356588 - DNA, 22 bp, Homo sapiens
aaatctgggagcagctcggcca

SEQ ID NO: 7356589 - DNA, 22 bp, Homo sapiens
aaatctgggtcaaggtggagtg

SEQ ID NO: 7356590 - DNA, 22 bp, Homo sapiens
aaatctggttcagtaagtcctc

SEQ ID NO: 7356591 - DNA, 22 bp, Homo sapiens
aaatctgtttcaggtatatttg

SEQ ID NO: 7356592 - DNA, 22 bp, Homo sapiens
aaatctcaatttgaattgtagc

SEQ ID NO: 7356593 - DNA, 22 bp, Homo sapiens
aaatctcactggcaggcaggca

SEQ ID NO: 7356594 - DNA, 22 bp, Homo sapiens
aaatctcattatttataccata

SEQ ID NO: 7356595 - DNA, 22 bp, Homo sapiens
aagatcaagatttaggttgagg

SEQ ID NO: 7356596 - DNA, 22 bp, Homo sapiens
aagcaggagatgcaggaatgta

SEQ ID NO: 7356597 - DNA, 22 bp, Homo sapiens
aagcaggcatgggaggccatcc

SEQ ID NO: 7356598 - DNA, 20 bp, Homo sapiens
aagattcattgtaattaggg

SEQ ID NO: 7356599 - DNA, 22 bp, Homo sapiens
aaagatttaagaataatttgtg

SEQ ID NO: 7356600 - DNA, 22 bp, Homo sapiens
aaagatttaagaataatttgtg

SEQ ID NO: 7356601 - DNA, 22 bp, Homo sapiens
aaagatttatgaagttcaatta

SEQ ID NO: 7356602 - DNA, 22 bp, Homo sapiens
aaagatttgagttctgcttata

SEQ ID NO: 7356603 - DNA, 22 bp, Homo sapiens
aaagatttgagttctgcttata

SEQ ID NO: 7356604 - DNA, 22 bp, Homo sapiens
aaagatttgaaattaggcatca

SEQ ID NO: 7356605 - DNA, 22 bp, Homo sapiens
aaagatttcacatcccaagcct

SEQ ID NO: 7356606 - DNA, 22 bp, Homo sapiens
aaagatttcagaagcctgtgcc

SEQ ID NO: 7356607 - DNA, 22 bp, Homo sapiens
aacactgtgaggtaatgaccta

SEQ ID NO: 7356608 - DNA, 22 bp, Homo sapiens
aacactgtggtcttttcagtaa

SEQ ID NO: 7356609 - DNA, 22 bp, Homo sapiens
aacactgtggtcttttcagtaa

SEQ ID NO: 7356610 - DNA, 22 bp, Homo sapiens
aacacttagatttttaaggttt

SEQ ID NO: 7356611 - DNA, 22 bp, Homo sapiens
aacacttctcatcactgcaagc

SEQ ID NO: 7356612 - DNA, 23 bp, Homo sapiens
aacaccaaggctcagagagataa

SEQ ID NO: 7356613 - DNA, 22 bp, Homo sapiens
aacactgtcttatacttcaatg

SEQ ID NO: 7356614 - DNA, 23 bp, Homo sapiens
aacacttgcatgaacagctacac

SEQ ID NO: 7356615 - DNA, 22 bp, Homo sapiens
aacactttcctgcctttctgat

SEQ ID NO: 7356616 - DNA, 22 bp, Homo sapiens
aaagcactctatcctttgtaga

SEQ ID NO: 7356617 - DNA, 22 bp, Homo sapiens
aaagcagaggtgatatgactta

SEQ ID NO: 7356618 - DNA, 22 bp, Homo sapiens
aacatataaactcttaagttca

SEQ ID NO: 7356619 - DNA, 22 bp, Homo sapiens
aacatagctttactcaaatgac

SEQ ID NO: 7356620 - DNA, 22 bp, Homo sapiens
aacatacatatttcagtgtcca

SEQ ID NO: 7356621 - DNA, 22 bp, Homo sapiens
aacatacagtgagcagtggact

SEQ ID NO: 7356622 - DNA, 22 bp, Homo sapiens
aacatagaattgttatattttc

SEQ ID NO: 7356623 - DNA, 22 bp, Homo sapiens
aacatacgagcagtttatagag

SEQ ID NO: 7356624 - DNA, 22 bp, Homo sapiens
aagaacatgagttatgatgatt

SEQ ID NO: 7356625 - DNA, 22 bp, Homo sapiens
aagaacagttgggaggtgagcc

SEQ ID NO: 7356626 - DNA, 22 bp, Homo sapiens
aagaacatgaacacaatgttta

SEQ ID NO: 7356627 - DNA, 22 bp, Homo sapiens
aagaacataacagaagctgtgt

SEQ ID NO: 7356628 - DNA, 22 bp, Homo sapiens
aactgtcatctttcaaggaaga

SEQ ID NO: 7356629 - DNA, 22 bp, Homo sapiens
aacccatgttggaagcttatca

SEQ ID NO: 7356630 - DNA, 18 bp, Homo sapiens
aaaggcagattactggga

SEQ ID NO: 7356631 - DNA, 22 bp, Homo sapiens
aaaggcagtgtgatactgtggt

SEQ ID NO: 7356632 - DNA, 22 bp, Homo sapiens
aaagcctgggttcctcactatc

SEQ ID NO: 7356633 - DNA, 22 bp, Homo sapiens
aacccagggtggaggttgcagt

SEQ ID NO: 7356634 - DNA, 22 bp, Homo sapiens
aacccaggagacaggttgcagt

SEQ ID NO: 7356635 - DNA, 20 bp, Homo sapiens
gtatataaccatagtgacta

SEQ ID NO: 7356636 - DNA, 22 bp, Homo sapiens
gtatagaagctttgctctctct

SEQ ID NO: 7356637 - DNA, 22 bp, Homo sapiens
gtatagaacttttggaggctgc

SEQ ID NO: 7356638 - DNA, 22 bp, Homo sapiens
gtatagaacctcatcatgccca

SEQ ID NO: 7356639 - DNA, 22 bp, Homo sapiens
gtatagaaacccagaaagatag

SEQ ID NO: 7356640 - DNA, 22 bp, Homo sapiens
gtatactcaacctgcctagaat

SEQ ID NO: 7356641 - DNA, 22 bp, Homo sapiens
gtatatatgtgtgaacatgtat

SEQ ID NO: 7356642 - DNA, 22 bp, Homo sapiens
gtatatatcggcactattttaa

SEQ ID NO: 7356643 - DNA, 20 bp, Homo sapiens
gtatataaccatagtgacta

SEQ ID NO: 7356644 - DNA, 21 bp, Homo sapiens
gtatatcagcagtgaattcaa

SEQ ID NO: 7356645 - DNA, 22 bp, Homo sapiens
gtatgtatacattgtggaatgg

SEQ ID NO: 7356646 - DNA, 22 bp, Homo sapiens
gtatggctaagacaattccaga

SEQ ID NO: 7356647 - DNA, 22 bp, Homo sapiens
gtatggctgctgggatgacaac

SEQ ID NO: 7356648 - DNA, 22 bp, Homo sapiens
gtatggcttacataacttacta

SEQ ID NO: 7356649 - DNA, 22 bp, Homo sapiens
gtatggcttctgcagaagagct

SEQ ID NO: 7356650 - DNA, 22 bp, Homo sapiens
gtacatattataaaatacagct

SEQ ID NO: 7356651 - DNA, 22 bp, Homo sapiens
gtacatgttggttgtttccagt

SEQ ID NO: 7356652 - DNA, 22 bp, Homo sapiens
gtacatgtgcacaacatgcatg

SEQ ID NO: 7356653 - DNA, 22 bp, Homo sapiens
gtacatttaggattcattgaaa

SEQ ID NO: 7356654 - DNA, 22 bp, Homo sapiens
gtacatgtgcacaatgtgcagg

SEQ ID NO: 7356655 - DNA, 22 bp, Homo sapiens
gtacattggcaactctcttaga

SEQ ID NO: 7356656 - DNA, 22 bp, Homo sapiens
gtacatttactgatgaaaagta

SEQ ID NO: 7356657 - DNA, 22 bp, Homo sapiens
gtacatattacagacaaagctt

SEQ ID NO: 7356658 - DNA, 22 bp, Homo sapiens
gtacatatggcacatgctattt

SEQ ID NO: 7356659 - DNA, 22 bp, Homo sapiens
gtacagtagtaaaagtgaatga

SEQ ID NO: 7356660 - DNA, 22 bp, Homo sapiens
gtacagtgccagacttctaggt

SEQ ID NO: 7356661 - DNA, 22 bp, Homo sapiens
gtacagggcccctcagcagggc

SEQ ID NO: 7356662 - DNA, 22 bp, Homo sapiens
gtaaagtacatacatgaactca

SEQ ID NO: 7356663 - DNA, 22 bp, Homo sapiens
gtaaagctgtttctccaccgtc

SEQ ID NO: 7356664 - DNA, 22 bp, Homo sapiens
gtacagaaggatttctagtagt

SEQ ID NO: 7356665 - DNA, 22 bp, Homo sapiens
gtacagctaagaatttcatctt

SEQ ID NO: 7356666 - DNA, 23 bp, Homo sapiens
ggtggtggtgagtcacgggctca

SEQ ID NO: 7356667 - DNA, 22 bp, Homo sapiens
ggtggccataggaccagcctgg

SEQ ID NO: 7356668 - DNA, 22 bp, Homo sapiens
ggtggccctaaccgcagcctcc

SEQ ID NO: 7356669 - DNA, 22 bp, Homo sapiens
ggtgtccgcgctgtagaaggtc

SEQ ID NO: 7356670 - DNA, 22 bp, Homo sapiens
ggtgtcagtctgggatgagact

SEQ ID NO: 7356671 - DNA, 22 bp, Homo sapiens
ggtgtcagtgagagcacagtac

SEQ ID NO: 7356672 - DNA, 22 bp, Homo sapiens
ggtggcaggccctgagcatccc

SEQ ID NO: 7356673 - DNA, 22 bp, Homo sapiens
ggtggccaggccagctctggcc

SEQ ID NO: 7356674 - DNA, 22 bp, Homo sapiens
gggtgggcctgtctggccatgt

SEQ ID NO: 7356675 - DNA, 22 bp, Homo sapiens
gggtgggcctgtctggccatgt

SEQ ID NO: 7356676 - DNA, 22 bp, Homo sapiens
gggtggggttcaggaatcttca

SEQ ID NO: 7356677 - DNA, 22 bp, Homo sapiens
ggtgaggggagagtgaaagaaa

SEQ ID NO: 7356678 - DNA, 22 bp, Homo sapiens
ggtgagggtaaactaaaacatc

SEQ ID NO: 7356679 - DNA, 22 bp, Homo sapiens
ggtgatccaccagcctcggcct

SEQ ID NO: 7356680 - DNA, 22 bp, Homo sapiens
ggtgattttcgagtttcatgtt

SEQ ID NO: 7356681 - DNA, 22 bp, Homo sapiens
ggtgagtcatttggctcaagag

SEQ ID NO: 7356682 - DNA, 22 bp, Homo sapiens
ggtgagtcctcagctgacacgg

SEQ ID NO: 7356683 - DNA, 22 bp, Homo sapiens
ggtgcaggaatctgcaattgaa

SEQ ID NO: 7356684 - DNA, 22 bp, Homo sapiens
ggtgcaggaaaattacctggag

SEQ ID NO: 7356685 - DNA, 22 bp, Homo sapiens
ggtgcaggacgaagtgggggtt

SEQ ID NO: 7356686 - DNA, 22 bp, Homo sapiens
ggtgcaggacgaagtgggggtt

SEQ ID NO: 7356687 - DNA, 22 bp, Homo sapiens
ggtgcaggcggtggggcaagta

SEQ ID NO: 7356688 - DNA, 22 bp, Homo sapiens
ggtgcaggagcggggtgctcgg

SEQ ID NO: 7356689 - DNA, 22 bp, Homo sapiens
ggtgcaggagcggggtgctcgg

SEQ ID NO: 7356690 - DNA, 22 bp, Homo sapiens
ggtggcagagaggaggtagttt

SEQ ID NO: 7356691 - DNA, 22 bp, Homo sapiens
gtctggggaagtcagggcatca

SEQ ID NO: 7356692 - DNA, 22 bp, Homo sapiens
gtctggggcagcaaggcgcgcg

SEQ ID NO: 7356693 - DNA, 22 bp, Homo sapiens
gtctgggggtccgggtgcctgc

SEQ ID NO: 7356694 - DNA, 22 bp, Homo sapiens
gtctggctttgctcagatgctg

SEQ ID NO: 7356695 - DNA, 22 bp, Homo sapiens
gtctggctccgaggagtggcag

SEQ ID NO: 7356696 - DNA, 22 bp, Homo sapiens
gtctggagtggtggatttaaag

SEQ ID NO: 7356697 - DNA, 20 bp, Homo sapiens
gtctgcagtaagagggaata

SEQ ID NO: 7356698 - DNA, 19 bp, Homo sapiens
gtctctgctccagggtctc

SEQ ID NO: 7356699 - DNA, 22 bp, Homo sapiens
gtctgaggaagatgcaggggga

SEQ ID NO: 7356700 - DNA, 22 bp, Homo sapiens
gtccttggctgggcttgcctcg

SEQ ID NO: 7356701 - DNA, 22 bp, Homo sapiens
gtccttggaaagtctaatctct

SEQ ID NO: 7356702 - DNA, 20 bp, Homo sapiens
gtcgaaaaagataaacaggc

SEQ ID NO: 7356703 - DNA, 22 bp, Homo sapiens
gtccttgaagccatttcagggc

SEQ ID NO: 7356704 - DNA, 22 bp, Homo sapiens
gtccttgagtaagtcatggtgg

SEQ ID NO: 7356705 - DNA, 22 bp, Homo sapiens
gtccttgaagccatttcagggc

SEQ ID NO: 7356706 - DNA, 22 bp, Homo sapiens
gtccttgagtaagtcatggtgg

SEQ ID NO: 7356707 - DNA, 22 bp, Homo sapiens
gtcctgggtccccgcaggtcag

SEQ ID NO: 7356708 - DNA, 22 bp, Homo sapiens
gtccttaaagagagcatcattc

SEQ ID NO: 7356709 - DNA, 22 bp, Homo sapiens
gtccttaaatgctgctgcagga

SEQ ID NO: 7356710 - DNA, 22 bp, Homo sapiens
gtccttaacaaacggggaaaag

SEQ ID NO: 7356711 - DNA, 22 bp, Homo sapiens
gtccttaaccacttgtgtttat

SEQ ID NO: 7356712 - DNA, 22 bp, Homo sapiens
gtccttaatctgattggtgcag

SEQ ID NO: 7356713 - DNA, 22 bp, Homo sapiens
gtcccagggatgcagacatgag

SEQ ID NO: 7356714 - DNA, 22 bp, Homo sapiens
gtccagtgcttatagaatcagt

SEQ ID NO: 7356715 - DNA, 21 bp, Homo sapiens
gtccagtggaggaggacagga

SEQ ID NO: 7356716 - DNA, 22 bp, Homo sapiens
gtccagggccccgagcaccagg

SEQ ID NO: 7356717 - DNA, 22 bp, Homo sapiens
gtcccagggaagaaggcagcac

SEQ ID NO: 7356718 - DNA, 22 bp, Homo sapiens
gtcagaggaggctgagtaggaa

SEQ ID NO: 7356719 - DNA, 22 bp, Homo sapiens
gtatgtgtgcaaatgtaaatat

SEQ ID NO: 7356720 - DNA, 22 bp, Homo sapiens
gtatgtctgagtaataatgtgt

SEQ ID NO: 7356721 - DNA, 22 bp, Homo sapiens
gtcagctgcacaggtgggagct

SEQ ID NO: 7356722 - DNA, 22 bp, Homo sapiens
gtcagctgcagtgggcacagcc

SEQ ID NO: 7356723 - DNA, 21 bp, Homo sapiens
gtcaggcccatagcagtgcct

SEQ ID NO: 7356724 - DNA, 22 bp, Homo sapiens
gtccagggaaatagcgacaggg

SEQ ID NO: 7356725 - DNA, 22 bp, Homo sapiens
gtccagggaaatagcgacaggg

SEQ ID NO: 7356726 - DNA, 19 bp, Homo sapiens
gtcaggcacgtgagagcat

SEQ ID NO: 7356727 - DNA, 22 bp, Homo sapiens
gtggcaggatcacggctcactg

SEQ ID NO: 7356728 - DNA, 22 bp, Homo sapiens
gtggcaggatcacggctcactg

SEQ ID NO: 7356729 - DNA, 22 bp, Homo sapiens
gtggcatgaaagcatctgtgat

SEQ ID NO: 7356730 - DNA, 22 bp, Homo sapiens
gtggcagttgctgtggcaataa

SEQ ID NO: 7356731 - DNA, 22 bp, Homo sapiens
gtggccaggacattgccaggca

SEQ ID NO: 7356732 - DNA, 22 bp, Homo sapiens
gtggccagctgtcagcaccctt

SEQ ID NO: 7356733 - DNA, 21 bp, Homo sapiens
gtggccctgccgcagtgtcca

SEQ ID NO: 7356734 - DNA, 22 bp, Homo sapiens
gtggccctaacaccgtttctca

SEQ ID NO: 7356735 - DNA, 22 bp, Homo sapiens
gtggcccagccctacagaggac

SEQ ID NO: 7356736 - DNA, 22 bp, Homo sapiens
gtggcccaggctggagtgcagt

SEQ ID NO: 7356737 - DNA, 22 bp, Homo sapiens
gtggcccaggctggagtgcagt

SEQ ID NO: 7356738 - DNA, 22 bp, Homo sapiens
gtggcccaggttggagtgcagt

SEQ ID NO: 7356739 - DNA, 22 bp, Homo sapiens
gtggcccaggttggagtgcagt

SEQ ID NO: 7356740 - DNA, 22 bp, Homo sapiens
gtggcccaggcttggcgctggc

SEQ ID NO: 7356741 - DNA, 22 bp, Homo sapiens
gtggccagaggtcccatgtgtc

SEQ ID NO: 7356742 - DNA, 22 bp, Homo sapiens
gtggccagaaccaggagaatga

SEQ ID NO: 7356743 - DNA, 18 bp, Homo sapiens
gtggccagcctggtcttg

SEQ ID NO: 7356744 - DNA, 22 bp, Homo sapiens
gtggccagccccatggacagtt

SEQ ID NO: 7356745 - DNA, 22 bp, Homo sapiens
gtggccagccccatggacagtt

SEQ ID NO: 7356746 - DNA, 22 bp, Homo sapiens
gtggccagcaagtgctgcctct

SEQ ID NO: 7356747 - DNA, 22 bp, Homo sapiens
gtgggagcatggtcccagtgcc

SEQ ID NO: 7356748 - DNA, 22 bp, Homo sapiens
gtgggagccatttccagtatgc

SEQ ID NO: 7356749 - DNA, 22 bp, Homo sapiens
gtgggagaagatttggtcatct

SEQ ID NO: 7356750 - DNA, 22 bp, Homo sapiens
gtgggagcttcatcaagcagtt

SEQ ID NO: 7356751 - DNA, 22 bp, Homo sapiens
gtgggagtttgaacttcatgtt

SEQ ID NO: 7356752 - DNA, 22 bp, Homo sapiens
gtggctgggctccgagcggctt

SEQ ID NO: 7356753 - DNA, 22 bp, Homo sapiens
gtggctggtttcctgcatgcaa

SEQ ID NO: 7356754 - DNA, 22 bp, Homo sapiens
gtggctgtatagccaagtcaga

SEQ ID NO: 7356755 - DNA, 22 bp, Homo sapiens
gtggctgcagagggcacagcat

SEQ ID NO: 7356756 - DNA, 22 bp, Homo sapiens
gtggctgcatcggggtgaccag

SEQ ID NO: 7356757 - DNA, 22 bp, Homo sapiens
gtggctgctcgggctccggccc

SEQ ID NO: 7356758 - DNA, 22 bp, Homo sapiens
gtggctgctacagagctggagg

SEQ ID NO: 7356759 - DNA, 22 bp, Homo sapiens
gtggccctgtgaacagcgcagt

SEQ ID NO: 7356760 - DNA, 22 bp, Homo sapiens
gtggcccttgaagcagcttcat

SEQ ID NO: 7356761 - DNA, 22 bp, Homo sapiens
gtggcccttgaagcagcttcat

SEQ ID NO: 7356762 - DNA, 22 bp, Homo sapiens
gtggccctgtgaacagcgcagt

SEQ ID NO: 7356763 - DNA, 22 bp, Homo sapiens
gtggctgcagagccagcaagct

SEQ ID NO: 7356764 - DNA, 22 bp, Homo sapiens
gtgcctgctgcagctgagcagt

SEQ ID NO: 7356765 - DNA, 22 bp, Homo sapiens
gtgacagagtgagaccttgtct

SEQ ID NO: 7356766 - DNA, 22 bp, Homo sapiens
gtgacagagttttagatctcat

SEQ ID NO: 7356767 - DNA, 22 bp, Homo sapiens
gtgacagagctgggatttgaag

SEQ ID NO: 7356768 - DNA, 22 bp, Homo sapiens
gtgacagagtgagaccctgtct

SEQ ID NO: 7356769 - DNA, 22 bp, Homo sapiens
gtgacagatttgctgcgcatgg

SEQ ID NO: 7356770 - DNA, 22 bp, Homo sapiens
gtgacagatttgctgcgcatgg

SEQ ID NO: 7356771 - DNA, 22 bp, Homo sapiens
gtgacagattatagggagcgtt

SEQ ID NO: 7356772 - DNA, 22 bp, Homo sapiens
gtgaaggccagtagggtcctgg

SEQ ID NO: 7356773 - DNA, 20 bp, Homo sapiens
gtgaagggagtcaggtgtgc

SEQ ID NO: 7356774 - DNA, 22 bp, Homo sapiens
gtgacaaaaacactgattattt

SEQ ID NO: 7356775 - DNA, 22 bp, Homo sapiens
gtgacagagattaatagcttgg

SEQ ID NO: 7356776 - DNA, 16 bp, Homo sapiens
gtgacagacaataggc

SEQ ID NO: 7356777 - DNA, 22 bp, Homo sapiens
gtgacagaaacagggctagaat

SEQ ID NO: 7356778 - DNA, 22 bp, Homo sapiens
gtgctaaatattgtgtttgtct

SEQ ID NO: 7356779 - DNA, 22 bp, Homo sapiens
gtgcgtatgcatgtgaatacgt

SEQ ID NO: 7356780 - DNA, 22 bp, Homo sapiens
gtgcgggggttcccagcagccg

SEQ ID NO: 7356781 - DNA, 22 bp, Homo sapiens
gtgcgggggttcccagcagccg

SEQ ID NO: 7356782 - DNA, 23 bp, Homo sapiens
gtgcgccaggacaacctgacgga

SEQ ID NO: 7356783 - DNA, 22 bp, Homo sapiens
gtgcgcaccctcccggcatccc

SEQ ID NO: 7356784 - DNA, 20 bp, Homo sapiens
gtgcctggagaagaggctgt

SEQ ID NO: 7356785 - DNA, 22 bp, Homo sapiens
gtggaaggtgaaggagcagcga

SEQ ID NO: 7356786 - DNA, 23 bp, Homo sapiens
gtgctacttacagggagcttggt

SEQ ID NO: 7356787 - DNA, 22 bp, Homo sapiens
gtggaaagaacacaaaattagg

SEQ ID NO: 7356788 - DNA, 22 bp, Homo sapiens
gtggaaaagaaagtcttccttg

SEQ ID NO: 7356789 - DNA, 22 bp, Homo sapiens
gtggaacagtattttaaaagct

SEQ ID NO: 7356790 - DNA, 16 bp, Homo sapiens
gtggaacacattttgg

SEQ ID NO: 7356791 - DNA, 22 bp, Homo sapiens
gtggaacagaactgtttattga

SEQ ID NO: 7356792 - DNA, 22 bp, Homo sapiens
gtggcagaggctgtgaggatgc

SEQ ID NO: 7356793 - DNA, 22 bp, Homo sapiens
gtggcagcggcccaggccgtct

SEQ ID NO: 7356794 - DNA, 22 bp, Homo sapiens
gtggatggattgaggcagtggg

SEQ ID NO: 7356795 - DNA, 22 bp, Homo sapiens
gtggcacacaggagagagctca

SEQ ID NO: 7356796 - DNA, 22 bp, Homo sapiens
gtggcacaaggcttacacagca

SEQ ID NO: 7356797 - DNA, 22 bp, Homo sapiens
gtggcacacaggagagagctca

SEQ ID NO: 7356798 - DNA, 22 bp, Homo sapiens
gtggcagagccaaggctggagc

SEQ ID NO: 7356799 - DNA, 22 bp, Homo sapiens
gtggagggtttgcaatgtgcag

SEQ ID NO: 7356800 - DNA, 22 bp, Homo sapiens
gtggagggtttgcaatgtgcag

SEQ ID NO: 7356801 - DNA, 22 bp, Homo sapiens
gtggaggtcccgggcaggagca

SEQ ID NO: 7356802 - DNA, 22 bp, Homo sapiens
gtggagtggtgatggataggtt

SEQ ID NO: 7356803 - DNA, 22 bp, Homo sapiens
gtggatctaaagaaggagggtg

SEQ ID NO: 7356804 - DNA, 22 bp, Homo sapiens
gtggaggagaggcgccttgcgg

SEQ ID NO: 7356805 - DNA, 22 bp, Homo sapiens
gtggagggaatgaatcttctct

SEQ ID NO: 7356806 - DNA, 18 bp, Homo sapiens
gtggagggttctcagaat

SEQ ID NO: 7356807 - DNA, 22 bp, Homo sapiens
gtggagggtgattgccggctgt

SEQ ID NO: 7356808 - DNA, 22 bp, Homo sapiens
gtggagggtgattgccggctgt

SEQ ID NO: 7356809 - DNA, 22 bp, Homo sapiens
gtggagggtgagctcatgtttg

SEQ ID NO: 7356810 - DNA, 22 bp, Homo sapiens
gtggacagcttctaggtgccag

SEQ ID NO: 7356811 - DNA, 22 bp, Homo sapiens
gtggacaggcaggctgtcgggg

SEQ ID NO: 7356812 - DNA, 22 bp, Homo sapiens
gtggacagcttctaggtgccag

SEQ ID NO: 7356813 - DNA, 22 bp, Homo sapiens
gtggacagagctagaaaatgtg

SEQ ID NO: 7356814 - DNA, 22 bp, Homo sapiens
gtggacttgagatggaccgagg

SEQ ID NO: 7356815 - DNA, 22 bp, Homo sapiens
gtggaccaaggtggaagataaa

SEQ ID NO: 7356816 - DNA, 22 bp, Homo sapiens
gtggaggaaaagaagttgggtg

SEQ ID NO: 7356817 - DNA, 22 bp, Homo sapiens
gtggagctggacccaggcctct

SEQ ID NO: 7356818 - DNA, 22 bp, Homo sapiens
gtggagctggacccaggcctct

SEQ ID NO: 7356819 - DNA, 19 bp, Homo sapiens
gtggagctaagaaaaggaa

SEQ ID NO: 7356820 - DNA, 22 bp, Homo sapiens
gtggaggaagggattcagacca

SEQ ID NO: 7356821 - DNA, 22 bp, Homo sapiens
gtggaggaaaagaagttgggtg

SEQ ID NO: 7356822 - DNA, 22 bp, Homo sapiens
gttcaaggttttacagagtgta

SEQ ID NO: 7356823 - DNA, 22 bp, Homo sapiens
gttgttttaaaatactccagaa

SEQ ID NO: 7356824 - DNA, 22 bp, Homo sapiens
gttgttgctatgttattgttat

SEQ ID NO: 7356825 - DNA, 22 bp, Homo sapiens
gttgttttataattgattgcaa

SEQ ID NO: 7356826 - DNA, 22 bp, Homo sapiens
gttgtacaggactgcccagtgt

SEQ ID NO: 7356827 - DNA, 22 bp, Homo sapiens
gtgtccagcctgcacagggtgc

SEQ ID NO: 7356828 - DNA, 22 bp, Homo sapiens
gtgtccatcagcagccactgtg

SEQ ID NO: 7356829 - DNA, 22 bp, Homo sapiens
gtgtcattaaccaccatgcaaa

SEQ ID NO: 7356830 - DNA, 22 bp, Homo sapiens
gtgtcatgcacactcagtgttg

SEQ ID NO: 7356831 - DNA, 22 bp, Homo sapiens
gtgtcagtccagaggcagccac

SEQ ID NO: 7356832 - DNA, 21 bp, Homo sapiens
gtgtcatggttgactttggca

SEQ ID NO: 7356833 - DNA, 22 bp, Homo sapiens
gtgtcatgtagaaattgatgaa

SEQ ID NO: 7356834 - DNA, 22 bp, Homo sapiens
gtgtcatgggagtcagaagtga

SEQ ID NO: 7356835 - DNA, 22 bp, Homo sapiens
gtgtcatggaaaattgcaatgg

SEQ ID NO: 7356836 - DNA, 22 bp, Homo sapiens
gtgtcatggggtttgttataca

SEQ ID NO: 7356837 - DNA, 22 bp, Homo sapiens
gtgtcagctaatttgggagctc

SEQ ID NO: 7356838 - DNA, 22 bp, Homo sapiens
gtgtccttttatgtgactggtt

SEQ ID NO: 7356839 - DNA, 22 bp, Homo sapiens
gtgtgagctcagccttgggaga

SEQ ID NO: 7356840 - DNA, 22 bp, Homo sapiens
gtgtgagccatgatgtgtccag

SEQ ID NO: 7356841 - DNA, 22 bp, Homo sapiens
gtgtgtacatatttttaatggg

SEQ ID NO: 7356842 - DNA, 22 bp, Homo sapiens
gtgtgtatgtagaactatgtat

SEQ ID NO: 7356843 - DNA, 22 bp, Homo sapiens
gtgtgtatgtagaactatgtat

SEQ ID NO: 7356844 - DNA, 22 bp, Homo sapiens
gtgtgtattattgcatacacat

SEQ ID NO: 7356845 - DNA, 22 bp, Homo sapiens
gtgtgtatttaaaggatagttg

SEQ ID NO: 7356846 - DNA, 22 bp, Homo sapiens
gtgtgggaggaaggtgaacaga

SEQ ID NO: 7356847 - DNA, 22 bp, Homo sapiens
gtgtgggcagggccgtgctccc

SEQ ID NO: 7356848 - DNA, 18 bp, Homo sapiens
gtgtgggctcctccgagt

SEQ ID NO: 7356849 - DNA, 22 bp, Homo sapiens
gtgtgggctatgtgcgtgggca

SEQ ID NO: 7356850 - DNA, 22 bp, Homo sapiens
gtgtgggctgcagaggcacagc

SEQ ID NO: 7356851 - DNA, 22 bp, Homo sapiens
gtgtgcaggggcttggtggagc

SEQ ID NO: 7356852 - DNA, 22 bp, Homo sapiens
gtgtgcagggggccagcgcagc

SEQ ID NO: 7356853 - DNA, 22 bp, Homo sapiens
gtgtgcaggccacaggccaggg

SEQ ID NO: 7356854 - DNA, 21 bp, Homo sapiens
gtgtgagtagcatgtgtctca

SEQ ID NO: 7356855 - DNA, 22 bp, Homo sapiens
gtgtgagctccctctcctcctg

SEQ ID NO: 7356856 - DNA, 22 bp, Homo sapiens
gtgtgcagatgtgatgctgggc

SEQ ID NO: 7356857 - DNA, 22 bp, Homo sapiens
gtgtgcagatgtgatgctgggc

SEQ ID NO: 7356858 - DNA, 22 bp, Homo sapiens
gtgtgcagcagagacaggactc

SEQ ID NO: 7356859 - DNA, 22 bp, Homo sapiens
gtgtgcagaagacacaagacat

SEQ ID NO: 7356860 - DNA, 22 bp, Homo sapiens
gtggggggagctgcaagctgga

SEQ ID NO: 7356861 - DNA, 22 bp, Homo sapiens
gtgggggtggaaaggcaagttg

SEQ ID NO: 7356862 - DNA, 22 bp, Homo sapiens
gtgggggtggaaaggcaagttg

SEQ ID NO: 7356863 - DNA, 22 bp, Homo sapiens
gtgggggtttcattaagacaat

SEQ ID NO: 7356864 - DNA, 22 bp, Homo sapiens
gtggggggagctgcaagctgga

SEQ ID NO: 7356865 - DNA, 22 bp, Homo sapiens
gtggggtagatctttctcagga

SEQ ID NO: 7356866 - DNA, 22 bp, Homo sapiens
gtggggtgggctgagttaggcc

SEQ ID NO: 7356867 - DNA, 22 bp, Homo sapiens
gtggggtgtccagcagcgagct

SEQ ID NO: 7356868 - DNA, 22 bp, Homo sapiens
gtggggtgtccagcagcgagct

SEQ ID NO: 7356869 - DNA, 22 bp, Homo sapiens
gtgggtgctgtcaggcagggaa

SEQ ID NO: 7356870 - DNA, 18 bp, Homo sapiens
gtggggtgttgtgaggat

SEQ ID NO: 7356871 - DNA, 22 bp, Homo sapiens
gtggtcagagatgacagtgggt

SEQ ID NO: 7356872 - DNA, 22 bp, Homo sapiens
gtggtcagggagcagagccatg

SEQ ID NO: 7356873 - DNA, 22 bp, Homo sapiens
gtgtaagtatctttgtatcttt

SEQ ID NO: 7356874 - DNA, 22 bp, Homo sapiens
gtgtcacatggtttactgcagc

SEQ ID NO: 7356875 - DNA, 22 bp, Homo sapiens
gtgtaaaaacatactatttcta

SEQ ID NO: 7356876 - DNA, 22 bp, Homo sapiens
gtggtttgttttattcctggaa

SEQ ID NO: 7356877 - DNA, 22 bp, Homo sapiens
gtggtgagattgctggatcaaa

SEQ ID NO: 7356878 - DNA, 22 bp, Homo sapiens
gtgggggatgctgagttggaaa

SEQ ID NO: 7356879 - DNA, 22 bp, Homo sapiens
gtgggggcaggcagtgctagga

SEQ ID NO: 7356880 - DNA, 22 bp, Homo sapiens
gtgggggctggaaatcttgcca

SEQ ID NO: 7356881 - DNA, 22 bp, Homo sapiens
gtggggcttcctggggcaagtt

SEQ ID NO: 7356882 - DNA, 22 bp, Homo sapiens
gtgggcttttgacagtgcctgg

SEQ ID NO: 7356883 - DNA, 22 bp, Homo sapiens
gtggggaaaggagtggggctca

SEQ ID NO: 7356884 - DNA, 22 bp, Homo sapiens
gtggggaggcctaagcaagttg

SEQ ID NO: 7356885 - DNA, 22 bp, Homo sapiens
gtgggctggaccctcctgctcc

SEQ ID NO: 7356886 - DNA, 22 bp, Homo sapiens
gtgggctggatttgcttgcaga

SEQ ID NO: 7356887 - DNA, 22 bp, Homo sapiens
gtgggctgcttcctccttccac

SEQ ID NO: 7356888 - DNA, 22 bp, Homo sapiens
gtgggctgcccttgaggtcagc

SEQ ID NO: 7356889 - DNA, 22 bp, Homo sapiens
gtgggccagttcctcacaggta

SEQ ID NO: 7356890 - DNA, 22 bp, Homo sapiens
gtgggccaggcgtctaggccct

SEQ ID NO: 7356891 - DNA, 22 bp, Homo sapiens
gtgggcgatcatctcagccgtc

SEQ ID NO: 7356892 - DNA, 22 bp, Homo sapiens
gtgggctcaggcctctgtgggg

SEQ ID NO: 7356893 - DNA, 22 bp, Homo sapiens
gtgggctcccctggcatgtcca

SEQ ID NO: 7356894 - DNA, 22 bp, Homo sapiens
gtgggcagtggtttgcgcggtc

SEQ ID NO: 7356895 - DNA, 22 bp, Homo sapiens
gtgggcagtgtgtcagtatctt

SEQ ID NO: 7356896 - DNA, 22 bp, Homo sapiens
gtgggcagttcaattctgggag

SEQ ID NO: 7356897 - DNA, 22 bp, Homo sapiens
gtgggcagtgtgtcagtatctt

SEQ ID NO: 7356898 - DNA, 22 bp, Homo sapiens
gtgggcagtggtttgcgcggtc

SEQ ID NO: 7356899 - DNA, 22 bp, Homo sapiens
gtgggcaggaggccctgccctg

SEQ ID NO: 7356900 - DNA, 22 bp, Homo sapiens
gtgggcagccccttcaaggcca

SEQ ID NO: 7356901 - DNA, 22 bp, Homo sapiens
gtgggcagcctcctttattttc

SEQ ID NO: 7356902 - DNA, 22 bp, Homo sapiens
gtgggcagcctgtccggagacc

SEQ ID NO: 7356903 - DNA, 22 bp, Homo sapiens
gtgggcagcctgtccggagacc

SEQ ID NO: 7356904 - DNA, 22 bp, Homo sapiens
gtgggcagcctgtccggagacc

SEQ ID NO: 7356905 - DNA, 22 bp, Homo sapiens
gtgggcagttcaattctgggag

SEQ ID NO: 7356906 - DNA, 22 bp, Homo sapiens
gtgggcagttggtgattctcgt

SEQ ID NO: 7356907 - DNA, 22 bp, Homo sapiens
gtgggcagttggtgattctcgt

SEQ ID NO: 7356908 - DNA, 22 bp, Homo sapiens
gtgggccaggacccgctgtccg

SEQ ID NO: 7356909 - DNA, 22 bp, Homo sapiens
gtgggcagaggagagaacatta

SEQ ID NO: 7356910 - DNA, 20 bp, Homo sapiens
gtgggcagagcaccacctgg

SEQ ID NO: 7356911 - DNA, 20 bp, Homo sapiens
gtgggcagagcaccacctgg

SEQ ID NO: 7356912 - DNA, 22 bp, Homo sapiens
gtgggcagagcaagggaactca

SEQ ID NO: 7356913 - DNA, 22 bp, Homo sapiens
gtgggcagagcaagggaactca

SEQ ID NO: 7356914 - DNA, 22 bp, Homo sapiens
gtgggcagacatgatagaagga

SEQ ID NO: 7356915 - DNA, 22 bp, Homo sapiens
gtgggcagacatgatagaagga

SEQ ID NO: 7356916 - DNA, 22 bp, Homo sapiens
gtgggcagagcaagggaactca

SEQ ID NO: 7356917 - DNA, 22 bp, Homo sapiens
gtgggcagaattgaatctttaa

SEQ ID NO: 7356918 - DNA, 22 bp, Homo sapiens
gtgggcagaacatttgtaggct

SEQ ID NO: 7356919 - DNA, 22 bp, Homo sapiens
gtgggcagacagtgctttgcag

SEQ ID NO: 7356920 - DNA, 22 bp, Homo sapiens
gtgggcagacagtgctttgcag

SEQ ID NO: 7356921 - DNA, 22 bp, Homo sapiens
gtgggcagaacatttgtaggct

SEQ ID NO: 7356922 - DNA, 22 bp, Homo sapiens
gtgggcagattaatttctcaat

SEQ ID NO: 7356923 - DNA, 22 bp, Homo sapiens
gtgggcagattatagatgatgc

SEQ ID NO: 7356924 - DNA, 22 bp, Homo sapiens
gtgggcagattatagatgatgc

SEQ ID NO: 7356925 - DNA, 22 bp, Homo sapiens
gtgggcagaggagagaacatta

SEQ ID NO: 7356926 - DNA, 22 bp, Homo sapiens
gtgggcagatacatttgatatg

SEQ ID NO: 7356927 - DNA, 20 bp, Homo sapiens
gtgggcagatgtgtgcatgg

SEQ ID NO: 7356928 - DNA, 22 bp, Homo sapiens
gtgggcagcaccagggaagtgt

SEQ ID NO: 7356929 - DNA, 22 bp, Homo sapiens
gtgggcagattatagatgatgc

SEQ ID NO: 7356930 - DNA, 22 bp, Homo sapiens
gtgggcagcaccagggaagtgt

SEQ ID NO: 7356931 - DNA, 20 bp, Homo sapiens
gtgggcagcaggcatactgg

SEQ ID NO: 7356932 - DNA, 20 bp, Homo sapiens
gtgggcagcaggcatactgg

SEQ ID NO: 7356933 - DNA, 22 bp, Homo sapiens
taacagaatagcagaaacagaa

SEQ ID NO: 7356934 - DNA, 22 bp, Homo sapiens
taacagaatagcagaaacagaa

SEQ ID NO: 7356935 - DNA, 22 bp, Homo sapiens
taacactgtccaaagaattcca

SEQ ID NO: 7356936 - DNA, 22 bp, Homo sapiens
taacactgtggtgttctttgtc

SEQ ID NO: 7356937 - DNA, 22 bp, Homo sapiens
taagaacaagatgttcctgttt

SEQ ID NO: 7356938 - DNA, 22 bp, Homo sapiens
taacactgatttgttctcaggg

SEQ ID NO: 7356939 - DNA, 22 bp, Homo sapiens
taacactgcttcattttggaga

SEQ ID NO: 7356940 - DNA, 22 bp, Homo sapiens
taacactggagagttggttgtg

SEQ ID NO: 7356941 - DNA, 22 bp, Homo sapiens
taacactggcttttgctgaggc

SEQ ID NO: 7356942 - DNA, 22 bp, Homo sapiens
taaatagaatctaaactgctca

SEQ ID NO: 7356943 - DNA, 22 bp, Homo sapiens
taaatcagtagatatggtatag

SEQ ID NO: 7356944 - DNA, 22 bp, Homo sapiens
taaatcagtttctcttattggt

SEQ ID NO: 7356945 - DNA, 22 bp, Homo sapiens
gtttaataatgttgaattacta

SEQ ID NO: 7356946 - DNA, 22 bp, Homo sapiens
gtttaagtttcagaagctaaga

SEQ ID NO: 7356947 - DNA, 22 bp, Homo sapiens
gtttttctaagtagcgatattt

SEQ ID NO: 7356948 - DNA, 22 bp, Homo sapiens
gtttttcctgctgacttgggtc

SEQ ID NO: 7356949 - DNA, 22 bp, Homo sapiens
gtttttccttgctgaggacccg

SEQ ID NO: 7356950 - DNA, 19 bp, Homo sapiens
gtttttcccagacgaggca

SEQ ID NO: 7356951 - DNA, 22 bp, Homo sapiens
gttgtttttgaacggtggtggc

SEQ ID NO: 7356952 - DNA, 22 bp, Homo sapiens
gttgttttcagcagtttatgac

SEQ ID NO: 7356953 - DNA, 22 bp, Homo sapiens
gtttaaagtcttggaaggagga

SEQ ID NO: 7356954 - DNA, 22 bp, Homo sapiens
gtttaaagtagcttccttttgg

SEQ ID NO: 7356955 - DNA, 22 bp, Homo sapiens
gtttaacatctgtgaagctgct

SEQ ID NO: 7356956 - DNA, 22 bp, Homo sapiens
gtttttctctgaaatagttgac

SEQ ID NO: 7356957 - DNA, 20 bp, Homo sapiens
gtttttcttgggcgagctat

SEQ ID NO: 7356958 - DNA, 22 bp, Homo sapiens
gtttttctgtgagcggtaaagg

SEQ ID NO: 7356959 - DNA, 22 bp, Homo sapiens
gtttttctagactgggagtttg

SEQ ID NO: 7356960 - DNA, 22 bp, Homo sapiens
gtttttctaggaccatgtgatt

SEQ ID NO: 7356961 - DNA, 20 bp, Homo sapiens
gtttttctctcttgccacta

SEQ ID NO: 7356962 - DNA, 22 bp, Homo sapiens
taaaacactcagcacctagcaa

SEQ ID NO: 7356963 - DNA, 22 bp, Homo sapiens
taaaacacctgtagtgtctgcc

SEQ ID NO: 7356964 - DNA, 22 bp, Homo sapiens
gtttttctttgtgtgaagacaa

SEQ ID NO: 7356965 - DNA, 22 bp, Homo sapiens
taaatacttttactccactgat

SEQ ID NO: 7356966 - DNA, 22 bp, Homo sapiens
taaaggctttattttccagtca

SEQ ID NO: 7356967 - DNA, 22 bp, Homo sapiens
taaaggagtgtgatgaaaggga

SEQ ID NO: 7356968 - DNA, 22 bp, Homo sapiens
taaaggaggagttaatgagact

SEQ ID NO: 7356969 - DNA, 22 bp, Homo sapiens
taaagctgttcagtgcagaaag

SEQ ID NO: 7356970 - DNA, 22 bp, Homo sapiens
taaaacagcagggcagagaagt

SEQ ID NO: 7356971 - DNA, 22 bp, Homo sapiens
taaaactagaccgtgagtctaa

SEQ ID NO: 7356972 - DNA, 22 bp, Homo sapiens
ggaggggtggtcgcgaagagca

SEQ ID NO: 7356973 - DNA, 22 bp, Homo sapiens
ggaggggtggtcacctggcagg

SEQ ID NO: 7356974 - DNA, 22 bp, Homo sapiens
ggagggtccactgtgaggcaga

SEQ ID NO: 7356975 - DNA, 22 bp, Homo sapiens
ggagggtccatcttgtgaaaag

SEQ ID NO: 7356976 - DNA, 22 bp, Homo sapiens
ggagggtgcagaccctttgcaa

SEQ ID NO: 7356977 - DNA, 22 bp, Homo sapiens
ggagggtgcattttaccctgtg

SEQ ID NO: 7356978 - DNA, 22 bp, Homo sapiens
ggaggggtgagaatggctgcct

SEQ ID NO: 7356979 - DNA, 22 bp, Homo sapiens
ggaggggtgctcagctgtcacg

SEQ ID NO: 7356980 - DNA, 22 bp, Homo sapiens
ggaggggtgctcagctgtcacg

SEQ ID NO: 7356981 - DNA, 22 bp, Homo sapiens
ggaggggtctctagcgaggaga

SEQ ID NO: 7356982 - DNA, 22 bp, Homo sapiens
ggaggggtctctagcgaggaga

SEQ ID NO: 7356983 - DNA, 22 bp, Homo sapiens
ggaggggtgagaatggctgcct

SEQ ID NO: 7356984 - DNA, 22 bp, Homo sapiens
ggagggggactgacactgattt

SEQ ID NO: 7356985 - DNA, 22 bp, Homo sapiens
ggagggggactgacactgattt

SEQ ID NO: 7356986 - DNA, 22 bp, Homo sapiens
ggaggggaggattaatgacaaa

SEQ ID NO: 7356987 - DNA, 22 bp, Homo sapiens
ggaggggctcctgttcgccccc

SEQ ID NO: 7356988 - DNA, 22 bp, Homo sapiens
ggaggggctcctgttcgccccc

SEQ ID NO: 7356989 - DNA, 22 bp, Homo sapiens
ggaggggctcctgttcgccccc

SEQ ID NO: 7356990 - DNA, 22 bp, Homo sapiens
ggaggggctgagcaactttcag

SEQ ID NO: 7356991 - DNA, 22 bp, Homo sapiens
ggaggggctgagcaactttcag

SEQ ID NO: 7356992 - DNA, 22 bp, Homo sapiens
ggagggggaaactttggctgcc

SEQ ID NO: 7356993 - DNA, 22 bp, Homo sapiens
ggagggggaaactttggctgcc

SEQ ID NO: 7356994 - DNA, 22 bp, Homo sapiens
ggagggggaattcagccccagc

SEQ ID NO: 7356995 - DNA, 22 bp, Homo sapiens
ggagggggaagaagctaaagac

SEQ ID NO: 7356996 - DNA, 22 bp, Homo sapiens
ggagggggaagaagctaaagac

SEQ ID NO: 7356997 - DNA, 20 bp, Homo sapiens
ggagggtggaagaaagcaag

SEQ ID NO: 7356998 - DNA, 22 bp, Homo sapiens
ggagggtggcagcgtcctgggc

SEQ ID NO: 7356999 - DNA, 20 bp, Homo sapiens
ggaggtcaaatgatgagaag

SEQ ID NO: 7357000 - DNA, 22 bp, Homo sapiens
ggagggtgggtcattcttacat

SEQ ID NO: 7357001 - DNA, 22 bp, Homo sapiens
ggaggtcacgactgggatgcct

SEQ ID NO: 7357002 - DNA, 22 bp, Homo sapiens
ggaggtggaggttgcagtgagc

SEQ ID NO: 7357003 - DNA, 22 bp, Homo sapiens
ggaggtggaggttgcagtgagc

SEQ ID NO: 7357004 - DNA, 22 bp, Homo sapiens
ggaggtgggagacataggcggc

SEQ ID NO: 7357005 - DNA, 22 bp, Homo sapiens
ggaggtgggagacataggcggc

SEQ ID NO: 7357006 - DNA, 22 bp, Homo sapiens
ggaggtgggagacataggcggc

SEQ ID NO: 7357007 - DNA, 22 bp, Homo sapiens
ggaggtggcagggaacataatt

SEQ ID NO: 7357008 - DNA, 22 bp, Homo sapiens
ggaggtgggagcctccagtggt

SEQ ID NO: 7357009 - DNA, 22 bp, Homo sapiens
ggaggtggtggcagtgacaatt

SEQ ID NO: 7357010 - DNA, 22 bp, Homo sapiens
ggaggctgaggcaggcggatca

SEQ ID NO: 7357011 - DNA, 22 bp, Homo sapiens
ggaggctgaggcccctcacagg

SEQ ID NO: 7357012 - DNA, 22 bp, Homo sapiens
ggaggctgctgcctcacgtggg

SEQ ID NO: 7357013 - DNA, 22 bp, Homo sapiens
ggaggctgctgcctcacgtggg

SEQ ID NO: 7357014 - DNA, 22 bp, Homo sapiens
ggaggctcttgagaggggagta

SEQ ID NO: 7357015 - DNA, 22 bp, Homo sapiens
ggaggctcttgagaggggagta

SEQ ID NO: 7357016 - DNA, 22 bp, Homo sapiens
ggaggctgagaagtccaagatc

SEQ ID NO: 7357017 - DNA, 22 bp, Homo sapiens
ggaggcggaggttgcagtgagc

SEQ ID NO: 7357018 - DNA, 22 bp, Homo sapiens
ggaggcggaggttgcagtgagt

SEQ ID NO: 7357019 - DNA, 22 bp, Homo sapiens
ggaggctcagactccatcctca

SEQ ID NO: 7357020 - DNA, 22 bp, Homo sapiens
ggaggcggggaaggcatcccat

SEQ ID NO: 7357021 - DNA, 22 bp, Homo sapiens
ggaggcggggaaggcatcccat

SEQ ID NO: 7357022 - DNA, 23 bp, Homo sapiens
ggaggctcaagtatcacgggcag

SEQ ID NO: 7357023 - DNA, 22 bp, Homo sapiens
ggaggctccatgagctcctgca

SEQ ID NO: 7357024 - DNA, 22 bp, Homo sapiens
ggaggcccagaaggaagcccag

SEQ ID NO: 7357025 - DNA, 22 bp, Homo sapiens
ggaggcctcctgggggaggttc

SEQ ID NO: 7357026 - DNA, 22 bp, Homo sapiens
ggaggcctagccagctccagtt

SEQ ID NO: 7357027 - DNA, 22 bp, Homo sapiens
ggagggaatgtctagcattctt

SEQ ID NO: 7357028 - DNA, 22 bp, Homo sapiens
ggagggaagtgagttctcagct

SEQ ID NO: 7357029 - DNA, 22 bp, Homo sapiens
ggagggacccactctagaggtg

SEQ ID NO: 7357030 - DNA, 22 bp, Homo sapiens
ggagggagagtgaccctaccaa

SEQ ID NO: 7357031 - DNA, 22 bp, Homo sapiens
ggagggcacaggaccagaaatc

SEQ ID NO: 7357032 - DNA, 22 bp, Homo sapiens
ggagggcagagtcccctgctga

SEQ ID NO: 7357033 - DNA, 22 bp, Homo sapiens
ggagggcatcaatcaggcctgg

SEQ ID NO: 7357034 - DNA, 22 bp, Homo sapiens
ggagggccatcttgggtgtgat

SEQ ID NO: 7357035 - DNA, 22 bp, Homo sapiens
ggagggcccctccagtgggcag

SEQ ID NO: 7357036 - DNA, 22 bp, Homo sapiens
ggagggcagagtcccctgctga

SEQ ID NO: 7357037 - DNA, 21 bp, Homo sapiens
ggagggcagcccagactggct

SEQ ID NO: 7357038 - DNA, 20 bp, Homo sapiens
ggagggcagctgagagttgg

SEQ ID NO: 7357039 - DNA, 20 bp, Homo sapiens
ggagggcagctgagagttgg

SEQ ID NO: 7357040 - DNA, 22 bp, Homo sapiens
ggagggctgccaggtggagcgg

SEQ ID NO: 7357041 - DNA, 22 bp, Homo sapiens
ggagggctgccaggtggagcgg

SEQ ID NO: 7357042 - DNA, 22 bp, Homo sapiens
ggagggctgtagaggagacctg

SEQ ID NO: 7357043 - DNA, 22 bp, Homo sapiens
ggagggctgtagaggagacctg

SEQ ID NO: 7357044 - DNA, 22 bp, Homo sapiens
ggagggctgccaggtggagcgg

SEQ ID NO: 7357045 - DNA, 18 bp, Homo sapiens
ggagggctttggggactg

SEQ ID NO: 7357046 - DNA, 18 bp, Homo sapiens
ggagggctttggggactg

SEQ ID NO: 7357047 - DNA, 22 bp, Homo sapiens
ggagggctgtagaggagacctg

SEQ ID NO: 7357048 - DNA, 22 bp, Homo sapiens
ggagggctgtagaggagacctg

SEQ ID NO: 7357049 - DNA, 18 bp, Homo sapiens
ggagggctttggggactg

SEQ ID NO: 7357050 - DNA, 22 bp, Homo sapiens
ggagggctgagactggggtctg

SEQ ID NO: 7357051 - DNA, 22 bp, Homo sapiens
ggagggctgagactggggtctg

SEQ ID NO: 7357052 - DNA, 22 bp, Homo sapiens
ggagggctgagactggggtctg

SEQ ID NO: 7357053 - DNA, 22 bp, Homo sapiens
ggagggctgagactggggtctg

SEQ ID NO: 7357054 - DNA, 22 bp, Homo sapiens
ggagggctcaattgactcctga

SEQ ID NO: 7357055 - DNA, 22 bp, Homo sapiens
ggagggctccctgggagtggat

SEQ ID NO: 7357056 - DNA, 22 bp, Homo sapiens
ggagggctccctgggagtggat

SEQ ID NO: 7357057 - DNA, 22 bp, Homo sapiens
ggcacagcactgtaggcctggg

SEQ ID NO: 7357058 - DNA, 22 bp, Homo sapiens
ggcagacctctccagccccaca

SEQ ID NO: 7357059 - DNA, 18 bp, Homo sapiens
ggcagacgcgaggggcgg

SEQ ID NO: 7357060 - DNA, 22 bp, Homo sapiens
ggagtggcctctcctgtgcagg

SEQ ID NO: 7357061 - DNA, 22 bp, Homo sapiens
ggagtggccacgactgggagat

SEQ ID NO: 7357062 - DNA, 22 bp, Homo sapiens
ggagtggcagctaggctgtcag

SEQ ID NO: 7357063 - DNA, 22 bp, Homo sapiens
ggagtggcagcgaggatcagat

SEQ ID NO: 7357064 - DNA, 22 bp, Homo sapiens
ggagtgggcagcactgccctgt

SEQ ID NO: 7357065 - DNA, 22 bp, Homo sapiens
ggagtgggcagcactgccctgt

SEQ ID NO: 7357066 - DNA, 22 bp, Homo sapiens
ggagtggctatttgtgctggtt

SEQ ID NO: 7357067 - DNA, 22 bp, Homo sapiens
ggagtggctatttgtgctggtt

SEQ ID NO: 7357068 - DNA, 22 bp, Homo sapiens
ggagtggtgtcactgagaggaa

SEQ ID NO: 7357069 - DNA, 22 bp, Homo sapiens
ggcacacatagatctgcactgg

SEQ ID NO: 7357070 - DNA, 22 bp, Homo sapiens
ggcacacatagatctgcactgg

SEQ ID NO: 7357071 - DNA, 22 bp, Homo sapiens
ggcacacaggcagatggagtgt

SEQ ID NO: 7357072 - DNA, 22 bp, Homo sapiens
ggcacacatggtggttggtgaa

SEQ ID NO: 7357073 - DNA, 22 bp, Homo sapiens
ggcaaggccttgcccagcattc

SEQ ID NO: 7357074 - DNA, 22 bp, Homo sapiens
ggcacacagatggagcactagc

SEQ ID NO: 7357075 - DNA, 22 bp, Homo sapiens
ggcacacagcttggcaggagat

SEQ ID NO: 7357076 - DNA, 22 bp, Homo sapiens
ggcacacagcttggcaggagat

SEQ ID NO: 7357077 - DNA, 22 bp, Homo sapiens
ggcacacagcggaatttgctct

SEQ ID NO: 7357078 - DNA, 22 bp, Homo sapiens
ggcacacagcttggcaggagat

SEQ ID NO: 7357079 - DNA, 22 bp, Homo sapiens
ggcacacagatggagcactagc

SEQ ID NO: 7357080 - DNA, 22 bp, Homo sapiens
ggcacacagatggagcactagc

SEQ ID NO: 7357081 - DNA, 22 bp, Homo sapiens
ggcaggctccaagcatcctatg

SEQ ID NO: 7357082 - DNA, 18 bp, Homo sapiens
ggcaggctctctgggtca

SEQ ID NO: 7357083 - DNA, 22 bp, Homo sapiens
ggcaggcattagagattcccag

SEQ ID NO: 7357084 - DNA, 22 bp, Homo sapiens
ggcaggcagcctccatccacag

SEQ ID NO: 7357085 - DNA, 22 bp, Homo sapiens
ggcaggcgtggtggcctcagaa

SEQ ID NO: 7357086 - DNA, 22 bp, Homo sapiens
ggcaggctagcactgatgtcct

SEQ ID NO: 7357087 - DNA, 16 bp, Homo sapiens
ggcaggcgcggagccc

SEQ ID NO: 7357088 - DNA, 22 bp, Homo sapiens
ggcaggcctgagaggcagggct

SEQ ID NO: 7357089 - DNA, 22 bp, Homo sapiens
ggcaggctgggagtcatcagag

SEQ ID NO: 7357090 - DNA, 22 bp, Homo sapiens
ggcaggtgaggcatgtgcctgg

SEQ ID NO: 7357091 - DNA, 17 bp, Homo sapiens
ggcaggtgcggggccgc

SEQ ID NO: 7357092 - DNA, 22 bp, Homo sapiens
ggcagctctgatgatgctctgg

SEQ ID NO: 7357093 - DNA, 22 bp, Homo sapiens
ggcagaggaagctggaagtggg

SEQ ID NO: 7357094 - DNA, 22 bp, Homo sapiens
ggcagctggggcagtgccctgt

SEQ ID NO: 7357095 - DNA, 22 bp, Homo sapiens
ggaggaagggtagcataatgta

SEQ ID NO: 7357096 - DNA, 22 bp, Homo sapiens
ggaggaagggtagcataatgta

SEQ ID NO: 7357097 - DNA, 22 bp, Homo sapiens
ggaggagcatgagagggtagtg

SEQ ID NO: 7357098 - DNA, 22 bp, Homo sapiens
ggaggagcatgagagggtagtg

SEQ ID NO: 7357099 - DNA, 22 bp, Homo sapiens
ggaggagcatgagagggtagtg

SEQ ID NO: 7357100 - DNA, 22 bp, Homo sapiens
ggaggagcatgagagggtagtg

SEQ ID NO: 7357101 - DNA, 22 bp, Homo sapiens
ggagctgatggtagaagaatga

SEQ ID NO: 7357102 - DNA, 22 bp, Homo sapiens
ggagctgatgacgtcaccatgg

SEQ ID NO: 7357103 - DNA, 22 bp, Homo sapiens
ggagctcaggcccagcaaggcc

SEQ ID NO: 7357104 - DNA, 22 bp, Homo sapiens
ggaggaggcaagtaccagatgc

SEQ ID NO: 7357105 - DNA, 22 bp, Homo sapiens
ggaggaggcaagtaccagatgc

SEQ ID NO: 7357106 - DNA, 22 bp, Homo sapiens
ggaggaggcaagtaccagatgc

SEQ ID NO: 7357107 - DNA, 22 bp, Homo sapiens
ggaggaggcggcagaagttcct

SEQ ID NO: 7357108 - DNA, 22 bp, Homo sapiens
ggaggcagaatagagtgtgggt

SEQ ID NO: 7357109 - DNA, 22 bp, Homo sapiens
ggaggccacctgacctgctgtt

SEQ ID NO: 7357110 - DNA, 22 bp, Homo sapiens
ggaggccatctggctggaggct

SEQ ID NO: 7357111 - DNA, 22 bp, Homo sapiens
ggaggccaggaagagccgccct

SEQ ID NO: 7357112 - DNA, 22 bp, Homo sapiens
ggagaaggaatattggagtagg

SEQ ID NO: 7357113 - DNA, 22 bp, Homo sapiens
ggagaaggaatattggagtagg

SEQ ID NO: 7357114 - DNA, 22 bp, Homo sapiens
ggagacagcaggaagaaatatc

SEQ ID NO: 7357115 - DNA, 22 bp, Homo sapiens
ggaagtctcagcaacagagtta

SEQ ID NO: 7357116 - DNA, 22 bp, Homo sapiens
ggaaggtgctccctggacagag

SEQ ID NO: 7357117 - DNA, 22 bp, Homo sapiens
ggaagtattcaatcctgccaca

SEQ ID NO: 7357118 - DNA, 22 bp, Homo sapiens
ggaagtatttgtttttgcatcc

SEQ ID NO: 7357119 - DNA, 19 bp, Homo sapiens
ggagaagcccaggaatcct

SEQ ID NO: 7357120 - DNA, 23 bp, Homo sapiens
ggagaggggtgtgggcatcttta

SEQ ID NO: 7357121 - DNA, 22 bp, Homo sapiens
ggagagggtaggggtcctgccc

SEQ ID NO: 7357122 - DNA, 23 bp, Homo sapiens
ggagaggggtgtgggcatcttta

SEQ ID NO: 7357123 - DNA, 22 bp, Homo sapiens
ggagagggggctccctgcttgg

SEQ ID NO: 7357124 - DNA, 22 bp, Homo sapiens
ggagaggggaacttgttgcttg

SEQ ID NO: 7357125 - DNA, 22 bp, Homo sapiens
ggagaggggcaagtttatctag

SEQ ID NO: 7357126 - DNA, 22 bp, Homo sapiens
ggagaggggaacttgttgcttg

SEQ ID NO: 7357127 - DNA, 22 bp, Homo sapiens
ggagaggggaacttgttgcttg

SEQ ID NO: 7357128 - DNA, 22 bp, Homo sapiens
ggagagggtaggggtcctgccc

SEQ ID NO: 7357129 - DNA, 22 bp, Homo sapiens
ggagagggtgtggaaagttatc

SEQ ID NO: 7357130 - DNA, 22 bp, Homo sapiens
ggagagggtaggggtcctgccc

SEQ ID NO: 7357131 - DNA, 22 bp, Homo sapiens
ggagagggtgtggaaagttatc

SEQ ID NO: 7357132 - DNA, 22 bp, Homo sapiens
ggagaggtgaatggctgctcta

SEQ ID NO: 7357133 - DNA, 22 bp, Homo sapiens
ggagaggtgaatggctgctcta

SEQ ID NO: 7357134 - DNA, 22 bp, Homo sapiens
ggagaggtgcaggtcagtggca

SEQ ID NO: 7357135 - DNA, 22 bp, Homo sapiens
ggagaggtgcaggtcagtggca

SEQ ID NO: 7357136 - DNA, 22 bp, Homo sapiens
ggagaggtgtattcagtgggtc

SEQ ID NO: 7357137 - DNA, 22 bp, Homo sapiens
ggagatctttgttatcttttga

SEQ ID NO: 7357138 - DNA, 22 bp, Homo sapiens
ggagatgacacaatttatttat

SEQ ID NO: 7357139 - DNA, 22 bp, Homo sapiens
ggagcggcagatggagtgggag

SEQ ID NO: 7357140 - DNA, 22 bp, Homo sapiens
ggaaagcatccaggtgccccca

SEQ ID NO: 7357141 - DNA, 22 bp, Homo sapiens
ggaaagagttttggtatatttg

SEQ ID NO: 7357142 - DNA, 22 bp, Homo sapiens
ggaaagagggacccagcttggt

SEQ ID NO: 7357143 - DNA, 22 bp, Homo sapiens
ggaaagagctaaaagggtgaga

SEQ ID NO: 7357144 - DNA, 22 bp, Homo sapiens
ggaaagagctaaaagggtgaga

SEQ ID NO: 7357145 - DNA, 21 bp, Homo sapiens
ggaaagaaggcaaggctcagg

SEQ ID NO: 7357146 - DNA, 22 bp, Homo sapiens
ggaaagaatagagactttatca

SEQ ID NO: 7357147 - DNA, 22 bp, Homo sapiens
ggaaagaaccctggatggctgg

SEQ ID NO: 7357148 - DNA, 22 bp, Homo sapiens
ggaaagagcccagcagtgcttg

SEQ ID NO: 7357149 - DNA, 23 bp, Homo sapiens
ggaaagagaggagttgtgcatag

SEQ ID NO: 7357150 - DNA, 22 bp, Homo sapiens
ggaaagaatcaagtgatcctgt

SEQ ID NO: 7357151 - DNA, 20 bp, Homo sapiens
ggaaacatttttatttccat

SEQ ID NO: 7357152 - DNA, 22 bp, Homo sapiens
ggaaacattccaagagttgaaa

SEQ ID NO: 7357153 - DNA, 22 bp, Homo sapiens
ggaaacatgcctgctggacagt

SEQ ID NO: 7357154 - DNA, 19 bp, Homo sapiens
ggaaacaggggccagagga

SEQ ID NO: 7357155 - DNA, 22 bp, Homo sapiens
ggaaacatattctgatgtgcat

SEQ ID NO: 7357156 - DNA, 19 bp, Homo sapiens
ggaaacaggggccagagga

SEQ ID NO: 7357157 - DNA, 22 bp, Homo sapiens
ggaaacagagggcacctgagcc

SEQ ID NO: 7357158 - DNA, 22 bp, Homo sapiens
ggaaagaaagtgtgaacaactt

SEQ ID NO: 7357159 - DNA, 22 bp, Homo sapiens
ggaaagaaagtgtgaacaactt

SEQ ID NO: 7357160 - DNA, 22 bp, Homo sapiens
gcttctggcagtgcagccacca

SEQ ID NO: 7357161 - DNA, 22 bp, Homo sapiens
ggaactgattaagtcatgagaa

SEQ ID NO: 7357162 - DNA, 22 bp, Homo sapiens
ggaaggtcgagctgcatctggc

SEQ ID NO: 7357163 - DNA, 18 bp, Homo sapiens
ggaaggtgattcagtttt

SEQ ID NO: 7357164 - DNA, 22 bp, Homo sapiens
ggaaggggtgtcgcccatggat

SEQ ID NO: 7357165 - DNA, 22 bp, Homo sapiens
ggaaggggttaggggtccctga

SEQ ID NO: 7357166 - DNA, 22 bp, Homo sapiens
ggaaggggttaggggtccctga

SEQ ID NO: 7357167 - DNA, 22 bp, Homo sapiens
ggaaggtcacagatgagggaag

SEQ ID NO: 7357168 - DNA, 22 bp, Homo sapiens
ggaaggggtcacctcctgatga

SEQ ID NO: 7357169 - DNA, 22 bp, Homo sapiens
ggaagggcaaaagagatgaact

SEQ ID NO: 7357170 - DNA, 21 bp, Homo sapiens
ggaaggggtcctcccaacagt

SEQ ID NO: 7357171 - DNA, 22 bp, Homo sapiens
ggaaggggtgggtgagcctcag

SEQ ID NO: 7357172 - DNA, 22 bp, Homo sapiens
ggaaggggtgggtgagcctcag

SEQ ID NO: 7357173 - DNA, 22 bp, Homo sapiens
gcttaattctggctcagtttcc

SEQ ID NO: 7357174 - DNA, 22 bp, Homo sapiens
gctgggctggaaggccaaggca

SEQ ID NO: 7357175 - DNA, 22 bp, Homo sapiens
gcttattttcaccttctctcag

SEQ ID NO: 7357176 - DNA, 22 bp, Homo sapiens
gcttattaggttatttcaagga

SEQ ID NO: 7357177 - DNA, 22 bp, Homo sapiens
gctgggcatgtgaccaacagaa

SEQ ID NO: 7357178 - DNA, 22 bp, Homo sapiens
gctgggccagagcagcagcact

SEQ ID NO: 7357179 - DNA, 22 bp, Homo sapiens
gctgggctgagctagacttggc

SEQ ID NO: 7357180 - DNA, 22 bp, Homo sapiens
gcttctgcagggtcctcgctgt

SEQ ID NO: 7357181 - DNA, 22 bp, Homo sapiens
gcttctgcgcctagcctcaggt

SEQ ID NO: 7357182 - DNA, 22 bp, Homo sapiens
gcttctagggaaggcagtcaca

SEQ ID NO: 7357183 - DNA, 22 bp, Homo sapiens
gggacgggcacggagggccctc

SEQ ID NO: 7357184 - DNA, 22 bp, Homo sapiens
gggacgagatcttggcagtgtg

SEQ ID NO: 7357185 - DNA, 22 bp, Homo sapiens
gggagaagaatgtgtcaattgt

SEQ ID NO: 7357186 - DNA, 22 bp, Homo sapiens
gggacgggcagtccaaggggtc

SEQ ID NO: 7357187 - DNA, 22 bp, Homo sapiens
gggacgggcagtccaaggggtc

SEQ ID NO: 7357188 - DNA, 22 bp, Homo sapiens
gggactccagggccactgggcc

SEQ ID NO: 7357189 - DNA, 22 bp, Homo sapiens
gggactccaaaactgtacccaa

SEQ ID NO: 7357190 - DNA, 22 bp, Homo sapiens
gggacccacgaaaggctttgga

SEQ ID NO: 7357191 - DNA, 22 bp, Homo sapiens
gggacctgaggccctgctccac

SEQ ID NO: 7357192 - DNA, 22 bp, Homo sapiens
gggacctggtctagcactgagc

SEQ ID NO: 7357193 - DNA, 22 bp, Homo sapiens
gggaggcgccgagggtagctaa

SEQ ID NO: 7357194 - DNA, 20 bp, Homo sapiens
gggaggcgagggctgagcag

SEQ ID NO: 7357195 - DNA, 22 bp, Homo sapiens
gggaggctcagtggtgtcctct

SEQ ID NO: 7357196 - DNA, 22 bp, Homo sapiens
gggaggcgccgagggtagctaa

SEQ ID NO: 7357197 - DNA, 22 bp, Homo sapiens
gggaggaggaatgttttgtgta

SEQ ID NO: 7357198 - DNA, 22 bp, Homo sapiens
gggaggagcttggagattcact

SEQ ID NO: 7357199 - DNA, 20 bp, Homo sapiens
gggagaagggctgatgagag

SEQ ID NO: 7357200 - DNA, 22 bp, Homo sapiens
gggagaaggaggactgtgctgt

SEQ ID NO: 7357201 - DNA, 22 bp, Homo sapiens
gggagaaggaggactgtgctgt

SEQ ID NO: 7357202 - DNA, 22 bp, Homo sapiens
gggagaaggagctagttcttga

SEQ ID NO: 7357203 - DNA, 22 bp, Homo sapiens
gggatggctttgtggctgactc

SEQ ID NO: 7357204 - DNA, 19 bp, Homo sapiens
gggatgggccctcaccctc

SEQ ID NO: 7357205 - DNA, 22 bp, Homo sapiens
gggcagaggggcgcttccctct

SEQ ID NO: 7357206 - DNA, 22 bp, Homo sapiens
gggatggggagctggaaagggg

SEQ ID NO: 7357207 - DNA, 22 bp, Homo sapiens
gggatggagggtagagcaagtg

SEQ ID NO: 7357208 - DNA, 22 bp, Homo sapiens
gggatggatcttggctgaggct

SEQ ID NO: 7357209 - DNA, 22 bp, Homo sapiens
gggaggcttgagccatactgcc

SEQ ID NO: 7357210 - DNA, 22 bp, Homo sapiens
gggaggctgccatccttcagga

SEQ ID NO: 7357211 - DNA, 22 bp, Homo sapiens
gggaggctggctctggccacag

SEQ ID NO: 7357212 - DNA, 22 bp, Homo sapiens
gggagggaaggaggcgccgtgt

SEQ ID NO: 7357213 - DNA, 22 bp, Homo sapiens
gggagggaaggaccttatgaat

SEQ ID NO: 7357214 - DNA, 22 bp, Homo sapiens
gggagggaaagcttgatctgtc

SEQ ID NO: 7357215 - DNA, 22 bp, Homo sapiens
gggatcgtcatggaaagtgcta

SEQ ID NO: 7357216 - DNA, 22 bp, Homo sapiens
gggagggaaggtacctgtgtga

SEQ ID NO: 7357217 - DNA, 22 bp, Homo sapiens
gggatgaggatcaatcagggag

SEQ ID NO: 7357218 - DNA, 19 bp, Homo sapiens
gggatgcactctgaccact

SEQ ID NO: 7357219 - DNA, 22 bp, Homo sapiens
gggatgcagtcagagcccctgt

SEQ ID NO: 7357220 - DNA, 22 bp, Homo sapiens
gggcagaggttcaacttcaaca

SEQ ID NO: 7357221 - DNA, 22 bp, Homo sapiens
gggcagaggggcgcttccctct

SEQ ID NO: 7357222 - DNA, 22 bp, Homo sapiens
gggcagaggttcaacttcaaca

SEQ ID NO: 7357223 - DNA, 22 bp, Homo sapiens
gggcagcacagacagtgaaggc

SEQ ID NO: 7357224 - DNA, 20 bp, Homo sapiens
gggcagcaagacatttgaca

SEQ ID NO: 7357225 - DNA, 22 bp, Homo sapiens
gggcagcagaattggacagaaa

SEQ ID NO: 7357226 - DNA, 22 bp, Homo sapiens
gggcagcagaattggacagaaa

SEQ ID NO: 7357227 - DNA, 22 bp, Homo sapiens
gggcagcacgtttcaggaggat

SEQ ID NO: 7357228 - DNA, 22 bp, Homo sapiens
gggcagcacgtttcaggaggat

SEQ ID NO: 7357229 - DNA, 22 bp, Homo sapiens
gggccaggtatcgtctttagta

SEQ ID NO: 7357230 - DNA, 22 bp, Homo sapiens
gggccaggagtggagatatggg

SEQ ID NO: 7357231 - DNA, 22 bp, Homo sapiens
gggccaggtggaccccagcctc

SEQ ID NO: 7357232 - DNA, 22 bp, Homo sapiens
gggccaggtcggtgaatggtca

SEQ ID NO: 7357233 - DNA, 22 bp, Homo sapiens
gggccagtagcacctgtgtgga

SEQ ID NO: 7357234 - DNA, 22 bp, Homo sapiens
gggccagtagcacctgtgtgga

SEQ ID NO: 7357235 - DNA, 22 bp, Homo sapiens
gggccagtctgactctgctggt

SEQ ID NO: 7357236 - DNA, 22 bp, Homo sapiens
gggccaggtggaccccagcctc

SEQ ID NO: 7357237 - DNA, 22 bp, Homo sapiens
gggccaggtggaccccagcctc

SEQ ID NO: 7357238 - DNA, 20 bp, Homo sapiens
gggcagcctcgggagtgggt

SEQ ID NO: 7357239 - DNA, 22 bp, Homo sapiens
gggcagcctcggtgcctgctgc

SEQ ID NO: 7357240 - DNA, 22 bp, Homo sapiens
gggcagcctgctttctgatcca

SEQ ID NO: 7357241 - DNA, 22 bp, Homo sapiens
gggccatgagaggttcatcaac

SEQ ID NO: 7357242 - DNA, 22 bp, Homo sapiens
gggccagtgggacctgggtctc

SEQ ID NO: 7357243 - DNA, 22 bp, Homo sapiens
gggcccagcactggctgggatc

SEQ ID NO: 7357244 - DNA, 22 bp, Homo sapiens
gggcccagcactggctgggatc

SEQ ID NO: 7357245 - DNA, 22 bp, Homo sapiens
gggcctggtgcttctgactcct

SEQ ID NO: 7357246 - DNA, 22 bp, Homo sapiens
gggcggggcttccgtcctccac

SEQ ID NO: 7357247 - DNA, 22 bp, Homo sapiens
gggcggggtggctcatgcctgt

SEQ ID NO: 7357248 - DNA, 22 bp, Homo sapiens
gggcggggggagctggaatgaa

SEQ ID NO: 7357249 - DNA, 22 bp, Homo sapiens
gggcggtgcctgtctccgaagc

SEQ ID NO: 7357250 - DNA, 22 bp, Homo sapiens
gggcgtcctggaccctcccctg

SEQ ID NO: 7357251 - DNA, 22 bp, Homo sapiens
gggcgtgaccatctgggagctc

SEQ ID NO: 7357252 - DNA, 22 bp, Homo sapiens
gggcgtggatggtcagtgcagg

SEQ ID NO: 7357253 - DNA, 22 bp, Homo sapiens
ggggacgcagaaagagtggcag

SEQ ID NO: 7357254 - DNA, 22 bp, Homo sapiens
ggggacgggacttagcatgagt

SEQ ID NO: 7357255 - DNA, 22 bp, Homo sapiens
ggggaccctcaggactgcgtct

SEQ ID NO: 7357256 - DNA, 22 bp, Homo sapiens
gggggctctgactccctcagct

SEQ ID NO: 7357257 - DNA, 22 bp, Homo sapiens
gggggctggaatatccatcaac

SEQ ID NO: 7357258 - DNA, 16 bp, Homo sapiens
gggggctgcaagcttc

SEQ ID NO: 7357259 - DNA, 23 bp, Homo sapiens
gggggctggttgactctctgcag

SEQ ID NO: 7357260 - DNA, 22 bp, Homo sapiens
gggggctgtcctgtgcattgta

SEQ ID NO: 7357261 - DNA, 22 bp, Homo sapiens
ggggggacgcagtcgctgccta

SEQ ID NO: 7357262 - DNA, 22 bp, Homo sapiens
gggggctggactttcccacaca

SEQ ID NO: 7357263 - DNA, 22 bp, Homo sapiens
gggggctggactttcccacaca

SEQ ID NO: 7357264 - DNA, 22 bp, Homo sapiens
gggggtcccaagctgggctgct

SEQ ID NO: 7357265 - DNA, 22 bp, Homo sapiens
ggggggctgttctggacaggaa

SEQ ID NO: 7357266 - DNA, 22 bp, Homo sapiens
ggggggcagctgtcctggccat

SEQ ID NO: 7357267 - DNA, 20 bp, Homo sapiens
ggggggcttcagggcctgtg

SEQ ID NO: 7357268 - DNA, 20 bp, Homo sapiens
ggggggcttcagggcctgtg

SEQ ID NO: 7357269 - DNA, 22 bp, Homo sapiens
gggtccaggcgtggcccagatg

SEQ ID NO: 7357270 - DNA, 22 bp, Homo sapiens
gggtccaggcgtggcccagatg

SEQ ID NO: 7357271 - DNA, 22 bp, Homo sapiens
gggggtggttctaagtcctata

SEQ ID NO: 7357272 - DNA, 22 bp, Homo sapiens
gggggtggttctaagtcctata

SEQ ID NO: 7357273 - DNA, 22 bp, Homo sapiens
gggtgggccactgagcagcgtg

SEQ ID NO: 7357274 - DNA, 22 bp, Homo sapiens
gggtgggcccagcccagagaag

SEQ ID NO: 7357275 - DNA, 22 bp, Homo sapiens
gggtgggccccaggtatctgta

SEQ ID NO: 7357276 - DNA, 17 bp, Homo sapiens
gggtgggcactgctggc

SEQ ID NO: 7357277 - DNA, 23 bp, Homo sapiens
gggtgggccaaattaggtagcct

SEQ ID NO: 7357278 - DNA, 22 bp, Homo sapiens
gggtgggatggcaggagccgct

SEQ ID NO: 7357279 - DNA, 22 bp, Homo sapiens
gggtgaggagctgccagtcatg

SEQ ID NO: 7357280 - DNA, 19 bp, Homo sapiens
gggtgaggaagagcgttgc

SEQ ID NO: 7357281 - DNA, 20 bp, Homo sapiens
gggtgagatgtaggagaggg

SEQ ID NO: 7357282 - DNA, 22 bp, Homo sapiens
gggtctggagggcagcccttct

SEQ ID NO: 7357283 - DNA, 22 bp, Homo sapiens
gggctctgtggcttccttctta

SEQ ID NO: 7357284 - DNA, 22 bp, Homo sapiens
gggctgagacgatggggtcttc

SEQ ID NO: 7357285 - DNA, 22 bp, Homo sapiens
gggctgctgtgttcctgaggca

SEQ ID NO: 7357286 - DNA, 22 bp, Homo sapiens
gggctgcttggaggaggcgctc

SEQ ID NO: 7357287 - DNA, 22 bp, Homo sapiens
gggctgcttggaggaggcgctc

SEQ ID NO: 7357288 - DNA, 22 bp, Homo sapiens
gggctggacatctaaggtagct

SEQ ID NO: 7357289 - DNA, 21 bp, Homo sapiens
gggctggacatggtggctcat

SEQ ID NO: 7357290 - DNA, 18 bp, Homo sapiens
gggctaggcaaggaccac

SEQ ID NO: 7357291 - DNA, 22 bp, Homo sapiens
gggctagcctcttccctgctcc

SEQ ID NO: 7357292 - DNA, 22 bp, Homo sapiens
gggctagcctcttccctgctcc

SEQ ID NO: 7357293 - DNA, 22 bp, Homo sapiens
gggctagggcctgctatggttt

SEQ ID NO: 7357294 - DNA, 22 bp, Homo sapiens
gggctagggcctgctatggttt

SEQ ID NO: 7357295 - DNA, 22 bp, Homo sapiens
gggctagggcctgctatggttt

SEQ ID NO: 7357296 - DNA, 22 bp, Homo sapiens
gggctaggcttggccagcactg

SEQ ID NO: 7357297 - DNA, 22 bp, Homo sapiens
gggctctgggtcgtgtctccat

SEQ ID NO: 7357298 - DNA, 22 bp, Homo sapiens
gggctctggggtgccctggcat

SEQ ID NO: 7357299 - DNA, 22 bp, Homo sapiens
gggctctggggtgccctggcat

SEQ ID NO: 7357300 - DNA, 20 bp, Homo sapiens
gggctctgtaaggttgaaag

SEQ ID NO: 7357301 - DNA, 22 bp, Homo sapiens
gggctctggtacttcctggctc

SEQ ID NO: 7357302 - DNA, 22 bp, Homo sapiens
gggctctgtgcaccccagcacc

SEQ ID NO: 7357303 - DNA, 22 bp, Homo sapiens
gggctctgtggatgtgagagct

SEQ ID NO: 7357304 - DNA, 22 bp, Homo sapiens
gggctctgtggatgtgagagct

SEQ ID NO: 7357305 - DNA, 22 bp, Homo sapiens
ggggaccctcaggactgcgtct

SEQ ID NO: 7357306 - DNA, 23 bp, Homo sapiens
ggggacagttcccactggggtct

SEQ ID NO: 7357307 - DNA, 23 bp, Homo sapiens
ggggacagttcccactggggtct

SEQ ID NO: 7357308 - DNA, 23 bp, Homo sapiens
ggggacagttcccactggggtct

SEQ ID NO: 7357309 - DNA, 23 bp, Homo sapiens
ggggacagttcccactggggtct

SEQ ID NO: 7357310 - DNA, 22 bp, Homo sapiens
ggggacagttaaagaccaagac

SEQ ID NO: 7357311 - DNA, 22 bp, Homo sapiens
ggggacagtcgatctagtgatt

SEQ ID NO: 7357312 - DNA, 22 bp, Homo sapiens
ggggacagtcgatctagtgatt

SEQ ID NO: 7357313 - DNA, 22 bp, Homo sapiens
ggggaagtcggagcctgagcac

SEQ ID NO: 7357314 - DNA, 22 bp, Homo sapiens
ggggaaggattgagttgaccca

SEQ ID NO: 7357315 - DNA, 22 bp, Homo sapiens
ggggaaggattgagttgaccca

SEQ ID NO: 7357316 - DNA, 16 bp, Homo sapiens
ggggaaggcaagaggg

SEQ ID NO: 7357317 - DNA, 22 bp, Homo sapiens
ggggaagggagtccaagtgtta

SEQ ID NO: 7357318 - DNA, 22 bp, Homo sapiens
gggctggagacaagtgagccgc

SEQ ID NO: 7357319 - DNA, 22 bp, Homo sapiens
gggctggaccgctcgcctccct

SEQ ID NO: 7357320 - DNA, 21 bp, Homo sapiens
gggctggacatggtggctcat

SEQ ID NO: 7357321 - DNA, 22 bp, Homo sapiens
gggctggcaggacctgggctga

SEQ ID NO: 7357322 - DNA, 22 bp, Homo sapiens
gggctggcaggacctgggctga

SEQ ID NO: 7357323 - DNA, 22 bp, Homo sapiens
gggctggatctcctgcaggcag

SEQ ID NO: 7357324 - DNA, 20 bp, Homo sapiens
ggcaggtgctcgcttggtct

SEQ ID NO: 7357325 - DNA, 22 bp, Homo sapiens
ggcaggtggaaggtctccattc

SEQ ID NO: 7357326 - DNA, 22 bp, Homo sapiens
ggcaggtgcttgtcgaaggcct

SEQ ID NO: 7357327 - DNA, 20 bp, Homo sapiens
ggcaggtgctgtcccctcct

SEQ ID NO: 7357328 - DNA, 18 bp, Homo sapiens
ggccagagggagggtccc

SEQ ID NO: 7357329 - DNA, 18 bp, Homo sapiens
ggccagagggagggtccc

SEQ ID NO: 7357330 - DNA, 17 bp, Homo sapiens
ggccagaggcggggctg

SEQ ID NO: 7357331 - DNA, 17 bp, Homo sapiens
ggccagaggcggggctg

SEQ ID NO: 7357332 - DNA, 22 bp, Homo sapiens
ggccagaggccatcctcctgct

SEQ ID NO: 7357333 - DNA, 18 bp, Homo sapiens
ggccagagggagggtccc

SEQ ID NO: 7357334 - DNA, 17 bp, Homo sapiens
ggccagaggcggggctg

SEQ ID NO: 7357335 - DNA, 22 bp, Homo sapiens
ggccccaggtctgaacacgctg

SEQ ID NO: 7357336 - DNA, 22 bp, Homo sapiens
ggccccagttcactcctggccg

SEQ ID NO: 7357337 - DNA, 21 bp, Homo sapiens
ggccccgcagacccagcacgt

SEQ ID NO: 7357338 - DNA, 22 bp, Homo sapiens
ggcccctcagcatctgagtcag

SEQ ID NO: 7357339 - DNA, 22 bp, Homo sapiens
ggcccctgcggactgcctagag

SEQ ID NO: 7357340 - DNA, 22 bp, Homo sapiens
ggcccctggcaccaggctgatt

SEQ ID NO: 7357341 - DNA, 22 bp, Homo sapiens
ggcccctgcggactgcctagag

SEQ ID NO: 7357342 - DNA, 22 bp, Homo sapiens
ggcccagcgaggccacctacag

SEQ ID NO: 7357343 - DNA, 22 bp, Homo sapiens
ggcccagccttggggtttcttt

SEQ ID NO: 7357344 - DNA, 22 bp, Homo sapiens
ggcccagcctcagacatgccct

SEQ ID NO: 7357345 - DNA, 22 bp, Homo sapiens
ggcccagccggcgagtctcgcg

SEQ ID NO: 7357346 - DNA, 22 bp, Homo sapiens
ggcccaaaccaagtacctcaaa

SEQ ID NO: 7357347 - DNA, 22 bp, Homo sapiens
ggccatggtgaggtcttctcag

SEQ ID NO: 7357348 - DNA, 22 bp, Homo sapiens
ggccatggtcatgggtgagctt

SEQ ID NO: 7357349 - DNA, 22 bp, Homo sapiens
ggcccaaatctccacttgttgc

SEQ ID NO: 7357350 - DNA, 22 bp, Homo sapiens
ggcccaaaccagctgggcagga

SEQ ID NO: 7357351 - DNA, 22 bp, Homo sapiens
ggcccaaacgggtccagtgaaa

SEQ ID NO: 7357352 - DNA, 22 bp, Homo sapiens
ggcccaaaggagtcttggacca

SEQ ID NO: 7357353 - DNA, 22 bp, Homo sapiens
ggcccaaagggctctgtgggct

SEQ ID NO: 7357354 - DNA, 22 bp, Homo sapiens
ggcccagcccgagtcagccttc

SEQ ID NO: 7357355 - DNA, 22 bp, Homo sapiens
ggctcaggtttccttcccagct

SEQ ID NO: 7357356 - DNA, 22 bp, Homo sapiens
ggctcaggtttccttcccagct

SEQ ID NO: 7357357 - DNA, 22 bp, Homo sapiens
ggctcaggcctgtaatcctagc

SEQ ID NO: 7357358 - DNA, 22 bp, Homo sapiens
ggctcctgcacctgtccctctg

SEQ ID NO: 7357359 - DNA, 23 bp, Homo sapiens
ggctcctgcttcatgtcccacct

SEQ ID NO: 7357360 - DNA, 21 bp, Homo sapiens
ggctcctgctttgtgaggggc

SEQ ID NO: 7357361 - DNA, 21 bp, Homo sapiens
ggctcctgctttgtgaggggc

SEQ ID NO: 7357362 - DNA, 22 bp, Homo sapiens
ggctcctgcacctgtccctctg

SEQ ID NO: 7357363 - DNA, 22 bp, Homo sapiens
ggctcctgatttgagggggctg

SEQ ID NO: 7357364 - DNA, 22 bp, Homo sapiens
ggctccaccctgcttccagaag

SEQ ID NO: 7357365 - DNA, 18 bp, Homo sapiens
ggctcagcaggctctctc

SEQ ID NO: 7357366 - DNA, 22 bp, Homo sapiens
ggctcagcacagggctggcatc

SEQ ID NO: 7357367 - DNA, 22 bp, Homo sapiens
ggctcagccccgtaacacagca

SEQ ID NO: 7357368 - DNA, 22 bp, Homo sapiens
ggctcagcgcgctgggagggag

SEQ ID NO: 7357369 - DNA, 22 bp, Homo sapiens
ggccttggcctagccctccagg

SEQ ID NO: 7357370 - DNA, 22 bp, Homo sapiens
ggctcaggactgcagcgtagag

SEQ ID NO: 7357371 - DNA, 22 bp, Homo sapiens
ggctcaggacctgggattgcca

SEQ ID NO: 7357372 - DNA, 22 bp, Homo sapiens
ggctcagcttatctgggcaggc

SEQ ID NO: 7357373 - DNA, 22 bp, Homo sapiens
ggctcagcttggtgcgcagaaa

SEQ ID NO: 7357374 - DNA, 22 bp, Homo sapiens
ggctcaggacacagtggtttag

SEQ ID NO: 7357375 - DNA, 22 bp, Homo sapiens
ggctcaggagaggggctaaaag

SEQ ID NO: 7357376 - DNA, 22 bp, Homo sapiens
ggctcaggatgagccttctcat

SEQ ID NO: 7357377 - DNA, 22 bp, Homo sapiens
ggctcaggatgagccttctcat

SEQ ID NO: 7357378 - DNA, 22 bp, Homo sapiens
ggctcaggccagaccacgactc

SEQ ID NO: 7357379 - DNA, 22 bp, Homo sapiens
ggccttccttcccagcctactg

SEQ ID NO: 7357380 - DNA, 22 bp, Homo sapiens
ggccttcacgtgacctggcgtg

SEQ ID NO: 7357381 - DNA, 22 bp, Homo sapiens
ggccttccagggaagacagggc

SEQ ID NO: 7357382 - DNA, 22 bp, Homo sapiens
ggccttcacgtgacctggcgtg

SEQ ID NO: 7357383 - DNA, 22 bp, Homo sapiens
ggccttgcggaacgctcaggcg

SEQ ID NO: 7357384 - DNA, 22 bp, Homo sapiens
ggccttgcggaacgctcaggcg

SEQ ID NO: 7357385 - DNA, 22 bp, Homo sapiens
ggccttgctgcttccagaaggt

SEQ ID NO: 7357386 - DNA, 22 bp, Homo sapiens
ggccttgccaaggagcccttaa

SEQ ID NO: 7357387 - DNA, 22 bp, Homo sapiens
ggccctccctgagccaggtggg

SEQ ID NO: 7357388 - DNA, 22 bp, Homo sapiens
ggccctccctgagccaggtggg

SEQ ID NO: 7357389 - DNA, 22 bp, Homo sapiens
ggccctctgagtagctgcaaac

SEQ ID NO: 7357390 - DNA, 22 bp, Homo sapiens
ggccctctgtggctgccatgga

SEQ ID NO: 7357391 - DNA, 22 bp, Homo sapiens
ggccctctggtgagtatcacat

SEQ ID NO: 7357392 - DNA, 22 bp, Homo sapiens
ggccctgcatgagattaaggtt

SEQ ID NO: 7357393 - DNA, 22 bp, Homo sapiens
ggccctgcaaggtacccaggcc

SEQ ID NO: 7357394 - DNA, 22 bp, Homo sapiens
ggccctgcgattaggtggcagg

SEQ ID NO: 7357395 - DNA, 22 bp, Homo sapiens
ggccctgagtctagctgctctt

SEQ ID NO: 7357396 - DNA, 22 bp, Homo sapiens
ggccctgagtctagctgctctt

SEQ ID NO: 7357397 - DNA, 22 bp, Homo sapiens
ggccctgagcacagctcctctc

SEQ ID NO: 7357398 - DNA, 22 bp, Homo sapiens
ggcttcctccttcctgctgtca

SEQ ID NO: 7357399 - DNA, 22 bp, Homo sapiens
gggaaaggatcagtgggaggct

SEQ ID NO: 7357400 - DNA, 22 bp, Homo sapiens
gggaaaggatttacagtttgat

SEQ ID NO: 7357401 - DNA, 22 bp, Homo sapiens
gggaaaggatcagtgggaggct

SEQ ID NO: 7357402 - DNA, 22 bp, Homo sapiens
gggaaaggatttacagtttgat

SEQ ID NO: 7357403 - DNA, 22 bp, Homo sapiens
gggaaaggatttacagtttgat

SEQ ID NO: 7357404 - DNA, 22 bp, Homo sapiens
gggaagagaggaggtggtttcg

SEQ ID NO: 7357405 - DNA, 22 bp, Homo sapiens
gggaacagggcctgagctgggg

SEQ ID NO: 7357406 - DNA, 22 bp, Homo sapiens
gggaacagggcctgagctgggg

SEQ ID NO: 7357407 - DNA, 22 bp, Homo sapiens
ggcttccccacagtcctgagct

SEQ ID NO: 7357408 - DNA, 22 bp, Homo sapiens
ggcttcccaaggagccaggatg

SEQ ID NO: 7357409 - DNA, 22 bp, Homo sapiens
ggcttcccagcagagggcgcac

SEQ ID NO: 7357410 - DNA, 19 bp, Homo sapiens
ggcttcagtttagcaggct

SEQ ID NO: 7357411 - DNA, 22 bp, Homo sapiens
ggctggctgtgccctgtactct

SEQ ID NO: 7357412 - DNA, 22 bp, Homo sapiens
ggctgtggtctgggtgctcccc

SEQ ID NO: 7357413 - DNA, 22 bp, Homo sapiens
ggctgtggtggcatccctgagc

SEQ ID NO: 7357414 - DNA, 22 bp, Homo sapiens
ggctgcaggaacgacggagggg

SEQ ID NO: 7357415 - DNA, 22 bp, Homo sapiens
ggctgcaggatgcccagccgtg

SEQ ID NO: 7357416 - DNA, 22 bp, Homo sapiens
ggctgcaggcagaggctgtctg

SEQ ID NO: 7357417 - DNA, 22 bp, Homo sapiens
ggctgccttcagactccagctt

SEQ ID NO: 7357418 - DNA, 22 bp, Homo sapiens
ggctgctcggagcctcctgtga

SEQ ID NO: 7357419 - DNA, 22 bp, Homo sapiens
ggctgccttccctgagccccgg

SEQ ID NO: 7357420 - DNA, 22 bp, Homo sapiens
ggctgctcggcagctcctgagc

SEQ ID NO: 7357421 - DNA, 22 bp, Homo sapiens
ggctgctctccatcccaggcct

SEQ ID NO: 7357422 - DNA, 22 bp, Homo sapiens
ggctgctcttcttggcgacctc

SEQ ID NO: 7357423 - DNA, 22 bp, Homo sapiens
ggctgctgaacaagggaaccct

SEQ ID NO: 7357424 - DNA, 22 bp, Homo sapiens
ggctgctgaacaagggaaccct

SEQ ID NO: 7357425 - DNA, 22 bp, Homo sapiens
ggctggcctctacagggaggca

SEQ ID NO: 7357426 - DNA, 22 bp, Homo sapiens
ggctgcagagctgggtgggcct

SEQ ID NO: 7357427 - DNA, 22 bp, Homo sapiens
ggctctagagactctagagaaa

SEQ ID NO: 7357428 - DNA, 22 bp, Homo sapiens
ggctctcagggaaaggcctccc

SEQ ID NO: 7357429 - DNA, 23 bp, Homo sapiens
ggctccttgcccatccagcagcc

SEQ ID NO: 7357430 - DNA, 22 bp, Homo sapiens
ggctccttgccaccagctctgc

SEQ ID NO: 7357431 - DNA, 22 bp, Homo sapiens
ggctccttcaagcctgtcactg

SEQ ID NO: 7357432 - DNA, 19 bp, Homo sapiens
ggctcctgtggctgcagcc

SEQ ID NO: 7357433 - DNA, 19 bp, Homo sapiens
ggctcctgtggctgcagcc

SEQ ID NO: 7357434 - DNA, 22 bp, Homo sapiens
ggctcctggggaggtgagcttg

SEQ ID NO: 7357435 - DNA, 22 bp, Homo sapiens
ggctcctggggaggtgagcttg

SEQ ID NO: 7357436 - DNA, 22 bp, Homo sapiens
ggctcctggcatctggtgggta

SEQ ID NO: 7357437 - DNA, 22 bp, Homo sapiens
ggctcctggaaagccctcgctc

SEQ ID NO: 7357438 - DNA, 22 bp, Homo sapiens
ggctcctggaaagccctcgctc

SEQ ID NO: 7357439 - DNA, 22 bp, Homo sapiens
ggctcctggaggcaccactggt

SEQ ID NO: 7357440 - DNA, 22 bp, Homo sapiens
ggctcctgggcagctgctccct

SEQ ID NO: 7357441 - DNA, 22 bp, Homo sapiens
ggctcctgggatgggactgagc

SEQ ID NO: 7357442 - DNA, 22 bp, Homo sapiens
gccgtggggagagagggtgcgt

SEQ ID NO: 7357443 - DNA, 22 bp, Homo sapiens
gccgtgggtgtcatggcccata

SEQ ID NO: 7357444 - DNA, 22 bp, Homo sapiens
gcctcctgtcccaggctgagga

SEQ ID NO: 7357445 - DNA, 19 bp, Homo sapiens
gccgggggcgccccgctct

SEQ ID NO: 7357446 - DNA, 22 bp, Homo sapiens
gccggggctggggagagacatg

SEQ ID NO: 7357447 - DNA, 22 bp, Homo sapiens
gccggtggcttttgtctcccct

SEQ ID NO: 7357448 - DNA, 22 bp, Homo sapiens
gccgggaccaaggccacggagc

SEQ ID NO: 7357449 - DNA, 19 bp, Homo sapiens
gccgggcccgggttggccg

SEQ ID NO: 7357450 - DNA, 22 bp, Homo sapiens
gccgggaccaaggccacggagc

SEQ ID NO: 7357451 - DNA, 22 bp, Homo sapiens
gccgatgaaaagaccaaagact

SEQ ID NO: 7357452 - DNA, 22 bp, Homo sapiens
gccgaggctctgcccagctgct

SEQ ID NO: 7357453 - DNA, 22 bp, Homo sapiens
gccgccgctgtgcaatttagca

SEQ ID NO: 7357454 - DNA, 22 bp, Homo sapiens
gccgcgtcgatgccctctagtt

SEQ ID NO: 7357455 - DNA, 22 bp, Homo sapiens
gcctctgcatcttcgccgcact

SEQ ID NO: 7357456 - DNA, 22 bp, Homo sapiens
gcctctgcatgctcagcaccca

SEQ ID NO: 7357457 - DNA, 22 bp, Homo sapiens
gcctctgccaagggggctgcgg

SEQ ID NO: 7357458 - DNA, 22 bp, Homo sapiens
gcctctgccaagggggctgcgg

SEQ ID NO: 7357459 - DNA, 22 bp, Homo sapiens
gcctctgcaactccgccttggt

SEQ ID NO: 7357460 - DNA, 19 bp, Homo sapiens
gcctctgctggggacaggc

SEQ ID NO: 7357461 - DNA, 22 bp, Homo sapiens
gcctctgcgcctcagccgacct

SEQ ID NO: 7357462 - DNA, 22 bp, Homo sapiens
gcctctgcggggcccgagcccg

SEQ ID NO: 7357463 - DNA, 22 bp, Homo sapiens
gccctctcttctgcagcctcca

SEQ ID NO: 7357464 - DNA, 20 bp, Homo sapiens
gccctctgcctccctcagcg

SEQ ID NO: 7357465 - DNA, 22 bp, Homo sapiens
gccctttcttcttctggactgg

SEQ ID NO: 7357466 - DNA, 16 bp, Homo sapiens
gccctttccttggctg

SEQ ID NO: 7357467 - DNA, 22 bp, Homo sapiens
gcccttccttagacagcaggat

SEQ ID NO: 7357468 - DNA, 22 bp, Homo sapiens
gcccttccaacccagagggcaa

SEQ ID NO: 7357469 - DNA, 22 bp, Homo sapiens
gccctctcggcatagcaggggc

SEQ ID NO: 7357470 - DNA, 22 bp, Homo sapiens
gccctcctttgcttctcctagt

SEQ ID NO: 7357471 - DNA, 22 bp, Homo sapiens
gccctcctttgcttctcctagt

SEQ ID NO: 7357472 - DNA, 22 bp, Homo sapiens
gcccaggctggagtgcagtggc

SEQ ID NO: 7357473 - DNA, 22 bp, Homo sapiens
gcccaggctagcgtagagtgca

SEQ ID NO: 7357474 - DNA, 22 bp, Homo sapiens
gcccaggattctttcttcctta

SEQ ID NO: 7357475 - DNA, 22 bp, Homo sapiens
gcccaggctggagtgcagtagc

SEQ ID NO: 7357476 - DNA, 22 bp, Homo sapiens
gccatgttttggtaaataccat

SEQ ID NO: 7357477 - DNA, 22 bp, Homo sapiens
gccatgggtctgctggctcagc

SEQ ID NO: 7357478 - DNA, 22 bp, Homo sapiens
gccatggggagggcagcgcctg

SEQ ID NO: 7357479 - DNA, 22 bp, Homo sapiens
gccatggggctcagctgcacta

SEQ ID NO: 7357480 - DNA, 22 bp, Homo sapiens
gccatggggctcagctgcacta

SEQ ID NO: 7357481 - DNA, 22 bp, Homo sapiens
gccatcatatcccctgtgacct

SEQ ID NO: 7357482 - DNA, 23 bp, Homo sapiens
gccatcacgttcaaccaaagcct

SEQ ID NO: 7357483 - DNA, 19 bp, Homo sapiens
gccatgggctggcagcaga

SEQ ID NO: 7357484 - DNA, 21 bp, Homo sapiens
gccatttcacacagacatttg

SEQ ID NO: 7357485 - DNA, 22 bp, Homo sapiens
gccattcattcagaattccaga

SEQ ID NO: 7357486 - DNA, 22 bp, Homo sapiens
gccaggctggtgtcacaactct

SEQ ID NO: 7357487 - DNA, 22 bp, Homo sapiens
gccaggctgactcccccggcct

SEQ ID NO: 7357488 - DNA, 22 bp, Homo sapiens
gccagggaaactgcagaccagc

SEQ ID NO: 7357489 - DNA, 22 bp, Homo sapiens
gccataatagagtgtgaggaat

SEQ ID NO: 7357490 - DNA, 22 bp, Homo sapiens
gccatattcgcattcttcattt

SEQ ID NO: 7357491 - DNA, 22 bp, Homo sapiens
gccagtgttattcctggggctg

SEQ ID NO: 7357492 - DNA, 19 bp, Homo sapiens
gccagtgtgtggtacagtg

SEQ ID NO: 7357493 - DNA, 22 bp, Homo sapiens
gccagtgtgtcttgcaggctcc

SEQ ID NO: 7357494 - DNA, 22 bp, Homo sapiens
gccagtgtttatagcagtgagg

SEQ ID NO: 7357495 - DNA, 22 bp, Homo sapiens
gccagtgttggtgataagctct

SEQ ID NO: 7357496 - DNA, 22 bp, Homo sapiens
gccagtgttgaactttccctgg

SEQ ID NO: 7357497 - DNA, 22 bp, Homo sapiens
gccagtgttcttcaccccctct

SEQ ID NO: 7357498 - DNA, 22 bp, Homo sapiens
gccagtgtggtgtagtcatgaa

SEQ ID NO: 7357499 - DNA, 22 bp, Homo sapiens
gccagtgtgtcatccggctgca

SEQ ID NO: 7357500 - DNA, 22 bp, Homo sapiens
gccagtgtgtcctctcagtttc

SEQ ID NO: 7357501 - DNA, 22 bp, Homo sapiens
gccagtgtgcaagaggccacca

SEQ ID NO: 7357502 - DNA, 22 bp, Homo sapiens
gccagtgtgcaagaaaacagaa

SEQ ID NO: 7357503 - DNA, 22 bp, Homo sapiens
gccagtgtcttcctgttaatcg

SEQ ID NO: 7357504 - DNA, 22 bp, Homo sapiens
gcctgtggggctgaggctgcct

SEQ ID NO: 7357505 - DNA, 22 bp, Homo sapiens
gcctgtggttgctttgggatcc

SEQ ID NO: 7357506 - DNA, 21 bp, Homo sapiens
gcctgtgtaaattgagtttcc

SEQ ID NO: 7357507 - DNA, 22 bp, Homo sapiens
gcctggtgtgcgccgcgcagct

SEQ ID NO: 7357508 - DNA, 22 bp, Homo sapiens
gcctggtgtctccccaaggaag

SEQ ID NO: 7357509 - DNA, 23 bp, Homo sapiens
gcctgggactggtagtgtgacct

SEQ ID NO: 7357510 - DNA, 23 bp, Homo sapiens
gcctggccaccccagggctgctt

SEQ ID NO: 7357511 - DNA, 22 bp, Homo sapiens
gcctggccaacgtggtgaaacc

SEQ ID NO: 7357512 - DNA, 17 bp, Homo sapiens
gcctggcccagcctggc

SEQ ID NO: 7357513 - DNA, 22 bp, Homo sapiens
gcctggccgctccgagctccgc

SEQ ID NO: 7357514 - DNA, 22 bp, Homo sapiens
gcctggcccagggctccgcagg

SEQ ID NO: 7357515 - DNA, 22 bp, Homo sapiens
gcctggcccagggctcttgttg

SEQ ID NO: 7357516 - DNA, 22 bp, Homo sapiens
gcctggcctgaactaggaggtg

SEQ ID NO: 7357517 - DNA, 22 bp, Homo sapiens
gcctggccgggtcttggatttt

SEQ ID NO: 7357518 - DNA, 21 bp, Homo sapiens
gcctgggaaatctgggaagcc

SEQ ID NO: 7357519 - DNA, 22 bp, Homo sapiens
gcctgggaaatggtggggtcag

SEQ ID NO: 7357520 - DNA, 22 bp, Homo sapiens
gcctggagtagcatggcaagcc

SEQ ID NO: 7357521 - DNA, 22 bp, Homo sapiens
gcctgccttttggaggcacatt

SEQ ID NO: 7357522 - DNA, 22 bp, Homo sapiens
gcctggagggatagaatgcaag

SEQ ID NO: 7357523 - DNA, 18 bp, Homo sapiens
gcctgccatccccacagc

SEQ ID NO: 7357524 - DNA, 22 bp, Homo sapiens
gcctgcctgaaggctgtaccag

SEQ ID NO: 7357525 - DNA, 22 bp, Homo sapiens
gcctgcctcaaaatcccagttc

SEQ ID NO: 7357526 - DNA, 22 bp, Homo sapiens
gctgggcagctgaggcctctca

SEQ ID NO: 7357527 - DNA, 22 bp, Homo sapiens
gctgggcaggcctcgtgagggc

SEQ ID NO: 7357528 - DNA, 22 bp, Homo sapiens
gctgggcaggcctcgtgagggc

SEQ ID NO: 7357529 - DNA, 22 bp, Homo sapiens
gctgggcagcaggctctccggg

SEQ ID NO: 7357530 - DNA, 22 bp, Homo sapiens
gctgggcagcctggccgctgcc

SEQ ID NO: 7357531 - DNA, 22 bp, Homo sapiens
gctgggcaatgccagagaggag

SEQ ID NO: 7357532 - DNA, 22 bp, Homo sapiens
gctgggcaatgccagagaggag

SEQ ID NO: 7357533 - DNA, 22 bp, Homo sapiens
gctgggcaccggagagacccca

SEQ ID NO: 7357534 - DNA, 22 bp, Homo sapiens
gctgggcaccggagagacccca

SEQ ID NO: 7357535 - DNA, 22 bp, Homo sapiens
gctgggcaagtgccttgggttt

SEQ ID NO: 7357536 - DNA, 22 bp, Homo sapiens
gctgggcaagtgccttgggttt

SEQ ID NO: 7357537 - DNA, 22 bp, Homo sapiens
gctgggcaaggctgaagctacc

SEQ ID NO: 7357538 - DNA, 22 bp, Homo sapiens
gctgggcaaggctgaagctacc

SEQ ID NO: 7357539 - DNA, 22 bp, Homo sapiens
gctggcggcagtggtgtctctg

SEQ ID NO: 7357540 - DNA, 22 bp, Homo sapiens
gctgggagttactgtctccttt

SEQ ID NO: 7357541 - DNA, 22 bp, Homo sapiens
gctgggatgcgtcttcccaggc

SEQ ID NO: 7357542 - DNA, 22 bp, Homo sapiens
gctgggatgcgtcttcccaggc

SEQ ID NO: 7357543 - DNA, 22 bp, Homo sapiens
gctggcctgggcagaggctatg

SEQ ID NO: 7357544 - DNA, 22 bp, Homo sapiens
gctggagcgggttcgggccgct

SEQ ID NO: 7357545 - DNA, 22 bp, Homo sapiens
gctggagagtagtaagcagtta

SEQ ID NO: 7357546 - DNA, 22 bp, Homo sapiens
gctggagatagaatggccactg

SEQ ID NO: 7357547 - DNA, 19 bp, Homo sapiens
gctggcccctgggatccag

SEQ ID NO: 7357548 - DNA, 19 bp, Homo sapiens
gctggcccctgggatccag

SEQ ID NO: 7357549 - DNA, 22 bp, Homo sapiens
gctggccccgagtgctacgctc

SEQ ID NO: 7357550 - DNA, 22 bp, Homo sapiens
gctggccccgagtgctacgctc

SEQ ID NO: 7357551 - DNA, 22 bp, Homo sapiens
gctggcccagtgacccacagtg

SEQ ID NO: 7357552 - DNA, 22 bp, Homo sapiens
gctggcccagggtcacctagga

SEQ ID NO: 7357553 - DNA, 22 bp, Homo sapiens
gctggcccagtgacccacagtg

SEQ ID NO: 7357554 - DNA, 22 bp, Homo sapiens
gctggcccagtgacccacagtg

SEQ ID NO: 7357555 - DNA, 22 bp, Homo sapiens
gctggccccgagtgctacgctc

SEQ ID NO: 7357556 - DNA, 22 bp, Homo sapiens
gctgctctggctctgcagtgtc

SEQ ID NO: 7357557 - DNA, 22 bp, Homo sapiens
gctgctctacccatgcatctgt

SEQ ID NO: 7357558 - DNA, 21 bp, Homo sapiens
gctgctcgagatccagtgctt

SEQ ID NO: 7357559 - DNA, 22 bp, Homo sapiens
gctgctctgttaattgctgtaa

SEQ ID NO: 7357560 - DNA, 22 bp, Homo sapiens
gctgctgcaagagccagctctt

SEQ ID NO: 7357561 - DNA, 21 bp, Homo sapiens
gctgctgcccctagtgaggcc

SEQ ID NO: 7357562 - DNA, 21 bp, Homo sapiens
gctgctgcccctagtgaggcc

SEQ ID NO: 7357563 - DNA, 22 bp, Homo sapiens
gctgctgctggtctggggccac

SEQ ID NO: 7357564 - DNA, 19 bp, Homo sapiens
gctgctgctcctccctcgc

SEQ ID NO: 7357565 - DNA, 22 bp, Homo sapiens
gctgctgccgcggccgctggga

SEQ ID NO: 7357566 - DNA, 22 bp, Homo sapiens
gctgctgcctgtagccagggtg

SEQ ID NO: 7357567 - DNA, 22 bp, Homo sapiens
gctgctgcctgtagccagggtg

SEQ ID NO: 7357568 - DNA, 22 bp, Homo sapiens
gctgctgctggtctggggccac

SEQ ID NO: 7357569 - DNA, 21 bp, Homo sapiens
gctggagagccaggcaggggc

SEQ ID NO: 7357570 - DNA, 22 bp, Homo sapiens
gctgcctggagctcagcctgcc

SEQ ID NO: 7357571 - DNA, 22 bp, Homo sapiens
gctgagctagaaaaggaccaca

SEQ ID NO: 7357572 - DNA, 22 bp, Homo sapiens
gctgagccacaggcagtgcact

SEQ ID NO: 7357573 - DNA, 22 bp, Homo sapiens
gctgagccatgaggcctcttgc

SEQ ID NO: 7357574 - DNA, 22 bp, Homo sapiens
gctgagcaggtgtaaggaaggc

SEQ ID NO: 7357575 - DNA, 22 bp, Homo sapiens
gctcctgggtgtggctgcccct

SEQ ID NO: 7357576 - DNA, 22 bp, Homo sapiens
gctcctgggtgtggctgcccct

SEQ ID NO: 7357577 - DNA, 22 bp, Homo sapiens
gctcctggtctggagcttcaag

SEQ ID NO: 7357578 - DNA, 22 bp, Homo sapiens
gctcctgggtgtggctgcccct

SEQ ID NO: 7357579 - DNA, 22 bp, Homo sapiens
gctcctgggtgtggctgcccct

SEQ ID NO: 7357580 - DNA, 19 bp, Homo sapiens
gctcctgggcctcactcat

SEQ ID NO: 7357581 - DNA, 22 bp, Homo sapiens
gctcctgggctctaccttgcta

SEQ ID NO: 7357582 - DNA, 22 bp, Homo sapiens
gctcctgggccctgggctaact

SEQ ID NO: 7357583 - DNA, 22 bp, Homo sapiens
gctcctggcttcactgacatca

SEQ ID NO: 7357584 - DNA, 16 bp, Homo sapiens
gctcctgggccctcga

SEQ ID NO: 7357585 - DNA, 22 bp, Homo sapiens
gctcctggcttcactgacatca

SEQ ID NO: 7357586 - DNA, 22 bp, Homo sapiens
gctcctggctctctgagggctg

SEQ ID NO: 7357587 - DNA, 22 bp, Homo sapiens
gctcctggctctggccaaggga

SEQ ID NO: 7357588 - DNA, 22 bp, Homo sapiens
gctctgccaaggacccattctc

SEQ ID NO: 7357589 - DNA, 18 bp, Homo sapiens
gctctgcagctgaggctt

SEQ ID NO: 7357590 - DNA, 22 bp, Homo sapiens
gctctgccaacagtttgggcaa

SEQ ID NO: 7357591 - DNA, 22 bp, Homo sapiens
gctctgccaacagtttgggcaa

SEQ ID NO: 7357592 - DNA, 23 bp, Homo sapiens
gctctgaggaagttgggcacggg

SEQ ID NO: 7357593 - DNA, 18 bp, Homo sapiens
gctgaaattctaaacaaa

SEQ ID NO: 7357594 - DNA, 22 bp, Homo sapiens
gctgaaatgccttgtaaatatt

SEQ ID NO: 7357595 - DNA, 22 bp, Homo sapiens
gctgagcacagcaaagagacaa

SEQ ID NO: 7357596 - DNA, 22 bp, Homo sapiens
gctgagcagggtggggaaaggc

SEQ ID NO: 7357597 - DNA, 22 bp, Homo sapiens
gctgagcacacctagggtagag

SEQ ID NO: 7357598 - DNA, 22 bp, Homo sapiens
gctgagcacacctagggtagag

SEQ ID NO: 7357599 - DNA, 22 bp, Homo sapiens
gctgagagtgggtgcagtgctt

SEQ ID NO: 7357600 - DNA, 22 bp, Homo sapiens
gctctgtgttttgcccaggaga

SEQ ID NO: 7357601 - DNA, 22 bp, Homo sapiens
gctctgtgttgtcagaggcacc

SEQ ID NO: 7357602 - DNA, 22 bp, Homo sapiens
gctctgtgttcctctggattgc

SEQ ID NO: 7357603 - DNA, 22 bp, Homo sapiens
gctctgtgttccctccaggctc

SEQ ID NO: 7357604 - DNA, 22 bp, Homo sapiens
gctctgtgtccacagctggaaa

SEQ ID NO: 7357605 - DNA, 22 bp, Homo sapiens
gctctgtgtccacagctggaaa

SEQ ID NO: 7357606 - DNA, 21 bp, Homo sapiens
gctctgtgttacaagttgggg

SEQ ID NO: 7357607 - DNA, 22 bp, Homo sapiens
gctctgcccaaagctgtggctg

SEQ ID NO: 7357608 - DNA, 22 bp, Homo sapiens
gctctgcccaatgtccctacac

SEQ ID NO: 7357609 - DNA, 22 bp, Homo sapiens
gctctgccagacactgtggcca

SEQ ID NO: 7357610 - DNA, 22 bp, Homo sapiens
gctctgccagcccaaggcgcag

SEQ ID NO: 7357611 - DNA, 22 bp, Homo sapiens
gcctgtttaagtattctgacat

SEQ ID NO: 7357612 - DNA, 22 bp, Homo sapiens
gcctgtttccctgacgcttaca

SEQ ID NO: 7357613 - DNA, 22 bp, Homo sapiens
gcctgtttctcctccttggccc

SEQ ID NO: 7357614 - DNA, 22 bp, Homo sapiens
gcctgtttctaatctcatttct

SEQ ID NO: 7357615 - DNA, 22 bp, Homo sapiens
gcctgtttgactggtctctgct

SEQ ID NO: 7357616 - DNA, 22 bp, Homo sapiens
gcctgtttggcatcattggttg

SEQ ID NO: 7357617 - DNA, 22 bp, Homo sapiens
gcctgtttggaatctgtttaat

SEQ ID NO: 7357618 - DNA, 22 bp, Homo sapiens
gcctgtttggctgctgacattg

SEQ ID NO: 7357619 - DNA, 22 bp, Homo sapiens
gcctgtttgttatgtcatggta

SEQ ID NO: 7357620 - DNA, 22 bp, Homo sapiens
gcctgttttcctgctgtggttg

SEQ ID NO: 7357621 - DNA, 22 bp, Homo sapiens
gcctgttttagatgcattgatg

SEQ ID NO: 7357622 - DNA, 22 bp, Homo sapiens
gctcagagcatcccagtgaatg

SEQ ID NO: 7357623 - DNA, 22 bp, Homo sapiens
gctcagagcccgaggcttgcat

SEQ ID NO: 7357624 - DNA, 20 bp, Homo sapiens
gctcagagcctgaacttcat

SEQ ID NO: 7357625 - DNA, 22 bp, Homo sapiens
gctcagagcagatggtactcag

SEQ ID NO: 7357626 - DNA, 22 bp, Homo sapiens
gctcagagcatcccagtgaatg

SEQ ID NO: 7357627 - DNA, 22 bp, Homo sapiens
gctcagaccccaccctggcaga

SEQ ID NO: 7357628 - DNA, 22 bp, Homo sapiens
gctcagaaatggcagatggaga

SEQ ID NO: 7357629 - DNA, 22 bp, Homo sapiens
gctcagagatgttcagtagctt

SEQ ID NO: 7357630 - DNA, 22 bp, Homo sapiens
gctcagagatgtctgctgcctt

SEQ ID NO: 7357631 - DNA, 22 bp, Homo sapiens
gctcagagatgtctgctgcctt

SEQ ID NO: 7357632 - DNA, 22 bp, Homo sapiens
gctcagagatggggaatgaaaa

SEQ ID NO: 7357633 - DNA, 22 bp, Homo sapiens
gctcctggctccaggcagccaa

SEQ ID NO: 7357634 - DNA, 22 bp, Homo sapiens
gctcctggctccaggcagccaa

SEQ ID NO: 7357635 - DNA, 22 bp, Homo sapiens
gctcctggccagcacagggccc

SEQ ID NO: 7357636 - DNA, 22 bp, Homo sapiens
gctcctggccagcacagggccc

SEQ ID NO: 7357637 - DNA, 22 bp, Homo sapiens
gctcctggcaggcagtgtgtgt

SEQ ID NO: 7357638 - DNA, 22 bp, Homo sapiens
gctcctggcatcctgcttttaa

SEQ ID NO: 7357639 - DNA, 22 bp, Homo sapiens
gctcctggctctctgagggctg

SEQ ID NO: 7357640 - DNA, 22 bp, Homo sapiens
gctcctggctccaggcagccaa

SEQ ID NO: 7357641 - DNA, 22 bp, Homo sapiens
gctcctggctctctgagggctg

SEQ ID NO: 7357642 - DNA, 22 bp, Homo sapiens
gctcctggcaggcagtgtgtgt

SEQ ID NO: 7357643 - DNA, 22 bp, Homo sapiens
gctcctctgtcaaatgagagtg

SEQ ID NO: 7357644 - DNA, 22 bp, Homo sapiens
gctcctctcccagagctgcagg

SEQ ID NO: 7357645 - DNA, 22 bp, Homo sapiens
gctcctctcctcggagtcgggg

SEQ ID NO: 7357646 - DNA, 22 bp, Homo sapiens
gctccaggagctcacagctcgc

SEQ ID NO: 7357647 - DNA, 22 bp, Homo sapiens
gctccactaggaatctgctctt

SEQ ID NO: 7357648 - DNA, 22 bp, Homo sapiens
gctccactaggaatctgctctt

SEQ ID NO: 7357649 - DNA, 22 bp, Homo sapiens
gctccaaggtatccaccagggt

SEQ ID NO: 7357650 - DNA, 22 bp, Homo sapiens
gctccaaggtatccaccagggt

SEQ ID NO: 7357651 - DNA, 18 bp, Homo sapiens
gctcatttggatgggctt

SEQ ID NO: 7357652 - DNA, 20 bp, Homo sapiens
gctccaagcccctttagagg

SEQ ID NO: 7357653 - DNA, 22 bp, Homo sapiens
gctccaagatcattttcccatt

SEQ ID NO: 7357654 - DNA, 22 bp, Homo sapiens
gctcatttcttctttccacaat

SEQ ID NO: 7357655 - DNA, 22 bp, Homo sapiens
gctccacttccttctgccctca

SEQ ID NO: 7357656 - DNA, 22 bp, Homo sapiens
gctccacttgattgttacagca

SEQ ID NO: 7357657 - DNA, 22 bp, Homo sapiens
gctccactgtcccatgggactt

SEQ ID NO: 7357658 - DNA, 22 bp, Homo sapiens
gctccactgcccctgggcaccg

SEQ ID NO: 7357659 - DNA, 22 bp, Homo sapiens
gctccactgtttattggcagaa

SEQ ID NO: 7357660 - DNA, 22 bp, Homo sapiens
gctccacttgcagctaggcttg

SEQ ID NO: 7357661 - DNA, 21 bp, Homo sapiens
gctccagaactctatgctaac

SEQ ID NO: 7357662 - DNA, 22 bp, Homo sapiens
gctccaggagagggaagcagat

SEQ ID NO: 7357663 - DNA, 22 bp, Homo sapiens
gctccagctcgtggctcccagc

SEQ ID NO: 7357664 - DNA, 22 bp, Homo sapiens
gctccagctcgtggctcccagc

SEQ ID NO: 7357665 - DNA, 22 bp, Homo sapiens
gctccagctctgttctggggaa

SEQ ID NO: 7357666 - DNA, 22 bp, Homo sapiens
gctccaggaagggaaatctcca

SEQ ID NO: 7357667 - DNA, 22 bp, Homo sapiens
gctccagatgaatgcacttgtt

SEQ ID NO: 7357668 - DNA, 22 bp, Homo sapiens
gctccagcacctagagcaggtc

SEQ ID NO: 7357669 - DNA, 22 bp, Homo sapiens
gctccagccacatggtagaagg

SEQ ID NO: 7357670 - DNA, 22 bp, Homo sapiens
gctccagatgaaaggccagagg

SEQ ID NO: 7357671 - DNA, 22 bp, Homo sapiens
gctccagagtgtggcatctggg

SEQ ID NO: 7357672 - DNA, 22 bp, Homo sapiens
gcagtgggagcttaggcagtgc

SEQ ID NO: 7357673 - DNA, 22 bp, Homo sapiens
gcagtagcagtatccagaagca

SEQ ID NO: 7357674 - DNA, 18 bp, Homo sapiens
gcagtaggcgcgcaggac

SEQ ID NO: 7357675 - DNA, 22 bp, Homo sapiens
gcagtgttatgttttctataat

SEQ ID NO: 7357676 - DNA, 22 bp, Homo sapiens
gcagtgttaggaataaaaatga

SEQ ID NO: 7357677 - DNA, 22 bp, Homo sapiens
gcagtgttccttctactggggc

SEQ ID NO: 7357678 - DNA, 22 bp, Homo sapiens
gcagtgttcagtgaagcaggag

SEQ ID NO: 7357679 - DNA, 22 bp, Homo sapiens
gcagtgttgagccagctggggg

SEQ ID NO: 7357680 - DNA, 22 bp, Homo sapiens
gcagtgttgactatggtatgag

SEQ ID NO: 7357681 - DNA, 22 bp, Homo sapiens
gcagtgttcttgttgcttttat

SEQ ID NO: 7357682 - DNA, 22 bp, Homo sapiens
gcagtgttctaaattgggtgtg

SEQ ID NO: 7357683 - DNA, 22 bp, Homo sapiens
gcagtgtccagggtggtctgca

SEQ ID NO: 7357684 - DNA, 22 bp, Homo sapiens
gcagtgtcagtgcctgggtggt

SEQ ID NO: 7357685 - DNA, 19 bp, Homo sapiens
gcagtgtcatggtaggagc

SEQ ID NO: 7357686 - DNA, 22 bp, Homo sapiens
gcagtgggcaacaagagctgga

SEQ ID NO: 7357687 - DNA, 22 bp, Homo sapiens
gcagtgggcaacaagagctgga

SEQ ID NO: 7357688 - DNA, 22 bp, Homo sapiens
gcagtggggaatgctggggaga

SEQ ID NO: 7357689 - DNA, 22 bp, Homo sapiens
gcagtgggcctgaggaagggtg

SEQ ID NO: 7357690 - DNA, 22 bp, Homo sapiens
gcagtgggcctgaggaagggtg

SEQ ID NO: 7357691 - DNA, 22 bp, Homo sapiens
gcagtgggcctgaggaagggtg

SEQ ID NO: 7357692 - DNA, 22 bp, Homo sapiens
gcagtggggaatgctggggaga

SEQ ID NO: 7357693 - DNA, 22 bp, Homo sapiens
gcagtggggaatgctggggaga

SEQ ID NO: 7357694 - DNA, 22 bp, Homo sapiens
gcaggtggtgggggagccgttc

SEQ ID NO: 7357695 - DNA, 22 bp, Homo sapiens
gcaggtggttaaggtcccatgt

SEQ ID NO: 7357696 - DNA, 22 bp, Homo sapiens
gcaggtggtcactcatccccag

SEQ ID NO: 7357697 - DNA, 22 bp, Homo sapiens
gcaggtggtggcgcgcgccctg

SEQ ID NO: 7357698 - DNA, 22 bp, Homo sapiens
gcaggtggggctgctaccagaa

SEQ ID NO: 7357699 - DNA, 22 bp, Homo sapiens
gcaggtgggagccgctgcctga

SEQ ID NO: 7357700 - DNA, 19 bp, Homo sapiens
gcagggtggcagagctctt

SEQ ID NO: 7357701 - DNA, 22 bp, Homo sapiens
gcagggtggatggcagggccag

SEQ ID NO: 7357702 - DNA, 22 bp, Homo sapiens
gcagggtgccgacttcagggat

SEQ ID NO: 7357703 - DNA, 22 bp, Homo sapiens
gcagggtggatggcagggccag

SEQ ID NO: 7357704 - DNA, 22 bp, Homo sapiens
gcagggtgatagtgaggctcag

SEQ ID NO: 7357705 - DNA, 22 bp, Homo sapiens
gcagggtgacgttgcccacctc

SEQ ID NO: 7357706 - DNA, 22 bp, Homo sapiens
gcagggtgacgttgcccacctc

SEQ ID NO: 7357707 - DNA, 22 bp, Homo sapiens
gcagggtgatagtgaggctcag

SEQ ID NO: 7357708 - DNA, 22 bp, Homo sapiens
gcagggtgccgacttcagggat

SEQ ID NO: 7357709 - DNA, 22 bp, Homo sapiens
gcaggtggcagaggtgggatct

SEQ ID NO: 7357710 - DNA, 22 bp, Homo sapiens
gccacagacagagagtctagtg

SEQ ID NO: 7357711 - DNA, 22 bp, Homo sapiens
gccacagcccgagcaccatgag

SEQ ID NO: 7357712 - DNA, 22 bp, Homo sapiens
gccacagcccgagcaccatgag

SEQ ID NO: 7357713 - DNA, 22 bp, Homo sapiens
gcatgggctttctcagagttct

SEQ ID NO: 7357714 - DNA, 22 bp, Homo sapiens
gcatggtggagtctgagcaggg

SEQ ID NO: 7357715 - DNA, 22 bp, Homo sapiens
gcatggtggccttagggtagcc

SEQ ID NO: 7357716 - DNA, 22 bp, Homo sapiens
gcatgggcaagaggactggggg

SEQ ID NO: 7357717 - DNA, 22 bp, Homo sapiens
gcatgggaggacagtctgggct

SEQ ID NO: 7357718 - DNA, 22 bp, Homo sapiens
gcagtgttgagtggtggctgaa

SEQ ID NO: 7357719 - DNA, 22 bp, Homo sapiens
gcatggcttctgccaggcacct

SEQ ID NO: 7357720 - DNA, 22 bp, Homo sapiens
gcagtgttgctaggtgcggtga

SEQ ID NO: 7357721 - DNA, 22 bp, Homo sapiens
gcatgtggcccaaggaggctgt

SEQ ID NO: 7357722 - DNA, 22 bp, Homo sapiens
gcatgtggccttcaggctggaa

SEQ ID NO: 7357723 - DNA, 22 bp, Homo sapiens
gccagcagccacagaagtcact

SEQ ID NO: 7357724 - DNA, 19 bp, Homo sapiens
gccagcacccagctgtgtc

SEQ ID NO: 7357725 - DNA, 20 bp, Homo sapiens
gccagcacagggagcagttc

SEQ ID NO: 7357726 - DNA, 22 bp, Homo sapiens
gccacaggctccagcatcagta

SEQ ID NO: 7357727 - DNA, 22 bp, Homo sapiens
gccagatgtagatagcaaggta

SEQ ID NO: 7357728 - DNA, 20 bp, Homo sapiens
gccagaggccggcaggggct

SEQ ID NO: 7357729 - DNA, 22 bp, Homo sapiens
gccagaggctcaggttgccatg

SEQ ID NO: 7357730 - DNA, 20 bp, Homo sapiens
gccagaggccggcaggggct

SEQ ID NO: 7357731 - DNA, 22 bp, Homo sapiens
gcaggcaccgggttgctcccct

SEQ ID NO: 7357732 - DNA, 22 bp, Homo sapiens
gcaggcacctcgtggagtggaa

SEQ ID NO: 7357733 - DNA, 22 bp, Homo sapiens
gcaggcaccgcggcggcaggtt

SEQ ID NO: 7357734 - DNA, 22 bp, Homo sapiens
gcaggcaccacggctcaggtct

SEQ ID NO: 7357735 - DNA, 22 bp, Homo sapiens
gcaggcacatgggcgggtctgg

SEQ ID NO: 7357736 - DNA, 19 bp, Homo sapiens
gcaggcacagccctgggtg

SEQ ID NO: 7357737 - DNA, 19 bp, Homo sapiens
gcaggcacagccctgggtg

SEQ ID NO: 7357738 - DNA, 22 bp, Homo sapiens
gcaggagctgctctcctgacga

SEQ ID NO: 7357739 - DNA, 22 bp, Homo sapiens
gcaggagctcgtttccaggctg

SEQ ID NO: 7357740 - DNA, 22 bp, Homo sapiens
gcaggagccacttcagggatgc

SEQ ID NO: 7357741 - DNA, 22 bp, Homo sapiens
gcaggagccacttcagggatgc

SEQ ID NO: 7357742 - DNA, 22 bp, Homo sapiens
gcaggagccaggccgagctggt

SEQ ID NO: 7357743 - DNA, 22 bp, Homo sapiens
gcaggagccaggccgagctggt

SEQ ID NO: 7357744 - DNA, 22 bp, Homo sapiens
gcaggacagcaggatgcttaga

SEQ ID NO: 7357745 - DNA, 22 bp, Homo sapiens
gcaggacaggcgttggtccagt

SEQ ID NO: 7357746 - DNA, 22 bp, Homo sapiens
gcaggacctctggatgcaatgc

SEQ ID NO: 7357747 - DNA, 22 bp, Homo sapiens
gcaggacctctggatgcaatgc

SEQ ID NO: 7357748 - DNA, 22 bp, Homo sapiens
gcaggaccaggcacgagggcca

SEQ ID NO: 7357749 - DNA, 22 bp, Homo sapiens
gcaggacctggcagatggggca

SEQ ID NO: 7357750 - DNA, 22 bp, Homo sapiens
gcaggagacaactgtaaggaga

SEQ ID NO: 7357751 - DNA, 22 bp, Homo sapiens
gcagctcccatcagggcacaga

SEQ ID NO: 7357752 - DNA, 22 bp, Homo sapiens
gcagctcctcctgggctggaga

SEQ ID NO: 7357753 - DNA, 22 bp, Homo sapiens
gcagagcggtgatcaggcgcag

SEQ ID NO: 7357754 - DNA, 22 bp, Homo sapiens
gcagagctcaaggtgttcagct

SEQ ID NO: 7357755 - DNA, 22 bp, Homo sapiens
gcagagctcatgcctgcacctc

SEQ ID NO: 7357756 - DNA, 22 bp, Homo sapiens
gcagcctctgcagttcaggagg

SEQ ID NO: 7357757 - DNA, 22 bp, Homo sapiens
gcagagcctgacgggatttttc

SEQ ID NO: 7357758 - DNA, 22 bp, Homo sapiens
gcaggcactcctaggaccatca

SEQ ID NO: 7357759 - DNA, 21 bp, Homo sapiens
gcaggcactctagaggagctg

SEQ ID NO: 7357760 - DNA, 17 bp, Homo sapiens
gcaggcactgctgcctg

SEQ ID NO: 7357761 - DNA, 21 bp, Homo sapiens
gcaggcactctagaggagctg

SEQ ID NO: 7357762 - DNA, 21 bp, Homo sapiens
gcaggcactctagaggagctg

SEQ ID NO: 7357763 - DNA, 22 bp, Homo sapiens
gcaggcagagaggggtttccag

SEQ ID NO: 7357764 - DNA, 22 bp, Homo sapiens
gcaggcagagaggggtttccag

SEQ ID NO: 7357765 - DNA, 22 bp, Homo sapiens
gcaggctgccctcttgtgttga

SEQ ID NO: 7357766 - DNA, 22 bp, Homo sapiens
gcaggctggaggctgttctggg

SEQ ID NO: 7357767 - DNA, 22 bp, Homo sapiens
gcaggctgctgagatccttagg

SEQ ID NO: 7357768 - DNA, 22 bp, Homo sapiens
gcaggctggtctgaccatccct

SEQ ID NO: 7357769 - DNA, 22 bp, Homo sapiens
gcaggctggggtagccccactt

SEQ ID NO: 7357770 - DNA, 22 bp, Homo sapiens
gcaggctggggtagccccactt

SEQ ID NO: 7357771 - DNA, 21 bp, Homo sapiens
gcaggctggtcaaacctcagt

SEQ ID NO: 7357772 - DNA, 22 bp, Homo sapiens
gcagggaaacaggtgctaagga

SEQ ID NO: 7357773 - DNA, 22 bp, Homo sapiens
gcagggacctgccactgctgtc

SEQ ID NO: 7357774 - DNA, 22 bp, Homo sapiens
gcagggacgccagggacagcaa

SEQ ID NO: 7357775 - DNA, 22 bp, Homo sapiens
gcagggcaaacccaggtgttca

SEQ ID NO: 7357776 - DNA, 22 bp, Homo sapiens
gcagggcaaatgtggaaaggag

SEQ ID NO: 7357777 - DNA, 20 bp, Homo sapiens
gcagggcaagggatatgaaa

SEQ ID NO: 7357778 - DNA, 22 bp, Homo sapiens
gcagggcacagacagtgccaag

SEQ ID NO: 7357779 - DNA, 22 bp, Homo sapiens
gcagggcagacctccagcctat

SEQ ID NO: 7357780 - DNA, 22 bp, Homo sapiens
gcagggcagagggagaatctct

SEQ ID NO: 7357781 - DNA, 22 bp, Homo sapiens
gcagggcagacctccagcctat

SEQ ID NO: 7357782 - DNA, 22 bp, Homo sapiens
gcaggggctgctgggaactcgg

SEQ ID NO: 7357783 - DNA, 22 bp, Homo sapiens
gcaggggctactctgagcttcc

SEQ ID NO: 7357784 - DNA, 22 bp, Homo sapiens
gcaggggctgagcaccagcggg

SEQ ID NO: 7357785 - DNA, 21 bp, Homo sapiens
gcaggggatagaaatggtctg

SEQ ID NO: 7357786 - DNA, 22 bp, Homo sapiens
gcaggggcaggagatctcaggc

SEQ ID NO: 7357787 - DNA, 22 bp, Homo sapiens
gcaggggcaggagatctcaggc

SEQ ID NO: 7357788 - DNA, 22 bp, Homo sapiens
gcaggggcggctgggtttccag

SEQ ID NO: 7357789 - DNA, 22 bp, Homo sapiens
gcaggggcggctgggtttccag

SEQ ID NO: 7357790 - DNA, 22 bp, Homo sapiens
gcaggggctactctgagcttcc

SEQ ID NO: 7357791 - DNA, 22 bp, Homo sapiens
gcaggggctactctgagcttcc

SEQ ID NO: 7357792 - DNA, 22 bp, Homo sapiens
gcaggggctaaggacacagaga

SEQ ID NO: 7357793 - DNA, 22 bp, Homo sapiens
gcaggggcggctgggtttccag

SEQ ID NO: 7357794 - DNA, 22 bp, Homo sapiens
gatttataaaggttgcactgga

SEQ ID NO: 7357795 - DNA, 22 bp, Homo sapiens
gatttatagtatgtgctttcag

SEQ ID NO: 7357796 - DNA, 21 bp, Homo sapiens
gatttataagccttaagccta

SEQ ID NO: 7357797 - DNA, 22 bp, Homo sapiens
gatttattggtctttcattggt

SEQ ID NO: 7357798 - DNA, 22 bp, Homo sapiens
gatttcaaaagtagatccatca

SEQ ID NO: 7357799 - DNA, 22 bp, Homo sapiens
gatttcaacctaacagtatgac

SEQ ID NO: 7357800 - DNA, 20 bp, Homo sapiens
gatttcaaagcagagtggcc

SEQ ID NO: 7357801 - DNA, 22 bp, Homo sapiens
gatttcaaaggttctgcatgcc

SEQ ID NO: 7357802 - DNA, 22 bp, Homo sapiens
gattgagtctgaggatgctgca

SEQ ID NO: 7357803 - DNA, 22 bp, Homo sapiens
gatttacagatctaagggtcac

SEQ ID NO: 7357804 - DNA, 22 bp, Homo sapiens
gatttacaaagctctctagtgt

SEQ ID NO: 7357805 - DNA, 22 bp, Homo sapiens
gattgtgtctcactgtgatgct

SEQ ID NO: 7357806 - DNA, 22 bp, Homo sapiens
gattgttgcctggctttgacct

SEQ ID NO: 7357807 - DNA, 22 bp, Homo sapiens
gattgtctgtgatcatgagcaa

SEQ ID NO: 7357808 - DNA, 22 bp, Homo sapiens
gattattttgtgcaataatcgg

SEQ ID NO: 7357809 - DNA, 22 bp, Homo sapiens
gattatgttcgactttagaaat

SEQ ID NO: 7357810 - DNA, 22 bp, Homo sapiens
gattaagtaactgaacactttg

SEQ ID NO: 7357811 - DNA, 22 bp, Homo sapiens
gatgtttcatgctagcatgtgt

SEQ ID NO: 7357812 - DNA, 22 bp, Homo sapiens
gatgtttcccacactgtttccc

SEQ ID NO: 7357813 - DNA, 22 bp, Homo sapiens
gatgttttctggaaaatgaatg

SEQ ID NO: 7357814 - DNA, 22 bp, Homo sapiens
gatgtgtgtttatacatatatt

SEQ ID NO: 7357815 - DNA, 22 bp, Homo sapiens
gatgttaaaggttggtaagtca

SEQ ID NO: 7357816 - DNA, 17 bp, Homo sapiens
gatggggctgacatcag

SEQ ID NO: 7357817 - DNA, 22 bp, Homo sapiens
gatgggggccagggcctgcttt

SEQ ID NO: 7357818 - DNA, 22 bp, Homo sapiens
gatggggatgagaagtgagcag

SEQ ID NO: 7357819 - DNA, 22 bp, Homo sapiens
gatggtttatgatagatgggaa

SEQ ID NO: 7357820 - DNA, 22 bp, Homo sapiens
gatggtttggaatgaagtagct

SEQ ID NO: 7357821 - DNA, 22 bp, Homo sapiens
gatggtttggtaaaagtatgtt

SEQ ID NO: 7357822 - DNA, 22 bp, Homo sapiens
gatggtgcaggtgaagtgctgg

SEQ ID NO: 7357823 - DNA, 22 bp, Homo sapiens
gatgtgtgctgcatagtatatt

SEQ ID NO: 7357824 - DNA, 22 bp, Homo sapiens
gatgtgtgctgcatagtatatt

SEQ ID NO: 7357825 - DNA, 22 bp, Homo sapiens
gatgtctgtgagatcaaactaa

SEQ ID NO: 7357826 - DNA, 22 bp, Homo sapiens
gatgtctgccaaagaatcaagc

SEQ ID NO: 7357827 - DNA, 22 bp, Homo sapiens
gatggctaggggactggagtta

SEQ ID NO: 7357828 - DNA, 18 bp, Homo sapiens
gatgggagcaagagaaga

SEQ ID NO: 7357829 - DNA, 22 bp, Homo sapiens
gatgggcgtggcgcgtttggtg

SEQ ID NO: 7357830 - DNA, 22 bp, Homo sapiens
gatggctttgcctgctgtgagg

SEQ ID NO: 7357831 - DNA, 22 bp, Homo sapiens
gatggcttgcttagtgacagca

SEQ ID NO: 7357832 - DNA, 20 bp, Homo sapiens
gatggctttagaagctggta

SEQ ID NO: 7357833 - DNA, 22 bp, Homo sapiens
gatggcttaagagtaaaaggca

SEQ ID NO: 7357834 - DNA, 22 bp, Homo sapiens
gatgcgggcccgctccactgcc

SEQ ID NO: 7357835 - DNA, 20 bp, Homo sapiens
gatgcgcagccctggagggc

SEQ ID NO: 7357836 - DNA, 22 bp, Homo sapiens
gatgccctgcatgagtcctgct

SEQ ID NO: 7357837 - DNA, 22 bp, Homo sapiens
gatgcctgtggtgagcacacat

SEQ ID NO: 7357838 - DNA, 22 bp, Homo sapiens
gatgcctggcacccagcaagga

SEQ ID NO: 7357839 - DNA, 22 bp, Homo sapiens
gcaatgatattgaagtgatgaa

SEQ ID NO: 7357840 - DNA, 20 bp, Homo sapiens
gcaattaatttttggttaca

SEQ ID NO: 7357841 - DNA, 20 bp, Homo sapiens
gcaatgttggttcctgtcac

SEQ ID NO: 7357842 - DNA, 22 bp, Homo sapiens
gcaatgttgtgttggcattcta

SEQ ID NO: 7357843 - DNA, 22 bp, Homo sapiens
gcaatgtttttccttccatatt

SEQ ID NO: 7357844 - DNA, 22 bp, Homo sapiens
gcaatgttaagatcacacctgg

SEQ ID NO: 7357845 - DNA, 22 bp, Homo sapiens
gcaatgtgcacgcccttgggga

SEQ ID NO: 7357846 - DNA, 22 bp, Homo sapiens
gcaatgtctgcaatgggtgtgg

SEQ ID NO: 7357847 - DNA, 22 bp, Homo sapiens
gcaatgtctgtgctaaaaactg

SEQ ID NO: 7357848 - DNA, 22 bp, Homo sapiens
gcaatgtctagtctgagggctt

SEQ ID NO: 7357849 - DNA, 22 bp, Homo sapiens
gcaattgctttagggaaaggta

SEQ ID NO: 7357850 - DNA, 22 bp, Homo sapiens
gcaattgtactagaaaacaata

SEQ ID NO: 7357851 - DNA, 22 bp, Homo sapiens
gcacaaaacacattttgacaat

SEQ ID NO: 7357852 - DNA, 22 bp, Homo sapiens
gcacaaaaggtacttcatgtag

SEQ ID NO: 7357853 - DNA, 22 bp, Homo sapiens
gcacaaagatgaatacagaatg

SEQ ID NO: 7357854 - DNA, 22 bp, Homo sapiens
gcaaacattcaggagtacagga

SEQ ID NO: 7357855 - DNA, 22 bp, Homo sapiens
gcaaacatgttgtgagatacca

SEQ ID NO: 7357856 - DNA, 22 bp, Homo sapiens
gcaaacatgctgagaaataaga

SEQ ID NO: 7357857 - DNA, 22 bp, Homo sapiens
gcaaacatcttagccatagagt

SEQ ID NO: 7357858 - DNA, 22 bp, Homo sapiens
gcaatataaccagttgtcatgc

SEQ ID NO: 7357859 - DNA, 22 bp, Homo sapiens
gcaatagattatgatctacagt

SEQ ID NO: 7357860 - DNA, 22 bp, Homo sapiens
gcaaaaaatgcttgttgcttag

SEQ ID NO: 7357861 - DNA, 22 bp, Homo sapiens
gcaaacataatatgaagacact

SEQ ID NO: 7357862 - DNA, 22 bp, Homo sapiens
gattttgtcaaattccaaatgt

SEQ ID NO: 7357863 - DNA, 22 bp, Homo sapiens
gatttcacctgatcttgtcatc

SEQ ID NO: 7357864 - DNA, 22 bp, Homo sapiens
gatttcacccacttcccagtgt

SEQ ID NO: 7357865 - DNA, 22 bp, Homo sapiens
gatttcaagtatcttgggcgag

SEQ ID NO: 7357866 - DNA, 22 bp, Homo sapiens
gatttcaatccagctttcttct

SEQ ID NO: 7357867 - DNA, 22 bp, Homo sapiens
gatttcaagcccccagagattc

SEQ ID NO: 7357868 - DNA, 22 bp, Homo sapiens
gatttcaaggagttttcacagt

SEQ ID NO: 7357869 - DNA, 22 bp, Homo sapiens
gatttcaaggatgttagaggtg

SEQ ID NO: 7357870 - DNA, 21 bp, Homo sapiens
gattttaaagagactgccaca

SEQ ID NO: 7357871 - DNA, 22 bp, Homo sapiens
gattttaattataggaggtcct

SEQ ID NO: 7357872 - DNA, 22 bp, Homo sapiens
gattttatagtcaggaaaaaga

SEQ ID NO: 7357873 - DNA, 22 bp, Homo sapiens
gattttcatgataaacttgtga

SEQ ID NO: 7357874 - DNA, 22 bp, Homo sapiens
gcagaaggatccgcaggtgcaa

SEQ ID NO: 7357875 - DNA, 22 bp, Homo sapiens
gcagagccatgggaggtttttg

SEQ ID NO: 7357876 - DNA, 22 bp, Homo sapiens
gcagaagcacaggtgacgggcc

SEQ ID NO: 7357877 - DNA, 22 bp, Homo sapiens
gcagaacatttcacagtatctt

SEQ ID NO: 7357878 - DNA, 22 bp, Homo sapiens
gcagaagctgggcagcgaggtg

SEQ ID NO: 7357879 - DNA, 22 bp, Homo sapiens
gcagaagcagggcaggggcaaa

SEQ ID NO: 7357880 - DNA, 22 bp, Homo sapiens
gcagaacaacgtaggagtggag

SEQ ID NO: 7357881 - DNA, 22 bp, Homo sapiens
gcagaaatatgatgcataaagg

SEQ ID NO: 7357882 - DNA, 22 bp, Homo sapiens
gcagaaaccacagtgtctttta

SEQ ID NO: 7357883 - DNA, 23 bp, Homo sapiens
gcacttttataggtggggaaaca

SEQ ID NO: 7357884 - DNA, 17 bp, Homo sapiens
gcagaaaagtcaaggga

SEQ ID NO: 7357885 - DNA, 22 bp, Homo sapiens
gcacccctgcgtgccttccctt

SEQ ID NO: 7357886 - DNA, 19 bp, Homo sapiens
gcaccctgaggtcatggcc

SEQ ID NO: 7357887 - DNA, 22 bp, Homo sapiens
gcaccctgctctatccttgcta

SEQ ID NO: 7357888 - DNA, 22 bp, Homo sapiens
gcaccctgctctatccttgcta

SEQ ID NO: 7357889 - DNA, 22 bp, Homo sapiens
gcaccctgagtgttcagctcca

SEQ ID NO: 7357890 - DNA, 22 bp, Homo sapiens
gcaccctgagtgttcagctcca

SEQ ID NO: 7357891 - DNA, 19 bp, Homo sapiens
gcaccctggccactcccac

SEQ ID NO: 7357892 - DNA, 22 bp, Homo sapiens
gcaccctggctctctggaatgg

SEQ ID NO: 7357893 - DNA, 22 bp, Homo sapiens
gcaccctgtcaaaatggaccaa

SEQ ID NO: 7357894 - DNA, 22 bp, Homo sapiens
gcaccctgtttatcctgagttc

SEQ ID NO: 7357895 - DNA, 22 bp, Homo sapiens
gcacctgcaggatgagccaggg

SEQ ID NO: 7357896 - DNA, 22 bp, Homo sapiens
gcacctgagcaactatacattg

SEQ ID NO: 7357897 - DNA, 22 bp, Homo sapiens
gcaccgccttggaccgcccgct

SEQ ID NO: 7357898 - DNA, 20 bp, Homo sapiens
gcacttggctgctgcttctc

SEQ ID NO: 7357899 - DNA, 22 bp, Homo sapiens
gcacacactgttttcctcacat

SEQ ID NO: 7357900 - DNA, 16 bp, Homo sapiens
gcacacacatcaatga

SEQ ID NO: 7357901 - DNA, 22 bp, Homo sapiens
gcacccatgctcttgtctcagg

SEQ ID NO: 7357902 - DNA, 22 bp, Homo sapiens
gagtcctggagaaacgcaggtg

SEQ ID NO: 7357903 - DNA, 22 bp, Homo sapiens
gagtgagtggccaggaggcaga

SEQ ID NO: 7357904 - DNA, 22 bp, Homo sapiens
gagtgagtgctgggctgaggct

SEQ ID NO: 7357905 - DNA, 22 bp, Homo sapiens
gagtgagggcagcaggggctgc

SEQ ID NO: 7357906 - DNA, 22 bp, Homo sapiens
gagtgagggcagcaggggctgc

SEQ ID NO: 7357907 - DNA, 22 bp, Homo sapiens
gagtgagggcagcaggggctgc

SEQ ID NO: 7357908 - DNA, 22 bp, Homo sapiens
gagtctggtcattttctctccc

SEQ ID NO: 7357909 - DNA, 22 bp, Homo sapiens
gagtgaaaaaggaagggccata

SEQ ID NO: 7357910 - DNA, 22 bp, Homo sapiens
gagtgctgcttgggatagtgag

SEQ ID NO: 7357911 - DNA, 22 bp, Homo sapiens
gagtgctggaggtgtgagtggg

SEQ ID NO: 7357912 - DNA, 22 bp, Homo sapiens
gagtgctgtaggactgagccct

SEQ ID NO: 7357913 - DNA, 17 bp, Homo sapiens
gagtgctggtggagctc

SEQ ID NO: 7357914 - DNA, 22 bp, Homo sapiens
gagtgcagtatgagaggctgct

SEQ ID NO: 7357915 - DNA, 22 bp, Homo sapiens
gagtgcagttggggtgagggga

SEQ ID NO: 7357916 - DNA, 22 bp, Homo sapiens
gagtgcagttggggtgagggga

SEQ ID NO: 7357917 - DNA, 22 bp, Homo sapiens
gagtgctcgggtgtcccgcggg

SEQ ID NO: 7357918 - DNA, 22 bp, Homo sapiens
gagtgctcgggcctctgcctgc

SEQ ID NO: 7357919 - DNA, 22 bp, Homo sapiens
gagtgctccgtcttggacaggg

SEQ ID NO: 7357920 - DNA, 22 bp, Homo sapiens
gagtgctcctggatggatttcc

SEQ ID NO: 7357921 - DNA, 21 bp, Homo sapiens
gagtgggacatgggagtggtt

SEQ ID NO: 7357922 - DNA, 22 bp, Homo sapiens
gagtggagcaaaagaggtagat

SEQ ID NO: 7357923 - DNA, 21 bp, Homo sapiens
gagtggaacgctcttcacacc

SEQ ID NO: 7357924 - DNA, 22 bp, Homo sapiens
gataaagtagatttgttctaga

SEQ ID NO: 7357925 - DNA, 22 bp, Homo sapiens
gataacattttgaagtgctagt

SEQ ID NO: 7357926 - DNA, 22 bp, Homo sapiens
gataaacactgatgatatgggg

SEQ ID NO: 7357927 - DNA, 22 bp, Homo sapiens
gataaacacaaggtgatttcat

SEQ ID NO: 7357928 - DNA, 22 bp, Homo sapiens
gataaaataactatggaatact

SEQ ID NO: 7357929 - DNA, 23 bp, Homo sapiens
gagtttcttccaggagccctggg

SEQ ID NO: 7357930 - DNA, 22 bp, Homo sapiens
gagtgtggtgaacaggagcacc

SEQ ID NO: 7357931 - DNA, 22 bp, Homo sapiens
gagtgtggtgaacaggagcacc

SEQ ID NO: 7357932 - DNA, 22 bp, Homo sapiens
gagtgtgtgcatgatctcttat

SEQ ID NO: 7357933 - DNA, 22 bp, Homo sapiens
gagtgttcccacaccccagttg

SEQ ID NO: 7357934 - DNA, 23 bp, Homo sapiens
gagtgttcatagcaggctcttgc

SEQ ID NO: 7357935 - DNA, 22 bp, Homo sapiens
gagtgttccagaaactggccct

SEQ ID NO: 7357936 - DNA, 22 bp, Homo sapiens
gagtgtgttctttatgctgtga

SEQ ID NO: 7357937 - DNA, 22 bp, Homo sapiens
gagtgtgttctttatgctgtga

SEQ ID NO: 7357938 - DNA, 22 bp, Homo sapiens
gagtggggtctgggcatcagtc

SEQ ID NO: 7357939 - DNA, 22 bp, Homo sapiens
gagtggggggtccgtctcagtg

SEQ ID NO: 7357940 - DNA, 22 bp, Homo sapiens
gagtggtaggcagtgttaggaa

SEQ ID NO: 7357941 - DNA, 22 bp, Homo sapiens
gatgaagtcagttagtgggaaa

SEQ ID NO: 7357942 - DNA, 22 bp, Homo sapiens
gatgaaatttgggcaggttaaa

SEQ ID NO: 7357943 - DNA, 22 bp, Homo sapiens
gatgacaaaacttttgccagca

SEQ ID NO: 7357944 - DNA, 22 bp, Homo sapiens
gatgaaggggctggtgccctct

SEQ ID NO: 7357945 - DNA, 22 bp, Homo sapiens
gatgaattctggcttggacaga

SEQ ID NO: 7357946 - DNA, 22 bp, Homo sapiens
gatgagctgtgtgtgagggtca

SEQ ID NO: 7357947 - DNA, 22 bp, Homo sapiens
gatgatgggttgatgtgaaggg

SEQ ID NO: 7357948 - DNA, 22 bp, Homo sapiens
gatgacttatgtttacaaatgt

SEQ ID NO: 7357949 - DNA, 22 bp, Homo sapiens
gatgcaggtgtgccacagagct

SEQ ID NO: 7357950 - DNA, 22 bp, Homo sapiens
gatgcagggggaacgacgccct

SEQ ID NO: 7357951 - DNA, 22 bp, Homo sapiens
gatgcagggctggcaggagctt

SEQ ID NO: 7357952 - DNA, 22 bp, Homo sapiens
gatgcagggctggcaggagctt

SEQ ID NO: 7357953 - DNA, 22 bp, Homo sapiens
gatgcacagagggcctggaact

SEQ ID NO: 7357954 - DNA, 21 bp, Homo sapiens
gatgcacaatgggtaagtaca

SEQ ID NO: 7357955 - DNA, 22 bp, Homo sapiens
gatgcacaaagcagagggaatc

SEQ ID NO: 7357956 - DNA, 22 bp, Homo sapiens
gatgcacatgtgagtatagaag

SEQ ID NO: 7357957 - DNA, 22 bp, Homo sapiens
gatgcacattgaacaatcacaa

SEQ ID NO: 7357958 - DNA, 22 bp, Homo sapiens
gatgcacagccatgttaatgtg

SEQ ID NO: 7357959 - DNA, 22 bp, Homo sapiens
gatgcacaggtgagcaggtgca

SEQ ID NO: 7357960 - DNA, 22 bp, Homo sapiens
gatgcacagtgaccctgccagt

SEQ ID NO: 7357961 - DNA, 22 bp, Homo sapiens
gatgattttatgtcttgtcatt

SEQ ID NO: 7357962 - DNA, 22 bp, Homo sapiens
gatgatttgaggatttcatgag

SEQ ID NO: 7357963 - DNA, 22 bp, Homo sapiens
gatgattacacttttaaaacag

SEQ ID NO: 7357964 - DNA, 20 bp, Homo sapiens
gatgattatctgaagccctt

SEQ ID NO: 7357965 - DNA, 22 bp, Homo sapiens
gatgcaaagaggaccttcagta

SEQ ID NO: 7357966 - DNA, 22 bp, Homo sapiens
gatgcaaaccttacatggacct

SEQ ID NO: 7357967 - DNA, 22 bp, Homo sapiens
gatgaaaaattgctgtgtcata

SEQ ID NO: 7357968 - DNA, 22 bp, Homo sapiens
gatgaaaaattgctgtgtcata

SEQ ID NO: 7357969 - DNA, 22 bp, Homo sapiens
gatccacagtttgatgatcata

SEQ ID NO: 7357970 - DNA, 22 bp, Homo sapiens
gatccacagggccctggcccag

SEQ ID NO: 7357971 - DNA, 22 bp, Homo sapiens
gatccacagctgcggtaggaga

SEQ ID NO: 7357972 - DNA, 22 bp, Homo sapiens
gatccacagcccgcttgggccc

SEQ ID NO: 7357973 - DNA, 22 bp, Homo sapiens
gatccacaggaaccaaaacgca

SEQ ID NO: 7357974 - DNA, 22 bp, Homo sapiens
gatctgtttcaattgtcttagt

SEQ ID NO: 7357975 - DNA, 22 bp, Homo sapiens
gatctttactactgccttctct

SEQ ID NO: 7357976 - DNA, 22 bp, Homo sapiens
gatctttaaggcttaccctgga

SEQ ID NO: 7357977 - DNA, 22 bp, Homo sapiens
gatactgtgtcattctcacatg

SEQ ID NO: 7357978 - DNA, 22 bp, Homo sapiens
gatactgtaggtgaaagtgttt

SEQ ID NO: 7357979 - DNA, 22 bp, Homo sapiens
gatactcttcaggtcttgcaga

SEQ ID NO: 7357980 - DNA, 22 bp, Homo sapiens
gataccagacagggagggagaa

SEQ ID NO: 7357981 - DNA, 22 bp, Homo sapiens
gatatacagagcattctttgat

SEQ ID NO: 7357982 - DNA, 22 bp, Homo sapiens
gatatacaatccacagttgatt

SEQ ID NO: 7357983 - DNA, 22 bp, Homo sapiens
gatagtattacaggaaatcata

SEQ ID NO: 7357984 - DNA, 22 bp, Homo sapiens
gatacagtgtgttaacgagaaa

SEQ ID NO: 7357985 - DNA, 22 bp, Homo sapiens
gatacacattttagctttgtct

SEQ ID NO: 7357986 - DNA, 22 bp, Homo sapiens
gatacacattttagctttgtct

SEQ ID NO: 7357987 - DNA, 22 bp, Homo sapiens
gatacagtatttaaagagcaac

SEQ ID NO: 7357988 - DNA, 21 bp, Homo sapiens
gatacagagggccactgattg

SEQ ID NO: 7357989 - DNA, 22 bp, Homo sapiens
gataatatctggtttattcacc

SEQ ID NO: 7357990 - DNA, 22 bp, Homo sapiens
gataactacacttaagacaacc

SEQ ID NO: 7357991 - DNA, 22 bp, Homo sapiens
gataaggactttggggtctaca

SEQ ID NO: 7357992 - DNA, 22 bp, Homo sapiens
gatacacagggctaagatggat

SEQ ID NO: 7357993 - DNA, 20 bp, Homo sapiens
gatacacagcttcactgttg

SEQ ID NO: 7357994 - DNA, 22 bp, Homo sapiens
gatacacatgcatgtgcatgta

SEQ ID NO: 7357995 - DNA, 15 bp, Homo sapiens
gatacacatgactgg

SEQ ID NO: 7357996 - DNA, 20 bp, Homo sapiens
gatacacagcacagagggcc

SEQ ID NO: 7357997 - DNA, 22 bp, Homo sapiens
gatacacacccttgataggact

SEQ ID NO: 7357998 - DNA, 22 bp, Homo sapiens
gatacacaagtggaaggagacg

SEQ ID NO: 7357999 - DNA, 22 bp, Homo sapiens
gatcagtttaatcttcaggggt

SEQ ID NO: 7358000 - DNA, 22 bp, Homo sapiens
gatcatcaagcaagaacctgat

SEQ ID NO: 7358001 - DNA, 22 bp, Homo sapiens
gatcatcatctttcaggcaagt

SEQ ID NO: 7358002 - DNA, 22 bp, Homo sapiens
gatcacataatttggaaacagc

SEQ ID NO: 7358003 - DNA, 22 bp, Homo sapiens
gatcaattcaaactattttcct

SEQ ID NO: 7358004 - DNA, 22 bp, Homo sapiens
gatatacataggtttctatgca

SEQ ID NO: 7358005 - DNA, 22 bp, Homo sapiens
gatatatgtaaaagtagacaga

SEQ ID NO: 7358006 - DNA, 22 bp, Homo sapiens
gatatttacattaagcacattg

SEQ ID NO: 7358007 - DNA, 22 bp, Homo sapiens
gatatttacattaagcacattg

SEQ ID NO: 7358008 - DNA, 21 bp, Homo sapiens
gatatttatgactcattcctt

SEQ ID NO: 7358009 - DNA, 22 bp, Homo sapiens
gatatttattaagtggttggta

SEQ ID NO: 7358010 - DNA, 22 bp, Homo sapiens
gatattttgagaaatcctatga

SEQ ID NO: 7358011 - DNA, 22 bp, Homo sapiens
gagtcaggctagggtgacaggc

SEQ ID NO: 7358012 - DNA, 22 bp, Homo sapiens
gagtcaggctagaggtgagtct

SEQ ID NO: 7358013 - DNA, 19 bp, Homo sapiens
gaggtgggtccccgcagcc

SEQ ID NO: 7358014 - DNA, 22 bp, Homo sapiens
gaggtggggttttgttcttgaa

SEQ ID NO: 7358015 - DNA, 22 bp, Homo sapiens
gaggtgggtgtatcacaggtca

SEQ ID NO: 7358016 - DNA, 20 bp, Homo sapiens
gagtcacagaagaagctgaa

SEQ ID NO: 7358017 - DNA, 22 bp, Homo sapiens
gaggtaggtgtaggaggcctgc

SEQ ID NO: 7358018 - DNA, 22 bp, Homo sapiens
gaggtaggtgtaggaggcctgc

SEQ ID NO: 7358019 - DNA, 22 bp, Homo sapiens
gaggggcagttgattgtgctat

SEQ ID NO: 7358020 - DNA, 22 bp, Homo sapiens
gaggggccggcatgtgcctctc

SEQ ID NO: 7358021 - DNA, 22 bp, Homo sapiens
gaggggcctggcactgagctgg

SEQ ID NO: 7358022 - DNA, 22 bp, Homo sapiens
gaggggcctggcactgagctgg

SEQ ID NO: 7358023 - DNA, 22 bp, Homo sapiens
gaggggcctggcgaggacatgt

SEQ ID NO: 7358024 - DNA, 22 bp, Homo sapiens
gaggggcgctgtcgggtcacct

SEQ ID NO: 7358025 - DNA, 22 bp, Homo sapiens
gaggggcgtcctgagtgggcct

SEQ ID NO: 7358026 - DNA, 22 bp, Homo sapiens
gaggggcgtcctgagtgggcct

SEQ ID NO: 7358027 - DNA, 22 bp, Homo sapiens
gaggtgggcggatcacaaggtc

SEQ ID NO: 7358028 - DNA, 22 bp, Homo sapiens
gaggtgggatgtgtgtgctact

SEQ ID NO: 7358029 - DNA, 22 bp, Homo sapiens
gaggtgggagggcagtccctaa

SEQ ID NO: 7358030 - DNA, 22 bp, Homo sapiens
gaggggcacagcagctgttgca

SEQ ID NO: 7358031 - DNA, 22 bp, Homo sapiens
gaggggcacagtaaagggtccc

SEQ ID NO: 7358032 - DNA, 22 bp, Homo sapiens
gaggggcagaatgtgatcaggg

SEQ ID NO: 7358033 - DNA, 22 bp, Homo sapiens
gaggggcacagtaaagggtccc

SEQ ID NO: 7358034 - DNA, 22 bp, Homo sapiens
gaggggcagaatgtgatcaggg

SEQ ID NO: 7358035 - DNA, 22 bp, Homo sapiens
gaggggcagaggtagagaacaa

SEQ ID NO: 7358036 - DNA, 22 bp, Homo sapiens
gaggggcagaatgtgatcaggg

SEQ ID NO: 7358037 - DNA, 22 bp, Homo sapiens
gaggggcagaatgtgatcaggg

SEQ ID NO: 7358038 - DNA, 22 bp, Homo sapiens
gaggggcagaatgtgatcaggg

SEQ ID NO: 7358039 - DNA, 22 bp, Homo sapiens
gaggggcagaggtagagaacaa

SEQ ID NO: 7358040 - DNA, 21 bp, Homo sapiens
gaggggcagctcttagcatta

SEQ ID NO: 7358041 - DNA, 22 bp, Homo sapiens
gaggggcagtgcacccgggccc

SEQ ID NO: 7358042 - DNA, 22 bp, Homo sapiens
gaggggcagtgcacccgggccc

SEQ ID NO: 7358043 - DNA, 22 bp, Homo sapiens
gaggggagtgtcctccgggccc

SEQ ID NO: 7358044 - DNA, 22 bp, Homo sapiens
gaggggagtgtcctccgggccc

SEQ ID NO: 7358045 - DNA, 22 bp, Homo sapiens
gaggggcaagaagttggcctct

SEQ ID NO: 7358046 - DNA, 22 bp, Homo sapiens
gaggggcaatgagggaaagagt

SEQ ID NO: 7358047 - DNA, 22 bp, Homo sapiens
gaggggcacagcagctgttgca

SEQ ID NO: 7358048 - DNA, 22 bp, Homo sapiens
gagggccaactagcaccacttt

SEQ ID NO: 7358049 - DNA, 22 bp, Homo sapiens
gagggccaatggatttcaactg

SEQ ID NO: 7358050 - DNA, 22 bp, Homo sapiens
gagggccaatgtgtccctgagc

SEQ ID NO: 7358051 - DNA, 22 bp, Homo sapiens
gaggggaaagtgtgaggctgcg

SEQ ID NO: 7358052 - DNA, 22 bp, Homo sapiens
gagggcagtgaattttgaagct

SEQ ID NO: 7358053 - DNA, 22 bp, Homo sapiens
gagggcatagttaaataggagg

SEQ ID NO: 7358054 - DNA, 22 bp, Homo sapiens
gagggcatctagagcctaatcc

SEQ ID NO: 7358055 - DNA, 22 bp, Homo sapiens
gagggcagtgaattttgaagct

SEQ ID NO: 7358056 - DNA, 22 bp, Homo sapiens
gagggccaactagcaccacttt

SEQ ID NO: 7358057 - DNA, 22 bp, Homo sapiens
gagggccaaagagcaagagcct

SEQ ID NO: 7358058 - DNA, 20 bp, Homo sapiens
gagggcaggcacccatttca

SEQ ID NO: 7358059 - DNA, 22 bp, Homo sapiens
gagggcaggggtcttgcacggt

SEQ ID NO: 7358060 - DNA, 22 bp, Homo sapiens
gagggcagagtctaatgatgca

SEQ ID NO: 7358061 - DNA, 22 bp, Homo sapiens
gagggcagtagcctcgtaccct

SEQ ID NO: 7358062 - DNA, 22 bp, Homo sapiens
gagggcagtagcctcgtaccct

SEQ ID NO: 7358063 - DNA, 22 bp, Homo sapiens
gagggcaggggtcttgcacggt

SEQ ID NO: 7358064 - DNA, 22 bp, Homo sapiens
gagggcaggggtcttgcacggt

SEQ ID NO: 7358065 - DNA, 22 bp, Homo sapiens
gaggctggaggtcaaagatgaa

SEQ ID NO: 7358066 - DNA, 22 bp, Homo sapiens
gaggctggcagaaaagcacagg

SEQ ID NO: 7358067 - DNA, 22 bp, Homo sapiens
gaggcctgaggctgcctggagc

SEQ ID NO: 7358068 - DNA, 22 bp, Homo sapiens
gaggctggacgtgcatttctac

SEQ ID NO: 7358069 - DNA, 22 bp, Homo sapiens
gaggctgcccacacctgcgccg

SEQ ID NO: 7358070 - DNA, 22 bp, Homo sapiens
gaggctgcccacacctgcgccg

SEQ ID NO: 7358071 - DNA, 22 bp, Homo sapiens
gaggctgcccaactggagtgga

SEQ ID NO: 7358072 - DNA, 16 bp, Homo sapiens
gagggcagaggcggaa

SEQ ID NO: 7358073 - DNA, 16 bp, Homo sapiens
gagggcagaggcggaa

SEQ ID NO: 7358074 - DNA, 16 bp, Homo sapiens
gagggcagaggcggaa

SEQ ID NO: 7358075 - DNA, 22 bp, Homo sapiens
gagggcagagacagtgattcac

SEQ ID NO: 7358076 - DNA, 22 bp, Homo sapiens
gagggcagagacagtgattcac

SEQ ID NO: 7358077 - DNA, 22 bp, Homo sapiens
gagggatgcagaaacagaggcc

SEQ ID NO: 7358078 - DNA, 22 bp, Homo sapiens
gaggctgggggctgccttcctc

SEQ ID NO: 7358079 - DNA, 22 bp, Homo sapiens
gaggctgggaagtccaagatca

SEQ ID NO: 7358080 - DNA, 22 bp, Homo sapiens
gaggctgggaagtccaagacca

SEQ ID NO: 7358081 - DNA, 22 bp, Homo sapiens
gaggctgggaagtccaagacca

SEQ ID NO: 7358082 - DNA, 22 bp, Homo sapiens
gaggcagctgaaggagtgacag

SEQ ID NO: 7358083 - DNA, 22 bp, Homo sapiens
gaggcccagcagcgcaggtctt

SEQ ID NO: 7358084 - DNA, 22 bp, Homo sapiens
gaggcagcaggctgaggaggat

SEQ ID NO: 7358085 - DNA, 22 bp, Homo sapiens
gaggcagcgggtcaggaccgtg

SEQ ID NO: 7358086 - DNA, 22 bp, Homo sapiens
gaggcagcaggctgaggaggat

SEQ ID NO: 7358087 - DNA, 22 bp, Homo sapiens
gaggccctgaagacagctgggg

SEQ ID NO: 7358088 - DNA, 22 bp, Homo sapiens
gaggaggtctcctccgcagggg

SEQ ID NO: 7358089 - DNA, 22 bp, Homo sapiens
gaggcagaggttgcagtgagct

SEQ ID NO: 7358090 - DNA, 22 bp, Homo sapiens
gaggagggttggccttaggtag

SEQ ID NO: 7358091 - DNA, 22 bp, Homo sapiens
gaggaggcttccgggaggcacg

SEQ ID NO: 7358092 - DNA, 22 bp, Homo sapiens
gaggagggagaattaggcttaa

SEQ ID NO: 7358093 - DNA, 23 bp, Homo sapiens
gaggagggtctgacaagtgtagc

SEQ ID NO: 7358094 - DNA, 22 bp, Homo sapiens
gaggaggctgaacaatgccctg

SEQ ID NO: 7358095 - DNA, 22 bp, Homo sapiens
gaggaggctggcgccgcctgcc

SEQ ID NO: 7358096 - DNA, 22 bp, Homo sapiens
gaggacagcttagggcttcctg

SEQ ID NO: 7358097 - DNA, 22 bp, Homo sapiens
gaggacagcttagggcttcctg

SEQ ID NO: 7358098 - DNA, 22 bp, Homo sapiens
gaggacagctctaactaaagtc

SEQ ID NO: 7358099 - DNA, 22 bp, Homo sapiens
gaggacacggccttttggaaaa

SEQ ID NO: 7358100 - DNA, 22 bp, Homo sapiens
gaggacacctcacagcctcaca

SEQ ID NO: 7358101 - DNA, 22 bp, Homo sapiens
gaggacacatgactccagcagg

SEQ ID NO: 7358102 - DNA, 22 bp, Homo sapiens
gaggacagagccgcctggcaag

SEQ ID NO: 7358103 - DNA, 22 bp, Homo sapiens
gaggacagagccgcctggcaag

SEQ ID NO: 7358104 - DNA, 22 bp, Homo sapiens
gaggacacaaagtggctgagat

SEQ ID NO: 7358105 - DNA, 23 bp, Homo sapiens
gaggacacagcccagacagccgt

SEQ ID NO: 7358106 - DNA, 22 bp, Homo sapiens
gaggaagggctgcctgccgggc

SEQ ID NO: 7358107 - DNA, 22 bp, Homo sapiens
gaggaagggctgcctgccgggc

SEQ ID NO: 7358108 - DNA, 22 bp, Homo sapiens
gaggaaggtcccatcagaattt

SEQ ID NO: 7358109 - DNA, 22 bp, Homo sapiens
gaggaagggctgcctgccgggc

SEQ ID NO: 7358110 - DNA, 22 bp, Homo sapiens
gagctgggagttatagcatgtt

SEQ ID NO: 7358111 - DNA, 23 bp, Homo sapiens
gagctgggatacaggcttactgc

SEQ ID NO: 7358112 - DNA, 22 bp, Homo sapiens
gagctgggacatgggtcctctc

SEQ ID NO: 7358113 - DNA, 22 bp, Homo sapiens
gagatccataagtgatagaaat

SEQ ID NO: 7358114 - DNA, 22 bp, Homo sapiens
gagctggaggaccaggactggg

SEQ ID NO: 7358115 - DNA, 22 bp, Homo sapiens
gagctggccgcagagagggcag

SEQ ID NO: 7358116 - DNA, 22 bp, Homo sapiens
gagagtgtcgggggccccagga

SEQ ID NO: 7358117 - DNA, 17 bp, Homo sapiens
gagagtgtattggatgc

SEQ ID NO: 7358118 - DNA, 22 bp, Homo sapiens
gagagtggatggagctgcgaag

SEQ ID NO: 7358119 - DNA, 22 bp, Homo sapiens
gagagtgattccctcccataga

SEQ ID NO: 7358120 - DNA, 22 bp, Homo sapiens
gagagtgaggcctgggaatcta

SEQ ID NO: 7358121 - DNA, 22 bp, Homo sapiens
gagagtgatgaatggttaaaca

SEQ ID NO: 7358122 - DNA, 22 bp, Homo sapiens
gagagtgcgattcattcattta

SEQ ID NO: 7358123 - DNA, 20 bp, Homo sapiens
gagagtgcttttcattgctc

SEQ ID NO: 7358124 - DNA, 22 bp, Homo sapiens
gagagtgaggcatcaggggcag

SEQ ID NO: 7358125 - DNA, 22 bp, Homo sapiens
gagagtgagataatttcacata

SEQ ID NO: 7358126 - DNA, 22 bp, Homo sapiens
gagagtgagatcctcctgggga

SEQ ID NO: 7358127 - DNA, 22 bp, Homo sapiens
gagagtctagtgcacctagttt

SEQ ID NO: 7358128 - DNA, 22 bp, Homo sapiens
gagagtgaaggcttcccagcaa

SEQ ID NO: 7358129 - DNA, 22 bp, Homo sapiens
gagagtctagtgcacctagttt

SEQ ID NO: 7358130 - DNA, 22 bp, Homo sapiens
cttgaaagatttggcctctgtg

SEQ ID NO: 7358131 - DNA, 22 bp, Homo sapiens
cttgaaagctttgcgtcttcta

SEQ ID NO: 7358132 - DNA, 21 bp, Homo sapiens
cttgaaaggtagagtctacag

SEQ ID NO: 7358133 - DNA, 22 bp, Homo sapiens
cttgaaagtcacatgcagccct

SEQ ID NO: 7358134 - DNA, 22 bp, Homo sapiens
cttgaaatccagatttcagagg

SEQ ID NO: 7358135 - DNA, 22 bp, Homo sapiens
cttctctggcatagcaagcagg

SEQ ID NO: 7358136 - DNA, 22 bp, Homo sapiens
cttctctgcccataggaaatgc

SEQ ID NO: 7358137 - DNA, 17 bp, Homo sapiens
cttctctggcagaagat

SEQ ID NO: 7358138 - DNA, 23 bp, Homo sapiens
cttctctgagctaggaatgctct

SEQ ID NO: 7358139 - DNA, 22 bp, Homo sapiens
cttcttgaagtcctccagaagt

SEQ ID NO: 7358140 - DNA, 22 bp, Homo sapiens
cttctcttgggtgtggtgtctt

SEQ ID NO: 7358141 - DNA, 22 bp, Homo sapiens
cttctctctgcataggcatggg

SEQ ID NO: 7358142 - DNA, 22 bp, Homo sapiens
cttctctacttcctggaagggg

SEQ ID NO: 7358143 - DNA, 22 bp, Homo sapiens
cttctcagttgcaagtgtcaga

SEQ ID NO: 7358144 - DNA, 22 bp, Homo sapiens
ctggctgtcttggaggaaggag

SEQ ID NO: 7358145 - DNA, 22 bp, Homo sapiens
ctttggcagacattaggggtga

SEQ ID NO: 7358146 - DNA, 20 bp, Homo sapiens
ctttatcaaagggctactag

SEQ ID NO: 7358147 - DNA, 22 bp, Homo sapiens
ctttgtcattttgtctctcagt

SEQ ID NO: 7358148 - DNA, 22 bp, Homo sapiens
ctttgtagtcaaactgatacat

SEQ ID NO: 7358149 - DNA, 22 bp, Homo sapiens
ctttgtagctgcttctgattta

SEQ ID NO: 7358150 - DNA, 22 bp, Homo sapiens
ctttggcagcctctgctattga

SEQ ID NO: 7358151 - DNA, 22 bp, Homo sapiens
ctttagatttctatgtatcact

SEQ ID NO: 7358152 - DNA, 22 bp, Homo sapiens
cttgggatgtaacctttgttcc

SEQ ID NO: 7358153 - DNA, 22 bp, Homo sapiens
cttgggccagcccagggggcat

SEQ ID NO: 7358154 - DNA, 22 bp, Homo sapiens
cttggcacgtgataggtgttga

SEQ ID NO: 7358155 - DNA, 22 bp, Homo sapiens
cttggcaccaccaagtggccat

SEQ ID NO: 7358156 - DNA, 22 bp, Homo sapiens
cttgaagttgcaaaacattaat

SEQ ID NO: 7358157 - DNA, 22 bp, Homo sapiens
cttgggaatgctaacagatgac

SEQ ID NO: 7358158 - DNA, 22 bp, Homo sapiens
cttggcttttgctcccagatca

SEQ ID NO: 7358159 - DNA, 22 bp, Homo sapiens
cttggctggaactcctgagaaa

SEQ ID NO: 7358160 - DNA, 22 bp, Homo sapiens
gaacgggtgcagccatgggccc

SEQ ID NO: 7358161 - DNA, 22 bp, Homo sapiens
gaactgagaaggactagcccat

SEQ ID NO: 7358162 - DNA, 22 bp, Homo sapiens
gaactgaagacttttactgtac

SEQ ID NO: 7358163 - DNA, 19 bp, Homo sapiens
gaacacttactatatttct

SEQ ID NO: 7358164 - DNA, 22 bp, Homo sapiens
gaacagaattaccgaagatctg

SEQ ID NO: 7358165 - DNA, 17 bp, Homo sapiens
gaacagcagaggggaca

SEQ ID NO: 7358166 - DNA, 22 bp, Homo sapiens
gaacagactttgccaattacag

SEQ ID NO: 7358167 - DNA, 22 bp, Homo sapiens
gaacccagccagactccctaca

SEQ ID NO: 7358168 - DNA, 23 bp, Homo sapiens
gaacccagctctgccacttgcca

SEQ ID NO: 7358169 - DNA, 22 bp, Homo sapiens
gaacccaggaggttgcagtgag

SEQ ID NO: 7358170 - DNA, 22 bp, Homo sapiens
gaacccaggaggttgcagtgag

SEQ ID NO: 7358171 - DNA, 22 bp, Homo sapiens
gaacccagtccaggtgcagcct

SEQ ID NO: 7358172 - DNA, 22 bp, Homo sapiens
gaacccagtccaggtgcagcct

SEQ ID NO: 7358173 - DNA, 22 bp, Homo sapiens
gaacccggggaggttgcagtga

SEQ ID NO: 7358174 - DNA, 22 bp, Homo sapiens
gaaatttacaactttctcatgg

SEQ ID NO: 7358175 - DNA, 22 bp, Homo sapiens
gaacacaactcagaatgctggt

SEQ ID NO: 7358176 - DNA, 22 bp, Homo sapiens
gaaatacaaatgcctagatcct

SEQ ID NO: 7358177 - DNA, 22 bp, Homo sapiens
gaaatacaaagccagccatttt

SEQ ID NO: 7358178 - DNA, 22 bp, Homo sapiens
gaaagtttcttcattaagatgt

SEQ ID NO: 7358179 - DNA, 21 bp, Homo sapiens
gaaaggtcttaacttacagag

SEQ ID NO: 7358180 - DNA, 17 bp, Homo sapiens
gaaaggtcctagaaatc

SEQ ID NO: 7358181 - DNA, 22 bp, Homo sapiens
gaaaggtcttccggtcttccag

SEQ ID NO: 7358182 - DNA, 22 bp, Homo sapiens
gaaaggggcatgtagggatcac

SEQ ID NO: 7358183 - DNA, 22 bp, Homo sapiens
gaaaggggcatgtagggatcac

SEQ ID NO: 7358184 - DNA, 22 bp, Homo sapiens
gaaaggtcagttccacttccat

SEQ ID NO: 7358185 - DNA, 22 bp, Homo sapiens
gaaagggataccatgttacttg

SEQ ID NO: 7358186 - DNA, 22 bp, Homo sapiens
gaaagggagtggacaacaggca

SEQ ID NO: 7358187 - DNA, 22 bp, Homo sapiens
gaaagtgccagaataggaggcc

SEQ ID NO: 7358188 - DNA, 18 bp, Homo sapiens
gaaagtgcggggcagggg

SEQ ID NO: 7358189 - DNA, 22 bp, Homo sapiens
gaaaagttcatcatatattcag

SEQ ID NO: 7358190 - DNA, 21 bp, Homo sapiens
gaaaatacaatgagcttgacc

SEQ ID NO: 7358191 - DNA, 21 bp, Homo sapiens
gaaaatacaatgagcttgacc

SEQ ID NO: 7358192 - DNA, 21 bp, Homo sapiens
gaaaatacaatgagcttgacc

SEQ ID NO: 7358193 - DNA, 22 bp, Homo sapiens
gaaaatacaaatagccttgaaa

SEQ ID NO: 7358194 - DNA, 22 bp, Homo sapiens
gaaaatacttcagtgttctggc

SEQ ID NO: 7358195 - DNA, 18 bp, Homo sapiens
gaaaatactctgggctca

SEQ ID NO: 7358196 - DNA, 22 bp, Homo sapiens
gaaagggagtgaagatggtata

SEQ ID NO: 7358197 - DNA, 22 bp, Homo sapiens
gaaagggagtgaagatggtata

SEQ ID NO: 7358198 - DNA, 22 bp, Homo sapiens
ctttgtgcgtagtgagtggtca

SEQ ID NO: 7358199 - DNA, 22 bp, Homo sapiens
ctttgtgctttgaatgatagct

SEQ ID NO: 7358200 - DNA, 22 bp, Homo sapiens
ctttgtgatagtgttaagacca

SEQ ID NO: 7358201 - DNA, 22 bp, Homo sapiens
ctttgttttactcagaggcatg

SEQ ID NO: 7358202 - DNA, 22 bp, Homo sapiens
cttttaagggataataagatgt

SEQ ID NO: 7358203 - DNA, 22 bp, Homo sapiens
cttttaatgagcattgctgtct

SEQ ID NO: 7358204 - DNA, 17 bp, Homo sapiens
cttttaatttacttccc

SEQ ID NO: 7358205 - DNA, 22 bp, Homo sapiens
gaaaagggcaagagagagggca

SEQ ID NO: 7358206 - DNA, 22 bp, Homo sapiens
gaaaacatccagagatagacct

SEQ ID NO: 7358207 - DNA, 22 bp, Homo sapiens
gaaaagcttactgccacttggc

SEQ ID NO: 7358208 - DNA, 22 bp, Homo sapiens
gaagtgatgacgctgtgttttt

SEQ ID NO: 7358209 - DNA, 22 bp, Homo sapiens
gaagtacaaaggacatggaaac

SEQ ID NO: 7358210 - DNA, 22 bp, Homo sapiens
gaagtggaagccatcggcagtc

SEQ ID NO: 7358211 - DNA, 22 bp, Homo sapiens
gaagtggaattactgggtcata

SEQ ID NO: 7358212 - DNA, 22 bp, Homo sapiens
gaagtgttttagttcttcaggt

SEQ ID NO: 7358213 - DNA, 22 bp, Homo sapiens
gaagtgtttaagtcttctttgt

SEQ ID NO: 7358214 - DNA, 22 bp, Homo sapiens
gaagtgtctccgtttttaaagg

SEQ ID NO: 7358215 - DNA, 22 bp, Homo sapiens
gaagtgttgtatctttttaata

SEQ ID NO: 7358216 - DNA, 22 bp, Homo sapiens
gaaggaagtcattagtgcagac

SEQ ID NO: 7358217 - DNA, 20 bp, Homo sapiens
gaaggaagggggcaaggtga

SEQ ID NO: 7358218 - DNA, 22 bp, Homo sapiens
gaaggaagtttattttagaaga

SEQ ID NO: 7358219 - DNA, 22 bp, Homo sapiens
gaaggacccacgaagtcactgg

SEQ ID NO: 7358220 - DNA, 22 bp, Homo sapiens
gaaggaagggctggctgtcttg

SEQ ID NO: 7358221 - DNA, 22 bp, Homo sapiens
gaaggaagccgtttctctccag

SEQ ID NO: 7358222 - DNA, 22 bp, Homo sapiens
gaaggaagctgtctggatgtgt

SEQ ID NO: 7358223 - DNA, 22 bp, Homo sapiens
gaactgttccctcacaggctgg

SEQ ID NO: 7358224 - DNA, 23 bp, Homo sapiens
gaactgttgatgaatagaatata

SEQ ID NO: 7358225 - DNA, 22 bp, Homo sapiens
gaactgtttttaagtcctaaga

SEQ ID NO: 7358226 - DNA, 22 bp, Homo sapiens
gaacttaacggcaactatttaa

SEQ ID NO: 7358227 - DNA, 22 bp, Homo sapiens
gaaggagagaaaggcaattctg

SEQ ID NO: 7358228 - DNA, 22 bp, Homo sapiens
gaaggagaccctgaagatgctg

SEQ ID NO: 7358229 - DNA, 22 bp, Homo sapiens
gaaggagaccctgaagatgctg

SEQ ID NO: 7358230 - DNA, 22 bp, Homo sapiens
gaaggagaccctgaagatgctg

SEQ ID NO: 7358231 - DNA, 21 bp, Homo sapiens
gaaggagaaagcaagtgctgc

SEQ ID NO: 7358232 - DNA, 22 bp, Homo sapiens
gaaggagagagacatcgtccct

SEQ ID NO: 7358233 - DNA, 19 bp, Homo sapiens
gaaggagagctgagttagg

SEQ ID NO: 7358234 - DNA, 19 bp, Homo sapiens
gaaggagagctgagttagg

SEQ ID NO: 7358235 - DNA, 22 bp, Homo sapiens
gaaggagagggtcaaggataat

SEQ ID NO: 7358236 - DNA, 22 bp, Homo sapiens
gaaggagagggtcaaggataat

SEQ ID NO: 7358237 - DNA, 22 bp, Homo sapiens
gaaggagagggtcaaggataat

SEQ ID NO: 7358238 - DNA, 22 bp, Homo sapiens
gaaggagaggattgtgaggctg

SEQ ID NO: 7358239 - DNA, 22 bp, Homo sapiens
gacaggacttcactgtgttgcc

SEQ ID NO: 7358240 - DNA, 21 bp, Homo sapiens
gacaggactagaccagagctc

SEQ ID NO: 7358241 - DNA, 19 bp, Homo sapiens
gacaggacgaagggaagtt

SEQ ID NO: 7358242 - DNA, 22 bp, Homo sapiens
gacaggaagtctgaaggaggga

SEQ ID NO: 7358243 - DNA, 19 bp, Homo sapiens
gacaggaaggctaccagta

SEQ ID NO: 7358244 - DNA, 22 bp, Homo sapiens
gacaggaacataaatgtaggag

SEQ ID NO: 7358245 - DNA, 22 bp, Homo sapiens
gacacagcttgatgagggcttt

SEQ ID NO: 7358246 - DNA, 22 bp, Homo sapiens
gacacagatgatcaggtgtgga

SEQ ID NO: 7358247 - DNA, 22 bp, Homo sapiens
gacacagcactgtacaaggaat

SEQ ID NO: 7358248 - DNA, 18 bp, Homo sapiens
gacacaggagagagtccc

SEQ ID NO: 7358249 - DNA, 22 bp, Homo sapiens
gacacaggattcctggctctgc

SEQ ID NO: 7358250 - DNA, 22 bp, Homo sapiens
gaattcattagggaagctatct

SEQ ID NO: 7358251 - DNA, 22 bp, Homo sapiens
gaattcagttatctaattcaag

SEQ ID NO: 7358252 - DNA, 22 bp, Homo sapiens
gaattcatcgtcttagctgcca

SEQ ID NO: 7358253 - DNA, 22 bp, Homo sapiens
gaattacatgaccctgagtaga

SEQ ID NO: 7358254 - DNA, 22 bp, Homo sapiens
gaattagacatgctttgctttt

SEQ ID NO: 7358255 - DNA, 22 bp, Homo sapiens
gaattcttttctttctgaaagt

SEQ ID NO: 7358256 - DNA, 22 bp, Homo sapiens
gaattctttaggtgaatttcta

SEQ ID NO: 7358257 - DNA, 22 bp, Homo sapiens
gaattctggtcctgtccaaggt

SEQ ID NO: 7358258 - DNA, 22 bp, Homo sapiens
gaattctaaccattaagccaag

SEQ ID NO: 7358259 - DNA, 22 bp, Homo sapiens
gagacacaagaagacatgcaca

SEQ ID NO: 7358260 - DNA, 22 bp, Homo sapiens
gagaaaatagcatgtgtagtat

SEQ ID NO: 7358261 - DNA, 22 bp, Homo sapiens
gagacacaagacgcaactctgt

SEQ ID NO: 7358262 - DNA, 22 bp, Homo sapiens
gagacacaatttccccatccta

SEQ ID NO: 7358263 - DNA, 22 bp, Homo sapiens
gagacacaatctcatttacatt

SEQ ID NO: 7358264 - DNA, 22 bp, Homo sapiens
gagacacaggcacagaagaggc

SEQ ID NO: 7358265 - DNA, 22 bp, Homo sapiens
gagacacagcagatattcaatc

SEQ ID NO: 7358266 - DNA, 22 bp, Homo sapiens
gagacacagttatcaggcatac

SEQ ID NO: 7358267 - DNA, 22 bp, Homo sapiens
gagagtctaggaacctcatata

SEQ ID NO: 7358268 - DNA, 22 bp, Homo sapiens
gagagctgggggactgtggatg

SEQ ID NO: 7358269 - DNA, 20 bp, Homo sapiens
gagagctggggatgaggctg

SEQ ID NO: 7358270 - DNA, 22 bp, Homo sapiens
gagagctgatagatgagctact

SEQ ID NO: 7358271 - DNA, 22 bp, Homo sapiens
gagagctgcagccgagaggggg

SEQ ID NO: 7358272 - DNA, 22 bp, Homo sapiens
gacaggaggcagagctcaggtg

SEQ ID NO: 7358273 - DNA, 22 bp, Homo sapiens
gacaggcagacctgtgccctgg

SEQ ID NO: 7358274 - DNA, 22 bp, Homo sapiens
gacccacctcaccaagcatgtg

SEQ ID NO: 7358275 - DNA, 22 bp, Homo sapiens
gacccaggaagctacttctggt

SEQ ID NO: 7358276 - DNA, 22 bp, Homo sapiens
gacccaggaagctacttctggt

SEQ ID NO: 7358277 - DNA, 22 bp, Homo sapiens
gacccaggcaatgaacttactt

SEQ ID NO: 7358278 - DNA, 22 bp, Homo sapiens
gacccaggggtccatttctcct

SEQ ID NO: 7358279 - DNA, 23 bp, Homo sapiens
gacttgtccctggcaattcatcc

SEQ ID NO: 7358280 - DNA, 22 bp, Homo sapiens
gacttaaaggctgaatgtagga

SEQ ID NO: 7358281 - DNA, 22 bp, Homo sapiens
gactgttagaatgtaaaatata

SEQ ID NO: 7358282 - DNA, 22 bp, Homo sapiens
gacttattcacgcagctatact

SEQ ID NO: 7358283 - DNA, 22 bp, Homo sapiens
gacccagggtttctgcacaggg

SEQ ID NO: 7358284 - DNA, 22 bp, Homo sapiens
gactggggtaaggtgaggaggt

SEQ ID NO: 7358285 - DNA, 22 bp, Homo sapiens
gactggggtaaggtgaggaggt

SEQ ID NO: 7358286 - DNA, 22 bp, Homo sapiens
gactgtgggaagactgtaggtt

SEQ ID NO: 7358287 - DNA, 22 bp, Homo sapiens
cctgggctttgctggcaaggcc

SEQ ID NO: 7358288 - DNA, 22 bp, Homo sapiens
cctgggccttgacctcgtgggc

SEQ ID NO: 7358289 - DNA, 22 bp, Homo sapiens
tgtgtgtccttgacctcagtgg

SEQ ID NO: 7358290 - DNA, 22 bp, Homo sapiens
tgtgtgtctgcacatgtataat

SEQ ID NO: 7358291 - DNA, 22 bp, Homo sapiens
tgtgtgtctgcacatgtataat

SEQ ID NO: 7358292 - DNA, 22 bp, Homo sapiens
cctgggcctcacccagctcttg

SEQ ID NO: 7358293 - DNA, 22 bp, Homo sapiens
cctgggcctctcaaagtgctgg

SEQ ID NO: 7358294 - DNA, 22 bp, Homo sapiens
tgtgtgtatccattagaggcca

SEQ ID NO: 7358295 - DNA, 22 bp, Homo sapiens
tgtgtgtatatgcatttatcta

SEQ ID NO: 7358296 - DNA, 22 bp, Homo sapiens
tgtgtgtatgtttacttttcct

SEQ ID NO: 7358297 - DNA, 21 bp, Homo sapiens
tgtgtgtatgcacacacatgc

SEQ ID NO: 7358298 - DNA, 19 bp, Homo sapiens
tgtgtgtatttcagttctt

SEQ ID NO: 7358299 - DNA, 22 bp, Homo sapiens
tgtgtgtcactgaaagaaatct

SEQ ID NO: 7358300 - DNA, 22 bp, Homo sapiens
tgtgtgtcagagtctccatggt

SEQ ID NO: 7358301 - DNA, 22 bp, Homo sapiens
tgtgtgtcagtcttgtttaggg

SEQ ID NO: 7358302 - DNA, 22 bp, Homo sapiens
tgtgtgtataataatgtctgca

SEQ ID NO: 7358303 - DNA, 22 bp, Homo sapiens
tgtgtgtatatgcatttatcta

SEQ ID NO: 7358304 - DNA, 22 bp, Homo sapiens
tgtgtgtactctccagtcctga

SEQ ID NO: 7358305 - DNA, 22 bp, Homo sapiens
tgtgtgtataataatgtctgca

SEQ ID NO: 7358306 - DNA, 22 bp, Homo sapiens
tgtgtgtataataatgtctgca

SEQ ID NO: 7358307 - DNA, 22 bp, Homo sapiens
tgtgtgtaaggaagctttatgg

SEQ ID NO: 7358308 - DNA, 22 bp, Homo sapiens
tgtgtgtaatgtttctctcttc

SEQ ID NO: 7358309 - DNA, 22 bp, Homo sapiens
tgtgtgggtggtaaggaaggcc

SEQ ID NO: 7358310 - DNA, 23 bp, Homo sapiens
tgtgttctcacacagatgcagta

SEQ ID NO: 7358311 - DNA, 22 bp, Homo sapiens
cctggggctcaagatggcgccg

SEQ ID NO: 7358312 - DNA, 22 bp, Homo sapiens
tgtgttcctgcctggctctggt

SEQ ID NO: 7358313 - DNA, 21 bp, Homo sapiens
cctgggccaaattccctggac

SEQ ID NO: 7358314 - DNA, 22 bp, Homo sapiens
cctgggccctcaccgccggtgg

SEQ ID NO: 7358315 - DNA, 19 bp, Homo sapiens
cctgggaggcggaggttgc

SEQ ID NO: 7358316 - DNA, 22 bp, Homo sapiens
cctgggaggcggaggttgcagg

SEQ ID NO: 7358317 - DNA, 22 bp, Homo sapiens
cctgggaggcggaggttgcagg

SEQ ID NO: 7358318 - DNA, 22 bp, Homo sapiens
cctgggaggcggaggttgcagt

SEQ ID NO: 7358319 - DNA, 22 bp, Homo sapiens
cctgggaggcggaggttgcagt

SEQ ID NO: 7358320 - DNA, 22 bp, Homo sapiens
tgtgtctgtcctcggttgatgc

SEQ ID NO: 7358321 - DNA, 21 bp, Homo sapiens
tgtgtgggcatatctgctgca

SEQ ID NO: 7358322 - DNA, 21 bp, Homo sapiens
tgtgtgggcatatctgctgca

SEQ ID NO: 7358323 - DNA, 19 bp, Homo sapiens
tgtggggagtcagggggct

SEQ ID NO: 7358324 - DNA, 20 bp, Homo sapiens
tgtggaaaaacagaagcaga

SEQ ID NO: 7358325 - DNA, 20 bp, Homo sapiens
tgtggaaaaacagaagcaga

SEQ ID NO: 7358326 - DNA, 22 bp, Homo sapiens
tgtgcttggggttgactagtgt

SEQ ID NO: 7358327 - DNA, 22 bp, Homo sapiens
tgtgctttggttttacaggatg

SEQ ID NO: 7358328 - DNA, 22 bp, Homo sapiens
tgtggcaggaagagcttctgag

SEQ ID NO: 7358329 - DNA, 22 bp, Homo sapiens
tgtggcagctggaggtggagaa

SEQ ID NO: 7358330 - DNA, 22 bp, Homo sapiens
tgtggcagctggaggtggagaa

SEQ ID NO: 7358331 - DNA, 22 bp, Homo sapiens
tgtggcagctgctgcaggagct

SEQ ID NO: 7358332 - DNA, 22 bp, Homo sapiens
tgtggcagggatactgaggcag

SEQ ID NO: 7358333 - DNA, 18 bp, Homo sapiens
tgtggcaggggtgggaga

SEQ ID NO: 7358334 - DNA, 22 bp, Homo sapiens
tgtggcaggcattctgaggctg

SEQ ID NO: 7358335 - DNA, 20 bp, Homo sapiens
tgtggcaggatgagggcgga

SEQ ID NO: 7358336 - DNA, 20 bp, Homo sapiens
tgtggcaggatgagggcgga

SEQ ID NO: 7358337 - DNA, 22 bp, Homo sapiens
cctgggagctgtggaaaggctg

SEQ ID NO: 7358338 - DNA, 22 bp, Homo sapiens
cctgggaggcagaggttgcagt

SEQ ID NO: 7358339 - DNA, 22 bp, Homo sapiens
cctgggaggcagaggttgcagt

SEQ ID NO: 7358340 - DNA, 22 bp, Homo sapiens
tgtgagcttaggacagggctat

SEQ ID NO: 7358341 - DNA, 22 bp, Homo sapiens
tgtgagctttctgctctcctgt

SEQ ID NO: 7358342 - DNA, 21 bp, Homo sapiens
tgtgagctttgtgaaagcagg

SEQ ID NO: 7358343 - DNA, 22 bp, Homo sapiens
tgtgagcagctctgtggactca

SEQ ID NO: 7358344 - DNA, 22 bp, Homo sapiens
tgtgagctgaagtgacaggctg

SEQ ID NO: 7358345 - DNA, 22 bp, Homo sapiens
tgtgagcatatgttttcagctc

SEQ ID NO: 7358346 - DNA, 22 bp, Homo sapiens
tgtgagggttttaagggaatga

SEQ ID NO: 7358347 - DNA, 22 bp, Homo sapiens
tgtgaggcgaggccagtgagct

SEQ ID NO: 7358348 - DNA, 22 bp, Homo sapiens
tgtgaggctacctgccagggtc

SEQ ID NO: 7358349 - DNA, 22 bp, Homo sapiens
tgtgaggctggcaggggccagg

SEQ ID NO: 7358350 - DNA, 22 bp, Homo sapiens
tgtgagggttttaagggaatga

SEQ ID NO: 7358351 - DNA, 22 bp, Homo sapiens
tgtgaggcctagacagcctggg

SEQ ID NO: 7358352 - DNA, 22 bp, Homo sapiens
tgtgaggcctctgcaggagcag

SEQ ID NO: 7358353 - DNA, 22 bp, Homo sapiens
tgtgaggataaaaaggaaggag

SEQ ID NO: 7358354 - DNA, 22 bp, Homo sapiens
tgtctttagttttactgtctgg

SEQ ID NO: 7358355 - DNA, 22 bp, Homo sapiens
tgtctttggaatatttagctga

SEQ ID NO: 7358356 - DNA, 22 bp, Homo sapiens
tgtgaaccttggtgagtcagta

SEQ ID NO: 7358357 - DNA, 22 bp, Homo sapiens
tgtgaaggagcatgcagagggg

SEQ ID NO: 7358358 - DNA, 22 bp, Homo sapiens
tgtgaaggtaaggaggggcaag

SEQ ID NO: 7358359 - DNA, 22 bp, Homo sapiens
tgtgaaggtaaggaggggcaag

SEQ ID NO: 7358360 - DNA, 22 bp, Homo sapiens
tgtgaaggcagagccagtgaaa

SEQ ID NO: 7358361 - DNA, 22 bp, Homo sapiens
tgtgaagcattttggacagcgc

SEQ ID NO: 7358362 - DNA, 19 bp, Homo sapiens
cctggctctgagcccagcc

SEQ ID NO: 7358363 - DNA, 22 bp, Homo sapiens
cctggctgaggggccaaggacc

SEQ ID NO: 7358364 - DNA, 22 bp, Homo sapiens
cctggctgaggggccaaggacc

SEQ ID NO: 7358365 - DNA, 22 bp, Homo sapiens
tgtctgtcagcagtgggtcagg

SEQ ID NO: 7358366 - DNA, 22 bp, Homo sapiens
tgtctgtccatctgtctgggac

SEQ ID NO: 7358367 - DNA, 22 bp, Homo sapiens
tgtctgtctgcaagccagaaag

SEQ ID NO: 7358368 - DNA, 22 bp, Homo sapiens
tgtctttagccagcagtcttct

SEQ ID NO: 7358369 - DNA, 22 bp, Homo sapiens
cctggctgtggcggtgctctca

SEQ ID NO: 7358370 - DNA, 22 bp, Homo sapiens
cctggcttccttcatgacctgg

SEQ ID NO: 7358371 - DNA, 20 bp, Homo sapiens
cctggctttgcagcatgaga

SEQ ID NO: 7358372 - DNA, 22 bp, Homo sapiens
cctggctgcccatggaccctct

SEQ ID NO: 7358373 - DNA, 22 bp, Homo sapiens
cctggctgctctgatgagcgcc

SEQ ID NO: 7358374 - DNA, 19 bp, Homo sapiens
cctggctgtgaagcctgca

SEQ ID NO: 7358375 - DNA, 20 bp, Homo sapiens
tgtgcccagcagaggctgcc

SEQ ID NO: 7358376 - DNA, 22 bp, Homo sapiens
tgtgcccattacacagaggcat

SEQ ID NO: 7358377 - DNA, 20 bp, Homo sapiens
tgtgcccaatgtccaggttc

SEQ ID NO: 7358378 - DNA, 19 bp, Homo sapiens
tgtgcttatgtttagatat

SEQ ID NO: 7358379 - DNA, 22 bp, Homo sapiens
tgtgcttactttgaattatata

SEQ ID NO: 7358380 - DNA, 22 bp, Homo sapiens
tgtgcccattccacttgagtac

SEQ ID NO: 7358381 - DNA, 21 bp, Homo sapiens
cctgggagatcagctgccttc

SEQ ID NO: 7358382 - DNA, 22 bp, Homo sapiens
cctgggagagtctgtggtctcc

SEQ ID NO: 7358383 - DNA, 22 bp, Homo sapiens
cctgggagagtctgtggtctcc

SEQ ID NO: 7358384 - DNA, 22 bp, Homo sapiens
cctgggagagccatctgtggcc

SEQ ID NO: 7358385 - DNA, 21 bp, Homo sapiens
cctgggagaattgggtgtggc

SEQ ID NO: 7358386 - DNA, 22 bp, Homo sapiens
cctgggaagagctgacaggagg

SEQ ID NO: 7358387 - DNA, 22 bp, Homo sapiens
tgtatgtttctaaatgattgct

SEQ ID NO: 7358388 - DNA, 22 bp, Homo sapiens
tgtattatcaagtaaatacatg

SEQ ID NO: 7358389 - DNA, 22 bp, Homo sapiens
tgtcatggggttgttttgtaca

SEQ ID NO: 7358390 - DNA, 20 bp, Homo sapiens
tgtcatgcattagatgaaga

SEQ ID NO: 7358391 - DNA, 22 bp, Homo sapiens
tgtcatgccaccgtttcccaga

SEQ ID NO: 7358392 - DNA, 22 bp, Homo sapiens
tgtcatgccaggaaatagtccc

SEQ ID NO: 7358393 - DNA, 22 bp, Homo sapiens
tgtcatgccaggaaatagtccc

SEQ ID NO: 7358394 - DNA, 22 bp, Homo sapiens
tgtcatgccatttaaaatgttt

SEQ ID NO: 7358395 - DNA, 22 bp, Homo sapiens
tgtcatgccatttaaaatgttt

SEQ ID NO: 7358396 - DNA, 22 bp, Homo sapiens
tgtcatgcccaggagcaaggta

SEQ ID NO: 7358397 - DNA, 22 bp, Homo sapiens
tgtcatgcttatgttacatact

SEQ ID NO: 7358398 - DNA, 22 bp, Homo sapiens
tgtcatgtgagggaacttgttc

SEQ ID NO: 7358399 - DNA, 22 bp, Homo sapiens
tgtcatgtctgtaaatacacca

SEQ ID NO: 7358400 - DNA, 22 bp, Homo sapiens
tgtcatgtaacctttctgagcc

SEQ ID NO: 7358401 - DNA, 22 bp, Homo sapiens
tgtcatggtgctatttaattag

SEQ ID NO: 7358402 - DNA, 22 bp, Homo sapiens
cctggcactgctgaagtcctgg

SEQ ID NO: 7358403 - DNA, 22 bp, Homo sapiens
cctggcacatagtgggcatgca

SEQ ID NO: 7358404 - DNA, 22 bp, Homo sapiens
cctggcacgaagggctgaggtt

SEQ ID NO: 7358405 - DNA, 22 bp, Homo sapiens
tgtatgtgtatgtacatatgca

SEQ ID NO: 7358406 - DNA, 22 bp, Homo sapiens
tgtatgtggctacttttcttgc

SEQ ID NO: 7358407 - DNA, 22 bp, Homo sapiens
tgtatgtgtggatagatgtata

SEQ ID NO: 7358408 - DNA, 22 bp, Homo sapiens
tgtatgtatgtatgtatttggg

SEQ ID NO: 7358409 - DNA, 22 bp, Homo sapiens
tgtatgtattttgctaggctga

SEQ ID NO: 7358410 - DNA, 22 bp, Homo sapiens
tgtatgtatgtatgtatttggg

SEQ ID NO: 7358411 - DNA, 17 bp, Homo sapiens
tgtatgtggatacacta

SEQ ID NO: 7358412 - DNA, 22 bp, Homo sapiens
tgtagggagaagagaggcacct

SEQ ID NO: 7358413 - DNA, 22 bp, Homo sapiens
tgtataaaccatggacagcttt

SEQ ID NO: 7358414 - DNA, 22 bp, Homo sapiens
tgtataaaccatggacagcttt

SEQ ID NO: 7358415 - DNA, 22 bp, Homo sapiens
cctggagcaaaaatctaaggag

SEQ ID NO: 7358416 - DNA, 22 bp, Homo sapiens
cctggagcacagcccagtccca

SEQ ID NO: 7358417 - DNA, 19 bp, Homo sapiens
cctggaggtgaaggttctc

SEQ ID NO: 7358418 - DNA, 22 bp, Homo sapiens
cctggcacatagtgggcatgca

SEQ ID NO: 7358419 - DNA, 22 bp, Homo sapiens
cctggcacatagtaagtactag

SEQ ID NO: 7358420 - DNA, 22 bp, Homo sapiens
cctctgtgcctcagtttcatgt

SEQ ID NO: 7358421 - DNA, 22 bp, Homo sapiens
cctctgtgcctcgtgtcctctg

SEQ ID NO: 7358422 - DNA, 22 bp, Homo sapiens
cctctgtgcctcgtgtcctctg

SEQ ID NO: 7358423 - DNA, 21 bp, Homo sapiens
cctctgtgctaaagggctccc

SEQ ID NO: 7358424 - DNA, 22 bp, Homo sapiens
cctctgtgctttgtccagcctc

SEQ ID NO: 7358425 - DNA, 22 bp, Homo sapiens
tggtcccattgttctgcccagg

SEQ ID NO: 7358426 - DNA, 22 bp, Homo sapiens
tggtccctgcgttaagagcact

SEQ ID NO: 7358427 - DNA, 22 bp, Homo sapiens
cctgccatgccagcatgcccgt

SEQ ID NO: 7358428 - DNA, 18 bp, Homo sapiens
cctgccagtctggagcag

SEQ ID NO: 7358429 - DNA, 22 bp, Homo sapiens
tggtccgggatggacgcgggct

SEQ ID NO: 7358430 - DNA, 17 bp, Homo sapiens
cctgcccagagacagat

SEQ ID NO: 7358431 - DNA, 22 bp, Homo sapiens
tggtgctgataatggcaggatt

SEQ ID NO: 7358432 - DNA, 19 bp, Homo sapiens
tggtgcgcccggcccttct

SEQ ID NO: 7358433 - DNA, 22 bp, Homo sapiens
tggtgctcccaagattgttcta

SEQ ID NO: 7358434 - DNA, 22 bp, Homo sapiens
tggtgctcttatgttttcatca

SEQ ID NO: 7358435 - DNA, 21 bp, Homo sapiens
cctggagacaaagacagggtg

SEQ ID NO: 7358436 - DNA, 22 bp, Homo sapiens
tggtgctgccaggctcctgcca

SEQ ID NO: 7358437 - DNA, 22 bp, Homo sapiens
tggtgctgcaggtgggcacagt

SEQ ID NO: 7358438 - DNA, 22 bp, Homo sapiens
tggtgctgataatggcaggatt

SEQ ID NO: 7358439 - DNA, 22 bp, Homo sapiens
tggtgctggtgccacgcccctt

SEQ ID NO: 7358440 - DNA, 22 bp, Homo sapiens
tggtgctggtgccacgcccctt

SEQ ID NO: 7358441 - DNA, 22 bp, Homo sapiens
cctggcccacatggcttctccc

SEQ ID NO: 7358442 - DNA, 22 bp, Homo sapiens
cctggcccacatggcttctccc

SEQ ID NO: 7358443 - DNA, 22 bp, Homo sapiens
cctggcatccggaacctggaaa

SEQ ID NO: 7358444 - DNA, 22 bp, Homo sapiens
cctggcatgtcctcctggcatg

SEQ ID NO: 7358445 - DNA, 22 bp, Homo sapiens
cctggccagcgccggctgctcg

SEQ ID NO: 7358446 - DNA, 22 bp, Homo sapiens
cctggccagcgccggctgctcg

SEQ ID NO: 7358447 - DNA, 22 bp, Homo sapiens
cctggccagctaattgcccatc

SEQ ID NO: 7358448 - DNA, 22 bp, Homo sapiens
cctggccaggcatggagtcaca

SEQ ID NO: 7358449 - DNA, 22 bp, Homo sapiens
cctggccaggctccaagtactg

SEQ ID NO: 7358450 - DNA, 22 bp, Homo sapiens
cctggccatagggcccaggaaa

SEQ ID NO: 7358451 - DNA, 22 bp, Homo sapiens
cctggccagggtctgggctgct

SEQ ID NO: 7358452 - DNA, 22 bp, Homo sapiens
tgtcattatgaggattacaata

SEQ ID NO: 7358453 - DNA, 21 bp, Homo sapiens
tgtcattaatcgctatagaag

SEQ ID NO: 7358454 - DNA, 22 bp, Homo sapiens
tgtcattaaaatgcttctcaaa

SEQ ID NO: 7358455 - DNA, 22 bp, Homo sapiens
tgtcatgtttcatgtttgtagg

SEQ ID NO: 7358456 - DNA, 22 bp, Homo sapiens
cctggcagctgtttggcttggc

SEQ ID NO: 7358457 - DNA, 23 bp, Homo sapiens
cctggcagcaaacgaggaggtta

SEQ ID NO: 7358458 - DNA, 23 bp, Homo sapiens
cctggcagcaaacgaggaggtta

SEQ ID NO: 7358459 - DNA, 22 bp, Homo sapiens
cctggcaggctggggacagtgc

SEQ ID NO: 7358460 - DNA, 22 bp, Homo sapiens
cctggcaggtggaggttgcagt

SEQ ID NO: 7358461 - DNA, 22 bp, Homo sapiens
cctggctctctgcagatcctgg

SEQ ID NO: 7358462 - DNA, 22 bp, Homo sapiens
cctggctctctgcagatcctgg

SEQ ID NO: 7358463 - DNA, 22 bp, Homo sapiens
cctggctccgtgtcacgtgccc

SEQ ID NO: 7358464 - DNA, 22 bp, Homo sapiens
cctggctccggttcaagggaaa

SEQ ID NO: 7358465 - DNA, 22 bp, Homo sapiens
cctggctccctggacctcatta

SEQ ID NO: 7358466 - DNA, 22 bp, Homo sapiens
cctggctccctgcacagggctc

SEQ ID NO: 7358467 - DNA, 22 bp, Homo sapiens
cctggctccctgcacagggctc

SEQ ID NO: 7358468 - DNA, 22 bp, Homo sapiens
cctggccctggaatagggcagg

SEQ ID NO: 7358469 - DNA, 19 bp, Homo sapiens
cctggccctgctgcgcggg

SEQ ID NO: 7358470 - DNA, 22 bp, Homo sapiens
cctggcccagggactttcgcct

SEQ ID NO: 7358471 - DNA, 22 bp, Homo sapiens
cctggcccacatggcttctccc

SEQ ID NO: 7358472 - DNA, 16 bp, Homo sapiens
cctggcccggcttcct

SEQ ID NO: 7358473 - DNA, 16 bp, Homo sapiens
cctggcccggcttcct

SEQ ID NO: 7358474 - DNA, 19 bp, Homo sapiens
cctggccctgctgcgcggg

SEQ ID NO: 7358475 - DNA, 22 bp, Homo sapiens
cctggcctcgtgctcacggctc

SEQ ID NO: 7358476 - DNA, 22 bp, Homo sapiens
cctggcctcagcctagggctga

SEQ ID NO: 7358477 - DNA, 22 bp, Homo sapiens
cctggcctcagacagagggtgg

SEQ ID NO: 7358478 - DNA, 22 bp, Homo sapiens
cctggccttaagggcagggagc

SEQ ID NO: 7358479 - DNA, 22 bp, Homo sapiens
cctggctcccggaacagggtct

SEQ ID NO: 7358480 - DNA, 22 bp, Homo sapiens
tgtcctctccaacagcctctgt

SEQ ID NO: 7358481 - DNA, 22 bp, Homo sapiens
tgtcctgcaactgaaggagaag

SEQ ID NO: 7358482 - DNA, 21 bp, Homo sapiens
tgtctcaatcagaagtcatta

SEQ ID NO: 7358483 - DNA, 22 bp, Homo sapiens
tgtctcagaatggctcataata

SEQ ID NO: 7358484 - DNA, 22 bp, Homo sapiens
tgtctcagaatggctcataata

SEQ ID NO: 7358485 - DNA, 22 bp, Homo sapiens
tgtctatgtatacatgtgtata

SEQ ID NO: 7358486 - DNA, 22 bp, Homo sapiens
tgtctatgtatacatgtgtata

SEQ ID NO: 7358487 - DNA, 22 bp, Homo sapiens
tgtctattaacacaagaaagga

SEQ ID NO: 7358488 - DNA, 22 bp, Homo sapiens
tgtctattcaatatccatttct

SEQ ID NO: 7358489 - DNA, 22 bp, Homo sapiens
tgtctcagatacgccatcaagg

SEQ ID NO: 7358490 - DNA, 22 bp, Homo sapiens
tgtctcagagtatccctgaact

SEQ ID NO: 7358491 - DNA, 23 bp, Homo sapiens
tgtctcagactgaggggtttccc

SEQ ID NO: 7358492 - DNA, 22 bp, Homo sapiens
tgtctcagaggcaggaagagcc

SEQ ID NO: 7358493 - DNA, 22 bp, Homo sapiens
tgtctcaggggcattgaaataa

SEQ ID NO: 7358494 - DNA, 22 bp, Homo sapiens
tgtctcagggcagcagcagggg

SEQ ID NO: 7358495 - DNA, 18 bp, Homo sapiens
tgtctcaggctgaaacag

SEQ ID NO: 7358496 - DNA, 22 bp, Homo sapiens
tgtctcaggcccaagccagtaa

SEQ ID NO: 7358497 - DNA, 22 bp, Homo sapiens
tgtctcttggctctatcactta

SEQ ID NO: 7358498 - DNA, 18 bp, Homo sapiens
tgtctcagttctgctatg

SEQ ID NO: 7358499 - DNA, 19 bp, Homo sapiens
tgtctcagtgtcccttcct

SEQ ID NO: 7358500 - DNA, 22 bp, Homo sapiens
tgtctcagttcccttctctgga

SEQ ID NO: 7358501 - DNA, 22 bp, Homo sapiens
tgtctcagtacactccgatgtt

SEQ ID NO: 7358502 - DNA, 22 bp, Homo sapiens
tgtctcagtatacgaaacactt

SEQ ID NO: 7358503 - DNA, 22 bp, Homo sapiens
tgtctctggcccatgagcagag

SEQ ID NO: 7358504 - DNA, 22 bp, Homo sapiens
tgctcagtagagtttttggaat

SEQ ID NO: 7358505 - DNA, 22 bp, Homo sapiens
tgctccaggtgtgcctctcatg

SEQ ID NO: 7358506 - DNA, 23 bp, Homo sapiens
tgctccaggtacagaactccagg

SEQ ID NO: 7358507 - DNA, 22 bp, Homo sapiens
tgctccaggtgtgcctctcatg

SEQ ID NO: 7358508 - DNA, 22 bp, Homo sapiens
tgctccagggctgccagaccct

SEQ ID NO: 7358509 - DNA, 23 bp, Homo sapiens
tgctccaggtacagaactccagg

SEQ ID NO: 7358510 - DNA, 20 bp, Homo sapiens
tgctccatctaaagtgatta

SEQ ID NO: 7358511 - DNA, 22 bp, Homo sapiens
tgctccattctctagccagtgc

SEQ ID NO: 7358512 - DNA, 22 bp, Homo sapiens
cccaggctcctagaggcccaga

SEQ ID NO: 7358513 - DNA, 22 bp, Homo sapiens
tgcctgctctgtgccacagttg

SEQ ID NO: 7358514 - DNA, 22 bp, Homo sapiens
tgctgaataaagatatattttc

SEQ ID NO: 7358515 - DNA, 21 bp, Homo sapiens
tgctgacatcaggtctgctat

SEQ ID NO: 7358516 - DNA, 22 bp, Homo sapiens
tgctgcagaaattctgtgagga

SEQ ID NO: 7358517 - DNA, 20 bp, Homo sapiens
tgctgcagacagggccattg

SEQ ID NO: 7358518 - DNA, 22 bp, Homo sapiens
tgctgaccttgttctgtgagga

SEQ ID NO: 7358519 - DNA, 22 bp, Homo sapiens
cccagggaggcccaggctctgc

SEQ ID NO: 7358520 - DNA, 22 bp, Homo sapiens
cccagggaggcccaggctctgc

SEQ ID NO: 7358521 - DNA, 22 bp, Homo sapiens
tgctctggagtggcttgtgcac

SEQ ID NO: 7358522 - DNA, 22 bp, Homo sapiens
ccccagccttccatgggaattg

SEQ ID NO: 7358523 - DNA, 22 bp, Homo sapiens
ccccagcccacaagcatattaa

SEQ ID NO: 7358524 - DNA, 23 bp, Homo sapiens
tgctggagacaagtgtgagaagg

SEQ ID NO: 7358525 - DNA, 22 bp, Homo sapiens
tgctggagacatagcaggcagc

SEQ ID NO: 7358526 - DNA, 22 bp, Homo sapiens
tgctggagacatagcaggcagc

SEQ ID NO: 7358527 - DNA, 22 bp, Homo sapiens
tgctggagcatctgagagcatc

SEQ ID NO: 7358528 - DNA, 22 bp, Homo sapiens
tgctggagatgaaagggccctg

SEQ ID NO: 7358529 - DNA, 22 bp, Homo sapiens
tgctggagaggaaggtggggtc

SEQ ID NO: 7358530 - DNA, 22 bp, Homo sapiens
ccccagccagcaggacctctga

SEQ ID NO: 7358531 - DNA, 22 bp, Homo sapiens
ccccagccagcttgtagtagaa

SEQ ID NO: 7358532 - DNA, 22 bp, Homo sapiens
ccccagccagcaggacctctga

SEQ ID NO: 7358533 - DNA, 22 bp, Homo sapiens
ccccagcatatcatggtttcgt

SEQ ID NO: 7358534 - DNA, 18 bp, Homo sapiens
ccccagcagtgtggtgcc

SEQ ID NO: 7358535 - DNA, 22 bp, Homo sapiens
ccccagcaggaatacaggggtc

SEQ ID NO: 7358536 - DNA, 22 bp, Homo sapiens
tgctgcaggaattctcaaggga

SEQ ID NO: 7358537 - DNA, 22 bp, Homo sapiens
tgctgcagacgaagcccatgcc

SEQ ID NO: 7358538 - DNA, 22 bp, Homo sapiens
tgctgcagacgaagcccatgcc

SEQ ID NO: 7358539 - DNA, 22 bp, Homo sapiens
tgctgcagcagtgcgggcagct

SEQ ID NO: 7358540 - DNA, 18 bp, Homo sapiens
cccccagccaaattctct

SEQ ID NO: 7358541 - DNA, 22 bp, Homo sapiens
cccccagccagcagtgctcagc

SEQ ID NO: 7358542 - DNA, 22 bp, Homo sapiens
cccccactaagttgagggccct

SEQ ID NO: 7358543 - DNA, 22 bp, Homo sapiens
cccccagctctgctgggtcccg

SEQ ID NO: 7358544 - DNA, 19 bp, Homo sapiens
ccctcaggtctgagcagtc

SEQ ID NO: 7358545 - DNA, 22 bp, Homo sapiens
ccctcagggaccactgacttca

SEQ ID NO: 7358546 - DNA, 22 bp, Homo sapiens
ccctcaggatgcagtggaagtg

SEQ ID NO: 7358547 - DNA, 22 bp, Homo sapiens
ccctcaggagatgtcagctgga

SEQ ID NO: 7358548 - DNA, 22 bp, Homo sapiens
ccctcaggagatgtcagctgga

SEQ ID NO: 7358549 - DNA, 21 bp, Homo sapiens
ccctcaggaaacagaatgcac

SEQ ID NO: 7358550 - DNA, 22 bp, Homo sapiens
cccctctgcaaatagccaggct

SEQ ID NO: 7358551 - DNA, 22 bp, Homo sapiens
cccctcctggccacactgtcag

SEQ ID NO: 7358552 - DNA, 22 bp, Homo sapiens
cccctcctgcagcacctttctt

SEQ ID NO: 7358553 - DNA, 22 bp, Homo sapiens
cccctcctggccacactgtcag

SEQ ID NO: 7358554 - DNA, 22 bp, Homo sapiens
cccaggcagtagaaagaagagg

SEQ ID NO: 7358555 - DNA, 22 bp, Homo sapiens
cccaggcagggacgtgctctgg

SEQ ID NO: 7358556 - DNA, 22 bp, Homo sapiens
cccaggcagtgctgatccctca

SEQ ID NO: 7358557 - DNA, 22 bp, Homo sapiens
cccaggcagtgtgtgcatgcgt

SEQ ID NO: 7358558 - DNA, 22 bp, Homo sapiens
cccaggcagcctgcagggaagg

SEQ ID NO: 7358559 - DNA, 22 bp, Homo sapiens
cccaggcagcccttctgacgca

SEQ ID NO: 7358560 - DNA, 22 bp, Homo sapiens
cccaggagggtggcctctgccc

SEQ ID NO: 7358561 - DNA, 21 bp, Homo sapiens
cccaggaggctgagaagagca

SEQ ID NO: 7358562 - DNA, 22 bp, Homo sapiens
cccaggaggtgtgcccaactcg

SEQ ID NO: 7358563 - DNA, 22 bp, Homo sapiens
tgccaatttgcccctttgctga

SEQ ID NO: 7358564 - DNA, 22 bp, Homo sapiens
tgccacactcccctgctgcagt

SEQ ID NO: 7358565 - DNA, 22 bp, Homo sapiens
tgccacactcccctgctgcagt

SEQ ID NO: 7358566 - DNA, 22 bp, Homo sapiens
tgccacactcacttctgtggac

SEQ ID NO: 7358567 - DNA, 22 bp, Homo sapiens
tgccacactcacttctgtggac

SEQ ID NO: 7358568 - DNA, 22 bp, Homo sapiens
tgccacaccaacatctttcagc

SEQ ID NO: 7358569 - DNA, 22 bp, Homo sapiens
tgccacacattgtcaggttagt

SEQ ID NO: 7358570 - DNA, 22 bp, Homo sapiens
tgccacacagctgtatgaggga

SEQ ID NO: 7358571 - DNA, 22 bp, Homo sapiens
tgccacacaattactgctgcta

SEQ ID NO: 7358572 - DNA, 22 bp, Homo sapiens
tgccacacaattactgctgcta

SEQ ID NO: 7358573 - DNA, 22 bp, Homo sapiens
tgccacacagctgtatgaggga

SEQ ID NO: 7358574 - DNA, 22 bp, Homo sapiens
tgccacacagtctggtagaata

SEQ ID NO: 7358575 - DNA, 22 bp, Homo sapiens
tgccacacagtctggtagaata

SEQ ID NO: 7358576 - DNA, 22 bp, Homo sapiens
tgcattcaaatctccaggctca

SEQ ID NO: 7358577 - DNA, 22 bp, Homo sapiens
cccagctcttcctgggagctaa

SEQ ID NO: 7358578 - DNA, 22 bp, Homo sapiens
cccagctgcacctctatggcct

SEQ ID NO: 7358579 - DNA, 22 bp, Homo sapiens
cccagctgtggcagaggccggg

SEQ ID NO: 7358580 - DNA, 17 bp, Homo sapiens
cccagctggcagtgccg

SEQ ID NO: 7358581 - DNA, 23 bp, Homo sapiens
cccagctgcagacaagggagggt

SEQ ID NO: 7358582 - DNA, 17 bp, Homo sapiens
cccagctgcgtctgagg

SEQ ID NO: 7358583 - DNA, 17 bp, Homo sapiens
cccagctgcgtctgagg

SEQ ID NO: 7358584 - DNA, 22 bp, Homo sapiens
tgcagggagctctggggtgcag

SEQ ID NO: 7358585 - DNA, 22 bp, Homo sapiens
tgcagggagctctggggtgcag

SEQ ID NO: 7358586 - DNA, 22 bp, Homo sapiens
tgcagggaccccgaggctctct

SEQ ID NO: 7358587 - DNA, 22 bp, Homo sapiens
tgcagggaccccgaggctctct

SEQ ID NO: 7358588 - DNA, 22 bp, Homo sapiens
tgcagggacaggctctggggat

SEQ ID NO: 7358589 - DNA, 22 bp, Homo sapiens
tgcagggagggcccagcaatct

SEQ ID NO: 7358590 - DNA, 22 bp, Homo sapiens
tgcagggaggccccgcagccct

SEQ ID NO: 7358591 - DNA, 22 bp, Homo sapiens
tgcagggaggccccgcagccct

SEQ ID NO: 7358592 - DNA, 22 bp, Homo sapiens
cccagctccttacagggccgaa

SEQ ID NO: 7358593 - DNA, 22 bp, Homo sapiens
tgcagggaatctgtggctggac

SEQ ID NO: 7358594 - DNA, 22 bp, Homo sapiens
tgcagggaatgcttgcagcatg

SEQ ID NO: 7358595 - DNA, 22 bp, Homo sapiens
cccagccttccaccctggacta

SEQ ID NO: 7358596 - DNA, 22 bp, Homo sapiens
cccagcctgtgacagccgtcct

SEQ ID NO: 7358597 - DNA, 22 bp, Homo sapiens
cccagcctgtgacagccgtcct

SEQ ID NO: 7358598 - DNA, 22 bp, Homo sapiens
cccagcctgtctttcccaatga

SEQ ID NO: 7358599 - DNA, 20 bp, Homo sapiens
tctgtggcaggtggcgcttg

SEQ ID NO: 7358600 - DNA, 22 bp, Homo sapiens
cccagcctactctgccatagca

SEQ ID NO: 7358601 - DNA, 22 bp, Homo sapiens
tggcaaggctgtgggggcagag

SEQ ID NO: 7358602 - DNA, 22 bp, Homo sapiens
tggcaaggctgtgggggcagag

SEQ ID NO: 7358603 - DNA, 22 bp, Homo sapiens
tggcaaggccacaggtgcagtt

SEQ ID NO: 7358604 - DNA, 22 bp, Homo sapiens
tggcagcaccagcagtgtcctt

SEQ ID NO: 7358605 - DNA, 22 bp, Homo sapiens
tggccacacccacctagaggag

SEQ ID NO: 7358606 - DNA, 22 bp, Homo sapiens
tggccacaaagagaacgaggtc

SEQ ID NO: 7358607 - DNA, 23 bp, Homo sapiens
tggccaggcataaaggtgggtgg

SEQ ID NO: 7358608 - DNA, 22 bp, Homo sapiens
tggccaggcaggtagaacggcc

SEQ ID NO: 7358609 - DNA, 22 bp, Homo sapiens
cctatgactctgattctttaga

SEQ ID NO: 7358610 - DNA, 22 bp, Homo sapiens
cctatacaggcttctttacatg

SEQ ID NO: 7358611 - DNA, 22 bp, Homo sapiens
cctatattacaggcttgctcta

SEQ ID NO: 7358612 - DNA, 22 bp, Homo sapiens
cctatattcagggaactgaccc

SEQ ID NO: 7358613 - DNA, 22 bp, Homo sapiens
ccctggagctagtctgagcaga

SEQ ID NO: 7358614 - DNA, 22 bp, Homo sapiens
ccctcaggtgaaaggaaaaatt

SEQ ID NO: 7358615 - DNA, 19 bp, Homo sapiens
ccctcaggtctgagcagtc

SEQ ID NO: 7358616 - DNA, 22 bp, Homo sapiens
ccctccacagacaggacttgtc

SEQ ID NO: 7358617 - DNA, 22 bp, Homo sapiens
ccctccagtgtcccagtgggga

SEQ ID NO: 7358618 - DNA, 22 bp, Homo sapiens
tggatgaaaaatgagaattttc

SEQ ID NO: 7358619 - DNA, 22 bp, Homo sapiens
tggatgaacagttttggagaga

SEQ ID NO: 7358620 - DNA, 22 bp, Homo sapiens
tggatgctatggagtatttaga

SEQ ID NO: 7358621 - DNA, 22 bp, Homo sapiens
ccctggctatttttacgcaagg

SEQ ID NO: 7358622 - DNA, 22 bp, Homo sapiens
ccctggctctgcctcagagccc

SEQ ID NO: 7358623 - DNA, 22 bp, Homo sapiens
ccctggctgataccggaaaggc

SEQ ID NO: 7358624 - DNA, 23 bp, Homo sapiens
ccctggccttggggcacaggctg

SEQ ID NO: 7358625 - DNA, 23 bp, Homo sapiens
ccctggccttggggcacaggctg

SEQ ID NO: 7358626 - DNA, 20 bp, Homo sapiens
ccctggcctgtttcatgccc

SEQ ID NO: 7358627 - DNA, 20 bp, Homo sapiens
ccctggcctgtttcatgccc

SEQ ID NO: 7358628 - DNA, 22 bp, Homo sapiens
ccctggcctacaggcccagaga

SEQ ID NO: 7358629 - DNA, 22 bp, Homo sapiens
ccctggcctacaggcccagaga

SEQ ID NO: 7358630 - DNA, 22 bp, Homo sapiens
ccctggcctccaggcagtcctg

SEQ ID NO: 7358631 - DNA, 22 bp, Homo sapiens
ccctggcaaaatccctggtaca

SEQ ID NO: 7358632 - DNA, 22 bp, Homo sapiens
ccctggcccctcactccgaggc

SEQ ID NO: 7358633 - DNA, 22 bp, Homo sapiens
ccctggcctacaggcccagaga

SEQ ID NO: 7358634 - DNA, 22 bp, Homo sapiens
cctctctgtgtggcctctccat

SEQ ID NO: 7358635 - DNA, 22 bp, Homo sapiens
cctctctgtagcagcccccagt

SEQ ID NO: 7358636 - DNA, 22 bp, Homo sapiens
cctctctgtcacaccagtggcc

SEQ ID NO: 7358637 - DNA, 22 bp, Homo sapiens
cctctctgtaagggtccctccc

SEQ ID NO: 7358638 - DNA, 20 bp, Homo sapiens
cctctctgcatgctccctga

SEQ ID NO: 7358639 - DNA, 22 bp, Homo sapiens
cctctcctggctgtaggacctc

SEQ ID NO: 7358640 - DNA, 22 bp, Homo sapiens
cctctcccgggtgccgctgggc

SEQ ID NO: 7358641 - DNA, 22 bp, Homo sapiens
cctctacttaccactcagccag

SEQ ID NO: 7358642 - DNA, 22 bp, Homo sapiens
cctcgtggtgtcagacctgtgc

SEQ ID NO: 7358643 - DNA, 22 bp, Homo sapiens
cctctacagggcatagcccaaa

SEQ ID NO: 7358644 - DNA, 18 bp, Homo sapiens
cctctacctacccctaga

SEQ ID NO: 7358645 - DNA, 22 bp, Homo sapiens
cctctcatagtctgtatccttt

SEQ ID NO: 7358646 - DNA, 22 bp, Homo sapiens
cctctcatcattatcgctttgt

SEQ ID NO: 7358647 - DNA, 22 bp, Homo sapiens
tggctgccctcatgggcctgat

SEQ ID NO: 7358648 - DNA, 22 bp, Homo sapiens
tggctgcctgatcgagcaggtg

SEQ ID NO: 7358649 - DNA, 22 bp, Homo sapiens
tggctgcctgaatgcaagacag

SEQ ID NO: 7358650 - DNA, 22 bp, Homo sapiens
tggctgcctgaatgcaagacag

SEQ ID NO: 7358651 - DNA, 22 bp, Homo sapiens
tggctgcctcagtgtccctgca

SEQ ID NO: 7358652 - DNA, 22 bp, Homo sapiens
cctctgtaatgattcactgaat

SEQ ID NO: 7358653 - DNA, 22 bp, Homo sapiens
cctctgtcctggggagtggagc

SEQ ID NO: 7358654 - DNA, 22 bp, Homo sapiens
cctctgtgacaaacagtcctgg

SEQ ID NO: 7358655 - DNA, 22 bp, Homo sapiens
cctctgtgacttctaccttcac

SEQ ID NO: 7358656 - DNA, 22 bp, Homo sapiens
cctctgtgcaggaaatacatgt

SEQ ID NO: 7358657 - DNA, 22 bp, Homo sapiens
cctctgtgatttctgagccaat

SEQ ID NO: 7358658 - DNA, 22 bp, Homo sapiens
cctctgggtatctgtggaagta

SEQ ID NO: 7358659 - DNA, 22 bp, Homo sapiens
cctctgagaccagctctgcacc

SEQ ID NO: 7358660 - DNA, 22 bp, Homo sapiens
cctctgagaggccatctctcct

SEQ ID NO: 7358661 - DNA, 22 bp, Homo sapiens
cctctgggggcttccttaccct

SEQ ID NO: 7358662 - DNA, 22 bp, Homo sapiens
cctctgggctgcctgcacgggt

SEQ ID NO: 7358663 - DNA, 22 bp, Homo sapiens
cctctgagcctgtgtgcggcac

SEQ ID NO: 7358664 - DNA, 22 bp, Homo sapiens
cctctggctgtaccactggcac

SEQ ID NO: 7358665 - DNA, 22 bp, Homo sapiens
cctccactctggcctctcaggt

SEQ ID NO: 7358666 - DNA, 22 bp, Homo sapiens
cctccactctggcctctcaggt

SEQ ID NO: 7358667 - DNA, 22 bp, Homo sapiens
cctccactctggcctctcaggt

SEQ ID NO: 7358668 - DNA, 22 bp, Homo sapiens
cctccaagtttgactcaggaca

SEQ ID NO: 7358669 - DNA, 22 bp, Homo sapiens
cctccactgcttcccagctttg

SEQ ID NO: 7358670 - DNA, 20 bp, Homo sapiens
cctccactgtcactgacctg

SEQ ID NO: 7358671 - DNA, 22 bp, Homo sapiens
cctccagactttggccatcctc

SEQ ID NO: 7358672 - DNA, 22 bp, Homo sapiens
cctccagagggaagtactttct

SEQ ID NO: 7358673 - DNA, 22 bp, Homo sapiens
cctccagagggtttcccatgaa

SEQ ID NO: 7358674 - DNA, 22 bp, Homo sapiens
cctccagcgcgatccactccgg

SEQ ID NO: 7358675 - DNA, 22 bp, Homo sapiens
cctccctgtctacctgttgtgg

SEQ ID NO: 7358676 - DNA, 22 bp, Homo sapiens
cctccctggccagagcagcagc

SEQ ID NO: 7358677 - DNA, 22 bp, Homo sapiens
cctccctgggtgctgggattgc

SEQ ID NO: 7358678 - DNA, 22 bp, Homo sapiens
cctccctggtggctctggtcta

SEQ ID NO: 7358679 - DNA, 22 bp, Homo sapiens
cctccctgggtgacgggctcct

SEQ ID NO: 7358680 - DNA, 22 bp, Homo sapiens
cctcctccttatggtggcccag

SEQ ID NO: 7358681 - DNA, 22 bp, Homo sapiens
cctcctctgggaagattcagag

SEQ ID NO: 7358682 - DNA, 22 bp, Homo sapiens
cctcctctggtgctgccaaccc

SEQ ID NO: 7358683 - DNA, 22 bp, Homo sapiens
cctcggggcaccgcggcctgct

SEQ ID NO: 7358684 - DNA, 22 bp, Homo sapiens
cctcgtccacaatccttgcaca

SEQ ID NO: 7358685 - DNA, 22 bp, Homo sapiens
tggcccagtgcttatgctctga

SEQ ID NO: 7358686 - DNA, 22 bp, Homo sapiens
tggcccagccctgctctagggc

SEQ ID NO: 7358687 - DNA, 22 bp, Homo sapiens
tggcccagccctgctctagggc

SEQ ID NO: 7358688 - DNA, 22 bp, Homo sapiens
tggcccagcagttctgccccag

SEQ ID NO: 7358689 - DNA, 20 bp, Homo sapiens
tggcccagtggggcagggtg

SEQ ID NO: 7358690 - DNA, 20 bp, Homo sapiens
tggcccagtggggcagggtg

SEQ ID NO: 7358691 - DNA, 22 bp, Homo sapiens
tggcccgaagatccgagggtca

SEQ ID NO: 7358692 - DNA, 22 bp, Homo sapiens
tggccccattttacagatgaaa

SEQ ID NO: 7358693 - DNA, 22 bp, Homo sapiens
tggccctgctatgatcctgcaa

SEQ ID NO: 7358694 - DNA, 22 bp, Homo sapiens
tggccctgctggacacgcctgc

SEQ ID NO: 7358695 - DNA, 22 bp, Homo sapiens
tggccctgctggccaaaggcta

SEQ ID NO: 7358696 - DNA, 22 bp, Homo sapiens
tggctcagtttctgcccagctg

SEQ ID NO: 7358697 - DNA, 22 bp, Homo sapiens
tggctcagtttgggggattgaa

SEQ ID NO: 7358698 - DNA, 22 bp, Homo sapiens
tggctcagtttcagtcctggtt

SEQ ID NO: 7358699 - DNA, 22 bp, Homo sapiens
tggctcagtttctgcccagctg

SEQ ID NO: 7358700 - DNA, 22 bp, Homo sapiens
tggctcagtttcagtcctggtt

SEQ ID NO: 7358701 - DNA, 22 bp, Homo sapiens
tggccctgctgtatcatctgct

SEQ ID NO: 7358702 - DNA, 22 bp, Homo sapiens
tggccctgctgtatcatctgct

SEQ ID NO: 7358703 - DNA, 22 bp, Homo sapiens
tggccctgctggccaaaggcta

SEQ ID NO: 7358704 - DNA, 22 bp, Homo sapiens
tggccctgctgggtcagagctg

SEQ ID NO: 7358705 - DNA, 22 bp, Homo sapiens
tggctcagctgtcacagcctgg

SEQ ID NO: 7358706 - DNA, 22 bp, Homo sapiens
tggctcagctgtcacagcctgg

SEQ ID NO: 7358707 - DNA, 22 bp, Homo sapiens
tggctcagtttagcagctcagt

SEQ ID NO: 7358708 - DNA, 21 bp, Homo sapiens
tggctcagttgctgggcacag

SEQ ID NO: 7358709 - DNA, 22 bp, Homo sapiens
ttttattcatagggatggagag

SEQ ID NO: 7358710 - DNA, 22 bp, Homo sapiens
ttttagtttggatttctaaagc

SEQ ID NO: 7358711 - DNA, 22 bp, Homo sapiens
ttttagttgctcaggtattctc

SEQ ID NO: 7358712 - DNA, 22 bp, Homo sapiens
ctctgggccaccgctggtgtat

SEQ ID NO: 7358713 - DNA, 22 bp, Homo sapiens
ctctgggctccttcagcccttt

SEQ ID NO: 7358714 - DNA, 23 bp, Homo sapiens
ctctgggcgggcaggtcagcctc

SEQ ID NO: 7358715 - DNA, 22 bp, Homo sapiens
ctctgggcaaagatgcctcatc

SEQ ID NO: 7358716 - DNA, 17 bp, Homo sapiens
ctctgggcagcctgggg

SEQ ID NO: 7358717 - DNA, 22 bp, Homo sapiens
ctctggcttctaccttgcagtt

SEQ ID NO: 7358718 - DNA, 22 bp, Homo sapiens
ctctggctggctgggcctcagt

SEQ ID NO: 7358719 - DNA, 23 bp, Homo sapiens
ctctcctgaaggacaagctgccg

SEQ ID NO: 7358720 - DNA, 22 bp, Homo sapiens
ctctcctgggctgaccgtccga

SEQ ID NO: 7358721 - DNA, 22 bp, Homo sapiens
tttgtcttggcctcagttttct

SEQ ID NO: 7358722 - DNA, 22 bp, Homo sapiens
tttgtcttggcctcagttttct

SEQ ID NO: 7358723 - DNA, 22 bp, Homo sapiens
tttgtcttgtaagttaaattca

SEQ ID NO: 7358724 - DNA, 22 bp, Homo sapiens
tttgtgaataggttggcttcca

SEQ ID NO: 7358725 - DNA, 22 bp, Homo sapiens
ctctggttgagtgagaaccaag

SEQ ID NO: 7358726 - DNA, 22 bp, Homo sapiens
ctctggttcgtggtagatttta

SEQ ID NO: 7358727 - DNA, 22 bp, Homo sapiens
ctctggtcttcaaggccacctc

SEQ ID NO: 7358728 - DNA, 22 bp, Homo sapiens
ctctttttcagccttaccaaag

SEQ ID NO: 7358729 - DNA, 22 bp, Homo sapiens
ctgaaagcattaactccacttc

SEQ ID NO: 7358730 - DNA, 22 bp, Homo sapiens
ctgaaattctgcctctgcacaa

SEQ ID NO: 7358731 - DNA, 22 bp, Homo sapiens
ctgaacattcttgaacatctgt

SEQ ID NO: 7358732 - DNA, 22 bp, Homo sapiens
ctgaacatcatagagtgtactt

SEQ ID NO: 7358733 - DNA, 22 bp, Homo sapiens
ctgaagactgctgagaagttac

SEQ ID NO: 7358734 - DNA, 22 bp, Homo sapiens
ctgaagaagtctctaggctatt

SEQ ID NO: 7358735 - DNA, 22 bp, Homo sapiens
ctgagaaatacccaagtctggt

SEQ ID NO: 7358736 - DNA, 22 bp, Homo sapiens
ctgagaaatgcatttttccagc

SEQ ID NO: 7358737 - DNA, 22 bp, Homo sapiens
ctgagaaattctttctttcact

SEQ ID NO: 7358738 - DNA, 22 bp, Homo sapiens
ctgagaagagggtatgtggcgc

SEQ ID NO: 7358739 - DNA, 22 bp, Homo sapiens
ctgaagagcactgtggccagtt

SEQ ID NO: 7358740 - DNA, 22 bp, Homo sapiens
ctgatgttcatttcttttgtac

SEQ ID NO: 7358741 - DNA, 22 bp, Homo sapiens
ctgatcctcctttaagtagctg

SEQ ID NO: 7358742 - DNA, 22 bp, Homo sapiens
ctgatcttaagtaacattattt

SEQ ID NO: 7358743 - DNA, 22 bp, Homo sapiens
ctgaggcagagaatgagtttgt

SEQ ID NO: 7358744 - DNA, 22 bp, Homo sapiens
ctgaggcagagagaacccgggc

SEQ ID NO: 7358745 - DNA, 22 bp, Homo sapiens
ctgaggtttgtccatccttggt

SEQ ID NO: 7358746 - DNA, 22 bp, Homo sapiens
ctgcagacctctgaggtccatg

SEQ ID NO: 7358747 - DNA, 21 bp, Homo sapiens
ctgcagagcatgcaaaatgtt

SEQ ID NO: 7358748 - DNA, 22 bp, Homo sapiens
ctgcagagcatgaggaggtctg

SEQ ID NO: 7358749 - DNA, 22 bp, Homo sapiens
ctgattttcaaaatgtgttaaa

SEQ ID NO: 7358750 - DNA, 22 bp, Homo sapiens
ctgatttctcagttctaggaag

SEQ ID NO: 7358751 - DNA, 22 bp, Homo sapiens
ctgatttctacatggaccacat

SEQ ID NO: 7358752 - DNA, 22 bp, Homo sapiens
ctgatttcatgctatcaatgtt

SEQ ID NO: 7358753 - DNA, 19 bp, Homo sapiens
ctgaggcaagtggtggtca

SEQ ID NO: 7358754 - DNA, 22 bp, Homo sapiens
ctgaggcacagtgaacttctcc

SEQ ID NO: 7358755 - DNA, 22 bp, Homo sapiens
ctgaggagtgggtgggcagtga

SEQ ID NO: 7358756 - DNA, 22 bp, Homo sapiens
ctgaggagtgggtgggcagtga

SEQ ID NO: 7358757 - DNA, 22 bp, Homo sapiens
ctgaggcactaacaaggacaag

SEQ ID NO: 7358758 - DNA, 22 bp, Homo sapiens
ctgaggcacctacagtctcggg

SEQ ID NO: 7358759 - DNA, 22 bp, Homo sapiens
ctgaggcaccggcaatgttctg

SEQ ID NO: 7358760 - DNA, 22 bp, Homo sapiens
ctgaggcacccatcttctcctg

SEQ ID NO: 7358761 - DNA, 22 bp, Homo sapiens
ctgaggcactggtaatgggcat

SEQ ID NO: 7358762 - DNA, 22 bp, Homo sapiens
ctgaggcactgtcagctgaggc

SEQ ID NO: 7358763 - DNA, 22 bp, Homo sapiens
ctgaggcactgtcagctgaggc

SEQ ID NO: 7358764 - DNA, 22 bp, Homo sapiens
ctgaggcagaaaaagcaagggt

SEQ ID NO: 7358765 - DNA, 22 bp, Homo sapiens
ctgagagaaacatgactcagga

SEQ ID NO: 7358766 - DNA, 22 bp, Homo sapiens
ctgaggagaaatgggatggttc

SEQ ID NO: 7358767 - DNA, 22 bp, Homo sapiens
ctgaggagctgaaggccctcca

SEQ ID NO: 7358768 - DNA, 22 bp, Homo sapiens
ctgagagatcaagccacaggat

SEQ ID NO: 7358769 - DNA, 22 bp, Homo sapiens
ctgccaggtgagctccaggcct

SEQ ID NO: 7358770 - DNA, 22 bp, Homo sapiens
ctgccatcctcaccagagcagc

SEQ ID NO: 7358771 - DNA, 22 bp, Homo sapiens
ctgccctggggggcctccttgc

SEQ ID NO: 7358772 - DNA, 22 bp, Homo sapiens
ctgcctcatgctgcctgcagcc

SEQ ID NO: 7358773 - DNA, 22 bp, Homo sapiens
ctgcctcagcgttgtggcccta

SEQ ID NO: 7358774 - DNA, 22 bp, Homo sapiens
ctgcctccaggctcaccttgac

SEQ ID NO: 7358775 - DNA, 22 bp, Homo sapiens
ctgcctcctcacgtccacagtg

SEQ ID NO: 7358776 - DNA, 22 bp, Homo sapiens
ctgccaggctgtcccaggtccg

SEQ ID NO: 7358777 - DNA, 22 bp, Homo sapiens
ctgccaggggcctcacaggcca

SEQ ID NO: 7358778 - DNA, 22 bp, Homo sapiens
ctgccaggtaaactgcaggaat

SEQ ID NO: 7358779 - DNA, 22 bp, Homo sapiens
ctgccagctggagaccaaggaa

SEQ ID NO: 7358780 - DNA, 22 bp, Homo sapiens
ctgcagaggtcttgctgatggt

SEQ ID NO: 7358781 - DNA, 22 bp, Homo sapiens
ctgcagaggggttgaagggtcc

SEQ ID NO: 7358782 - DNA, 22 bp, Homo sapiens
ctgcagagggtttgagcatcct

SEQ ID NO: 7358783 - DNA, 22 bp, Homo sapiens
ctgcagaggcctcgcctcctct

SEQ ID NO: 7358784 - DNA, 22 bp, Homo sapiens
ctgcagagcttgtctggatgtg

SEQ ID NO: 7358785 - DNA, 22 bp, Homo sapiens
ctgcagagctaggctgagtgaa

SEQ ID NO: 7358786 - DNA, 22 bp, Homo sapiens
ctgcagagctaggctgagtgaa

SEQ ID NO: 7358787 - DNA, 22 bp, Homo sapiens
ctggacagaagtggctgggcag

SEQ ID NO: 7358788 - DNA, 22 bp, Homo sapiens
ctggacaggctggggactgcaa

SEQ ID NO: 7358789 - DNA, 22 bp, Homo sapiens
ctggacaggctggggactgcaa

SEQ ID NO: 7358790 - DNA, 22 bp, Homo sapiens
ctggacagaagtggctgggcag

SEQ ID NO: 7358791 - DNA, 22 bp, Homo sapiens
ctggaaagtacagtgtgtcaca

SEQ ID NO: 7358792 - DNA, 22 bp, Homo sapiens
ctggaaagtagacaatctaaaa

SEQ ID NO: 7358793 - DNA, 22 bp, Homo sapiens
ctggaaagtagatgtactaagg

SEQ ID NO: 7358794 - DNA, 22 bp, Homo sapiens
ctggaaaatgaagaagcagagg

SEQ ID NO: 7358795 - DNA, 22 bp, Homo sapiens
ctgctttttctaggaggacaat

SEQ ID NO: 7358796 - DNA, 22 bp, Homo sapiens
ctggaaagatttctttggagtc

SEQ ID NO: 7358797 - DNA, 22 bp, Homo sapiens
ctggaaagctgcaggacccaga

SEQ ID NO: 7358798 - DNA, 16 bp, Homo sapiens
ctggaaaggctagctc

SEQ ID NO: 7358799 - DNA, 22 bp, Homo sapiens
ctggaaagggtcctcattctgt

SEQ ID NO: 7358800 - DNA, 22 bp, Homo sapiens
ctggaaagggtcctcattctgt

SEQ ID NO: 7358801 - DNA, 22 bp, Homo sapiens
ctggaaagacagagggcatggg

SEQ ID NO: 7358802 - DNA, 22 bp, Homo sapiens
ctggaaagacctgcttgctttt

SEQ ID NO: 7358803 - DNA, 22 bp, Homo sapiens
ctggaaagacctgcttgctttt

SEQ ID NO: 7358804 - DNA, 22 bp, Homo sapiens
ctggaaagagatggcagggttt

SEQ ID NO: 7358805 - DNA, 22 bp, Homo sapiens
ctggaaagatttacacggggaa

SEQ ID NO: 7358806 - DNA, 22 bp, Homo sapiens
ctgcctgggccatgcccagtcc

SEQ ID NO: 7358807 - DNA, 22 bp, Homo sapiens
ctgcctgggccatgcccagtcc

SEQ ID NO: 7358808 - DNA, 22 bp, Homo sapiens
ctgcttctaagaacctgcagct

SEQ ID NO: 7358809 - DNA, 22 bp, Homo sapiens
ctgctttatattgagcttgaaa

SEQ ID NO: 7358810 - DNA, 22 bp, Homo sapiens
ctgcctggaaggagcaagggga

SEQ ID NO: 7358811 - DNA, 22 bp, Homo sapiens
ctgcctgctcaccagggctctg

SEQ ID NO: 7358812 - DNA, 22 bp, Homo sapiens
ctgcctgctctatccaggcctg

SEQ ID NO: 7358813 - DNA, 22 bp, Homo sapiens
ctgcctggaccggcagccctcc

SEQ ID NO: 7358814 - DNA, 17 bp, Homo sapiens
ctgcctggagtcccatc

SEQ ID NO: 7358815 - DNA, 22 bp, Homo sapiens
ctgcctggccacaacccagggt

SEQ ID NO: 7358816 - DNA, 22 bp, Homo sapiens
ctggactcactatggcttcaga

SEQ ID NO: 7358817 - DNA, 22 bp, Homo sapiens
ctggactcactatggcttcaga

SEQ ID NO: 7358818 - DNA, 22 bp, Homo sapiens
ctggacagtgggcagaggagac

SEQ ID NO: 7358819 - DNA, 22 bp, Homo sapiens
ctggactcagggtgctccagcg

SEQ ID NO: 7358820 - DNA, 23 bp, Homo sapiens
ctggactcaggggatgtgaagga

SEQ ID NO: 7358821 - DNA, 22 bp, Homo sapiens
ctggactcagggtgctccagcg

SEQ ID NO: 7358822 - DNA, 22 bp, Homo sapiens
ctggactcatccatagaggtga

SEQ ID NO: 7358823 - DNA, 22 bp, Homo sapiens
ctggactctgcagagaaaagta

SEQ ID NO: 7358824 - DNA, 22 bp, Homo sapiens
ctggaggaatcacagaaggctt

SEQ ID NO: 7358825 - DNA, 22 bp, Homo sapiens
ctggaggaataatggcatcttg

SEQ ID NO: 7358826 - DNA, 21 bp, Homo sapiens
ctggaggcaggtggtgccagg

SEQ ID NO: 7358827 - DNA, 22 bp, Homo sapiens
ctggaggctgagttgggtctcc

SEQ ID NO: 7358828 - DNA, 22 bp, Homo sapiens
ctggaggctggcttcccctggc

SEQ ID NO: 7358829 - DNA, 22 bp, Homo sapiens
ctggaggagcatggactggagt

SEQ ID NO: 7358830 - DNA, 22 bp, Homo sapiens
ctggaggcaaagcagaggcatg

SEQ ID NO: 7358831 - DNA, 22 bp, Homo sapiens
ctggaggacccctgcctggaag

SEQ ID NO: 7358832 - DNA, 22 bp, Homo sapiens
ctggaggaccacagaagctggt

SEQ ID NO: 7358833 - DNA, 22 bp, Homo sapiens
ctggagggactttctcacggat

SEQ ID NO: 7358834 - DNA, 22 bp, Homo sapiens
ctggagggacaaggtatgcatt

SEQ ID NO: 7358835 - DNA, 22 bp, Homo sapiens
ctggagggactttctcacggat

SEQ ID NO: 7358836 - DNA, 22 bp, Homo sapiens
ctggagggctggactaaggaaa

SEQ ID NO: 7358837 - DNA, 22 bp, Homo sapiens
ctggaggggctggcatggtagc

SEQ ID NO: 7358838 - DNA, 22 bp, Homo sapiens
ctggaggggccatccacagtct

SEQ ID NO: 7358839 - DNA, 22 bp, Homo sapiens
ctggagggcttctgcaggttac

SEQ ID NO: 7358840 - DNA, 22 bp, Homo sapiens
ctggaggggccatccacagtct

SEQ ID NO: 7358841 - DNA, 21 bp, Homo sapiens
ctggagggtagagttgggctg

SEQ ID NO: 7358842 - DNA, 22 bp, Homo sapiens
ctggagggggaaatgttcattg

SEQ ID NO: 7358843 - DNA, 21 bp, Homo sapiens
ctggagggtagagttgggctg

SEQ ID NO: 7358844 - DNA, 21 bp, Homo sapiens
ctggagggtagagttgggctg

SEQ ID NO: 7358845 - DNA, 22 bp, Homo sapiens
ctggagggtgagcctcatctct

SEQ ID NO: 7358846 - DNA, 22 bp, Homo sapiens
ctggagggtggagagaagtctc

SEQ ID NO: 7358847 - DNA, 22 bp, Homo sapiens
ctggaggtagatggtggtaatg

SEQ ID NO: 7358848 - DNA, 22 bp, Homo sapiens
ctggaggtcatgtaatatggaa

SEQ ID NO: 7358849 - DNA, 22 bp, Homo sapiens
ctggagtagccggacgggtctg

SEQ ID NO: 7358850 - DNA, 22 bp, Homo sapiens
ctggagtaagttaagatgttcc

SEQ ID NO: 7358851 - DNA, 22 bp, Homo sapiens
ctggaggttgggtccaggccag

SEQ ID NO: 7358852 - DNA, 22 bp, Homo sapiens
ctggaggttgggtccaggccag

SEQ ID NO: 7358853 - DNA, 22 bp, Homo sapiens
ctggaggtgcctagatgagctc

SEQ ID NO: 7358854 - DNA, 22 bp, Homo sapiens
ctggaggtgcctagatgagctc

SEQ ID NO: 7358855 - DNA, 22 bp, Homo sapiens
ctggaggtgggggcaagagtgt

SEQ ID NO: 7358856 - DNA, 22 bp, Homo sapiens
ctggaggtgcttcgctggccac

SEQ ID NO: 7358857 - DNA, 20 bp, Homo sapiens
ctggagtgtagcagtggctg

SEQ ID NO: 7358858 - DNA, 22 bp, Homo sapiens
ctggagttcgactgagttgaat

SEQ ID NO: 7358859 - DNA, 22 bp, Homo sapiens
ctggagttttggaaaaatgctt

SEQ ID NO: 7358860 - DNA, 22 bp, Homo sapiens
ctggatgctgagaggtaccaag

SEQ ID NO: 7358861 - DNA, 20 bp, Homo sapiens
ctggatgctaaaacacacac

SEQ ID NO: 7358862 - DNA, 22 bp, Homo sapiens
ctggatgcttcctctctgctag

SEQ ID NO: 7358863 - DNA, 22 bp, Homo sapiens
ctggatcccgtctgagcctcct

SEQ ID NO: 7358864 - DNA, 22 bp, Homo sapiens
ctggataaatgctttagttgga

SEQ ID NO: 7358865 - DNA, 22 bp, Homo sapiens
ctggataatcacagaggagcat

SEQ ID NO: 7358866 - DNA, 22 bp, Homo sapiens
ctggatttactgagttttatca

SEQ ID NO: 7358867 - DNA, 21 bp, Homo sapiens
ctggcatgaggagctttgttt

SEQ ID NO: 7358868 - DNA, 22 bp, Homo sapiens
ctggccaatccattaatttgtt

SEQ ID NO: 7358869 - DNA, 22 bp, Homo sapiens
ctggcatgcccagggtatgtgg

SEQ ID NO: 7358870 - DNA, 22 bp, Homo sapiens
ctggcatgccttgggtgcctct

SEQ ID NO: 7358871 - DNA, 22 bp, Homo sapiens
ctggcatggtgtatttgttcaa

SEQ ID NO: 7358872 - DNA, 22 bp, Homo sapiens
ctggcatgtgtttggctcctgt

SEQ ID NO: 7358873 - DNA, 22 bp, Homo sapiens
ctggctccagtgacaagtcgat

SEQ ID NO: 7358874 - DNA, 22 bp, Homo sapiens
ctggccctgtggcctaaggact

SEQ ID NO: 7358875 - DNA, 22 bp, Homo sapiens
ctggcctgagaatgctaccctt

SEQ ID NO: 7358876 - DNA, 22 bp, Homo sapiens
ctggcctgagcacagcggctgc

SEQ ID NO: 7358877 - DNA, 22 bp, Homo sapiens
ctggccagttgtcctggcttgg

SEQ ID NO: 7358878 - DNA, 22 bp, Homo sapiens
ctggcccagagagcagagctta

SEQ ID NO: 7358879 - DNA, 22 bp, Homo sapiens
ctggcccaggctcctggggcac

SEQ ID NO: 7358880 - DNA, 21 bp, Homo sapiens
ctggcccagggatctgcattt

SEQ ID NO: 7358881 - DNA, 23 bp, Homo sapiens
ctggcccaggtgagaggttggtg

SEQ ID NO: 7358882 - DNA, 22 bp, Homo sapiens
ctggcccagagctctggccttt

SEQ ID NO: 7358883 - DNA, 22 bp, Homo sapiens
ctggcccaggaagacgtgtccc

SEQ ID NO: 7358884 - DNA, 22 bp, Homo sapiens
ctggcccaggagagcaggcatt

SEQ ID NO: 7358885 - DNA, 20 bp, Homo sapiens
ctggcccaggatgatggcgc

SEQ ID NO: 7358886 - DNA, 23 bp, Homo sapiens
ctaggcaggattgtaggcgggta

SEQ ID NO: 7358887 - DNA, 22 bp, Homo sapiens
ctaggcatgtgaggaattctaa

SEQ ID NO: 7358888 - DNA, 22 bp, Homo sapiens
ttccttctaattttacacctga

SEQ ID NO: 7358889 - DNA, 22 bp, Homo sapiens
ttcctttctctggactgcagcc

SEQ ID NO: 7358890 - DNA, 22 bp, Homo sapiens
ttctgtccactgctggggcctc

SEQ ID NO: 7358891 - DNA, 22 bp, Homo sapiens
ttctgtatacgttacaattgag

SEQ ID NO: 7358892 - DNA, 22 bp, Homo sapiens
ttctgtatttagtttgaggaca

SEQ ID NO: 7358893 - DNA, 22 bp, Homo sapiens
ttctgtcaaagactttttcagg

SEQ ID NO: 7358894 - DNA, 22 bp, Homo sapiens
ctattttaacttgattacctct

SEQ ID NO: 7358895 - DNA, 22 bp, Homo sapiens
ctatttatgtgctattttgtat

SEQ ID NO: 7358896 - DNA, 22 bp, Homo sapiens
ctatttcaaggcccagatatga

SEQ ID NO: 7358897 - DNA, 22 bp, Homo sapiens
ctattcaattttgctattgtag

SEQ ID NO: 7358898 - DNA, 22 bp, Homo sapiens
ctatttgtacagcattagtaat

SEQ ID NO: 7358899 - DNA, 22 bp, Homo sapiens
ctatttcattgtgctgagtctg

SEQ ID NO: 7358900 - DNA, 23 bp, Homo sapiens
ctatttctcatagttcaggtctt

SEQ ID NO: 7358901 - DNA, 22 bp, Homo sapiens
ctatttctacacagggtcggcg

SEQ ID NO: 7358902 - DNA, 22 bp, Homo sapiens
ctatttcaaggcccagatatga

SEQ ID NO: 7358903 - DNA, 22 bp, Homo sapiens
ctatttcagcagaagccggaga

SEQ ID NO: 7358904 - DNA, 22 bp, Homo sapiens
ttgagaaacatctaatctttgt

SEQ ID NO: 7358905 - DNA, 22 bp, Homo sapiens
ttgagaaaatagttcgaatgtt

SEQ ID NO: 7358906 - DNA, 22 bp, Homo sapiens
ttgacttttcttggtcacatga

SEQ ID NO: 7358907 - DNA, 22 bp, Homo sapiens
ttgagaaaacattgagggccat

SEQ ID NO: 7358908 - DNA, 22 bp, Homo sapiens
ttgaggaggaaaagggggtacc

SEQ ID NO: 7358909 - DNA, 22 bp, Homo sapiens
ttgaggaggaactgtgaggcaa

SEQ ID NO: 7358910 - DNA, 22 bp, Homo sapiens
ttgaggagaagactttgcttcc

SEQ ID NO: 7358911 - DNA, 22 bp, Homo sapiens
ttgaggagcaggatgggaggct

SEQ ID NO: 7358912 - DNA, 22 bp, Homo sapiens
ttgataaaatgatgaaatcact

SEQ ID NO: 7358913 - DNA, 22 bp, Homo sapiens
ttgataaaatgatatcttcttt

SEQ ID NO: 7358914 - DNA, 21 bp, Homo sapiens
ttgaggagtgagagtgggttt

SEQ ID NO: 7358915 - DNA, 23 bp, Homo sapiens
ttgaggagtgctttttctatcca

SEQ ID NO: 7358916 - DNA, 22 bp, Homo sapiens
ttgagtttacattgtattagcc

SEQ ID NO: 7358917 - DNA, 18 bp, Homo sapiens
ttgataaacaatttcatt

SEQ ID NO: 7358918 - DNA, 18 bp, Homo sapiens
ttgataaacaatttcatt

SEQ ID NO: 7358919 - DNA, 22 bp, Homo sapiens
ttcttgttttgcccaagttgta

SEQ ID NO: 7358920 - DNA, 22 bp, Homo sapiens
ttcttgttttgcccaagttgta

SEQ ID NO: 7358921 - DNA, 22 bp, Homo sapiens
ttcttgtttattaagatataaa

SEQ ID NO: 7358922 - DNA, 22 bp, Homo sapiens
ctcagcaggtaccacatgatct

SEQ ID NO: 7358923 - DNA, 17 bp, Homo sapiens
ctcagcagggctcactt

SEQ ID NO: 7358924 - DNA, 22 bp, Homo sapiens
ctcagcagaggcagtattcagt

SEQ ID NO: 7358925 - DNA, 22 bp, Homo sapiens
ttcagaaaggtaaatggatttc

SEQ ID NO: 7358926 - DNA, 22 bp, Homo sapiens
ttcattcttgggatcagagagt

SEQ ID NO: 7358927 - DNA, 22 bp, Homo sapiens
ttcactgttgttagcagaggcg

SEQ ID NO: 7358928 - DNA, 22 bp, Homo sapiens
cggctctgtcctcagcactgct

SEQ ID NO: 7358929 - DNA, 21 bp, Homo sapiens
cggctcagtgcctgctccttc

SEQ ID NO: 7358930 - DNA, 22 bp, Homo sapiens
cggctggggctgtccccatgac

SEQ ID NO: 7358931 - DNA, 22 bp, Homo sapiens
ttcacagtgtttctcacggtta

SEQ ID NO: 7358932 - DNA, 22 bp, Homo sapiens
ttcacagtgttgtgccttttgt

SEQ ID NO: 7358933 - DNA, 22 bp, Homo sapiens
ttcacagtgtgatctatgggca

SEQ ID NO: 7358934 - DNA, 22 bp, Homo sapiens
ttcacagtggtaagggttgtga

SEQ ID NO: 7358935 - DNA, 22 bp, Homo sapiens
ttcacagtggtagtgcatttag

SEQ ID NO: 7358936 - DNA, 22 bp, Homo sapiens
ttcacagtggcttaggctatgg

SEQ ID NO: 7358937 - DNA, 22 bp, Homo sapiens
cctgggtggttccggcaaggag

SEQ ID NO: 7358938 - DNA, 22 bp, Homo sapiens
ttcacagttgggcaggttgtgt

SEQ ID NO: 7358939 - DNA, 22 bp, Homo sapiens
ttcacagttcctgggaaaacag

SEQ ID NO: 7358940 - DNA, 22 bp, Homo sapiens
ttcacagtttaatggcaaggat

SEQ ID NO: 7358941 - DNA, 22 bp, Homo sapiens
ttcacagtttgctgggacagga

SEQ ID NO: 7358942 - DNA, 22 bp, Homo sapiens
ttcacataaatagatcacatca

SEQ ID NO: 7358943 - DNA, 22 bp, Homo sapiens
ttcacataaatagatcacatca

SEQ ID NO: 7358944 - DNA, 22 bp, Homo sapiens
ttcacataatctgcagcaagcg

SEQ ID NO: 7358945 - DNA, 22 bp, Homo sapiens
ttcacataggagcatggttttt

SEQ ID NO: 7358946 - DNA, 22 bp, Homo sapiens
ttcacatataatgtctttaaaa

SEQ ID NO: 7358947 - DNA, 22 bp, Homo sapiens
cggcatgggcgtccccctcact

SEQ ID NO: 7358948 - DNA, 22 bp, Homo sapiens
cggctcaggccacaggacggca

SEQ ID NO: 7358949 - DNA, 22 bp, Homo sapiens
cggacaggctcctggagctcct

SEQ ID NO: 7358950 - DNA, 22 bp, Homo sapiens
cggacaggctcctggagctcct

SEQ ID NO: 7358951 - DNA, 22 bp, Homo sapiens
cgctgggggaacttcagccaat

SEQ ID NO: 7358952 - DNA, 22 bp, Homo sapiens
cgctgggggaacttcagccaat

SEQ ID NO: 7358953 - DNA, 22 bp, Homo sapiens
ttcacattacaaggccatattt

SEQ ID NO: 7358954 - DNA, 22 bp, Homo sapiens
cgctgggggaacagcgagggtg

SEQ ID NO: 7358955 - DNA, 22 bp, Homo sapiens
cgctgggggaacagcgagggtg

SEQ ID NO: 7358956 - DNA, 22 bp, Homo sapiens
cgctgggggaacttcagccaat

SEQ ID NO: 7358957 - DNA, 22 bp, Homo sapiens
cgctggggctttttgcttgaga

SEQ ID NO: 7358958 - DNA, 22 bp, Homo sapiens
cgctggggctttttgcttgaga

SEQ ID NO: 7358959 - DNA, 22 bp, Homo sapiens
ctaatttaatgaatgagtctta

SEQ ID NO: 7358960 - DNA, 22 bp, Homo sapiens
ctaattttcccaaggccttcta

SEQ ID NO: 7358961 - DNA, 22 bp, Homo sapiens
ctaatttttgttctgcattgaa

SEQ ID NO: 7358962 - DNA, 22 bp, Homo sapiens
ctaatttttgttctgcattgaa

SEQ ID NO: 7358963 - DNA, 22 bp, Homo sapiens
ctaatactcatttctgtaactc

SEQ ID NO: 7358964 - DNA, 22 bp, Homo sapiens
ctaagggcttgctggagccagg

SEQ ID NO: 7358965 - DNA, 22 bp, Homo sapiens
ttcccacattctttacattcat

SEQ ID NO: 7358966 - DNA, 22 bp, Homo sapiens
ttcccacagtgactccagagaa

SEQ ID NO: 7358967 - DNA, 22 bp, Homo sapiens
ttcccacagtgttgaatcctct

SEQ ID NO: 7358968 - DNA, 22 bp, Homo sapiens
ttcccacaggatgagagctgag

SEQ ID NO: 7358969 - DNA, 22 bp, Homo sapiens
ttcccacagtcactgggagaag

SEQ ID NO: 7358970 - DNA, 22 bp, Homo sapiens
ttccgctgtttagttgaagttt

SEQ ID NO: 7358971 - DNA, 22 bp, Homo sapiens
ttccggggatagtgtttcccat

SEQ ID NO: 7358972 - DNA, 22 bp, Homo sapiens
ttcctaaaagaatacactggat

SEQ ID NO: 7358973 - DNA, 22 bp, Homo sapiens
ttccgagggctcggcggccgcc

SEQ ID NO: 7358974 - DNA, 22 bp, Homo sapiens
ttccgctggggccgcctggcgg

SEQ ID NO: 7358975 - DNA, 22 bp, Homo sapiens
ttccctttcttaaagagttagg

SEQ ID NO: 7358976 - DNA, 22 bp, Homo sapiens
ttccaaatgcccatctacacag

SEQ ID NO: 7358977 - DNA, 22 bp, Homo sapiens
ttcccaaagctttgtctgtgaa

SEQ ID NO: 7358978 - DNA, 22 bp, Homo sapiens
ttcccacaacagatctgtatta

SEQ ID NO: 7358979 - DNA, 22 bp, Homo sapiens
ttcccacacaattaagtcattt

SEQ ID NO: 7358980 - DNA, 22 bp, Homo sapiens
ttccatttggcacttcactgag

SEQ ID NO: 7358981 - DNA, 22 bp, Homo sapiens
ttccatttattcttgtccagat

SEQ ID NO: 7358982 - DNA, 22 bp, Homo sapiens
ttccaaatgttggacaactgta

SEQ ID NO: 7358983 - DNA, 22 bp, Homo sapiens
tttagacaggggcaaaataagg

SEQ ID NO: 7358984 - DNA, 22 bp, Homo sapiens
tttagacatctataattgctaa

SEQ ID NO: 7358985 - DNA, 17 bp, Homo sapiens
ctcctctctgggttact

SEQ ID NO: 7358986 - DNA, 17 bp, Homo sapiens
ctcctctctgggttact

SEQ ID NO: 7358987 - DNA, 22 bp, Homo sapiens
ctcctctctggagttatgcaga

SEQ ID NO: 7358988 - DNA, 22 bp, Homo sapiens
tttagacagcggctctgaacca

SEQ ID NO: 7358989 - DNA, 16 bp, Homo sapiens
ctcctctccttcagga

SEQ ID NO: 7358990 - DNA, 22 bp, Homo sapiens
ctcctctctggagttatgcaga

SEQ ID NO: 7358991 - DNA, 22 bp, Homo sapiens
ctcctcccaattgccaagtgct

SEQ ID NO: 7358992 - DNA, 22 bp, Homo sapiens
ctcctctccatcagcgccaccc

SEQ ID NO: 7358993 - DNA, 22 bp, Homo sapiens
ctcctctggaaattcctctgcc

SEQ ID NO: 7358994 - DNA, 22 bp, Homo sapiens
ctcctctggaaattcctctgcc

SEQ ID NO: 7358995 - DNA, 22 bp, Homo sapiens
ctcctgagaattttcagttgga

SEQ ID NO: 7358996 - DNA, 22 bp, Homo sapiens
ctcctctttagccccagctgga

SEQ ID NO: 7358997 - DNA, 22 bp, Homo sapiens
ctcctctttagccccagctgga

SEQ ID NO: 7358998 - DNA, 22 bp, Homo sapiens
ctcctctttacccgcatggtct

SEQ ID NO: 7358999 - DNA, 22 bp, Homo sapiens
ctcctcttggaatgcgtggctc

SEQ ID NO: 7359000 - DNA, 22 bp, Homo sapiens
ctcctctggcttcctggaggca

SEQ ID NO: 7359001 - DNA, 22 bp, Homo sapiens
ctcctctgtctaccacgagggt

SEQ ID NO: 7359002 - DNA, 22 bp, Homo sapiens
tttaacactcagtttaatagcc

SEQ ID NO: 7359003 - DNA, 22 bp, Homo sapiens
tttaacactagtttctttaact

SEQ ID NO: 7359004 - DNA, 22 bp, Homo sapiens
tttaaatttagaagaaacactg

SEQ ID NO: 7359005 - DNA, 22 bp, Homo sapiens
tttaaaaccaaagaaagcctct

SEQ ID NO: 7359006 - DNA, 22 bp, Homo sapiens
tttacatgagtagcagatgttc

SEQ ID NO: 7359007 - DNA, 22 bp, Homo sapiens
tttacatgtcaagactggcagt

SEQ ID NO: 7359008 - DNA, 22 bp, Homo sapiens
tttacatgtccttcaagagcag

SEQ ID NO: 7359009 - DNA, 22 bp, Homo sapiens
tttacatgtccttcaagagcag

SEQ ID NO: 7359010 - DNA, 22 bp, Homo sapiens
tttacatgtaatgttatacaaa

SEQ ID NO: 7359011 - DNA, 22 bp, Homo sapiens
tttcagttcagtttattatatc

SEQ ID NO: 7359012 - DNA, 22 bp, Homo sapiens
tttcagttgtcctgttaatagc

SEQ ID NO: 7359013 - DNA, 22 bp, Homo sapiens
tttcagttgtcctgttaatagc

SEQ ID NO: 7359014 - DNA, 22 bp, Homo sapiens
tttcagttgtcctgttaatagc

SEQ ID NO: 7359015 - DNA, 22 bp, Homo sapiens
tttcagttctgtacaagtccag

SEQ ID NO: 7359016 - DNA, 22 bp, Homo sapiens
tttcagttcatgtattccgagt

SEQ ID NO: 7359017 - DNA, 22 bp, Homo sapiens
ctctcctccaggaactcacagt

SEQ ID NO: 7359018 - DNA, 22 bp, Homo sapiens
ctctcctcccatgtaggagatg

SEQ ID NO: 7359019 - DNA, 22 bp, Homo sapiens
ctctcctcagaacaggccctct

SEQ ID NO: 7359020 - DNA, 22 bp, Homo sapiens
ctctccactcagcgtcatgtcc

SEQ ID NO: 7359021 - DNA, 22 bp, Homo sapiens
ctcctgggctgggaactcagcc

SEQ ID NO: 7359022 - DNA, 18 bp, Homo sapiens
ctcctgggctgcagatgc

SEQ ID NO: 7359023 - DNA, 18 bp, Homo sapiens
ctcctgggctgcagatgc

SEQ ID NO: 7359024 - DNA, 19 bp, Homo sapiens
ctctccagctccagtagct

SEQ ID NO: 7359025 - DNA, 22 bp, Homo sapiens
ctctccagcctttagcccacgc

SEQ ID NO: 7359026 - DNA, 22 bp, Homo sapiens
ctcctgggagctgtggcagagc

SEQ ID NO: 7359027 - DNA, 22 bp, Homo sapiens
ctcctgggagcagggatggatg

SEQ ID NO: 7359028 - DNA, 22 bp, Homo sapiens
ctcctgggctatgtctgcttgg

SEQ ID NO: 7359029 - DNA, 22 bp, Homo sapiens
ttggatgatttccagtgtgaga

SEQ ID NO: 7359030 - DNA, 22 bp, Homo sapiens
ttggatgaggttgagaatcatt

SEQ ID NO: 7359031 - DNA, 22 bp, Homo sapiens
ttgcttttgtgtgctctctgga

SEQ ID NO: 7359032 - DNA, 22 bp, Homo sapiens
ttgcttttccctgtctctgatt

SEQ ID NO: 7359033 - DNA, 22 bp, Homo sapiens
ttgcttttaatctttgtacatc

SEQ ID NO: 7359034 - DNA, 22 bp, Homo sapiens
ctcagtttctgacattaaaatc

SEQ ID NO: 7359035 - DNA, 22 bp, Homo sapiens
ctcagtttcttcatattgtagg

SEQ ID NO: 7359036 - DNA, 20 bp, Homo sapiens
ctcatctctgagcctcctgg

SEQ ID NO: 7359037 - DNA, 22 bp, Homo sapiens
ttgggatctcaaatccagctat

SEQ ID NO: 7359038 - DNA, 22 bp, Homo sapiens
ttgggcagaggccaggaggatg

SEQ ID NO: 7359039 - DNA, 22 bp, Homo sapiens
ttgggcagaggccaggaggatg

SEQ ID NO: 7359040 - DNA, 22 bp, Homo sapiens
ttgggcagaggctgtgcagagg

SEQ ID NO: 7359041 - DNA, 22 bp, Homo sapiens
ttgggcagaggctgtgcagagg

SEQ ID NO: 7359042 - DNA, 22 bp, Homo sapiens
ttgggcagcattgcagttccct

SEQ ID NO: 7359043 - DNA, 22 bp, Homo sapiens
ttgggcagatgtttcctgtgga

SEQ ID NO: 7359044 - DNA, 22 bp, Homo sapiens
ttgggcagcattgcagttccct

SEQ ID NO: 7359045 - DNA, 22 bp, Homo sapiens
ttgggcaggaacagatgcttga

SEQ ID NO: 7359046 - DNA, 23 bp, Homo sapiens
ttgggcaggagagtaatgtgatc

SEQ ID NO: 7359047 - DNA, 22 bp, Homo sapiens
ttgggcaggaacagatgcttga

SEQ ID NO: 7359048 - DNA, 22 bp, Homo sapiens
ttgggcaggcacatagagttta

SEQ ID NO: 7359049 - DNA, 22 bp, Homo sapiens
ttgggcaggatgacaccacttg

SEQ ID NO: 7359050 - DNA, 22 bp, Homo sapiens
ttgggcaggctggcagactgct

SEQ ID NO: 7359051 - DNA, 22 bp, Homo sapiens
ttgggcaggctggcagactgct

SEQ ID NO: 7359052 - DNA, 22 bp, Homo sapiens
ctcatccaccctcaacaaagat

SEQ ID NO: 7359053 - DNA, 22 bp, Homo sapiens
ctcataatgtgactgtatttga

SEQ ID NO: 7359054 - DNA, 22 bp, Homo sapiens
ctcataatgtgactgtatttga

SEQ ID NO: 7359055 - DNA, 22 bp, Homo sapiens
ctcataaagtgagaatatgacc

SEQ ID NO: 7359056 - DNA, 22 bp, Homo sapiens
ctcataaagtgagaatatgacc

SEQ ID NO: 7359057 - DNA, 22 bp, Homo sapiens
ctcataaacaattctttgaggt

SEQ ID NO: 7359058 - DNA, 22 bp, Homo sapiens
ttgttaaaatgaggtcattctg

SEQ ID NO: 7359059 - DNA, 22 bp, Homo sapiens
ttgttaaaatattggagaaagg

SEQ ID NO: 7359060 - DNA, 22 bp, Homo sapiens
ttgttaaaatattggagaaagg

SEQ ID NO: 7359061 - DNA, 22 bp, Homo sapiens
ttgttaaaatattggagaaagg

SEQ ID NO: 7359062 - DNA, 22 bp, Homo sapiens
ttgttaaaatgcatattctggt

SEQ ID NO: 7359063 - DNA, 22 bp, Homo sapiens
ttgttaaaattggagccgagag

SEQ ID NO: 7359064 - DNA, 22 bp, Homo sapiens
ttgtattttgttatgctactgc

SEQ ID NO: 7359065 - DNA, 22 bp, Homo sapiens
ttgttaaaactccattggtttg

SEQ ID NO: 7359066 - DNA, 22 bp, Homo sapiens
ttgttaaaaatagatttccagg

SEQ ID NO: 7359067 - DNA, 22 bp, Homo sapiens
ttgttaaaggcaaaacaagcac

SEQ ID NO: 7359068 - DNA, 22 bp, Homo sapiens
ttgttaaagatgcagattccat

SEQ ID NO: 7359069 - DNA, 22 bp, Homo sapiens
ttgttaaatggatgcagaataa

SEQ ID NO: 7359070 - DNA, 22 bp, Homo sapiens
tttaaaaaactagtctgagtct

SEQ ID NO: 7359071 - DNA, 22 bp, Homo sapiens
tttaaaaaactagtctgagtct

SEQ ID NO: 7359072 - DNA, 22 bp, Homo sapiens
ttgtttcatggggatgtttatt

SEQ ID NO: 7359073 - DNA, 22 bp, Homo sapiens
ctccaggcgcttaccaagcgct

SEQ ID NO: 7359074 - DNA, 22 bp, Homo sapiens
ctccagggagctgcgggagcca

SEQ ID NO: 7359075 - DNA, 20 bp, Homo sapiens
ttggtaaggatgaagagcaa

SEQ ID NO: 7359076 - DNA, 22 bp, Homo sapiens
ttgtatttgattgtcatatcgt

SEQ ID NO: 7359077 - DNA, 22 bp, Homo sapiens
ctccagggatgagacagagtag

SEQ ID NO: 7359078 - DNA, 22 bp, Homo sapiens
ctccagggcagcatggcagtgg

SEQ ID NO: 7359079 - DNA, 22 bp, Homo sapiens
ctccagggaggtctgcaggact

SEQ ID NO: 7359080 - DNA, 22 bp, Homo sapiens
ctccaggggccagaagcctggc

SEQ ID NO: 7359081 - DNA, 22 bp, Homo sapiens
tacagtttgttacattgttagt

SEQ ID NO: 7359082 - DNA, 22 bp, Homo sapiens
tacatcatgaaagcatacatca

SEQ ID NO: 7359083 - DNA, 22 bp, Homo sapiens
tacatcatgaaagcatacatca

SEQ ID NO: 7359084 - DNA, 22 bp, Homo sapiens
tacatcaagataaaaactgtca

SEQ ID NO: 7359085 - DNA, 21 bp, Homo sapiens
tacatcagttttcttggctca

SEQ ID NO: 7359086 - DNA, 22 bp, Homo sapiens
tacatgtgataaattgattaaa

SEQ ID NO: 7359087 - DNA, 22 bp, Homo sapiens
tacagtaaagctgctatgaatt

SEQ ID NO: 7359088 - DNA, 22 bp, Homo sapiens
tacagtttgtgtggagctggag

SEQ ID NO: 7359089 - DNA, 18 bp, Homo sapiens
caggccctgtctggcctc

SEQ ID NO: 7359090 - DNA, 18 bp, Homo sapiens
caggccctgtctggcctc

SEQ ID NO: 7359091 - DNA, 22 bp, Homo sapiens
caggccctgggcaggatcagcc

SEQ ID NO: 7359092 - DNA, 22 bp, Homo sapiens
tacaagtaaattgtagatacca

SEQ ID NO: 7359093 - DNA, 20 bp, Homo sapiens
tacaagtacattatagttat

SEQ ID NO: 7359094 - DNA, 22 bp, Homo sapiens
tacaagtatggaatgattctca

SEQ ID NO: 7359095 - DNA, 22 bp, Homo sapiens
tacaagtactgtggctttgaat

SEQ ID NO: 7359096 - DNA, 22 bp, Homo sapiens
tacaagtactgtggctttgaat

SEQ ID NO: 7359097 - DNA, 22 bp, Homo sapiens
tacagggctgagtgagacatgg

SEQ ID NO: 7359098 - DNA, 22 bp, Homo sapiens
tacaggggtaacagtggggaat

SEQ ID NO: 7359099 - DNA, 22 bp, Homo sapiens
tacagctggactggtagctgtg

SEQ ID NO: 7359100 - DNA, 20 bp, Homo sapiens
tacaatacacatgcatatga

SEQ ID NO: 7359101 - DNA, 20 bp, Homo sapiens
tacaaacctccacactggtg

SEQ ID NO: 7359102 - DNA, 22 bp, Homo sapiens
caggcagggagctggaaaggat

SEQ ID NO: 7359103 - DNA, 22 bp, Homo sapiens
tacaaatgaaccaactttgatg

SEQ ID NO: 7359104 - DNA, 22 bp, Homo sapiens
tacaaggaaaatcttgaagtac

SEQ ID NO: 7359105 - DNA, 22 bp, Homo sapiens
tacaaattaatgggcatgttta

SEQ ID NO: 7359106 - DNA, 22 bp, Homo sapiens
caggcagcatcagtctgctgta

SEQ ID NO: 7359107 - DNA, 22 bp, Homo sapiens
caggcagctgactgtcagatat

SEQ ID NO: 7359108 - DNA, 22 bp, Homo sapiens
caggcagctctaatggaaagtg

SEQ ID NO: 7359109 - DNA, 22 bp, Homo sapiens
caggcagccctgcaccaagtgt

SEQ ID NO: 7359110 - DNA, 22 bp, Homo sapiens
caggcaggagaggaggatttct

SEQ ID NO: 7359111 - DNA, 23 bp, Homo sapiens
caggcaggatgaggactacactc

SEQ ID NO: 7359112 - DNA, 23 bp, Homo sapiens
caggcaggatgaggactacactc

SEQ ID NO: 7359113 - DNA, 22 bp, Homo sapiens
caggcagctgggtcaccgtccc

SEQ ID NO: 7359114 - DNA, 22 bp, Homo sapiens
caggcagctgctgggttcagcc

SEQ ID NO: 7359115 - DNA, 22 bp, Homo sapiens
caggcagctgcgacaagagagc

SEQ ID NO: 7359116 - DNA, 22 bp, Homo sapiens
caggcagagaggagcatttaat

SEQ ID NO: 7359117 - DNA, 22 bp, Homo sapiens
caggcagagaactcatccgtga

SEQ ID NO: 7359118 - DNA, 22 bp, Homo sapiens
caggcagagaccctctcctaaa

SEQ ID NO: 7359119 - DNA, 22 bp, Homo sapiens
caggcagaatgaccgacctcgc

SEQ ID NO: 7359120 - DNA, 22 bp, Homo sapiens
caggcagagcaactggtccaga

SEQ ID NO: 7359121 - DNA, 22 bp, Homo sapiens
taatgtttagaagcagacagct

SEQ ID NO: 7359122 - DNA, 22 bp, Homo sapiens
taattggcagtaatgtgattta

SEQ ID NO: 7359123 - DNA, 22 bp, Homo sapiens
taattgtcatcgtagtaaacat

SEQ ID NO: 7359124 - DNA, 22 bp, Homo sapiens
taattgtcctcggtccaaatga

SEQ ID NO: 7359125 - DNA, 22 bp, Homo sapiens
taattgtatggagaaggctgca

SEQ ID NO: 7359126 - DNA, 22 bp, Homo sapiens
taattgtcttagtctgtgcagg

SEQ ID NO: 7359127 - DNA, 22 bp, Homo sapiens
taatttactcagatgttcaatc

SEQ ID NO: 7359128 - DNA, 22 bp, Homo sapiens
caggcactagcagaatgaggct

SEQ ID NO: 7359129 - DNA, 22 bp, Homo sapiens
taaggcacgcggtgaatgccaa

SEQ ID NO: 7359130 - DNA, 22 bp, Homo sapiens
taaggcacttcaatgtttagaa

SEQ ID NO: 7359131 - DNA, 22 bp, Homo sapiens
taaggcacgcataagagggggc

SEQ ID NO: 7359132 - DNA, 22 bp, Homo sapiens
taaggcacctgtccaggctggg

SEQ ID NO: 7359133 - DNA, 22 bp, Homo sapiens
taaggcacccttctgagtagag

SEQ ID NO: 7359134 - DNA, 22 bp, Homo sapiens
taaggcacccgtgagctgccag

SEQ ID NO: 7359135 - DNA, 22 bp, Homo sapiens
taaggcaccataatatatttaa

SEQ ID NO: 7359136 - DNA, 22 bp, Homo sapiens
taaggcacccatgttcatacag

SEQ ID NO: 7359137 - DNA, 22 bp, Homo sapiens
taaggcacacagttgctgcatg

SEQ ID NO: 7359138 - DNA, 22 bp, Homo sapiens
taagatgtacaaccacttctct

SEQ ID NO: 7359139 - DNA, 22 bp, Homo sapiens
taagcaaaagtcgagtgtgagc

SEQ ID NO: 7359140 - DNA, 22 bp, Homo sapiens
caggcaaggagctggctcaagt

SEQ ID NO: 7359141 - DNA, 22 bp, Homo sapiens
caggcacaaaaggaccccagca

SEQ ID NO: 7359142 - DNA, 22 bp, Homo sapiens
caggcaataaagggttggttgg

SEQ ID NO: 7359143 - DNA, 22 bp, Homo sapiens
caggcacagttccaagcatttt

SEQ ID NO: 7359144 - DNA, 22 bp, Homo sapiens
caggcacagagttattcattta

SEQ ID NO: 7359145 - DNA, 22 bp, Homo sapiens
taacaactgaggaagaggcaga

SEQ ID NO: 7359146 - DNA, 22 bp, Homo sapiens
taacagaaaggctcaggtgctc

SEQ ID NO: 7359147 - DNA, 22 bp, Homo sapiens
taacagaagttgttcattgtgg

SEQ ID NO: 7359148 - DNA, 22 bp, Homo sapiens
taacattgtcagttcaactgct

SEQ ID NO: 7359149 - DNA, 22 bp, Homo sapiens
taacatttaaatttttcacata

SEQ ID NO: 7359150 - DNA, 22 bp, Homo sapiens
taacagaaatagaaatgagagt

SEQ ID NO: 7359151 - DNA, 22 bp, Homo sapiens
caggatgcttctggggccaggc

SEQ ID NO: 7359152 - DNA, 21 bp, Homo sapiens
caggatgatgataattcatgg

SEQ ID NO: 7359153 - DNA, 20 bp, Homo sapiens
caggatgattggacacgatg

SEQ ID NO: 7359154 - DNA, 22 bp, Homo sapiens
caggatgcagtgggacccaggg

SEQ ID NO: 7359155 - DNA, 22 bp, Homo sapiens
caggatcctggctgcatggacg

SEQ ID NO: 7359156 - DNA, 22 bp, Homo sapiens
caggatccctggcctccgccca

SEQ ID NO: 7359157 - DNA, 22 bp, Homo sapiens
caggatccccaggtcgccgtcc

SEQ ID NO: 7359158 - DNA, 22 bp, Homo sapiens
caggatgaggtagaggcagata

SEQ ID NO: 7359159 - DNA, 22 bp, Homo sapiens
taagaaacatttttatgacagt

SEQ ID NO: 7359160 - DNA, 22 bp, Homo sapiens
taacatttcggtgacagtggga

SEQ ID NO: 7359161 - DNA, 16 bp, Homo sapiens
taacatttttaaaagg

SEQ ID NO: 7359162 - DNA, 22 bp, Homo sapiens
caggaatgtttgtgctccttta

SEQ ID NO: 7359163 - DNA, 22 bp, Homo sapiens
caggacacagggtgtggctgat

SEQ ID NO: 7359164 - DNA, 22 bp, Homo sapiens
caggacacagggtgtggctgat

SEQ ID NO: 7359165 - DNA, 22 bp, Homo sapiens
caggacaccttagctaaaattc

SEQ ID NO: 7359166 - DNA, 22 bp, Homo sapiens
caggacacatttcttgttcagg

SEQ ID NO: 7359167 - DNA, 22 bp, Homo sapiens
caggacactaaaaagccaagct

SEQ ID NO: 7359168 - DNA, 22 bp, Homo sapiens
caggacacagaataaggcagtt

SEQ ID NO: 7359169 - DNA, 22 bp, Homo sapiens
caggacaatttccacttggtaa

SEQ ID NO: 7359170 - DNA, 22 bp, Homo sapiens
caggaatgagttctggtgctct

SEQ ID NO: 7359171 - DNA, 22 bp, Homo sapiens
caggaatgatattcgaggagat

SEQ ID NO: 7359172 - DNA, 18 bp, Homo sapiens
caggaatggatgggattt

SEQ ID NO: 7359173 - DNA, 22 bp, Homo sapiens
caggaatgggtgacagtcagct

SEQ ID NO: 7359174 - DNA, 22 bp, Homo sapiens
caggaatgtatgatacagtggt

SEQ ID NO: 7359175 - DNA, 22 bp, Homo sapiens
caggacaggtgttctagatcag

SEQ ID NO: 7359176 - DNA, 22 bp, Homo sapiens
caggacagtataggctttagga

SEQ ID NO: 7359177 - DNA, 22 bp, Homo sapiens
caggacagtgcaggtccatcct

SEQ ID NO: 7359178 - DNA, 22 bp, Homo sapiens
caggacagctcaacacctcctc

SEQ ID NO: 7359179 - DNA, 22 bp, Homo sapiens
caggacactacagatgggaggg

SEQ ID NO: 7359180 - DNA, 22 bp, Homo sapiens
caggacagctcaacacctcctc

SEQ ID NO: 7359181 - DNA, 22 bp, Homo sapiens
caggacaggccctgtggggtct

SEQ ID NO: 7359182 - DNA, 22 bp, Homo sapiens
caggacaggagtggggtcaaag

SEQ ID NO: 7359183 - DNA, 22 bp, Homo sapiens
caggacagctgggccaccacca

SEQ ID NO: 7359184 - DNA, 22 bp, Homo sapiens
caggacaggagtggggtcaaag

SEQ ID NO: 7359185 - DNA, 22 bp, Homo sapiens
caggaatagggcgtgagcatat

SEQ ID NO: 7359186 - DNA, 22 bp, Homo sapiens
caggaagtgtgcctgagcacct

SEQ ID NO: 7359187 - DNA, 22 bp, Homo sapiens
caggaatgactgcagatggggc

SEQ ID NO: 7359188 - DNA, 22 bp, Homo sapiens
caggaaggaaagggtgtggaga

SEQ ID NO: 7359189 - DNA, 22 bp, Homo sapiens
caggaaggaaagggtgtggaga

SEQ ID NO: 7359190 - DNA, 22 bp, Homo sapiens
gtttgtaaccagaacagagagt

SEQ ID NO: 7359191 - DNA, 22 bp, Homo sapiens
caggaagcatctggctagctaa

SEQ ID NO: 7359192 - DNA, 22 bp, Homo sapiens
gtttggtgacacatagtttgat

SEQ ID NO: 7359193 - DNA, 22 bp, Homo sapiens
gtttggctatttattctcagtg

SEQ ID NO: 7359194 - DNA, 22 bp, Homo sapiens
gtttggaatgagtcctgccatt

SEQ ID NO: 7359195 - DNA, 18 bp, Homo sapiens
gtttggacttttctccct

SEQ ID NO: 7359196 - DNA, 22 bp, Homo sapiens
gtttggagccccgtgggaagga

SEQ ID NO: 7359197 - DNA, 22 bp, Homo sapiens
taaaatagcttatgtcttttga

SEQ ID NO: 7359198 - DNA, 22 bp, Homo sapiens
taaaatgacttcctccaacatc

SEQ ID NO: 7359199 - DNA, 22 bp, Homo sapiens
gttttccttctcagccattgcc

SEQ ID NO: 7359200 - DNA, 22 bp, Homo sapiens
gttttcttcctgcaattggcat

SEQ ID NO: 7359201 - DNA, 22 bp, Homo sapiens
gttttcttcctgcaattggcat

SEQ ID NO: 7359202 - DNA, 22 bp, Homo sapiens
taaaaagtagtgagaatggcgc

SEQ ID NO: 7359203 - DNA, 22 bp, Homo sapiens
taaactgaagctcaactcaaat

SEQ ID NO: 7359204 - DNA, 22 bp, Homo sapiens
caggacagtgcaggtccatcct

SEQ ID NO: 7359205 - DNA, 22 bp, Homo sapiens
taaacatttgttattcttgttt

SEQ ID NO: 7359206 - DNA, 22 bp, Homo sapiens
caggagaagtctctagggggtg

SEQ ID NO: 7359207 - DNA, 22 bp, Homo sapiens
caggagaagtctctagggggtg

SEQ ID NO: 7359208 - DNA, 22 bp, Homo sapiens
caggagaaggtttggagtgcag

SEQ ID NO: 7359209 - DNA, 22 bp, Homo sapiens
caggagaaggtttggagtgcag

SEQ ID NO: 7359210 - DNA, 22 bp, Homo sapiens
caggagaaggtttggagtgcag

SEQ ID NO: 7359211 - DNA, 22 bp, Homo sapiens
caggagaagtctctagggggtg

SEQ ID NO: 7359212 - DNA, 22 bp, Homo sapiens
caggaccattgcaactgcccct

SEQ ID NO: 7359213 - DNA, 22 bp, Homo sapiens
caggaccaggcgttctgggctg

SEQ ID NO: 7359214 - DNA, 22 bp, Homo sapiens
caggaccattgcaactgcccct

SEQ ID NO: 7359215 - DNA, 22 bp, Homo sapiens
caggaccaagcaaagtttcttt

SEQ ID NO: 7359216 - DNA, 22 bp, Homo sapiens
caggaccaagcaaagtttcttt

SEQ ID NO: 7359217 - DNA, 22 bp, Homo sapiens
caggacagtttgctttgccctg

SEQ ID NO: 7359218 - DNA, 22 bp, Homo sapiens
caggacagttggcatctgctgc

SEQ ID NO: 7359219 - DNA, 22 bp, Homo sapiens
caggaggattgcttgaggccag

SEQ ID NO: 7359220 - DNA, 22 bp, Homo sapiens
caggaggcagaggatgcccagt

SEQ ID NO: 7359221 - DNA, 20 bp, Homo sapiens
caggaggcaaggtcaaggtc

SEQ ID NO: 7359222 - DNA, 22 bp, Homo sapiens
caggaggcagaggttgcagcga

SEQ ID NO: 7359223 - DNA, 22 bp, Homo sapiens
caggaggcagcgctctcaggac

SEQ ID NO: 7359224 - DNA, 22 bp, Homo sapiens
caggaggcagaggttgcagtga

SEQ ID NO: 7359225 - DNA, 22 bp, Homo sapiens
caggaggcagaggatgcccagt

SEQ ID NO: 7359226 - DNA, 22 bp, Homo sapiens
caggaggcagtttcagaagtca

SEQ ID NO: 7359227 - DNA, 22 bp, Homo sapiens
caggaggcagcgctctcaggac

SEQ ID NO: 7359228 - DNA, 22 bp, Homo sapiens
caggaggcagcgctctcaggac

SEQ ID NO: 7359229 - DNA, 22 bp, Homo sapiens
caggagctgggtctggaagcag

SEQ ID NO: 7359230 - DNA, 22 bp, Homo sapiens
taaatgtgcacaggttagaagg

SEQ ID NO: 7359231 - DNA, 22 bp, Homo sapiens
caggagctgggtctggaagcag

SEQ ID NO: 7359232 - DNA, 20 bp, Homo sapiens
taaatggtgcatttcttata

SEQ ID NO: 7359233 - DNA, 22 bp, Homo sapiens
taaatggttccgtgattcatga

SEQ ID NO: 7359234 - DNA, 22 bp, Homo sapiens
caggaggccaactgtgggactt

SEQ ID NO: 7359235 - DNA, 22 bp, Homo sapiens
caggaggcatcatggagcggac

SEQ ID NO: 7359236 - DNA, 22 bp, Homo sapiens
caggaggcatcatggagcggac

SEQ ID NO: 7359237 - DNA, 22 bp, Homo sapiens
caggaggcccggccacagccca

SEQ ID NO: 7359238 - DNA, 22 bp, Homo sapiens
caggaggcccaaagggcgcaga

SEQ ID NO: 7359239 - DNA, 22 bp, Homo sapiens
caggaggccaactgtgggactt

SEQ ID NO: 7359240 - DNA, 22 bp, Homo sapiens
caggaggccaactgtgggactt

SEQ ID NO: 7359241 - DNA, 22 bp, Homo sapiens
caggaggcccacaggcccctgc

SEQ ID NO: 7359242 - DNA, 22 bp, Homo sapiens
caggaggctcctagggctctgt

SEQ ID NO: 7359243 - DNA, 22 bp, Homo sapiens
caggaggcccggccacagccca

SEQ ID NO: 7359244 - DNA, 22 bp, Homo sapiens
caggaggctcctagggctctgt

SEQ ID NO: 7359245 - DNA, 22 bp, Homo sapiens
caggagggcccgagactcttcc

SEQ ID NO: 7359246 - DNA, 20 bp, Homo sapiens
caggagggacatttcagcat

SEQ ID NO: 7359247 - DNA, 20 bp, Homo sapiens
caggagggacatttcagcat

SEQ ID NO: 7359248 - DNA, 22 bp, Homo sapiens
caggagggcccgagactcttcc

SEQ ID NO: 7359249 - DNA, 22 bp, Homo sapiens
caggagggggtggagtttcgcc

SEQ ID NO: 7359250 - DNA, 22 bp, Homo sapiens
caggagtgtttgctacagtttc

SEQ ID NO: 7359251 - DNA, 22 bp, Homo sapiens
caggagggtgtggaaaactggg

SEQ ID NO: 7359252 - DNA, 22 bp, Homo sapiens
caggagtgaaatgaggcccagg

SEQ ID NO: 7359253 - DNA, 22 bp, Homo sapiens
caggagtgcaggtggtgaggca

SEQ ID NO: 7359254 - DNA, 22 bp, Homo sapiens
caggagtgtctccacacagcaa

SEQ ID NO: 7359255 - DNA, 22 bp, Homo sapiens
taaatatcagtccagctcttcc

SEQ ID NO: 7359256 - DNA, 22 bp, Homo sapiens
taaatgctttctatgaaagagg

SEQ ID NO: 7359257 - DNA, 22 bp, Homo sapiens
taaagcatttttgaaattatga

SEQ ID NO: 7359258 - DNA, 19 bp, Homo sapiens
caggagagcatgcactttg

SEQ ID NO: 7359259 - DNA, 15 bp, Homo sapiens
caggagaggaaggtt

SEQ ID NO: 7359260 - DNA, 22 bp, Homo sapiens
caggagaggaggctacttctta

SEQ ID NO: 7359261 - DNA, 22 bp, Homo sapiens
caggagaggctgtacgtttctc

SEQ ID NO: 7359262 - DNA, 22 bp, Homo sapiens
caggagctactcaggttgggtt

SEQ ID NO: 7359263 - DNA, 22 bp, Homo sapiens
caggagctctcatcgtcagggc

SEQ ID NO: 7359264 - DNA, 22 bp, Homo sapiens
caggagctctcatcgtcagggc

SEQ ID NO: 7359265 - DNA, 22 bp, Homo sapiens
caggagctcttaaggatgtgat

SEQ ID NO: 7359266 - DNA, 22 bp, Homo sapiens
taaagcataatgaatatctaga

SEQ ID NO: 7359267 - DNA, 22 bp, Homo sapiens
gttattaaagtatttgatgtta

SEQ ID NO: 7359268 - DNA, 22 bp, Homo sapiens
gttattctacagtcattgaagt

SEQ ID NO: 7359269 - DNA, 20 bp, Homo sapiens
cagcttggatgagaggctga

SEQ ID NO: 7359270 - DNA, 20 bp, Homo sapiens
cagcttggatgagaggctga

SEQ ID NO: 7359271 - DNA, 22 bp, Homo sapiens
caggaaagaaatgagaacacca

SEQ ID NO: 7359272 - DNA, 22 bp, Homo sapiens
gttaaagagtttggctttcttc

SEQ ID NO: 7359273 - DNA, 22 bp, Homo sapiens
gttaaacagttacatgtgctgg

SEQ ID NO: 7359274 - DNA, 22 bp, Homo sapiens
gttaaacagttacatgtgctgg

SEQ ID NO: 7359275 - DNA, 22 bp, Homo sapiens
gttaaacattgctccacgggtt

SEQ ID NO: 7359276 - DNA, 22 bp, Homo sapiens
gttaaacaagctggacactgaa

SEQ ID NO: 7359277 - DNA, 22 bp, Homo sapiens
gttaaacaataactggcacaca

SEQ ID NO: 7359278 - DNA, 22 bp, Homo sapiens
gtgttttattggtgcagtcaga

SEQ ID NO: 7359279 - DNA, 22 bp, Homo sapiens
gtgttttattggtgcagtcaga

SEQ ID NO: 7359280 - DNA, 22 bp, Homo sapiens
gtgttttggccattagtgtgat

SEQ ID NO: 7359281 - DNA, 22 bp, Homo sapiens
gttacaatgtccttacatgaaa

SEQ ID NO: 7359282 - DNA, 22 bp, Homo sapiens
gttacacaggaaaacattagca

SEQ ID NO: 7359283 - DNA, 22 bp, Homo sapiens
gtgtgtgcaagaggtttattga

SEQ ID NO: 7359284 - DNA, 22 bp, Homo sapiens
gtgtgtctttcatttcatgagg

SEQ ID NO: 7359285 - DNA, 20 bp, Homo sapiens
gtgtgtgctccatgcatgct

SEQ ID NO: 7359286 - DNA, 22 bp, Homo sapiens
gtgtgtgtactctgtatataaa

SEQ ID NO: 7359287 - DNA, 22 bp, Homo sapiens
gtgtgtgtactctgtatataaa

SEQ ID NO: 7359288 - DNA, 22 bp, Homo sapiens
gtgtgtgctccccaggagagct

SEQ ID NO: 7359289 - DNA, 22 bp, Homo sapiens
gtgtgtgctccccaggagagct

SEQ ID NO: 7359290 - DNA, 22 bp, Homo sapiens
gtgttttagtgctgctgagctg

SEQ ID NO: 7359291 - DNA, 22 bp, Homo sapiens
gtgtttgttcgtgactccaaag

SEQ ID NO: 7359292 - DNA, 22 bp, Homo sapiens
gtgtttgtttagtgcagagaga

SEQ ID NO: 7359293 - DNA, 22 bp, Homo sapiens
gtgtttgtttgggtagctagac

SEQ ID NO: 7359294 - DNA, 22 bp, Homo sapiens
gtgtttgtttgggtagctagac

SEQ ID NO: 7359295 - DNA, 22 bp, Homo sapiens
gtgtttgtctcttggcctacct

SEQ ID NO: 7359296 - DNA, 22 bp, Homo sapiens
gtgtttgttcatcctctcttct

SEQ ID NO: 7359297 - DNA, 22 bp, Homo sapiens
gtgtttgtgagctaggtgacat

SEQ ID NO: 7359298 - DNA, 22 bp, Homo sapiens
gtgtgtgtatatatacacacac

SEQ ID NO: 7359299 - DNA, 22 bp, Homo sapiens
gtgtgtgtatatatacacacac

SEQ ID NO: 7359300 - DNA, 22 bp, Homo sapiens
cagctgttgttatgtctgcagg

SEQ ID NO: 7359301 - DNA, 22 bp, Homo sapiens
cagctgttgtgtatcaggcaga

SEQ ID NO: 7359302 - DNA, 22 bp, Homo sapiens
cagctgtgctgtattaagctct

SEQ ID NO: 7359303 - DNA, 22 bp, Homo sapiens
gtttattattcaacttcatgtt

SEQ ID NO: 7359304 - DNA, 22 bp, Homo sapiens
gtttacattaagtattagcatc

SEQ ID NO: 7359305 - DNA, 22 bp, Homo sapiens
gtttacatgcatgcaagaatga

SEQ ID NO: 7359306 - DNA, 22 bp, Homo sapiens
gtttcaaaagtcaggctattct

SEQ ID NO: 7359307 - DNA, 22 bp, Homo sapiens
gtttcctaggcttatacagctg

SEQ ID NO: 7359308 - DNA, 18 bp, Homo sapiens
gtttgctacattcacttg

SEQ ID NO: 7359309 - DNA, 22 bp, Homo sapiens
gtttgcttttttgaatcaggag

SEQ ID NO: 7359310 - DNA, 22 bp, Homo sapiens
gtttgcatttcttgaactatat

SEQ ID NO: 7359311 - DNA, 22 bp, Homo sapiens
gtttgcatttattagtcttctg

SEQ ID NO: 7359312 - DNA, 22 bp, Homo sapiens
gtttcctgtttctcagcagccc

SEQ ID NO: 7359313 - DNA, 22 bp, Homo sapiens
caggaacagcaccaggagctag

SEQ ID NO: 7359314 - DNA, 22 bp, Homo sapiens
caggaagattgtggaggtggtt

SEQ ID NO: 7359315 - DNA, 20 bp, Homo sapiens
gttggaaagttcactctgct

SEQ ID NO: 7359316 - DNA, 22 bp, Homo sapiens
gttcacagtctacatagtaaag

SEQ ID NO: 7359317 - DNA, 19 bp, Homo sapiens
gttccgggagtaggccggg

SEQ ID NO: 7359318 - DNA, 22 bp, Homo sapiens
gttcctaaatctggaggacctc

SEQ ID NO: 7359319 - DNA, 22 bp, Homo sapiens
gttcctaaccagcagagaaaca

SEQ ID NO: 7359320 - DNA, 22 bp, Homo sapiens
gttcctaaatttgaaggacttt

SEQ ID NO: 7359321 - DNA, 22 bp, Homo sapiens
gttcctatatagccttaaggat

SEQ ID NO: 7359322 - DNA, 22 bp, Homo sapiens
caggaaagtctgtaaaggaacc

SEQ ID NO: 7359323 - DNA, 22 bp, Homo sapiens
caggaacaatcttactactatt

SEQ ID NO: 7359324 - DNA, 22 bp, Homo sapiens
gttggcagaaagctttcgatcg

SEQ ID NO: 7359325 - DNA, 22 bp, Homo sapiens
gttgggaacatgacctaatggt

SEQ ID NO: 7359326 - DNA, 22 bp, Homo sapiens
gttgggaagcagatggatgagc

SEQ ID NO: 7359327 - DNA, 22 bp, Homo sapiens
caggaaagggatgggctgccac

SEQ ID NO: 7359328 - DNA, 22 bp, Homo sapiens
caggaaaggtagtcacaatgta

SEQ ID NO: 7359329 - DNA, 22 bp, Homo sapiens
caggaaaggtagtcacaatgta

SEQ ID NO: 7359330 - DNA, 22 bp, Homo sapiens
caggaaaggtgtgtcatgatgg

SEQ ID NO: 7359331 - DNA, 22 bp, Homo sapiens
caggaaaggtagtcacaatgta

SEQ ID NO: 7359332 - DNA, 22 bp, Homo sapiens
gtgtacatagaattgtgctttg

SEQ ID NO: 7359333 - DNA, 22 bp, Homo sapiens
gtggtaagactaacatttctca

SEQ ID NO: 7359334 - DNA, 22 bp, Homo sapiens
gtgggtggatggctcacctcca

SEQ ID NO: 7359335 - DNA, 22 bp, Homo sapiens
gtgtacatgagaaatcaacttt

SEQ ID NO: 7359336 - DNA, 22 bp, Homo sapiens
gtgtactgcaaatgctgctgcc

SEQ ID NO: 7359337 - DNA, 22 bp, Homo sapiens
gtgtacatattgagtctgctga

SEQ ID NO: 7359338 - DNA, 22 bp, Homo sapiens
gtgtatctgttaagtataaaaa

SEQ ID NO: 7359339 - DNA, 22 bp, Homo sapiens
gtgtataatgctgtttgtacat

SEQ ID NO: 7359340 - DNA, 22 bp, Homo sapiens
gtgtctgctgcaccctcacacc

SEQ ID NO: 7359341 - DNA, 22 bp, Homo sapiens
gtgtctggcttatgggaactgg

SEQ ID NO: 7359342 - DNA, 22 bp, Homo sapiens
gtgtcttaatgaagtagattat

SEQ ID NO: 7359343 - DNA, 20 bp, Homo sapiens
gtgtctggagtactagagag

SEQ ID NO: 7359344 - DNA, 22 bp, Homo sapiens
gtgtctggaacgggtggtactc

SEQ ID NO: 7359345 - DNA, 20 bp, Homo sapiens
gtgtctgcatatagcaggtg

SEQ ID NO: 7359346 - DNA, 22 bp, Homo sapiens
gtgtctgcacataggatctcaa

SEQ ID NO: 7359347 - DNA, 22 bp, Homo sapiens
gtgtatgttctacttaatatta

SEQ ID NO: 7359348 - DNA, 19 bp, Homo sapiens
gtgtatgtaagttgtgagg

SEQ ID NO: 7359349 - DNA, 17 bp, Homo sapiens
gtgtctttgctgttgtg

SEQ ID NO: 7359350 - DNA, 22 bp, Homo sapiens
gtgtctttattcctctatgttt

SEQ ID NO: 7359351 - DNA, 22 bp, Homo sapiens
gtgtcttaattcttgttgttca

SEQ ID NO: 7359352 - DNA, 22 bp, Homo sapiens
gtgtgaaatggttctctttgtt

SEQ ID NO: 7359353 - DNA, 22 bp, Homo sapiens
gtgtgaaaatgtgcacaatatg

SEQ ID NO: 7359354 - DNA, 22 bp, Homo sapiens
gtgtgagcatcaaagcctgtca

SEQ ID NO: 7359355 - DNA, 22 bp, Homo sapiens
gtgtgagcaggtttgacctaag

SEQ ID NO: 7359356 - DNA, 22 bp, Homo sapiens
gtgtgagcagaaaccatgagta

SEQ ID NO: 7359357 - DNA, 22 bp, Homo sapiens
gtgtgagcacactcgggccagc

SEQ ID NO: 7359358 - DNA, 17 bp, Homo sapiens
gtgtgctactatcattt

SEQ ID NO: 7359359 - DNA, 17 bp, Homo sapiens
gtgtgctactatcattt

SEQ ID NO: 7359360 - DNA, 22 bp, Homo sapiens
gtgtgctagctgcttcacacag

SEQ ID NO: 7359361 - DNA, 22 bp, Homo sapiens
gtgtgctattctcttatattca

SEQ ID NO: 7359362 - DNA, 22 bp, Homo sapiens
gtgtgcgcgcgcgtcccgggtg

SEQ ID NO: 7359363 - DNA, 22 bp, Homo sapiens
gtgtgctgagtgactgtcatca

SEQ ID NO: 7359364 - DNA, 21 bp, Homo sapiens
gtgtgctgatacattggagaa

SEQ ID NO: 7359365 - DNA, 22 bp, Homo sapiens
gtgtggaaacagagagggcaac

SEQ ID NO: 7359366 - DNA, 22 bp, Homo sapiens
gtgtgctgttgttcaggtagaa

SEQ ID NO: 7359367 - DNA, 22 bp, Homo sapiens
gtgtgctgggaccacgctgggt

SEQ ID NO: 7359368 - DNA, 22 bp, Homo sapiens
gtgtgctgcccaactcgcagat

SEQ ID NO: 7359369 - DNA, 22 bp, Homo sapiens
gtgtggactctctggtgcacag

SEQ ID NO: 7359370 - DNA, 22 bp, Homo sapiens
cagctggctgcggtgaggggac

SEQ ID NO: 7359371 - DNA, 22 bp, Homo sapiens
cagctggggagagacatggcag

SEQ ID NO: 7359372 - DNA, 22 bp, Homo sapiens
cagctggggcagccacgtgcgg

SEQ ID NO: 7359373 - DNA, 22 bp, Homo sapiens
cagctgtctgctgaaggaagct

SEQ ID NO: 7359374 - DNA, 22 bp, Homo sapiens
cagctgcccctccagggctggg

SEQ ID NO: 7359375 - DNA, 22 bp, Homo sapiens
cagctgccctgccttgccctta

SEQ ID NO: 7359376 - DNA, 22 bp, Homo sapiens
cagctgccacttgctctcggct

SEQ ID NO: 7359377 - DNA, 22 bp, Homo sapiens
gtggggcagtggcctgggagca

SEQ ID NO: 7359378 - DNA, 22 bp, Homo sapiens
gtggggcctgtggcttccgtgg

SEQ ID NO: 7359379 - DNA, 22 bp, Homo sapiens
gtggggcatgcacgctgctcct

SEQ ID NO: 7359380 - DNA, 22 bp, Homo sapiens
gtggggcggcagatgctccctg

SEQ ID NO: 7359381 - DNA, 22 bp, Homo sapiens
gtggggctaaaaactgtgcagt

SEQ ID NO: 7359382 - DNA, 22 bp, Homo sapiens
gtggggctcccatctcctggct

SEQ ID NO: 7359383 - DNA, 22 bp, Homo sapiens
gtggggagtgttctgtgattgg

SEQ ID NO: 7359384 - DNA, 22 bp, Homo sapiens
gtggggagggagatgctgaagt

SEQ ID NO: 7359385 - DNA, 22 bp, Homo sapiens
gtggggctgagtggagccagaa

SEQ ID NO: 7359386 - DNA, 22 bp, Homo sapiens
cagctgatttgagaaagaatga

SEQ ID NO: 7359387 - DNA, 22 bp, Homo sapiens
cagctgcttctcctccagagct

SEQ ID NO: 7359388 - DNA, 22 bp, Homo sapiens
cagctgctgttcagttttgttt

SEQ ID NO: 7359389 - DNA, 22 bp, Homo sapiens
cagctgctgttcagttttgttt

SEQ ID NO: 7359390 - DNA, 22 bp, Homo sapiens
cagctgctgcccttggctgcag

SEQ ID NO: 7359391 - DNA, 22 bp, Homo sapiens
cagctgctgtaacagaatactt

SEQ ID NO: 7359392 - DNA, 22 bp, Homo sapiens
cagctgctgagaagcctccctt

SEQ ID NO: 7359393 - DNA, 22 bp, Homo sapiens
cagctgctctggtggtctctcc

SEQ ID NO: 7359394 - DNA, 22 bp, Homo sapiens
cagctgctctggtggtctctcc

SEQ ID NO: 7359395 - DNA, 22 bp, Homo sapiens
gtgggtggaggcgtcgagggca

SEQ ID NO: 7359396 - DNA, 22 bp, Homo sapiens
gtgggtggaggcgtcgagggca

SEQ ID NO: 7359397 - DNA, 22 bp, Homo sapiens
gtggcccacacagacagcatct

SEQ ID NO: 7359398 - DNA, 22 bp, Homo sapiens
cagctctgtgcaggcctgggga

SEQ ID NO: 7359399 - DNA, 22 bp, Homo sapiens
cagctctggctattgaggacca

SEQ ID NO: 7359400 - DNA, 22 bp, Homo sapiens
cagctctggctttggggagctt

SEQ ID NO: 7359401 - DNA, 22 bp, Homo sapiens
gtggccagggcccacaggatga

SEQ ID NO: 7359402 - DNA, 22 bp, Homo sapiens
gtggccagtggtgggcgccctg

SEQ ID NO: 7359403 - DNA, 22 bp, Homo sapiens
gtggccaggcgtccgcgcggct

SEQ ID NO: 7359404 - DNA, 19 bp, Homo sapiens
gtggccagggcaggggctg

SEQ ID NO: 7359405 - DNA, 22 bp, Homo sapiens
gtggcagtctcatctgtggctc

SEQ ID NO: 7359406 - DNA, 22 bp, Homo sapiens
gtggcagtctcatctgtggctc

SEQ ID NO: 7359407 - DNA, 22 bp, Homo sapiens
gtggcagtagacagtgcatcta

SEQ ID NO: 7359408 - DNA, 22 bp, Homo sapiens
gtggcaggtcccattggagcag

SEQ ID NO: 7359409 - DNA, 22 bp, Homo sapiens
gtggcaggttccgtagacagca

SEQ ID NO: 7359410 - DNA, 22 bp, Homo sapiens
cagcccagccgagggcctggct

SEQ ID NO: 7359411 - DNA, 22 bp, Homo sapiens
cagcccagcgcaaacaactggc

SEQ ID NO: 7359412 - DNA, 22 bp, Homo sapiens
cagcccaggactgcaggtgttt

SEQ ID NO: 7359413 - DNA, 22 bp, Homo sapiens
cagcccagctgggatcacactc

SEQ ID NO: 7359414 - DNA, 22 bp, Homo sapiens
cagcccagctctgactaaccct

SEQ ID NO: 7359415 - DNA, 22 bp, Homo sapiens
cagcccagcgcaaacaactggc

SEQ ID NO: 7359416 - DNA, 22 bp, Homo sapiens
cagctgagtggaccctagaggc

SEQ ID NO: 7359417 - DNA, 22 bp, Homo sapiens
gtgggcaggagtgagcaacagg

SEQ ID NO: 7359418 - DNA, 22 bp, Homo sapiens
gtgggcaggagtgagcaacagg

SEQ ID NO: 7359419 - DNA, 22 bp, Homo sapiens
gtgggcaggccccaaagcaggg

SEQ ID NO: 7359420 - DNA, 22 bp, Homo sapiens
gtgggcaggagtgagcaacagg

SEQ ID NO: 7359421 - DNA, 22 bp, Homo sapiens
gtgggcaggaggccctgccctg

SEQ ID NO: 7359422 - DNA, 22 bp, Homo sapiens
gtgggcaggaggccctgccctg

SEQ ID NO: 7359423 - DNA, 22 bp, Homo sapiens
gtgggcagtcatgaaatctaga

SEQ ID NO: 7359424 - DNA, 22 bp, Homo sapiens
gtgggcaggtaggcaccagcta

SEQ ID NO: 7359425 - DNA, 22 bp, Homo sapiens
gtgggcagtcatgaaatctaga

SEQ ID NO: 7359426 - DNA, 22 bp, Homo sapiens
gtgggcaggtaggcaccagcta

SEQ ID NO: 7359427 - DNA, 22 bp, Homo sapiens
gtgggcaggccctaggcgattt

SEQ ID NO: 7359428 - DNA, 22 bp, Homo sapiens
gtgggcagggttgctttctccg

SEQ ID NO: 7359429 - DNA, 22 bp, Homo sapiens
gtgggcaggtaggcaccagcta

SEQ ID NO: 7359430 - DNA, 22 bp, Homo sapiens
gtgggcaggtaggcaccagcta

SEQ ID NO: 7359431 - DNA, 22 bp, Homo sapiens
gtgggcagtggggtcttctgcc

SEQ ID NO: 7359432 - DNA, 22 bp, Homo sapiens
gtgggcagtgcctgacggatga

SEQ ID NO: 7359433 - DNA, 22 bp, Homo sapiens
gtgggcagtgcctgacggatga

SEQ ID NO: 7359434 - DNA, 22 bp, Homo sapiens
gtggccttgggcactgaccttg

SEQ ID NO: 7359435 - DNA, 22 bp, Homo sapiens
gtggccttggcttctaccctga

SEQ ID NO: 7359436 - DNA, 22 bp, Homo sapiens
gtggcttgaccatccctgctac

SEQ ID NO: 7359437 - DNA, 22 bp, Homo sapiens
gtggctttggaattgtagactc

SEQ ID NO: 7359438 - DNA, 22 bp, Homo sapiens
gtggctttgtttccaaatgaaa

SEQ ID NO: 7359439 - DNA, 21 bp, Homo sapiens
ccagatgcaaatgcagacatt

SEQ ID NO: 7359440 - DNA, 20 bp, Homo sapiens
tctctctggttggaggagct

SEQ ID NO: 7359441 - DNA, 22 bp, Homo sapiens
ccagaggtgctgggagaggtct

SEQ ID NO: 7359442 - DNA, 22 bp, Homo sapiens
ccagatatcactgccgtgttgt

SEQ ID NO: 7359443 - DNA, 22 bp, Homo sapiens
ccagaggacttgggggctgaat

SEQ ID NO: 7359444 - DNA, 22 bp, Homo sapiens
ccagaggacttgggggctgaat

SEQ ID NO: 7359445 - DNA, 22 bp, Homo sapiens
tctctacctgctccatagccat

SEQ ID NO: 7359446 - DNA, 19 bp, Homo sapiens
tctctacactacatttcta

SEQ ID NO: 7359447 - DNA, 22 bp, Homo sapiens
ccagagcttcggggcggctgta

SEQ ID NO: 7359448 - DNA, 22 bp, Homo sapiens
ccagagctgattcctgggactt

SEQ ID NO: 7359449 - DNA, 22 bp, Homo sapiens
ccagaatttggatcatgatttt

SEQ ID NO: 7359450 - DNA, 22 bp, Homo sapiens
ccagaatgttctagagccaccc

SEQ ID NO: 7359451 - DNA, 22 bp, Homo sapiens
ccagacagcagttaaaggacat

SEQ ID NO: 7359452 - DNA, 22 bp, Homo sapiens
ccagaataggagtaataaaacc

SEQ ID NO: 7359453 - DNA, 22 bp, Homo sapiens
ccagaagtgtctatcaagatgt

SEQ ID NO: 7359454 - DNA, 22 bp, Homo sapiens
ccagaagtgtctatcaagatgt

SEQ ID NO: 7359455 - DNA, 22 bp, Homo sapiens
ccagaatcatcatctgaagcct

SEQ ID NO: 7359456 - DNA, 22 bp, Homo sapiens
ccagaatgtgtgaaatttgatg

SEQ ID NO: 7359457 - DNA, 22 bp, Homo sapiens
ccagaagtcaggaatgagtctt

SEQ ID NO: 7359458 - DNA, 22 bp, Homo sapiens
ccagaagtcaagtaagatgaag

SEQ ID NO: 7359459 - DNA, 22 bp, Homo sapiens
ccactgccagccgcccggaggc

SEQ ID NO: 7359460 - DNA, 22 bp, Homo sapiens
ccactgccatgggctaggcatg

SEQ ID NO: 7359461 - DNA, 22 bp, Homo sapiens
ccactgccgatgttccatcttg

SEQ ID NO: 7359462 - DNA, 22 bp, Homo sapiens
ccactgccccctgaagaccagg

SEQ ID NO: 7359463 - DNA, 22 bp, Homo sapiens
ccagaaaaggagctgcaggatg

SEQ ID NO: 7359464 - DNA, 22 bp, Homo sapiens
ccactgcctctccagggccatc

SEQ ID NO: 7359465 - DNA, 22 bp, Homo sapiens
ccactgcctatttgcagggccc

SEQ ID NO: 7359466 - DNA, 22 bp, Homo sapiens
ccactgccgtgggccttgggga

SEQ ID NO: 7359467 - DNA, 22 bp, Homo sapiens
ccactgagtgagcagagcaggg

SEQ ID NO: 7359468 - DNA, 22 bp, Homo sapiens
ccactgatcctgactttggagc

SEQ ID NO: 7359469 - DNA, 22 bp, Homo sapiens
ccacagggtcagccactctgca

SEQ ID NO: 7359470 - DNA, 22 bp, Homo sapiens
ccacagtcctggcttctgtctg

SEQ ID NO: 7359471 - DNA, 22 bp, Homo sapiens
ccacagtccgggctggcaggac

SEQ ID NO: 7359472 - DNA, 22 bp, Homo sapiens
ccacagtccgggctggcaggac

SEQ ID NO: 7359473 - DNA, 22 bp, Homo sapiens
ccacagtgagttagattgacca

SEQ ID NO: 7359474 - DNA, 22 bp, Homo sapiens
ccacagtgagttctgtactctg

SEQ ID NO: 7359475 - DNA, 21 bp, Homo sapiens
ccactctgagtgttgaacaga

SEQ ID NO: 7359476 - DNA, 22 bp, Homo sapiens
ccactctgattttggctccact

SEQ ID NO: 7359477 - DNA, 22 bp, Homo sapiens
ccactctgctgtgctccatgat

SEQ ID NO: 7359478 - DNA, 22 bp, Homo sapiens
ccactgaaggtcaacatagagc

SEQ ID NO: 7359479 - DNA, 22 bp, Homo sapiens
ccacagctgaaagcagaggctc

SEQ ID NO: 7359480 - DNA, 22 bp, Homo sapiens
ccacagccattccagggaggct

SEQ ID NO: 7359481 - DNA, 22 bp, Homo sapiens
ccacagccattccagggaggct

SEQ ID NO: 7359482 - DNA, 22 bp, Homo sapiens
ccacagcatgcaggcctgacac

SEQ ID NO: 7359483 - DNA, 18 bp, Homo sapiens
ccacagcagagttcttac

SEQ ID NO: 7359484 - DNA, 22 bp, Homo sapiens
ccacagcaccgctgccagtccc

SEQ ID NO: 7359485 - DNA, 22 bp, Homo sapiens
ccacagcacctgcagccagttg

SEQ ID NO: 7359486 - DNA, 22 bp, Homo sapiens
ccacagagttacaaaacagtca

SEQ ID NO: 7359487 - DNA, 22 bp, Homo sapiens
ccacagagttgatgcaataaga

SEQ ID NO: 7359488 - DNA, 22 bp, Homo sapiens
ccacagagttacaaaacagtca

SEQ ID NO: 7359489 - DNA, 20 bp, Homo sapiens
ccacagaggacagggctgtg

SEQ ID NO: 7359490 - DNA, 22 bp, Homo sapiens
ccacaaggcctgtggggctgct

SEQ ID NO: 7359491 - DNA, 22 bp, Homo sapiens
tcctgcagtgtgtctcctgcac

SEQ ID NO: 7359492 - DNA, 22 bp, Homo sapiens
tcctgcagttacatcccagcca

SEQ ID NO: 7359493 - DNA, 22 bp, Homo sapiens
ccacacagggggatgagttatt

SEQ ID NO: 7359494 - DNA, 15 bp, Homo sapiens
ccaatgtcagatgct

SEQ ID NO: 7359495 - DNA, 20 bp, Homo sapiens
ccaatgtttacagattactt

SEQ ID NO: 7359496 - DNA, 22 bp, Homo sapiens
ccaatgttaggctctggtttta

SEQ ID NO: 7359497 - DNA, 18 bp, Homo sapiens
ccaatgttggccccaagg

SEQ ID NO: 7359498 - DNA, 22 bp, Homo sapiens
ccaagggccatcctatcacttg

SEQ ID NO: 7359499 - DNA, 22 bp, Homo sapiens
ccaatgtttattttcctgctgc

SEQ ID NO: 7359500 - DNA, 22 bp, Homo sapiens
ccaatgttttatacagaagtac

SEQ ID NO: 7359501 - DNA, 22 bp, Homo sapiens
ccacaagatgcaaactctaaca

SEQ ID NO: 7359502 - DNA, 22 bp, Homo sapiens
ccacaaaactgtgtgtcaaaga

SEQ ID NO: 7359503 - DNA, 22 bp, Homo sapiens
tcctccccaaagcccagcctgg

SEQ ID NO: 7359504 - DNA, 22 bp, Homo sapiens
ccaaattaaatcatacagacag

SEQ ID NO: 7359505 - DNA, 22 bp, Homo sapiens
ccaaatgctccactgactttgg

SEQ ID NO: 7359506 - DNA, 22 bp, Homo sapiens
ccaaatattaacaaagtaattt

SEQ ID NO: 7359507 - DNA, 22 bp, Homo sapiens
catttacttaaatctttacaag

SEQ ID NO: 7359508 - DNA, 22 bp, Homo sapiens
catttagaaactgtttttaaca

SEQ ID NO: 7359509 - DNA, 22 bp, Homo sapiens
catttagaaactgtttttaaca

SEQ ID NO: 7359510 - DNA, 17 bp, Homo sapiens
tccaggcagcaactgag

SEQ ID NO: 7359511 - DNA, 20 bp, Homo sapiens
tccaggcagacagctatggg

SEQ ID NO: 7359512 - DNA, 23 bp, Homo sapiens
tccaggcacgcatttcttctagc

SEQ ID NO: 7359513 - DNA, 22 bp, Homo sapiens
tccaggcacgaggccctgtgca

SEQ ID NO: 7359514 - DNA, 19 bp, Homo sapiens
catttagaagtacatatta

SEQ ID NO: 7359515 - DNA, 22 bp, Homo sapiens
catttagtctgatatggatgaa

SEQ ID NO: 7359516 - DNA, 22 bp, Homo sapiens
catttagtacaacttttacagt

SEQ ID NO: 7359517 - DNA, 22 bp, Homo sapiens
catttatataaaatgtccagaa

SEQ ID NO: 7359518 - DNA, 22 bp, Homo sapiens
catttatgaagcactttagagt

SEQ ID NO: 7359519 - DNA, 22 bp, Homo sapiens
tccctgctgcactcacacctac

SEQ ID NO: 7359520 - DNA, 20 bp, Homo sapiens
tccctgccttttactgctgg

SEQ ID NO: 7359521 - DNA, 22 bp, Homo sapiens
tccctgcttggaatgaccctta

SEQ ID NO: 7359522 - DNA, 23 bp, Homo sapiens
catttgatcctcacaataaatgg

SEQ ID NO: 7359523 - DNA, 22 bp, Homo sapiens
catttgaatggcatttcacttt

SEQ ID NO: 7359524 - DNA, 22 bp, Homo sapiens
catttgcatatgaagaagtaag

SEQ ID NO: 7359525 - DNA, 22 bp, Homo sapiens
tccctgcctctcagacttcctt

SEQ ID NO: 7359526 - DNA, 22 bp, Homo sapiens
catttggaaagagactagagaa

SEQ ID NO: 7359527 - DNA, 22 bp, Homo sapiens
ccaggaagctctgctccacggg

SEQ ID NO: 7359528 - DNA, 22 bp, Homo sapiens
ccaggaggatgaggggcataga

SEQ ID NO: 7359529 - DNA, 22 bp, Homo sapiens
ccaggaggatgaggggcataga

SEQ ID NO: 7359530 - DNA, 22 bp, Homo sapiens
ccaggaggatggttgttaggtg

SEQ ID NO: 7359531 - DNA, 22 bp, Homo sapiens
ccaggaggcaatatcaagtcca

SEQ ID NO: 7359532 - DNA, 22 bp, Homo sapiens
ccaggaggcagaggttgtagtg

SEQ ID NO: 7359533 - DNA, 22 bp, Homo sapiens
ccaggaggcagaggttacagtg

SEQ ID NO: 7359534 - DNA, 22 bp, Homo sapiens
ccaggaggcagaagttgcagtg

SEQ ID NO: 7359535 - DNA, 22 bp, Homo sapiens
ccaggaggcggaaggtacagtg

SEQ ID NO: 7359536 - DNA, 22 bp, Homo sapiens
ccaggaggcggaaggtacagtg

SEQ ID NO: 7359537 - DNA, 22 bp, Homo sapiens
tctgtctgtagttttacatgat

SEQ ID NO: 7359538 - DNA, 22 bp, Homo sapiens
tctgtctgggtgcctcgagtac

SEQ ID NO: 7359539 - DNA, 23 bp, Homo sapiens
tctgtctgtgtatgtgcagaaag

SEQ ID NO: 7359540 - DNA, 22 bp, Homo sapiens
tctgccttgccgaattccaggc

SEQ ID NO: 7359541 - DNA, 22 bp, Homo sapiens
tctgccttggcaaccacagctt

SEQ ID NO: 7359542 - DNA, 22 bp, Homo sapiens
tctgccttgttgcaggcgctat

SEQ ID NO: 7359543 - DNA, 22 bp, Homo sapiens
tctgccttttactagctggatg

SEQ ID NO: 7359544 - DNA, 22 bp, Homo sapiens
tctgcgtgggactgaggaggct

SEQ ID NO: 7359545 - DNA, 22 bp, Homo sapiens
tctgcgtgatgagggtgcagca

SEQ ID NO: 7359546 - DNA, 22 bp, Homo sapiens
tctgcgtgaaactagatggcag

SEQ ID NO: 7359547 - DNA, 22 bp, Homo sapiens
tctgcgctgccttgatccttgg

SEQ ID NO: 7359548 - DNA, 22 bp, Homo sapiens
tctggagcgaggtccctgtctg

SEQ ID NO: 7359549 - DNA, 22 bp, Homo sapiens
tctggagctggagggcaaggca

SEQ ID NO: 7359550 - DNA, 19 bp, Homo sapiens
tctggagctgatgcaggtg

SEQ ID NO: 7359551 - DNA, 21 bp, Homo sapiens
tctggagctgcaggctgggca

SEQ ID NO: 7359552 - DNA, 22 bp, Homo sapiens
tctggaggcaactaacctagtt

SEQ ID NO: 7359553 - DNA, 22 bp, Homo sapiens
tctggctcatacaagcctgcaa

SEQ ID NO: 7359554 - DNA, 22 bp, Homo sapiens
tctggcttcaagtcccagctct

SEQ ID NO: 7359555 - DNA, 22 bp, Homo sapiens
tctggctcatctctccaggtaa

SEQ ID NO: 7359556 - DNA, 22 bp, Homo sapiens
tctggctcataggaaggccatt

SEQ ID NO: 7359557 - DNA, 22 bp, Homo sapiens
tctggctttattttcatcatct

SEQ ID NO: 7359558 - DNA, 22 bp, Homo sapiens
tctggctttattccttcactga

SEQ ID NO: 7359559 - DNA, 22 bp, Homo sapiens
tctggcttgaacaattaggtaa

SEQ ID NO: 7359560 - DNA, 22 bp, Homo sapiens
tctgaggttctgttttcaactg

SEQ ID NO: 7359561 - DNA, 20 bp, Homo sapiens
tctgagagtctgagtgatga

SEQ ID NO: 7359562 - DNA, 22 bp, Homo sapiens
ccagccctcactgaggcctctc

SEQ ID NO: 7359563 - DNA, 22 bp, Homo sapiens
ccagccataatacgaacccagc

SEQ ID NO: 7359564 - DNA, 22 bp, Homo sapiens
ccagcccctatcctcgctccac

SEQ ID NO: 7359565 - DNA, 22 bp, Homo sapiens
ccagccccgggaacctggccgt

SEQ ID NO: 7359566 - DNA, 22 bp, Homo sapiens
ccagccagtcccgcatgaccgc

SEQ ID NO: 7359567 - DNA, 22 bp, Homo sapiens
ccagccagtccagcattggtgt

SEQ ID NO: 7359568 - DNA, 22 bp, Homo sapiens
ccagccagtcccgcatgaccgc

SEQ ID NO: 7359569 - DNA, 22 bp, Homo sapiens
ccagccacgaagctcccttcat

SEQ ID NO: 7359570 - DNA, 22 bp, Homo sapiens
ccagccactgggccactgccag

SEQ ID NO: 7359571 - DNA, 22 bp, Homo sapiens
tctgaaatattggtaatacttt

SEQ ID NO: 7359572 - DNA, 22 bp, Homo sapiens
tctgaaataggcttcttttggt

SEQ ID NO: 7359573 - DNA, 22 bp, Homo sapiens
tctgaaataggagccatgtaga

SEQ ID NO: 7359574 - DNA, 22 bp, Homo sapiens
tctgaaataggaaagcaaatgg

SEQ ID NO: 7359575 - DNA, 22 bp, Homo sapiens
tctctctgtgacagctttgctg

SEQ ID NO: 7359576 - DNA, 19 bp, Homo sapiens
tctctctgtacattagata

SEQ ID NO: 7359577 - DNA, 22 bp, Homo sapiens
tctctcttcatgcttttagaat

SEQ ID NO: 7359578 - DNA, 22 bp, Homo sapiens
tctcttggaggttcttcctgtt

SEQ ID NO: 7359579 - DNA, 22 bp, Homo sapiens
tctcttgatgttcccagacagc

SEQ ID NO: 7359580 - DNA, 22 bp, Homo sapiens
tctcttgagctcagttctgatg

SEQ ID NO: 7359581 - DNA, 22 bp, Homo sapiens
ccagctcctcttgtctctagca

SEQ ID NO: 7359582 - DNA, 22 bp, Homo sapiens
ccagctcctcttgtctctagca

SEQ ID NO: 7359583 - DNA, 22 bp, Homo sapiens
ccagctcctcttcccagtgtca

SEQ ID NO: 7359584 - DNA, 21 bp, Homo sapiens
ccagctccaggaccttggatc

SEQ ID NO: 7359585 - DNA, 22 bp, Homo sapiens
ccagctccaggactgggagctg

SEQ ID NO: 7359586 - DNA, 21 bp, Homo sapiens
ccagctccaggaccttggatc

SEQ ID NO: 7359587 - DNA, 20 bp, Homo sapiens
tctgccactgcactctgccc

SEQ ID NO: 7359588 - DNA, 22 bp, Homo sapiens
tctgcctcgctaacagcagcca

SEQ ID NO: 7359589 - DNA, 22 bp, Homo sapiens
ccagcctcatcatattcctgct

SEQ ID NO: 7359590 - DNA, 22 bp, Homo sapiens
ccagcctggagggcagtggtgg

SEQ ID NO: 7359591 - DNA, 23 bp, Homo sapiens
ccagcgctcactcagagcatgtt

SEQ ID NO: 7359592 - DNA, 22 bp, Homo sapiens
ccagccttgaatcagttgctgc

SEQ ID NO: 7359593 - DNA, 22 bp, Homo sapiens
ccagccttggctttcctagccc

SEQ ID NO: 7359594 - DNA, 22 bp, Homo sapiens
ccagctcagggtcacatggcac

SEQ ID NO: 7359595 - DNA, 22 bp, Homo sapiens
ccagctccaagtttgggcatca

SEQ ID NO: 7359596 - DNA, 22 bp, Homo sapiens
ccagcgcttcccatcagggagg

SEQ ID NO: 7359597 - DNA, 21 bp, Homo sapiens
ccagctccaggaccttggatc

SEQ ID NO: 7359598 - DNA, 22 bp, Homo sapiens
ccagctccactgtcagatgaga

SEQ ID NO: 7359599 - DNA, 22 bp, Homo sapiens
ccagctccagcatagccaccat

SEQ ID NO: 7359600 - DNA, 23 bp, Homo sapiens
tatctcagaggaatgtagttact

SEQ ID NO: 7359601 - DNA, 22 bp, Homo sapiens
tatctcagctggatcagtggaa

SEQ ID NO: 7359602 - DNA, 17 bp, Homo sapiens
tatctcatacaattata

SEQ ID NO: 7359603 - DNA, 22 bp, Homo sapiens
tatctctgttccaagccttatc

SEQ ID NO: 7359604 - DNA, 17 bp, Homo sapiens
tatctctgcttcatggt

SEQ ID NO: 7359605 - DNA, 22 bp, Homo sapiens
tatctcttgtctgttttgcaaa

SEQ ID NO: 7359606 - DNA, 22 bp, Homo sapiens
tatctctttcattttagagtca

SEQ ID NO: 7359607 - DNA, 22 bp, Homo sapiens
tatctgtaaaccaaggaggctt

SEQ ID NO: 7359608 - DNA, 22 bp, Homo sapiens
tatgcacacattagcacagggt

SEQ ID NO: 7359609 - DNA, 22 bp, Homo sapiens
tatgcacagttacaagaatatc

SEQ ID NO: 7359610 - DNA, 22 bp, Homo sapiens
tatgcacagaagtttgctgaat

SEQ ID NO: 7359611 - DNA, 22 bp, Homo sapiens
tatgtactaactttcattctag

SEQ ID NO: 7359612 - DNA, 22 bp, Homo sapiens
tatggcttctgctttcttgact

SEQ ID NO: 7359613 - DNA, 22 bp, Homo sapiens
tatggcttctataaggaagctt

SEQ ID NO: 7359614 - DNA, 22 bp, Homo sapiens
tatggcttctcagtcatgaaaa

SEQ ID NO: 7359615 - DNA, 22 bp, Homo sapiens
tatggcttcattgtgctccgca

SEQ ID NO: 7359616 - DNA, 22 bp, Homo sapiens
tatggcttccaggctggccagg

SEQ ID NO: 7359617 - DNA, 23 bp, Homo sapiens
tatggcttacagtgctttaggta

SEQ ID NO: 7359618 - DNA, 22 bp, Homo sapiens
tatggcttaggagagtttaact

SEQ ID NO: 7359619 - DNA, 22 bp, Homo sapiens
tatggcttatgctgaacacctg

SEQ ID NO: 7359620 - DNA, 22 bp, Homo sapiens
tatggctggaatactgaaaggc

SEQ ID NO: 7359621 - DNA, 22 bp, Homo sapiens
tatggctgtattctatgttact

SEQ ID NO: 7359622 - DNA, 22 bp, Homo sapiens
tatggctgtattctatgttact

SEQ ID NO: 7359623 - DNA, 22 bp, Homo sapiens
tatggctgaggcctccgtggcc

SEQ ID NO: 7359624 - DNA, 22 bp, Homo sapiens
tatggcttaaaatttcagcatg

SEQ ID NO: 7359625 - DNA, 22 bp, Homo sapiens
tatggctgtggtgatctcattt

SEQ ID NO: 7359626 - DNA, 22 bp, Homo sapiens
tatgtgtcccttggtgtagcaa

SEQ ID NO: 7359627 - DNA, 22 bp, Homo sapiens
tatgtgtatgttcattcatgca

SEQ ID NO: 7359628 - DNA, 19 bp, Homo sapiens
tatgtgtatatgtatctgt

SEQ ID NO: 7359629 - DNA, 22 bp, Homo sapiens
tatgtgtatgtacatacataca

SEQ ID NO: 7359630 - DNA, 22 bp, Homo sapiens
tatgtgtatgtacatacataca

SEQ ID NO: 7359631 - DNA, 22 bp, Homo sapiens
tatgtgtatttagttctataca

SEQ ID NO: 7359632 - DNA, 22 bp, Homo sapiens
tatgtgtattgagcattgttac

SEQ ID NO: 7359633 - DNA, 23 bp, Homo sapiens
tatgtgcatatgtgtaagaatac

SEQ ID NO: 7359634 - DNA, 22 bp, Homo sapiens
tatgtgctttgcactgtgctat

SEQ ID NO: 7359635 - DNA, 22 bp, Homo sapiens
tatgtgcttaatacatggtgtt

SEQ ID NO: 7359636 - DNA, 22 bp, Homo sapiens
tatgtgctttgcactgtgctat

SEQ ID NO: 7359637 - DNA, 22 bp, Homo sapiens
tatgtgctaaacaccttccata

SEQ ID NO: 7359638 - DNA, 22 bp, Homo sapiens
tatgtgctaagctccagatcag

SEQ ID NO: 7359639 - DNA, 22 bp, Homo sapiens
tatgtgctatcaaatgctcatt

SEQ ID NO: 7359640 - DNA, 22 bp, Homo sapiens
tatgtgctgaagtctttacacc

SEQ ID NO: 7359641 - DNA, 22 bp, Homo sapiens
tatgtgctgccaccagggagag

SEQ ID NO: 7359642 - DNA, 22 bp, Homo sapiens
tatgtgtaatcatatctgatac

SEQ ID NO: 7359643 - DNA, 22 bp, Homo sapiens
tatgtgtaagctgtttatcttt

SEQ ID NO: 7359644 - DNA, 22 bp, Homo sapiens
tatgtgtaatcaaacacatgct

SEQ ID NO: 7359645 - DNA, 22 bp, Homo sapiens
tatgtgtatatctgtatgtgca

SEQ ID NO: 7359646 - DNA, 22 bp, Homo sapiens
tatgtgtatacctatacatgtg

SEQ ID NO: 7359647 - DNA, 22 bp, Homo sapiens
tatgtgtactcgttaaatattt

SEQ ID NO: 7359648 - DNA, 22 bp, Homo sapiens
tattgctgacttgttcagtgtt

SEQ ID NO: 7359649 - DNA, 22 bp, Homo sapiens
tattgctgaaatgctgagttca

SEQ ID NO: 7359650 - DNA, 22 bp, Homo sapiens
tattcctcctttctgctcagcc

SEQ ID NO: 7359651 - DNA, 22 bp, Homo sapiens
tattaaagggaagttatgcatg

SEQ ID NO: 7359652 - DNA, 22 bp, Homo sapiens
tattaaagagagaatcatcatc

SEQ ID NO: 7359653 - DNA, 22 bp, Homo sapiens
cagggtggcacatcacagcatt

SEQ ID NO: 7359654 - DNA, 22 bp, Homo sapiens
cagggtggaatggaatgctggc

SEQ ID NO: 7359655 - DNA, 22 bp, Homo sapiens
cagggtggaatggaatgctggc

SEQ ID NO: 7359656 - DNA, 22 bp, Homo sapiens
cagggtggaagctgtagagtgg

SEQ ID NO: 7359657 - DNA, 22 bp, Homo sapiens
cagggtggaatggaatgctggc

SEQ ID NO: 7359658 - DNA, 22 bp, Homo sapiens
cagggtggcacatcacagcatt

SEQ ID NO: 7359659 - DNA, 22 bp, Homo sapiens
cagggtggcacatcacagcatt

SEQ ID NO: 7359660 - DNA, 22 bp, Homo sapiens
tatacagatggaaagatacaca

SEQ ID NO: 7359661 - DNA, 21 bp, Homo sapiens
tatacagtaattaagtggtat

SEQ ID NO: 7359662 - DNA, 20 bp, Homo sapiens
tatacagtcttttgggaaaa

SEQ ID NO: 7359663 - DNA, 22 bp, Homo sapiens
tatacagttaagtttcttcagt

SEQ ID NO: 7359664 - DNA, 22 bp, Homo sapiens
tatacagtgcctcttccattag

SEQ ID NO: 7359665 - DNA, 22 bp, Homo sapiens
tatacagtatcttttgaaggca

SEQ ID NO: 7359666 - DNA, 21 bp, Homo sapiens
tatacagtaattaagtggtat

SEQ ID NO: 7359667 - DNA, 22 bp, Homo sapiens
tatacagtatcttttgaaggca

SEQ ID NO: 7359668 - DNA, 23 bp, Homo sapiens
tatacagtctccaggcagtcctt

SEQ ID NO: 7359669 - DNA, 22 bp, Homo sapiens
tatacagtcttttgctatattc

SEQ ID NO: 7359670 - DNA, 22 bp, Homo sapiens
tatacagtcttttgctatattc

SEQ ID NO: 7359671 - DNA, 22 bp, Homo sapiens
tatacagtttgagttcttgcat

SEQ ID NO: 7359672 - DNA, 22 bp, Homo sapiens
caggtctcttttgtcacaccac

SEQ ID NO: 7359673 - DNA, 22 bp, Homo sapiens
caggtctgaagagtcacatgcc

SEQ ID NO: 7359674 - DNA, 22 bp, Homo sapiens
tatctattatgttctatgtgtc

SEQ ID NO: 7359675 - DNA, 22 bp, Homo sapiens
tataagaaattgccaacctgtt

SEQ ID NO: 7359676 - DNA, 22 bp, Homo sapiens
tataagaaacaaggcaaatttt

SEQ ID NO: 7359677 - DNA, 22 bp, Homo sapiens
tataagaagtgaagaagagtta

SEQ ID NO: 7359678 - DNA, 22 bp, Homo sapiens
tataatattccttgttgtaggt

SEQ ID NO: 7359679 - DNA, 22 bp, Homo sapiens
tataatctcctgagttaggtag

SEQ ID NO: 7359680 - DNA, 22 bp, Homo sapiens
cagggtgcttccgtggagctgt

SEQ ID NO: 7359681 - DNA, 22 bp, Homo sapiens
cagggtggaaaagctagttgga

SEQ ID NO: 7359682 - DNA, 22 bp, Homo sapiens
caggggcctggctgtctaggaa

SEQ ID NO: 7359683 - DNA, 22 bp, Homo sapiens
caggggcctggctgtctaggaa

SEQ ID NO: 7359684 - DNA, 22 bp, Homo sapiens
caggggcaggtgtgagatcatc

SEQ ID NO: 7359685 - DNA, 22 bp, Homo sapiens
caggggcaggtgtgagatcatc

SEQ ID NO: 7359686 - DNA, 22 bp, Homo sapiens
caggggcagtctgtgtgcgtgg

SEQ ID NO: 7359687 - DNA, 22 bp, Homo sapiens
tattggctgcagcttcctctgt

SEQ ID NO: 7359688 - DNA, 22 bp, Homo sapiens
tatttagttatctttcataaaa

SEQ ID NO: 7359689 - DNA, 22 bp, Homo sapiens
tatttacttttaaattgagaac

SEQ ID NO: 7359690 - DNA, 19 bp, Homo sapiens
tatttacttcttgattgca

SEQ ID NO: 7359691 - DNA, 22 bp, Homo sapiens
tatttagaacagacaatagaaa

SEQ ID NO: 7359692 - DNA, 22 bp, Homo sapiens
cagtcctgtgtcccttggtggg

SEQ ID NO: 7359693 - DNA, 22 bp, Homo sapiens
cagtcctctctgtgtctgcacc

SEQ ID NO: 7359694 - DNA, 22 bp, Homo sapiens
cagtcctgggcaggtcaggcca

SEQ ID NO: 7359695 - DNA, 22 bp, Homo sapiens
cagtcctggggaccaggctgag

SEQ ID NO: 7359696 - DNA, 22 bp, Homo sapiens
cagtcctggggaccaggctgag

SEQ ID NO: 7359697 - DNA, 20 bp, Homo sapiens
cagtcctgtccctgctgccc

SEQ ID NO: 7359698 - DNA, 20 bp, Homo sapiens
cagtcctgtccctgctgccc

SEQ ID NO: 7359699 - DNA, 20 bp, Homo sapiens
cagtgcaactgaagaactga

SEQ ID NO: 7359700 - DNA, 22 bp, Homo sapiens
cagtgatttttacagtaaggaa

SEQ ID NO: 7359701 - DNA, 22 bp, Homo sapiens
cagtgattaaaacatgacagcc

SEQ ID NO: 7359702 - DNA, 22 bp, Homo sapiens
cagtgcaattacaagctaattc

SEQ ID NO: 7359703 - DNA, 22 bp, Homo sapiens
cagtgcaatgttaaataggaaa

SEQ ID NO: 7359704 - DNA, 22 bp, Homo sapiens
cagtgcaatgcagatgacacca

SEQ ID NO: 7359705 - DNA, 22 bp, Homo sapiens
cagtgcagacgtggagggggca

SEQ ID NO: 7359706 - DNA, 22 bp, Homo sapiens
cagtgaggtggagtagttccca

SEQ ID NO: 7359707 - DNA, 22 bp, Homo sapiens
cagtgaggtgcccagcctgccc

SEQ ID NO: 7359708 - DNA, 22 bp, Homo sapiens
cagtgaggtggatggatggcct

SEQ ID NO: 7359709 - DNA, 22 bp, Homo sapiens
cagtgaggtagacagctttttc

SEQ ID NO: 7359710 - DNA, 22 bp, Homo sapiens
tcactcagaaatagaatgaacc

SEQ ID NO: 7359711 - DNA, 22 bp, Homo sapiens
tcactcagaaatagaatgaacc

SEQ ID NO: 7359712 - DNA, 22 bp, Homo sapiens
tcactcagatgttaaagggctt

SEQ ID NO: 7359713 - DNA, 22 bp, Homo sapiens
tcactcagcattcactgggcct

SEQ ID NO: 7359714 - DNA, 22 bp, Homo sapiens
tcactcagcattcactgggcct

SEQ ID NO: 7359715 - DNA, 22 bp, Homo sapiens
tcactcagcattcactgggcct

SEQ ID NO: 7359716 - DNA, 22 bp, Homo sapiens
tcactcaggctggagtgcagtg

SEQ ID NO: 7359717 - DNA, 22 bp, Homo sapiens
tcactcaggctggagtgcagtg

SEQ ID NO: 7359718 - DNA, 22 bp, Homo sapiens
tcagaaatacaaaacacttact

SEQ ID NO: 7359719 - DNA, 22 bp, Homo sapiens
tcagaaatagtctttaaaatga

SEQ ID NO: 7359720 - DNA, 22 bp, Homo sapiens
tcagaaatcttgtcaaggcatc

SEQ ID NO: 7359721 - DNA, 22 bp, Homo sapiens
tcagaaatcttgtcaaggcatc

SEQ ID NO: 7359722 - DNA, 22 bp, Homo sapiens
tcagaaatgatcgttattcatt

SEQ ID NO: 7359723 - DNA, 21 bp, Homo sapiens
tcagaacaattccatgcctcc

SEQ ID NO: 7359724 - DNA, 22 bp, Homo sapiens
tcagaaattttctcagtagttc

SEQ ID NO: 7359725 - DNA, 22 bp, Homo sapiens
tcagaaattttctcagtagttc

SEQ ID NO: 7359726 - DNA, 22 bp, Homo sapiens
cagtgctgacagggaggaacct

SEQ ID NO: 7359727 - DNA, 22 bp, Homo sapiens
cagtgctgagagcctggccagg

SEQ ID NO: 7359728 - DNA, 22 bp, Homo sapiens
cagtgctgagagcctggccagg

SEQ ID NO: 7359729 - DNA, 22 bp, Homo sapiens
cagtgctgcatctccatgccag

SEQ ID NO: 7359730 - DNA, 22 bp, Homo sapiens
cagtgctgggcagaggagagcg

SEQ ID NO: 7359731 - DNA, 22 bp, Homo sapiens
cagtgctggtgtaggctgacca

SEQ ID NO: 7359732 - DNA, 22 bp, Homo sapiens
cagtgctggagatgggtggaac

SEQ ID NO: 7359733 - DNA, 22 bp, Homo sapiens
cagtgctggaggctggagggaa

SEQ ID NO: 7359734 - DNA, 22 bp, Homo sapiens
cagtgctggaggggtgcttgca

SEQ ID NO: 7359735 - DNA, 22 bp, Homo sapiens
tcacattgaatggaagaataga

SEQ ID NO: 7359736 - DNA, 22 bp, Homo sapiens
tcacattgattacattccatgt

SEQ ID NO: 7359737 - DNA, 22 bp, Homo sapiens
tcacattgaagaaattttaagt

SEQ ID NO: 7359738 - DNA, 19 bp, Homo sapiens
cagtgctgttcattcagtg

SEQ ID NO: 7359739 - DNA, 22 bp, Homo sapiens
cagtgctgttgggcccagagag

SEQ ID NO: 7359740 - DNA, 22 bp, Homo sapiens
cagtgctgttgggcccagagag

SEQ ID NO: 7359741 - DNA, 22 bp, Homo sapiens
cagtgctgttgggcccagagag

SEQ ID NO: 7359742 - DNA, 22 bp, Homo sapiens
cagtgctgtgctggaagctgtt

SEQ ID NO: 7359743 - DNA, 22 bp, Homo sapiens
catgattatattaatggcttca

SEQ ID NO: 7359744 - DNA, 21 bp, Homo sapiens
catgataatgaaggtgttatt

SEQ ID NO: 7359745 - DNA, 22 bp, Homo sapiens
catgatacttgaatttggaagg

SEQ ID NO: 7359746 - DNA, 22 bp, Homo sapiens
catgatcaccacttgacagccc

SEQ ID NO: 7359747 - DNA, 22 bp, Homo sapiens
catgatcagaaagagaagctag

SEQ ID NO: 7359748 - DNA, 22 bp, Homo sapiens
catgagaaggttttggcatata

SEQ ID NO: 7359749 - DNA, 22 bp, Homo sapiens
tcatgtaagagcttttgtgtca

SEQ ID NO: 7359750 - DNA, 22 bp, Homo sapiens
tcatgtaaagtgtaggtttaga

SEQ ID NO: 7359751 - DNA, 22 bp, Homo sapiens
tcatgtaagagcttttgtgtca

SEQ ID NO: 7359752 - DNA, 22 bp, Homo sapiens
catgattatgtgttagagtttg

SEQ ID NO: 7359753 - DNA, 22 bp, Homo sapiens
catgatttactaaaatttgttt

SEQ ID NO: 7359754 - DNA, 18 bp, Homo sapiens
tcatgtcactgtgctccc

SEQ ID NO: 7359755 - DNA, 22 bp, Homo sapiens
tcatttgttgaactttagtgcg

SEQ ID NO: 7359756 - DNA, 22 bp, Homo sapiens
tcatttgtttaggtagcaccat

SEQ ID NO: 7359757 - DNA, 22 bp, Homo sapiens
tcatttgtttctgtttggggct

SEQ ID NO: 7359758 - DNA, 22 bp, Homo sapiens
tcaggtggctggttgctggcta

SEQ ID NO: 7359759 - DNA, 22 bp, Homo sapiens
tcaggtggcttcggggagtggc

SEQ ID NO: 7359760 - DNA, 22 bp, Homo sapiens
catccattaactcatttgtttc

SEQ ID NO: 7359761 - DNA, 22 bp, Homo sapiens
catccatagcctcaataaatag

SEQ ID NO: 7359762 - DNA, 22 bp, Homo sapiens
tcaggtgggacctgctaggaca

SEQ ID NO: 7359763 - DNA, 22 bp, Homo sapiens
tcaggtgggagtagaatgctag

SEQ ID NO: 7359764 - DNA, 22 bp, Homo sapiens
catctttaaaggggagacaccc

SEQ ID NO: 7359765 - DNA, 22 bp, Homo sapiens
catctttaacaatttacaatgt

SEQ ID NO: 7359766 - DNA, 22 bp, Homo sapiens
catcttaaattaaagcttaagg

SEQ ID NO: 7359767 - DNA, 22 bp, Homo sapiens
catctttagtaggttctggaga

SEQ ID NO: 7359768 - DNA, 22 bp, Homo sapiens
catctttagttattgaatatag

SEQ ID NO: 7359769 - DNA, 22 bp, Homo sapiens
catctttagggaccattattct

SEQ ID NO: 7359770 - DNA, 22 bp, Homo sapiens
catctttaatttgtgacaacta

SEQ ID NO: 7359771 - DNA, 22 bp, Homo sapiens
catctttatttatatagacagg

SEQ ID NO: 7359772 - DNA, 22 bp, Homo sapiens
tcagttgctatgagaaataaat

SEQ ID NO: 7359773 - DNA, 22 bp, Homo sapiens
tccaggcaaagtgctgggctgc

SEQ ID NO: 7359774 - DNA, 22 bp, Homo sapiens
tccaggcacagagttggtcagt

SEQ ID NO: 7359775 - DNA, 22 bp, Homo sapiens
tccaggcaagggaggagcatgg

SEQ ID NO: 7359776 - DNA, 22 bp, Homo sapiens
tccaggcaaagggactagcagg

SEQ ID NO: 7359777 - DNA, 22 bp, Homo sapiens
tccaggcaaaaggaactgcttg

SEQ ID NO: 7359778 - DNA, 19 bp, Homo sapiens
catgtgcatgagcacagga

SEQ ID NO: 7359779 - DNA, 22 bp, Homo sapiens
tccaggcaaaaaccaactacag

SEQ ID NO: 7359780 - DNA, 22 bp, Homo sapiens
tccaggcaaaaaccaactacag

SEQ ID NO: 7359781 - DNA, 22 bp, Homo sapiens
catgtgcagtgtaagacatgct

SEQ ID NO: 7359782 - DNA, 22 bp, Homo sapiens
catgtgcagtgtaagacatgct

SEQ ID NO: 7359783 - DNA, 22 bp, Homo sapiens
catgtacatgcctactatcaat

SEQ ID NO: 7359784 - DNA, 23 bp, Homo sapiens
catgtctgctttcatgctacaac

SEQ ID NO: 7359785 - DNA, 23 bp, Homo sapiens
catgtctgctttcatgctacaac

SEQ ID NO: 7359786 - DNA, 22 bp, Homo sapiens
catgtctgccaatttggaagga

SEQ ID NO: 7359787 - DNA, 22 bp, Homo sapiens
catgggagctatctccatcact

SEQ ID NO: 7359788 - DNA, 22 bp, Homo sapiens
catggcttttttattctgaatg

SEQ ID NO: 7359789 - DNA, 22 bp, Homo sapiens
catggctttgttctgttagatg

SEQ ID NO: 7359790 - DNA, 22 bp, Homo sapiens
tccagccaggatggcccaggga

SEQ ID NO: 7359791 - DNA, 21 bp, Homo sapiens
tccagccagtaaatgctcagc

SEQ ID NO: 7359792 - DNA, 22 bp, Homo sapiens
tccagccacttgcacagttaaa

SEQ ID NO: 7359793 - DNA, 22 bp, Homo sapiens
tccagccaggatggcccaggga

SEQ ID NO: 7359794 - DNA, 22 bp, Homo sapiens
tccagccattcattatgacacc

SEQ ID NO: 7359795 - DNA, 22 bp, Homo sapiens
tccagccatgcatgacaatcac

SEQ ID NO: 7359796 - DNA, 22 bp, Homo sapiens
tccagccatatcttgtagccct

SEQ ID NO: 7359797 - DNA, 22 bp, Homo sapiens
tccagccatgactcggacagtg

SEQ ID NO: 7359798 - DNA, 22 bp, Homo sapiens
catgcacaaaggtaagatgcgt

SEQ ID NO: 7359799 - DNA, 22 bp, Homo sapiens
catgcacaacatactcaagagg

SEQ ID NO: 7359800 - DNA, 22 bp, Homo sapiens
catgcacaagggatgatgaaat

SEQ ID NO: 7359801 - DNA, 22 bp, Homo sapiens
catggctgcattggaatgggtt

SEQ ID NO: 7359802 - DNA, 22 bp, Homo sapiens
catggccaggcacgcgcatagc

SEQ ID NO: 7359803 - DNA, 22 bp, Homo sapiens
catggcttctaagtgataacgt

SEQ ID NO: 7359804 - DNA, 22 bp, Homo sapiens
catggcttggagcaggatgaga

SEQ ID NO: 7359805 - DNA, 22 bp, Homo sapiens
catggcttactttcagggagta

SEQ ID NO: 7359806 - DNA, 22 bp, Homo sapiens
tcattttcacacataaatagca

SEQ ID NO: 7359807 - DNA, 22 bp, Homo sapiens
tcattttcacacataaatagca

SEQ ID NO: 7359808 - DNA, 22 bp, Homo sapiens
tcattttcccactgaagctgtc

SEQ ID NO: 7359809 - DNA, 22 bp, Homo sapiens
tcattttcaagtttgaacagga

SEQ ID NO: 7359810 - DNA, 23 bp, Homo sapiens
catgcaaacactattgcatttgg

SEQ ID NO: 7359811 - DNA, 22 bp, Homo sapiens
tcagaagggaaacacaagtgac

SEQ ID NO: 7359812 - DNA, 22 bp, Homo sapiens
cagtttctgtctgttcttatcc

SEQ ID NO: 7359813 - DNA, 22 bp, Homo sapiens
cagtttggtacatagttcaaaa

SEQ ID NO: 7359814 - DNA, 22 bp, Homo sapiens
cagtttggggtcggagtcaggg

SEQ ID NO: 7359815 - DNA, 22 bp, Homo sapiens
tcagcagtgagaattaatgttg

SEQ ID NO: 7359816 - DNA, 22 bp, Homo sapiens
tcagcagtgcagggtgaggcag

SEQ ID NO: 7359817 - DNA, 22 bp, Homo sapiens
tcagcagtggctctcatgcagt

SEQ ID NO: 7359818 - DNA, 22 bp, Homo sapiens
cataatttttttaagtcagaac

SEQ ID NO: 7359819 - DNA, 22 bp, Homo sapiens
tcagctgcagcaggcaccattt

SEQ ID NO: 7359820 - DNA, 22 bp, Homo sapiens
catagaaaagagtaggtaatgt

SEQ ID NO: 7359821 - DNA, 22 bp, Homo sapiens
tcagccctagcctcagtccagg

SEQ ID NO: 7359822 - DNA, 20 bp, Homo sapiens
tcagccctgagtccaggctg

SEQ ID NO: 7359823 - DNA, 20 bp, Homo sapiens
tcagccctgagtccaggctg

SEQ ID NO: 7359824 - DNA, 22 bp, Homo sapiens
tcagccctgggcttcctcatgg

SEQ ID NO: 7359825 - DNA, 22 bp, Homo sapiens
catcacatcagtgtgaacagtt

SEQ ID NO: 7359826 - DNA, 22 bp, Homo sapiens
catcacaggcattttgagtgtc

SEQ ID NO: 7359827 - DNA, 22 bp, Homo sapiens
catcacaggtcctgatgacatt

SEQ ID NO: 7359828 - DNA, 22 bp, Homo sapiens
catccagggcagccatggcctg

SEQ ID NO: 7359829 - DNA, 22 bp, Homo sapiens
tcagggccacaacaccagagtc

SEQ ID NO: 7359830 - DNA, 22 bp, Homo sapiens
tcagggccacgcggaggtgacg

SEQ ID NO: 7359831 - DNA, 22 bp, Homo sapiens
tcagggccatcttttgcctcaa

SEQ ID NO: 7359832 - DNA, 22 bp, Homo sapiens
tcagggccaggactaggatgag

SEQ ID NO: 7359833 - DNA, 22 bp, Homo sapiens
tcagggccatcttttgcctcaa

SEQ ID NO: 7359834 - DNA, 19 bp, Homo sapiens
tcagggccatgagcgccac

SEQ ID NO: 7359835 - DNA, 22 bp, Homo sapiens
tcagggcccagagctcaggcaa

SEQ ID NO: 7359836 - DNA, 22 bp, Homo sapiens
tcagggccctggacaaccctcc

SEQ ID NO: 7359837 - DNA, 22 bp, Homo sapiens
tcagggccctcacttgcatagg

SEQ ID NO: 7359838 - DNA, 22 bp, Homo sapiens
tcagggcccagtctgtgcatct

SEQ ID NO: 7359839 - DNA, 21 bp, Homo sapiens
catcacaggatgattttttca

SEQ ID NO: 7359840 - DNA, 22 bp, Homo sapiens
catcacagatgttgtgtggagt

SEQ ID NO: 7359841 - DNA, 20 bp, Homo sapiens
catatatacctagaagtgga

SEQ ID NO: 7359842 - DNA, 22 bp, Homo sapiens
catatatgtagatgtatgtgaa

SEQ ID NO: 7359843 - DNA, 22 bp, Homo sapiens
catatattctggttttcactgg

SEQ ID NO: 7359844 - DNA, 22 bp, Homo sapiens
catatactgcatacatatgtgt

SEQ ID NO: 7359845 - DNA, 22 bp, Homo sapiens
catatactgcatacatatgtgt

SEQ ID NO: 7359846 - DNA, 20 bp, Homo sapiens
catatatacctagaagtgga

SEQ ID NO: 7359847 - DNA, 20 bp, Homo sapiens
catatatacctagaagtgga

SEQ ID NO: 7359848 - DNA, 22 bp, Homo sapiens
catatccaggtttctttggttt

SEQ ID NO: 7359849 - DNA, 22 bp, Homo sapiens
catatcatttgcttataaatct

SEQ ID NO: 7359850 - DNA, 22 bp, Homo sapiens
catagacattcagcactcacta

SEQ ID NO: 7359851 - DNA, 22 bp, Homo sapiens
catatacacttccacctctgtg

SEQ ID NO: 7359852 - DNA, 22 bp, Homo sapiens
catatacacttccacctctgtg

SEQ ID NO: 7359853 - DNA, 22 bp, Homo sapiens
tgtgcctaatgtttccattttc

SEQ ID NO: 7359854 - DNA, 22 bp, Homo sapiens
tgtgcccttttgacagtgagag

SEQ ID NO: 7359855 - DNA, 22 bp, Homo sapiens
tgtgccctttcctgctcctcca

SEQ ID NO: 7359856 - DNA, 19 bp, Homo sapiens
tgtgcccttggcaatggga

SEQ ID NO: 7359857 - DNA, 22 bp, Homo sapiens
tgtgccctcctgccaggggctg

SEQ ID NO: 7359858 - DNA, 22 bp, Homo sapiens
tgtgccctctctgagccataaa

SEQ ID NO: 7359859 - DNA, 22 bp, Homo sapiens
tgtgccctctctgagccataaa

SEQ ID NO: 7359860 - DNA, 22 bp, Homo sapiens
tgtgcatattactacctactcc

SEQ ID NO: 7359861 - DNA, 17 bp, Homo sapiens
tgtgcatagaataatga

SEQ ID NO: 7359862 - DNA, 17 bp, Homo sapiens
tgtgcatagaataatga

SEQ ID NO: 7359863 - DNA, 22 bp, Homo sapiens
tgtgcatgcatatgtatttttg

SEQ ID NO: 7359864 - DNA, 22 bp, Homo sapiens
tgtgcatgcacatatatgttgc

SEQ ID NO: 7359865 - DNA, 22 bp, Homo sapiens
tgtgcatgttgcttgaactcct

SEQ ID NO: 7359866 - DNA, 22 bp, Homo sapiens
tgtgcatgttctcatttctaac

SEQ ID NO: 7359867 - DNA, 22 bp, Homo sapiens
tgtgcatgtaccttattctgga

SEQ ID NO: 7359868 - DNA, 22 bp, Homo sapiens
tgtgcatgtattgatttgtacc

SEQ ID NO: 7359869 - DNA, 18 bp, Homo sapiens
tgtgcaatattaaccacc

SEQ ID NO: 7359870 - DNA, 22 bp, Homo sapiens
tgtgcaatcatattttaaaatg

SEQ ID NO: 7359871 - DNA, 22 bp, Homo sapiens
tgtgcaatttcaatttacacag

SEQ ID NO: 7359872 - DNA, 22 bp, Homo sapiens
tgtgcacatatactcatattcc

SEQ ID NO: 7359873 - DNA, 22 bp, Homo sapiens
tgtgcagggaagggcatgctat

SEQ ID NO: 7359874 - DNA, 22 bp, Homo sapiens
tgtgcagctagtcctggacttg

SEQ ID NO: 7359875 - DNA, 22 bp, Homo sapiens
tgtgcagagtaaggcagctgtt

SEQ ID NO: 7359876 - DNA, 22 bp, Homo sapiens
tgtgcctggagtccctgaggag

SEQ ID NO: 7359877 - DNA, 22 bp, Homo sapiens
tgtgcctgatggtcacgtggcc

SEQ ID NO: 7359878 - DNA, 22 bp, Homo sapiens
tgtgcctggcattctgggcttc

SEQ ID NO: 7359879 - DNA, 22 bp, Homo sapiens
tgtgcgtgatggaccgggcctg

SEQ ID NO: 7359880 - DNA, 22 bp, Homo sapiens
tgtgcgggtgcgcatgcagagg

SEQ ID NO: 7359881 - DNA, 22 bp, Homo sapiens
tgtgcctgtcaccctcagagag

SEQ ID NO: 7359882 - DNA, 19 bp, Homo sapiens
tgtgccttatactcacatt

SEQ ID NO: 7359883 - DNA, 22 bp, Homo sapiens
tgtgccttccctctgctgattt

SEQ ID NO: 7359884 - DNA, 22 bp, Homo sapiens
tgtggaaaagccccacaggact

SEQ ID NO: 7359885 - DNA, 19 bp, Homo sapiens
tgtggaaaaaggagacatt

SEQ ID NO: 7359886 - DNA, 23 bp, Homo sapiens
tgtgctggcatctcaggctttgg

SEQ ID NO: 7359887 - DNA, 22 bp, Homo sapiens
tgtgctgctctcagtgacagcc

SEQ ID NO: 7359888 - DNA, 22 bp, Homo sapiens
tgtgctgagcaaatccatctgt

SEQ ID NO: 7359889 - DNA, 22 bp, Homo sapiens
tgtgctgagcaaatccatctgt

SEQ ID NO: 7359890 - DNA, 22 bp, Homo sapiens
tgtgctgacaattcacagagaa

SEQ ID NO: 7359891 - DNA, 22 bp, Homo sapiens
tgtgctctggagttgccttcac

SEQ ID NO: 7359892 - DNA, 22 bp, Homo sapiens
tgtgctattacacatttattta

SEQ ID NO: 7359893 - DNA, 22 bp, Homo sapiens
tgtgctaagtattttcttattt

SEQ ID NO: 7359894 - DNA, 22 bp, Homo sapiens
tgtgcgtggttcccggggccat

SEQ ID NO: 7359895 - DNA, 22 bp, Homo sapiens
tgtgctcatggtccagcatggt

SEQ ID NO: 7359896 - DNA, 22 bp, Homo sapiens
tgtgctccaacaatttatattc

SEQ ID NO: 7359897 - DNA, 22 bp, Homo sapiens
tgtgctccacactcccagtcct

SEQ ID NO: 7359898 - DNA, 22 bp, Homo sapiens
tgtgctctgactttctcctggt

SEQ ID NO: 7359899 - DNA, 22 bp, Homo sapiens
tgtgctctgcccctgactgttt

SEQ ID NO: 7359900 - DNA, 22 bp, Homo sapiens
tgtgctccatcatccataatct

SEQ ID NO: 7359901 - DNA, 23 bp, Homo sapiens
tgtgctcccaaatgtaggtctat

SEQ ID NO: 7359902 - DNA, 17 bp, Homo sapiens
tgtgctctctcactcag

SEQ ID NO: 7359903 - DNA, 22 bp, Homo sapiens
tgtgaatgttaatattggatta

SEQ ID NO: 7359904 - DNA, 22 bp, Homo sapiens
tgtgaatggcagttggatagca

SEQ ID NO: 7359905 - DNA, 22 bp, Homo sapiens
tgtgaatggacaattaaatcta

SEQ ID NO: 7359906 - DNA, 22 bp, Homo sapiens
tgtgaataatgccgcaataaac

SEQ ID NO: 7359907 - DNA, 22 bp, Homo sapiens
tgtgaatagtgccgcaataaac

SEQ ID NO: 7359908 - DNA, 22 bp, Homo sapiens
tgtgacagatctttaaataatg

SEQ ID NO: 7359909 - DNA, 22 bp, Homo sapiens
tgtgacagccagtaaagtaagc

SEQ ID NO: 7359910 - DNA, 22 bp, Homo sapiens
tgtgaaatgctattgtgacaaa

SEQ ID NO: 7359911 - DNA, 21 bp, Homo sapiens
tgtgaaatagctatgctacat

SEQ ID NO: 7359912 - DNA, 22 bp, Homo sapiens
tgtgagcactgtgatgctgttc

SEQ ID NO: 7359913 - DNA, 19 bp, Homo sapiens
tgtgataagcagaattcca

SEQ ID NO: 7359914 - DNA, 22 bp, Homo sapiens
tgtgagcaagtgactggtgaga

SEQ ID NO: 7359915 - DNA, 22 bp, Homo sapiens
tgtgagcaagtttatgtgtaca

SEQ ID NO: 7359916 - DNA, 22 bp, Homo sapiens
tgtgagcaagattcagagattc

SEQ ID NO: 7359917 - DNA, 22 bp, Homo sapiens
tgtgagatacctgttcaaatta

SEQ ID NO: 7359918 - DNA, 22 bp, Homo sapiens
tgtgattatttgattaacatgt

SEQ ID NO: 7359919 - DNA, 22 bp, Homo sapiens
tgtgaccataatttgtaaataa

SEQ ID NO: 7359920 - DNA, 22 bp, Homo sapiens
tgtgacccccgtcacggctgct

SEQ ID NO: 7359921 - DNA, 19 bp, Homo sapiens
tgtgaccccagacaagctg

SEQ ID NO: 7359922 - DNA, 22 bp, Homo sapiens
tgtgacatgtgtcatcttttct

SEQ ID NO: 7359923 - DNA, 21 bp, Homo sapiens
tgtgacctgatgtagtacatt

SEQ ID NO: 7359924 - DNA, 22 bp, Homo sapiens
tgtgacctcatcttaactggaa

SEQ ID NO: 7359925 - DNA, 22 bp, Homo sapiens
tgtgactgagctgcagagtgtc

SEQ ID NO: 7359926 - DNA, 22 bp, Homo sapiens
tgtgactgaggctccaagctag

SEQ ID NO: 7359927 - DNA, 22 bp, Homo sapiens
tgtgactgcatttggagctggg

SEQ ID NO: 7359928 - DNA, 22 bp, Homo sapiens
tgtgactggcttatttcactta

SEQ ID NO: 7359929 - DNA, 22 bp, Homo sapiens
tgtgactgtggtgagatttaag

SEQ ID NO: 7359930 - DNA, 22 bp, Homo sapiens
tgtgactgtggacttttgtggg

SEQ ID NO: 7359931 - DNA, 21 bp, Homo sapiens
tgtgactgttgcatttgtcgt

SEQ ID NO: 7359932 - DNA, 22 bp, Homo sapiens
tgtgagacaattgcatcagggc

SEQ ID NO: 7359933 - DNA, 22 bp, Homo sapiens
tgtgagacgtgttagaacagtg

SEQ ID NO: 7359934 - DNA, 22 bp, Homo sapiens
tgtgagagctccatcctcatga

SEQ ID NO: 7359935 - DNA, 22 bp, Homo sapiens
tgtctcctgggccctggccctg

SEQ ID NO: 7359936 - DNA, 22 bp, Homo sapiens
tgtctcctcaactcatgctcga

SEQ ID NO: 7359937 - DNA, 22 bp, Homo sapiens
tgtctcctaatgtctgtttcct

SEQ ID NO: 7359938 - DNA, 22 bp, Homo sapiens
tgtctcccaggtgtgcccagtg

SEQ ID NO: 7359939 - DNA, 19 bp, Homo sapiens
tgtctagctgcacagctga

SEQ ID NO: 7359940 - DNA, 21 bp, Homo sapiens
tgtctagacctcatcctacag

SEQ ID NO: 7359941 - DNA, 22 bp, Homo sapiens
tgtctaaatgcaatggatttcc

SEQ ID NO: 7359942 - DNA, 22 bp, Homo sapiens
tgtctaagagtgcaatgcatga

SEQ ID NO: 7359943 - DNA, 22 bp, Homo sapiens
tgtctaagggaagatgcaatgt

SEQ ID NO: 7359944 - DNA, 22 bp, Homo sapiens
tgtctaggggcaggggtttgaa

SEQ ID NO: 7359945 - DNA, 22 bp, Homo sapiens
tgtctaggttgcggttttatgt

SEQ ID NO: 7359946 - DNA, 22 bp, Homo sapiens
tgtctagtggtttataaaatca

SEQ ID NO: 7359947 - DNA, 22 bp, Homo sapiens
tgtctagttttagcttttggag

SEQ ID NO: 7359948 - DNA, 22 bp, Homo sapiens
tgtctccaggggcaggccagcc

SEQ ID NO: 7359949 - DNA, 22 bp, Homo sapiens
tgtctccatagagtagcttgat

SEQ ID NO: 7359950 - DNA, 22 bp, Homo sapiens
tgtctctttggcctcccatatg

SEQ ID NO: 7359951 - DNA, 22 bp, Homo sapiens
tgtctctgagatgactcccacc

SEQ ID NO: 7359952 - DNA, 22 bp, Homo sapiens
tgtctgccattagcccagtcca

SEQ ID NO: 7359953 - DNA, 22 bp, Homo sapiens
tgtctgcaaagtccagcacagg

SEQ ID NO: 7359954 - DNA, 20 bp, Homo sapiens
tgtctgctgagctgctgccc

SEQ ID NO: 7359955 - DNA, 21 bp, Homo sapiens
tgtctgctgaaggctggtcac

SEQ ID NO: 7359956 - DNA, 20 bp, Homo sapiens
tgtctgctcataataaaccc

SEQ ID NO: 7359957 - DNA, 22 bp, Homo sapiens
tgtctgcctgcgggccggcaca

SEQ ID NO: 7359958 - DNA, 22 bp, Homo sapiens
tgtctgccctcaacccagaggc

SEQ ID NO: 7359959 - DNA, 22 bp, Homo sapiens
tgtctgctaaattactattaca

SEQ ID NO: 7359960 - DNA, 22 bp, Homo sapiens
tgtctgagcgagaaagtagtgt

SEQ ID NO: 7359961 - DNA, 22 bp, Homo sapiens
tgtcttcagtgtgttaccatgg

SEQ ID NO: 7359962 - DNA, 22 bp, Homo sapiens
tgtcttcatctccatgcacaga

SEQ ID NO: 7359963 - DNA, 22 bp, Homo sapiens
tgtctttaaaattaaacacatc

SEQ ID NO: 7359964 - DNA, 22 bp, Homo sapiens
tgtgaaaagggctttgtacaaa

SEQ ID NO: 7359965 - DNA, 22 bp, Homo sapiens
tgtgaaaagcaggctactttct

SEQ ID NO: 7359966 - DNA, 22 bp, Homo sapiens
tgtgaaaagcgtgtgttctagg

SEQ ID NO: 7359967 - DNA, 22 bp, Homo sapiens
tgtctttttactatgttcaatc

SEQ ID NO: 7359968 - DNA, 22 bp, Homo sapiens
tgtctttttactatgttcaatc

SEQ ID NO: 7359969 - DNA, 22 bp, Homo sapiens
tgtgaaaaaagttctagaagga

SEQ ID NO: 7359970 - DNA, 22 bp, Homo sapiens
tgtcttttataactgacatata

SEQ ID NO: 7359971 - DNA, 23 bp, Homo sapiens
tgtctttgttaggactgtgttta

SEQ ID NO: 7359972 - DNA, 19 bp, Homo sapiens
tgtctttggtctgagtttc

SEQ ID NO: 7359973 - DNA, 22 bp, Homo sapiens
tgtctttggggctgtacctgtt

SEQ ID NO: 7359974 - DNA, 22 bp, Homo sapiens
tgtctttacttaataaatatac

SEQ ID NO: 7359975 - DNA, 22 bp, Homo sapiens
tgtcttcaggagtaaatatcat

SEQ ID NO: 7359976 - DNA, 22 bp, Homo sapiens
tgtcttatggtcttgggcttcc

SEQ ID NO: 7359977 - DNA, 18 bp, Homo sapiens
tgtcttatgtttgggtgg

SEQ ID NO: 7359978 - DNA, 20 bp, Homo sapiens
tgtcttattccagtgtttac

SEQ ID NO: 7359979 - DNA, 22 bp, Homo sapiens
tgtcttattgcctttgtaattt

SEQ ID NO: 7359980 - DNA, 22 bp, Homo sapiens
tgtcttattttaaaagggaagt

SEQ ID NO: 7359981 - DNA, 22 bp, Homo sapiens
tgtcttatgctgcatagactat

SEQ ID NO: 7359982 - DNA, 23 bp, Homo sapiens
tgtcttatctagcttctagaggc

SEQ ID NO: 7359983 - DNA, 22 bp, Homo sapiens
tgtcttaacataaaaggaaatc

SEQ ID NO: 7359984 - DNA, 22 bp, Homo sapiens
tgtcttaacataaaaggaaatc

SEQ ID NO: 7359985 - DNA, 22 bp, Homo sapiens
tgtcttaagtagattacagcct

SEQ ID NO: 7359986 - DNA, 18 bp, Homo sapiens
tgtctgcttctccaactc

SEQ ID NO: 7359987 - DNA, 18 bp, Homo sapiens
tgtctgcttctccaactc

SEQ ID NO: 7359988 - DNA, 19 bp, Homo sapiens
tgtctggaagagctgcagg

SEQ ID NO: 7359989 - DNA, 22 bp, Homo sapiens
tgtctggaagggctatgtgacc

SEQ ID NO: 7359990 - DNA, 22 bp, Homo sapiens
tgtctggaagtaccagggaagc

SEQ ID NO: 7359991 - DNA, 22 bp, Homo sapiens
tgtctggaatttctattttgtc

SEQ ID NO: 7359992 - DNA, 22 bp, Homo sapiens
tgtctggacagagattctcaat

SEQ ID NO: 7359993 - DNA, 22 bp, Homo sapiens
tgtctggacattgacaatcatg

SEQ ID NO: 7359994 - DNA, 22 bp, Homo sapiens
tgtctggactgctcacagtacc

SEQ ID NO: 7359995 - DNA, 23 bp, Homo sapiens
tgtctggagagggcttgctctcc

SEQ ID NO: 7359996 - DNA, 23 bp, Homo sapiens
tgtctggagcctgagcaggtgct

SEQ ID NO: 7359997 - DNA, 22 bp, Homo sapiens
tgtctggagggctggctccctg

SEQ ID NO: 7359998 - DNA, 22 bp, Homo sapiens
tgtctggaggggatgttatggt

SEQ ID NO: 7359999 - DNA, 22 bp, Homo sapiens
tgtctggaggtcaggtcctggg

SEQ ID NO: 7360000 - DNA, 23 bp, Homo sapiens
tgtctggagttttgcactgttgc

SEQ ID NO: 7360001 - DNA, 22 bp, Homo sapiens
tgtctggatagagcctaggccc

SEQ ID NO: 7360002 - DNA, 22 bp, Homo sapiens
tgtctggatcagtgggtgcttg

SEQ ID NO: 7360003 - DNA, 22 bp, Homo sapiens
tgtctggatggtggagattgag

SEQ ID NO: 7360004 - DNA, 23 bp, Homo sapiens
tgtctggattcgactgtggttgg

SEQ ID NO: 7360005 - DNA, 22 bp, Homo sapiens
tgtctggattgctgagccccag

SEQ ID NO: 7360006 - DNA, 22 bp, Homo sapiens
tgtctggatgtctggagcatcg

SEQ ID NO: 7360007 - DNA, 20 bp, Homo sapiens
tgtctggatgtttaagcaga

SEQ ID NO: 7360008 - DNA, 22 bp, Homo sapiens
tgtctgggatgttggcagccac

SEQ ID NO: 7360009 - DNA, 22 bp, Homo sapiens
tgtttttgtctccttgtctgct

SEQ ID NO: 7360010 - DNA, 22 bp, Homo sapiens
tgttttatataagcagagcggt

SEQ ID NO: 7360011 - DNA, 22 bp, Homo sapiens
tgttttaatctcccattgctct

SEQ ID NO: 7360012 - DNA, 22 bp, Homo sapiens
tgttttaaagccattgcctttc

SEQ ID NO: 7360013 - DNA, 22 bp, Homo sapiens
tgtttggaaacactggcagaaa

SEQ ID NO: 7360014 - DNA, 22 bp, Homo sapiens
tgtttgcttggtcagtaagtag

SEQ ID NO: 7360015 - DNA, 22 bp, Homo sapiens
tgtttgcttacttgtatgctgc

SEQ ID NO: 7360016 - DNA, 22 bp, Homo sapiens
tgtttgcttacttgtatgctgc

SEQ ID NO: 7360017 - DNA, 22 bp, Homo sapiens
tgtttgcttacttgtatgctgc

SEQ ID NO: 7360018 - DNA, 22 bp, Homo sapiens
tgtttgtatggacctgttctat

SEQ ID NO: 7360019 - DNA, 22 bp, Homo sapiens
tgtttgtagagacagctgatgc

SEQ ID NO: 7360020 - DNA, 22 bp, Homo sapiens
tgtttgctagggttggtattta

SEQ ID NO: 7360021 - DNA, 22 bp, Homo sapiens
tgtttgctatatcctacttcat

SEQ ID NO: 7360022 - DNA, 22 bp, Homo sapiens
tgtttgctctgactatcttgcg

SEQ ID NO: 7360023 - DNA, 22 bp, Homo sapiens
tgtttgctctgactatcttgcg

SEQ ID NO: 7360024 - DNA, 22 bp, Homo sapiens
tgtttgctgttttctccaatga

SEQ ID NO: 7360025 - DNA, 18 bp, Homo sapiens
tgtttatttttctcttac

SEQ ID NO: 7360026 - DNA, 22 bp, Homo sapiens
tgtttcaaaacagtgataattt

SEQ ID NO: 7360027 - DNA, 22 bp, Homo sapiens
tgtttttgttcaatgctaggtc

SEQ ID NO: 7360028 - DNA, 22 bp, Homo sapiens
ttaaaacagcgtgaatctggca

SEQ ID NO: 7360029 - DNA, 22 bp, Homo sapiens
ttaaaatgcagattctgattca

SEQ ID NO: 7360030 - DNA, 23 bp, Homo sapiens
ttaaaatgtggtctctccctagt

SEQ ID NO: 7360031 - DNA, 17 bp, Homo sapiens
ttaaaccataaagaagg

SEQ ID NO: 7360032 - DNA, 22 bp, Homo sapiens
ttaaaccatagtttaacataag

SEQ ID NO: 7360033 - DNA, 22 bp, Homo sapiens
ttaaacagagtctgaaatgtaa

SEQ ID NO: 7360034 - DNA, 22 bp, Homo sapiens
ttaaacaggtttttgaatggcc

SEQ ID NO: 7360035 - DNA, 22 bp, Homo sapiens
tgttctttgctgttgatgtaga

SEQ ID NO: 7360036 - DNA, 22 bp, Homo sapiens
tgttctttgccagtgatttaat

SEQ ID NO: 7360037 - DNA, 22 bp, Homo sapiens
tgttagcaaggataattatgat

SEQ ID NO: 7360038 - DNA, 22 bp, Homo sapiens
tgttagaatattgtaatattcg

SEQ ID NO: 7360039 - DNA, 22 bp, Homo sapiens
tgttcttaggtatttgacagtc

SEQ ID NO: 7360040 - DNA, 22 bp, Homo sapiens
tgttaaatgttttgctagtgtc

SEQ ID NO: 7360041 - DNA, 22 bp, Homo sapiens
tgttaacatactgctttctaat

SEQ ID NO: 7360042 - DNA, 22 bp, Homo sapiens
tgttaaatgtattatgtgttct

SEQ ID NO: 7360043 - DNA, 22 bp, Homo sapiens
tgttaaatgttcctttactgga

SEQ ID NO: 7360044 - DNA, 22 bp, Homo sapiens
tgttaaatgtattatgtgttct

SEQ ID NO: 7360045 - DNA, 18 bp, Homo sapiens
tgttaaatgaagatttgc

SEQ ID NO: 7360046 - DNA, 22 bp, Homo sapiens
tgttaagagagtttctaatatt

SEQ ID NO: 7360047 - DNA, 22 bp, Homo sapiens
tgttaagagaagctctctctga

SEQ ID NO: 7360048 - DNA, 22 bp, Homo sapiens
tgttaaggaaactgtggggtta

SEQ ID NO: 7360049 - DNA, 22 bp, Homo sapiens
tgttaaggagacacatgaaaaa

SEQ ID NO: 7360050 - DNA, 22 bp, Homo sapiens
tgttactgagtaatgtatagat

SEQ ID NO: 7360051 - DNA, 22 bp, Homo sapiens
tgttactgagtaatgtatagat

SEQ ID NO: 7360052 - DNA, 18 bp, Homo sapiens
tgttactgagttatgttc

SEQ ID NO: 7360053 - DNA, 22 bp, Homo sapiens
tgttactgatttgatatacagt

SEQ ID NO: 7360054 - DNA, 22 bp, Homo sapiens
tgttactgggcatctagtgggt

SEQ ID NO: 7360055 - DNA, 22 bp, Homo sapiens
tgtttattcatggctaatgaaa

SEQ ID NO: 7360056 - DNA, 22 bp, Homo sapiens
tgtttattgcagtgctgggctg

SEQ ID NO: 7360057 - DNA, 22 bp, Homo sapiens
tgttgtactcaacagatgaatt

SEQ ID NO: 7360058 - DNA, 22 bp, Homo sapiens
tgttgtaatcattttatgaaaa

SEQ ID NO: 7360059 - DNA, 22 bp, Homo sapiens
tgtttaaatagaacatactgca

SEQ ID NO: 7360060 - DNA, 22 bp, Homo sapiens
tgtttaagcctgtggtgtcatc

SEQ ID NO: 7360061 - DNA, 22 bp, Homo sapiens
tgtttaagctgatgaggtatcg

SEQ ID NO: 7360062 - DNA, 21 bp, Homo sapiens
tgttgttttatggctatgaat

SEQ ID NO: 7360063 - DNA, 22 bp, Homo sapiens
tgttgttttctcatggagaata

SEQ ID NO: 7360064 - DNA, 22 bp, Homo sapiens
tgttgtttctactaataggcca

SEQ ID NO: 7360065 - DNA, 23 bp, Homo sapiens
tgttgtgactggatgctttgtcc

SEQ ID NO: 7360066 - DNA, 22 bp, Homo sapiens
tgtgtgtgtcctcatttgcaga

SEQ ID NO: 7360067 - DNA, 22 bp, Homo sapiens
tgtgtgtgtgcgcgcacgcata

SEQ ID NO: 7360068 - DNA, 22 bp, Homo sapiens
tgtgtgtgtgcgcgcacgcata

SEQ ID NO: 7360069 - DNA, 22 bp, Homo sapiens
tgtgtgtgttcctcctcagcta

SEQ ID NO: 7360070 - DNA, 22 bp, Homo sapiens
tgtgtgtgttcctcctcagcta

SEQ ID NO: 7360071 - DNA, 23 bp, Homo sapiens
tgtgtgtgtattctacgcaaggt

SEQ ID NO: 7360072 - DNA, 20 bp, Homo sapiens
tgtgtgtgtacttctaaata

SEQ ID NO: 7360073 - DNA, 20 bp, Homo sapiens
tgtgtgtgtacttctaaata

SEQ ID NO: 7360074 - DNA, 21 bp, Homo sapiens
tgtgtgtgcaggcacacacac

SEQ ID NO: 7360075 - DNA, 22 bp, Homo sapiens
tgtgtgtgcaggagagcaggtg

SEQ ID NO: 7360076 - DNA, 22 bp, Homo sapiens
tgtgtgtgtaaaagcatttata

SEQ ID NO: 7360077 - DNA, 22 bp, Homo sapiens
tgtgtgtggggaggcagcagat

SEQ ID NO: 7360078 - DNA, 22 bp, Homo sapiens
tgtgtgtgggcggaacggcccc

SEQ ID NO: 7360079 - DNA, 20 bp, Homo sapiens
tgttaaaggacacttgcttt

SEQ ID NO: 7360080 - DNA, 20 bp, Homo sapiens
tgttaaaggacacttgcttt

SEQ ID NO: 7360081 - DNA, 22 bp, Homo sapiens
tgttaaactgtattgcataagg

SEQ ID NO: 7360082 - DNA, 22 bp, Homo sapiens
tgttaaacagctgtcttcttca

SEQ ID NO: 7360083 - DNA, 22 bp, Homo sapiens
tgtgttaagtatttgatacact

SEQ ID NO: 7360084 - DNA, 22 bp, Homo sapiens
tgtgttaaggtgcatctagtgc

SEQ ID NO: 7360085 - DNA, 22 bp, Homo sapiens
tgtgttaacactgcatgataat

SEQ ID NO: 7360086 - DNA, 19 bp, Homo sapiens
tgtgtgtttatatatgtat

SEQ ID NO: 7360087 - DNA, 19 bp, Homo sapiens
tgtgtgtttatatatgtat

SEQ ID NO: 7360088 - DNA, 22 bp, Homo sapiens
tgtgtgtgtttctgctcataca

SEQ ID NO: 7360089 - DNA, 22 bp, Homo sapiens
tgtgtgttaacttatttaatgt

SEQ ID NO: 7360090 - DNA, 22 bp, Homo sapiens
tgtgtgttagtctcaaagccgt

SEQ ID NO: 7360091 - DNA, 22 bp, Homo sapiens
tgtgtgttatcttagttcatct

SEQ ID NO: 7360092 - DNA, 22 bp, Homo sapiens
tgtgtgttctcaattattgatg

SEQ ID NO: 7360093 - DNA, 22 bp, Homo sapiens
tgtgtgttggctggagagggct

SEQ ID NO: 7360094 - DNA, 22 bp, Homo sapiens
tgtgtgttcagagatagatata

SEQ ID NO: 7360095 - DNA, 22 bp, Homo sapiens
tgtgtgttcagagatagatata

SEQ ID NO: 7360096 - DNA, 22 bp, Homo sapiens
tgtgtgttcagagatagatata

SEQ ID NO: 7360097 - DNA, 22 bp, Homo sapiens
tgtgtgttattttcagccatta

SEQ ID NO: 7360098 - DNA, 22 bp, Homo sapiens
tgtgtgttattttcagccatta

SEQ ID NO: 7360099 - DNA, 22 bp, Homo sapiens
tgtgtgttattttcagccatta

SEQ ID NO: 7360100 - DNA, 22 bp, Homo sapiens
tgtgtgtgtttctgctcataca

SEQ ID NO: 7360101 - DNA, 22 bp, Homo sapiens
tgtgtgtgtttataaatctaaa

SEQ ID NO: 7360102 - DNA, 22 bp, Homo sapiens
tgtgtgtgtttataaatctaaa

SEQ ID NO: 7360103 - DNA, 22 bp, Homo sapiens
tgtgtgcattagcattctaggg

SEQ ID NO: 7360104 - DNA, 22 bp, Homo sapiens
tgtgtgctaatgtatgctctaa

SEQ ID NO: 7360105 - DNA, 20 bp, Homo sapiens
tgtgtgctaggactacagtg

SEQ ID NO: 7360106 - DNA, 22 bp, Homo sapiens
tgtgtgccagggcatgcacagg

SEQ ID NO: 7360107 - DNA, 22 bp, Homo sapiens
tgtgtattaccattttacagct

SEQ ID NO: 7360108 - DNA, 22 bp, Homo sapiens
tgtgtatttctggaacagacta

SEQ ID NO: 7360109 - DNA, 20 bp, Homo sapiens
tgtgtagcaggtgctgtgcc

SEQ ID NO: 7360110 - DNA, 22 bp, Homo sapiens
tgtgtagaaagatctccaagat

SEQ ID NO: 7360111 - DNA, 17 bp, Homo sapiens
tgtgtagagcatcgcca

SEQ ID NO: 7360112 - DNA, 22 bp, Homo sapiens
tgtgtagaggtaagtaacactt

SEQ ID NO: 7360113 - DNA, 22 bp, Homo sapiens
tgtgtattctgaggtaggtata

SEQ ID NO: 7360114 - DNA, 22 bp, Homo sapiens
tgtgtgggagcacgggctgttg

SEQ ID NO: 7360115 - DNA, 22 bp, Homo sapiens
tgtgtgcttaagggctgaacct

SEQ ID NO: 7360116 - DNA, 19 bp, Homo sapiens
tgtgtgctgactgccagag

SEQ ID NO: 7360117 - DNA, 22 bp, Homo sapiens
tgtgtgctcgatggccctgcag

SEQ ID NO: 7360118 - DNA, 22 bp, Homo sapiens
tgtgtgctctaatgcctagtac

SEQ ID NO: 7360119 - DNA, 22 bp, Homo sapiens
tgtgtggatgcagcgtgggtct

SEQ ID NO: 7360120 - DNA, 22 bp, Homo sapiens
tgtgtgcttatagtctagtagt

SEQ ID NO: 7360121 - DNA, 22 bp, Homo sapiens
tgtgtgtgcacatgcatataca

SEQ ID NO: 7360122 - DNA, 22 bp, Homo sapiens
tgtgtgtgagtcctggctttcc

SEQ ID NO: 7360123 - DNA, 22 bp, Homo sapiens
tgtgtgtgagtcctggctttcc

SEQ ID NO: 7360124 - DNA, 22 bp, Homo sapiens
tgtgtgtgagtcctggctttcc

SEQ ID NO: 7360125 - DNA, 22 bp, Homo sapiens
tgtgtgtgactcatactagaac

SEQ ID NO: 7360126 - DNA, 22 bp, Homo sapiens
tgtgtgtgactcatactagaac

SEQ ID NO: 7360127 - DNA, 22 bp, Homo sapiens
tgtgtgtgacaacctagttcag

SEQ ID NO: 7360128 - DNA, 22 bp, Homo sapiens
tgtgtgtgacaacctagttcag

SEQ ID NO: 7360129 - DNA, 22 bp, Homo sapiens
tgtgggagaaggaagcaagctg

SEQ ID NO: 7360130 - DNA, 22 bp, Homo sapiens
tgtggaagtcgcctctccttgg

SEQ ID NO: 7360131 - DNA, 22 bp, Homo sapiens
tgtggaagaacttcttgcttgg

SEQ ID NO: 7360132 - DNA, 22 bp, Homo sapiens
tgtggacaagatgccaattgat

SEQ ID NO: 7360133 - DNA, 22 bp, Homo sapiens
tgtggacaagatgccaattgat

SEQ ID NO: 7360134 - DNA, 22 bp, Homo sapiens
tgtggacaccactgggaggtct

SEQ ID NO: 7360135 - DNA, 22 bp, Homo sapiens
tgtggacaccactgggactgga

SEQ ID NO: 7360136 - DNA, 22 bp, Homo sapiens
tgtggctgactcctggtcccca

SEQ ID NO: 7360137 - DNA, 22 bp, Homo sapiens
tgtgggccaggaggcctcagtg

SEQ ID NO: 7360138 - DNA, 23 bp, Homo sapiens
tgtgggcgcattgtaagggtagc

SEQ ID NO: 7360139 - DNA, 23 bp, Homo sapiens
tgtgggcgcattgtaagggtagc

SEQ ID NO: 7360140 - DNA, 19 bp, Homo sapiens
tgtgggcaagggatggcag

SEQ ID NO: 7360141 - DNA, 22 bp, Homo sapiens
tgtgtacacacagatatataca

SEQ ID NO: 7360142 - DNA, 22 bp, Homo sapiens
tgtgtacacgagaggttatata

SEQ ID NO: 7360143 - DNA, 22 bp, Homo sapiens
tgtgtacaggacagaaaggagg

SEQ ID NO: 7360144 - DNA, 22 bp, Homo sapiens
tgtgtacatatacacaaataca

SEQ ID NO: 7360145 - DNA, 19 bp, Homo sapiens
tgtgtacctaatgtttgtg

SEQ ID NO: 7360146 - DNA, 22 bp, Homo sapiens
tgtgtacaagcctgagtacaga

SEQ ID NO: 7360147 - DNA, 22 bp, Homo sapiens
tgtggggactgagtggaggctt

SEQ ID NO: 7360148 - DNA, 22 bp, Homo sapiens
tgtgtacacaagtatatataca

SEQ ID NO: 7360149 - DNA, 22 bp, Homo sapiens
tgtggggacccatgccatgggc

SEQ ID NO: 7360150 - DNA, 22 bp, Homo sapiens
ttagtcctggatctcagagttc

SEQ ID NO: 7360151 - DNA, 22 bp, Homo sapiens
ttatcttggtgttttagtaatt

SEQ ID NO: 7360152 - DNA, 22 bp, Homo sapiens
ttatcttgtagagatattttcg

SEQ ID NO: 7360153 - DNA, 22 bp, Homo sapiens
ttatgaaagacatttctgttgg

SEQ ID NO: 7360154 - DNA, 22 bp, Homo sapiens
ttatgcaaagaaatagactaat

SEQ ID NO: 7360155 - DNA, 22 bp, Homo sapiens
ttatgatttgccacagattggt

SEQ ID NO: 7360156 - DNA, 19 bp, Homo sapiens
ttattctgtcagagcacac

SEQ ID NO: 7360157 - DNA, 22 bp, Homo sapiens
ttatttcattgatttctaagac

SEQ ID NO: 7360158 - DNA, 22 bp, Homo sapiens
ttatttccctgagggttgcagg

SEQ ID NO: 7360159 - DNA, 21 bp, Homo sapiens
ttattctgagatgagattctt

SEQ ID NO: 7360160 - DNA, 22 bp, Homo sapiens
ttattctgactaatgtataact

SEQ ID NO: 7360161 - DNA, 22 bp, Homo sapiens
ttattcccactgtgaaatgagg

SEQ ID NO: 7360162 - DNA, 22 bp, Homo sapiens
ttattcagtgcatatattaaaa

SEQ ID NO: 7360163 - DNA, 22 bp, Homo sapiens
ttagggacaaatttgcagaacc

SEQ ID NO: 7360164 - DNA, 22 bp, Homo sapiens
ttagggaaatattgtaggttag

SEQ ID NO: 7360165 - DNA, 22 bp, Homo sapiens
ttagggaaggacagtgaagaaa

SEQ ID NO: 7360166 - DNA, 22 bp, Homo sapiens
ttagggaaggctgctgtcagct

SEQ ID NO: 7360167 - DNA, 22 bp, Homo sapiens
ttagggaactctcatcgtgaag

SEQ ID NO: 7360168 - DNA, 22 bp, Homo sapiens
ttagatttacaagcactgttta

SEQ ID NO: 7360169 - DNA, 22 bp, Homo sapiens
ttagatttatatgtgagaatgg

SEQ ID NO: 7360170 - DNA, 22 bp, Homo sapiens
ttagatgtttatatacagattt

SEQ ID NO: 7360171 - DNA, 22 bp, Homo sapiens
ttagatgtgtatatacatgtca

SEQ ID NO: 7360172 - DNA, 22 bp, Homo sapiens
ttagatttgtagtgagttcaga

SEQ ID NO: 7360173 - DNA, 22 bp, Homo sapiens
ttagcattctgcctcctatatc

SEQ ID NO: 7360174 - DNA, 22 bp, Homo sapiens
ttagcagctaaactgacagacc

SEQ ID NO: 7360175 - DNA, 22 bp, Homo sapiens
ttagaaatcacctctgaagatc

SEQ ID NO: 7360176 - DNA, 22 bp, Homo sapiens
ttagaaatacaagtgaggttga

SEQ ID NO: 7360177 - DNA, 22 bp, Homo sapiens
ttagaaaggttttgctctgaaa

SEQ ID NO: 7360178 - DNA, 22 bp, Homo sapiens
ttagaaaggggtgaatcaatgg

SEQ ID NO: 7360179 - DNA, 22 bp, Homo sapiens
ttagaaagggtgtctgaatctg

SEQ ID NO: 7360180 - DNA, 22 bp, Homo sapiens
ttagaaaggaatcttcatttca

SEQ ID NO: 7360181 - DNA, 22 bp, Homo sapiens
ttagaaaggagcttatttcttt

SEQ ID NO: 7360182 - DNA, 22 bp, Homo sapiens
ttagaacatagcaacagaatta

SEQ ID NO: 7360183 - DNA, 22 bp, Homo sapiens
ttagaacatagcaacagaatta

SEQ ID NO: 7360184 - DNA, 22 bp, Homo sapiens
ttagaagcactaattactcaca

SEQ ID NO: 7360185 - DNA, 22 bp, Homo sapiens
ttacagatggatctagcaaaat

SEQ ID NO: 7360186 - DNA, 22 bp, Homo sapiens
ttacagatggggttgcaataaa

SEQ ID NO: 7360187 - DNA, 22 bp, Homo sapiens
ttacagatggggttgcaataaa

SEQ ID NO: 7360188 - DNA, 22 bp, Homo sapiens
ttacagatgtaggaactgaagt

SEQ ID NO: 7360189 - DNA, 22 bp, Homo sapiens
ttacatgcaggtcagactgcat

SEQ ID NO: 7360190 - DNA, 22 bp, Homo sapiens
ttacattttagttaacctgtga

SEQ ID NO: 7360191 - DNA, 22 bp, Homo sapiens
ttacattttagttaacctgtga

SEQ ID NO: 7360192 - DNA, 22 bp, Homo sapiens
ttacattgtccagaaattattg

SEQ ID NO: 7360193 - DNA, 22 bp, Homo sapiens
ttacattgtccagaaattattg

SEQ ID NO: 7360194 - DNA, 22 bp, Homo sapiens
ttacattaagccaatggattct

SEQ ID NO: 7360195 - DNA, 22 bp, Homo sapiens
ttacattaagccaatggattct

SEQ ID NO: 7360196 - DNA, 22 bp, Homo sapiens
ttacattagacccactttcatg

SEQ ID NO: 7360197 - DNA, 22 bp, Homo sapiens
ttacaagatatgtgagaactag

SEQ ID NO: 7360198 - DNA, 22 bp, Homo sapiens
ttacagagtagtgcagaactca

SEQ ID NO: 7360199 - DNA, 22 bp, Homo sapiens
ttacagatactttgtaggcaag

SEQ ID NO: 7360200 - DNA, 22 bp, Homo sapiens
ttacagatactttgtaggcaag

SEQ ID NO: 7360201 - DNA, 22 bp, Homo sapiens
ttacagagggcttctctgaact

SEQ ID NO: 7360202 - DNA, 22 bp, Homo sapiens
ttacagagataaactgtaagtg

SEQ ID NO: 7360203 - DNA, 22 bp, Homo sapiens
ttacagaaaatgtgttttaact

SEQ ID NO: 7360204 - DNA, 22 bp, Homo sapiens
ttacagaaaagggctttaagag

SEQ ID NO: 7360205 - DNA, 22 bp, Homo sapiens
ttacaacaccaggcagtatcct

SEQ ID NO: 7360206 - DNA, 17 bp, Homo sapiens
ttacaacaattcatgag

SEQ ID NO: 7360207 - DNA, 23 bp, Homo sapiens
ttacaacagtgtccatatttgta

SEQ ID NO: 7360208 - DNA, 22 bp, Homo sapiens
ttacaacactacttatccttga

SEQ ID NO: 7360209 - DNA, 22 bp, Homo sapiens
ttacaacagacacatattctaa

SEQ ID NO: 7360210 - DNA, 22 bp, Homo sapiens
ttacaacatatgataggagtct

SEQ ID NO: 7360211 - DNA, 22 bp, Homo sapiens
ttacaacatatttagcttgatt

SEQ ID NO: 7360212 - DNA, 21 bp, Homo sapiens
ttacaacatttgtgttctatg

SEQ ID NO: 7360213 - DNA, 22 bp, Homo sapiens
ttacaactggtgaattttatgg

SEQ ID NO: 7360214 - DNA, 22 bp, Homo sapiens
ttacaactctgaactacagagg

SEQ ID NO: 7360215 - DNA, 22 bp, Homo sapiens
ttacaactctgtcagtatagct

SEQ ID NO: 7360216 - DNA, 22 bp, Homo sapiens
ttaaagcaaccatcaatttgga

SEQ ID NO: 7360217 - DNA, 22 bp, Homo sapiens
ttaaagcagtttgtatacatgg

SEQ ID NO: 7360218 - DNA, 22 bp, Homo sapiens
ttaaagagtaatcataggtcaa

SEQ ID NO: 7360219 - DNA, 22 bp, Homo sapiens
ttaaagagtaatcataggtcaa

SEQ ID NO: 7360220 - DNA, 22 bp, Homo sapiens
ttaaactatagcttgatgtgaa

SEQ ID NO: 7360221 - DNA, 22 bp, Homo sapiens
ttaaacctcagagtctttttca

SEQ ID NO: 7360222 - DNA, 22 bp, Homo sapiens
ttaatggattggaggtttcaat

SEQ ID NO: 7360223 - DNA, 22 bp, Homo sapiens
ttaatggactaggcagttgtaa

SEQ ID NO: 7360224 - DNA, 22 bp, Homo sapiens
ttaatggccccattttatgtct

SEQ ID NO: 7360225 - DNA, 22 bp, Homo sapiens
ttatttgtgaatcatttatcta

SEQ ID NO: 7360226 - DNA, 22 bp, Homo sapiens
ttatttcttgtctatgtagcca

SEQ ID NO: 7360227 - DNA, 22 bp, Homo sapiens
ttatttcttgtctatgtagcca

SEQ ID NO: 7360228 - DNA, 22 bp, Homo sapiens
ttatttcttgtctatgtagcca

SEQ ID NO: 7360229 - DNA, 22 bp, Homo sapiens
ttatttgaatgatggcacaatt

SEQ ID NO: 7360230 - DNA, 20 bp, Homo sapiens
ttatttctcattctcctact

SEQ ID NO: 7360231 - DNA, 20 bp, Homo sapiens
ttatttctcattctcctact

SEQ ID NO: 7360232 - DNA, 22 bp, Homo sapiens
ttatttctactattttgcctga

SEQ ID NO: 7360233 - DNA, 22 bp, Homo sapiens
ttcacattggtgatatgtttct

SEQ ID NO: 7360234 - DNA, 22 bp, Homo sapiens
ttcacatttcataccacagctt

SEQ ID NO: 7360235 - DNA, 22 bp, Homo sapiens
ttcaccaggtgtacagttagtt

SEQ ID NO: 7360236 - DNA, 18 bp, Homo sapiens
ttcaccaggtagataggg

SEQ ID NO: 7360237 - DNA, 22 bp, Homo sapiens
ttcaccagattttgtatagtca

SEQ ID NO: 7360238 - DNA, 22 bp, Homo sapiens
ttcaccagcagctcactagtca

SEQ ID NO: 7360239 - DNA, 22 bp, Homo sapiens
ttcaccagaggttagaatattt

SEQ ID NO: 7360240 - DNA, 22 bp, Homo sapiens
ttcaccatcattaacttcatgt

SEQ ID NO: 7360241 - DNA, 21 bp, Homo sapiens
ttcagcagtcctctagagata

SEQ ID NO: 7360242 - DNA, 22 bp, Homo sapiens
ttcactgcagcccatgaaggga

SEQ ID NO: 7360243 - DNA, 22 bp, Homo sapiens
ttcactgagagacatgaaggtc

SEQ ID NO: 7360244 - DNA, 22 bp, Homo sapiens
ttcactgaagtttcttccatgt

SEQ ID NO: 7360245 - DNA, 22 bp, Homo sapiens
ttcactgaattaaaaagagtat

SEQ ID NO: 7360246 - DNA, 22 bp, Homo sapiens
ttcactgaattaatttccttct

SEQ ID NO: 7360247 - DNA, 22 bp, Homo sapiens
ttcaccctggaccagaaattgg

SEQ ID NO: 7360248 - DNA, 22 bp, Homo sapiens
ttcagctcagcactgacaagat

SEQ ID NO: 7360249 - DNA, 21 bp, Homo sapiens
ttcagctctgcttcagggaat

SEQ ID NO: 7360250 - DNA, 22 bp, Homo sapiens
ttcagccagtcatcagtcttgt

SEQ ID NO: 7360251 - DNA, 22 bp, Homo sapiens
ttcagcctgtctgcagacccct

SEQ ID NO: 7360252 - DNA, 22 bp, Homo sapiens
ttcagcctgttcatgctgttgc

SEQ ID NO: 7360253 - DNA, 22 bp, Homo sapiens
ttcattcagcacatatttattg

SEQ ID NO: 7360254 - DNA, 22 bp, Homo sapiens
ttcattcagcacatatttattg

SEQ ID NO: 7360255 - DNA, 22 bp, Homo sapiens
ttcattcaggtgtatttatggg

SEQ ID NO: 7360256 - DNA, 21 bp, Homo sapiens
ttcattcatggcataatatag

SEQ ID NO: 7360257 - DNA, 22 bp, Homo sapiens
ttcattcatctctaaaatgcct

SEQ ID NO: 7360258 - DNA, 22 bp, Homo sapiens
ttcatgttttattcagtaatta

SEQ ID NO: 7360259 - DNA, 22 bp, Homo sapiens
ttcattaagtataaaatgtggt

SEQ ID NO: 7360260 - DNA, 22 bp, Homo sapiens
ttcattcatgtattgtctatgg

SEQ ID NO: 7360261 - DNA, 22 bp, Homo sapiens
ttcattgatttaacaaacaagt

SEQ ID NO: 7360262 - DNA, 22 bp, Homo sapiens
ttccagaggcctgggcacactc

SEQ ID NO: 7360263 - DNA, 22 bp, Homo sapiens
ttcattgatagttttatgtatg

SEQ ID NO: 7360264 - DNA, 22 bp, Homo sapiens
tgtatgcttgagtgtgtatact

SEQ ID NO: 7360265 - DNA, 22 bp, Homo sapiens
tgtatgtatacacatagatacg

SEQ ID NO: 7360266 - DNA, 22 bp, Homo sapiens
tgtatgtatacactgatcatca

SEQ ID NO: 7360267 - DNA, 22 bp, Homo sapiens
tgtatgtatacactgatcatca

SEQ ID NO: 7360268 - DNA, 22 bp, Homo sapiens
tgtatgtatacactgatcatca

SEQ ID NO: 7360269 - DNA, 22 bp, Homo sapiens
tgtattcttagttttaatcaga

SEQ ID NO: 7360270 - DNA, 22 bp, Homo sapiens
tgtatgtaaagtttgtaataga

SEQ ID NO: 7360271 - DNA, 22 bp, Homo sapiens
tgtatgtaaagaaggatatttt

SEQ ID NO: 7360272 - DNA, 22 bp, Homo sapiens
tgtatgtaaaggtcttcatgtt

SEQ ID NO: 7360273 - DNA, 22 bp, Homo sapiens
tgtatgctttggttgtttctct

SEQ ID NO: 7360274 - DNA, 22 bp, Homo sapiens
tgtatgtaaagaaggatatttt

SEQ ID NO: 7360275 - DNA, 22 bp, Homo sapiens
tgtatgctttccttctttctgg

SEQ ID NO: 7360276 - DNA, 22 bp, Homo sapiens
tgtatgctttccttctttctgg

SEQ ID NO: 7360277 - DNA, 22 bp, Homo sapiens
tgtatgctttggttgtttctct

SEQ ID NO: 7360278 - DNA, 22 bp, Homo sapiens
tgtattgttataatttgtatgt

SEQ ID NO: 7360279 - DNA, 22 bp, Homo sapiens
tgtatttaattgtatcatcaca

SEQ ID NO: 7360280 - DNA, 22 bp, Homo sapiens
tgtatttaattgtatcatcaca

SEQ ID NO: 7360281 - DNA, 22 bp, Homo sapiens
tgtatttggtgtatttaatgag

SEQ ID NO: 7360282 - DNA, 22 bp, Homo sapiens
tgtatttgaaacagtgcatggg

SEQ ID NO: 7360283 - DNA, 22 bp, Homo sapiens
tgtatttgagttatgaaagaga

SEQ ID NO: 7360284 - DNA, 22 bp, Homo sapiens
tgtatttattcttctggtgttt

SEQ ID NO: 7360285 - DNA, 22 bp, Homo sapiens
tgtcaatgaaaatgtataaggt

SEQ ID NO: 7360286 - DNA, 22 bp, Homo sapiens
tgtcaatgggaatttgttttag

SEQ ID NO: 7360287 - DNA, 22 bp, Homo sapiens
tgtcaatgctggtcttgaatga

SEQ ID NO: 7360288 - DNA, 22 bp, Homo sapiens
tgtcaatgaagatatgaataat

SEQ ID NO: 7360289 - DNA, 22 bp, Homo sapiens
tgtcacagagcaactatttctt

SEQ ID NO: 7360290 - DNA, 22 bp, Homo sapiens
tgtcacaacagaggaactgaat

SEQ ID NO: 7360291 - DNA, 22 bp, Homo sapiens
tgtcaaactgtgacttctaatg

SEQ ID NO: 7360292 - DNA, 22 bp, Homo sapiens
tgtcacatgacacaaatatcta

SEQ ID NO: 7360293 - DNA, 22 bp, Homo sapiens
tgtcacatgtgtggcatttttc

SEQ ID NO: 7360294 - DNA, 22 bp, Homo sapiens
tgtcacctggaaatcactctaa

SEQ ID NO: 7360295 - DNA, 22 bp, Homo sapiens
tgtcacatgaagccaacatagc

SEQ ID NO: 7360296 - DNA, 22 bp, Homo sapiens
tgtcacatatataatgttcaat

SEQ ID NO: 7360297 - DNA, 22 bp, Homo sapiens
tgtcacatatataatgttcaat

SEQ ID NO: 7360298 - DNA, 22 bp, Homo sapiens
tgtcacataggcaaaatgtttt

SEQ ID NO: 7360299 - DNA, 22 bp, Homo sapiens
tgtcacataatttatctgtagg

SEQ ID NO: 7360300 - DNA, 22 bp, Homo sapiens
tgtagaacaagaaaatctcagt

SEQ ID NO: 7360301 - DNA, 22 bp, Homo sapiens
tgtagaaattagtaagatcaac

SEQ ID NO: 7360302 - DNA, 22 bp, Homo sapiens
tgtactaggggtgtggaaggta

SEQ ID NO: 7360303 - DNA, 22 bp, Homo sapiens
tgtacttcaaaccctttggttt

SEQ ID NO: 7360304 - DNA, 22 bp, Homo sapiens
tgtacttctggtgactttatag

SEQ ID NO: 7360305 - DNA, 22 bp, Homo sapiens
tgtagaggaggaaactgaggct

SEQ ID NO: 7360306 - DNA, 22 bp, Homo sapiens
tgtagcatgtaaattggttatt

SEQ ID NO: 7360307 - DNA, 22 bp, Homo sapiens
tgtataaatttaaattcctgct

SEQ ID NO: 7360308 - DNA, 22 bp, Homo sapiens
tgtatacaggattactcatagc

SEQ ID NO: 7360309 - DNA, 22 bp, Homo sapiens
tgtatcacatgactctgcacta

SEQ ID NO: 7360310 - DNA, 22 bp, Homo sapiens
tgtatgaacctttaatatagtg

SEQ ID NO: 7360311 - DNA, 22 bp, Homo sapiens
tgtatgaagacttcttctgtgt

SEQ ID NO: 7360312 - DNA, 22 bp, Homo sapiens
tgtatgaagccagaatctgttt

SEQ ID NO: 7360313 - DNA, 22 bp, Homo sapiens
tgtatgaggcatacatcaggca

SEQ ID NO: 7360314 - DNA, 22 bp, Homo sapiens
tgtatgaatgggaaaaggaaac

SEQ ID NO: 7360315 - DNA, 20 bp, Homo sapiens
tgtatattttctggtgtaaa

SEQ ID NO: 7360316 - DNA, 22 bp, Homo sapiens
tgtatcaagggtttatgtaagc

SEQ ID NO: 7360317 - DNA, 22 bp, Homo sapiens
tgtatatgagtctgagtgtaca

SEQ ID NO: 7360318 - DNA, 22 bp, Homo sapiens
tgtatatgtgtattttatgaca

SEQ ID NO: 7360319 - DNA, 22 bp, Homo sapiens
tgtatatgtgcacatgtgcttc

SEQ ID NO: 7360320 - DNA, 22 bp, Homo sapiens
tgtatatgtttgtatgtacaca

SEQ ID NO: 7360321 - DNA, 22 bp, Homo sapiens
tgtcctgggtggatgcttcatt

SEQ ID NO: 7360322 - DNA, 22 bp, Homo sapiens
tgtccttagaagaagtgaaaga

SEQ ID NO: 7360323 - DNA, 22 bp, Homo sapiens
tgtcctcagatatgtctactct

SEQ ID NO: 7360324 - DNA, 22 bp, Homo sapiens
tgtcctgggtcaaccaggtcga

SEQ ID NO: 7360325 - DNA, 22 bp, Homo sapiens
tgtcctggggacaagaggccct

SEQ ID NO: 7360326 - DNA, 22 bp, Homo sapiens
tgtcccctttctttccttcgta

SEQ ID NO: 7360327 - DNA, 22 bp, Homo sapiens
tgtccctggactccaggagcca

SEQ ID NO: 7360328 - DNA, 18 bp, Homo sapiens
tgtccctgcaaataacat

SEQ ID NO: 7360329 - DNA, 22 bp, Homo sapiens
tgtccctcattgacgctgtgcc

SEQ ID NO: 7360330 - DNA, 18 bp, Homo sapiens
tgtcataatatatcacct

SEQ ID NO: 7360331 - DNA, 22 bp, Homo sapiens
tgtcataacttagtgacaaatc

SEQ ID NO: 7360332 - DNA, 22 bp, Homo sapiens
tgtcatagtgtggtagcagtgg

SEQ ID NO: 7360333 - DNA, 22 bp, Homo sapiens
tgtcataatgctgctagaaatt

SEQ ID NO: 7360334 - DNA, 22 bp, Homo sapiens
tgtcagtgtatacatacagtat

SEQ ID NO: 7360335 - DNA, 22 bp, Homo sapiens
tgtcactttggggagagttttg

SEQ ID NO: 7360336 - DNA, 22 bp, Homo sapiens
tgtcactgcagaaattttctcc

SEQ ID NO: 7360337 - DNA, 18 bp, Homo sapiens
tgtcactggataatggtc

SEQ ID NO: 7360338 - DNA, 22 bp, Homo sapiens
tgtcactgtcaatgtcaactac

SEQ ID NO: 7360339 - DNA, 19 bp, Homo sapiens
tgtcactgtcatggcccag

SEQ ID NO: 7360340 - DNA, 22 bp, Homo sapiens
tgtcactgttacatgaactctt

SEQ ID NO: 7360341 - DNA, 22 bp, Homo sapiens
tgtcactgtgctctgttcattt

SEQ ID NO: 7360342 - DNA, 22 bp, Homo sapiens
tgtcatatgtaatatgttcatt

SEQ ID NO: 7360343 - DNA, 22 bp, Homo sapiens
tgtcatctacccgttaggcttt

SEQ ID NO: 7360344 - DNA, 22 bp, Homo sapiens
tgtcatctcactgatatagatg

SEQ ID NO: 7360345 - DNA, 22 bp, Homo sapiens
tgtcatgcaggtttgttataga

SEQ ID NO: 7360346 - DNA, 22 bp, Homo sapiens
tgtcatgcaggtttgttataga

SEQ ID NO: 7360347 - DNA, 22 bp, Homo sapiens
tgtcatcttgtccagccaggca

SEQ ID NO: 7360348 - DNA, 22 bp, Homo sapiens
tgtcatctttttaaagaagaga

SEQ ID NO: 7360349 - DNA, 22 bp, Homo sapiens
tgtcatgaccatgataactaag

SEQ ID NO: 7360350 - DNA, 22 bp, Homo sapiens
tgtcatcttaaatcattcccac

SEQ ID NO: 7360351 - DNA, 22 bp, Homo sapiens
tgtcatcttcatcataagtaaa

SEQ ID NO: 7360352 - DNA, 22 bp, Homo sapiens
tgtcatcttcactgggtcacaa

SEQ ID NO: 7360353 - DNA, 22 bp, Homo sapiens
tgtcatcttggtctggaataag

SEQ ID NO: 7360354 - DNA, 22 bp, Homo sapiens
tgtcatctggcctggccttgtg

SEQ ID NO: 7360355 - DNA, 18 bp, Homo sapiens
tgtcatctgtttaaaacc

SEQ ID NO: 7360356 - DNA, 22 bp, Homo sapiens
tgtcatctgatattacttatag

SEQ ID NO: 7360357 - DNA, 22 bp, Homo sapiens
tgtcatctggcctgattggtgt

SEQ ID NO: 7360358 - DNA, 22 bp, Homo sapiens
tgtcatctgtgttttgctggag

SEQ ID NO: 7360359 - DNA, 23 bp, Homo sapiens
tgtcatctccagactcccagtgc

SEQ ID NO: 7360360 - DNA, 22 bp, Homo sapiens
tgtcatctcttgcaggaagcct

SEQ ID NO: 7360361 - DNA, 22 bp, Homo sapiens
tgtcatctgaatttctcatcac

SEQ ID NO: 7360362 - DNA, 22 bp, Homo sapiens
tgtcatctgcgggtggcactgc

SEQ ID NO: 7360363 - DNA, 23 bp, Homo sapiens
tgtcattgtgactacagaaccag

SEQ ID NO: 7360364 - DNA, 20 bp, Homo sapiens
tgtcattgtttctaggacct

SEQ ID NO: 7360365 - DNA, 18 bp, Homo sapiens
tgtcattgccagggaagc

SEQ ID NO: 7360366 - DNA, 22 bp, Homo sapiens
tgtcattgaggaaaactaggtg

SEQ ID NO: 7360367 - DNA, 22 bp, Homo sapiens
tgtcatttcctgaatgctgagt

SEQ ID NO: 7360368 - DNA, 22 bp, Homo sapiens
tgtccaagaacagactgccagg

SEQ ID NO: 7360369 - DNA, 22 bp, Homo sapiens
tggtcctggggtgcaggctgac

SEQ ID NO: 7360370 - DNA, 22 bp, Homo sapiens
tggtcctgtctcaaggagcctt

SEQ ID NO: 7360371 - DNA, 22 bp, Homo sapiens
tggtctcccagagcagggacgc

SEQ ID NO: 7360372 - DNA, 22 bp, Homo sapiens
tggtctctgactctgaagaccc

SEQ ID NO: 7360373 - DNA, 22 bp, Homo sapiens
tggtcgtggggcttcccaggat

SEQ ID NO: 7360374 - DNA, 22 bp, Homo sapiens
tggtgaggtcatagagaactgt

SEQ ID NO: 7360375 - DNA, 22 bp, Homo sapiens
tggtgaggtcatagagaactgt

SEQ ID NO: 7360376 - DNA, 22 bp, Homo sapiens
tggtgaggccaaagccatgaca

SEQ ID NO: 7360377 - DNA, 22 bp, Homo sapiens
tggtgaggaagacctgctcctg

SEQ ID NO: 7360378 - DNA, 22 bp, Homo sapiens
tggtgaggccaaagccatgaca

SEQ ID NO: 7360379 - DNA, 22 bp, Homo sapiens
tggtgagcgatgctgcatgttc

SEQ ID NO: 7360380 - DNA, 18 bp, Homo sapiens
tggtgaagggtggaggag

SEQ ID NO: 7360381 - DNA, 22 bp, Homo sapiens
tggtcctgccccgtgcacagag

SEQ ID NO: 7360382 - DNA, 22 bp, Homo sapiens
tggtcctcaccctacccagctg

SEQ ID NO: 7360383 - DNA, 22 bp, Homo sapiens
tggtcctcaggttctctgtgcg

SEQ ID NO: 7360384 - DNA, 22 bp, Homo sapiens
tggtcaggctgctctgcggcgt

SEQ ID NO: 7360385 - DNA, 22 bp, Homo sapiens
tggtcagttgatcaggcagcag

SEQ ID NO: 7360386 - DNA, 22 bp, Homo sapiens
tggtcaggtacctctggctgtc

SEQ ID NO: 7360387 - DNA, 22 bp, Homo sapiens
tggtcaggtacctctggctgtc

SEQ ID NO: 7360388 - DNA, 22 bp, Homo sapiens
tggtcagttgcatcagagaagt

SEQ ID NO: 7360389 - DNA, 22 bp, Homo sapiens
tggtgcagtagaaggccgactt

SEQ ID NO: 7360390 - DNA, 22 bp, Homo sapiens
tggtgcaggtgttgatgcagga

SEQ ID NO: 7360391 - DNA, 22 bp, Homo sapiens
tggtgcagtagaaggccgactt

SEQ ID NO: 7360392 - DNA, 22 bp, Homo sapiens
tggtgcagtagagctgtctggg

SEQ ID NO: 7360393 - DNA, 22 bp, Homo sapiens
tggtgcaggagttggcagggac

SEQ ID NO: 7360394 - DNA, 22 bp, Homo sapiens
tggtgcaggagttggcagggac

SEQ ID NO: 7360395 - DNA, 22 bp, Homo sapiens
tggtgcaggccaagctgcgagc

SEQ ID NO: 7360396 - DNA, 22 bp, Homo sapiens
tggtgcagatgcaggtcactgg

SEQ ID NO: 7360397 - DNA, 22 bp, Homo sapiens
tggtgcagatagtggtgtagta

SEQ ID NO: 7360398 - DNA, 22 bp, Homo sapiens
tggtgccatcatagctcactgc

SEQ ID NO: 7360399 - DNA, 22 bp, Homo sapiens
tggtgccattagccctgctgtt

SEQ ID NO: 7360400 - DNA, 22 bp, Homo sapiens
tggtgcagtccaaagggagcag

SEQ ID NO: 7360401 - DNA, 22 bp, Homo sapiens
tggtgcagtccaaagggagcag

SEQ ID NO: 7360402 - DNA, 22 bp, Homo sapiens
tggtgcagttcccagggccggg

SEQ ID NO: 7360403 - DNA, 22 bp, Homo sapiens
tggtgcagttcccagggccggg

SEQ ID NO: 7360404 - DNA, 22 bp, Homo sapiens
tggtgcagtcattggcccaggg

SEQ ID NO: 7360405 - DNA, 22 bp, Homo sapiens
tggtggagtttctctttcaaac

SEQ ID NO: 7360406 - DNA, 19 bp, Homo sapiens
tggtggaggtgcacctgac

SEQ ID NO: 7360407 - DNA, 19 bp, Homo sapiens
tggtggaggtgcacctgac

SEQ ID NO: 7360408 - DNA, 22 bp, Homo sapiens
tggtggaggtgcatttcggagc

SEQ ID NO: 7360409 - DNA, 21 bp, Homo sapiens
tggtggagtgtgctgagcatg

SEQ ID NO: 7360410 - DNA, 22 bp, Homo sapiens
tggtgcccttgtgggtgagatg

SEQ ID NO: 7360411 - DNA, 22 bp, Homo sapiens
tggtgctgtggaggggcagaag

SEQ ID NO: 7360412 - DNA, 22 bp, Homo sapiens
tggtggagctgtggccacgacc

SEQ ID NO: 7360413 - DNA, 19 bp, Homo sapiens
tggtggaggccccatgttc

SEQ ID NO: 7360414 - DNA, 22 bp, Homo sapiens
tggtggagggaactatttccag

SEQ ID NO: 7360415 - DNA, 22 bp, Homo sapiens
tggtggagcctaggctaagtct

SEQ ID NO: 7360416 - DNA, 22 bp, Homo sapiens
tggtggagacctcgctaacccc

SEQ ID NO: 7360417 - DNA, 22 bp, Homo sapiens
tggtggagacctcgctaacccc

SEQ ID NO: 7360418 - DNA, 20 bp, Homo sapiens
tggtggagagaagctatttg

SEQ ID NO: 7360419 - DNA, 22 bp, Homo sapiens
tggtggagagacagtgtattgg

SEQ ID NO: 7360420 - DNA, 23 bp, Homo sapiens
tggtgggccctgcttgctcactg

SEQ ID NO: 7360421 - DNA, 22 bp, Homo sapiens
tggtgggctgagtctcatcgga

SEQ ID NO: 7360422 - DNA, 22 bp, Homo sapiens
tggtgggcacagtgcccaggct

SEQ ID NO: 7360423 - DNA, 22 bp, Homo sapiens
tgtaagaacaactgtcaaatgt

SEQ ID NO: 7360424 - DNA, 22 bp, Homo sapiens
tgtaagaaaagtaaatagtgac

SEQ ID NO: 7360425 - DNA, 22 bp, Homo sapiens
tgtaagaagggccagagctcca

SEQ ID NO: 7360426 - DNA, 22 bp, Homo sapiens
tgtaagaataatgatttctaag

SEQ ID NO: 7360427 - DNA, 22 bp, Homo sapiens
tgtaagtagtaatggaaggaca

SEQ ID NO: 7360428 - DNA, 22 bp, Homo sapiens
tgtaacatggttcttactctca

SEQ ID NO: 7360429 - DNA, 22 bp, Homo sapiens
tgtaaattgtcacctaaatgct

SEQ ID NO: 7360430 - DNA, 22 bp, Homo sapiens
tgtaaattgaaggaaatttgtg

SEQ ID NO: 7360431 - DNA, 23 bp, Homo sapiens
tgtaaattttgtagtcacatttt

SEQ ID NO: 7360432 - DNA, 22 bp, Homo sapiens
tgtaacaatgaatatagtgact

SEQ ID NO: 7360433 - DNA, 22 bp, Homo sapiens
tgtaacaaatacccttgaagtt

SEQ ID NO: 7360434 - DNA, 22 bp, Homo sapiens
tgtacagaggtgtacatatgat

SEQ ID NO: 7360435 - DNA, 22 bp, Homo sapiens
tgtacacgtggccatctttaca

SEQ ID NO: 7360436 - DNA, 22 bp, Homo sapiens
tgtacagtaggaacttgttatt

SEQ ID NO: 7360437 - DNA, 22 bp, Homo sapiens
tgtacagtatatttcaaagcca

SEQ ID NO: 7360438 - DNA, 22 bp, Homo sapiens
tgtacaggagaacaatgagaaa

SEQ ID NO: 7360439 - DNA, 19 bp, Homo sapiens
tgtacctgggtcatggtgc

SEQ ID NO: 7360440 - DNA, 22 bp, Homo sapiens
tgtacagtgccatgcagtttgc

SEQ ID NO: 7360441 - DNA, 22 bp, Homo sapiens
tgtacacaatgataaattatta

SEQ ID NO: 7360442 - DNA, 22 bp, Homo sapiens
tgtacaatctgatgatgtatgg

SEQ ID NO: 7360443 - DNA, 22 bp, Homo sapiens
tgtacaaggccatctacatgct

SEQ ID NO: 7360444 - DNA, 19 bp, Homo sapiens
tgtacaaggattatgcagg

SEQ ID NO: 7360445 - DNA, 22 bp, Homo sapiens
tgtacaagaataattttatata

SEQ ID NO: 7360446 - DNA, 20 bp, Homo sapiens
tggtgttagaccagagagtg

SEQ ID NO: 7360447 - DNA, 23 bp, Homo sapiens
tggttctaggcctataattatat

SEQ ID NO: 7360448 - DNA, 22 bp, Homo sapiens
tggttctaaaggactatacaga

SEQ ID NO: 7360449 - DNA, 22 bp, Homo sapiens
tggttccttctgcattttcagc

SEQ ID NO: 7360450 - DNA, 18 bp, Homo sapiens
tggtttctggaggaataa

SEQ ID NO: 7360451 - DNA, 22 bp, Homo sapiens
tggtttcccattatctgcagga

SEQ ID NO: 7360452 - DNA, 21 bp, Homo sapiens
tggtttatttcactcagcata

SEQ ID NO: 7360453 - DNA, 22 bp, Homo sapiens
tggttgtgtcacttagattaga

SEQ ID NO: 7360454 - DNA, 22 bp, Homo sapiens
tgtaaatcactgaactaaatga

SEQ ID NO: 7360455 - DNA, 22 bp, Homo sapiens
tgtaaattctatacacttaaaa

SEQ ID NO: 7360456 - DNA, 22 bp, Homo sapiens
tgtaaataatgcatgtaaatca

SEQ ID NO: 7360457 - DNA, 22 bp, Homo sapiens
tgtaaagttacttttgaaagga

SEQ ID NO: 7360458 - DNA, 22 bp, Homo sapiens
tgtaaataattcctaggctttt

SEQ ID NO: 7360459 - DNA, 21 bp, Homo sapiens
tggtttgcggccaaagttaaa

SEQ ID NO: 7360460 - DNA, 22 bp, Homo sapiens
tggtttgcccactcgagtgatt

SEQ ID NO: 7360461 - DNA, 22 bp, Homo sapiens
tggttttaaaagatgtttgaga

SEQ ID NO: 7360462 - DNA, 22 bp, Homo sapiens
tggttttaaaaacatgctgcat

SEQ ID NO: 7360463 - DNA, 22 bp, Homo sapiens
tgtaaaataattctccatgttt

SEQ ID NO: 7360464 - DNA, 22 bp, Homo sapiens
tgtaaaataccattccttgtca

SEQ ID NO: 7360465 - DNA, 22 bp, Homo sapiens
tgggaggcttccagaccttgct

SEQ ID NO: 7360466 - DNA, 22 bp, Homo sapiens
tgggaggtctcttgcggcctag

SEQ ID NO: 7360467 - DNA, 22 bp, Homo sapiens
tgggaggccgaggcaggtggat

SEQ ID NO: 7360468 - DNA, 22 bp, Homo sapiens
tgggagtgaggcagagtctatc

SEQ ID NO: 7360469 - DNA, 22 bp, Homo sapiens
tgggaggcccaggcctggcagg

SEQ ID NO: 7360470 - DNA, 22 bp, Homo sapiens
tgggaggccaaggcaggcggat

SEQ ID NO: 7360471 - DNA, 22 bp, Homo sapiens
tgggaggcaggtaggtgatgat

SEQ ID NO: 7360472 - DNA, 22 bp, Homo sapiens
tgggatgagctatatagaaagt

SEQ ID NO: 7360473 - DNA, 22 bp, Homo sapiens
tgggatgaggcctctgttgtga

SEQ ID NO: 7360474 - DNA, 22 bp, Homo sapiens
tgggatgagttgttaggactga

SEQ ID NO: 7360475 - DNA, 19 bp, Homo sapiens
tgggatgatgcagaaggta

SEQ ID NO: 7360476 - DNA, 22 bp, Homo sapiens
tgggcaagtatcggactctgag

SEQ ID NO: 7360477 - DNA, 21 bp, Homo sapiens
tgggcaagtttgggggtcctc

SEQ ID NO: 7360478 - DNA, 22 bp, Homo sapiens
tgggcagactgagccctgtccc

SEQ ID NO: 7360479 - DNA, 22 bp, Homo sapiens
tgggcagactaaggtcaaagct

SEQ ID NO: 7360480 - DNA, 22 bp, Homo sapiens
tgggcagagtcatacaggagac

SEQ ID NO: 7360481 - DNA, 22 bp, Homo sapiens
tgggcagaggctctgaagtcca

SEQ ID NO: 7360482 - DNA, 22 bp, Homo sapiens
tgggcagaggctctgaagtcca

SEQ ID NO: 7360483 - DNA, 22 bp, Homo sapiens
tgggcagagtagctcagaagaa

SEQ ID NO: 7360484 - DNA, 22 bp, Homo sapiens
tgggcagagtcatacaggagac

SEQ ID NO: 7360485 - DNA, 22 bp, Homo sapiens
tgggcagaggcagcagaaacct

SEQ ID NO: 7360486 - DNA, 22 bp, Homo sapiens
tgggcagaggacagggaagatc

SEQ ID NO: 7360487 - DNA, 22 bp, Homo sapiens
tgggcagagagtagaggcaacg

SEQ ID NO: 7360488 - DNA, 22 bp, Homo sapiens
tgggcagagagtagaggcaacg

SEQ ID NO: 7360489 - DNA, 22 bp, Homo sapiens
tgggcagagatctggatcaaac

SEQ ID NO: 7360490 - DNA, 22 bp, Homo sapiens
tgggcagagtcgtggggaatag

SEQ ID NO: 7360491 - DNA, 22 bp, Homo sapiens
tgggcagagttgtgatgaactg

SEQ ID NO: 7360492 - DNA, 15 bp, Homo sapiens
tgggcagatcacttg

SEQ ID NO: 7360493 - DNA, 21 bp, Homo sapiens
tgggcagatggcagtgtggct

SEQ ID NO: 7360494 - DNA, 16 bp, Homo sapiens
tgggcagatgagaaga

SEQ ID NO: 7360495 - DNA, 22 bp, Homo sapiens
tgggcagatctttggtggctag

SEQ ID NO: 7360496 - DNA, 22 bp, Homo sapiens
tgggcagatctttggtggctag

SEQ ID NO: 7360497 - DNA, 22 bp, Homo sapiens
tgggcagatgtcctctgaagtg

SEQ ID NO: 7360498 - DNA, 22 bp, Homo sapiens
tgggcagatgtggctctccttg

SEQ ID NO: 7360499 - DNA, 21 bp, Homo sapiens
tgggcagatggcagtgtggct

SEQ ID NO: 7360500 - DNA, 22 bp, Homo sapiens
tgggcagatgtcctctgaagtg

SEQ ID NO: 7360501 - DNA, 20 bp, Homo sapiens
tgggcagcactgctggctgg

SEQ ID NO: 7360502 - DNA, 20 bp, Homo sapiens
tgggcagcactgctggctgg

SEQ ID NO: 7360503 - DNA, 22 bp, Homo sapiens
tgggcagattaatgcagtggct

SEQ ID NO: 7360504 - DNA, 22 bp, Homo sapiens
tgggcagcaaagactgtgtgct

SEQ ID NO: 7360505 - DNA, 22 bp, Homo sapiens
tgggcagattaatgcagtggct

SEQ ID NO: 7360506 - DNA, 22 bp, Homo sapiens
tgggcagcagcaaagccagact

SEQ ID NO: 7360507 - DNA, 22 bp, Homo sapiens
tgggcagcatcctccacagtca

SEQ ID NO: 7360508 - DNA, 20 bp, Homo sapiens
tgggcagcactgctggctgg

SEQ ID NO: 7360509 - DNA, 22 bp, Homo sapiens
tgggcagcagaaccaggccgac

SEQ ID NO: 7360510 - DNA, 22 bp, Homo sapiens
tgggcagggatctcttttgcaa

SEQ ID NO: 7360511 - DNA, 22 bp, Homo sapiens
tgggcagggatctcttttgcaa

SEQ ID NO: 7360512 - DNA, 22 bp, Homo sapiens
tgggcaggggccctgcttccgt

SEQ ID NO: 7360513 - DNA, 22 bp, Homo sapiens
tgggcagggatctcttttgcaa

SEQ ID NO: 7360514 - DNA, 22 bp, Homo sapiens
tgggcagggagctggaaccaca

SEQ ID NO: 7360515 - DNA, 22 bp, Homo sapiens
tgggcagggagctggaaccaca

SEQ ID NO: 7360516 - DNA, 22 bp, Homo sapiens
tgggcagggagctggaaccaca

SEQ ID NO: 7360517 - DNA, 19 bp, Homo sapiens
tgggcagctccctctgtcc

SEQ ID NO: 7360518 - DNA, 23 bp, Homo sapiens
tgggcagcttctgcatgcccacc

SEQ ID NO: 7360519 - DNA, 22 bp, Homo sapiens
tgggcagccatcccagcctctc

SEQ ID NO: 7360520 - DNA, 19 bp, Homo sapiens
tgggcaggttcagtaatgg

SEQ ID NO: 7360521 - DNA, 19 bp, Homo sapiens
tgggcaggttcagtaatgg

SEQ ID NO: 7360522 - DNA, 19 bp, Homo sapiens
tgggcaggttcagtaatgg

SEQ ID NO: 7360523 - DNA, 22 bp, Homo sapiens
tgggcagggtctctgttatcag

SEQ ID NO: 7360524 - DNA, 22 bp, Homo sapiens
tgggcaggtgctattttccatg

SEQ ID NO: 7360525 - DNA, 22 bp, Homo sapiens
tgggcaggtgctattttccatg

SEQ ID NO: 7360526 - DNA, 22 bp, Homo sapiens
tgggcaggtgctattttccatg

SEQ ID NO: 7360527 - DNA, 22 bp, Homo sapiens
tgggcaggggccctgcttccgt

SEQ ID NO: 7360528 - DNA, 22 bp, Homo sapiens
tgggcagggtctctgttatcag

SEQ ID NO: 7360529 - DNA, 22 bp, Homo sapiens
tgggcagggtctctgttatcag

SEQ ID NO: 7360530 - DNA, 22 bp, Homo sapiens
tgggcaggggccctgcttccgt

SEQ ID NO: 7360531 - DNA, 22 bp, Homo sapiens
tgggcaggttgttatttgacat

SEQ ID NO: 7360532 - DNA, 22 bp, Homo sapiens
tgggcaggttgttatttgacat

SEQ ID NO: 7360533 - DNA, 22 bp, Homo sapiens
tgggcagtatttgcagaataat

SEQ ID NO: 7360534 - DNA, 22 bp, Homo sapiens
tgggcagtcatcagcacaccgg

SEQ ID NO: 7360535 - DNA, 22 bp, Homo sapiens
tgggcaggttgttatttgacat

SEQ ID NO: 7360536 - DNA, 22 bp, Homo sapiens
tgggcagtggcgcaatctctgg

SEQ ID NO: 7360537 - DNA, 22 bp, Homo sapiens
tgggcagtggctgggcctctct

SEQ ID NO: 7360538 - DNA, 19 bp, Homo sapiens
tgggcagtgccagggctta

SEQ ID NO: 7360539 - DNA, 22 bp, Homo sapiens
tgggcagtgtgtaatgcataga

SEQ ID NO: 7360540 - DNA, 22 bp, Homo sapiens
tgggcatcccgcgtctggctgc

SEQ ID NO: 7360541 - DNA, 22 bp, Homo sapiens
tgggcatggactgtggagccgc

SEQ ID NO: 7360542 - DNA, 22 bp, Homo sapiens
tgggcatgagtggacagagaag

SEQ ID NO: 7360543 - DNA, 22 bp, Homo sapiens
tgggcatggactgtggagccgc

SEQ ID NO: 7360544 - DNA, 22 bp, Homo sapiens
tgggccagctgaagtgccgccc

SEQ ID NO: 7360545 - DNA, 22 bp, Homo sapiens
tgggccagctccctgcccctgg

SEQ ID NO: 7360546 - DNA, 22 bp, Homo sapiens
tgggccagcactgggtgctcat

SEQ ID NO: 7360547 - DNA, 22 bp, Homo sapiens
tgggccagcaattgctgctcag

SEQ ID NO: 7360548 - DNA, 22 bp, Homo sapiens
tgggccacgggggtggagagct

SEQ ID NO: 7360549 - DNA, 22 bp, Homo sapiens
tgggccacgtcatctcccacaa

SEQ ID NO: 7360550 - DNA, 22 bp, Homo sapiens
tgggcgaggagaatgctgtgaa

SEQ ID NO: 7360551 - DNA, 20 bp, Homo sapiens
tgggcctgtggcagaagtct

SEQ ID NO: 7360552 - DNA, 22 bp, Homo sapiens
tgggcgaggcccagggctgcgt

SEQ ID NO: 7360553 - DNA, 22 bp, Homo sapiens
tgggcgaggcccagggctgcgt

SEQ ID NO: 7360554 - DNA, 23 bp, Homo sapiens
tgggcgaggcaggagtggagcac

SEQ ID NO: 7360555 - DNA, 22 bp, Homo sapiens
tgggcgaggagaatgctgtgaa

SEQ ID NO: 7360556 - DNA, 23 bp, Homo sapiens
tgggcgaggcaggagtggagcac

SEQ ID NO: 7360557 - DNA, 22 bp, Homo sapiens
tgggcggactcgggcatggaat

SEQ ID NO: 7360558 - DNA, 22 bp, Homo sapiens
tgggcgggcaggagcgcacctg

SEQ ID NO: 7360559 - DNA, 23 bp, Homo sapiens
tgggcggggcttttcactctgcc

SEQ ID NO: 7360560 - DNA, 22 bp, Homo sapiens
tgggcggtgtgcaggctctgct

SEQ ID NO: 7360561 - DNA, 23 bp, Homo sapiens
tgggcggggcttttcactctgcc

SEQ ID NO: 7360562 - DNA, 22 bp, Homo sapiens
tgggctagatatttttgggctg

SEQ ID NO: 7360563 - DNA, 21 bp, Homo sapiens
tgggctcagccccagccctgc

SEQ ID NO: 7360564 - DNA, 22 bp, Homo sapiens
tgggctcactggggcagggacc

SEQ ID NO: 7360565 - DNA, 22 bp, Homo sapiens
tgggctcaggaccccagaggcc

SEQ ID NO: 7360566 - DNA, 22 bp, Homo sapiens
tgggctcagggaagcttggcct

SEQ ID NO: 7360567 - DNA, 22 bp, Homo sapiens
tgggctctctttacctcataac

SEQ ID NO: 7360568 - DNA, 22 bp, Homo sapiens
tgggctctgcatcagtgcccat

SEQ ID NO: 7360569 - DNA, 22 bp, Homo sapiens
tgggctctgggtggcctgagca

SEQ ID NO: 7360570 - DNA, 22 bp, Homo sapiens
tgggctctggagggcctaggat

SEQ ID NO: 7360571 - DNA, 21 bp, Homo sapiens
tgggctctttaacccaggcac

SEQ ID NO: 7360572 - DNA, 22 bp, Homo sapiens
tgggctgcccaaggtggccatg

SEQ ID NO: 7360573 - DNA, 22 bp, Homo sapiens
tgggctgccagctctccagatg

SEQ ID NO: 7360574 - DNA, 22 bp, Homo sapiens
tgggctgccctgatggtcctca

SEQ ID NO: 7360575 - DNA, 22 bp, Homo sapiens
tgggctgccctgatggtcctca

SEQ ID NO: 7360576 - DNA, 22 bp, Homo sapiens
tgggctgccggcaggctctgcc

SEQ ID NO: 7360577 - DNA, 22 bp, Homo sapiens
tgggctgccggcaggctctgcc

SEQ ID NO: 7360578 - DNA, 22 bp, Homo sapiens
tgggctgcaccctcagcctctg

SEQ ID NO: 7360579 - DNA, 22 bp, Homo sapiens
tgggctgcacctttgtaaatct

SEQ ID NO: 7360580 - DNA, 22 bp, Homo sapiens
tgggctgcaccctcagcctctg

SEQ ID NO: 7360581 - DNA, 22 bp, Homo sapiens
tgggctgcactccattttctgc

SEQ ID NO: 7360582 - DNA, 22 bp, Homo sapiens
tgggctgcactgctctttatcg

SEQ ID NO: 7360583 - DNA, 22 bp, Homo sapiens
tgggctgcagagcccggccttc

SEQ ID NO: 7360584 - DNA, 22 bp, Homo sapiens
tgggctgcaggggttgagagct

SEQ ID NO: 7360585 - DNA, 22 bp, Homo sapiens
tgggccagggcacccagtccag

SEQ ID NO: 7360586 - DNA, 23 bp, Homo sapiens
tgggccagggagtccggtttctt

SEQ ID NO: 7360587 - DNA, 22 bp, Homo sapiens
tgggccaggggcctcttctgat

SEQ ID NO: 7360588 - DNA, 17 bp, Homo sapiens
tgggccagtagaaggga

SEQ ID NO: 7360589 - DNA, 22 bp, Homo sapiens
tgggccaggtctgtgtcagctg

SEQ ID NO: 7360590 - DNA, 22 bp, Homo sapiens
tgggccagttatttcacctctg

SEQ ID NO: 7360591 - DNA, 22 bp, Homo sapiens
tgggccagtcctgcctaaggtg

SEQ ID NO: 7360592 - DNA, 22 bp, Homo sapiens
tgggccagtccagccccaggga

SEQ ID NO: 7360593 - DNA, 22 bp, Homo sapiens
tgggccagttggaatggatact

SEQ ID NO: 7360594 - DNA, 22 bp, Homo sapiens
tgggccagttctttactcgtcc

SEQ ID NO: 7360595 - DNA, 22 bp, Homo sapiens
tgggccagttggtgactacaaa

SEQ ID NO: 7360596 - DNA, 22 bp, Homo sapiens
tgggcctcagtttccttaggat

SEQ ID NO: 7360597 - DNA, 22 bp, Homo sapiens
tgggcctcatgcccagccaccc

SEQ ID NO: 7360598 - DNA, 22 bp, Homo sapiens
tgggcctcctgccctggcctag

SEQ ID NO: 7360599 - DNA, 22 bp, Homo sapiens
tgggcctcccatgtcttaggga

SEQ ID NO: 7360600 - DNA, 22 bp, Homo sapiens
tgggcctcctgccctggcctag

SEQ ID NO: 7360601 - DNA, 22 bp, Homo sapiens
tgggcctctgccacgctccccc

SEQ ID NO: 7360602 - DNA, 22 bp, Homo sapiens
tgggcctctgccacgctccccc

SEQ ID NO: 7360603 - DNA, 22 bp, Homo sapiens
tgggcctctgggttagtcccta

SEQ ID NO: 7360604 - DNA, 20 bp, Homo sapiens
tgggcctctggtgcctctgg

SEQ ID NO: 7360605 - DNA, 22 bp, Homo sapiens
tgggcctcctttccattcagag

SEQ ID NO: 7360606 - DNA, 22 bp, Homo sapiens
tgggcctcggggaagcccgtgt

SEQ ID NO: 7360607 - DNA, 20 bp, Homo sapiens
tgggcctctggtgcctctgg

SEQ ID NO: 7360608 - DNA, 22 bp, Homo sapiens
tgggcctctgtttcctcatctg

SEQ ID NO: 7360609 - DNA, 22 bp, Homo sapiens
tggggatgtcatataagaggaa

SEQ ID NO: 7360610 - DNA, 21 bp, Homo sapiens
tggggaggggacctgattatg

SEQ ID NO: 7360611 - DNA, 21 bp, Homo sapiens
tggggaggggacctgattatg

SEQ ID NO: 7360612 - DNA, 22 bp, Homo sapiens
tggggaggttcgggaatcttgt

SEQ ID NO: 7360613 - DNA, 22 bp, Homo sapiens
tggggaggtaacaatttcaggc

SEQ ID NO: 7360614 - DNA, 22 bp, Homo sapiens
tggggaggtaacaatttcaggc

SEQ ID NO: 7360615 - DNA, 22 bp, Homo sapiens
tggggaggttcgggaatcttgt

SEQ ID NO: 7360616 - DNA, 22 bp, Homo sapiens
tggggaggttcgggaatcttgt

SEQ ID NO: 7360617 - DNA, 23 bp, Homo sapiens
tggggagggaagtcatttctgta

SEQ ID NO: 7360618 - DNA, 23 bp, Homo sapiens
tggggagggaagtcatttctgta

SEQ ID NO: 7360619 - DNA, 22 bp, Homo sapiens
tggggaggatatgtgagttatt

SEQ ID NO: 7360620 - DNA, 22 bp, Homo sapiens
tggggaggatatgtgagttatt

SEQ ID NO: 7360621 - DNA, 22 bp, Homo sapiens
tggggaggacgggcgccttcct

SEQ ID NO: 7360622 - DNA, 22 bp, Homo sapiens
tggggaggacgggcgccttcct

SEQ ID NO: 7360623 - DNA, 22 bp, Homo sapiens
tggggaggaagtcagatttcag

SEQ ID NO: 7360624 - DNA, 22 bp, Homo sapiens
tggggaggaagtcagatttcag

SEQ ID NO: 7360625 - DNA, 22 bp, Homo sapiens
tggggaggaagtcagatttcag

SEQ ID NO: 7360626 - DNA, 22 bp, Homo sapiens
tgggctttgagctcggtcacct

SEQ ID NO: 7360627 - DNA, 22 bp, Homo sapiens
tgggctttatcatgggtctggt

SEQ ID NO: 7360628 - DNA, 22 bp, Homo sapiens
tgggctggcgtggagagtttag

SEQ ID NO: 7360629 - DNA, 22 bp, Homo sapiens
tgggctggcgtggagagtttag

SEQ ID NO: 7360630 - DNA, 22 bp, Homo sapiens
tggggaaagacattcatacagt

SEQ ID NO: 7360631 - DNA, 22 bp, Homo sapiens
tggggaaagttcttgaaagtaa

SEQ ID NO: 7360632 - DNA, 17 bp, Homo sapiens
tggggaagctcagattt

SEQ ID NO: 7360633 - DNA, 22 bp, Homo sapiens
tggggaaggcggagcttgcagc

SEQ ID NO: 7360634 - DNA, 22 bp, Homo sapiens
tggggaagggcaccctggagac

SEQ ID NO: 7360635 - DNA, 22 bp, Homo sapiens
tggggcctgtgacgggtccaga

SEQ ID NO: 7360636 - DNA, 20 bp, Homo sapiens
tggggcctgtttctgtggtt

SEQ ID NO: 7360637 - DNA, 22 bp, Homo sapiens
tggggcgcccccactccacaga

SEQ ID NO: 7360638 - DNA, 22 bp, Homo sapiens
tggggcgcccccactccacaga

SEQ ID NO: 7360639 - DNA, 22 bp, Homo sapiens
tggggcctgcacaggctgaatg

SEQ ID NO: 7360640 - DNA, 22 bp, Homo sapiens
tggggcctggtcagagctgcac

SEQ ID NO: 7360641 - DNA, 22 bp, Homo sapiens
tggggctcacctaggctggaag

SEQ ID NO: 7360642 - DNA, 22 bp, Homo sapiens
tggggctcatgcctgctggaac

SEQ ID NO: 7360643 - DNA, 22 bp, Homo sapiens
tggggctcctcctggcaggagg

SEQ ID NO: 7360644 - DNA, 22 bp, Homo sapiens
tggggctctccacagtgtctca

SEQ ID NO: 7360645 - DNA, 23 bp, Homo sapiens
tggggctgatggagacggaccag

SEQ ID NO: 7360646 - DNA, 23 bp, Homo sapiens
tggggctgatggagacggaccag

SEQ ID NO: 7360647 - DNA, 22 bp, Homo sapiens
tggggctgaggagcctcactct

SEQ ID NO: 7360648 - DNA, 23 bp, Homo sapiens
tggggctctggcaggcctgaggt

SEQ ID NO: 7360649 - DNA, 22 bp, Homo sapiens
tggggccagcggggaggactca

SEQ ID NO: 7360650 - DNA, 22 bp, Homo sapiens
tggggccagagctgcagggagc

SEQ ID NO: 7360651 - DNA, 22 bp, Homo sapiens
tggggccagggaggaccagaca

SEQ ID NO: 7360652 - DNA, 22 bp, Homo sapiens
tggggccagggaggaccagaca

SEQ ID NO: 7360653 - DNA, 22 bp, Homo sapiens
tggggccagggaggaccagaca

SEQ ID NO: 7360654 - DNA, 22 bp, Homo sapiens
tggggccaggtggctgcaggtc

SEQ ID NO: 7360655 - DNA, 22 bp, Homo sapiens
tggggccatctcacccactgtt

SEQ ID NO: 7360656 - DNA, 22 bp, Homo sapiens
tggggcctcaggccttttccta

SEQ ID NO: 7360657 - DNA, 22 bp, Homo sapiens
tggggccatctcacccactgtt

SEQ ID NO: 7360658 - DNA, 22 bp, Homo sapiens
tggggcctgaaaggttctcgcc

SEQ ID NO: 7360659 - DNA, 22 bp, Homo sapiens
tggggcagagtaggattttggc

SEQ ID NO: 7360660 - DNA, 22 bp, Homo sapiens
tggggcagagtaggattttggc

SEQ ID NO: 7360661 - DNA, 22 bp, Homo sapiens
tggggccacactgatctcccag

SEQ ID NO: 7360662 - DNA, 22 bp, Homo sapiens
tggggcagcagacctttcttgg

SEQ ID NO: 7360663 - DNA, 22 bp, Homo sapiens
tggggccacagcctcctagctt

SEQ ID NO: 7360664 - DNA, 22 bp, Homo sapiens
tggggccagagatggggcgcag

SEQ ID NO: 7360665 - DNA, 22 bp, Homo sapiens
tggggccagagatggggcgcag

SEQ ID NO: 7360666 - DNA, 22 bp, Homo sapiens
tgggggagccttcacagtagct

SEQ ID NO: 7360667 - DNA, 22 bp, Homo sapiens
tgggggagcgacagacataatt

SEQ ID NO: 7360668 - DNA, 22 bp, Homo sapiens
tgggggagattgtgcatctcta

SEQ ID NO: 7360669 - DNA, 22 bp, Homo sapiens
tgggggagctcagtccagccca

SEQ ID NO: 7360670 - DNA, 22 bp, Homo sapiens
tgggggagtatagtctggcctc

SEQ ID NO: 7360671 - DNA, 22 bp, Homo sapiens
tgggggcacttcgaggtcgcct

SEQ ID NO: 7360672 - DNA, 22 bp, Homo sapiens
tgggggcagccaggctgtcaag

SEQ ID NO: 7360673 - DNA, 22 bp, Homo sapiens
tgggggcatggaccagcctggc

SEQ ID NO: 7360674 - DNA, 22 bp, Homo sapiens
tgggggcatggaccagcctggc

SEQ ID NO: 7360675 - DNA, 22 bp, Homo sapiens
tgggggagattagagcttctta

SEQ ID NO: 7360676 - DNA, 22 bp, Homo sapiens
tgggggagagtttagatgattt

SEQ ID NO: 7360677 - DNA, 22 bp, Homo sapiens
tgggggagatagagtctgatgg

SEQ ID NO: 7360678 - DNA, 22 bp, Homo sapiens
tgggggagagtgcaagcatgaa

SEQ ID NO: 7360679 - DNA, 22 bp, Homo sapiens
tgggggagagtgcaagcatgaa

SEQ ID NO: 7360680 - DNA, 22 bp, Homo sapiens
tgggggagagtttagatgattt

SEQ ID NO: 7360681 - DNA, 22 bp, Homo sapiens
tgggggagagaggcattctttc

SEQ ID NO: 7360682 - DNA, 22 bp, Homo sapiens
tgggggagagaggcattctttc

SEQ ID NO: 7360683 - DNA, 22 bp, Homo sapiens
tggggctggcacagtctctatt

SEQ ID NO: 7360684 - DNA, 22 bp, Homo sapiens
tggggctggctattgtctccct

SEQ ID NO: 7360685 - DNA, 22 bp, Homo sapiens
tggggctggctattgtctccct

SEQ ID NO: 7360686 - DNA, 22 bp, Homo sapiens
tggggctgtcccggtttggcga

SEQ ID NO: 7360687 - DNA, 22 bp, Homo sapiens
tggggctggggatcttgagcct

SEQ ID NO: 7360688 - DNA, 22 bp, Homo sapiens
tggggctggggatcttgagcct

SEQ ID NO: 7360689 - DNA, 22 bp, Homo sapiens
tggggtggtgggaaccaagtag

SEQ ID NO: 7360690 - DNA, 22 bp, Homo sapiens
tggggttacctacaagtctgag

SEQ ID NO: 7360691 - DNA, 22 bp, Homo sapiens
tggggtggtgggaaccaagtag

SEQ ID NO: 7360692 - DNA, 22 bp, Homo sapiens
tggggtggggttactcattctg

SEQ ID NO: 7360693 - DNA, 22 bp, Homo sapiens
tggggtggtaatacaccgttct

SEQ ID NO: 7360694 - DNA, 22 bp, Homo sapiens
tggggtgggcatgcgctgtcct

SEQ ID NO: 7360695 - DNA, 22 bp, Homo sapiens
tggggtgggcatgcgctgtcct

SEQ ID NO: 7360696 - DNA, 22 bp, Homo sapiens
tggggtgggcatgcgctgtcct

SEQ ID NO: 7360697 - DNA, 22 bp, Homo sapiens
tggggtgccgacagggagggca

SEQ ID NO: 7360698 - DNA, 22 bp, Homo sapiens
tggggtgacagtgcagtggtca

SEQ ID NO: 7360699 - DNA, 22 bp, Homo sapiens
tggggtggatagaaagtgatgt

SEQ ID NO: 7360700 - DNA, 22 bp, Homo sapiens
tggggtggaacccttctgctgg

SEQ ID NO: 7360701 - DNA, 22 bp, Homo sapiens
tggggtggaacccttctgctgg

SEQ ID NO: 7360702 - DNA, 22 bp, Homo sapiens
tgggggtcctcctctgcttaag

SEQ ID NO: 7360703 - DNA, 22 bp, Homo sapiens
tgggggtgaaagtctggacagt

SEQ ID NO: 7360704 - DNA, 22 bp, Homo sapiens
tggggggcatgaacctccacgg

SEQ ID NO: 7360705 - DNA, 22 bp, Homo sapiens
tggggtctgagtatctgcattt

SEQ ID NO: 7360706 - DNA, 22 bp, Homo sapiens
tgggggtgctgagaagacagga

SEQ ID NO: 7360707 - DNA, 22 bp, Homo sapiens
tgggtagagtggagggataaga

SEQ ID NO: 7360708 - DNA, 22 bp, Homo sapiens
tggggttgcctcccgccctgga

SEQ ID NO: 7360709 - DNA, 22 bp, Homo sapiens
tgggtagggcctgcgcctgtgc

SEQ ID NO: 7360710 - DNA, 22 bp, Homo sapiens
tgggtaggggacgtggaagaaa

SEQ ID NO: 7360711 - DNA, 22 bp, Homo sapiens
tgggtcctcgtcttccaaggca

SEQ ID NO: 7360712 - DNA, 16 bp, Homo sapiens
tgggtgggaggagcgg

SEQ ID NO: 7360713 - DNA, 21 bp, Homo sapiens
tgggtgggcagagtctcttca

SEQ ID NO: 7360714 - DNA, 17 bp, Homo sapiens
tgggtggtagggagagg

SEQ ID NO: 7360715 - DNA, 22 bp, Homo sapiens
tgggtgggagcgccctgtctgg

SEQ ID NO: 7360716 - DNA, 19 bp, Homo sapiens
tgggtgtgaccatctctgc

SEQ ID NO: 7360717 - DNA, 22 bp, Homo sapiens
tgggtgtgcccagatggtgtcc

SEQ ID NO: 7360718 - DNA, 22 bp, Homo sapiens
tgggttaacctgggcaggtgac

SEQ ID NO: 7360719 - DNA, 23 bp, Homo sapiens
tgggttaatttattgccagctgc

SEQ ID NO: 7360720 - DNA, 22 bp, Homo sapiens
tgggttaaaagttgaatgaatt

SEQ ID NO: 7360721 - DNA, 22 bp, Homo sapiens
tgggttaacagtttataccaga

SEQ ID NO: 7360722 - DNA, 22 bp, Homo sapiens
tgggtggtccaggctcagcaga

SEQ ID NO: 7360723 - DNA, 22 bp, Homo sapiens
tgggtggtggcagtaatgagaa

SEQ ID NO: 7360724 - DNA, 22 bp, Homo sapiens
tgggtggttatagagatcaact

SEQ ID NO: 7360725 - DNA, 22 bp, Homo sapiens
tgggtgaggatgatgaggcagc

SEQ ID NO: 7360726 - DNA, 22 bp, Homo sapiens
tgggtgagtggagggcattcta

SEQ ID NO: 7360727 - DNA, 23 bp, Homo sapiens
tgggtgctaatctgctctgtgga

SEQ ID NO: 7360728 - DNA, 21 bp, Homo sapiens
tgggtggaagcgggaggccgc

SEQ ID NO: 7360729 - DNA, 21 bp, Homo sapiens
tgggtggaagcgggaggccgc

SEQ ID NO: 7360730 - DNA, 22 bp, Homo sapiens
tgggtgctctgcttccctgcac

SEQ ID NO: 7360731 - DNA, 22 bp, Homo sapiens
tggtaaattatttttatatccc

SEQ ID NO: 7360732 - DNA, 22 bp, Homo sapiens
tggtaaatgctattcctatatt

SEQ ID NO: 7360733 - DNA, 22 bp, Homo sapiens
tggtatgtaataagtgttctaa

SEQ ID NO: 7360734 - DNA, 22 bp, Homo sapiens
tggctccacaggccagggtgtg

SEQ ID NO: 7360735 - DNA, 22 bp, Homo sapiens
tggctccaaatcaactgctgtt

SEQ ID NO: 7360736 - DNA, 22 bp, Homo sapiens
tggctcagtggcagccgcagct

SEQ ID NO: 7360737 - DNA, 22 bp, Homo sapiens
tggctcagttaggtcagaaaca

SEQ ID NO: 7360738 - DNA, 22 bp, Homo sapiens
tggctcagttccatcatctgga

SEQ ID NO: 7360739 - DNA, 22 bp, Homo sapiens
tggctcagttccatcatctgga

SEQ ID NO: 7360740 - DNA, 21 bp, Homo sapiens
tggctcagttgctgggcacag

SEQ ID NO: 7360741 - DNA, 22 bp, Homo sapiens
tggctccagatctgtctcctgt

SEQ ID NO: 7360742 - DNA, 22 bp, Homo sapiens
tggctccactctccaggagttt

SEQ ID NO: 7360743 - DNA, 22 bp, Homo sapiens
tggctccagatttcctgctgca

SEQ ID NO: 7360744 - DNA, 22 bp, Homo sapiens
tggctccaccgccgcggagctc

SEQ ID NO: 7360745 - DNA, 23 bp, Homo sapiens
tggctccaggagaagccagaagc

SEQ ID NO: 7360746 - DNA, 23 bp, Homo sapiens
tggctccaggagaagccagaagc

SEQ ID NO: 7360747 - DNA, 22 bp, Homo sapiens
tggctccagcgtccacgtcctg

SEQ ID NO: 7360748 - DNA, 22 bp, Homo sapiens
tggctccagctcaagtatggca

SEQ ID NO: 7360749 - DNA, 20 bp, Homo sapiens
tggctccagcctcccctacc

SEQ ID NO: 7360750 - DNA, 22 bp, Homo sapiens
tggctccagccctgagcaagct

SEQ ID NO: 7360751 - DNA, 22 bp, Homo sapiens
tggctccagccctgagcaagct

SEQ ID NO: 7360752 - DNA, 22 bp, Homo sapiens
tggctccatcatccatgcaaga

SEQ ID NO: 7360753 - DNA, 22 bp, Homo sapiens
tggctccaggggacacgcagta

SEQ ID NO: 7360754 - DNA, 22 bp, Homo sapiens
tggctcagcaagacattgacct

SEQ ID NO: 7360755 - DNA, 22 bp, Homo sapiens
tggctcagcattcactggtctt

SEQ ID NO: 7360756 - DNA, 22 bp, Homo sapiens
tggctcagcaggttagaaacta

SEQ ID NO: 7360757 - DNA, 22 bp, Homo sapiens
tggctcagctttccccatctgg

SEQ ID NO: 7360758 - DNA, 22 bp, Homo sapiens
tggctcagcttacttttgaggg

SEQ ID NO: 7360759 - DNA, 22 bp, Homo sapiens
tggctcagcttacttttgaggg

SEQ ID NO: 7360760 - DNA, 22 bp, Homo sapiens
tggctcagccagccctaggaac

SEQ ID NO: 7360761 - DNA, 22 bp, Homo sapiens
tggctcaggcttgaaaatagat

SEQ ID NO: 7360762 - DNA, 22 bp, Homo sapiens
tggctcaggcctacgacgcctt

SEQ ID NO: 7360763 - DNA, 22 bp, Homo sapiens
tggctcaggcctacgacgcctt

SEQ ID NO: 7360764 - DNA, 22 bp, Homo sapiens
tggctcaggccacttcttttat

SEQ ID NO: 7360765 - DNA, 22 bp, Homo sapiens
tggctcagctttccccatctgg

SEQ ID NO: 7360766 - DNA, 22 bp, Homo sapiens
tggctcaggagggatctttgct

SEQ ID NO: 7360767 - DNA, 22 bp, Homo sapiens
tggctcaggatctaagcagaat

SEQ ID NO: 7360768 - DNA, 22 bp, Homo sapiens
tggctcaggataattttcccaa

SEQ ID NO: 7360769 - DNA, 23 bp, Homo sapiens
tggctcagggtctcttatgaagt

SEQ ID NO: 7360770 - DNA, 22 bp, Homo sapiens
tggctcagggtccccaaatggt

SEQ ID NO: 7360771 - DNA, 22 bp, Homo sapiens
tggctcaggggtctggctctgt

SEQ ID NO: 7360772 - DNA, 22 bp, Homo sapiens
tggctcaggggtctggctctgt

SEQ ID NO: 7360773 - DNA, 22 bp, Homo sapiens
tggctcagtaatcgagtctcct

SEQ ID NO: 7360774 - DNA, 22 bp, Homo sapiens
tggctcagtagcagtgtggtca

SEQ ID NO: 7360775 - DNA, 22 bp, Homo sapiens
tggctcagtagcagtgtggtca

SEQ ID NO: 7360776 - DNA, 22 bp, Homo sapiens
tggctcagtaatcgagtctcct

SEQ ID NO: 7360777 - DNA, 22 bp, Homo sapiens
tggctcagtaatcgagtctcct

SEQ ID NO: 7360778 - DNA, 22 bp, Homo sapiens
tggctcaggtgtgagctgaaga

SEQ ID NO: 7360779 - DNA, 22 bp, Homo sapiens
tggctcagtctgggttgactga

SEQ ID NO: 7360780 - DNA, 22 bp, Homo sapiens
tggctcagtcatggatgagtaa

SEQ ID NO: 7360781 - DNA, 22 bp, Homo sapiens
tggctcagtgaagagataactt

SEQ ID NO: 7360782 - DNA, 22 bp, Homo sapiens
tggctcagtgacattcctccca

SEQ ID NO: 7360783 - DNA, 22 bp, Homo sapiens
tggctcagtgcattcacagtaa

SEQ ID NO: 7360784 - DNA, 22 bp, Homo sapiens
tggctcagtgcattcacagtaa

SEQ ID NO: 7360785 - DNA, 22 bp, Homo sapiens
tggctcagtggcagccgcagct

SEQ ID NO: 7360786 - DNA, 22 bp, Homo sapiens
tggcgcagtttctctgctgcct

SEQ ID NO: 7360787 - DNA, 17 bp, Homo sapiens
tggcgctcccagggtgc

SEQ ID NO: 7360788 - DNA, 22 bp, Homo sapiens
tggcgcgctcgctctcgctgag

SEQ ID NO: 7360789 - DNA, 22 bp, Homo sapiens
tggcgcgacgtgccccctgctt

SEQ ID NO: 7360790 - DNA, 21 bp, Homo sapiens
tggcggggacttgtggctgcc

SEQ ID NO: 7360791 - DNA, 21 bp, Homo sapiens
tggcggggacttgtggctgcc

SEQ ID NO: 7360792 - DNA, 20 bp, Homo sapiens
tggcggggatgagggagtta

SEQ ID NO: 7360793 - DNA, 22 bp, Homo sapiens
tggctagtccgttagaggcgtg

SEQ ID NO: 7360794 - DNA, 22 bp, Homo sapiens
tggctatgcaatttaggagttc

SEQ ID NO: 7360795 - DNA, 22 bp, Homo sapiens
tggctatgcaaacctgaggctg

SEQ ID NO: 7360796 - DNA, 22 bp, Homo sapiens
tggctcagaactacttctagtt

SEQ ID NO: 7360797 - DNA, 22 bp, Homo sapiens
tggctcagaagaaaaggtaaac

SEQ ID NO: 7360798 - DNA, 22 bp, Homo sapiens
tggctcagaactacttctagtt

SEQ ID NO: 7360799 - DNA, 22 bp, Homo sapiens
tggctcagatttttgtaggctt

SEQ ID NO: 7360800 - DNA, 18 bp, Homo sapiens
tggctcagatggctttaa

SEQ ID NO: 7360801 - DNA, 22 bp, Homo sapiens
tggctcagatgctcttccagtg

SEQ ID NO: 7360802 - DNA, 22 bp, Homo sapiens
tggctcagatgctcttccagtg

SEQ ID NO: 7360803 - DNA, 22 bp, Homo sapiens
tggctcagataattcaaggggc

SEQ ID NO: 7360804 - DNA, 22 bp, Homo sapiens
tggctcagagttcatcttttag

SEQ ID NO: 7360805 - DNA, 22 bp, Homo sapiens
tggctcagataattcaaggggc

SEQ ID NO: 7360806 - DNA, 22 bp, Homo sapiens
tggctcagataattcaaggggc

SEQ ID NO: 7360807 - DNA, 22 bp, Homo sapiens
tggctcagaggggaagtggttt

SEQ ID NO: 7360808 - DNA, 22 bp, Homo sapiens
tggctcagaaggctgccttcac

SEQ ID NO: 7360809 - DNA, 22 bp, Homo sapiens
tggctcagaaggctgccttcac

SEQ ID NO: 7360810 - DNA, 22 bp, Homo sapiens
tggctcagagagggagtgtgga

SEQ ID NO: 7360811 - DNA, 22 bp, Homo sapiens
tggctcagagcagggactctgg

SEQ ID NO: 7360812 - DNA, 22 bp, Homo sapiens
tggctcagagagggagtgtgga

SEQ ID NO: 7360813 - DNA, 22 bp, Homo sapiens
tggctcagagcagggactctgg

SEQ ID NO: 7360814 - DNA, 22 bp, Homo sapiens
tggctcagagccttgagagctg

SEQ ID NO: 7360815 - DNA, 22 bp, Homo sapiens
tggcctgggtcacaccagggtc

SEQ ID NO: 7360816 - DNA, 22 bp, Homo sapiens
tggcctggtccttgtcaaggca

SEQ ID NO: 7360817 - DNA, 18 bp, Homo sapiens
tggcgatggtcatttttc

SEQ ID NO: 7360818 - DNA, 22 bp, Homo sapiens
tggcgaggccaggccagggcct

SEQ ID NO: 7360819 - DNA, 22 bp, Homo sapiens
tggctgcagtgcttgagatgtc

SEQ ID NO: 7360820 - DNA, 20 bp, Homo sapiens
tggctgcccgaggcacacac

SEQ ID NO: 7360821 - DNA, 22 bp, Homo sapiens
tggctgagtgttccaaggagca

SEQ ID NO: 7360822 - DNA, 21 bp, Homo sapiens
tggctgcaagcagctgcctcc

SEQ ID NO: 7360823 - DNA, 22 bp, Homo sapiens
tggctgagttctccaggagtag

SEQ ID NO: 7360824 - DNA, 22 bp, Homo sapiens
tggctgcagatcaagggcaggc

SEQ ID NO: 7360825 - DNA, 23 bp, Homo sapiens
tggctctgagcttcctggtggcc

SEQ ID NO: 7360826 - DNA, 23 bp, Homo sapiens
tggctctgagcttcctggtggcc

SEQ ID NO: 7360827 - DNA, 23 bp, Homo sapiens
tggctctgagcttcctggtggcc

SEQ ID NO: 7360828 - DNA, 21 bp, Homo sapiens
tggctctgagcctcatggctg

SEQ ID NO: 7360829 - DNA, 23 bp, Homo sapiens
tggctctgagaggttcagatgct

SEQ ID NO: 7360830 - DNA, 22 bp, Homo sapiens
tggctctgcagcagtgtgcgtg

SEQ ID NO: 7360831 - DNA, 22 bp, Homo sapiens
tggctctggagctcctgggccc

SEQ ID NO: 7360832 - DNA, 22 bp, Homo sapiens
tggctctggagctcctgggccc

SEQ ID NO: 7360833 - DNA, 22 bp, Homo sapiens
tggctctgctgaacctagtgca

SEQ ID NO: 7360834 - DNA, 22 bp, Homo sapiens
tggctctgttcgccatcaggag

SEQ ID NO: 7360835 - DNA, 22 bp, Homo sapiens
tggctctgttgtgctgagccag

SEQ ID NO: 7360836 - DNA, 22 bp, Homo sapiens
tggctctgttcgccatcaggag

SEQ ID NO: 7360837 - DNA, 19 bp, Homo sapiens
tggctctgtttctctggag

SEQ ID NO: 7360838 - DNA, 19 bp, Homo sapiens
tggctctgtttctctggag

SEQ ID NO: 7360839 - DNA, 19 bp, Homo sapiens
tggctcttgtgggactgca

SEQ ID NO: 7360840 - DNA, 22 bp, Homo sapiens
tggctctggccaccgggagggc

SEQ ID NO: 7360841 - DNA, 22 bp, Homo sapiens
tggctctggccaccgggagggc

SEQ ID NO: 7360842 - DNA, 22 bp, Homo sapiens
tggctctggagctggcggctga

SEQ ID NO: 7360843 - DNA, 23 bp, Homo sapiens
tggctctgtggatccctcaggag

SEQ ID NO: 7360844 - DNA, 22 bp, Homo sapiens
tgggaactctctgggaggcatc

SEQ ID NO: 7360845 - DNA, 18 bp, Homo sapiens
tgggaaagtttatagaat

SEQ ID NO: 7360846 - DNA, 22 bp, Homo sapiens
tgggaagactcctcaggaggcg

SEQ ID NO: 7360847 - DNA, 23 bp, Homo sapiens
tgggaaatgtagccttggcatga

SEQ ID NO: 7360848 - DNA, 22 bp, Homo sapiens
tgggaaatattctaaaagtctt

SEQ ID NO: 7360849 - DNA, 22 bp, Homo sapiens
tgggaaagtgttgaggtgtctt

SEQ ID NO: 7360850 - DNA, 20 bp, Homo sapiens
tgggaaagtctaagtgcctc

SEQ ID NO: 7360851 - DNA, 22 bp, Homo sapiens
tggcttttgaaaaggtgatgta

SEQ ID NO: 7360852 - DNA, 21 bp, Homo sapiens
tggcttttatggagctctggg

SEQ ID NO: 7360853 - DNA, 22 bp, Homo sapiens
tggctttttctcagctctggct

SEQ ID NO: 7360854 - DNA, 22 bp, Homo sapiens
tgggaaagccagcagtgtcacc

SEQ ID NO: 7360855 - DNA, 22 bp, Homo sapiens
tggcttcaggagcacctggctt

SEQ ID NO: 7360856 - DNA, 22 bp, Homo sapiens
tggcttcagagacagaatctat

SEQ ID NO: 7360857 - DNA, 22 bp, Homo sapiens
tggcttctgggatgtgttgaca

SEQ ID NO: 7360858 - DNA, 22 bp, Homo sapiens
tggcttctggctggtgagaaat

SEQ ID NO: 7360859 - DNA, 22 bp, Homo sapiens
tggcttctggctggtgagaaat

SEQ ID NO: 7360860 - DNA, 22 bp, Homo sapiens
tggcttctggtttatccttata

SEQ ID NO: 7360861 - DNA, 21 bp, Homo sapiens
tggcttctgccaatgttaaga

SEQ ID NO: 7360862 - DNA, 22 bp, Homo sapiens
tggcttctccctccccatctag

SEQ ID NO: 7360863 - DNA, 22 bp, Homo sapiens
tggctggagtgggagaagttta

SEQ ID NO: 7360864 - DNA, 22 bp, Homo sapiens
tggctggatgtgagatcaagag

SEQ ID NO: 7360865 - DNA, 23 bp, Homo sapiens
tggctggcagaaactgaagcatg

SEQ ID NO: 7360866 - DNA, 18 bp, Homo sapiens
tggctggcagtgggcagc

SEQ ID NO: 7360867 - DNA, 22 bp, Homo sapiens
tggctgtgggatatgtgactga

SEQ ID NO: 7360868 - DNA, 22 bp, Homo sapiens
tggctgtggactcagatggctc

SEQ ID NO: 7360869 - DNA, 22 bp, Homo sapiens
tggctgtggtttatcccagttc

SEQ ID NO: 7360870 - DNA, 22 bp, Homo sapiens
tggctgtgggtggaaggaaacc

SEQ ID NO: 7360871 - DNA, 20 bp, Homo sapiens
tggctgtgggcatctgtttc

SEQ ID NO: 7360872 - DNA, 19 bp, Homo sapiens
tggctgtggggaaatgctt

SEQ ID NO: 7360873 - DNA, 22 bp, Homo sapiens
tggctgtgggatgagagcctca

SEQ ID NO: 7360874 - DNA, 22 bp, Homo sapiens
tggctgtgcctctttccaggcc

SEQ ID NO: 7360875 - DNA, 22 bp, Homo sapiens
tggctgtgcggcctcgggcaga

SEQ ID NO: 7360876 - DNA, 22 bp, Homo sapiens
tggctgtgaacaaagagaataa

SEQ ID NO: 7360877 - DNA, 22 bp, Homo sapiens
tggctgtgatttgcacgagatg

SEQ ID NO: 7360878 - DNA, 22 bp, Homo sapiens
tggctgtgaacaaagagaataa

SEQ ID NO: 7360879 - DNA, 22 bp, Homo sapiens
tggctgtgaatggcaaataatc

SEQ ID NO: 7360880 - DNA, 23 bp, Homo sapiens
tggcttcaactctgtcggcagcc

SEQ ID NO: 7360881 - DNA, 22 bp, Homo sapiens
tggctgtgttaccacttcatgt

SEQ ID NO: 7360882 - DNA, 22 bp, Homo sapiens
tggctgtgtgccaggctgtctg

SEQ ID NO: 7360883 - DNA, 22 bp, Homo sapiens
tggctgtgttaccacttcatgt

SEQ ID NO: 7360884 - DNA, 22 bp, Homo sapiens
tggctgtgtcatcatagctgtg

SEQ ID NO: 7360885 - DNA, 22 bp, Homo sapiens
tggctgtgtccctgtccagagt

SEQ ID NO: 7360886 - DNA, 22 bp, Homo sapiens
tggctggggcctgaatcctgca

SEQ ID NO: 7360887 - DNA, 22 bp, Homo sapiens
tggctgggtgctatccagtact

SEQ ID NO: 7360888 - DNA, 22 bp, Homo sapiens
tgggaaggttagcagtttgtca

SEQ ID NO: 7360889 - DNA, 23 bp, Homo sapiens
tgggaatgacatctagagcagag

SEQ ID NO: 7360890 - DNA, 22 bp, Homo sapiens
tgggaatgtagaatgtaaacca

SEQ ID NO: 7360891 - DNA, 22 bp, Homo sapiens
tgggaatgctgatttcaggaac

SEQ ID NO: 7360892 - DNA, 22 bp, Homo sapiens
tgggactgtgacctccagggta

SEQ ID NO: 7360893 - DNA, 21 bp, Homo sapiens
tgggacagtgatggctcctcc

SEQ ID NO: 7360894 - DNA, 22 bp, Homo sapiens
tgggaagatggagtgacaggca

SEQ ID NO: 7360895 - DNA, 22 bp, Homo sapiens
tgggaagagttagagacagctg

SEQ ID NO: 7360896 - DNA, 22 bp, Homo sapiens
tgggaagatatgagtgaccaac

SEQ ID NO: 7360897 - DNA, 22 bp, Homo sapiens
tgggaagggagtttcttggagt

SEQ ID NO: 7360898 - DNA, 22 bp, Homo sapiens
tgggaagggccgatggagcctc

SEQ ID NO: 7360899 - DNA, 22 bp, Homo sapiens
tgggaagggccgatggagcctc

SEQ ID NO: 7360900 - DNA, 22 bp, Homo sapiens
tgggaaggcgtggaagtagaag

SEQ ID NO: 7360901 - DNA, 22 bp, Homo sapiens
tgggaagggagagtgtcctgga

SEQ ID NO: 7360902 - DNA, 22 bp, Homo sapiens
tgggaagcattaatgatagggg

SEQ ID NO: 7360903 - DNA, 22 bp, Homo sapiens
tgggaaggcgtggaagtagaag

SEQ ID NO: 7360904 - DNA, 22 bp, Homo sapiens
tgggaaggggagctggaaagga

SEQ ID NO: 7360905 - DNA, 22 bp, Homo sapiens
tgggaaggggagctggaaagga

SEQ ID NO: 7360906 - DNA, 22 bp, Homo sapiens
tgggaagggtcaacagctggaa

SEQ ID NO: 7360907 - DNA, 22 bp, Homo sapiens
tgggaagggccgatggagcctc

SEQ ID NO: 7360908 - DNA, 22 bp, Homo sapiens
tgggaagggtcaacagctggaa

SEQ ID NO: 7360909 - DNA, 22 bp, Homo sapiens
tgggaagggtcaacagctggaa

SEQ ID NO: 7360910 - DNA, 22 bp, Homo sapiens
tgggaagggtcaacagctggaa

SEQ ID NO: 7360911 - DNA, 22 bp, Homo sapiens
tgggaaggtacacgggaaagag

SEQ ID NO: 7360912 - DNA, 22 bp, Homo sapiens
tgggaagggtctgaatctgaga

SEQ ID NO: 7360913 - DNA, 22 bp, Homo sapiens
tgggaaggtacacgggaaagag

SEQ ID NO: 7360914 - DNA, 22 bp, Homo sapiens
tgggaaggtgattttccaaaag

SEQ ID NO: 7360915 - DNA, 22 bp, Homo sapiens
tgggagagcttcatgccttcag

SEQ ID NO: 7360916 - DNA, 19 bp, Homo sapiens
tgggagaggcaacagagta

SEQ ID NO: 7360917 - DNA, 22 bp, Homo sapiens
tgggagagtaaccaattccttc

SEQ ID NO: 7360918 - DNA, 21 bp, Homo sapiens
tgggagagggctcagctaccc

SEQ ID NO: 7360919 - DNA, 21 bp, Homo sapiens
tgggagagggctcagctaccc

SEQ ID NO: 7360920 - DNA, 22 bp, Homo sapiens
tgggagaggctgccatcttgca

SEQ ID NO: 7360921 - DNA, 22 bp, Homo sapiens
tgggagagtctaaaaccgaggt

SEQ ID NO: 7360922 - DNA, 22 bp, Homo sapiens
tgggagagtgctcaatgtgcaa

SEQ ID NO: 7360923 - DNA, 22 bp, Homo sapiens
tgggagagtttgtttagagtga

SEQ ID NO: 7360924 - DNA, 22 bp, Homo sapiens
tgggactgtggtcaaggacaaa

SEQ ID NO: 7360925 - DNA, 22 bp, Homo sapiens
tgggagaacccagggtcaggct

SEQ ID NO: 7360926 - DNA, 22 bp, Homo sapiens
tgggagaagcatggggtgcaga

SEQ ID NO: 7360927 - DNA, 22 bp, Homo sapiens
tgggagaagcagtgggacagta

SEQ ID NO: 7360928 - DNA, 22 bp, Homo sapiens
tgggaggatctcttgaggccag

SEQ ID NO: 7360929 - DNA, 22 bp, Homo sapiens
tgggaggcagaagttgactgga

SEQ ID NO: 7360930 - DNA, 22 bp, Homo sapiens
tgggaggatcgcttgagcccag

SEQ ID NO: 7360931 - DNA, 22 bp, Homo sapiens
tgggaggaatgtcactgagcca

SEQ ID NO: 7360932 - DNA, 22 bp, Homo sapiens
tgggagcagcagggagatgcgg

SEQ ID NO: 7360933 - DNA, 22 bp, Homo sapiens
tggcagagccttgccaaactcc

SEQ ID NO: 7360934 - DNA, 22 bp, Homo sapiens
tggcagagctggctgcggatga

SEQ ID NO: 7360935 - DNA, 22 bp, Homo sapiens
tggcagagatgaagagttgttt

SEQ ID NO: 7360936 - DNA, 22 bp, Homo sapiens
tggcagagcccagaactgagca

SEQ ID NO: 7360937 - DNA, 22 bp, Homo sapiens
tggcagagcccagactccagtc

SEQ ID NO: 7360938 - DNA, 22 bp, Homo sapiens
tggcagagaataaatcttgact

SEQ ID NO: 7360939 - DNA, 22 bp, Homo sapiens
tggcagagaacctgggctttgt

SEQ ID NO: 7360940 - DNA, 22 bp, Homo sapiens
tggcagagacaaggccgggcct

SEQ ID NO: 7360941 - DNA, 22 bp, Homo sapiens
tggcagagagagtgcagtcgac

SEQ ID NO: 7360942 - DNA, 22 bp, Homo sapiens
tggcacatggttaatcataatt

SEQ ID NO: 7360943 - DNA, 22 bp, Homo sapiens
tggcacatggtaagtgcttaac

SEQ ID NO: 7360944 - DNA, 22 bp, Homo sapiens
tggcacatatttttagtgctca

SEQ ID NO: 7360945 - DNA, 22 bp, Homo sapiens
tggcaccaccagacaccaggag

SEQ ID NO: 7360946 - DNA, 22 bp, Homo sapiens
tggcaccagggaacaagcattt

SEQ ID NO: 7360947 - DNA, 22 bp, Homo sapiens
tggcaccatgttggcaaatgtt

SEQ ID NO: 7360948 - DNA, 22 bp, Homo sapiens
tggcacccagtggagctgtgct

SEQ ID NO: 7360949 - DNA, 22 bp, Homo sapiens
tggcactcactctcagagtctg

SEQ ID NO: 7360950 - DNA, 22 bp, Homo sapiens
tggcacagacagatcaggagtc

SEQ ID NO: 7360951 - DNA, 22 bp, Homo sapiens
tggcacagacagcacagcaatg

SEQ ID NO: 7360952 - DNA, 22 bp, Homo sapiens
tggcacagacatttaatagcct

SEQ ID NO: 7360953 - DNA, 22 bp, Homo sapiens
tggcacaagggctattccttag

SEQ ID NO: 7360954 - DNA, 22 bp, Homo sapiens
tggcacagaaaaatgctccatt

SEQ ID NO: 7360955 - DNA, 22 bp, Homo sapiens
tggcacagcttgtcataaactc

SEQ ID NO: 7360956 - DNA, 22 bp, Homo sapiens
tggcacagcccattcagagaag

SEQ ID NO: 7360957 - DNA, 16 bp, Homo sapiens
tggcacagagcagata

SEQ ID NO: 7360958 - DNA, 20 bp, Homo sapiens
tggattccctcctgggactc

SEQ ID NO: 7360959 - DNA, 22 bp, Homo sapiens
tggcaataattgtaattcaatt

SEQ ID NO: 7360960 - DNA, 22 bp, Homo sapiens
tggcaatatgctttcagtggcc

SEQ ID NO: 7360961 - DNA, 22 bp, Homo sapiens
tggcaatacttgtcttggccgc

SEQ ID NO: 7360962 - DNA, 20 bp, Homo sapiens
tggcaggaatagggccagag

SEQ ID NO: 7360963 - DNA, 22 bp, Homo sapiens
tggcaggaaggagactcagccc

SEQ ID NO: 7360964 - DNA, 22 bp, Homo sapiens
tggcaggaagacgtggggcacc

SEQ ID NO: 7360965 - DNA, 22 bp, Homo sapiens
tggcaggaagacgtggggcacc

SEQ ID NO: 7360966 - DNA, 22 bp, Homo sapiens
tggcaggaagacgtggggcacc

SEQ ID NO: 7360967 - DNA, 20 bp, Homo sapiens
tggcaggagccactggaagc

SEQ ID NO: 7360968 - DNA, 20 bp, Homo sapiens
tggcaggaatagggccagag

SEQ ID NO: 7360969 - DNA, 20 bp, Homo sapiens
tggcaggaatagggccagag

SEQ ID NO: 7360970 - DNA, 22 bp, Homo sapiens
tggcaggaggatgaggcggcta

SEQ ID NO: 7360971 - DNA, 22 bp, Homo sapiens
tggcaggagcctgcggggaggt

SEQ ID NO: 7360972 - DNA, 22 bp, Homo sapiens
tggcaggagcctgcggggaggt

SEQ ID NO: 7360973 - DNA, 22 bp, Homo sapiens
tggcaggaaagtaacagagcac

SEQ ID NO: 7360974 - DNA, 22 bp, Homo sapiens
tggcaggaaccaggaggctctc

SEQ ID NO: 7360975 - DNA, 22 bp, Homo sapiens
tggcaggaaccaggaggctctc

SEQ ID NO: 7360976 - DNA, 22 bp, Homo sapiens
tggcaggaaaaagggccagagg

SEQ ID NO: 7360977 - DNA, 22 bp, Homo sapiens
tggcaggatctttgagagtgaa

SEQ ID NO: 7360978 - DNA, 22 bp, Homo sapiens
tggcagggagccaccggtcatg

SEQ ID NO: 7360979 - DNA, 22 bp, Homo sapiens
tggcagggagttcgttcacaac

SEQ ID NO: 7360980 - DNA, 18 bp, Homo sapiens
tggcagagtgtctgttct

SEQ ID NO: 7360981 - DNA, 22 bp, Homo sapiens
tggcagagttatgggtatttat

SEQ ID NO: 7360982 - DNA, 22 bp, Homo sapiens
tggcagagtctgggcttgggca

SEQ ID NO: 7360983 - DNA, 22 bp, Homo sapiens
tggcatggactagtgctgaggt

SEQ ID NO: 7360984 - DNA, 18 bp, Homo sapiens
tggcatgctttgatacat

SEQ ID NO: 7360985 - DNA, 21 bp, Homo sapiens
tggcatgcagtgttcctgtgc

SEQ ID NO: 7360986 - DNA, 22 bp, Homo sapiens
tggcatgcatctgttgtcctag

SEQ ID NO: 7360987 - DNA, 22 bp, Homo sapiens
tggcatcacctccacgatcatc

SEQ ID NO: 7360988 - DNA, 22 bp, Homo sapiens
tggcatcctccctcaagctgaa

SEQ ID NO: 7360989 - DNA, 22 bp, Homo sapiens
tggcatcctttatctgcaggct

SEQ ID NO: 7360990 - DNA, 22 bp, Homo sapiens
tggcaggtttcctcctcatagt

SEQ ID NO: 7360991 - DNA, 22 bp, Homo sapiens
tggcagtcttgctctctaagag

SEQ ID NO: 7360992 - DNA, 22 bp, Homo sapiens
tggcaggtccactcacagatct

SEQ ID NO: 7360993 - DNA, 22 bp, Homo sapiens
tggcaggtgccatgggctcaga

SEQ ID NO: 7360994 - DNA, 22 bp, Homo sapiens
tggcaggttatgcgggccacat

SEQ ID NO: 7360995 - DNA, 22 bp, Homo sapiens
tggcaggtggagacagcagagc

SEQ ID NO: 7360996 - DNA, 22 bp, Homo sapiens
tggcaggtcatgagtggccacc

SEQ ID NO: 7360997 - DNA, 22 bp, Homo sapiens
tggccaggccggggacagaact

SEQ ID NO: 7360998 - DNA, 22 bp, Homo sapiens
tggccagccttgtcatcgcttt

SEQ ID NO: 7360999 - DNA, 21 bp, Homo sapiens
tggccagctgctcgtctcctc

SEQ ID NO: 7361000 - DNA, 22 bp, Homo sapiens
tggccaggcattcagataagac

SEQ ID NO: 7361001 - DNA, 22 bp, Homo sapiens
tggccagcagagttcactctct

SEQ ID NO: 7361002 - DNA, 22 bp, Homo sapiens
tggccagcagagttcactctct

SEQ ID NO: 7361003 - DNA, 22 bp, Homo sapiens
tggccagcccttcagccatgcc

SEQ ID NO: 7361004 - DNA, 22 bp, Homo sapiens
tggccaggctggtctggaacgc

SEQ ID NO: 7361005 - DNA, 23 bp, Homo sapiens
tggccaggtagaggaggtagtga

SEQ ID NO: 7361006 - DNA, 23 bp, Homo sapiens
tggccaggtagaggaggtagtga

SEQ ID NO: 7361007 - DNA, 22 bp, Homo sapiens
tggccaggtgtgggttctcaga

SEQ ID NO: 7361008 - DNA, 22 bp, Homo sapiens
tggccagagtccagtgagcctt

SEQ ID NO: 7361009 - DNA, 22 bp, Homo sapiens
tggccacagtgtccagcagcag

SEQ ID NO: 7361010 - DNA, 22 bp, Homo sapiens
tggccacagtgtccagcagcag

SEQ ID NO: 7361011 - DNA, 22 bp, Homo sapiens
tggccacatatgtgggacagct

SEQ ID NO: 7361012 - DNA, 22 bp, Homo sapiens
tggccacatgcgtctgtgaggc

SEQ ID NO: 7361013 - DNA, 22 bp, Homo sapiens
tggccacacccacctagaggag

SEQ ID NO: 7361014 - DNA, 22 bp, Homo sapiens
tggccacacccacctagaggag

SEQ ID NO: 7361015 - DNA, 22 bp, Homo sapiens
tggcctggccacatccagcagg

SEQ ID NO: 7361016 - DNA, 22 bp, Homo sapiens
tggcctggcagagcaaggcctg

SEQ ID NO: 7361017 - DNA, 22 bp, Homo sapiens
tggcctctggctgaggactaac

SEQ ID NO: 7361018 - DNA, 22 bp, Homo sapiens
tggccctgtgtcctgctgccag

SEQ ID NO: 7361019 - DNA, 22 bp, Homo sapiens
tggccctgtgtgcaggctgcac

SEQ ID NO: 7361020 - DNA, 22 bp, Homo sapiens
tggccctgtgtgcaggctgcac

SEQ ID NO: 7361021 - DNA, 22 bp, Homo sapiens
tggccctgtggaggtcagtgag

SEQ ID NO: 7361022 - DNA, 22 bp, Homo sapiens
tggccctgtggaggtcagtgag

SEQ ID NO: 7361023 - DNA, 22 bp, Homo sapiens
tggccctgtggcttcagaacag

SEQ ID NO: 7361024 - DNA, 23 bp, Homo sapiens
tggccctgtgcatgctgcttccc

SEQ ID NO: 7361025 - DNA, 23 bp, Homo sapiens
tggccctgtgcatgctgcttccc

SEQ ID NO: 7361026 - DNA, 22 bp, Homo sapiens
tggccctgttctgtacctcata

SEQ ID NO: 7361027 - DNA, 20 bp, Homo sapiens
tggccctgttttctccaggc

SEQ ID NO: 7361028 - DNA, 22 bp, Homo sapiens
tggccgggaagggacagtgtgg

SEQ ID NO: 7361029 - DNA, 22 bp, Homo sapiens
tggccgggccgggcgcctccac

SEQ ID NO: 7361030 - DNA, 22 bp, Homo sapiens
tggccggggctgatggacagtg

SEQ ID NO: 7361031 - DNA, 22 bp, Homo sapiens
tggccctgtcctcatttcatct

SEQ ID NO: 7361032 - DNA, 22 bp, Homo sapiens
tggccctgtccctggagcctgg

SEQ ID NO: 7361033 - DNA, 22 bp, Homo sapiens
tggccctgtctgcacacaggat

SEQ ID NO: 7361034 - DNA, 22 bp, Homo sapiens
tggccctgtgactgagttctag

SEQ ID NO: 7361035 - DNA, 22 bp, Homo sapiens
tggccctgggtggaatgtccca

SEQ ID NO: 7361036 - DNA, 22 bp, Homo sapiens
tggccctggtggcacagcctgc

SEQ ID NO: 7361037 - DNA, 22 bp, Homo sapiens
tggccctgtccctggagcctgg

SEQ ID NO: 7361038 - DNA, 22 bp, Homo sapiens
tggccctggctgagttagattt

SEQ ID NO: 7361039 - DNA, 22 bp, Homo sapiens
tggccctgccgccacgacgtct

SEQ ID NO: 7361040 - DNA, 21 bp, Homo sapiens
tggccctggccacggctgcca

SEQ ID NO: 7361041 - DNA, 22 bp, Homo sapiens
tggccctgggcatctttcgtga

SEQ ID NO: 7361042 - DNA, 22 bp, Homo sapiens
tggccctgggcatctttcgtga

SEQ ID NO: 7361043 - DNA, 22 bp, Homo sapiens
tggccctgggcagaggcaacat

SEQ ID NO: 7361044 - DNA, 22 bp, Homo sapiens
tggccctgccgcactatcctca

SEQ ID NO: 7361045 - DNA, 22 bp, Homo sapiens
tggccctgccgcactatcctca

SEQ ID NO: 7361046 - DNA, 22 bp, Homo sapiens
tggccctgccctcttcatcttt

SEQ ID NO: 7361047 - DNA, 22 bp, Homo sapiens
tggccctgccactcactgctga

SEQ ID NO: 7361048 - DNA, 22 bp, Homo sapiens
tggcccaggaggccagagggca

SEQ ID NO: 7361049 - DNA, 22 bp, Homo sapiens
tggcccaggaggccagagggca

SEQ ID NO: 7361050 - DNA, 22 bp, Homo sapiens
tggcccaggccaaagccctgga

SEQ ID NO: 7361051 - DNA, 22 bp, Homo sapiens
tggcccagggagttcatggtgt

SEQ ID NO: 7361052 - DNA, 22 bp, Homo sapiens
tggcccagggagttcatggtgt

SEQ ID NO: 7361053 - DNA, 22 bp, Homo sapiens
tggcccaggcgaggtgggcaga

SEQ ID NO: 7361054 - DNA, 22 bp, Homo sapiens
tggcccaggccaaagccctgga

SEQ ID NO: 7361055 - DNA, 22 bp, Homo sapiens
tggcccaggccaaagccctgga

SEQ ID NO: 7361056 - DNA, 22 bp, Homo sapiens
tggcccaggtctctctgagccc

SEQ ID NO: 7361057 - DNA, 22 bp, Homo sapiens
tggcccagggtctacagcctca

SEQ ID NO: 7361058 - DNA, 22 bp, Homo sapiens
tggcccagggagttcatggtgt

SEQ ID NO: 7361059 - DNA, 22 bp, Homo sapiens
tggcccagggcacagcagggag

SEQ ID NO: 7361060 - DNA, 22 bp, Homo sapiens
tggcccagggcacagcagggag

SEQ ID NO: 7361061 - DNA, 22 bp, Homo sapiens
tggccatgggatagtgcagggg

SEQ ID NO: 7361062 - DNA, 22 bp, Homo sapiens
tggcccagagcactgctgggca

SEQ ID NO: 7361063 - DNA, 22 bp, Homo sapiens
tggcccagactctgctcttatc

SEQ ID NO: 7361064 - DNA, 22 bp, Homo sapiens
tggcccaatatgttaacatgat

SEQ ID NO: 7361065 - DNA, 22 bp, Homo sapiens
tggcccaagacgttacctcctt

SEQ ID NO: 7361066 - DNA, 22 bp, Homo sapiens
tggcccaagcccgggacggcca

SEQ ID NO: 7361067 - DNA, 22 bp, Homo sapiens
tggcccaaggttacatggctag

SEQ ID NO: 7361068 - DNA, 22 bp, Homo sapiens
tggcccaagtctgctagaagag

SEQ ID NO: 7361069 - DNA, 22 bp, Homo sapiens
tggcccagctgcagatggtgga

SEQ ID NO: 7361070 - DNA, 22 bp, Homo sapiens
tggcccagctcagggtgggcgg

SEQ ID NO: 7361071 - DNA, 22 bp, Homo sapiens
tggccctgactgatgtggaggg

SEQ ID NO: 7361072 - DNA, 22 bp, Homo sapiens
tggccctgacttggaggcctga

SEQ ID NO: 7361073 - DNA, 22 bp, Homo sapiens
tggccctgaggacccagtgtgg

SEQ ID NO: 7361074 - DNA, 22 bp, Homo sapiens
tggccctgacaggtcctgggca

SEQ ID NO: 7361075 - DNA, 22 bp, Homo sapiens
tggccctgacacgtggtactgg

SEQ ID NO: 7361076 - DNA, 22 bp, Homo sapiens
tggccctgacacgtggtactgg

SEQ ID NO: 7361077 - DNA, 22 bp, Homo sapiens
tggccctgaggggctgtgcccc

SEQ ID NO: 7361078 - DNA, 22 bp, Homo sapiens
tggccctgaggggctgtgcccc

SEQ ID NO: 7361079 - DNA, 22 bp, Homo sapiens
tggccctgaggacccagtgtgg

SEQ ID NO: 7361080 - DNA, 22 bp, Homo sapiens
tggccctgagggctcggagcca

SEQ ID NO: 7361081 - DNA, 22 bp, Homo sapiens
tggccctgcagaactagcctgg

SEQ ID NO: 7361082 - DNA, 22 bp, Homo sapiens
tggccctgcagaactagcctgg

SEQ ID NO: 7361083 - DNA, 22 bp, Homo sapiens
tggccctgcacccagagcagtt

SEQ ID NO: 7361084 - DNA, 23 bp, Homo sapiens
tggccctgaatctgtcctggagg

SEQ ID NO: 7361085 - DNA, 22 bp, Homo sapiens
tggccctgaaggccttgagcat

SEQ ID NO: 7361086 - DNA, 22 bp, Homo sapiens
tggccctgaaggccttgagcat

SEQ ID NO: 7361087 - DNA, 22 bp, Homo sapiens
tggccctgaatcaaggccagca

SEQ ID NO: 7361088 - DNA, 22 bp, Homo sapiens
tggcccaggtgcaagagacaga

SEQ ID NO: 7361089 - DNA, 22 bp, Homo sapiens
tggcccaggtgcaagagacaga

SEQ ID NO: 7361090 - DNA, 22 bp, Homo sapiens
tggcccaggtgcaagagacaga

SEQ ID NO: 7361091 - DNA, 22 bp, Homo sapiens
tggcccaggtgcacccagaggc

SEQ ID NO: 7361092 - DNA, 22 bp, Homo sapiens
tggcccggctctgagctgtgct

SEQ ID NO: 7361093 - DNA, 21 bp, Homo sapiens
tgctgggtttgcccatcaggc

SEQ ID NO: 7361094 - DNA, 22 bp, Homo sapiens
tgctgggtcccttgagagctca

SEQ ID NO: 7361095 - DNA, 22 bp, Homo sapiens
tgctgggtggttgctcctcccg

SEQ ID NO: 7361096 - DNA, 22 bp, Homo sapiens
tgctggtggagaaagtggaggt

SEQ ID NO: 7361097 - DNA, 21 bp, Homo sapiens
tgctggtgagctcatgtggct

SEQ ID NO: 7361098 - DNA, 22 bp, Homo sapiens
tgctgtatatattttgaagtga

SEQ ID NO: 7361099 - DNA, 22 bp, Homo sapiens
tgctggttgtattttctctgtg

SEQ ID NO: 7361100 - DNA, 22 bp, Homo sapiens
tgctgtattacttttacaaact

SEQ ID NO: 7361101 - DNA, 22 bp, Homo sapiens
tgctgggtcagtgagagcaggg

SEQ ID NO: 7361102 - DNA, 22 bp, Homo sapiens
tgctgggtcagtgagagcaggg

SEQ ID NO: 7361103 - DNA, 22 bp, Homo sapiens
tgctggggtctctccggtgccc

SEQ ID NO: 7361104 - DNA, 22 bp, Homo sapiens
tgctggggtcatggggcgcccg

SEQ ID NO: 7361105 - DNA, 22 bp, Homo sapiens
tgctggggtcatggggcgcccg

SEQ ID NO: 7361106 - DNA, 23 bp, Homo sapiens
tgctggggtagtttgtggcacag

SEQ ID NO: 7361107 - DNA, 22 bp, Homo sapiens
tgctggggatccgtaccaaccc

SEQ ID NO: 7361108 - DNA, 16 bp, Homo sapiens
tgctggggcgccgtcc

SEQ ID NO: 7361109 - DNA, 22 bp, Homo sapiens
tgctggggcagaagagccaaga

SEQ ID NO: 7361110 - DNA, 22 bp, Homo sapiens
tgctggggagtgattgaccatc

SEQ ID NO: 7361111 - DNA, 20 bp, Homo sapiens
tgctggggacatacagggtg

SEQ ID NO: 7361112 - DNA, 22 bp, Homo sapiens
tgctgggcatcgtaggaggtac

SEQ ID NO: 7361113 - DNA, 22 bp, Homo sapiens
tgctgggccaaagcagggtttt

SEQ ID NO: 7361114 - DNA, 22 bp, Homo sapiens
tgctgggcatttttatggctcc

SEQ ID NO: 7361115 - DNA, 22 bp, Homo sapiens
tgctgggctagaagctgaggcc

SEQ ID NO: 7361116 - DNA, 22 bp, Homo sapiens
tgctgggcggtgggctcatccc

SEQ ID NO: 7361117 - DNA, 22 bp, Homo sapiens
tgcttaaacacatacatacata

SEQ ID NO: 7361118 - DNA, 22 bp, Homo sapiens
tgcttaaacatactatttatat

SEQ ID NO: 7361119 - DNA, 22 bp, Homo sapiens
tgcttaaacatccagacagtat

SEQ ID NO: 7361120 - DNA, 22 bp, Homo sapiens
tgcttaaaccctgatcatgtgt

SEQ ID NO: 7361121 - DNA, 22 bp, Homo sapiens
tgcttaaaggatagtttaaact

SEQ ID NO: 7361122 - DNA, 22 bp, Homo sapiens
tgcttaaagctgctcagttgta

SEQ ID NO: 7361123 - DNA, 22 bp, Homo sapiens
tgcttaatccaacctggctgac

SEQ ID NO: 7361124 - DNA, 19 bp, Homo sapiens
tgcttaattcctagtaggt

SEQ ID NO: 7361125 - DNA, 22 bp, Homo sapiens
tgcttagatgaggcagcaggag

SEQ ID NO: 7361126 - DNA, 22 bp, Homo sapiens
tgctgtgacctttgagtacgca

SEQ ID NO: 7361127 - DNA, 22 bp, Homo sapiens
tgctgtctttcattgtctgcct

SEQ ID NO: 7361128 - DNA, 22 bp, Homo sapiens
tgcttaaaatgatgattatttt

SEQ ID NO: 7361129 - DNA, 22 bp, Homo sapiens
tgcttaaaatagttcatttttg

SEQ ID NO: 7361130 - DNA, 22 bp, Homo sapiens
tgcttaaaaagtaactgctgat

SEQ ID NO: 7361131 - DNA, 23 bp, Homo sapiens
tgctgtgcctttgtctgcctcca

SEQ ID NO: 7361132 - DNA, 22 bp, Homo sapiens
tgctgtgcaaaggtgatgtgag

SEQ ID NO: 7361133 - DNA, 22 bp, Homo sapiens
tgctgtgcaaaggtgatgtgag

SEQ ID NO: 7361134 - DNA, 22 bp, Homo sapiens
tgctgtgaggttgagaaggaag

SEQ ID NO: 7361135 - DNA, 22 bp, Homo sapiens
tgcttctgcattcaatgttgga

SEQ ID NO: 7361136 - DNA, 22 bp, Homo sapiens
tgcttctgattcatggttattg

SEQ ID NO: 7361137 - DNA, 22 bp, Homo sapiens
tgcttctgcaacttgaatgtac

SEQ ID NO: 7361138 - DNA, 22 bp, Homo sapiens
tgcttctgactgggtcagttga

SEQ ID NO: 7361139 - DNA, 22 bp, Homo sapiens
tgcttctgacatgttcttggtt

SEQ ID NO: 7361140 - DNA, 22 bp, Homo sapiens
tgcttctccattgatgctaagt

SEQ ID NO: 7361141 - DNA, 22 bp, Homo sapiens
tgcttccctgaaggcacaggag

SEQ ID NO: 7361142 - DNA, 22 bp, Homo sapiens
tgcttatttgaatttattctca

SEQ ID NO: 7361143 - DNA, 22 bp, Homo sapiens
tgcttattaacatgtatatctc

SEQ ID NO: 7361144 - DNA, 23 bp, Homo sapiens
tgcttattcaaaaggtgctttca

SEQ ID NO: 7361145 - DNA, 22 bp, Homo sapiens
tgcttccagccttcccaatgct

SEQ ID NO: 7361146 - DNA, 22 bp, Homo sapiens
tgctgctgtttcctacatctca

SEQ ID NO: 7361147 - DNA, 20 bp, Homo sapiens
tgctgctgtgagcgtccctg

SEQ ID NO: 7361148 - DNA, 22 bp, Homo sapiens
tgctgctttgatgtgtaaatca

SEQ ID NO: 7361149 - DNA, 22 bp, Homo sapiens
tgctgcttttagttggatagaa

SEQ ID NO: 7361150 - DNA, 22 bp, Homo sapiens
tgctgctttaaaaagtgctgat

SEQ ID NO: 7361151 - DNA, 22 bp, Homo sapiens
tgctgctgatggatgcctggac

SEQ ID NO: 7361152 - DNA, 22 bp, Homo sapiens
tgctggaaccaggaatttgaag

SEQ ID NO: 7361153 - DNA, 22 bp, Homo sapiens
tgctggaactcagtgaatcatt

SEQ ID NO: 7361154 - DNA, 22 bp, Homo sapiens
tgctggaagaaaattctttaac

SEQ ID NO: 7361155 - DNA, 22 bp, Homo sapiens
tgctggaagaattccatgctgg

SEQ ID NO: 7361156 - DNA, 22 bp, Homo sapiens
tgctggaaagttaaattttgga

SEQ ID NO: 7361157 - DNA, 22 bp, Homo sapiens
tgctggaaataggcattgtagc

SEQ ID NO: 7361158 - DNA, 22 bp, Homo sapiens
tgctggaagggtagtattaact

SEQ ID NO: 7361159 - DNA, 22 bp, Homo sapiens
tgctggaataatttcatgttaa

SEQ ID NO: 7361160 - DNA, 23 bp, Homo sapiens
tgctggaatttgtaccctggcag

SEQ ID NO: 7361161 - DNA, 22 bp, Homo sapiens
tgctggaattttgctcttgcaa

SEQ ID NO: 7361162 - DNA, 17 bp, Homo sapiens
tgctgccaagtcccaac

SEQ ID NO: 7361163 - DNA, 22 bp, Homo sapiens
tgctgccaaatgcgagctctgt

SEQ ID NO: 7361164 - DNA, 22 bp, Homo sapiens
tgctgccaagcccgtgctcctg

SEQ ID NO: 7361165 - DNA, 22 bp, Homo sapiens
tgctgccacccctcaccagagc

SEQ ID NO: 7361166 - DNA, 22 bp, Homo sapiens
tgctgccacctggtggctgaag

SEQ ID NO: 7361167 - DNA, 22 bp, Homo sapiens
tgctgccactggtagtctcatt

SEQ ID NO: 7361168 - DNA, 22 bp, Homo sapiens
tgctgccaggtcttgctgtcca

SEQ ID NO: 7361169 - DNA, 22 bp, Homo sapiens
tgctgccagggctctgcccaca

SEQ ID NO: 7361170 - DNA, 21 bp, Homo sapiens
tgctgccatcatgcagagatg

SEQ ID NO: 7361171 - DNA, 22 bp, Homo sapiens
tgctgcctcaactgtcaggaac

SEQ ID NO: 7361172 - DNA, 22 bp, Homo sapiens
tgctgcctaacagaactctttc

SEQ ID NO: 7361173 - DNA, 22 bp, Homo sapiens
tgctgcctaataagtcgagggt

SEQ ID NO: 7361174 - DNA, 22 bp, Homo sapiens
tgctgcctaataagtcgagggt

SEQ ID NO: 7361175 - DNA, 22 bp, Homo sapiens
tgctgctgacatttggggcttg

SEQ ID NO: 7361176 - DNA, 22 bp, Homo sapiens
tgctgctcctgcctggctccca

SEQ ID NO: 7361177 - DNA, 22 bp, Homo sapiens
tgctgctcgccacggcccaggg

SEQ ID NO: 7361178 - DNA, 22 bp, Homo sapiens
tgctgctcttcaccatggcctc

SEQ ID NO: 7361179 - DNA, 22 bp, Homo sapiens
tgctgctgaaaaggtgtgctta

SEQ ID NO: 7361180 - DNA, 22 bp, Homo sapiens
tgctgctcttcaccatggcctc

SEQ ID NO: 7361181 - DNA, 22 bp, Homo sapiens
tgctggctgtatatgtgagagt

SEQ ID NO: 7361182 - DNA, 22 bp, Homo sapiens
tgctggctgttctagggaggcc

SEQ ID NO: 7361183 - DNA, 22 bp, Homo sapiens
tgctggctgcagtgctgtcaaa

SEQ ID NO: 7361184 - DNA, 22 bp, Homo sapiens
tgctggctactgatggcaggcc

SEQ ID NO: 7361185 - DNA, 22 bp, Homo sapiens
tgctggcacgtggaccaggaga

SEQ ID NO: 7361186 - DNA, 22 bp, Homo sapiens
tgctggcaccagaatgactgca

SEQ ID NO: 7361187 - DNA, 22 bp, Homo sapiens
tgctggcatcttaatgttctgt

SEQ ID NO: 7361188 - DNA, 23 bp, Homo sapiens
tgctggagtttactcaggccagc

SEQ ID NO: 7361189 - DNA, 19 bp, Homo sapiens
tgctggagggtagtgagtc

SEQ ID NO: 7361190 - DNA, 22 bp, Homo sapiens
tgctggaggccgagaagcagca

SEQ ID NO: 7361191 - DNA, 22 bp, Homo sapiens
tgctggaggcagtggaggtgcc

SEQ ID NO: 7361192 - DNA, 22 bp, Homo sapiens
tgctggaggattaaacaagtca

SEQ ID NO: 7361193 - DNA, 22 bp, Homo sapiens
tgcgggggaagctgtgggagaa

SEQ ID NO: 7361194 - DNA, 22 bp, Homo sapiens
tgcgggggaagctgtgggagaa

SEQ ID NO: 7361195 - DNA, 22 bp, Homo sapiens
tgcggggccctcccgtgcactg

SEQ ID NO: 7361196 - DNA, 22 bp, Homo sapiens
tgcgtctctgtcctcaaagacc

SEQ ID NO: 7361197 - DNA, 23 bp, Homo sapiens
tgctaaaggcagaatattcacct

SEQ ID NO: 7361198 - DNA, 22 bp, Homo sapiens
tgcgggagggcaacgcggcatt

SEQ ID NO: 7361199 - DNA, 22 bp, Homo sapiens
tgcgggagtgcgccgagctctc

SEQ ID NO: 7361200 - DNA, 22 bp, Homo sapiens
tgcggcggcgggcagaggacta

SEQ ID NO: 7361201 - DNA, 22 bp, Homo sapiens
tgcggcagccaccgcgtggccc

SEQ ID NO: 7361202 - DNA, 22 bp, Homo sapiens
tgcggcagccaccgcgtggccc

SEQ ID NO: 7361203 - DNA, 22 bp, Homo sapiens
tgcgctggtggcggataagggt

SEQ ID NO: 7361204 - DNA, 22 bp, Homo sapiens
tgcgcggctcagtcatctccag

SEQ ID NO: 7361205 - DNA, 22 bp, Homo sapiens
tgcgcgggtgcctatctgtata

SEQ ID NO: 7361206 - DNA, 22 bp, Homo sapiens
tgcgcaggacacttgcagtgac

SEQ ID NO: 7361207 - DNA, 22 bp, Homo sapiens
tgcgccatgtgctctcggccct

SEQ ID NO: 7361208 - DNA, 22 bp, Homo sapiens
tgcgcaggagctctgccaggag

SEQ ID NO: 7361209 - DNA, 22 bp, Homo sapiens
tgcgcccagccaagtctggcac

SEQ ID NO: 7361210 - DNA, 22 bp, Homo sapiens
tgctataagagtcacttttcct

SEQ ID NO: 7361211 - DNA, 22 bp, Homo sapiens
tgctaactattcctaaagatca

SEQ ID NO: 7361212 - DNA, 22 bp, Homo sapiens
tgctataagaattatattactc

SEQ ID NO: 7361213 - DNA, 22 bp, Homo sapiens
tgctatgtaaagctctgggttt

SEQ ID NO: 7361214 - DNA, 22 bp, Homo sapiens
tgctatgtgagtgctccaggtg

SEQ ID NO: 7361215 - DNA, 22 bp, Homo sapiens
tgctattaaattaaattgatat

SEQ ID NO: 7361216 - DNA, 22 bp, Homo sapiens
tgctattgtgaacagtgccaca

SEQ ID NO: 7361217 - DNA, 19 bp, Homo sapiens
tgctatttgaagaagtgta

SEQ ID NO: 7361218 - DNA, 22 bp, Homo sapiens
tgctatttgggggctacatgat

SEQ ID NO: 7361219 - DNA, 22 bp, Homo sapiens
tgctatttggaaaagcatttgg

SEQ ID NO: 7361220 - DNA, 16 bp, Homo sapiens
tgctattttagagagg

SEQ ID NO: 7361221 - DNA, 22 bp, Homo sapiens
tgctcagactagctccagggaa

SEQ ID NO: 7361222 - DNA, 22 bp, Homo sapiens
tgctcagcagtcaaggtcatag

SEQ ID NO: 7361223 - DNA, 22 bp, Homo sapiens
tgctcagctaggctgaagaaga

SEQ ID NO: 7361224 - DNA, 22 bp, Homo sapiens
tgctcagcacagaccaggccag

SEQ ID NO: 7361225 - DNA, 22 bp, Homo sapiens
tgctcagcagatctcaggagat

SEQ ID NO: 7361226 - DNA, 22 bp, Homo sapiens
tgctcaaatgtggacaactgat

SEQ ID NO: 7361227 - DNA, 22 bp, Homo sapiens
tgctcacagcccagaacataat

SEQ ID NO: 7361228 - DNA, 22 bp, Homo sapiens
tgctcacactcatgtccacgct

SEQ ID NO: 7361229 - DNA, 22 bp, Homo sapiens
tgctcacaattatcagaagtat

SEQ ID NO: 7361230 - DNA, 22 bp, Homo sapiens
tgctcacattaggcatccatgg

SEQ ID NO: 7361231 - DNA, 22 bp, Homo sapiens
tgctcacagcccagaacataat

SEQ ID NO: 7361232 - DNA, 22 bp, Homo sapiens
tgctcattggcgatctgaggga

SEQ ID NO: 7361233 - DNA, 22 bp, Homo sapiens
tgctccagaaaaacttgagact

SEQ ID NO: 7361234 - DNA, 22 bp, Homo sapiens
tgctccagaacctgaccatgct

SEQ ID NO: 7361235 - DNA, 22 bp, Homo sapiens
tgctccagcaacaggcttagct

SEQ ID NO: 7361236 - DNA, 22 bp, Homo sapiens
tgctccagcaccaagagctcca

SEQ ID NO: 7361237 - DNA, 22 bp, Homo sapiens
tgctcagtcctaccttggctcc

SEQ ID NO: 7361238 - DNA, 22 bp, Homo sapiens
tgctcagctggtgccagggtcc

SEQ ID NO: 7361239 - DNA, 18 bp, Homo sapiens
tgctcagctggtgctgaa

SEQ ID NO: 7361240 - DNA, 22 bp, Homo sapiens
tgctcagtgtcttttttggagg

SEQ ID NO: 7361241 - DNA, 22 bp, Homo sapiens
tgcctgggctcaccgcctcttt

SEQ ID NO: 7361242 - DNA, 22 bp, Homo sapiens
tgcctggggattgctctgggcc

SEQ ID NO: 7361243 - DNA, 17 bp, Homo sapiens
tgcctgtgataagcaca

SEQ ID NO: 7361244 - DNA, 22 bp, Homo sapiens
tgcctgtgacccaaggatgcga

SEQ ID NO: 7361245 - DNA, 22 bp, Homo sapiens
tgcctgtgaaaaccctggggtt

SEQ ID NO: 7361246 - DNA, 22 bp, Homo sapiens
tgcctgggtgccctctgctcct

SEQ ID NO: 7361247 - DNA, 22 bp, Homo sapiens
tgcctgggtccaggccaagcct

SEQ ID NO: 7361248 - DNA, 22 bp, Homo sapiens
tgcctgggtgctggctggtcac

SEQ ID NO: 7361249 - DNA, 22 bp, Homo sapiens
tgcctgggtgctggctggtcac

SEQ ID NO: 7361250 - DNA, 22 bp, Homo sapiens
tgcctgggtgtaaagggccaac

SEQ ID NO: 7361251 - DNA, 22 bp, Homo sapiens
tgcgatggcgtagacaaatccc

SEQ ID NO: 7361252 - DNA, 22 bp, Homo sapiens
tgcgatgcaacagcttggcgga

SEQ ID NO: 7361253 - DNA, 22 bp, Homo sapiens
tgcgatgagcttatgtgtgaat

SEQ ID NO: 7361254 - DNA, 22 bp, Homo sapiens
tgcctgtgcccttcttggcatt

SEQ ID NO: 7361255 - DNA, 22 bp, Homo sapiens
tgcctgtgatcagctgagttca

SEQ ID NO: 7361256 - DNA, 22 bp, Homo sapiens
tgcctgtggagccactagtttt

SEQ ID NO: 7361257 - DNA, 22 bp, Homo sapiens
tgcctgtggaaaggctggtgct

SEQ ID NO: 7361258 - DNA, 22 bp, Homo sapiens
tgcctgtgccctttgctgggag

SEQ ID NO: 7361259 - DNA, 22 bp, Homo sapiens
tgcctgtgctgggattgcatgt

SEQ ID NO: 7361260 - DNA, 22 bp, Homo sapiens
tgcctgtggttccagttttttc

SEQ ID NO: 7361261 - DNA, 22 bp, Homo sapiens
tgcctgtgggtgatgatttgat

SEQ ID NO: 7361262 - DNA, 22 bp, Homo sapiens
tgcctgtgggtgccaccaccct

SEQ ID NO: 7361263 - DNA, 22 bp, Homo sapiens
tgcctgtgggcagagggccaga

SEQ ID NO: 7361264 - DNA, 22 bp, Homo sapiens
tgcctgtgggcagagggccaga

SEQ ID NO: 7361265 - DNA, 19 bp, Homo sapiens
tgcctgtggcgagcatctt

SEQ ID NO: 7361266 - DNA, 22 bp, Homo sapiens
tgcctgtgtcagcaggtggaag

SEQ ID NO: 7361267 - DNA, 22 bp, Homo sapiens
tgcctgtgtcacagtgatgttt

SEQ ID NO: 7361268 - DNA, 22 bp, Homo sapiens
tgcctgtgtccccttcttggca

SEQ ID NO: 7361269 - DNA, 22 bp, Homo sapiens
tgcctgtgtatgtgcatgcaca

SEQ ID NO: 7361270 - DNA, 22 bp, Homo sapiens
tgcctgtgtatttccggcctgc

SEQ ID NO: 7361271 - DNA, 22 bp, Homo sapiens
tgccttgaacatagtggacagt

SEQ ID NO: 7361272 - DNA, 22 bp, Homo sapiens
tgccttcttctccctggctcag

SEQ ID NO: 7361273 - DNA, 22 bp, Homo sapiens
tgctccagggctgccagaccct

SEQ ID NO: 7361274 - DNA, 22 bp, Homo sapiens
tgctccagggcctccagtgggg

SEQ ID NO: 7361275 - DNA, 22 bp, Homo sapiens
tgctccgggaaagagcagccgc

SEQ ID NO: 7361276 - DNA, 22 bp, Homo sapiens
tgctcctgagtgtgcaggagat

SEQ ID NO: 7361277 - DNA, 22 bp, Homo sapiens
tgctcctgctgcatgcatctcc

SEQ ID NO: 7361278 - DNA, 22 bp, Homo sapiens
tgctcctgctgcatgcatctcc

SEQ ID NO: 7361279 - DNA, 22 bp, Homo sapiens
tgctcctgcttagccgtgtttt

SEQ ID NO: 7361280 - DNA, 22 bp, Homo sapiens
tgctcctgacagagtccatatg

SEQ ID NO: 7361281 - DNA, 22 bp, Homo sapiens
tgctcctgaggttggagatcca

SEQ ID NO: 7361282 - DNA, 22 bp, Homo sapiens
tgctcctgagtgtgcaggagat

SEQ ID NO: 7361283 - DNA, 23 bp, Homo sapiens
tgctccagcctctttgatagtgt

SEQ ID NO: 7361284 - DNA, 22 bp, Homo sapiens
tgctccagcgctgccaccagtt

SEQ ID NO: 7361285 - DNA, 22 bp, Homo sapiens
tgctccagcctatgctctccgg

SEQ ID NO: 7361286 - DNA, 22 bp, Homo sapiens
tgctccagcaccaagagctcca

SEQ ID NO: 7361287 - DNA, 22 bp, Homo sapiens
tgctccagcatgaccctcaatg

SEQ ID NO: 7361288 - DNA, 22 bp, Homo sapiens
tgctccagcccctggtgcacag

SEQ ID NO: 7361289 - DNA, 22 bp, Homo sapiens
tgctccagcccctggtgcacag

SEQ ID NO: 7361290 - DNA, 22 bp, Homo sapiens
tgctccagcccctggtgcacag

SEQ ID NO: 7361291 - DNA, 22 bp, Homo sapiens
tgctccagcccctggtgcacag

SEQ ID NO: 7361292 - DNA, 22 bp, Homo sapiens
tgctccagcctatgctctccgg

SEQ ID NO: 7361293 - DNA, 22 bp, Homo sapiens
tgctccagcgctgccaccagtt

SEQ ID NO: 7361294 - DNA, 22 bp, Homo sapiens
tgctccagctggagatgggggc

SEQ ID NO: 7361295 - DNA, 20 bp, Homo sapiens
tgctccaggaacactggccg

SEQ ID NO: 7361296 - DNA, 22 bp, Homo sapiens
tgctccaggagcaacctttgag

SEQ ID NO: 7361297 - DNA, 22 bp, Homo sapiens
tgctccaggagcaacctttgag

SEQ ID NO: 7361298 - DNA, 22 bp, Homo sapiens
tgctccaggcaagctgagagtt

SEQ ID NO: 7361299 - DNA, 22 bp, Homo sapiens
tgctccaggcaagctgagagtt

SEQ ID NO: 7361300 - DNA, 21 bp, Homo sapiens
tgctccaggagggggcagtcc

SEQ ID NO: 7361301 - DNA, 21 bp, Homo sapiens
tgctccaggagggggcagtcc

SEQ ID NO: 7361302 - DNA, 18 bp, Homo sapiens
tgctccaggcccatgggc

SEQ ID NO: 7361303 - DNA, 22 bp, Homo sapiens
tgctccaggccgcctggggctg

SEQ ID NO: 7361304 - DNA, 22 bp, Homo sapiens
tgctccaggccgcctggggctg

SEQ ID NO: 7361305 - DNA, 18 bp, Homo sapiens
tgctccaggcccatgggc

SEQ ID NO: 7361306 - DNA, 22 bp, Homo sapiens
tgctccagggcctccagtgggg

SEQ ID NO: 7361307 - DNA, 22 bp, Homo sapiens
tgctccagggcctccagtgggg

SEQ ID NO: 7361308 - DNA, 21 bp, Homo sapiens
tgctccagggcagcttccagc

SEQ ID NO: 7361309 - DNA, 19 bp, Homo sapiens
tgctccaggccttgccgca

SEQ ID NO: 7361310 - DNA, 22 bp, Homo sapiens
tgctccaggccgcctggggctg

SEQ ID NO: 7361311 - DNA, 19 bp, Homo sapiens
tgctccaggccttgccgca

SEQ ID NO: 7361312 - DNA, 22 bp, Homo sapiens
tgctctgggattcagcagcctg

SEQ ID NO: 7361313 - DNA, 22 bp, Homo sapiens
tgctctggggctccccaccaga

SEQ ID NO: 7361314 - DNA, 22 bp, Homo sapiens
tgctctccggcttccgtggcct

SEQ ID NO: 7361315 - DNA, 22 bp, Homo sapiens
tgctctgggaccgtcattaaaa

SEQ ID NO: 7361316 - DNA, 17 bp, Homo sapiens
tgctcctgtggcagcct

SEQ ID NO: 7361317 - DNA, 22 bp, Homo sapiens
tgctcctggcttcaggttgggc

SEQ ID NO: 7361318 - DNA, 22 bp, Homo sapiens
tgctcctggcttcaggttgggc

SEQ ID NO: 7361319 - DNA, 22 bp, Homo sapiens
tgctcctggctccttccctaac

SEQ ID NO: 7361320 - DNA, 22 bp, Homo sapiens
tgctcctggcatctctgcgtcc

SEQ ID NO: 7361321 - DNA, 22 bp, Homo sapiens
tgctcctggactggtgtgagat

SEQ ID NO: 7361322 - DNA, 22 bp, Homo sapiens
tgctcctggactggtgtgagat

SEQ ID NO: 7361323 - DNA, 22 bp, Homo sapiens
tgctcgccccacatgccctcat

SEQ ID NO: 7361324 - DNA, 22 bp, Homo sapiens
tgctctatgggacacttctgct

SEQ ID NO: 7361325 - DNA, 20 bp, Homo sapiens
tgctgaggttgacatgccca

SEQ ID NO: 7361326 - DNA, 22 bp, Homo sapiens
tgctgaggcagtcctaacagga

SEQ ID NO: 7361327 - DNA, 22 bp, Homo sapiens
tgctgaggcatttggacagagt

SEQ ID NO: 7361328 - DNA, 22 bp, Homo sapiens
tgctgaggcatttggacagagt

SEQ ID NO: 7361329 - DNA, 22 bp, Homo sapiens
tgctgaggcagatgtctgtgac

SEQ ID NO: 7361330 - DNA, 22 bp, Homo sapiens
tgctgaggcagatgtctgtgac

SEQ ID NO: 7361331 - DNA, 20 bp, Homo sapiens
tgctgaggcctgaggcctgg

SEQ ID NO: 7361332 - DNA, 20 bp, Homo sapiens
tgctgaggcctgaggcctgg

SEQ ID NO: 7361333 - DNA, 22 bp, Homo sapiens
tgctgaggctagacctggaagt

SEQ ID NO: 7361334 - DNA, 22 bp, Homo sapiens
tgctgatgctgttctgttagga

SEQ ID NO: 7361335 - DNA, 19 bp, Homo sapiens
tgctgcagtcaggcgaggg

SEQ ID NO: 7361336 - DNA, 22 bp, Homo sapiens
tgctgcagggccttccctgcat

SEQ ID NO: 7361337 - DNA, 22 bp, Homo sapiens
tgctgcaggccttggctgggaa

SEQ ID NO: 7361338 - DNA, 22 bp, Homo sapiens
tgctgagcgcatccggcggccg

SEQ ID NO: 7361339 - DNA, 22 bp, Homo sapiens
tgctgaaagaccgtatttatct

SEQ ID NO: 7361340 - DNA, 22 bp, Homo sapiens
tgctgaggactaaaggagatga

SEQ ID NO: 7361341 - DNA, 22 bp, Homo sapiens
tgctgaggaaagaggataaaag

SEQ ID NO: 7361342 - DNA, 22 bp, Homo sapiens
tgctgaggagggcacccggggg

SEQ ID NO: 7361343 - DNA, 22 bp, Homo sapiens
tgctgaggaggtggctgtgctt

SEQ ID NO: 7361344 - DNA, 22 bp, Homo sapiens
tgctgaggaggtggctgtgctt

SEQ ID NO: 7361345 - DNA, 22 bp, Homo sapiens
tgctctgggttcttgctgttac

SEQ ID NO: 7361346 - DNA, 18 bp, Homo sapiens
tgctctggtctcacttgg

SEQ ID NO: 7361347 - DNA, 22 bp, Homo sapiens
tgctctggtaactcacttccat

SEQ ID NO: 7361348 - DNA, 21 bp, Homo sapiens
tgctctggtagaaactctttc

SEQ ID NO: 7361349 - DNA, 22 bp, Homo sapiens
tgctctgtgtgtggttatttcc

SEQ ID NO: 7361350 - DNA, 22 bp, Homo sapiens
tgctctgttcagtgtatcttgt

SEQ ID NO: 7361351 - DNA, 22 bp, Homo sapiens
tgctctgtaaggtcagaaaagg

SEQ ID NO: 7361352 - DNA, 22 bp, Homo sapiens
tgctctgtaggggaaagagagc

SEQ ID NO: 7361353 - DNA, 22 bp, Homo sapiens
tgctctgtaacaaattgacatg

SEQ ID NO: 7361354 - DNA, 22 bp, Homo sapiens
tgctctgtaacaaattgacatg

SEQ ID NO: 7361355 - DNA, 20 bp, Homo sapiens
tgctctgtctaaaacttccc

SEQ ID NO: 7361356 - DNA, 22 bp, Homo sapiens
tggagaaaaggttgaatccatc

SEQ ID NO: 7361357 - DNA, 22 bp, Homo sapiens
tggagaaagctgcatatggaaa

SEQ ID NO: 7361358 - DNA, 22 bp, Homo sapiens
tggagaaagctgcatatggaaa

SEQ ID NO: 7361359 - DNA, 22 bp, Homo sapiens
tggagaaggccggccaggagtg

SEQ ID NO: 7361360 - DNA, 22 bp, Homo sapiens
tggagaagctgtaggtggactc

SEQ ID NO: 7361361 - DNA, 22 bp, Homo sapiens
tggagaagctgtaggtggactc

SEQ ID NO: 7361362 - DNA, 22 bp, Homo sapiens
tggagaaggacagcctgagaaa

SEQ ID NO: 7361363 - DNA, 22 bp, Homo sapiens
tggagaagctgtaggtggactc

SEQ ID NO: 7361364 - DNA, 22 bp, Homo sapiens
tggagaagctgtaggtggactc

SEQ ID NO: 7361365 - DNA, 22 bp, Homo sapiens
tggagagaagaggcagtgtgct

SEQ ID NO: 7361366 - DNA, 22 bp, Homo sapiens
tggagagaagaggcagtgtgct

SEQ ID NO: 7361367 - DNA, 22 bp, Homo sapiens
tggagaagtcaaagtgaacagg

SEQ ID NO: 7361368 - DNA, 22 bp, Homo sapiens
tggagaaggggcagggtctcca

SEQ ID NO: 7361369 - DNA, 22 bp, Homo sapiens
tggagagaaaaaagacagttct

SEQ ID NO: 7361370 - DNA, 22 bp, Homo sapiens
tggagagcaagtcgcagacatg

SEQ ID NO: 7361371 - DNA, 19 bp, Homo sapiens
tggagaggaaatgctgctc

SEQ ID NO: 7361372 - DNA, 22 bp, Homo sapiens
tggagaggaaagtgcagttttg

SEQ ID NO: 7361373 - DNA, 22 bp, Homo sapiens
tggagaggaaagtgcagttttg

SEQ ID NO: 7361374 - DNA, 22 bp, Homo sapiens
tggagaggaaagtgcagttttg

SEQ ID NO: 7361375 - DNA, 22 bp, Homo sapiens
tggagagcgcgacgggaggaag

SEQ ID NO: 7361376 - DNA, 22 bp, Homo sapiens
tggagcagcacaagaaagggga

SEQ ID NO: 7361377 - DNA, 22 bp, Homo sapiens
tggagcagccatgatgacagag

SEQ ID NO: 7361378 - DNA, 22 bp, Homo sapiens
tggagcagaggctgaggttggg

SEQ ID NO: 7361379 - DNA, 22 bp, Homo sapiens
tggagcagaggaagaaggcttt

SEQ ID NO: 7361380 - DNA, 22 bp, Homo sapiens
tggagcagaaatttgaagccat

SEQ ID NO: 7361381 - DNA, 22 bp, Homo sapiens
tggagaggttgaataacttgtc

SEQ ID NO: 7361382 - DNA, 22 bp, Homo sapiens
tggagaggagcaccatggccat

SEQ ID NO: 7361383 - DNA, 19 bp, Homo sapiens
tggagaggaaatgctgctc

SEQ ID NO: 7361384 - DNA, 22 bp, Homo sapiens
tggagaggagcaccatggccat

SEQ ID NO: 7361385 - DNA, 22 bp, Homo sapiens
tggagcagctctagcgggcgcc

SEQ ID NO: 7361386 - DNA, 22 bp, Homo sapiens
tggagcagctaagcctctgaga

SEQ ID NO: 7361387 - DNA, 22 bp, Homo sapiens
tggagcaggtgccaggtgtgtg

SEQ ID NO: 7361388 - DNA, 22 bp, Homo sapiens
tggagcaggtgctcagggtaat

SEQ ID NO: 7361389 - DNA, 22 bp, Homo sapiens
tggagcaggtgccaggtgtgtg

SEQ ID NO: 7361390 - DNA, 22 bp, Homo sapiens
tggagcaggacggggagtggta

SEQ ID NO: 7361391 - DNA, 22 bp, Homo sapiens
tggagccaaaaagggaaggaga

SEQ ID NO: 7361392 - DNA, 22 bp, Homo sapiens
tggagcaggtgctcagggtaat

SEQ ID NO: 7361393 - DNA, 22 bp, Homo sapiens
tggagcaggtgctcagggtaat

SEQ ID NO: 7361394 - DNA, 22 bp, Homo sapiens
tggagccagcaggactcagagg

SEQ ID NO: 7361395 - DNA, 22 bp, Homo sapiens
tggagccaggagcctgggagtc

SEQ ID NO: 7361396 - DNA, 22 bp, Homo sapiens
tggagccaggagcctgggagtc

SEQ ID NO: 7361397 - DNA, 22 bp, Homo sapiens
tggagccagcggcctgctgagg

SEQ ID NO: 7361398 - DNA, 22 bp, Homo sapiens
tggagccagcccaggcccctct

SEQ ID NO: 7361399 - DNA, 22 bp, Homo sapiens
tggagcgagctcaaaggcagga

SEQ ID NO: 7361400 - DNA, 18 bp, Homo sapiens
tggagccattgccaccat

SEQ ID NO: 7361401 - DNA, 22 bp, Homo sapiens
tggagccaggctggccctgcca

SEQ ID NO: 7361402 - DNA, 22 bp, Homo sapiens
tggagcccagacactggcattg

SEQ ID NO: 7361403 - DNA, 22 bp, Homo sapiens
tggagcccctcacccacacctg

SEQ ID NO: 7361404 - DNA, 22 bp, Homo sapiens
tggagcccatgagccataccag

SEQ ID NO: 7361405 - DNA, 22 bp, Homo sapiens
tggagggcatgctgtccatggg

SEQ ID NO: 7361406 - DNA, 22 bp, Homo sapiens
tggagggcatgctgtccatggg

SEQ ID NO: 7361407 - DNA, 22 bp, Homo sapiens
tggagggcgcttagatggaggg

SEQ ID NO: 7361408 - DNA, 22 bp, Homo sapiens
tggagggcatctgtggtcaggc

SEQ ID NO: 7361409 - DNA, 22 bp, Homo sapiens
tggagggcatgctgtccatggg

SEQ ID NO: 7361410 - DNA, 22 bp, Homo sapiens
tggagggcatagctgttctttc

SEQ ID NO: 7361411 - DNA, 22 bp, Homo sapiens
tggagggcatagctgttctttc

SEQ ID NO: 7361412 - DNA, 23 bp, Homo sapiens
tggagggcagaataacagactac

SEQ ID NO: 7361413 - DNA, 20 bp, Homo sapiens
tggagggattgttggcaaat

SEQ ID NO: 7361414 - DNA, 22 bp, Homo sapiens
tggagggatacaaagatgaaaa

SEQ ID NO: 7361415 - DNA, 22 bp, Homo sapiens
tggagggaacaaaggagtccca

SEQ ID NO: 7361416 - DNA, 22 bp, Homo sapiens
tggagggaacaaaggagtccca

SEQ ID NO: 7361417 - DNA, 22 bp, Homo sapiens
tggagggaacccaggctgctct

SEQ ID NO: 7361418 - DNA, 22 bp, Homo sapiens
tggaggctggtttctgctgagg

SEQ ID NO: 7361419 - DNA, 18 bp, Homo sapiens
tggagggcttgctgcagc

SEQ ID NO: 7361420 - DNA, 22 bp, Homo sapiens
tggagggctctttcacctggta

SEQ ID NO: 7361421 - DNA, 18 bp, Homo sapiens
tggagggcttgctgcagc

SEQ ID NO: 7361422 - DNA, 22 bp, Homo sapiens
tggagggctaagctgagggata

SEQ ID NO: 7361423 - DNA, 22 bp, Homo sapiens
tggagggcgcttagatggaggg

SEQ ID NO: 7361424 - DNA, 22 bp, Homo sapiens
tggagggctaagctgagggata

SEQ ID NO: 7361425 - DNA, 22 bp, Homo sapiens
tggagggctctttcacctggta

SEQ ID NO: 7361426 - DNA, 22 bp, Homo sapiens
tggaggtggcacaagggaggtc

SEQ ID NO: 7361427 - DNA, 22 bp, Homo sapiens
tggaggttgggatgcttgtgat

SEQ ID NO: 7361428 - DNA, 22 bp, Homo sapiens
tggagtgaagtaaagaggacaa

SEQ ID NO: 7361429 - DNA, 22 bp, Homo sapiens
tggatggattgacgaaggcagc

SEQ ID NO: 7361430 - DNA, 22 bp, Homo sapiens
tggatgctgtaggacacgctct

SEQ ID NO: 7361431 - DNA, 22 bp, Homo sapiens
tggatgctgagaacactgcctg

SEQ ID NO: 7361432 - DNA, 20 bp, Homo sapiens
tggatgctgcacgtagatgg

SEQ ID NO: 7361433 - DNA, 22 bp, Homo sapiens
tggagttctttttcaagataga

SEQ ID NO: 7361434 - DNA, 22 bp, Homo sapiens
tggagttcttgttctatgcaag

SEQ ID NO: 7361435 - DNA, 22 bp, Homo sapiens
tggagtggacttcatgaggcca

SEQ ID NO: 7361436 - DNA, 22 bp, Homo sapiens
tggaggagtgtgattgtctgcc

SEQ ID NO: 7361437 - DNA, 22 bp, Homo sapiens
tggaggagtgtgattgtctgcc

SEQ ID NO: 7361438 - DNA, 22 bp, Homo sapiens
tggaggagggctggtgtctgta

SEQ ID NO: 7361439 - DNA, 22 bp, Homo sapiens
tggaggagtagattttcagagg

SEQ ID NO: 7361440 - DNA, 22 bp, Homo sapiens
tggaggagaccattccactcag

SEQ ID NO: 7361441 - DNA, 22 bp, Homo sapiens
tggaggagaatttatggtcgaa

SEQ ID NO: 7361442 - DNA, 22 bp, Homo sapiens
tggaggagaatttatggtcgaa

SEQ ID NO: 7361443 - DNA, 22 bp, Homo sapiens
tggaggagaactccctggctac

SEQ ID NO: 7361444 - DNA, 22 bp, Homo sapiens
tggaggaggaacttcttatctc

SEQ ID NO: 7361445 - DNA, 22 bp, Homo sapiens
tggaggaggaacttcttatctc

SEQ ID NO: 7361446 - DNA, 22 bp, Homo sapiens
tggaggagggctggtgtctgta

SEQ ID NO: 7361447 - DNA, 22 bp, Homo sapiens
tggaggaaaaaaccaggcagag

SEQ ID NO: 7361448 - DNA, 22 bp, Homo sapiens
tggaggcaggttagccagacga

SEQ ID NO: 7361449 - DNA, 22 bp, Homo sapiens
tggaggcccacactgggtagat

SEQ ID NO: 7361450 - DNA, 22 bp, Homo sapiens
tggaggccatgccagagcccta

SEQ ID NO: 7361451 - DNA, 22 bp, Homo sapiens
tggaggccgcgtagtctgagca

SEQ ID NO: 7361452 - DNA, 22 bp, Homo sapiens
tggaggccggactgagaggcat

SEQ ID NO: 7361453 - DNA, 22 bp, Homo sapiens
tggaggcaggtggaggagtgaa

SEQ ID NO: 7361454 - DNA, 22 bp, Homo sapiens
tggaggcaggtggaggagtgaa

SEQ ID NO: 7361455 - DNA, 20 bp, Homo sapiens
tggaggcagagccagaggga

SEQ ID NO: 7361456 - DNA, 22 bp, Homo sapiens
tggaggcaactgaagatgtagt

SEQ ID NO: 7361457 - DNA, 22 bp, Homo sapiens
tggaaattactaacacttagag

SEQ ID NO: 7361458 - DNA, 22 bp, Homo sapiens
tggaagaaaattcaatcgagtt

SEQ ID NO: 7361459 - DNA, 22 bp, Homo sapiens
tggaaaggacagttgctgatag

SEQ ID NO: 7361460 - DNA, 22 bp, Homo sapiens
tggaaatacaagaagtatgtca

SEQ ID NO: 7361461 - DNA, 22 bp, Homo sapiens
tggaaagtttctgatttcctaa

SEQ ID NO: 7361462 - DNA, 22 bp, Homo sapiens
tggaaagtgagacatatttata

SEQ ID NO: 7361463 - DNA, 22 bp, Homo sapiens
tggaaatatgctccattctttt

SEQ ID NO: 7361464 - DNA, 22 bp, Homo sapiens
tggaaatagctccagtttcatt

SEQ ID NO: 7361465 - DNA, 22 bp, Homo sapiens
tggaaatagatagtatcattca

SEQ ID NO: 7361466 - DNA, 22 bp, Homo sapiens
tggaaatagatagtatcattca

SEQ ID NO: 7361467 - DNA, 22 bp, Homo sapiens
tggaaatatttgctcattatct

SEQ ID NO: 7361468 - DNA, 22 bp, Homo sapiens
tggaaatatttgctcattatct

SEQ ID NO: 7361469 - DNA, 19 bp, Homo sapiens
tggaaatggaagctcagcc

SEQ ID NO: 7361470 - DNA, 22 bp, Homo sapiens
tggaaatggatctgatgagtct

SEQ ID NO: 7361471 - DNA, 22 bp, Homo sapiens
tggaaaaactgagacttagaca

SEQ ID NO: 7361472 - DNA, 22 bp, Homo sapiens
tggaaaacaaagctctcattat

SEQ ID NO: 7361473 - DNA, 22 bp, Homo sapiens
tgctttttagtactgtcttatt

SEQ ID NO: 7361474 - DNA, 22 bp, Homo sapiens
tgctttgtgatatgctgtgtct

SEQ ID NO: 7361475 - DNA, 22 bp, Homo sapiens
tgcttttaggagattaaaatta

SEQ ID NO: 7361476 - DNA, 22 bp, Homo sapiens
tggaaaacataaagcttttcct

SEQ ID NO: 7361477 - DNA, 22 bp, Homo sapiens
tggaaaatcaggggacattgat

SEQ ID NO: 7361478 - DNA, 17 bp, Homo sapiens
tggaaacaaaacttatt

SEQ ID NO: 7361479 - DNA, 22 bp, Homo sapiens
tggaaaatgtgactattctaaa

SEQ ID NO: 7361480 - DNA, 22 bp, Homo sapiens
tggaaagaggtagaggatctgg

SEQ ID NO: 7361481 - DNA, 22 bp, Homo sapiens
tggaaagatgaagatgtttaag

SEQ ID NO: 7361482 - DNA, 22 bp, Homo sapiens
tggaaacactcaagcttatatt

SEQ ID NO: 7361483 - DNA, 21 bp, Homo sapiens
tgctttatgggaaaaatgtca

SEQ ID NO: 7361484 - DNA, 22 bp, Homo sapiens
tgcttctgtttcattgatctta

SEQ ID NO: 7361485 - DNA, 22 bp, Homo sapiens
tgcttctgttctttcacctacg

SEQ ID NO: 7361486 - DNA, 22 bp, Homo sapiens
tgcttctgctgatattttgtga

SEQ ID NO: 7361487 - DNA, 22 bp, Homo sapiens
tgcttgtgacagaactgtgtcc

SEQ ID NO: 7361488 - DNA, 22 bp, Homo sapiens
tgctttaacataagatatcttt

SEQ ID NO: 7361489 - DNA, 22 bp, Homo sapiens
tgctttaaaatggactgttttg

SEQ ID NO: 7361490 - DNA, 22 bp, Homo sapiens
tggactcagagttggtggcagt

SEQ ID NO: 7361491 - DNA, 22 bp, Homo sapiens
tggactccagtgtctgtgttct

SEQ ID NO: 7361492 - DNA, 22 bp, Homo sapiens
tggactcccagagctgctctcc

SEQ ID NO: 7361493 - DNA, 22 bp, Homo sapiens
tggactggaatgctgatcctct

SEQ ID NO: 7361494 - DNA, 22 bp, Homo sapiens
tggaccctttatgcggaacagg

SEQ ID NO: 7361495 - DNA, 22 bp, Homo sapiens
tggaccggcagtggctatacag

SEQ ID NO: 7361496 - DNA, 22 bp, Homo sapiens
tggaccccctcaaggcagagct

SEQ ID NO: 7361497 - DNA, 22 bp, Homo sapiens
tggacccatattgtctgcattc

SEQ ID NO: 7361498 - DNA, 22 bp, Homo sapiens
tggaccccagacaagccagggt

SEQ ID NO: 7361499 - DNA, 22 bp, Homo sapiens
tggacctcactgtctgctggta

SEQ ID NO: 7361500 - DNA, 22 bp, Homo sapiens
tggacattccacccatatcaga

SEQ ID NO: 7361501 - DNA, 21 bp, Homo sapiens
tggaccaggaaggtggtggtg

SEQ ID NO: 7361502 - DNA, 22 bp, Homo sapiens
tggacagcttgcagagccaccc

SEQ ID NO: 7361503 - DNA, 20 bp, Homo sapiens
tggacagaattagacacttt

SEQ ID NO: 7361504 - DNA, 22 bp, Homo sapiens
tggacagagaggaaggccattt

SEQ ID NO: 7361505 - DNA, 22 bp, Homo sapiens
tggacagcaaacatggagagaa

SEQ ID NO: 7361506 - DNA, 22 bp, Homo sapiens
tggacagagaggaaggccattt

SEQ ID NO: 7361507 - DNA, 22 bp, Homo sapiens
tggaattatctgaagtgatttg

SEQ ID NO: 7361508 - DNA, 22 bp, Homo sapiens
tggaatgttgggatttaagtgt

SEQ ID NO: 7361509 - DNA, 21 bp, Homo sapiens
tggaatgaggctgagcagtgc

SEQ ID NO: 7361510 - DNA, 22 bp, Homo sapiens
tggaatctgtgctgttttagtg

SEQ ID NO: 7361511 - DNA, 22 bp, Homo sapiens
tggaaggggagttgttccacgt

SEQ ID NO: 7361512 - DNA, 22 bp, Homo sapiens
tggaaggggagctggaaagggg

SEQ ID NO: 7361513 - DNA, 22 bp, Homo sapiens
tggaaggggagctggaaagggg

SEQ ID NO: 7361514 - DNA, 22 bp, Homo sapiens
tggaagggggaagacagctctg

SEQ ID NO: 7361515 - DNA, 22 bp, Homo sapiens
tggaaggggccaggcgcggagt

SEQ ID NO: 7361516 - DNA, 22 bp, Homo sapiens
tggaagggggaagacagctctg

SEQ ID NO: 7361517 - DNA, 16 bp, Homo sapiens
tggaaggggtctccgg

SEQ ID NO: 7361518 - DNA, 22 bp, Homo sapiens
tggaaggggttacgcagcagga

SEQ ID NO: 7361519 - DNA, 22 bp, Homo sapiens
tggaaggagactgggaagtgtg

SEQ ID NO: 7361520 - DNA, 22 bp, Homo sapiens
tggaaggaagccaaggaaggtt

SEQ ID NO: 7361521 - DNA, 22 bp, Homo sapiens
tggaaggagctaaggacctggg

SEQ ID NO: 7361522 - DNA, 22 bp, Homo sapiens
tggaagggagtgacagtcagag

SEQ ID NO: 7361523 - DNA, 22 bp, Homo sapiens
tggaagggagtgacagtcagag

SEQ ID NO: 7361524 - DNA, 22 bp, Homo sapiens
tggaaggaagccaaggaaggtt

SEQ ID NO: 7361525 - DNA, 22 bp, Homo sapiens
tggaaggaaaggtagcagagaa

SEQ ID NO: 7361526 - DNA, 22 bp, Homo sapiens
tggaaggaaaggtagcagagaa

SEQ ID NO: 7361527 - DNA, 22 bp, Homo sapiens
tggaagcttttgagattgttgc

SEQ ID NO: 7361528 - DNA, 22 bp, Homo sapiens
tggaagcttcctgttcttgagg

SEQ ID NO: 7361529 - DNA, 22 bp, Homo sapiens
tggaagcttctgaccatttttg

SEQ ID NO: 7361530 - DNA, 17 bp, Homo sapiens
tggaagcttcatgttgg

SEQ ID NO: 7361531 - DNA, 22 bp, Homo sapiens
tggaagaggtggaagtggcttc

SEQ ID NO: 7361532 - DNA, 22 bp, Homo sapiens
tggaagagcaggcagacaatgc

SEQ ID NO: 7361533 - DNA, 20 bp, Homo sapiens
tggaagaagaactcaggctt

SEQ ID NO: 7361534 - DNA, 22 bp, Homo sapiens
tgagggtcatttggaagtggaa

SEQ ID NO: 7361535 - DNA, 21 bp, Homo sapiens
tgaggggttataacagggtgg

SEQ ID NO: 7361536 - DNA, 22 bp, Homo sapiens
tgaggggttgtgagaaatgtag

SEQ ID NO: 7361537 - DNA, 22 bp, Homo sapiens
tgaggggggtaatcactgggtt

SEQ ID NO: 7361538 - DNA, 22 bp, Homo sapiens
tgaggggggtaatcactgggtt

SEQ ID NO: 7361539 - DNA, 19 bp, Homo sapiens
tgaggggctcacagtctca

SEQ ID NO: 7361540 - DNA, 19 bp, Homo sapiens
tgaggggctcacagtctca

SEQ ID NO: 7361541 - DNA, 22 bp, Homo sapiens
tgaggggtaagtaaaggaattg

SEQ ID NO: 7361542 - DNA, 22 bp, Homo sapiens
tgagggggttaattaggagagt

SEQ ID NO: 7361543 - DNA, 22 bp, Homo sapiens
tgagggggttaattaggagagt

SEQ ID NO: 7361544 - DNA, 22 bp, Homo sapiens
tgaggggcgctggcaggttcct

SEQ ID NO: 7361545 - DNA, 22 bp, Homo sapiens
tgaggggcgctggcaggttcct

SEQ ID NO: 7361546 - DNA, 22 bp, Homo sapiens
tgaggggcggcctgcagaggcc

SEQ ID NO: 7361547 - DNA, 22 bp, Homo sapiens
tgaggggcggcctgcagaggcc

SEQ ID NO: 7361548 - DNA, 22 bp, Homo sapiens
tgaggggcagagaggtgtccag

SEQ ID NO: 7361549 - DNA, 22 bp, Homo sapiens
tgaggggcagagaggtgtccag

SEQ ID NO: 7361550 - DNA, 22 bp, Homo sapiens
tgaggggcatgtgtttacacat

SEQ ID NO: 7361551 - DNA, 22 bp, Homo sapiens
tgaggggcatgtgtttacacat

SEQ ID NO: 7361552 - DNA, 22 bp, Homo sapiens
tgaggggccagaccccacctag

SEQ ID NO: 7361553 - DNA, 22 bp, Homo sapiens
tgaggggccagaccccacctag

SEQ ID NO: 7361554 - DNA, 22 bp, Homo sapiens
tgaggggccgcccaagcacttc

SEQ ID NO: 7361555 - DNA, 22 bp, Homo sapiens
tgaggggccgcccaagcacttc

SEQ ID NO: 7361556 - DNA, 22 bp, Homo sapiens
tgagggtggcacaggcacaaag

SEQ ID NO: 7361557 - DNA, 22 bp, Homo sapiens
tgagggtgggcctgcaggaaga

SEQ ID NO: 7361558 - DNA, 22 bp, Homo sapiens
tgagggtgtgcggcccagacag

SEQ ID NO: 7361559 - DNA, 22 bp, Homo sapiens
tgaggtaggagggtgatcagca

SEQ ID NO: 7361560 - DNA, 22 bp, Homo sapiens
tgaggtgaggttgaggaaagaa

SEQ ID NO: 7361561 - DNA, 22 bp, Homo sapiens
tgaggtgagcatctttatcttc

SEQ ID NO: 7361562 - DNA, 22 bp, Homo sapiens
tgaggtgagtcatgcattggag

SEQ ID NO: 7361563 - DNA, 22 bp, Homo sapiens
tgaggtggttactgtggtgctc

SEQ ID NO: 7361564 - DNA, 22 bp, Homo sapiens
tgaggtggctggatctcagcct

SEQ ID NO: 7361565 - DNA, 22 bp, Homo sapiens
tgagtcttctgcctaaagaagt

SEQ ID NO: 7361566 - DNA, 22 bp, Homo sapiens
tgagtcttctgcctaaagaagt

SEQ ID NO: 7361567 - DNA, 22 bp, Homo sapiens
tgagtagcggctatgtgtaact

SEQ ID NO: 7361568 - DNA, 22 bp, Homo sapiens
tgagtatatgatttgtgtttgc

SEQ ID NO: 7361569 - DNA, 22 bp, Homo sapiens
tgagtaattcacaaaacagatg

SEQ ID NO: 7361570 - DNA, 22 bp, Homo sapiens
tgagtaaaagtgaatcttatgt

SEQ ID NO: 7361571 - DNA, 22 bp, Homo sapiens
tgagtaaaaattctacatttcc

SEQ ID NO: 7361572 - DNA, 21 bp, Homo sapiens
tgaggctgttgtaccagggag

SEQ ID NO: 7361573 - DNA, 22 bp, Homo sapiens
tgaggctggcaaggctggtatt

SEQ ID NO: 7361574 - DNA, 22 bp, Homo sapiens
tgaggctgttctaccagggcca

SEQ ID NO: 7361575 - DNA, 22 bp, Homo sapiens
tgaggctgttctaccagggcca

SEQ ID NO: 7361576 - DNA, 22 bp, Homo sapiens
tgaggctgccttgggaagaggg

SEQ ID NO: 7361577 - DNA, 22 bp, Homo sapiens
tgaggggaggttggggcacatc

SEQ ID NO: 7361578 - DNA, 19 bp, Homo sapiens
tgaggggaggagaggcctg

SEQ ID NO: 7361579 - DNA, 22 bp, Homo sapiens
tgaggggaggttggggcacatc

SEQ ID NO: 7361580 - DNA, 22 bp, Homo sapiens
tgaggggagacagagtggactc

SEQ ID NO: 7361581 - DNA, 19 bp, Homo sapiens
tgaggggaggagaggcctg

SEQ ID NO: 7361582 - DNA, 22 bp, Homo sapiens
tgagggagttgggtgtatagga

SEQ ID NO: 7361583 - DNA, 22 bp, Homo sapiens
tgagggagtcatgattaaggaa

SEQ ID NO: 7361584 - DNA, 22 bp, Homo sapiens
tgagggagtgtggatacagtag

SEQ ID NO: 7361585 - DNA, 20 bp, Homo sapiens
tgagggagtattgatttccc

SEQ ID NO: 7361586 - DNA, 22 bp, Homo sapiens
tgagggaggcctccatctgcca

SEQ ID NO: 7361587 - DNA, 22 bp, Homo sapiens
tgagggaggccctttgagcaga

SEQ ID NO: 7361588 - DNA, 22 bp, Homo sapiens
tgagggaggcctccatctgcca

SEQ ID NO: 7361589 - DNA, 22 bp, Homo sapiens
tgagggagcacacactgaagtg

SEQ ID NO: 7361590 - DNA, 22 bp, Homo sapiens
tgagggagctgacctttctgtg

SEQ ID NO: 7361591 - DNA, 22 bp, Homo sapiens
tgagggaggccctttgagcaga

SEQ ID NO: 7361592 - DNA, 22 bp, Homo sapiens
tgagggagcacacactgaagtg

SEQ ID NO: 7361593 - DNA, 22 bp, Homo sapiens
tgagggagagggcgaaaatgaa

SEQ ID NO: 7361594 - DNA, 22 bp, Homo sapiens
tgagggaatcctcacatcaatc

SEQ ID NO: 7361595 - DNA, 22 bp, Homo sapiens
tgagggaatattgatagatccg

SEQ ID NO: 7361596 - DNA, 22 bp, Homo sapiens
tgaggaaatatggtgaactctt

SEQ ID NO: 7361597 - DNA, 22 bp, Homo sapiens
tgaggaaattgaggctcacaga

SEQ ID NO: 7361598 - DNA, 22 bp, Homo sapiens
tgaggaagggtgtgacggcacc

SEQ ID NO: 7361599 - DNA, 22 bp, Homo sapiens
tgaggagaaatgctcagagcca

SEQ ID NO: 7361600 - DNA, 22 bp, Homo sapiens
tgaggaggtgggcacacagagt

SEQ ID NO: 7361601 - DNA, 22 bp, Homo sapiens
tgaggaggtgggcacacagagt

SEQ ID NO: 7361602 - DNA, 22 bp, Homo sapiens
tgaggataacccaggcaaactg

SEQ ID NO: 7361603 - DNA, 22 bp, Homo sapiens
tgaggagtcgagaaggggtaat

SEQ ID NO: 7361604 - DNA, 22 bp, Homo sapiens
tgaggagtttagatatagggaa

SEQ ID NO: 7361605 - DNA, 22 bp, Homo sapiens
tgaggatatagtggtaaacagt

SEQ ID NO: 7361606 - DNA, 21 bp, Homo sapiens
tgaggataagtaaagctgaag

SEQ ID NO: 7361607 - DNA, 21 bp, Homo sapiens
tgaggataagtaaagctgaag

SEQ ID NO: 7361608 - DNA, 22 bp, Homo sapiens
tgaggatggcagtgtgctcagc

SEQ ID NO: 7361609 - DNA, 22 bp, Homo sapiens
tgaggaggtgggcacacagagt

SEQ ID NO: 7361610 - DNA, 22 bp, Homo sapiens
tgaggaggtcagagtctggctg

SEQ ID NO: 7361611 - DNA, 22 bp, Homo sapiens
tgaggaggtcagagtctggctg

SEQ ID NO: 7361612 - DNA, 22 bp, Homo sapiens
tgaggaggtcagagtctggctg

SEQ ID NO: 7361613 - DNA, 22 bp, Homo sapiens
tgaggaggcccaggttggggct

SEQ ID NO: 7361614 - DNA, 22 bp, Homo sapiens
tgaggagcttctggaaagtgca

SEQ ID NO: 7361615 - DNA, 22 bp, Homo sapiens
tgaggagcgggcagggatgcag

SEQ ID NO: 7361616 - DNA, 22 bp, Homo sapiens
tgaggaggcccaggttggggct

SEQ ID NO: 7361617 - DNA, 19 bp, Homo sapiens
tgaggagcagctggttgat

SEQ ID NO: 7361618 - DNA, 23 bp, Homo sapiens
tgaggagcatagctgactgacag

SEQ ID NO: 7361619 - DNA, 22 bp, Homo sapiens
tgaggatgtctgtattttgcct

SEQ ID NO: 7361620 - DNA, 22 bp, Homo sapiens
tgaggatggttaaagaacattg

SEQ ID NO: 7361621 - DNA, 22 bp, Homo sapiens
tgaggcaagtactttccctttt

SEQ ID NO: 7361622 - DNA, 22 bp, Homo sapiens
tgaggcaagctgggcccatgga

SEQ ID NO: 7361623 - DNA, 22 bp, Homo sapiens
tgaggcaggaatggggaaaagt

SEQ ID NO: 7361624 - DNA, 22 bp, Homo sapiens
tgaggcaggaagttatataatg

SEQ ID NO: 7361625 - DNA, 22 bp, Homo sapiens
tgaggcaggacatggacaactg

SEQ ID NO: 7361626 - DNA, 22 bp, Homo sapiens
tgaggcagctttttctgtgtgt

SEQ ID NO: 7361627 - DNA, 22 bp, Homo sapiens
tgaggcagaaaatagcagttca

SEQ ID NO: 7361628 - DNA, 22 bp, Homo sapiens
tgaggcaggactgagcgggatg

SEQ ID NO: 7361629 - DNA, 22 bp, Homo sapiens
tgaggcaggacttgcataaagt

SEQ ID NO: 7361630 - DNA, 22 bp, Homo sapiens
tgaggcaggagaatcacatgaa

SEQ ID NO: 7361631 - DNA, 22 bp, Homo sapiens
tgaggcaggagaatcaccggaa

SEQ ID NO: 7361632 - DNA, 20 bp, Homo sapiens
tgaggcaggagaatggcatg

SEQ ID NO: 7361633 - DNA, 22 bp, Homo sapiens
tgaggcaggagaatcaccggaa

SEQ ID NO: 7361634 - DNA, 22 bp, Homo sapiens
tgaggcagggagagtggatatg

SEQ ID NO: 7361635 - DNA, 22 bp, Homo sapiens
tgaggcagggagtttaattgtc

SEQ ID NO: 7361636 - DNA, 23 bp, Homo sapiens
tgaggcaggcggatcacgaggtc

SEQ ID NO: 7361637 - DNA, 21 bp, Homo sapiens
tgaggcaggggtgcttttgtc

SEQ ID NO: 7361638 - DNA, 22 bp, Homo sapiens
tgaggcagttgagcttcctgag

SEQ ID NO: 7361639 - DNA, 22 bp, Homo sapiens
tgaggcagttcttacttgtatt

SEQ ID NO: 7361640 - DNA, 21 bp, Homo sapiens
tgaggcaggggtgcttttgtc

SEQ ID NO: 7361641 - DNA, 19 bp, Homo sapiens
tgaggccaaggtcacagat

SEQ ID NO: 7361642 - DNA, 22 bp, Homo sapiens
tgaggccaagcctcctctgcca

SEQ ID NO: 7361643 - DNA, 22 bp, Homo sapiens
tgaggcagttgagcttcctgag

SEQ ID NO: 7361644 - DNA, 22 bp, Homo sapiens
tgaggcagttgagcttcctgag

SEQ ID NO: 7361645 - DNA, 22 bp, Homo sapiens
tgaggcaggagttcaggctgcg

SEQ ID NO: 7361646 - DNA, 22 bp, Homo sapiens
tgaggcaggagttcaggctgcg

SEQ ID NO: 7361647 - DNA, 23 bp, Homo sapiens
tgaggcaggcggatcacgaggtc

SEQ ID NO: 7361648 - DNA, 23 bp, Homo sapiens
tgaggcaggcggatcacgaggtc

SEQ ID NO: 7361649 - DNA, 22 bp, Homo sapiens
tgaggcaggatgcttgcacagg

SEQ ID NO: 7361650 - DNA, 22 bp, Homo sapiens
tgaggcaggagaatggcgggaa

SEQ ID NO: 7361651 - DNA, 22 bp, Homo sapiens
tgaggcaggagaatggcgggaa

SEQ ID NO: 7361652 - DNA, 22 bp, Homo sapiens
tgaggcaggaggattgcaggat

SEQ ID NO: 7361653 - DNA, 22 bp, Homo sapiens
tgaggcaggagttaatgtgctc

SEQ ID NO: 7361654 - DNA, 22 bp, Homo sapiens
tgaggcaggaggttgagaactg

SEQ ID NO: 7361655 - DNA, 22 bp, Homo sapiens
tgaggccctctgggctggtcct

SEQ ID NO: 7361656 - DNA, 22 bp, Homo sapiens
tgaggccaggacccccagcagg

SEQ ID NO: 7361657 - DNA, 22 bp, Homo sapiens
tgaggccaggatcccaggctct

SEQ ID NO: 7361658 - DNA, 22 bp, Homo sapiens
tgaggccagcttcagcagtgga

SEQ ID NO: 7361659 - DNA, 22 bp, Homo sapiens
tgaggccaggacccccagcagg

SEQ ID NO: 7361660 - DNA, 21 bp, Homo sapiens
tgaggccaatagcccctggac

SEQ ID NO: 7361661 - DNA, 22 bp, Homo sapiens
tgaggccaatgaccctgggcag

SEQ ID NO: 7361662 - DNA, 22 bp, Homo sapiens
tgaggccacagtatcagaacag

SEQ ID NO: 7361663 - DNA, 22 bp, Homo sapiens
tgaggccacttccccacagccc

SEQ ID NO: 7361664 - DNA, 21 bp, Homo sapiens
tgagaatttactctggagagt

SEQ ID NO: 7361665 - DNA, 23 bp, Homo sapiens
tgagaagccgccgggcagcctgg

SEQ ID NO: 7361666 - DNA, 20 bp, Homo sapiens
tgagaagctcctgtctcctc

SEQ ID NO: 7361667 - DNA, 22 bp, Homo sapiens
tgagaagctctgaaacagtatc

SEQ ID NO: 7361668 - DNA, 22 bp, Homo sapiens
tgagaagctgcttgtgctgtat

SEQ ID NO: 7361669 - DNA, 22 bp, Homo sapiens
tgagaagctgctgacttagcct

SEQ ID NO: 7361670 - DNA, 22 bp, Homo sapiens
tgagaagctgctgacttagcct

SEQ ID NO: 7361671 - DNA, 22 bp, Homo sapiens
tgagacagcagtcagggaaata

SEQ ID NO: 7361672 - DNA, 19 bp, Homo sapiens
tgagacagggattcaggtg

SEQ ID NO: 7361673 - DNA, 19 bp, Homo sapiens
tgagacagggattcaggtg

SEQ ID NO: 7361674 - DNA, 17 bp, Homo sapiens
tgagacagggcaggccc

SEQ ID NO: 7361675 - DNA, 22 bp, Homo sapiens
tgagacagtcaccaggcaggcc

SEQ ID NO: 7361676 - DNA, 22 bp, Homo sapiens
tgagaacattgggaaagctatg

SEQ ID NO: 7361677 - DNA, 22 bp, Homo sapiens
tgagaacatacaaacagagaaa

SEQ ID NO: 7361678 - DNA, 22 bp, Homo sapiens
tgagaacatacaaacagagaaa

SEQ ID NO: 7361679 - DNA, 22 bp, Homo sapiens
tgagaacagttggaagcagtca

SEQ ID NO: 7361680 - DNA, 22 bp, Homo sapiens
tgagaacatttgcagggagagt

SEQ ID NO: 7361681 - DNA, 22 bp, Homo sapiens
tgagaacttgtgctattgcaca

SEQ ID NO: 7361682 - DNA, 22 bp, Homo sapiens
tgagaagcccacactctttcct

SEQ ID NO: 7361683 - DNA, 22 bp, Homo sapiens
tgagaagcccaagccgggtggt

SEQ ID NO: 7361684 - DNA, 23 bp, Homo sapiens
tgagaagccattagagcaggtgg

SEQ ID NO: 7361685 - DNA, 22 bp, Homo sapiens
tgagaagcagtttcagtaagaa

SEQ ID NO: 7361686 - DNA, 22 bp, Homo sapiens
tgagaagcattaggaagaacat

SEQ ID NO: 7361687 - DNA, 23 bp, Homo sapiens
tgagaagccaggggagcgtgagg

SEQ ID NO: 7361688 - DNA, 22 bp, Homo sapiens
tgagaagcacagctcactcacg

SEQ ID NO: 7361689 - DNA, 22 bp, Homo sapiens
tgagaagcagcttacaggtgtc

SEQ ID NO: 7361690 - DNA, 22 bp, Homo sapiens
tgagaaagacagacattcctaa

SEQ ID NO: 7361691 - DNA, 22 bp, Homo sapiens
tgagaaagcctttagtcccagg

SEQ ID NO: 7361692 - DNA, 22 bp, Homo sapiens
tgagaaagacagacattcctaa

SEQ ID NO: 7361693 - DNA, 22 bp, Homo sapiens
tgagaaaatccagaggctagtt

SEQ ID NO: 7361694 - DNA, 22 bp, Homo sapiens
tgagaaaattactataattgtc

SEQ ID NO: 7361695 - DNA, 22 bp, Homo sapiens
tgagaaaagtgtggaggtcaat

SEQ ID NO: 7361696 - DNA, 22 bp, Homo sapiens
tgagaaatccagatgtgcagtt

SEQ ID NO: 7361697 - DNA, 19 bp, Homo sapiens
tgagaaattccacaggatg

SEQ ID NO: 7361698 - DNA, 22 bp, Homo sapiens
tgagaaattacttcagtgatgg

SEQ ID NO: 7361699 - DNA, 22 bp, Homo sapiens
tgagaaattcgacatatattta

SEQ ID NO: 7361700 - DNA, 22 bp, Homo sapiens
tgagaaattcgacatatattta

SEQ ID NO: 7361701 - DNA, 23 bp, Homo sapiens
tgagaaattttgattcagtagga

SEQ ID NO: 7361702 - DNA, 22 bp, Homo sapiens
tgagaaatattgcacagtgagg

SEQ ID NO: 7361703 - DNA, 20 bp, Homo sapiens
tgagaaagtagagactcagg

SEQ ID NO: 7361704 - DNA, 22 bp, Homo sapiens
tgagaaaggtatttcatgcact

SEQ ID NO: 7361705 - DNA, 22 bp, Homo sapiens
tgagatgtaaggtatgcttact

SEQ ID NO: 7361706 - DNA, 22 bp, Homo sapiens
tgagatgtaaggtatgcttact

SEQ ID NO: 7361707 - DNA, 22 bp, Homo sapiens
tgagattttcctaaatataatg

SEQ ID NO: 7361708 - DNA, 22 bp, Homo sapiens
tgagattttcctaaatataatg

SEQ ID NO: 7361709 - DNA, 20 bp, Homo sapiens
tgagatttgtattataagtc

SEQ ID NO: 7361710 - DNA, 22 bp, Homo sapiens
tgagatttgttttataaaatag

SEQ ID NO: 7361711 - DNA, 22 bp, Homo sapiens
tgagattttaatattgagaaaa

SEQ ID NO: 7361712 - DNA, 22 bp, Homo sapiens
tgagatttcgccgacagtattt

SEQ ID NO: 7361713 - DNA, 22 bp, Homo sapiens
tgagatttcgccgacagtattt

SEQ ID NO: 7361714 - DNA, 22 bp, Homo sapiens
tgagattcagttgattagtgat

SEQ ID NO: 7361715 - DNA, 22 bp, Homo sapiens
tgagatgaagtgatgtaaaaca

SEQ ID NO: 7361716 - DNA, 22 bp, Homo sapiens
tgagatgaaagcagaaagactt

SEQ ID NO: 7361717 - DNA, 22 bp, Homo sapiens
tgagagaggatgccctcatatt

SEQ ID NO: 7361718 - DNA, 22 bp, Homo sapiens
tgagagagcgcctgggatcatt

SEQ ID NO: 7361719 - DNA, 21 bp, Homo sapiens
tgagagagtagcaggacatat

SEQ ID NO: 7361720 - DNA, 22 bp, Homo sapiens
tgagagcagaggtgggcagcct

SEQ ID NO: 7361721 - DNA, 22 bp, Homo sapiens
tgagagcctgtgttcaaatgcc

SEQ ID NO: 7361722 - DNA, 22 bp, Homo sapiens
tgagaggaacaggcagtaggtt

SEQ ID NO: 7361723 - DNA, 22 bp, Homo sapiens
tgagaggaacaggcagtaggtt

SEQ ID NO: 7361724 - DNA, 22 bp, Homo sapiens
tgagaggatattttgggaggat

SEQ ID NO: 7361725 - DNA, 22 bp, Homo sapiens
tgagaggcagaatggtgcctgc

SEQ ID NO: 7361726 - DNA, 22 bp, Homo sapiens
tgagagcttgagtatcactggc

SEQ ID NO: 7361727 - DNA, 22 bp, Homo sapiens
tgagagctgacagtaagctgca

SEQ ID NO: 7361728 - DNA, 22 bp, Homo sapiens
tgagcaggcgcagcaggaggtc

SEQ ID NO: 7361729 - DNA, 22 bp, Homo sapiens
tgagcaggcgcagcaggaggtc

SEQ ID NO: 7361730 - DNA, 22 bp, Homo sapiens
tgagcaggattcgcctcttgca

SEQ ID NO: 7361731 - DNA, 22 bp, Homo sapiens
tgagcaggactgaccggcctta

SEQ ID NO: 7361732 - DNA, 22 bp, Homo sapiens
tgagcacagctttcactagaaa

SEQ ID NO: 7361733 - DNA, 22 bp, Homo sapiens
tgagcagggactttggagtctg

SEQ ID NO: 7361734 - DNA, 22 bp, Homo sapiens
tgagcagggagctgggctgagc

SEQ ID NO: 7361735 - DNA, 22 bp, Homo sapiens
tgagcagggagctgggctgagc

SEQ ID NO: 7361736 - DNA, 22 bp, Homo sapiens
tgagccacagtgagagctcctg

SEQ ID NO: 7361737 - DNA, 22 bp, Homo sapiens
tgagccaggagtttgaggctgt

SEQ ID NO: 7361738 - DNA, 19 bp, Homo sapiens
tgagccagggaggccatgc

SEQ ID NO: 7361739 - DNA, 21 bp, Homo sapiens
tgagccaggctgacggctgtg

SEQ ID NO: 7361740 - DNA, 22 bp, Homo sapiens
tgagctgtggtggggtagagga

SEQ ID NO: 7361741 - DNA, 22 bp, Homo sapiens
tgagctgtgtcttggtgagagt

SEQ ID NO: 7361742 - DNA, 22 bp, Homo sapiens
tgaggaaaacgtattgaaagga

SEQ ID NO: 7361743 - DNA, 22 bp, Homo sapiens
tgaggaaaatgtcttatagatt

SEQ ID NO: 7361744 - DNA, 22 bp, Homo sapiens
tgaggaaactgaggcacagatg

SEQ ID NO: 7361745 - DNA, 22 bp, Homo sapiens
tgagcttgcagtgccagccttg

SEQ ID NO: 7361746 - DNA, 22 bp, Homo sapiens
tgagcttgctacatagatcaga

SEQ ID NO: 7361747 - DNA, 22 bp, Homo sapiens
tgagctggaggacaggagggta

SEQ ID NO: 7361748 - DNA, 22 bp, Homo sapiens
tgagctctgttagggctggaac

SEQ ID NO: 7361749 - DNA, 22 bp, Homo sapiens
tgagctgacacccaatcatact

SEQ ID NO: 7361750 - DNA, 22 bp, Homo sapiens
tgagctgataggctgtgagcct

SEQ ID NO: 7361751 - DNA, 22 bp, Homo sapiens
tgagcccgtaggggccaaggct

SEQ ID NO: 7361752 - DNA, 22 bp, Homo sapiens
tgagccccggagtttcaggctg

SEQ ID NO: 7361753 - DNA, 22 bp, Homo sapiens
tgagcctctaccacaggtggaa

SEQ ID NO: 7361754 - DNA, 22 bp, Homo sapiens
tgagccaggttaagacaggagc

SEQ ID NO: 7361755 - DNA, 22 bp, Homo sapiens
tgaagcccttcatgcacagtca

SEQ ID NO: 7361756 - DNA, 22 bp, Homo sapiens
tgaagctagtattaactcagat

SEQ ID NO: 7361757 - DNA, 22 bp, Homo sapiens
tgaaggagatttttagggaggc

SEQ ID NO: 7361758 - DNA, 22 bp, Homo sapiens
tgaaggagctgatgtaaggggt

SEQ ID NO: 7361759 - DNA, 22 bp, Homo sapiens
tgaagctgtgggcagtggagcc

SEQ ID NO: 7361760 - DNA, 22 bp, Homo sapiens
tgaagctgtccttgataggggc

SEQ ID NO: 7361761 - DNA, 22 bp, Homo sapiens
tgaagctgtaggcatgggcagc

SEQ ID NO: 7361762 - DNA, 22 bp, Homo sapiens
tgaaggcacttgcctaggggca

SEQ ID NO: 7361763 - DNA, 22 bp, Homo sapiens
tgaaggcacgtgggtggatact

SEQ ID NO: 7361764 - DNA, 22 bp, Homo sapiens
tgaaggcacagtttaaccagta

SEQ ID NO: 7361765 - DNA, 22 bp, Homo sapiens
tgaaggcaaaacatgttacacc

SEQ ID NO: 7361766 - DNA, 22 bp, Homo sapiens
tgaaggcaactgagaaaaagca

SEQ ID NO: 7361767 - DNA, 22 bp, Homo sapiens
tgaaggcaacctctgtggtcct

SEQ ID NO: 7361768 - DNA, 22 bp, Homo sapiens
tgaaggagctgatgtaaggggt

SEQ ID NO: 7361769 - DNA, 22 bp, Homo sapiens
tgaaggcttttagctctgaaaa

SEQ ID NO: 7361770 - DNA, 22 bp, Homo sapiens
tgaaggctgtcacctgcacctt

SEQ ID NO: 7361771 - DNA, 22 bp, Homo sapiens
tgaagggcaaccccaggcccag

SEQ ID NO: 7361772 - DNA, 21 bp, Homo sapiens
tgaagggcagcctcaggctcc

SEQ ID NO: 7361773 - DNA, 21 bp, Homo sapiens
tgaaggggccatcacaaaggc

SEQ ID NO: 7361774 - DNA, 22 bp, Homo sapiens
tgaagggggagatatatgtgtg

SEQ ID NO: 7361775 - DNA, 21 bp, Homo sapiens
tgaaggggtggcagtgtgctt

SEQ ID NO: 7361776 - DNA, 22 bp, Homo sapiens
tgaaggggttcagcatgggggt

SEQ ID NO: 7361777 - DNA, 20 bp, Homo sapiens
tgaaggcaggtaagaaagat

SEQ ID NO: 7361778 - DNA, 22 bp, Homo sapiens
tgaaggcagcatgcacactagt

SEQ ID NO: 7361779 - DNA, 22 bp, Homo sapiens
tgaaggcagtgattttgtttgg

SEQ ID NO: 7361780 - DNA, 22 bp, Homo sapiens
tgaaggcagtgagtttgtgttt

SEQ ID NO: 7361781 - DNA, 22 bp, Homo sapiens
tgaaggcatttgagttggtgag

SEQ ID NO: 7361782 - DNA, 22 bp, Homo sapiens
tgaaggcattgatgaaggaatc

SEQ ID NO: 7361783 - DNA, 22 bp, Homo sapiens
tgaaggcattgatgaaggaatc

SEQ ID NO: 7361784 - DNA, 22 bp, Homo sapiens
tgaaggcataaatcttgggaac

SEQ ID NO: 7361785 - DNA, 22 bp, Homo sapiens
tgaaggtgggaattcaccaggt

SEQ ID NO: 7361786 - DNA, 22 bp, Homo sapiens
tgaaggtgacctgacagtggct

SEQ ID NO: 7361787 - DNA, 21 bp, Homo sapiens
tgaataaagctgctgtcgata

SEQ ID NO: 7361788 - DNA, 22 bp, Homo sapiens
tgaatttaagcactgatgttaa

SEQ ID NO: 7361789 - DNA, 22 bp, Homo sapiens
tgaattgggcctggaaactggt

SEQ ID NO: 7361790 - DNA, 22 bp, Homo sapiens
tgaattcttttagaattcagtg

SEQ ID NO: 7361791 - DNA, 22 bp, Homo sapiens
tgaattcttatgaaagtgcttg

SEQ ID NO: 7361792 - DNA, 22 bp, Homo sapiens
tgaattcttcccctgcaccaac

SEQ ID NO: 7361793 - DNA, 22 bp, Homo sapiens
tgaattctttccatgttcccat

SEQ ID NO: 7361794 - DNA, 20 bp, Homo sapiens
tgaattctagatgactggag

SEQ ID NO: 7361795 - DNA, 22 bp, Homo sapiens
tgaattctaatgggtgagatcc

SEQ ID NO: 7361796 - DNA, 21 bp, Homo sapiens
tgaattctggggtagttggga

SEQ ID NO: 7361797 - DNA, 22 bp, Homo sapiens
tgaattctgggtcagcagcttg

SEQ ID NO: 7361798 - DNA, 20 bp, Homo sapiens
tgaattctgggtttatctgc

SEQ ID NO: 7361799 - DNA, 22 bp, Homo sapiens
tgaattcttaatgaaatctact

SEQ ID NO: 7361800 - DNA, 22 bp, Homo sapiens
tgaattcttatctgggctgtgc

SEQ ID NO: 7361801 - DNA, 19 bp, Homo sapiens
tgaattctgttagaggcag

SEQ ID NO: 7361802 - DNA, 22 bp, Homo sapiens
tgaattctgtttgggccgctta

SEQ ID NO: 7361803 - DNA, 22 bp, Homo sapiens
tgaattctggctcttctgttta

SEQ ID NO: 7361804 - DNA, 22 bp, Homo sapiens
tgaattctggccaatggaatgt

SEQ ID NO: 7361805 - DNA, 22 bp, Homo sapiens
tgaattctggccctctcactta

SEQ ID NO: 7361806 - DNA, 22 bp, Homo sapiens
tgaattctcacaagcctggaag

SEQ ID NO: 7361807 - DNA, 22 bp, Homo sapiens
tgaattctcagaaggcaagggc

SEQ ID NO: 7361808 - DNA, 22 bp, Homo sapiens
tgaattctcatctcctgacact

SEQ ID NO: 7361809 - DNA, 22 bp, Homo sapiens
tgaattctctgcctgcgtattt

SEQ ID NO: 7361810 - DNA, 22 bp, Homo sapiens
tgaattctctttcctggagcat

SEQ ID NO: 7361811 - DNA, 22 bp, Homo sapiens
tgaattctgctgtagcaagtcc

SEQ ID NO: 7361812 - DNA, 22 bp, Homo sapiens
tgaatcctagttgaagataagg

SEQ ID NO: 7361813 - DNA, 22 bp, Homo sapiens
tgaatcctagttgaagataagg

SEQ ID NO: 7361814 - DNA, 22 bp, Homo sapiens
tgaatggtcactgagcatctgt

SEQ ID NO: 7361815 - DNA, 22 bp, Homo sapiens
tgaatctttttggaaataaaga

SEQ ID NO: 7361816 - DNA, 22 bp, Homo sapiens
tgacatttgagagagatataca

SEQ ID NO: 7361817 - DNA, 22 bp, Homo sapiens
tgaccctggcagcccactggcc

SEQ ID NO: 7361818 - DNA, 21 bp, Homo sapiens
tgacatttccaatataaagcc

SEQ ID NO: 7361819 - DNA, 21 bp, Homo sapiens
tgacatttccaatataaagcc

SEQ ID NO: 7361820 - DNA, 22 bp, Homo sapiens
tgactgagagagaactcagctt

SEQ ID NO: 7361821 - DNA, 22 bp, Homo sapiens
tgactggagacctcagtagggt

SEQ ID NO: 7361822 - DNA, 22 bp, Homo sapiens
tgactgtgcctgttgaatgaat

SEQ ID NO: 7361823 - DNA, 22 bp, Homo sapiens
tgactgtgcaagcagagagcat

SEQ ID NO: 7361824 - DNA, 22 bp, Homo sapiens
tgacttcctgcactcaggtgat

SEQ ID NO: 7361825 - DNA, 22 bp, Homo sapiens
tgacttgtattttaaataattg

SEQ ID NO: 7361826 - DNA, 22 bp, Homo sapiens
tgacgttttaggtgttaaatcg

SEQ ID NO: 7361827 - DNA, 22 bp, Homo sapiens
tgactatgtggccttgaccaag

SEQ ID NO: 7361828 - DNA, 22 bp, Homo sapiens
tgactcaggaggaaagactcca

SEQ ID NO: 7361829 - DNA, 19 bp, Homo sapiens
tgactctgtggaacagaag

SEQ ID NO: 7361830 - DNA, 22 bp, Homo sapiens
tgactctggcttcaagtttctt

SEQ ID NO: 7361831 - DNA, 22 bp, Homo sapiens
tgactctgaattgggaaatggg

SEQ ID NO: 7361832 - DNA, 22 bp, Homo sapiens
tgactctgaatttatgaaatgg

SEQ ID NO: 7361833 - DNA, 22 bp, Homo sapiens
tgactctgataagacatatggc

SEQ ID NO: 7361834 - DNA, 22 bp, Homo sapiens
tgacacttccagttaaaaatat

SEQ ID NO: 7361835 - DNA, 22 bp, Homo sapiens
tgacactgccgaaactgtagag

SEQ ID NO: 7361836 - DNA, 22 bp, Homo sapiens
tgacagaaagaatatgtcaatc

SEQ ID NO: 7361837 - DNA, 22 bp, Homo sapiens
tgacagattttttctgagctaa

SEQ ID NO: 7361838 - DNA, 18 bp, Homo sapiens
tgacagaacctggagcct

SEQ ID NO: 7361839 - DNA, 22 bp, Homo sapiens
tgacacagttgtcgactctaca

SEQ ID NO: 7361840 - DNA, 22 bp, Homo sapiens
tgacacagtgggggatcctttt

SEQ ID NO: 7361841 - DNA, 22 bp, Homo sapiens
tgacacagtatcaaacatgatt

SEQ ID NO: 7361842 - DNA, 22 bp, Homo sapiens
tgacacagtatcaaacatgatt

SEQ ID NO: 7361843 - DNA, 22 bp, Homo sapiens
tgacacagtatcaaacatgatt

SEQ ID NO: 7361844 - DNA, 22 bp, Homo sapiens
tgacaccttgctcttggacttc

SEQ ID NO: 7361845 - DNA, 22 bp, Homo sapiens
tgacaccttgatcttggacttt

SEQ ID NO: 7361846 - DNA, 22 bp, Homo sapiens
tgacaccttgatcttggacttc

SEQ ID NO: 7361847 - DNA, 22 bp, Homo sapiens
tgacaccttgatcttggactta

SEQ ID NO: 7361848 - DNA, 22 bp, Homo sapiens
tgacaccttcatcttggacttc

SEQ ID NO: 7361849 - DNA, 22 bp, Homo sapiens
tgacacctcgatcttggacttc

SEQ ID NO: 7361850 - DNA, 22 bp, Homo sapiens
tgacacattaaatgctcacaaa

SEQ ID NO: 7361851 - DNA, 22 bp, Homo sapiens
tgacaccacaactagccattga

SEQ ID NO: 7361852 - DNA, 22 bp, Homo sapiens
tgacacagggcatgcagcagaa

SEQ ID NO: 7361853 - DNA, 23 bp, Homo sapiens
tgacacaggtcaaaaataagatg

SEQ ID NO: 7361854 - DNA, 22 bp, Homo sapiens
tgacacaggtcaaatctacttt

SEQ ID NO: 7361855 - DNA, 22 bp, Homo sapiens
tgacacagattagagacatacc

SEQ ID NO: 7361856 - DNA, 22 bp, Homo sapiens
tgacacagattagagacatacc

SEQ ID NO: 7361857 - DNA, 22 bp, Homo sapiens
tgacacagattagagacatacc

SEQ ID NO: 7361858 - DNA, 22 bp, Homo sapiens
tgacacacagggggatggagtt

SEQ ID NO: 7361859 - DNA, 22 bp, Homo sapiens
tgacaggatgatgagcaggggg

SEQ ID NO: 7361860 - DNA, 22 bp, Homo sapiens
tgacaggatagtaggaagatct

SEQ ID NO: 7361861 - DNA, 22 bp, Homo sapiens
tgacaggattggttgcttctga

SEQ ID NO: 7361862 - DNA, 22 bp, Homo sapiens
tgacagggaaaggtcctctttt

SEQ ID NO: 7361863 - DNA, 22 bp, Homo sapiens
tgacaggaaacatgcagtgatt

SEQ ID NO: 7361864 - DNA, 22 bp, Homo sapiens
tgacaggacagagaaatgacct

SEQ ID NO: 7361865 - DNA, 22 bp, Homo sapiens
tgacagcagcatagtgagcaat

SEQ ID NO: 7361866 - DNA, 21 bp, Homo sapiens
tgacagcatagagcagggagg

SEQ ID NO: 7361867 - DNA, 22 bp, Homo sapiens
tgacagcatgaccacagggtct

SEQ ID NO: 7361868 - DNA, 22 bp, Homo sapiens
tgacagtaattcactgggaccc

SEQ ID NO: 7361869 - DNA, 22 bp, Homo sapiens
tgacaggtgattgtgaactaag

SEQ ID NO: 7361870 - DNA, 22 bp, Homo sapiens
tgacagtagtgttagaactgat

SEQ ID NO: 7361871 - DNA, 22 bp, Homo sapiens
tgacagggtgtttgtgagacta

SEQ ID NO: 7361872 - DNA, 22 bp, Homo sapiens
tgacagggtgattatgagagct

SEQ ID NO: 7361873 - DNA, 22 bp, Homo sapiens
tgacagggtcagagctgagctg

SEQ ID NO: 7361874 - DNA, 22 bp, Homo sapiens
tgacagggggcagaggtggctg

SEQ ID NO: 7361875 - DNA, 22 bp, Homo sapiens
tgacaggggctggtggataaat

SEQ ID NO: 7361876 - DNA, 22 bp, Homo sapiens
tgacagggctagaggcaatgca

SEQ ID NO: 7361877 - DNA, 22 bp, Homo sapiens
tgacagggctgttctgttttag

SEQ ID NO: 7361878 - DNA, 22 bp, Homo sapiens
tgacagggcttccctttaatca

SEQ ID NO: 7361879 - DNA, 22 bp, Homo sapiens
tgacagggcaggcttactggtt

SEQ ID NO: 7361880 - DNA, 22 bp, Homo sapiens
tgacagggccatgctgcactgc

SEQ ID NO: 7361881 - DNA, 22 bp, Homo sapiens
tgacagggaggtggaataagta

SEQ ID NO: 7361882 - DNA, 22 bp, Homo sapiens
tgacagggacagtggagatgga

SEQ ID NO: 7361883 - DNA, 22 bp, Homo sapiens
tgaaaggttatttaggtctgct

SEQ ID NO: 7361884 - DNA, 22 bp, Homo sapiens
tgaaaggtagctggcctcatag

SEQ ID NO: 7361885 - DNA, 22 bp, Homo sapiens
tgaaaggtgacatttcttggat

SEQ ID NO: 7361886 - DNA, 22 bp, Homo sapiens
tgaaaggtgtccaatatttctc

SEQ ID NO: 7361887 - DNA, 20 bp, Homo sapiens
tgaaaggtgggaattgtggg

SEQ ID NO: 7361888 - DNA, 22 bp, Homo sapiens
tgaaaggttaaaagtagtattg

SEQ ID NO: 7361889 - DNA, 22 bp, Homo sapiens
tgaaagcacaagttctaacagg

SEQ ID NO: 7361890 - DNA, 23 bp, Homo sapiens
tgaaagcaatgggtctatagtat

SEQ ID NO: 7361891 - DNA, 22 bp, Homo sapiens
tgaaagcactgattctcaactc

SEQ ID NO: 7361892 - DNA, 22 bp, Homo sapiens
tgaaagcactcacttctgctct

SEQ ID NO: 7361893 - DNA, 22 bp, Homo sapiens
tgaaagataagttattatgtac

SEQ ID NO: 7361894 - DNA, 22 bp, Homo sapiens
tgaaagatgctcaatgaatggt

SEQ ID NO: 7361895 - DNA, 22 bp, Homo sapiens
tgaaagcaacctgtaacagtga

SEQ ID NO: 7361896 - DNA, 22 bp, Homo sapiens
tgaaatactttggctctttgtt

SEQ ID NO: 7361897 - DNA, 22 bp, Homo sapiens
tgaaataggaaacagatgtttc

SEQ ID NO: 7361898 - DNA, 22 bp, Homo sapiens
tgaaatagacacagtgctatac

SEQ ID NO: 7361899 - DNA, 22 bp, Homo sapiens
tgaaatagacttgcactatatg

SEQ ID NO: 7361900 - DNA, 22 bp, Homo sapiens
tgaaatcaattgcaatgtttat

SEQ ID NO: 7361901 - DNA, 22 bp, Homo sapiens
tgaaatcagtatgtctttctca

SEQ ID NO: 7361902 - DNA, 22 bp, Homo sapiens
tgaaatatgctcccattcactt

SEQ ID NO: 7361903 - DNA, 22 bp, Homo sapiens
tgaaatcaatgtcttctgtctc

SEQ ID NO: 7361904 - DNA, 22 bp, Homo sapiens
tgaaatcaataattggtgattg

SEQ ID NO: 7361905 - DNA, 22 bp, Homo sapiens
tgaaatgtgatctgagcttggc

SEQ ID NO: 7361906 - DNA, 22 bp, Homo sapiens
tgaaatgtttgaagaccactga

SEQ ID NO: 7361907 - DNA, 22 bp, Homo sapiens
tgaaatcatgtagttattgcaa

SEQ ID NO: 7361908 - DNA, 22 bp, Homo sapiens
tgaaatcatgtagttattgcaa

SEQ ID NO: 7361909 - DNA, 22 bp, Homo sapiens
tgaaatcatgagatagtgtcac

SEQ ID NO: 7361910 - DNA, 22 bp, Homo sapiens
tgaaatctgtcccactttagct

SEQ ID NO: 7361911 - DNA, 22 bp, Homo sapiens
tgaaatctgtcccactttagct

SEQ ID NO: 7361912 - DNA, 22 bp, Homo sapiens
tgaaatcttagccattctgcct

SEQ ID NO: 7361913 - DNA, 22 bp, Homo sapiens
tgaaatctgcatgcaaagtcct

SEQ ID NO: 7361914 - DNA, 22 bp, Homo sapiens
tgaaatctaccctattcagggt

SEQ ID NO: 7361915 - DNA, 22 bp, Homo sapiens
tgaaatctcctctttatatatc

SEQ ID NO: 7361916 - DNA, 21 bp, Homo sapiens
tgaaatctgatgggacaaatg

SEQ ID NO: 7361917 - DNA, 22 bp, Homo sapiens
tgaaatcattggggttgaataa

SEQ ID NO: 7361918 - DNA, 22 bp, Homo sapiens
tgaaatcattgccaagtattga

SEQ ID NO: 7361919 - DNA, 22 bp, Homo sapiens
tgaaatctttagtttctgtccc

SEQ ID NO: 7361920 - DNA, 22 bp, Homo sapiens
tgaaatcttcactaagtctctt

SEQ ID NO: 7361921 - DNA, 22 bp, Homo sapiens
tgaaatcttatactttggtagt

SEQ ID NO: 7361922 - DNA, 22 bp, Homo sapiens
tgaaatgcttctctgaaaatac

SEQ ID NO: 7361923 - DNA, 22 bp, Homo sapiens
tgaaatgcctatgaagtcagga

SEQ ID NO: 7361924 - DNA, 22 bp, Homo sapiens
tgaaatggcaaggcagagcttt

SEQ ID NO: 7361925 - DNA, 22 bp, Homo sapiens
tgaagacagttttactcatgag

SEQ ID NO: 7361926 - DNA, 22 bp, Homo sapiens
tgaagcaactggacaagttggc

SEQ ID NO: 7361927 - DNA, 22 bp, Homo sapiens
tgaagcaactggacaagttggc

SEQ ID NO: 7361928 - DNA, 19 bp, Homo sapiens
tgaagcaataccatttttg

SEQ ID NO: 7361929 - DNA, 22 bp, Homo sapiens
tgaagcaaatttttctcagagt

SEQ ID NO: 7361930 - DNA, 22 bp, Homo sapiens
tgaagcaaacgcttctgttcct

SEQ ID NO: 7361931 - DNA, 22 bp, Homo sapiens
tgaagcagagtgaaggtgaatt

SEQ ID NO: 7361932 - DNA, 22 bp, Homo sapiens
tgaagcagaggggtcttgagct

SEQ ID NO: 7361933 - DNA, 22 bp, Homo sapiens
tgaagcagagaatttgacagtc

SEQ ID NO: 7361934 - DNA, 22 bp, Homo sapiens
tgaagcaggaaccagcagcatt

SEQ ID NO: 7361935 - DNA, 22 bp, Homo sapiens
tgaagcaggaaccagcagcatt

SEQ ID NO: 7361936 - DNA, 22 bp, Homo sapiens
tgaagcaggaaacttcttgttt

SEQ ID NO: 7361937 - DNA, 22 bp, Homo sapiens
tgaagcagcttctttctgtcaa

SEQ ID NO: 7361938 - DNA, 22 bp, Homo sapiens
tgaagcagatggtctggtcatt

SEQ ID NO: 7361939 - DNA, 19 bp, Homo sapiens
tgaagcagcaaactctcag

SEQ ID NO: 7361940 - DNA, 20 bp, Homo sapiens
tgaagcagccttgattctgt

SEQ ID NO: 7361941 - DNA, 22 bp, Homo sapiens
tgaagcagcaccattttagagc

SEQ ID NO: 7361942 - DNA, 22 bp, Homo sapiens
tgaagcagcaaatgatgggaga

SEQ ID NO: 7361943 - DNA, 19 bp, Homo sapiens
tgaagcaggcagagaagat

SEQ ID NO: 7361944 - DNA, 22 bp, Homo sapiens
tgaagcaggatcgtttgcttca

SEQ ID NO: 7361945 - DNA, 22 bp, Homo sapiens
tgaagcaggcattgactgatga

SEQ ID NO: 7361946 - DNA, 22 bp, Homo sapiens
tgaagcagttctcagaagtggg

SEQ ID NO: 7361947 - DNA, 22 bp, Homo sapiens
tgaagcagttactgggtgttaa

SEQ ID NO: 7361948 - DNA, 22 bp, Homo sapiens
tgaagcaggtgaatggatgtcg

SEQ ID NO: 7361949 - DNA, 22 bp, Homo sapiens
tgaagcagggtggccagattgt

SEQ ID NO: 7361950 - DNA, 21 bp, Homo sapiens
tgaactctggtcatcttcatt

SEQ ID NO: 7361951 - DNA, 22 bp, Homo sapiens
tgaacttacaaattaaaagact

SEQ ID NO: 7361952 - DNA, 22 bp, Homo sapiens
tgaactttgtagtaatggagat

SEQ ID NO: 7361953 - DNA, 22 bp, Homo sapiens
tgaacatgctgttgatggcctg

SEQ ID NO: 7361954 - DNA, 22 bp, Homo sapiens
tgaaccacagaagtcaggagct

SEQ ID NO: 7361955 - DNA, 22 bp, Homo sapiens
tgaaccacaggagggttcatgt

SEQ ID NO: 7361956 - DNA, 22 bp, Homo sapiens
tgaaattagtgaagttacagtt

SEQ ID NO: 7361957 - DNA, 22 bp, Homo sapiens
tgaaattagaaatatgtatggg

SEQ ID NO: 7361958 - DNA, 22 bp, Homo sapiens
tgaaattatgcattgttgtacc

SEQ ID NO: 7361959 - DNA, 22 bp, Homo sapiens
tgaaattattcttaccaaggtg

SEQ ID NO: 7361960 - DNA, 22 bp, Homo sapiens
tgaaattcaaaacacatttgtc

SEQ ID NO: 7361961 - DNA, 22 bp, Homo sapiens
tgaacacacacatcttaataat

SEQ ID NO: 7361962 - DNA, 22 bp, Homo sapiens
tgaacacacacctatgtacaaa

SEQ ID NO: 7361963 - DNA, 22 bp, Homo sapiens
tgaacagtggttcatgtcacgg

SEQ ID NO: 7361964 - DNA, 22 bp, Homo sapiens
tcttttagctctgcaaggaaag

SEQ ID NO: 7361965 - DNA, 22 bp, Homo sapiens
tcttttagagcatttctgattc

SEQ ID NO: 7361966 - DNA, 22 bp, Homo sapiens
tcttttaacctaactagcttgg

SEQ ID NO: 7361967 - DNA, 22 bp, Homo sapiens
tctttgttattgtgaatagggt

SEQ ID NO: 7361968 - DNA, 22 bp, Homo sapiens
tcttttatcctacatttagctc

SEQ ID NO: 7361969 - DNA, 22 bp, Homo sapiens
tctttgtggcgggcttaaatac

SEQ ID NO: 7361970 - DNA, 22 bp, Homo sapiens
tctttgtaagttatatgtagta

SEQ ID NO: 7361971 - DNA, 22 bp, Homo sapiens
tctttgtaagacatgtaagtcc

SEQ ID NO: 7361972 - DNA, 22 bp, Homo sapiens
tctttgtaactgtctattgaga

SEQ ID NO: 7361973 - DNA, 22 bp, Homo sapiens
tctttggaaggagcagtttttg

SEQ ID NO: 7361974 - DNA, 22 bp, Homo sapiens
tctttgattttgttactaagac

SEQ ID NO: 7361975 - DNA, 22 bp, Homo sapiens
tgaaaactccaagtttcatcag

SEQ ID NO: 7361976 - DNA, 22 bp, Homo sapiens
tctttttttcctgtgcagagct

SEQ ID NO: 7361977 - DNA, 22 bp, Homo sapiens
tgaaacaaaagtatgtagcttg

SEQ ID NO: 7361978 - DNA, 22 bp, Homo sapiens
tgaaaatttccatcagttatat

SEQ ID NO: 7361979 - DNA, 22 bp, Homo sapiens
tgaaaattgttgtacttgataa

SEQ ID NO: 7361980 - DNA, 22 bp, Homo sapiens
tgaaaattaagcagatgaatga

SEQ ID NO: 7361981 - DNA, 22 bp, Homo sapiens
tgaaaattaagcagatgaatga

SEQ ID NO: 7361982 - DNA, 22 bp, Homo sapiens
tgaaaatgccctctatgtctca

SEQ ID NO: 7361983 - DNA, 22 bp, Homo sapiens
tgaaaatgcacgctggaaagca

SEQ ID NO: 7361984 - DNA, 22 bp, Homo sapiens
tgaaaatatagttttccagact

SEQ ID NO: 7361985 - DNA, 20 bp, Homo sapiens
tgaaaaggtcaggagacatg

SEQ ID NO: 7361986 - DNA, 22 bp, Homo sapiens
tgaaaagactgcaagagagcat

SEQ ID NO: 7361987 - DNA, 22 bp, Homo sapiens
tgaaaagactgcaagagagcat

SEQ ID NO: 7361988 - DNA, 22 bp, Homo sapiens
tgaaacataaagttatcttcag

SEQ ID NO: 7361989 - DNA, 22 bp, Homo sapiens
tgaaacattaggaaatcattat

SEQ ID NO: 7361990 - DNA, 22 bp, Homo sapiens
tgaaacattaggaaatcattat

SEQ ID NO: 7361991 - DNA, 22 bp, Homo sapiens
tgaaacattatagaatatttat

SEQ ID NO: 7361992 - DNA, 23 bp, Homo sapiens
tgaaacatttagggtagaatttc

SEQ ID NO: 7361993 - DNA, 22 bp, Homo sapiens
tgaaacattgcactgtatgaat

SEQ ID NO: 7361994 - DNA, 22 bp, Homo sapiens
tgaaacattgcactgtatgaat

SEQ ID NO: 7361995 - DNA, 22 bp, Homo sapiens
tgaaacatttgatgatctttgg

SEQ ID NO: 7361996 - DNA, 21 bp, Homo sapiens
tgaaacatttgatcaaagcac

SEQ ID NO: 7361997 - DNA, 22 bp, Homo sapiens
tgaaacagtgcttcactcagcc

SEQ ID NO: 7361998 - DNA, 22 bp, Homo sapiens
tgaaacagtctccagacttgga

SEQ ID NO: 7361999 - DNA, 22 bp, Homo sapiens
tgaaacaggcaaaactgcagat

SEQ ID NO: 7362000 - DNA, 19 bp, Homo sapiens
tgaaacaaacttaaaagga

SEQ ID NO: 7362001 - DNA, 22 bp, Homo sapiens
tgaaacaaaattaagattctcg

SEQ ID NO: 7362002 - DNA, 22 bp, Homo sapiens
tgaaagaagggtggaaaatgta

SEQ ID NO: 7362003 - DNA, 21 bp, Homo sapiens
tgaaagaaggtgcagtctgaa

SEQ ID NO: 7362004 - DNA, 22 bp, Homo sapiens
tgaaagaagccttcgaggctcg

SEQ ID NO: 7362005 - DNA, 22 bp, Homo sapiens
tgaaagaagcctccctttggag

SEQ ID NO: 7362006 - DNA, 22 bp, Homo sapiens
tgaaagaactagcatcttcaag

SEQ ID NO: 7362007 - DNA, 17 bp, Homo sapiens
tgaaagaatcagggaga

SEQ ID NO: 7362008 - DNA, 22 bp, Homo sapiens
tgaaagaagtgtcacattgcca

SEQ ID NO: 7362009 - DNA, 22 bp, Homo sapiens
tgaaagaagtgtcacattgcca

SEQ ID NO: 7362010 - DNA, 22 bp, Homo sapiens
tgaaagaaacaggtatattggg

SEQ ID NO: 7362011 - DNA, 22 bp, Homo sapiens
tgccatttgctggttttctgat

SEQ ID NO: 7362012 - DNA, 22 bp, Homo sapiens
tgcccaaacctctcctagctct

SEQ ID NO: 7362013 - DNA, 22 bp, Homo sapiens
tgcccaaactgacattggcagt

SEQ ID NO: 7362014 - DNA, 22 bp, Homo sapiens
tgcccaagccgagctctctgtt

SEQ ID NO: 7362015 - DNA, 22 bp, Homo sapiens
tgcccaagtgtttggctgagtc

SEQ ID NO: 7362016 - DNA, 20 bp, Homo sapiens
tgcccacaattcacaatgcc

SEQ ID NO: 7362017 - DNA, 21 bp, Homo sapiens
tgcccacagcaaatgcagagg

SEQ ID NO: 7362018 - DNA, 22 bp, Homo sapiens
tgcccacagctcagggctgctc

SEQ ID NO: 7362019 - DNA, 22 bp, Homo sapiens
tgcccacaggaagacaccagcg

SEQ ID NO: 7362020 - DNA, 20 bp, Homo sapiens
tgcccagcaagagtgcagtt

SEQ ID NO: 7362021 - DNA, 22 bp, Homo sapiens
tgcccagcactgtgccagtcac

SEQ ID NO: 7362022 - DNA, 22 bp, Homo sapiens
tgcccagggtggagtgcagcgg

SEQ ID NO: 7362023 - DNA, 22 bp, Homo sapiens
tgcccagggtggagtgcagcgg

SEQ ID NO: 7362024 - DNA, 22 bp, Homo sapiens
tgccccctggtggccagagccg

SEQ ID NO: 7362025 - DNA, 20 bp, Homo sapiens
tgccccaggcctgcacctgc

SEQ ID NO: 7362026 - DNA, 19 bp, Homo sapiens
tgcccaggcctcccaaaag

SEQ ID NO: 7362027 - DNA, 22 bp, Homo sapiens
tgcccaggatctggcgatgctc

SEQ ID NO: 7362028 - DNA, 22 bp, Homo sapiens
tgcccaggattgtgaggtcagg

SEQ ID NO: 7362029 - DNA, 22 bp, Homo sapiens
tgcccaggattgtgaggtcagg

SEQ ID NO: 7362030 - DNA, 20 bp, Homo sapiens
tgccaggcacggagtgcatg

SEQ ID NO: 7362031 - DNA, 18 bp, Homo sapiens
tgccagccgactggcctg

SEQ ID NO: 7362032 - DNA, 22 bp, Homo sapiens
tgccaggcagtgtcagattgag

SEQ ID NO: 7362033 - DNA, 20 bp, Homo sapiens
tgccaggcacggagtgcatg

SEQ ID NO: 7362034 - DNA, 22 bp, Homo sapiens
tgccaggccctcccacagatta

SEQ ID NO: 7362035 - DNA, 22 bp, Homo sapiens
tgccaggctaagtggaggactt

SEQ ID NO: 7362036 - DNA, 22 bp, Homo sapiens
tgccaggcccagctccagagct

SEQ ID NO: 7362037 - DNA, 22 bp, Homo sapiens
tgccaggccaatgaaggcaggg

SEQ ID NO: 7362038 - DNA, 23 bp, Homo sapiens
tgccagggtttgtttgtggttca

SEQ ID NO: 7362039 - DNA, 23 bp, Homo sapiens
tgccagggtttgtttgtggttca

SEQ ID NO: 7362040 - DNA, 22 bp, Homo sapiens
tgccagggtgtcaggagagcta

SEQ ID NO: 7362041 - DNA, 22 bp, Homo sapiens
tgccatcttcaataacactgag

SEQ ID NO: 7362042 - DNA, 22 bp, Homo sapiens
tgccatctgaaaattacatcct

SEQ ID NO: 7362043 - DNA, 22 bp, Homo sapiens
tgccatctctccatagcataga

SEQ ID NO: 7362044 - DNA, 22 bp, Homo sapiens
tgccagggtcctgagggccttg

SEQ ID NO: 7362045 - DNA, 22 bp, Homo sapiens
tgccagggtgtcaggagagcta

SEQ ID NO: 7362046 - DNA, 22 bp, Homo sapiens
tgccagggtcctgagggccttg

SEQ ID NO: 7362047 - DNA, 22 bp, Homo sapiens
tgccaggggacctagggatgtc

SEQ ID NO: 7362048 - DNA, 22 bp, Homo sapiens
tgccagggtcagctgcagctct

SEQ ID NO: 7362049 - DNA, 22 bp, Homo sapiens
tgccagggtcagctgcagctct

SEQ ID NO: 7362050 - DNA, 22 bp, Homo sapiens
tgccagggccatagggagtcta

SEQ ID NO: 7362051 - DNA, 22 bp, Homo sapiens
tgccagggccatagggagtcta

SEQ ID NO: 7362052 - DNA, 22 bp, Homo sapiens
tgccagggctgctactggctga

SEQ ID NO: 7362053 - DNA, 23 bp, Homo sapiens
tgccagggccctgtgtgcaatgc

SEQ ID NO: 7362054 - DNA, 22 bp, Homo sapiens
tgccaggggacctagggatgtc

SEQ ID NO: 7362055 - DNA, 22 bp, Homo sapiens
tgccagggagccctgctgacca

SEQ ID NO: 7362056 - DNA, 22 bp, Homo sapiens
tgccagggaccctgtcggccct

SEQ ID NO: 7362057 - DNA, 22 bp, Homo sapiens
tgccaggcttagagcaggggct

SEQ ID NO: 7362058 - DNA, 20 bp, Homo sapiens
tgccagggccagcagaggct

SEQ ID NO: 7362059 - DNA, 22 bp, Homo sapiens
tgccaggctgccctccagtctg

SEQ ID NO: 7362060 - DNA, 22 bp, Homo sapiens
tgccgcagtgcggggagggccc

SEQ ID NO: 7362061 - DNA, 22 bp, Homo sapiens
tgccctgggaacacagatgcca

SEQ ID NO: 7362062 - DNA, 22 bp, Homo sapiens
tgccctgggacatgcagcggag

SEQ ID NO: 7362063 - DNA, 22 bp, Homo sapiens
tgccctgtctaagctgtcagta

SEQ ID NO: 7362064 - DNA, 22 bp, Homo sapiens
tgccctgttcctgcctccagct

SEQ ID NO: 7362065 - DNA, 17 bp, Homo sapiens
tgccctgtgcctggtgt

SEQ ID NO: 7362066 - DNA, 22 bp, Homo sapiens
tgccctgctgtggctctgccca

SEQ ID NO: 7362067 - DNA, 22 bp, Homo sapiens
tgccctgctgtgcctggagcca

SEQ ID NO: 7362068 - DNA, 22 bp, Homo sapiens
tgccctgcttggtttattttca

SEQ ID NO: 7362069 - DNA, 22 bp, Homo sapiens
tgccctgcttctcttgggacag

SEQ ID NO: 7362070 - DNA, 22 bp, Homo sapiens
tgccctggatgctgcaggtgtg

SEQ ID NO: 7362071 - DNA, 22 bp, Homo sapiens
tgccctggcacacacacagctg

SEQ ID NO: 7362072 - DNA, 22 bp, Homo sapiens
tgccctggctcctcccacgctg

SEQ ID NO: 7362073 - DNA, 22 bp, Homo sapiens
tgccctgctgtgcctggagcca

SEQ ID NO: 7362074 - DNA, 22 bp, Homo sapiens
tgccctgctaaccttggttcca

SEQ ID NO: 7362075 - DNA, 22 bp, Homo sapiens
tgccctgctaaatataggtagc

SEQ ID NO: 7362076 - DNA, 22 bp, Homo sapiens
tgccctgcggctatctagatga

SEQ ID NO: 7362077 - DNA, 22 bp, Homo sapiens
tgccctgcctgagagacagtaa

SEQ ID NO: 7362078 - DNA, 19 bp, Homo sapiens
tgccctgcccgcagccttg

SEQ ID NO: 7362079 - DNA, 22 bp, Homo sapiens
tgccctgcccttgctatttcta

SEQ ID NO: 7362080 - DNA, 22 bp, Homo sapiens
tgccctgcatgcagggagctgt

SEQ ID NO: 7362081 - DNA, 22 bp, Homo sapiens
tgccctgccaagaccaagtggt

SEQ ID NO: 7362082 - DNA, 22 bp, Homo sapiens
tgccctgccaagactcagtggt

SEQ ID NO: 7362083 - DNA, 22 bp, Homo sapiens
tgccctgcccatctaccctgtc

SEQ ID NO: 7362084 - DNA, 22 bp, Homo sapiens
tgccctgccaagactgagtggt

SEQ ID NO: 7362085 - DNA, 22 bp, Homo sapiens
tgccctgccaagactgagtggt

SEQ ID NO: 7362086 - DNA, 22 bp, Homo sapiens
tgccctgcatgcagggagctgt

SEQ ID NO: 7362087 - DNA, 22 bp, Homo sapiens
tgccctgcagtgagtgcgtctg

SEQ ID NO: 7362088 - DNA, 22 bp, Homo sapiens
tgccctgcagaccctgcagtgt

SEQ ID NO: 7362089 - DNA, 19 bp, Homo sapiens
tgccctgcacgctgtcctg

SEQ ID NO: 7362090 - DNA, 22 bp, Homo sapiens
tgcctccattcctgggtcattg

SEQ ID NO: 7362091 - DNA, 22 bp, Homo sapiens
tgcctcagctgaggccgctcca

SEQ ID NO: 7362092 - DNA, 22 bp, Homo sapiens
tgcctcaggcacctggcaggtt

SEQ ID NO: 7362093 - DNA, 22 bp, Homo sapiens
tgcctccttcaggagggcccgg

SEQ ID NO: 7362094 - DNA, 22 bp, Homo sapiens
tgcctcctctttgccaaggtca

SEQ ID NO: 7362095 - DNA, 22 bp, Homo sapiens
tgcctgagggagtaagagtcct

SEQ ID NO: 7362096 - DNA, 22 bp, Homo sapiens
tgcctggcaccccagtctgcac

SEQ ID NO: 7362097 - DNA, 19 bp, Homo sapiens
tgcctggagcataacaggc

SEQ ID NO: 7362098 - DNA, 22 bp, Homo sapiens
tgcctggatctgaggacccatt

SEQ ID NO: 7362099 - DNA, 22 bp, Homo sapiens
tgcctggatgtgctggcctcac

SEQ ID NO: 7362100 - DNA, 22 bp, Homo sapiens
tgcctgcaagagttggggctac

SEQ ID NO: 7362101 - DNA, 20 bp, Homo sapiens
tgcctgcccaggtcctgcac

SEQ ID NO: 7362102 - DNA, 19 bp, Homo sapiens
tgccagcattaggctgaag

SEQ ID NO: 7362103 - DNA, 22 bp, Homo sapiens
tgccagccaggttctgaggcta

SEQ ID NO: 7362104 - DNA, 22 bp, Homo sapiens
tgccagcccaccttggggcctc

SEQ ID NO: 7362105 - DNA, 22 bp, Homo sapiens
tgccagccaggttctgaggcta

SEQ ID NO: 7362106 - DNA, 23 bp, Homo sapiens
tgccacccttctcttcccagctt

SEQ ID NO: 7362107 - DNA, 22 bp, Homo sapiens
tgccaccctggcggcagcctgc

SEQ ID NO: 7362108 - DNA, 17 bp, Homo sapiens
tgccacttacctataca

SEQ ID NO: 7362109 - DNA, 22 bp, Homo sapiens
tgccactgggcatgcagatgtc

SEQ ID NO: 7362110 - DNA, 22 bp, Homo sapiens
tgccacaggcaatccctgcacg

SEQ ID NO: 7362111 - DNA, 22 bp, Homo sapiens
tgccacagggtcctcaggccag

SEQ ID NO: 7362112 - DNA, 22 bp, Homo sapiens
tgcatttcacagactgagaaat

SEQ ID NO: 7362113 - DNA, 22 bp, Homo sapiens
tgccaaatattctctacgtgct

SEQ ID NO: 7362114 - DNA, 21 bp, Homo sapiens
tgcattcttgtgtaaggtagt

SEQ ID NO: 7362115 - DNA, 22 bp, Homo sapiens
tgcattctgaacgtaaatgtga

SEQ ID NO: 7362116 - DNA, 22 bp, Homo sapiens
tgcattctgacttagttaatat

SEQ ID NO: 7362117 - DNA, 22 bp, Homo sapiens
tgcattgcatttgtcatgaaga

SEQ ID NO: 7362118 - DNA, 22 bp, Homo sapiens
tgcattgcagttaactcagtat

SEQ ID NO: 7362119 - DNA, 22 bp, Homo sapiens
tgcattgttgaatatttcatag

SEQ ID NO: 7362120 - DNA, 22 bp, Homo sapiens
tgcattgtaggatgtttagcag

SEQ ID NO: 7362121 - DNA, 17 bp, Homo sapiens
tgcattgtaggctagcc

SEQ ID NO: 7362122 - DNA, 22 bp, Homo sapiens
tgcattgttgaccagttgtgca

SEQ ID NO: 7362123 - DNA, 22 bp, Homo sapiens
tgcattgttgatgagttgaata

SEQ ID NO: 7362124 - DNA, 17 bp, Homo sapiens
tgcattgttggaaattt

SEQ ID NO: 7362125 - DNA, 22 bp, Homo sapiens
tgcattgtttagaactctttgg

SEQ ID NO: 7362126 - DNA, 22 bp, Homo sapiens
tgcattgtttgataggtgaatt

SEQ ID NO: 7362127 - DNA, 22 bp, Homo sapiens
tgcatgaaatattttctgtagg

SEQ ID NO: 7362128 - DNA, 22 bp, Homo sapiens
tgcatgcaaaaaaatctgcatt

SEQ ID NO: 7362129 - DNA, 22 bp, Homo sapiens
tgcatgcaaagtgtctgctttg

SEQ ID NO: 7362130 - DNA, 22 bp, Homo sapiens
tgcatgcaacaattcttctata

SEQ ID NO: 7362131 - DNA, 22 bp, Homo sapiens
tgcatggaacggtctcctggtc

SEQ ID NO: 7362132 - DNA, 18 bp, Homo sapiens
tgcatgcttttgtttcca

SEQ ID NO: 7362133 - DNA, 22 bp, Homo sapiens
tgcatggagctgtctgcatggt

SEQ ID NO: 7362134 - DNA, 23 bp, Homo sapiens
tgcatggggctatactgctgttc

SEQ ID NO: 7362135 - DNA, 23 bp, Homo sapiens
tgcatggggctatactgctgttc

SEQ ID NO: 7362136 - DNA, 22 bp, Homo sapiens
tgcatgtgtgtattcagagact

SEQ ID NO: 7362137 - DNA, 22 bp, Homo sapiens
tgcattccacagaagggaaaac

SEQ ID NO: 7362138 - DNA, 22 bp, Homo sapiens
tgcataattcatccttctggga

SEQ ID NO: 7362139 - DNA, 22 bp, Homo sapiens
tgcataatgctggacttttcaa

SEQ ID NO: 7362140 - DNA, 23 bp, Homo sapiens
tgcatcctcatttttcacacgag

SEQ ID NO: 7362141 - DNA, 22 bp, Homo sapiens
tgcagtttaaacttggcaactt

SEQ ID NO: 7362142 - DNA, 22 bp, Homo sapiens
tgcagtgtttttcagggcatat

SEQ ID NO: 7362143 - DNA, 22 bp, Homo sapiens
tgcataaaaaccacatacaagg

SEQ ID NO: 7362144 - DNA, 22 bp, Homo sapiens
tgcataaaatatgagaaatgta

SEQ ID NO: 7362145 - DNA, 19 bp, Homo sapiens
tgcataaattatatacttt

SEQ ID NO: 7362146 - DNA, 19 bp, Homo sapiens
tgcataaattatatacttt

SEQ ID NO: 7362147 - DNA, 22 bp, Homo sapiens
tgcataaagtgccatagtatta

SEQ ID NO: 7362148 - DNA, 22 bp, Homo sapiens
tgcataaagtgccatagtatta

SEQ ID NO: 7362149 - DNA, 22 bp, Homo sapiens
tgcataaagtgccatagtatta

SEQ ID NO: 7362150 - DNA, 22 bp, Homo sapiens
tgcataaagtgccatagtatta

SEQ ID NO: 7362151 - DNA, 21 bp, Homo sapiens
tgcataaagaaatacaaatac

SEQ ID NO: 7362152 - DNA, 21 bp, Homo sapiens
tgcataaagaaatacaaatac

SEQ ID NO: 7362153 - DNA, 21 bp, Homo sapiens
tgcataaagaaatacaaatac

SEQ ID NO: 7362154 - DNA, 22 bp, Homo sapiens
tgcataaacagatacttcatgt

SEQ ID NO: 7362155 - DNA, 22 bp, Homo sapiens
tgcagggaaaacccaggatgct

SEQ ID NO: 7362156 - DNA, 22 bp, Homo sapiens
tgcagggaaaacccaggatgct

SEQ ID NO: 7362157 - DNA, 22 bp, Homo sapiens
tgcagggaaaacccaggatgct

SEQ ID NO: 7362158 - DNA, 22 bp, Homo sapiens
tgcagggaaagggcactgggct

SEQ ID NO: 7362159 - DNA, 22 bp, Homo sapiens
tgcagggaacttggacagctag

SEQ ID NO: 7362160 - DNA, 22 bp, Homo sapiens
tgcagggaagtcccagctcctg

SEQ ID NO: 7362161 - DNA, 22 bp, Homo sapiens
tgcagggaatccagtctagggt

SEQ ID NO: 7362162 - DNA, 22 bp, Homo sapiens
tgcagggaagcaagggtggctc

SEQ ID NO: 7362163 - DNA, 22 bp, Homo sapiens
tgcagggaagcaagggtggctc

SEQ ID NO: 7362164 - DNA, 22 bp, Homo sapiens
tgcaggctctctgctgccagat

SEQ ID NO: 7362165 - DNA, 22 bp, Homo sapiens
tgcagggattatgtaggggttg

SEQ ID NO: 7362166 - DNA, 22 bp, Homo sapiens
tgcagggattatgtaggggttg

SEQ ID NO: 7362167 - DNA, 22 bp, Homo sapiens
tgcagggattgttggcatccat

SEQ ID NO: 7362168 - DNA, 23 bp, Homo sapiens
tgcagggcaagttagagacccca

SEQ ID NO: 7362169 - DNA, 21 bp, Homo sapiens
tgcagggatctttctgcctga

SEQ ID NO: 7362170 - DNA, 22 bp, Homo sapiens
tgcagggatcctagctgaagag

SEQ ID NO: 7362171 - DNA, 22 bp, Homo sapiens
tgcagggattagaggccgggga

SEQ ID NO: 7362172 - DNA, 22 bp, Homo sapiens
tgcagggatgctagaggtaaga

SEQ ID NO: 7362173 - DNA, 22 bp, Homo sapiens
tgcagggatgctagaggtaaga

SEQ ID NO: 7362174 - DNA, 22 bp, Homo sapiens
tgcagggcagctagggagcttt

SEQ ID NO: 7362175 - DNA, 22 bp, Homo sapiens
tgcagggcacacgcacgggtgt

SEQ ID NO: 7362176 - DNA, 22 bp, Homo sapiens
tgcagggcccttggggttgaac

SEQ ID NO: 7362177 - DNA, 22 bp, Homo sapiens
tgcagggccagactgggttgga

SEQ ID NO: 7362178 - DNA, 22 bp, Homo sapiens
tgcagggccatggtggcggctg

SEQ ID NO: 7362179 - DNA, 22 bp, Homo sapiens
tgcagtcagcattagcaaaata

SEQ ID NO: 7362180 - DNA, 22 bp, Homo sapiens
tgcagtgggccggaggccaggg

SEQ ID NO: 7362181 - DNA, 22 bp, Homo sapiens
tgcagtggtgtccaggtgtact

SEQ ID NO: 7362182 - DNA, 20 bp, Homo sapiens
tgcagtgtcctcacttgtca

SEQ ID NO: 7362183 - DNA, 23 bp, Homo sapiens
tgcagtgtcgctgcgagcccggc

SEQ ID NO: 7362184 - DNA, 22 bp, Homo sapiens
tgcagtgtcttgtggacttgag

SEQ ID NO: 7362185 - DNA, 22 bp, Homo sapiens
tgcagtgtgattttctggctga

SEQ ID NO: 7362186 - DNA, 22 bp, Homo sapiens
tgcagtgtgctagatttggact

SEQ ID NO: 7362187 - DNA, 22 bp, Homo sapiens
tgcagtgtgaggtccacatctg

SEQ ID NO: 7362188 - DNA, 22 bp, Homo sapiens
tgcagtgtgacctgtagcgagc

SEQ ID NO: 7362189 - DNA, 21 bp, Homo sapiens
tgcagtgtccctaacagtggt

SEQ ID NO: 7362190 - DNA, 23 bp, Homo sapiens
tgcagtgtagcatctacgaagct

SEQ ID NO: 7362191 - DNA, 22 bp, Homo sapiens
tgcagtgtagaaaaagagtgag

SEQ ID NO: 7362192 - DNA, 22 bp, Homo sapiens
tgcagtgtttggatgctgagtc

SEQ ID NO: 7362193 - DNA, 22 bp, Homo sapiens
tgcagtgtttccagatattgtc

SEQ ID NO: 7362194 - DNA, 23 bp, Homo sapiens
tgcagtgtttaacaatgacttga

SEQ ID NO: 7362195 - DNA, 22 bp, Homo sapiens
tgcagtgttcctgtgggtttat

SEQ ID NO: 7362196 - DNA, 22 bp, Homo sapiens
tgcagtgttcctgtagcctgcc

SEQ ID NO: 7362197 - DNA, 22 bp, Homo sapiens
tgcagtgttcagtgatctctcc

SEQ ID NO: 7362198 - DNA, 22 bp, Homo sapiens
tgcagtgtggccatgtcagcta

SEQ ID NO: 7362199 - DNA, 20 bp, Homo sapiens
tgcagtgtggaagactgaga

SEQ ID NO: 7362200 - DNA, 22 bp, Homo sapiens
tgcagtgtgattttctggctga

SEQ ID NO: 7362201 - DNA, 20 bp, Homo sapiens
tgcaggtgtgtccaagcact

SEQ ID NO: 7362202 - DNA, 22 bp, Homo sapiens
tgcaggtctctgcaaggcctat

SEQ ID NO: 7362203 - DNA, 23 bp, Homo sapiens
tgcaggggaggcttaaagcaggt

SEQ ID NO: 7362204 - DNA, 22 bp, Homo sapiens
tgcaggggcttgtctgggcctg

SEQ ID NO: 7362205 - DNA, 22 bp, Homo sapiens
tgcagggtatccttgtctctgc

SEQ ID NO: 7362206 - DNA, 19 bp, Homo sapiens
tgcagggctgcgcctgggg

SEQ ID NO: 7362207 - DNA, 19 bp, Homo sapiens
tgcagggctgcgcctgggg

SEQ ID NO: 7362208 - DNA, 20 bp, Homo sapiens
tgcagggctgcctcccagct

SEQ ID NO: 7362209 - DNA, 22 bp, Homo sapiens
tgcagggctcctggctccaatc

SEQ ID NO: 7362210 - DNA, 21 bp, Homo sapiens
tgatcatttgtgtaaaggaga

SEQ ID NO: 7362211 - DNA, 23 bp, Homo sapiens
tgatctctcttgggaggcaatat

SEQ ID NO: 7362212 - DNA, 21 bp, Homo sapiens
tgatcctttcccccatgttgc

SEQ ID NO: 7362213 - DNA, 22 bp, Homo sapiens
tgagttctgactgtgatgccag

SEQ ID NO: 7362214 - DNA, 22 bp, Homo sapiens
tgagttctcatgaaatctagtt

SEQ ID NO: 7362215 - DNA, 22 bp, Homo sapiens
tgatatttgctgactgcattgt

SEQ ID NO: 7362216 - DNA, 20 bp, Homo sapiens
tgatatttctggaagtggag

SEQ ID NO: 7362217 - DNA, 22 bp, Homo sapiens
tgatatgtgaagctattagttc

SEQ ID NO: 7362218 - DNA, 22 bp, Homo sapiens
tgatatcagctggcagcagtgg

SEQ ID NO: 7362219 - DNA, 22 bp, Homo sapiens
tgatatctaagaaattctacca

SEQ ID NO: 7362220 - DNA, 22 bp, Homo sapiens
tgagtggacacctgcttcttta

SEQ ID NO: 7362221 - DNA, 22 bp, Homo sapiens
tgagtggacgtgaggctgagta

SEQ ID NO: 7362222 - DNA, 22 bp, Homo sapiens
tgagtgggacctgcgtgtgtca

SEQ ID NO: 7362223 - DNA, 19 bp, Homo sapiens
tgagtggagtgcaatgaag

SEQ ID NO: 7362224 - DNA, 19 bp, Homo sapiens
tgagtgggcccctgcagac

SEQ ID NO: 7362225 - DNA, 22 bp, Homo sapiens
tgagtgtgtattatgtatcagg

SEQ ID NO: 7362226 - DNA, 22 bp, Homo sapiens
tgagtgtgtattatgtatcagg

SEQ ID NO: 7362227 - DNA, 22 bp, Homo sapiens
tgagtgtggggaatgtcatgag

SEQ ID NO: 7362228 - DNA, 22 bp, Homo sapiens
tgagtgtggggaatgtcatgag

SEQ ID NO: 7362229 - DNA, 22 bp, Homo sapiens
tgagtgtgctaggtgtctcggt

SEQ ID NO: 7362230 - DNA, 22 bp, Homo sapiens
tgagtgtgctaggtgtctcggt

SEQ ID NO: 7362231 - DNA, 23 bp, Homo sapiens
tgagtgtgttccctgtgagattt

SEQ ID NO: 7362232 - DNA, 22 bp, Homo sapiens
tgatgctttaagattaatctgg

SEQ ID NO: 7362233 - DNA, 22 bp, Homo sapiens
tgatggaaatattgacaccaca

SEQ ID NO: 7362234 - DNA, 22 bp, Homo sapiens
tgatgctgtcaaggaggtgaac

SEQ ID NO: 7362235 - DNA, 22 bp, Homo sapiens
tgatgcccccaaatctggctca

SEQ ID NO: 7362236 - DNA, 22 bp, Homo sapiens
tgatgcatcattttcataaatt

SEQ ID NO: 7362237 - DNA, 22 bp, Homo sapiens
tgatgatttgaaaccagtttct

SEQ ID NO: 7362238 - DNA, 22 bp, Homo sapiens
tgatgaaaatgttcagcaatta

SEQ ID NO: 7362239 - DNA, 22 bp, Homo sapiens
tgatgaaaaccagaactctcat

SEQ ID NO: 7362240 - DNA, 22 bp, Homo sapiens
tgatctttggtaatctggcaca

SEQ ID NO: 7362241 - DNA, 22 bp, Homo sapiens
tgattaaaatttaacttagtta

SEQ ID NO: 7362242 - DNA, 22 bp, Homo sapiens
tgatgtgtgattcattctcaaa

SEQ ID NO: 7362243 - DNA, 22 bp, Homo sapiens
tgatgtgtgattcattctcaaa

SEQ ID NO: 7362244 - DNA, 22 bp, Homo sapiens
tgatggttttattaataggacc

SEQ ID NO: 7362245 - DNA, 20 bp, Homo sapiens
tgatggttctttccgggttg

SEQ ID NO: 7362246 - DNA, 22 bp, Homo sapiens
tgatggttgattataaatcagt

SEQ ID NO: 7362247 - DNA, 22 bp, Homo sapiens
tgatgtaagagatacacttgat

SEQ ID NO: 7362248 - DNA, 22 bp, Homo sapiens
tgattaagttgcattttaatat

SEQ ID NO: 7362249 - DNA, 23 bp, Homo sapiens
tgattcagaaggttgttattgct

SEQ ID NO: 7362250 - DNA, 22 bp, Homo sapiens
tgattctttgaccaaaaaattg

SEQ ID NO: 7362251 - DNA, 22 bp, Homo sapiens
tgattctgtctccttcactccg

SEQ ID NO: 7362252 - DNA, 22 bp, Homo sapiens
tgattctgttctccttgagaat

SEQ ID NO: 7362253 - DNA, 21 bp, Homo sapiens
tgattctgttttatcatcagc

SEQ ID NO: 7362254 - DNA, 22 bp, Homo sapiens
tgattctttctccaccaattca

SEQ ID NO: 7362255 - DNA, 22 bp, Homo sapiens
tgattcatcagaataggagttt

SEQ ID NO: 7362256 - DNA, 21 bp, Homo sapiens
tgattccctaatcccagcacc

SEQ ID NO: 7362257 - DNA, 22 bp, Homo sapiens
tgatttatgaccaagttagaat

SEQ ID NO: 7362258 - DNA, 22 bp, Homo sapiens
tgatttatgcattatactgttg

SEQ ID NO: 7362259 - DNA, 22 bp, Homo sapiens
tgatttcatagtatatacatga

SEQ ID NO: 7362260 - DNA, 22 bp, Homo sapiens
tgatttccaataaggagaatgt

SEQ ID NO: 7362261 - DNA, 22 bp, Homo sapiens
tgatttccaataaggagaatgt

SEQ ID NO: 7362262 - DNA, 22 bp, Homo sapiens
tgatttccacagtcaggggtgc

SEQ ID NO: 7362263 - DNA, 22 bp, Homo sapiens
tgatttccaaaaggcttctaag

SEQ ID NO: 7362264 - DNA, 22 bp, Homo sapiens
tgatttcaagtagtgacatgct

SEQ ID NO: 7362265 - DNA, 22 bp, Homo sapiens
tgatttcaagtagtgacatgct

SEQ ID NO: 7362266 - DNA, 22 bp, Homo sapiens
tgatttccagttgctgggtgct

SEQ ID NO: 7362267 - DNA, 22 bp, Homo sapiens
tgatttccagttgctgggtgct

SEQ ID NO: 7362268 - DNA, 21 bp, Homo sapiens
tgatttccatcttaaaataaa

SEQ ID NO: 7362269 - DNA, 22 bp, Homo sapiens
tgatttccatgaagctgaaggc

SEQ ID NO: 7362270 - DNA, 22 bp, Homo sapiens
tgatttccatgaagctgaaggc

SEQ ID NO: 7362271 - DNA, 22 bp, Homo sapiens
tgatttccacgtgcacccaggt

SEQ ID NO: 7362272 - DNA, 21 bp, Homo sapiens
tgatttccagaaaattggccc

SEQ ID NO: 7362273 - DNA, 23 bp, Homo sapiens
tgatttccagtgagtcagtggga

SEQ ID NO: 7362274 - DNA, 22 bp, Homo sapiens
tgatttccccagtcttgctgct

SEQ ID NO: 7362275 - DNA, 22 bp, Homo sapiens
tgatttccctcatcataacaga

SEQ ID NO: 7362276 - DNA, 22 bp, Homo sapiens
tgatttccctgtagcctctgaa

SEQ ID NO: 7362277 - DNA, 15 bp, Homo sapiens
tgatttcctactaac

SEQ ID NO: 7362278 - DNA, 22 bp, Homo sapiens
tgatttcctagctgacatgaaa

SEQ ID NO: 7362279 - DNA, 22 bp, Homo sapiens
tgatttcctaggtctggagaag

SEQ ID NO: 7362280 - DNA, 22 bp, Homo sapiens
tgcaaaaactgcaattgctttt

SEQ ID NO: 7362281 - DNA, 22 bp, Homo sapiens
tgcaaaataatgaacgattttt

SEQ ID NO: 7362282 - DNA, 22 bp, Homo sapiens
tgatttcctaggtctggagaag

SEQ ID NO: 7362283 - DNA, 22 bp, Homo sapiens
tgatttcctctactagcaatta

SEQ ID NO: 7362284 - DNA, 22 bp, Homo sapiens
tgatttcctggctttggagttc

SEQ ID NO: 7362285 - DNA, 22 bp, Homo sapiens
tgattttattggtgaggaaatt

SEQ ID NO: 7362286 - DNA, 22 bp, Homo sapiens
tgatttcctgtgcgcccttagg

SEQ ID NO: 7362287 - DNA, 18 bp, Homo sapiens
tgcaaatggctgtttgat

SEQ ID NO: 7362288 - DNA, 22 bp, Homo sapiens
tgcaaatggagcatgtataaga

SEQ ID NO: 7362289 - DNA, 22 bp, Homo sapiens
tgcaaatgatgaaactaacttt

SEQ ID NO: 7362290 - DNA, 22 bp, Homo sapiens
tgcaaatgcccatttattttct

SEQ ID NO: 7362291 - DNA, 22 bp, Homo sapiens
tgcaaatcatactgagatgatt

SEQ ID NO: 7362292 - DNA, 23 bp, Homo sapiens
tgcaaaatttgcagagttcgatg

SEQ ID NO: 7362293 - DNA, 17 bp, Homo sapiens
tgcaaacaatcacatat

SEQ ID NO: 7362294 - DNA, 22 bp, Homo sapiens
tgcaaacatccgactgaaagcc

SEQ ID NO: 7362295 - DNA, 22 bp, Homo sapiens
tgcaaacaggagagtaagtata

SEQ ID NO: 7362296 - DNA, 22 bp, Homo sapiens
tgcaatgaattacttcccaaac

SEQ ID NO: 7362297 - DNA, 22 bp, Homo sapiens
tgcaatctcggcactttgggag

SEQ ID NO: 7362298 - DNA, 22 bp, Homo sapiens
tgcacaaacacagagaatagat

SEQ ID NO: 7362299 - DNA, 22 bp, Homo sapiens
tgcacaaacacagagaatagat

SEQ ID NO: 7362300 - DNA, 22 bp, Homo sapiens
tgcacaaacttgtgtcccaggg

SEQ ID NO: 7362301 - DNA, 21 bp, Homo sapiens
tgcacaaactttctgtggctt

SEQ ID NO: 7362302 - DNA, 22 bp, Homo sapiens
tgcacaaagcattctagacgca

SEQ ID NO: 7362303 - DNA, 22 bp, Homo sapiens
tgcacacacacgtagagaaaag

SEQ ID NO: 7362304 - DNA, 22 bp, Homo sapiens
tgcacacaagttggagaatgaa

SEQ ID NO: 7362305 - DNA, 22 bp, Homo sapiens
tgcacacaaatgtgaacgtgcc

SEQ ID NO: 7362306 - DNA, 22 bp, Homo sapiens
tgcacacaagttggagaatgaa

SEQ ID NO: 7362307 - DNA, 22 bp, Homo sapiens
tgcacaaaggctccctgctgag

SEQ ID NO: 7362308 - DNA, 22 bp, Homo sapiens
tgcacaaatttgtgtatgctca

SEQ ID NO: 7362309 - DNA, 17 bp, Homo sapiens
tgcacaagagacaatag

SEQ ID NO: 7362310 - DNA, 20 bp, Homo sapiens
tgcacacaccctgtcctcca

SEQ ID NO: 7362311 - DNA, 22 bp, Homo sapiens
tgcacacaccgtgcttcactga

SEQ ID NO: 7362312 - DNA, 22 bp, Homo sapiens
tgcacacacgcggcacatctgt

SEQ ID NO: 7362313 - DNA, 22 bp, Homo sapiens
tgcacacacggagataggcttt

SEQ ID NO: 7362314 - DNA, 22 bp, Homo sapiens
tgcacacactcgtgtatatgag

SEQ ID NO: 7362315 - DNA, 22 bp, Homo sapiens
tgcacacacggagataggcttt

SEQ ID NO: 7362316 - DNA, 22 bp, Homo sapiens
tgcacacacacgtagagaaaag

SEQ ID NO: 7362317 - DNA, 22 bp, Homo sapiens
tgcacacacaggagtctcctcc

SEQ ID NO: 7362318 - DNA, 22 bp, Homo sapiens
tgcacacacatgaagtagcatg

SEQ ID NO: 7362319 - DNA, 22 bp, Homo sapiens
tgcacacacatgaagtagcatg

SEQ ID NO: 7362320 - DNA, 22 bp, Homo sapiens
tgcacacacatgcagagggaga

SEQ ID NO: 7362321 - DNA, 22 bp, Homo sapiens
tgcacacacatgcagagggaga

SEQ ID NO: 7362322 - DNA, 20 bp, Homo sapiens
tgcacacagaaatttgcatt

SEQ ID NO: 7362323 - DNA, 19 bp, Homo sapiens
tgcacacagataagtatct

SEQ ID NO: 7362324 - DNA, 22 bp, Homo sapiens
tgcacacactctgcatatactt

SEQ ID NO: 7362325 - DNA, 22 bp, Homo sapiens
tgcacacaggtctaggacatgg

SEQ ID NO: 7362326 - DNA, 22 bp, Homo sapiens
tgcacacagtggacaagtcttg

SEQ ID NO: 7362327 - DNA, 22 bp, Homo sapiens
tgcacacaggtctaggacatgg

SEQ ID NO: 7362328 - DNA, 22 bp, Homo sapiens
tgcacacagccagtgagtggca

SEQ ID NO: 7362329 - DNA, 22 bp, Homo sapiens
tgcacacagctgggcctggctg

SEQ ID NO: 7362330 - DNA, 22 bp, Homo sapiens
tgcacacagccagtgagtggca

SEQ ID NO: 7362331 - DNA, 22 bp, Homo sapiens
tgcacacagatggtacatgcat

SEQ ID NO: 7362332 - DNA, 22 bp, Homo sapiens
tgcaactggaagggttatgtgg

SEQ ID NO: 7362333 - DNA, 22 bp, Homo sapiens
tgcaagaaacatattccacaag

SEQ ID NO: 7362334 - DNA, 21 bp, Homo sapiens
tgcaagaatcaggaagctgcc

SEQ ID NO: 7362335 - DNA, 22 bp, Homo sapiens
tgcaagagcccagggccaggaa

SEQ ID NO: 7362336 - DNA, 22 bp, Homo sapiens
tgcaagggtagaagtgatggca

SEQ ID NO: 7362337 - DNA, 22 bp, Homo sapiens
tgcagaaaccaattcaagtaag

SEQ ID NO: 7362338 - DNA, 22 bp, Homo sapiens
tgcagaaagcattgactcttcc

SEQ ID NO: 7362339 - DNA, 22 bp, Homo sapiens
tgcagaaagcattgactcttcc

SEQ ID NO: 7362340 - DNA, 22 bp, Homo sapiens
tgcagaaaccaattcaagtaag

SEQ ID NO: 7362341 - DNA, 22 bp, Homo sapiens
tgcagaaataaagatattatca

SEQ ID NO: 7362342 - DNA, 22 bp, Homo sapiens
tgcagaaataaagatattatca

SEQ ID NO: 7362343 - DNA, 22 bp, Homo sapiens
tgcagaaataactcatattgca

SEQ ID NO: 7362344 - DNA, 21 bp, Homo sapiens
tgcagaaagcggcttgaagca

SEQ ID NO: 7362345 - DNA, 22 bp, Homo sapiens
tgcagaaaggaggggtgggaat

SEQ ID NO: 7362346 - DNA, 22 bp, Homo sapiens
tgcagaaagtcacattcccttt

SEQ ID NO: 7362347 - DNA, 22 bp, Homo sapiens
tgcagaaattcagaaagcataa

SEQ ID NO: 7362348 - DNA, 22 bp, Homo sapiens
tgcagaaattcagaaagcataa

SEQ ID NO: 7362349 - DNA, 21 bp, Homo sapiens
tgcagaaatggtttttctaag

SEQ ID NO: 7362350 - DNA, 22 bp, Homo sapiens
tgcagaaatcacatttaaccct

SEQ ID NO: 7362351 - DNA, 21 bp, Homo sapiens
tgcagaaatggtttttctaag

SEQ ID NO: 7362352 - DNA, 22 bp, Homo sapiens
tgcacgtgcaagcacagataga

SEQ ID NO: 7362353 - DNA, 22 bp, Homo sapiens
tgcagaaacagtcattaatgta

SEQ ID NO: 7362354 - DNA, 22 bp, Homo sapiens
tgcagaaacagagttttgccat

SEQ ID NO: 7362355 - DNA, 22 bp, Homo sapiens
tgcagaaacaagccatcattca

SEQ ID NO: 7362356 - DNA, 22 bp, Homo sapiens
tgcagaaggcctgacattgcac

SEQ ID NO: 7362357 - DNA, 19 bp, Homo sapiens
tgcagaagacacagtggtg

SEQ ID NO: 7362358 - DNA, 22 bp, Homo sapiens
tgcagaagaatgtaggcataag

SEQ ID NO: 7362359 - DNA, 22 bp, Homo sapiens
tgcacaggtgagactcaggaag

SEQ ID NO: 7362360 - DNA, 21 bp, Homo sapiens
tgcacagggcccaggagagcc

SEQ ID NO: 7362361 - DNA, 22 bp, Homo sapiens
tgcacacagttctcaggaaaga

SEQ ID NO: 7362362 - DNA, 22 bp, Homo sapiens
tgcacacagttctcaggaaaga

SEQ ID NO: 7362363 - DNA, 22 bp, Homo sapiens
tgcacacatacatgggaagtgc

SEQ ID NO: 7362364 - DNA, 22 bp, Homo sapiens
tgcaccctcatcagtcaaatgg

SEQ ID NO: 7362365 - DNA, 22 bp, Homo sapiens
tgcaccattttgtcaggctact

SEQ ID NO: 7362366 - DNA, 22 bp, Homo sapiens
tgcaccatgtaagtggccacgt

SEQ ID NO: 7362367 - DNA, 22 bp, Homo sapiens
tgcaccattaatttatgtgaga

SEQ ID NO: 7362368 - DNA, 22 bp, Homo sapiens
tgcaccatacccattcccctct

SEQ ID NO: 7362369 - DNA, 21 bp, Homo sapiens
tgcacctgtgccccatccttc

SEQ ID NO: 7362370 - DNA, 22 bp, Homo sapiens
tgcacctggactaactaactca

SEQ ID NO: 7362371 - DNA, 22 bp, Homo sapiens
tgcacctgctcagactcctgtc

SEQ ID NO: 7362372 - DNA, 22 bp, Homo sapiens
tgcacctgcaatacctgtacct

SEQ ID NO: 7362373 - DNA, 22 bp, Homo sapiens
tgcacctgagaggtctctgagg

SEQ ID NO: 7362374 - DNA, 22 bp, Homo sapiens
tgcacattgaaatgaccagctg

SEQ ID NO: 7362375 - DNA, 22 bp, Homo sapiens
tgcacattgaatgagcaaactg

SEQ ID NO: 7362376 - DNA, 22 bp, Homo sapiens
tgcacatttgttattttgaggt

SEQ ID NO: 7362377 - DNA, 22 bp, Homo sapiens
tgcacattcacttaggtattgt

SEQ ID NO: 7362378 - DNA, 22 bp, Homo sapiens
tgcacattagtgtttgagatgc

SEQ ID NO: 7362379 - DNA, 20 bp, Homo sapiens
tgcacatggcagccatctag

SEQ ID NO: 7362380 - DNA, 22 bp, Homo sapiens
tgcacagttcgccttctccaag

SEQ ID NO: 7362381 - DNA, 22 bp, Homo sapiens
tgcacagtgtaatgaatcagaa

SEQ ID NO: 7362382 - DNA, 22 bp, Homo sapiens
tgcacaggtgagactcaggaag

SEQ ID NO: 7362383 - DNA, 22 bp, Homo sapiens
tgcagaggagtcagcctgggca

SEQ ID NO: 7362384 - DNA, 22 bp, Homo sapiens
tgcagaggagtcagcctgggca

SEQ ID NO: 7362385 - DNA, 22 bp, Homo sapiens
tgcagaggagtcagcctgggca

SEQ ID NO: 7362386 - DNA, 22 bp, Homo sapiens
tgcagaggagctggaaggctgg

SEQ ID NO: 7362387 - DNA, 22 bp, Homo sapiens
tgcagaggagctggaaggctgg

SEQ ID NO: 7362388 - DNA, 22 bp, Homo sapiens
tgcagaggcgccgtgggtgggg

SEQ ID NO: 7362389 - DNA, 22 bp, Homo sapiens
tgcagaggcgccgtgggtgggg

SEQ ID NO: 7362390 - DNA, 22 bp, Homo sapiens
tgcagagggaaaaggtgctcct

SEQ ID NO: 7362391 - DNA, 22 bp, Homo sapiens
tgcagaggctggctcgccgggt

SEQ ID NO: 7362392 - DNA, 22 bp, Homo sapiens
tgcagaggcatttattgatgta

SEQ ID NO: 7362393 - DNA, 22 bp, Homo sapiens
tgcagaggcccagcggttcttc

SEQ ID NO: 7362394 - DNA, 22 bp, Homo sapiens
tgcagaggcatttattgatgta

SEQ ID NO: 7362395 - DNA, 22 bp, Homo sapiens
tgcagagatcctggactgagcg

SEQ ID NO: 7362396 - DNA, 22 bp, Homo sapiens
tgcagaggagctggaaggctgg

SEQ ID NO: 7362397 - DNA, 22 bp, Homo sapiens
tgcagaggaccattgtcctgga

SEQ ID NO: 7362398 - DNA, 22 bp, Homo sapiens
tgcagagaaaccagtggaggac

SEQ ID NO: 7362399 - DNA, 19 bp, Homo sapiens
tgcagagggtaggaaggcc

SEQ ID NO: 7362400 - DNA, 19 bp, Homo sapiens
tgcagagggtaggaaggcc

SEQ ID NO: 7362401 - DNA, 22 bp, Homo sapiens
tgcagagggagtgacggttcac

SEQ ID NO: 7362402 - DNA, 23 bp, Homo sapiens
tgcagagggactgaagccagctt

SEQ ID NO: 7362403 - DNA, 22 bp, Homo sapiens
tgcagagggagtgacggttcac

SEQ ID NO: 7362404 - DNA, 23 bp, Homo sapiens
tgcagagggactgaagccagctt

SEQ ID NO: 7362405 - DNA, 22 bp, Homo sapiens
tgcagagggaaaaggtgctcct

SEQ ID NO: 7362406 - DNA, 22 bp, Homo sapiens
tgcagagggacagccacagctc

SEQ ID NO: 7362407 - DNA, 20 bp, Homo sapiens
tgcagcagaagcccatgctc

SEQ ID NO: 7362408 - DNA, 22 bp, Homo sapiens
tgcagcactgttcacaatagcc

SEQ ID NO: 7362409 - DNA, 22 bp, Homo sapiens
tgcagcaaatggggcccgtcct

SEQ ID NO: 7362410 - DNA, 22 bp, Homo sapiens
tgcagcaacaagatagaatggc

SEQ ID NO: 7362411 - DNA, 22 bp, Homo sapiens
tgcagcaagaaggcactgtctg

SEQ ID NO: 7362412 - DNA, 22 bp, Homo sapiens
tgcagatgagggatgaaaatga

SEQ ID NO: 7362413 - DNA, 22 bp, Homo sapiens
tgcaggagctgtgcggtgaggg

SEQ ID NO: 7362414 - DNA, 22 bp, Homo sapiens
tgcaggagccttggacttgaaa

SEQ ID NO: 7362415 - DNA, 22 bp, Homo sapiens
tgcaggaggctttattcaggat

SEQ ID NO: 7362416 - DNA, 22 bp, Homo sapiens
tgcaggagtccaatcaggagac

SEQ ID NO: 7362417 - DNA, 22 bp, Homo sapiens
tgcaggagtccaatcaggagac

SEQ ID NO: 7362418 - DNA, 22 bp, Homo sapiens
tgcaggaggattttgtggagct

SEQ ID NO: 7362419 - DNA, 22 bp, Homo sapiens
tgcaggagttaagtgctctcct

SEQ ID NO: 7362420 - DNA, 21 bp, Homo sapiens
tgcaggagtctgtgagtcagg

SEQ ID NO: 7362421 - DNA, 18 bp, Homo sapiens
tgcaggagtgaccccggc

SEQ ID NO: 7362422 - DNA, 18 bp, Homo sapiens
tgcaggagtgaccccggc

SEQ ID NO: 7362423 - DNA, 22 bp, Homo sapiens
tgcaggagcagagatggctgga

SEQ ID NO: 7362424 - DNA, 22 bp, Homo sapiens
tgcaggagcagagatggctgga

SEQ ID NO: 7362425 - DNA, 22 bp, Homo sapiens
tgcaggagagctggtctggccc

SEQ ID NO: 7362426 - DNA, 22 bp, Homo sapiens
tgcaggagataatggtgcttag

SEQ ID NO: 7362427 - DNA, 22 bp, Homo sapiens
tgcaggagaaagtacggagcgt

SEQ ID NO: 7362428 - DNA, 22 bp, Homo sapiens
tgcaggagacataatagggact

SEQ ID NO: 7362429 - DNA, 20 bp, Homo sapiens
tgcagctggtttcacaggga

SEQ ID NO: 7362430 - DNA, 22 bp, Homo sapiens
tgcagcttcaaagaacctttcc

SEQ ID NO: 7362431 - DNA, 20 bp, Homo sapiens
tgcagcttctcatcttcaaa

SEQ ID NO: 7362432 - DNA, 22 bp, Homo sapiens
tgcagccattttctgccaatgc

SEQ ID NO: 7362433 - DNA, 21 bp, Homo sapiens
tgcagccattcagccctatgc

SEQ ID NO: 7362434 - DNA, 22 bp, Homo sapiens
tgcagcaggtatggcaagctcc

SEQ ID NO: 7362435 - DNA, 22 bp, Homo sapiens
tgcagccaggaaatatttgctg

SEQ ID NO: 7362436 - DNA, 22 bp, Homo sapiens
tgcagcctagacattctggtca

SEQ ID NO: 7362437 - DNA, 22 bp, Homo sapiens
tgcagcctctctgcttcaggaa

SEQ ID NO: 7362438 - DNA, 21 bp, Homo sapiens
tgcagcctctgcccagcagtg

SEQ ID NO: 7362439 - DNA, 22 bp, Homo sapiens
tgcagcctggcttcgcgcctcc

SEQ ID NO: 7362440 - DNA, 22 bp, Homo sapiens
tgcagcctggtggtcactggag

SEQ ID NO: 7362441 - DNA, 18 bp, Homo sapiens
tgcagcctgtagtcttgt

SEQ ID NO: 7362442 - DNA, 22 bp, Homo sapiens
tgcagcagagtgggcctgggtg

SEQ ID NO: 7362443 - DNA, 21 bp, Homo sapiens
tgcagcagagtaagcagggga

SEQ ID NO: 7362444 - DNA, 22 bp, Homo sapiens
tgcagcagaatatggctgcagg

SEQ ID NO: 7362445 - DNA, 22 bp, Homo sapiens
tgcagcaggagccaggcctggt

SEQ ID NO: 7362446 - DNA, 22 bp, Homo sapiens
tgcagcaggagccaggcctggt

SEQ ID NO: 7362447 - DNA, 22 bp, Homo sapiens
tgcagccttggcaaccagggac

SEQ ID NO: 7362448 - DNA, 22 bp, Homo sapiens
tctgaaatagaagtgtctttct

SEQ ID NO: 7362449 - DNA, 22 bp, Homo sapiens
tctgaaatgcaggcaatttgct

SEQ ID NO: 7362450 - DNA, 22 bp, Homo sapiens
tctgaacatcctacaacatttt

SEQ ID NO: 7362451 - DNA, 22 bp, Homo sapiens
tctgaaggcctggagggtccca

SEQ ID NO: 7362452 - DNA, 22 bp, Homo sapiens
tctctttaagtataatcttata

SEQ ID NO: 7362453 - DNA, 23 bp, Homo sapiens
tctctttcaagagcttaatgtgc

SEQ ID NO: 7362454 - DNA, 22 bp, Homo sapiens
tctcttgttgggtatatgaaat

SEQ ID NO: 7362455 - DNA, 21 bp, Homo sapiens
tctctttctggaagcttccct

SEQ ID NO: 7362456 - DNA, 22 bp, Homo sapiens
tctctttctttgtatgtctatt

SEQ ID NO: 7362457 - DNA, 17 bp, Homo sapiens
tctctttccctttctgc

SEQ ID NO: 7362458 - DNA, 18 bp, Homo sapiens
tctctttcctcagtggag

SEQ ID NO: 7362459 - DNA, 22 bp, Homo sapiens
tctgaaaatgttgactttgttt

SEQ ID NO: 7362460 - DNA, 22 bp, Homo sapiens
tctgaaaatgttgactttgttt

SEQ ID NO: 7362461 - DNA, 22 bp, Homo sapiens
tctgaaataaatgcactgttag

SEQ ID NO: 7362462 - DNA, 21 bp, Homo sapiens
tctctgtgtctttaagctgga

SEQ ID NO: 7362463 - DNA, 22 bp, Homo sapiens
tctctgtgtcttagtgaaggga

SEQ ID NO: 7362464 - DNA, 21 bp, Homo sapiens
tctctgtgtctttaagctgga

SEQ ID NO: 7362465 - DNA, 21 bp, Homo sapiens
tctcttcctccgcgccgccgc

SEQ ID NO: 7362466 - DNA, 22 bp, Homo sapiens
tctcttcctagtgatgggcttt

SEQ ID NO: 7362467 - DNA, 22 bp, Homo sapiens
tctcttccagtaagagtcttta

SEQ ID NO: 7362468 - DNA, 22 bp, Homo sapiens
tctcttccatgtttcagcccca

SEQ ID NO: 7362469 - DNA, 19 bp, Homo sapiens
tctcttctccctggtttta

SEQ ID NO: 7362470 - DNA, 22 bp, Homo sapiens
tctcttctaattttcccgagta

SEQ ID NO: 7362471 - DNA, 22 bp, Homo sapiens
tctcttctaattagggtccatg

SEQ ID NO: 7362472 - DNA, 18 bp, Homo sapiens
tctcttcttggcagtcaa

SEQ ID NO: 7362473 - DNA, 22 bp, Homo sapiens
tctctgtgggctttggacttga

SEQ ID NO: 7362474 - DNA, 22 bp, Homo sapiens
tctctgtgggtttcaccagcgc

SEQ ID NO: 7362475 - DNA, 22 bp, Homo sapiens
tctctgtggtactgagagtcta

SEQ ID NO: 7362476 - DNA, 22 bp, Homo sapiens
tctctgtggtatgtcatagcaa

SEQ ID NO: 7362477 - DNA, 21 bp, Homo sapiens
tctctgtggtccaatcccagc

SEQ ID NO: 7362478 - DNA, 22 bp, Homo sapiens
tctctgtgtcctgaaatgaagg

SEQ ID NO: 7362479 - DNA, 21 bp, Homo sapiens
tctctgtgtacagtctcaccc

SEQ ID NO: 7362480 - DNA, 22 bp, Homo sapiens
tctctgtggtttgagagccggg

SEQ ID NO: 7362481 - DNA, 21 bp, Homo sapiens
tctctgtgtacagtctcaccc

SEQ ID NO: 7362482 - DNA, 22 bp, Homo sapiens
tctctgtggtgggaggctgagt

SEQ ID NO: 7362483 - DNA, 22 bp, Homo sapiens
tctctgtgtctcatgttcctat

SEQ ID NO: 7362484 - DNA, 19 bp, Homo sapiens
tctctgtgtctctgtttat

SEQ ID NO: 7362485 - DNA, 22 bp, Homo sapiens
tctctgtggcaagcatgctgct

SEQ ID NO: 7362486 - DNA, 22 bp, Homo sapiens
tctctgtggcaactacttagct

SEQ ID NO: 7362487 - DNA, 22 bp, Homo sapiens
tctctgtggcatccactcaact

SEQ ID NO: 7362488 - DNA, 21 bp, Homo sapiens
tctctgtggcctaccctctac

SEQ ID NO: 7362489 - DNA, 22 bp, Homo sapiens
tctctgtgcttgactttcccat

SEQ ID NO: 7362490 - DNA, 22 bp, Homo sapiens
tctctgtggcaacaattcacta

SEQ ID NO: 7362491 - DNA, 22 bp, Homo sapiens
tctctgtggagcagtgtgttca

SEQ ID NO: 7362492 - DNA, 22 bp, Homo sapiens
tctctgtgcaggatgctgagtt

SEQ ID NO: 7362493 - DNA, 22 bp, Homo sapiens
tctctgtgcccagtagttctct

SEQ ID NO: 7362494 - DNA, 22 bp, Homo sapiens
tctctgtgagtggaaggcaccc

SEQ ID NO: 7362495 - DNA, 22 bp, Homo sapiens
tctctgtgagatgccttcctga

SEQ ID NO: 7362496 - DNA, 22 bp, Homo sapiens
tctctgtgagccaggtcctagt

SEQ ID NO: 7362497 - DNA, 22 bp, Homo sapiens
tctctgtgagatttgtattaag

SEQ ID NO: 7362498 - DNA, 22 bp, Homo sapiens
tctctgtgacagctgggtatgt

SEQ ID NO: 7362499 - DNA, 22 bp, Homo sapiens
tctctgtgaatggcgtcacctg

SEQ ID NO: 7362500 - DNA, 22 bp, Homo sapiens
tctctgtgaagctcccgttagg

SEQ ID NO: 7362501 - DNA, 22 bp, Homo sapiens
tctctgtgacatttctgagcct

SEQ ID NO: 7362502 - DNA, 22 bp, Homo sapiens
tctctgtgactgcagctttgca

SEQ ID NO: 7362503 - DNA, 21 bp, Homo sapiens
tctctggagttagcagagaga

SEQ ID NO: 7362504 - DNA, 22 bp, Homo sapiens
tctctggcagacacctccctga

SEQ ID NO: 7362505 - DNA, 22 bp, Homo sapiens
tctctggcagaggccctatccc

SEQ ID NO: 7362506 - DNA, 19 bp, Homo sapiens
tctctgcttctcttggcat

SEQ ID NO: 7362507 - DNA, 22 bp, Homo sapiens
tctctgctcaggcaccagccct

SEQ ID NO: 7362508 - DNA, 19 bp, Homo sapiens
tctctgcttctcttggcat

SEQ ID NO: 7362509 - DNA, 23 bp, Homo sapiens
tctctggaactggagagtacggt

SEQ ID NO: 7362510 - DNA, 22 bp, Homo sapiens
tctctggaattggctgaggcaa

SEQ ID NO: 7362511 - DNA, 22 bp, Homo sapiens
tctctggacttccacctctatt

SEQ ID NO: 7362512 - DNA, 22 bp, Homo sapiens
tctctggagctgcagatccagg

SEQ ID NO: 7362513 - DNA, 22 bp, Homo sapiens
tctctggagggctccaggcggg

SEQ ID NO: 7362514 - DNA, 22 bp, Homo sapiens
tctctggagtataaccagggat

SEQ ID NO: 7362515 - DNA, 22 bp, Homo sapiens
tctctgggcctgttttctcatc

SEQ ID NO: 7362516 - DNA, 22 bp, Homo sapiens
tctctgggttctcactcagcac

SEQ ID NO: 7362517 - DNA, 23 bp, Homo sapiens
tctctgggtgggctgtgtctata

SEQ ID NO: 7362518 - DNA, 22 bp, Homo sapiens
tctctcagaggaagaggcagtg

SEQ ID NO: 7362519 - DNA, 22 bp, Homo sapiens
tctctcaggctggagtgcagtg

SEQ ID NO: 7362520 - DNA, 22 bp, Homo sapiens
tctctcctgtgttctgatgttt

SEQ ID NO: 7362521 - DNA, 22 bp, Homo sapiens
tctctcctgcactgaattatgt

SEQ ID NO: 7362522 - DNA, 21 bp, Homo sapiens
tctctcctcaagctcgacccc

SEQ ID NO: 7362523 - DNA, 22 bp, Homo sapiens
tctctcctaatttcaggtgctt

SEQ ID NO: 7362524 - DNA, 22 bp, Homo sapiens
tctctctgagttgagcaggagt

SEQ ID NO: 7362525 - DNA, 18 bp, Homo sapiens
tctctctgaagagttccc

SEQ ID NO: 7362526 - DNA, 18 bp, Homo sapiens
tctctctgaagagttccc

SEQ ID NO: 7362527 - DNA, 22 bp, Homo sapiens
tctctctactggggcactagga

SEQ ID NO: 7362528 - DNA, 18 bp, Homo sapiens
tctctgagaatattaatg

SEQ ID NO: 7362529 - DNA, 20 bp, Homo sapiens
tctctctggttggaggagct

SEQ ID NO: 7362530 - DNA, 22 bp, Homo sapiens
tctctgagttcctgtggatttt

SEQ ID NO: 7362531 - DNA, 22 bp, Homo sapiens
tctcattttgagtcagacacta

SEQ ID NO: 7362532 - DNA, 22 bp, Homo sapiens
tctcatttgtgtgcaattcaga

SEQ ID NO: 7362533 - DNA, 22 bp, Homo sapiens
tctcatttgcctcatctataaa

SEQ ID NO: 7362534 - DNA, 22 bp, Homo sapiens
tctcatttggctttgttttaaa

SEQ ID NO: 7362535 - DNA, 22 bp, Homo sapiens
tctcatttggctttgttttaaa

SEQ ID NO: 7362536 - DNA, 22 bp, Homo sapiens
tctcatttgcctcatctataaa

SEQ ID NO: 7362537 - DNA, 23 bp, Homo sapiens
tctcatttcccttgatctatctt

SEQ ID NO: 7362538 - DNA, 22 bp, Homo sapiens
tctcattcataccctacatgct

SEQ ID NO: 7362539 - DNA, 22 bp, Homo sapiens
tctcattcatccaaggatttat

SEQ ID NO: 7362540 - DNA, 22 bp, Homo sapiens
tctcatggttctaaaggtcgca

SEQ ID NO: 7362541 - DNA, 22 bp, Homo sapiens
tctccaagaaaagatctcagct

SEQ ID NO: 7362542 - DNA, 22 bp, Homo sapiens
tctccaagaaaagatctcagct

SEQ ID NO: 7362543 - DNA, 22 bp, Homo sapiens
tctccaagcagggctgcaaggc

SEQ ID NO: 7362544 - DNA, 22 bp, Homo sapiens
tctccaaggagctcctgtgccg

SEQ ID NO: 7362545 - DNA, 22 bp, Homo sapiens
tctccacaagctgatgctagga

SEQ ID NO: 7362546 - DNA, 22 bp, Homo sapiens
tctccaggactgagctccagcc

SEQ ID NO: 7362547 - DNA, 22 bp, Homo sapiens
tctccaggcacttggctgctac

SEQ ID NO: 7362548 - DNA, 22 bp, Homo sapiens
tctccaggagcaagtcacccag

SEQ ID NO: 7362549 - DNA, 23 bp, Homo sapiens
tctccaggccttactccaggcct

SEQ ID NO: 7362550 - DNA, 22 bp, Homo sapiens
tctcaggggcctggagtcctgg

SEQ ID NO: 7362551 - DNA, 22 bp, Homo sapiens
tctcaggggcagtgatcctaag

SEQ ID NO: 7362552 - DNA, 22 bp, Homo sapiens
tctcatgatgcctatgcagggt

SEQ ID NO: 7362553 - DNA, 22 bp, Homo sapiens
tctcatggcttgtaggaggtga

SEQ ID NO: 7362554 - DNA, 22 bp, Homo sapiens
tctcatgccctgtttttggttg

SEQ ID NO: 7362555 - DNA, 22 bp, Homo sapiens
tctcatgcctggaattatcatt

SEQ ID NO: 7362556 - DNA, 22 bp, Homo sapiens
tctcatgctgtagtgcactaac

SEQ ID NO: 7362557 - DNA, 22 bp, Homo sapiens
tctcatgctgtagtgcactaac

SEQ ID NO: 7362558 - DNA, 22 bp, Homo sapiens
tctcatcattccttcaaagccc

SEQ ID NO: 7362559 - DNA, 22 bp, Homo sapiens
tctcacagttgtccactgaaaa

SEQ ID NO: 7362560 - DNA, 22 bp, Homo sapiens
tctcactgcaaatattatgtat

SEQ ID NO: 7362561 - DNA, 23 bp, Homo sapiens
tctcagaaaggagaagtaatttg

SEQ ID NO: 7362562 - DNA, 23 bp, Homo sapiens
tctcagaggattcctgggccttg

SEQ ID NO: 7362563 - DNA, 19 bp, Homo sapiens
tctcagaggaaaaattgct

SEQ ID NO: 7362564 - DNA, 18 bp, Homo sapiens
tctcagaggccatcctag

SEQ ID NO: 7362565 - DNA, 22 bp, Homo sapiens
tctcagagcctaactaacctaa

SEQ ID NO: 7362566 - DNA, 22 bp, Homo sapiens
tctcagagctcacacctcctgg

SEQ ID NO: 7362567 - DNA, 22 bp, Homo sapiens
tctcagagcttcagaaagcacc

SEQ ID NO: 7362568 - DNA, 22 bp, Homo sapiens
tctcagagcttcagttattttc

SEQ ID NO: 7362569 - DNA, 19 bp, Homo sapiens
tctcagagccctagaggcc

SEQ ID NO: 7362570 - DNA, 22 bp, Homo sapiens
tctcagagcatcattttcttag

SEQ ID NO: 7362571 - DNA, 22 bp, Homo sapiens
tctcagagattcagggagaagt

SEQ ID NO: 7362572 - DNA, 22 bp, Homo sapiens
tctcagagattttgtttccctt

SEQ ID NO: 7362573 - DNA, 22 bp, Homo sapiens
tctcagagcatcattttcttag

SEQ ID NO: 7362574 - DNA, 22 bp, Homo sapiens
tctcagagatttatggaaaact

SEQ ID NO: 7362575 - DNA, 22 bp, Homo sapiens
tctcagagaggggccgggcctt

SEQ ID NO: 7362576 - DNA, 22 bp, Homo sapiens
tctcagagagctgtgttttcct

SEQ ID NO: 7362577 - DNA, 22 bp, Homo sapiens
tctcagagagctgtgttttcct

SEQ ID NO: 7362578 - DNA, 22 bp, Homo sapiens
tctcagagaggggccgggcctt

SEQ ID NO: 7362579 - DNA, 22 bp, Homo sapiens
tctcagagatctttctgcatgt

SEQ ID NO: 7362580 - DNA, 22 bp, Homo sapiens
tctcagagatgtcaagagtcta

SEQ ID NO: 7362581 - DNA, 22 bp, Homo sapiens
tctcagagatgttagggaagag

SEQ ID NO: 7362582 - DNA, 22 bp, Homo sapiens
tctcagaactttatatgtatca

SEQ ID NO: 7362583 - DNA, 22 bp, Homo sapiens
tctcagaacctcagtttgctct

SEQ ID NO: 7362584 - DNA, 22 bp, Homo sapiens
tctcagagggaaacatgagtga

SEQ ID NO: 7362585 - DNA, 22 bp, Homo sapiens
tctcagaggcccgacgttctcc

SEQ ID NO: 7362586 - DNA, 22 bp, Homo sapiens
tctcagagggaggattactgcc

SEQ ID NO: 7362587 - DNA, 22 bp, Homo sapiens
tctcagagggaaaggccaattt

SEQ ID NO: 7362588 - DNA, 22 bp, Homo sapiens
tctcagaggtgccctggcatct

SEQ ID NO: 7362589 - DNA, 22 bp, Homo sapiens
tctcagaggtcttcagcctctg

SEQ ID NO: 7362590 - DNA, 22 bp, Homo sapiens
tctcagagtggtggtccctctg

SEQ ID NO: 7362591 - DNA, 22 bp, Homo sapiens
tctcagagttcctctggagtcc

SEQ ID NO: 7362592 - DNA, 22 bp, Homo sapiens
tctcagagttcctctggagtcc

SEQ ID NO: 7362593 - DNA, 22 bp, Homo sapiens
tctcagagtgacaatgagaatt

SEQ ID NO: 7362594 - DNA, 22 bp, Homo sapiens
tctcagagtgacaatgagaatt

SEQ ID NO: 7362595 - DNA, 22 bp, Homo sapiens
tctcagagtaattctttaaggt

SEQ ID NO: 7362596 - DNA, 22 bp, Homo sapiens
tctcagcagggccatcctgagc

SEQ ID NO: 7362597 - DNA, 22 bp, Homo sapiens
tctcagcagccagatccagagc

SEQ ID NO: 7362598 - DNA, 22 bp, Homo sapiens
tctcagcacgttgttttcattg

SEQ ID NO: 7362599 - DNA, 22 bp, Homo sapiens
tctcagagtttagagctgagcc

SEQ ID NO: 7362600 - DNA, 22 bp, Homo sapiens
tctcagagtttgaatctggagt

SEQ ID NO: 7362601 - DNA, 22 bp, Homo sapiens
tctcagagtttttttccaggac

SEQ ID NO: 7362602 - DNA, 22 bp, Homo sapiens
tctcagagtttacggggctgaa

SEQ ID NO: 7362603 - DNA, 22 bp, Homo sapiens
tctcagagtttagagctgagcc

SEQ ID NO: 7362604 - DNA, 18 bp, Homo sapiens
tctcagcccagctccggc

SEQ ID NO: 7362605 - DNA, 22 bp, Homo sapiens
tctcctggcatttggttgagta

SEQ ID NO: 7362606 - DNA, 22 bp, Homo sapiens
tctcctctgtgccacagcttgg

SEQ ID NO: 7362607 - DNA, 22 bp, Homo sapiens
tctcctctgcgcggcagtgccc

SEQ ID NO: 7362608 - DNA, 22 bp, Homo sapiens
tctcctctatttctgtatgtat

SEQ ID NO: 7362609 - DNA, 22 bp, Homo sapiens
tctcctctactgggtctgcaga

SEQ ID NO: 7362610 - DNA, 22 bp, Homo sapiens
tctcctctcttacctggtacaa

SEQ ID NO: 7362611 - DNA, 22 bp, Homo sapiens
tctcctcccaggctcttccagg

SEQ ID NO: 7362612 - DNA, 22 bp, Homo sapiens
tctcctctactgggtctgcaga

SEQ ID NO: 7362613 - DNA, 22 bp, Homo sapiens
tctcctgtgcaccctccctgtg

SEQ ID NO: 7362614 - DNA, 22 bp, Homo sapiens
tctcctgtcttctcagcacccc

SEQ ID NO: 7362615 - DNA, 22 bp, Homo sapiens
tctcctgtatgggactggcgag

SEQ ID NO: 7362616 - DNA, 22 bp, Homo sapiens
tctcctgggtaaaagggttgat

SEQ ID NO: 7362617 - DNA, 22 bp, Homo sapiens
tctcctgggcttggttgaagtt

SEQ ID NO: 7362618 - DNA, 22 bp, Homo sapiens
tctccttgtgctgggtccttcc

SEQ ID NO: 7362619 - DNA, 22 bp, Homo sapiens
tctccttgctacccagtatgtc

SEQ ID NO: 7362620 - DNA, 22 bp, Homo sapiens
tctccttgtaagtaaattttac

SEQ ID NO: 7362621 - DNA, 22 bp, Homo sapiens
tctccttgacaggcaggcagac

SEQ ID NO: 7362622 - DNA, 22 bp, Homo sapiens
tctccaggtggcttgggcttct

SEQ ID NO: 7362623 - DNA, 19 bp, Homo sapiens
tctccaggtgccccaaaca

SEQ ID NO: 7362624 - DNA, 22 bp, Homo sapiens
tctccaggtgaaacttgcaggg

SEQ ID NO: 7362625 - DNA, 22 bp, Homo sapiens
tctccaggtaaatggcatcctg

SEQ ID NO: 7362626 - DNA, 22 bp, Homo sapiens
tctccaggtagatatgtcagga

SEQ ID NO: 7362627 - DNA, 22 bp, Homo sapiens
tctccaggtggggtcacctttt

SEQ ID NO: 7362628 - DNA, 22 bp, Homo sapiens
tctccaggttcagtcgatggaa

SEQ ID NO: 7362629 - DNA, 22 bp, Homo sapiens
tctcccagaggatcccagtgga

SEQ ID NO: 7362630 - DNA, 22 bp, Homo sapiens
tctccaggggcagggtctggag

SEQ ID NO: 7362631 - DNA, 22 bp, Homo sapiens
tctccaggtaaatggcatcctg

SEQ ID NO: 7362632 - DNA, 22 bp, Homo sapiens
tctccaggtaaatggcatcctg

SEQ ID NO: 7362633 - DNA, 22 bp, Homo sapiens
tctccagggtgagctaggccag

SEQ ID NO: 7362634 - DNA, 22 bp, Homo sapiens
tctccagggtgagctaggccag

SEQ ID NO: 7362635 - DNA, 22 bp, Homo sapiens
tctccaggggctgctgtgccac

SEQ ID NO: 7362636 - DNA, 22 bp, Homo sapiens
tctccagggactgaggctggag

SEQ ID NO: 7362637 - DNA, 22 bp, Homo sapiens
tctccagggacatgtttctgga

SEQ ID NO: 7362638 - DNA, 22 bp, Homo sapiens
tctccaggcctttcccatctta

SEQ ID NO: 7362639 - DNA, 22 bp, Homo sapiens
tctcccaggctggagtgcagtg

SEQ ID NO: 7362640 - DNA, 22 bp, Homo sapiens
tctcccaggcaggagtgcagtg

SEQ ID NO: 7362641 - DNA, 20 bp, Homo sapiens
tctcccaggctcagggaaga

SEQ ID NO: 7362642 - DNA, 22 bp, Homo sapiens
tctagggttgaggccacaggga

SEQ ID NO: 7362643 - DNA, 22 bp, Homo sapiens
tctataaagggccagatagtag

SEQ ID NO: 7362644 - DNA, 22 bp, Homo sapiens
tctataaagggccagatagtag

SEQ ID NO: 7362645 - DNA, 22 bp, Homo sapiens
tctataaagggccagatagtag

SEQ ID NO: 7362646 - DNA, 22 bp, Homo sapiens
tctataaaactcaagagcaatt

SEQ ID NO: 7362647 - DNA, 22 bp, Homo sapiens
tctagttttctcaaatgacttg

SEQ ID NO: 7362648 - DNA, 22 bp, Homo sapiens
tctatgtatatctttccattca

SEQ ID NO: 7362649 - DNA, 21 bp, Homo sapiens
tctatgtacgcatctatgcct

SEQ ID NO: 7362650 - DNA, 22 bp, Homo sapiens
tctattatggtacttatcatga

SEQ ID NO: 7362651 - DNA, 22 bp, Homo sapiens
tctattaatgattcaatagtgt

SEQ ID NO: 7362652 - DNA, 22 bp, Homo sapiens
tctatgttagagatacatccta

SEQ ID NO: 7362653 - DNA, 22 bp, Homo sapiens
tctatgttggtccatattatgg

SEQ ID NO: 7362654 - DNA, 22 bp, Homo sapiens
tctatattttgaaaggtattta

SEQ ID NO: 7362655 - DNA, 22 bp, Homo sapiens
tctatgaaaagtctattcattc

SEQ ID NO: 7362656 - DNA, 22 bp, Homo sapiens
tctatgaatgacacagataata

SEQ ID NO: 7362657 - DNA, 22 bp, Homo sapiens
tctattttcttgccaaaactgc

SEQ ID NO: 7362658 - DNA, 22 bp, Homo sapiens
tctattttatactcaaatcttc

SEQ ID NO: 7362659 - DNA, 22 bp, Homo sapiens
tctatttcgcatataagttttg

SEQ ID NO: 7362660 - DNA, 22 bp, Homo sapiens
tctatttctgggtttgtgtggt

SEQ ID NO: 7362661 - DNA, 22 bp, Homo sapiens
tctattttgtttccagctctac

SEQ ID NO: 7362662 - DNA, 22 bp, Homo sapiens
tctatttttatagttgaagtgc

SEQ ID NO: 7362663 - DNA, 22 bp, Homo sapiens
tctcaaactgtgtattataatt

SEQ ID NO: 7362664 - DNA, 19 bp, Homo sapiens
tctcaattctccccactgc

SEQ ID NO: 7362665 - DNA, 19 bp, Homo sapiens
tctcaattcagactgagag

SEQ ID NO: 7362666 - DNA, 19 bp, Homo sapiens
tctcacaagcaacattgtt

SEQ ID NO: 7362667 - DNA, 22 bp, Homo sapiens
tctcaattgtgggtgaggagca

SEQ ID NO: 7362668 - DNA, 19 bp, Homo sapiens
tctcacagctctactatgt

SEQ ID NO: 7362669 - DNA, 22 bp, Homo sapiens
tctagagctttttcctcttgta

SEQ ID NO: 7362670 - DNA, 23 bp, Homo sapiens
tctagcctgtcatcagcctctcc

SEQ ID NO: 7362671 - DNA, 22 bp, Homo sapiens
tctagctctgcttatcatggct

SEQ ID NO: 7362672 - DNA, 19 bp, Homo sapiens
tctaggagatctgaacctt

SEQ ID NO: 7362673 - DNA, 22 bp, Homo sapiens
tctactgagtgctgagattttg

SEQ ID NO: 7362674 - DNA, 22 bp, Homo sapiens
tctaccacagggtagaaccacg

SEQ ID NO: 7362675 - DNA, 22 bp, Homo sapiens
tctaccactaagtgtgctttga

SEQ ID NO: 7362676 - DNA, 22 bp, Homo sapiens
tctaccactcatgctacttact

SEQ ID NO: 7362677 - DNA, 22 bp, Homo sapiens
tctaccacttattagctctgtg

SEQ ID NO: 7362678 - DNA, 22 bp, Homo sapiens
tctaccaccccgggcctggaga

SEQ ID NO: 7362679 - DNA, 22 bp, Homo sapiens
tctaccacttatcttggttaaa

SEQ ID NO: 7362680 - DNA, 22 bp, Homo sapiens
tctaccactttgacctctctgt

SEQ ID NO: 7362681 - DNA, 23 bp, Homo sapiens
tctagaaaatgaaagaatgcagt

SEQ ID NO: 7362682 - DNA, 22 bp, Homo sapiens
tctagaaacaggtttctagaaa

SEQ ID NO: 7362683 - DNA, 22 bp, Homo sapiens
tctacaaactaaggagggtaat

SEQ ID NO: 7362684 - DNA, 22 bp, Homo sapiens
tctaattttaggcatttgttca

SEQ ID NO: 7362685 - DNA, 19 bp, Homo sapiens
tctaacagctttcattcta

SEQ ID NO: 7362686 - DNA, 22 bp, Homo sapiens
tctacaggtggggcctggcaat

SEQ ID NO: 7362687 - DNA, 21 bp, Homo sapiens
tctacatatcaatatgtaatt

SEQ ID NO: 7362688 - DNA, 22 bp, Homo sapiens
tctacatatgtgatttctaagt

SEQ ID NO: 7362689 - DNA, 22 bp, Homo sapiens
tctacattttaacaagatgccc

SEQ ID NO: 7362690 - DNA, 22 bp, Homo sapiens
tctacaaaggttgaggtgccct

SEQ ID NO: 7362691 - DNA, 22 bp, Homo sapiens
tctaaagatttggattcatttg

SEQ ID NO: 7362692 - DNA, 22 bp, Homo sapiens
tctaaagtactactactgttgg

SEQ ID NO: 7362693 - DNA, 23 bp, Homo sapiens
tctaaaattcatcatttacgttc

SEQ ID NO: 7362694 - DNA, 23 bp, Homo sapiens
tctaaaattcatcatttacgttc

SEQ ID NO: 7362695 - DNA, 22 bp, Homo sapiens
tctaaaatgcagatctactggt

SEQ ID NO: 7362696 - DNA, 23 bp, Homo sapiens
tcgttgaatagcaatagcacaac

SEQ ID NO: 7362697 - DNA, 22 bp, Homo sapiens
tcgtgtcagatcagaggttcct

SEQ ID NO: 7362698 - DNA, 19 bp, Homo sapiens
tcgtggggaggtgggcagc

SEQ ID NO: 7362699 - DNA, 22 bp, Homo sapiens
tcgtgaggctctgcatcgcaca

SEQ ID NO: 7362700 - DNA, 22 bp, Homo sapiens
tcgcagaggcacgagtgcagaa

SEQ ID NO: 7362701 - DNA, 22 bp, Homo sapiens
tcgtcctgtgcacctgcctgca

SEQ ID NO: 7362702 - DNA, 22 bp, Homo sapiens
tcgcccaggctggaagtgcagt

SEQ ID NO: 7362703 - DNA, 22 bp, Homo sapiens
tcctttcttcttctgcccatgg

SEQ ID NO: 7362704 - DNA, 19 bp, Homo sapiens
tcctttctgttcctgagat

SEQ ID NO: 7362705 - DNA, 19 bp, Homo sapiens
tcctttgaatatcagttga

SEQ ID NO: 7362706 - DNA, 22 bp, Homo sapiens
tcctttcttgtgtatcaaatgg

SEQ ID NO: 7362707 - DNA, 22 bp, Homo sapiens
tcctttctccttccgacttcat

SEQ ID NO: 7362708 - DNA, 18 bp, Homo sapiens
tcctttctccctcatctt

SEQ ID NO: 7362709 - DNA, 22 bp, Homo sapiens
tccttggctagtactggccagc

SEQ ID NO: 7362710 - DNA, 22 bp, Homo sapiens
tccttggctagtactggccagc

SEQ ID NO: 7362711 - DNA, 22 bp, Homo sapiens
tcctttctatcttgggtatcta

SEQ ID NO: 7362712 - DNA, 22 bp, Homo sapiens
tcgcaccattgcactccagcca

SEQ ID NO: 7362713 - DNA, 22 bp, Homo sapiens
tcgaaggaggcactcagacatg

SEQ ID NO: 7362714 - DNA, 22 bp, Homo sapiens
tcctttgacttcttgcagtcca

SEQ ID NO: 7362715 - DNA, 22 bp, Homo sapiens
tcctttgttcgggtgtgctgtc

SEQ ID NO: 7362716 - DNA, 22 bp, Homo sapiens
tccttacatagtgctgaaatat

SEQ ID NO: 7362717 - DNA, 22 bp, Homo sapiens
tccttacatagtgctgaaatat

SEQ ID NO: 7362718 - DNA, 22 bp, Homo sapiens
tccttaaatccttcagagatta

SEQ ID NO: 7362719 - DNA, 22 bp, Homo sapiens
tccttaaatgaactctgcatga

SEQ ID NO: 7362720 - DNA, 22 bp, Homo sapiens
tccttacagaaagcagtagaca

SEQ ID NO: 7362721 - DNA, 22 bp, Homo sapiens
tccttcaaagctcctagtgagc

SEQ ID NO: 7362722 - DNA, 23 bp, Homo sapiens
tccttcaagttaggaagtgaaca

SEQ ID NO: 7362723 - DNA, 20 bp, Homo sapiens
tccttcaggcagggcctagt

SEQ ID NO: 7362724 - DNA, 22 bp, Homo sapiens
tccttggatctttcctatgatt

SEQ ID NO: 7362725 - DNA, 22 bp, Homo sapiens
tccttgactgtgaggaactagc

SEQ ID NO: 7362726 - DNA, 22 bp, Homo sapiens
tccttgaatggacattacactg

SEQ ID NO: 7362727 - DNA, 22 bp, Homo sapiens
tccttgaattgtgccacttacc

SEQ ID NO: 7362728 - DNA, 22 bp, Homo sapiens
tccttgaatgaatgttctctcc

SEQ ID NO: 7362729 - DNA, 22 bp, Homo sapiens
tccttgaatcctagcatcctat

SEQ ID NO: 7362730 - DNA, 22 bp, Homo sapiens
tccttgaatgaagagaggtgac

SEQ ID NO: 7362731 - DNA, 22 bp, Homo sapiens
tccttgaatataataacagtag

SEQ ID NO: 7362732 - DNA, 22 bp, Homo sapiens
tccttgaagcaacgtgcagaca

SEQ ID NO: 7362733 - DNA, 22 bp, Homo sapiens
tccttgaagcttgtatctaata

SEQ ID NO: 7362734 - DNA, 22 bp, Homo sapiens
tccttgaagcaacgtgcagaca

SEQ ID NO: 7362735 - DNA, 22 bp, Homo sapiens
tccttgaagagtgggcggtcga

SEQ ID NO: 7362736 - DNA, 22 bp, Homo sapiens
tccttgaaaggggctgcagggc

SEQ ID NO: 7362737 - DNA, 20 bp, Homo sapiens
tccttgaaagtggggtatat

SEQ ID NO: 7362738 - DNA, 22 bp, Homo sapiens
tccttgaacagagggcctgggt

SEQ ID NO: 7362739 - DNA, 22 bp, Homo sapiens
tccttgaagaatgattcttgga

SEQ ID NO: 7362740 - DNA, 22 bp, Homo sapiens
tccttgaaaagaatgtctccat

SEQ ID NO: 7362741 - DNA, 22 bp, Homo sapiens
tccttgaaaatcttggtttaga

SEQ ID NO: 7362742 - DNA, 22 bp, Homo sapiens
tccttcagggggccgcctgcac

SEQ ID NO: 7362743 - DNA, 23 bp, Homo sapiens
tccttcctttgagaggctccatc

SEQ ID NO: 7362744 - DNA, 22 bp, Homo sapiens
tccttctctacaaatccaggca

SEQ ID NO: 7362745 - DNA, 19 bp, Homo sapiens
tccttctccggccaccccg

SEQ ID NO: 7362746 - DNA, 19 bp, Homo sapiens
tccttctccggccaccccg

SEQ ID NO: 7362747 - DNA, 22 bp, Homo sapiens
tcctggggctgcaaggcctgtc

SEQ ID NO: 7362748 - DNA, 22 bp, Homo sapiens
tcctggggctgcaaggcctgtc

SEQ ID NO: 7362749 - DNA, 21 bp, Homo sapiens
tcctggggggtaggtgagttt

SEQ ID NO: 7362750 - DNA, 21 bp, Homo sapiens
tcctggggggtaggtgagttt

SEQ ID NO: 7362751 - DNA, 22 bp, Homo sapiens
tcctggggctctttgatgtgat

SEQ ID NO: 7362752 - DNA, 22 bp, Homo sapiens
tcctggggctctgagcgagaca

SEQ ID NO: 7362753 - DNA, 16 bp, Homo sapiens
tcctggggatactgga

SEQ ID NO: 7362754 - DNA, 22 bp, Homo sapiens
tcctggggaggtcgaggctgag

SEQ ID NO: 7362755 - DNA, 22 bp, Homo sapiens
tcctggggaggtcgaggctgag

SEQ ID NO: 7362756 - DNA, 19 bp, Homo sapiens
tcctggggatgtggtcacc

SEQ ID NO: 7362757 - DNA, 19 bp, Homo sapiens
tcctggggatgtggtcacc

SEQ ID NO: 7362758 - DNA, 22 bp, Homo sapiens
tcctggggctcatgggatttgt

SEQ ID NO: 7362759 - DNA, 22 bp, Homo sapiens
tcctggggccaggcacctctgg

SEQ ID NO: 7362760 - DNA, 22 bp, Homo sapiens
tcctggggccagcactggtgga

SEQ ID NO: 7362761 - DNA, 22 bp, Homo sapiens
tcctggggtgtgttttgctgct

SEQ ID NO: 7362762 - DNA, 20 bp, Homo sapiens
tcctggggtaagccatggtc

SEQ ID NO: 7362763 - DNA, 22 bp, Homo sapiens
tcctggggtcctgactgcttcc

SEQ ID NO: 7362764 - DNA, 22 bp, Homo sapiens
tcctggggtttagagggaagtg

SEQ ID NO: 7362765 - DNA, 22 bp, Homo sapiens
tcctggggtttagagggaagtg

SEQ ID NO: 7362766 - DNA, 22 bp, Homo sapiens
tcctggggttttggccgcagct

SEQ ID NO: 7362767 - DNA, 22 bp, Homo sapiens
tcctgtcctctgggtgccccat

SEQ ID NO: 7362768 - DNA, 22 bp, Homo sapiens
tcctggtggtgccggtgcccgg

SEQ ID NO: 7362769 - DNA, 22 bp, Homo sapiens
tcctggtggtctgtgcttcttc

SEQ ID NO: 7362770 - DNA, 22 bp, Homo sapiens
tcctggtggctttccctgcctt

SEQ ID NO: 7362771 - DNA, 22 bp, Homo sapiens
tcctgtgccatctctagagact

SEQ ID NO: 7362772 - DNA, 22 bp, Homo sapiens
tcctgtctaaagacctgcaggc

SEQ ID NO: 7362773 - DNA, 22 bp, Homo sapiens
tcctgtgcctccacctgctccg

SEQ ID NO: 7362774 - DNA, 22 bp, Homo sapiens
tcctgtgctgttaatagtgata

SEQ ID NO: 7362775 - DNA, 17 bp, Homo sapiens
tcctgtgggtgcagcag

SEQ ID NO: 7362776 - DNA, 22 bp, Homo sapiens
tcctggggagggttctggctcc

SEQ ID NO: 7362777 - DNA, 19 bp, Homo sapiens
tcctgggctgggccaggtc

SEQ ID NO: 7362778 - DNA, 22 bp, Homo sapiens
tcctgggctgtggccccgggca

SEQ ID NO: 7362779 - DNA, 22 bp, Homo sapiens
tcctgggcagaatgggatggct

SEQ ID NO: 7362780 - DNA, 22 bp, Homo sapiens
tcctgggcaaagaggggcagtg

SEQ ID NO: 7362781 - DNA, 22 bp, Homo sapiens
tcctggctgttagagaggcaag

SEQ ID NO: 7362782 - DNA, 22 bp, Homo sapiens
tcctggctgcaccagtgaccct

SEQ ID NO: 7362783 - DNA, 22 bp, Homo sapiens
tcctggcctagagtttgtgttc

SEQ ID NO: 7362784 - DNA, 22 bp, Homo sapiens
tcctggcctagctcaccctgga

SEQ ID NO: 7362785 - DNA, 22 bp, Homo sapiens
tcctggcctcacagtcctgggt

SEQ ID NO: 7362786 - DNA, 22 bp, Homo sapiens
tcctggccctgtggcctgcagt

SEQ ID NO: 7362787 - DNA, 22 bp, Homo sapiens
tcctggccgctggcccctgaga

SEQ ID NO: 7362788 - DNA, 22 bp, Homo sapiens
tcctggccgccgcgtggggccg

SEQ ID NO: 7362789 - DNA, 22 bp, Homo sapiens
tcctggcccactatgccagcat

SEQ ID NO: 7362790 - DNA, 22 bp, Homo sapiens
tcctggcccactcctagcttct

SEQ ID NO: 7362791 - DNA, 21 bp, Homo sapiens
tcctggcccactctatcccca

SEQ ID NO: 7362792 - DNA, 22 bp, Homo sapiens
tcctggcccgatccctgtgaag

SEQ ID NO: 7362793 - DNA, 16 bp, Homo sapiens
tcctggcccctatgga

SEQ ID NO: 7362794 - DNA, 22 bp, Homo sapiens
tcctggccctctgcaaacgcca

SEQ ID NO: 7362795 - DNA, 22 bp, Homo sapiens
tcctggcccggccgggcctgct

SEQ ID NO: 7362796 - DNA, 17 bp, Homo sapiens
tcctggcctggtgtgtg

SEQ ID NO: 7362797 - DNA, 22 bp, Homo sapiens
tcctggctcctggagacctgct

SEQ ID NO: 7362798 - DNA, 22 bp, Homo sapiens
tcctggcctctgagtcaagaac

SEQ ID NO: 7362799 - DNA, 15 bp, Homo sapiens
tcctggcctgctctg

SEQ ID NO: 7362800 - DNA, 22 bp, Homo sapiens
tcctggcctcgctgtccacctt

SEQ ID NO: 7362801 - DNA, 22 bp, Homo sapiens
tcctggcctccgttctctgcat

SEQ ID NO: 7362802 - DNA, 20 bp, Homo sapiens
tcctggcctccctggggctc

SEQ ID NO: 7362803 - DNA, 22 bp, Homo sapiens
tcctggctcgattgctaccaat

SEQ ID NO: 7362804 - DNA, 22 bp, Homo sapiens
tcctggctcggcttggggactt

SEQ ID NO: 7362805 - DNA, 22 bp, Homo sapiens
tcctggctctaagtcctgagtg

SEQ ID NO: 7362806 - DNA, 22 bp, Homo sapiens
tcctggccagaggacaaagctg

SEQ ID NO: 7362807 - DNA, 22 bp, Homo sapiens
tcctggccaggatgacctaaca

SEQ ID NO: 7362808 - DNA, 18 bp, Homo sapiens
tcctggccacactacctt

SEQ ID NO: 7362809 - DNA, 22 bp, Homo sapiens
tcctggccacccgacagaagtc

SEQ ID NO: 7362810 - DNA, 21 bp, Homo sapiens
tcctggccagggcactaggca

SEQ ID NO: 7362811 - DNA, 22 bp, Homo sapiens
tcctggccataggctatttcag

SEQ ID NO: 7362812 - DNA, 22 bp, Homo sapiens
tcctggccatgcaagatgagga

SEQ ID NO: 7362813 - DNA, 22 bp, Homo sapiens
tcctggcccaatctgcccatga

SEQ ID NO: 7362814 - DNA, 22 bp, Homo sapiens
tcctggccacacattaatagtg

SEQ ID NO: 7362815 - DNA, 22 bp, Homo sapiens
tcctggccaagttactctctgc

SEQ ID NO: 7362816 - DNA, 22 bp, Homo sapiens
tcctggccaagtagatgtggcg

SEQ ID NO: 7362817 - DNA, 19 bp, Homo sapiens
tcctggcacagtggaacca

SEQ ID NO: 7362818 - DNA, 22 bp, Homo sapiens
tcctgcttgaaactctgccttc

SEQ ID NO: 7362819 - DNA, 22 bp, Homo sapiens
tcctgctgttttctggcccaca

SEQ ID NO: 7362820 - DNA, 22 bp, Homo sapiens
tcctgctgtttacctacaatgg

SEQ ID NO: 7362821 - DNA, 22 bp, Homo sapiens
tcctgctgggtctaactctggt

SEQ ID NO: 7362822 - DNA, 22 bp, Homo sapiens
taagaattatctcatggataat

SEQ ID NO: 7362823 - DNA, 22 bp, Homo sapiens
taagacaaatactatttcaaga

SEQ ID NO: 7362824 - DNA, 22 bp, Homo sapiens
taagaattgtgttgaatagagt

SEQ ID NO: 7362825 - DNA, 22 bp, Homo sapiens
taagaattgtgttgaatagagt

SEQ ID NO: 7362826 - DNA, 18 bp, Homo sapiens
taagaattgagagtttac

SEQ ID NO: 7362827 - DNA, 22 bp, Homo sapiens
taagaatattgggaatggatgg

SEQ ID NO: 7362828 - DNA, 22 bp, Homo sapiens
taagaatctattaggaatatgt

SEQ ID NO: 7362829 - DNA, 22 bp, Homo sapiens
taagaatcagtagatatagatt

SEQ ID NO: 7362830 - DNA, 22 bp, Homo sapiens
taagaacataaattcatacggg

SEQ ID NO: 7362831 - DNA, 21 bp, Homo sapiens
taagaacattatcttcttcct

SEQ ID NO: 7362832 - DNA, 22 bp, Homo sapiens
taagaacagtgtctgtctcaca

SEQ ID NO: 7362833 - DNA, 23 bp, Homo sapiens
taagaacagacaagcatttacat

SEQ ID NO: 7362834 - DNA, 22 bp, Homo sapiens
taagaacagataaagtttcccc

SEQ ID NO: 7362835 - DNA, 22 bp, Homo sapiens
taagaagtgctgaattgaatat

SEQ ID NO: 7362836 - DNA, 22 bp, Homo sapiens
taagaagtacaaaaattttctg

SEQ ID NO: 7362837 - DNA, 22 bp, Homo sapiens
taagaatacctctcagctcttt

SEQ ID NO: 7362838 - DNA, 22 bp, Homo sapiens
taagaatagtccctagatgtgt

SEQ ID NO: 7362839 - DNA, 22 bp, Homo sapiens
taagaatagtccctagatgtgt

SEQ ID NO: 7362840 - DNA, 22 bp, Homo sapiens
taagaactcgtgatcatttgaa

SEQ ID NO: 7362841 - DNA, 23 bp, Homo sapiens
tcttgaaaagcctacagcagttc

SEQ ID NO: 7362842 - DNA, 22 bp, Homo sapiens
tcttctccagttcatcctacca

SEQ ID NO: 7362843 - DNA, 22 bp, Homo sapiens
tcttctgtgatctatgtgtttt

SEQ ID NO: 7362844 - DNA, 22 bp, Homo sapiens
tcttctctacaccagcagcccc

SEQ ID NO: 7362845 - DNA, 22 bp, Homo sapiens
tcttctctacaccagcagcccc

SEQ ID NO: 7362846 - DNA, 22 bp, Homo sapiens
tcttcctgaaaccctgttccag

SEQ ID NO: 7362847 - DNA, 22 bp, Homo sapiens
tcttcctctctaattgatcaga

SEQ ID NO: 7362848 - DNA, 22 bp, Homo sapiens
tcttcctctagatctgaggccc

SEQ ID NO: 7362849 - DNA, 22 bp, Homo sapiens
tcttccagcttctagaggatgc

SEQ ID NO: 7362850 - DNA, 22 bp, Homo sapiens
tcttccaggagggcatttcttt

SEQ ID NO: 7362851 - DNA, 22 bp, Homo sapiens
tcttcctggatgggggttgatg

SEQ ID NO: 7362852 - DNA, 22 bp, Homo sapiens
tcttcctgctttggtgaggctt

SEQ ID NO: 7362853 - DNA, 22 bp, Homo sapiens
tcttccaattagaatatttggg

SEQ ID NO: 7362854 - DNA, 22 bp, Homo sapiens
tcttccaatggtttctagattt

SEQ ID NO: 7362855 - DNA, 22 bp, Homo sapiens
tcttccaaggttgcacactatc

SEQ ID NO: 7362856 - DNA, 22 bp, Homo sapiens
tcttccagaagtgttttcagaa

SEQ ID NO: 7362857 - DNA, 22 bp, Homo sapiens
tcttccagaagtgttttcagaa

SEQ ID NO: 7362858 - DNA, 22 bp, Homo sapiens
tcttccagaatgcattctcttt

SEQ ID NO: 7362859 - DNA, 20 bp, Homo sapiens
tcttccagagacattttccc

SEQ ID NO: 7362860 - DNA, 22 bp, Homo sapiens
tcttccagctcatattctatca

SEQ ID NO: 7362861 - DNA, 22 bp, Homo sapiens
tcttcatgtatactcatggtac

SEQ ID NO: 7362862 - DNA, 22 bp, Homo sapiens
tcttcatgaatgaatctttgac

SEQ ID NO: 7362863 - DNA, 22 bp, Homo sapiens
tcttcagtcaatccagatgttt

SEQ ID NO: 7362864 - DNA, 22 bp, Homo sapiens
tcttattttttaatgacagaga

SEQ ID NO: 7362865 - DNA, 22 bp, Homo sapiens
tcttattttttaatgacagaga

SEQ ID NO: 7362866 - DNA, 22 bp, Homo sapiens
tcttatgtttctagaaaataag

SEQ ID NO: 7362867 - DNA, 22 bp, Homo sapiens
tcttatgataatatcactacca

SEQ ID NO: 7362868 - DNA, 22 bp, Homo sapiens
tcttattcttttaaacaacgca

SEQ ID NO: 7362869 - DNA, 22 bp, Homo sapiens
tcttcacatgaccttcatgtct

SEQ ID NO: 7362870 - DNA, 22 bp, Homo sapiens
tcttcagatggccagttgtccc

SEQ ID NO: 7362871 - DNA, 22 bp, Homo sapiens
tcttcagattgcactgagcaag

SEQ ID NO: 7362872 - DNA, 22 bp, Homo sapiens
tcttcacagctttgtccagaag

SEQ ID NO: 7362873 - DNA, 22 bp, Homo sapiens
tcttcacagatgcatatacttc

SEQ ID NO: 7362874 - DNA, 22 bp, Homo sapiens
tcttcacatcatgttttttaat

SEQ ID NO: 7362875 - DNA, 22 bp, Homo sapiens
tcttcacaaagctgttgttaaa

SEQ ID NO: 7362876 - DNA, 22 bp, Homo sapiens
tcttcacagatgcatatacttc

SEQ ID NO: 7362877 - DNA, 22 bp, Homo sapiens
tcttcacaccgggcagcaggaa

SEQ ID NO: 7362878 - DNA, 22 bp, Homo sapiens
tcttggctattcttgaattctg

SEQ ID NO: 7362879 - DNA, 22 bp, Homo sapiens
tcttggctgtctttgaagttag

SEQ ID NO: 7362880 - DNA, 22 bp, Homo sapiens
tcttggctgtgcatgcatcttc

SEQ ID NO: 7362881 - DNA, 22 bp, Homo sapiens
tctttaattgtggaagagcagc

SEQ ID NO: 7362882 - DNA, 22 bp, Homo sapiens
tctttaatgtactttctttcac

SEQ ID NO: 7362883 - DNA, 22 bp, Homo sapiens
tctttagaaacttttcttcatg

SEQ ID NO: 7362884 - DNA, 21 bp, Homo sapiens
tctttacatttgcctcttgca

SEQ ID NO: 7362885 - DNA, 22 bp, Homo sapiens
tcttgacattgcaatcttcaga

SEQ ID NO: 7362886 - DNA, 22 bp, Homo sapiens
tcttgacattgttgttagcagg

SEQ ID NO: 7362887 - DNA, 22 bp, Homo sapiens
tcttgaaaggagattggaggca

SEQ ID NO: 7362888 - DNA, 19 bp, Homo sapiens
tcttgaggaaagtaaggca

SEQ ID NO: 7362889 - DNA, 22 bp, Homo sapiens
tcttggagactcttgtatattt

SEQ ID NO: 7362890 - DNA, 22 bp, Homo sapiens
tctttctagtggcctctattct

SEQ ID NO: 7362891 - DNA, 22 bp, Homo sapiens
tctttcttattagccattgttc

SEQ ID NO: 7362892 - DNA, 22 bp, Homo sapiens
tctttgaatcctttacatctga

SEQ ID NO: 7362893 - DNA, 22 bp, Homo sapiens
tctttgatgcttctgaaggtgt

SEQ ID NO: 7362894 - DNA, 22 bp, Homo sapiens
tctttgatacagatgtaagctg

SEQ ID NO: 7362895 - DNA, 22 bp, Homo sapiens
tctttgatgggagatctgagag

SEQ ID NO: 7362896 - DNA, 22 bp, Homo sapiens
tctttccttagaataattcttt

SEQ ID NO: 7362897 - DNA, 22 bp, Homo sapiens
tctttctacatcatttgcttct

SEQ ID NO: 7362898 - DNA, 22 bp, Homo sapiens
tctttcctagaggctgatgagt

SEQ ID NO: 7362899 - DNA, 22 bp, Homo sapiens
tctttccaaggactctgtagca

SEQ ID NO: 7362900 - DNA, 22 bp, Homo sapiens
tctttcaatgtgaaaccatgta

SEQ ID NO: 7362901 - DNA, 22 bp, Homo sapiens
tctttcagccacttacctgtct

SEQ ID NO: 7362902 - DNA, 22 bp, Homo sapiens
tctttcaatgagcattctttcc

SEQ ID NO: 7362903 - DNA, 20 bp, Homo sapiens
tctttagatttatcttatgt

SEQ ID NO: 7362904 - DNA, 20 bp, Homo sapiens
tctttagatttatcttatgt

SEQ ID NO: 7362905 - DNA, 22 bp, Homo sapiens
tctggggcagttactggggcct

SEQ ID NO: 7362906 - DNA, 22 bp, Homo sapiens
tctggggcagttactggggcct

SEQ ID NO: 7362907 - DNA, 22 bp, Homo sapiens
tctgggcttttccatgcctgtg

SEQ ID NO: 7362908 - DNA, 22 bp, Homo sapiens
tctgggggaggaggcatggccc

SEQ ID NO: 7362909 - DNA, 22 bp, Homo sapiens
tctgggggcgaccagggactgc

SEQ ID NO: 7362910 - DNA, 21 bp, Homo sapiens
tctgggggtgagcctagaaat

SEQ ID NO: 7362911 - DNA, 22 bp, Homo sapiens
tctgggtgaccctgggcaaggc

SEQ ID NO: 7362912 - DNA, 22 bp, Homo sapiens
tctgtaaaattagtataattgt

SEQ ID NO: 7362913 - DNA, 22 bp, Homo sapiens
tctgtaaaacaatattgtattc

SEQ ID NO: 7362914 - DNA, 22 bp, Homo sapiens
tctgtaaaacttctttgtaaat

SEQ ID NO: 7362915 - DNA, 23 bp, Homo sapiens
tctgggttctaatcatgtgtgat

SEQ ID NO: 7362916 - DNA, 22 bp, Homo sapiens
tctgggttcttgatgctacctt

SEQ ID NO: 7362917 - DNA, 22 bp, Homo sapiens
tctgggttgggttcctggaatt

SEQ ID NO: 7362918 - DNA, 22 bp, Homo sapiens
tctgggtgtagggcctggcaac

SEQ ID NO: 7362919 - DNA, 22 bp, Homo sapiens
tctgggggttaagtgaggacaa

SEQ ID NO: 7362920 - DNA, 22 bp, Homo sapiens
tctgtctacagggagaatgata

SEQ ID NO: 7362921 - DNA, 22 bp, Homo sapiens
tctgtctacagggagaatgata

SEQ ID NO: 7362922 - DNA, 22 bp, Homo sapiens
tctgtctcctcagatgactcca

SEQ ID NO: 7362923 - DNA, 22 bp, Homo sapiens
tctgtcctgtttcctcctgaca

SEQ ID NO: 7362924 - DNA, 18 bp, Homo sapiens
tctgtccttccattcttc

SEQ ID NO: 7362925 - DNA, 23 bp, Homo sapiens
tctgtctgaataatttactcttt

SEQ ID NO: 7362926 - DNA, 22 bp, Homo sapiens
tctgtccaacactctctagaca

SEQ ID NO: 7362927 - DNA, 22 bp, Homo sapiens
tctgtccctgagagctcaggag

SEQ ID NO: 7362928 - DNA, 22 bp, Homo sapiens
tctgtccctgagagctcaggag

SEQ ID NO: 7362929 - DNA, 22 bp, Homo sapiens
tctgtcctccggagctcccagt

SEQ ID NO: 7362930 - DNA, 22 bp, Homo sapiens
tctgtccattcagaatggccct

SEQ ID NO: 7362931 - DNA, 22 bp, Homo sapiens
tctgtcacaagtaatccttttc

SEQ ID NO: 7362932 - DNA, 22 bp, Homo sapiens
tctgtagtctctgatatatctg

SEQ ID NO: 7362933 - DNA, 22 bp, Homo sapiens
tctgtataaggacaaacattta

SEQ ID NO: 7362934 - DNA, 22 bp, Homo sapiens
tctgtagtaggttgtagttctt

SEQ ID NO: 7362935 - DNA, 22 bp, Homo sapiens
tctgtagtatggtacttattta

SEQ ID NO: 7362936 - DNA, 22 bp, Homo sapiens
tctgtacatttgtgttgtgaat

SEQ ID NO: 7362937 - DNA, 22 bp, Homo sapiens
tctgtacatttggggaccccag

SEQ ID NO: 7362938 - DNA, 20 bp, Homo sapiens
tctgtacactcatcttctgc

SEQ ID NO: 7362939 - DNA, 20 bp, Homo sapiens
tctgtacactcatcttctgc

SEQ ID NO: 7362940 - DNA, 22 bp, Homo sapiens
tctgtacaccaggggccattct

SEQ ID NO: 7362941 - DNA, 23 bp, Homo sapiens
tctgtacacatcagcatctccca

SEQ ID NO: 7362942 - DNA, 23 bp, Homo sapiens
tctgtacaattgagaagagaaca

SEQ ID NO: 7362943 - DNA, 22 bp, Homo sapiens
tctgtacagtaccagatagtaa

SEQ ID NO: 7362944 - DNA, 22 bp, Homo sapiens
tctgtacacttcagcatgcatc

SEQ ID NO: 7362945 - DNA, 21 bp, Homo sapiens
tctgtacatcattgagtcccc

SEQ ID NO: 7362946 - DNA, 22 bp, Homo sapiens
tctgtacatgagttgagaatca

SEQ ID NO: 7362947 - DNA, 22 bp, Homo sapiens
tctgtaaatctactaagagctc

SEQ ID NO: 7362948 - DNA, 22 bp, Homo sapiens
tctgtaatcccagctactcagg

SEQ ID NO: 7362949 - DNA, 22 bp, Homo sapiens
tctgtacaacaaagggatgaga

SEQ ID NO: 7362950 - DNA, 22 bp, Homo sapiens
tctgtacaaaggctatttggag

SEQ ID NO: 7362951 - DNA, 22 bp, Homo sapiens
tctgtgctcaagttctgcctct

SEQ ID NO: 7362952 - DNA, 21 bp, Homo sapiens
tctgtgctgccgtcaacatcc

SEQ ID NO: 7362953 - DNA, 19 bp, Homo sapiens
tctgtggagctcagagtag

SEQ ID NO: 7362954 - DNA, 22 bp, Homo sapiens
tctgtgtatttgtgacctgtat

SEQ ID NO: 7362955 - DNA, 22 bp, Homo sapiens
tctgtgggtttcagggggctgt

SEQ ID NO: 7362956 - DNA, 22 bp, Homo sapiens
tctgtgcaagtatttgacattt

SEQ ID NO: 7362957 - DNA, 22 bp, Homo sapiens
tctgtgaatatagggcttgtta

SEQ ID NO: 7362958 - DNA, 22 bp, Homo sapiens
tctgtgacattgaacatctaca

SEQ ID NO: 7362959 - DNA, 22 bp, Homo sapiens
tctgtctgcacctaagcacagt

SEQ ID NO: 7362960 - DNA, 22 bp, Homo sapiens
tctgtctgccccagcaagtcac

SEQ ID NO: 7362961 - DNA, 22 bp, Homo sapiens
tctgtctgcctgtgtccccacc

SEQ ID NO: 7362962 - DNA, 22 bp, Homo sapiens
tctgtgccctcggtgctgggcc

SEQ ID NO: 7362963 - DNA, 22 bp, Homo sapiens
tctgtgccatcagtctccagag

SEQ ID NO: 7362964 - DNA, 22 bp, Homo sapiens
tctgtgcagttcttgtcttgac

SEQ ID NO: 7362965 - DNA, 20 bp, Homo sapiens
tctgtgcattgcctgctggt

SEQ ID NO: 7362966 - DNA, 22 bp, Homo sapiens
tctgtgcaggaagtcattatga

SEQ ID NO: 7362967 - DNA, 22 bp, Homo sapiens
tctgtttttgaggctatcttct

SEQ ID NO: 7362968 - DNA, 22 bp, Homo sapiens
tctgttttgtaccagatacagc

SEQ ID NO: 7362969 - DNA, 22 bp, Homo sapiens
tcttaaaccacacatgtgctct

SEQ ID NO: 7362970 - DNA, 22 bp, Homo sapiens
tcttaaactttgctgtaattct

SEQ ID NO: 7362971 - DNA, 22 bp, Homo sapiens
tcttaaagcttacttcaattgt

SEQ ID NO: 7362972 - DNA, 22 bp, Homo sapiens
tctgttttagataagaaaggct

SEQ ID NO: 7362973 - DNA, 20 bp, Homo sapiens
tcttaaatccccagggccat

SEQ ID NO: 7362974 - DNA, 22 bp, Homo sapiens
tcttaaatgactgataagagga

SEQ ID NO: 7362975 - DNA, 22 bp, Homo sapiens
tcttaagcagagaagaagttga

SEQ ID NO: 7362976 - DNA, 22 bp, Homo sapiens
tcttatagacagtggcagcagg

SEQ ID NO: 7362977 - DNA, 22 bp, Homo sapiens
tctgttgcaatgtgcatggtga

SEQ ID NO: 7362978 - DNA, 22 bp, Homo sapiens
tctgttattctgtctattgcca

SEQ ID NO: 7362979 - DNA, 22 bp, Homo sapiens
tctgttattctgctcagtatag

SEQ ID NO: 7362980 - DNA, 20 bp, Homo sapiens
tctgttattattacattgcc

SEQ ID NO: 7362981 - DNA, 22 bp, Homo sapiens
tctgttatgcataagcatcagt

SEQ ID NO: 7362982 - DNA, 22 bp, Homo sapiens
tctgttgtctgcaattctggga

SEQ ID NO: 7362983 - DNA, 22 bp, Homo sapiens
tctgtttaatgggaatgatact

SEQ ID NO: 7362984 - DNA, 22 bp, Homo sapiens
tctgttgcaatgtgcatggtga

SEQ ID NO: 7362985 - DNA, 22 bp, Homo sapiens
tctgtttatgcatatttaaaac

SEQ ID NO: 7362986 - DNA, 20 bp, Homo sapiens
tctgtgtgccatcacctaac

SEQ ID NO: 7362987 - DNA, 22 bp, Homo sapiens
tctgtgtgcccacctgacacct

SEQ ID NO: 7362988 - DNA, 22 bp, Homo sapiens
tctgtgtggtagtttcagtgaa

SEQ ID NO: 7362989 - DNA, 22 bp, Homo sapiens
tctgtgtggtagtttcagtgaa

SEQ ID NO: 7362990 - DNA, 22 bp, Homo sapiens
tctgttagctgtcaaagtgttt

SEQ ID NO: 7362991 - DNA, 22 bp, Homo sapiens
tctgttataaatcacactgcat

SEQ ID NO: 7362992 - DNA, 22 bp, Homo sapiens
tctgttaacctggtcttggctt

SEQ ID NO: 7362993 - DNA, 22 bp, Homo sapiens
tctgttaaatattgatagatat

SEQ ID NO: 7362994 - DNA, 22 bp, Homo sapiens
tctgttaacaggagagaatgat

SEQ ID NO: 7362995 - DNA, 22 bp, Homo sapiens
tctgttatacagtctgtggcac

SEQ ID NO: 7362996 - DNA, 22 bp, Homo sapiens
tctgttatacaacaagtaacag

SEQ ID NO: 7362997 - DNA, 22 bp, Homo sapiens
tctgttatctcaagtcacaaga

SEQ ID NO: 7362998 - DNA, 22 bp, Homo sapiens
tctgttatatagataatgtgtg

SEQ ID NO: 7362999 - DNA, 20 bp, Homo sapiens
tctgtgtttcagctgcttga

SEQ ID NO: 7363000 - DNA, 22 bp, Homo sapiens
tctgtgtttgccatccttgctc

SEQ ID NO: 7363001 - DNA, 22 bp, Homo sapiens
tctgtgttttgtgcctactgct

SEQ ID NO: 7363002 - DNA, 22 bp, Homo sapiens
tctgtgttttaaacagtagaaa

SEQ ID NO: 7363003 - DNA, 22 bp, Homo sapiens
tctgtgttgagaaggatcatga

SEQ ID NO: 7363004 - DNA, 22 bp, Homo sapiens
tctgtgttgataattttggaga

SEQ ID NO: 7363005 - DNA, 22 bp, Homo sapiens
tctgtgtttaaaagatatgtcc

SEQ ID NO: 7363006 - DNA, 18 bp, Homo sapiens
tctgtgttctgtcattgc

SEQ ID NO: 7363007 - DNA, 22 bp, Homo sapiens
tctggagagatcttccacaaca

SEQ ID NO: 7363008 - DNA, 22 bp, Homo sapiens
tctggagaggggcctagaattt

SEQ ID NO: 7363009 - DNA, 22 bp, Homo sapiens
tctggagaagaaacttgctctg

SEQ ID NO: 7363010 - DNA, 22 bp, Homo sapiens
tctggacagtagagcaatgatt

SEQ ID NO: 7363011 - DNA, 22 bp, Homo sapiens
tctggacaggggcgctttgggg

SEQ ID NO: 7363012 - DNA, 22 bp, Homo sapiens
tctggaatgatttccttcccct

SEQ ID NO: 7363013 - DNA, 22 bp, Homo sapiens
tctggactataggctgccaagt

SEQ ID NO: 7363014 - DNA, 22 bp, Homo sapiens
tctggacatcctggagaatgac

SEQ ID NO: 7363015 - DNA, 22 bp, Homo sapiens
tctggaatcagacctaatccca

SEQ ID NO: 7363016 - DNA, 22 bp, Homo sapiens
tctgctggccttagcaggtcta

SEQ ID NO: 7363017 - DNA, 22 bp, Homo sapiens
tctgctgtaaagaatttctgcc

SEQ ID NO: 7363018 - DNA, 22 bp, Homo sapiens
tctgctgtaaccttcagaggta

SEQ ID NO: 7363019 - DNA, 22 bp, Homo sapiens
tctgctggttccgaattaggcc

SEQ ID NO: 7363020 - DNA, 18 bp, Homo sapiens
tctgctgctgcgtcctgc

SEQ ID NO: 7363021 - DNA, 22 bp, Homo sapiens
tctgctgctgcagctacactat

SEQ ID NO: 7363022 - DNA, 22 bp, Homo sapiens
tctgctgtcactcatttgcttc

SEQ ID NO: 7363023 - DNA, 22 bp, Homo sapiens
tctgctgtgggtctatatttta

SEQ ID NO: 7363024 - DNA, 22 bp, Homo sapiens
tctgctgtgaggaggcaggatg

SEQ ID NO: 7363025 - DNA, 22 bp, Homo sapiens
tctgctgcctgcagggcagaga

SEQ ID NO: 7363026 - DNA, 22 bp, Homo sapiens
tctgctgcctgcagggcagaga

SEQ ID NO: 7363027 - DNA, 22 bp, Homo sapiens
tctgctgctacagactctctag

SEQ ID NO: 7363028 - DNA, 22 bp, Homo sapiens
tctgctgccatgcagagcagta

SEQ ID NO: 7363029 - DNA, 22 bp, Homo sapiens
tctgctgcagggaaagactttc

SEQ ID NO: 7363030 - DNA, 22 bp, Homo sapiens
tctgctgcacaaattcatctct

SEQ ID NO: 7363031 - DNA, 22 bp, Homo sapiens
tctgctctgagagggccatcag

SEQ ID NO: 7363032 - DNA, 22 bp, Homo sapiens
tctgctctgtggcttcagctaa

SEQ ID NO: 7363033 - DNA, 22 bp, Homo sapiens
tctgctctgtggcttcagctaa

SEQ ID NO: 7363034 - DNA, 22 bp, Homo sapiens
tctggcccaagttttcggtgag

SEQ ID NO: 7363035 - DNA, 22 bp, Homo sapiens
tctggcccagcccctgaggtca

SEQ ID NO: 7363036 - DNA, 22 bp, Homo sapiens
tctggcccaagttttcggtgag

SEQ ID NO: 7363037 - DNA, 22 bp, Homo sapiens
tctggcccagcccctgatccca

SEQ ID NO: 7363038 - DNA, 22 bp, Homo sapiens
tctggcccatcttctgccacca

SEQ ID NO: 7363039 - DNA, 22 bp, Homo sapiens
tctggcccatgatcctgctaac

SEQ ID NO: 7363040 - DNA, 22 bp, Homo sapiens
tctggatcccaccgccacacac

SEQ ID NO: 7363041 - DNA, 23 bp, Homo sapiens
tctggatgccaccacatactaac

SEQ ID NO: 7363042 - DNA, 22 bp, Homo sapiens
tctggatgggatgaggcaacaa

SEQ ID NO: 7363043 - DNA, 22 bp, Homo sapiens
tctggatgatatgtgaacttga

SEQ ID NO: 7363044 - DNA, 22 bp, Homo sapiens
tctggatgacagaatggtcata

SEQ ID NO: 7363045 - DNA, 22 bp, Homo sapiens
tctggatgaaagggctatatat

SEQ ID NO: 7363046 - DNA, 22 bp, Homo sapiens
tctggatctccctcatcctggg

SEQ ID NO: 7363047 - DNA, 22 bp, Homo sapiens
tctggattgtggctattgttct

SEQ ID NO: 7363048 - DNA, 22 bp, Homo sapiens
tctggatggtcagctcttcctg

SEQ ID NO: 7363049 - DNA, 22 bp, Homo sapiens
tctggatgttgcggagtacaga

SEQ ID NO: 7363050 - DNA, 22 bp, Homo sapiens
tctggagggggatgcctcatcc

SEQ ID NO: 7363051 - DNA, 23 bp, Homo sapiens
tctggaggggacactgcagatgc

SEQ ID NO: 7363052 - DNA, 22 bp, Homo sapiens
tctggaggctctgagggtgagt

SEQ ID NO: 7363053 - DNA, 18 bp, Homo sapiens
tctggagggaagctttga

SEQ ID NO: 7363054 - DNA, 22 bp, Homo sapiens
tctggagggcccacatccacaa

SEQ ID NO: 7363055 - DNA, 22 bp, Homo sapiens
tctggaggccatagggaaggat

SEQ ID NO: 7363056 - DNA, 22 bp, Homo sapiens
tctggaggggtttagagggaca

SEQ ID NO: 7363057 - DNA, 22 bp, Homo sapiens
tctggagtggagctgatcattt

SEQ ID NO: 7363058 - DNA, 22 bp, Homo sapiens
tctggctccactctgtgcatgc

SEQ ID NO: 7363059 - DNA, 22 bp, Homo sapiens
tctggctccacctcctttacta

SEQ ID NO: 7363060 - DNA, 22 bp, Homo sapiens
tctggctccaggaccgggcaca

SEQ ID NO: 7363061 - DNA, 22 bp, Homo sapiens
tctggctccactttcttcattt

SEQ ID NO: 7363062 - DNA, 21 bp, Homo sapiens
tctggccctcacagtcacacc

SEQ ID NO: 7363063 - DNA, 22 bp, Homo sapiens
tctggccctgctgctgtgagca

SEQ ID NO: 7363064 - DNA, 22 bp, Homo sapiens
tctggctccacacctcactgca

SEQ ID NO: 7363065 - DNA, 22 bp, Homo sapiens
tctggctccacacctcactgca

SEQ ID NO: 7363066 - DNA, 19 bp, Homo sapiens
tctggctccgcctcttagt

SEQ ID NO: 7363067 - DNA, 22 bp, Homo sapiens
tctggctccgtgtccgctccca

SEQ ID NO: 7363068 - DNA, 22 bp, Homo sapiens
tctggctcctgagtccatgctc

SEQ ID NO: 7363069 - DNA, 22 bp, Homo sapiens
tctggctcctgagtccatgctc

SEQ ID NO: 7363070 - DNA, 22 bp, Homo sapiens
tctggctccctggagctccaca

SEQ ID NO: 7363071 - DNA, 22 bp, Homo sapiens
tctggctcccagcctgctctca

SEQ ID NO: 7363072 - DNA, 23 bp, Homo sapiens
tctggctccatccttggggatcc

SEQ ID NO: 7363073 - DNA, 22 bp, Homo sapiens
tctggcccctggtctctggtgt

SEQ ID NO: 7363074 - DNA, 20 bp, Homo sapiens
tctggccccttcctgtcctg

SEQ ID NO: 7363075 - DNA, 22 bp, Homo sapiens
tctggcccctggtctctggtgt

SEQ ID NO: 7363076 - DNA, 21 bp, Homo sapiens
tctggccctaggttgggcctc

SEQ ID NO: 7363077 - DNA, 22 bp, Homo sapiens
tctggccctatggcatgtacct

SEQ ID NO: 7363078 - DNA, 22 bp, Homo sapiens
tctggccccggtcttcacagct

SEQ ID NO: 7363079 - DNA, 22 bp, Homo sapiens
tctggccccggtcttcacagct

SEQ ID NO: 7363080 - DNA, 22 bp, Homo sapiens
tctggcccctatggcggtggag

SEQ ID NO: 7363081 - DNA, 22 bp, Homo sapiens
tctggcccctggcagtcctgga

SEQ ID NO: 7363082 - DNA, 22 bp, Homo sapiens
tctggccccatacagagggtct

SEQ ID NO: 7363083 - DNA, 22 bp, Homo sapiens
tctggccccgcatgcactttat

SEQ ID NO: 7363084 - DNA, 22 bp, Homo sapiens
tctggccccatacagagggtct

SEQ ID NO: 7363085 - DNA, 23 bp, Homo sapiens
tctggccccattctttcccatgt

SEQ ID NO: 7363086 - DNA, 22 bp, Homo sapiens
tctggctctcatactcgccagt

SEQ ID NO: 7363087 - DNA, 22 bp, Homo sapiens
tctggctctcaacaaatattta

SEQ ID NO: 7363088 - DNA, 22 bp, Homo sapiens
tctggctctccagtgctcttag

SEQ ID NO: 7363089 - DNA, 23 bp, Homo sapiens
tctggctctatgtgacagctctc

SEQ ID NO: 7363090 - DNA, 22 bp, Homo sapiens
tctggctctataactcctagct

SEQ ID NO: 7363091 - DNA, 22 bp, Homo sapiens
tctggctctaactaggcatcag

SEQ ID NO: 7363092 - DNA, 22 bp, Homo sapiens
tctggctcggatttgtctagca

SEQ ID NO: 7363093 - DNA, 22 bp, Homo sapiens
tctggctcctggctccactgcc

SEQ ID NO: 7363094 - DNA, 19 bp, Homo sapiens
tctggctcctgccaggctg

SEQ ID NO: 7363095 - DNA, 22 bp, Homo sapiens
tctggctctctcatcacccaat

SEQ ID NO: 7363096 - DNA, 22 bp, Homo sapiens
tctggctctgaattcacttctg

SEQ ID NO: 7363097 - DNA, 22 bp, Homo sapiens
tctggctctgacactactgtta

SEQ ID NO: 7363098 - DNA, 20 bp, Homo sapiens
tctggctctttgctcctccc

SEQ ID NO: 7363099 - DNA, 22 bp, Homo sapiens
tctggctctgtgtccccaccca

SEQ ID NO: 7363100 - DNA, 22 bp, Homo sapiens
tctggctctgtgtcctcaccca

SEQ ID NO: 7363101 - DNA, 22 bp, Homo sapiens
tctggctctggagtccacctgc

SEQ ID NO: 7363102 - DNA, 22 bp, Homo sapiens
tctggctctttgggtgattgta

SEQ ID NO: 7363103 - DNA, 22 bp, Homo sapiens
tctggcttttctcttggatggt

SEQ ID NO: 7363104 - DNA, 22 bp, Homo sapiens
tctgggaactctgtcatttccc

SEQ ID NO: 7363105 - DNA, 22 bp, Homo sapiens
tctggctgtcattggaggcccc

SEQ ID NO: 7363106 - DNA, 22 bp, Homo sapiens
tctggctgtgtaaggtagcacc

SEQ ID NO: 7363107 - DNA, 22 bp, Homo sapiens
tctggctgggaagggggcccga

SEQ ID NO: 7363108 - DNA, 22 bp, Homo sapiens
tctggctggctcggccgggagt

SEQ ID NO: 7363109 - DNA, 22 bp, Homo sapiens
tctggctggcagtgatggtgtg

SEQ ID NO: 7363110 - DNA, 22 bp, Homo sapiens
tctggctgctgcgtgagtgctt

SEQ ID NO: 7363111 - DNA, 22 bp, Homo sapiens
tctgggagtgtgtctggccatc

SEQ ID NO: 7363112 - DNA, 22 bp, Homo sapiens
tctgggaggtggcagggtgcat

SEQ ID NO: 7363113 - DNA, 22 bp, Homo sapiens
tctgggagagcacgtggctgac

SEQ ID NO: 7363114 - DNA, 23 bp, Homo sapiens
tctgggccacttgtctgcacttc

SEQ ID NO: 7363115 - DNA, 22 bp, Homo sapiens
tctgggccaacccttccatggg

SEQ ID NO: 7363116 - DNA, 22 bp, Homo sapiens
tctgggccagtgatttttccag

SEQ ID NO: 7363117 - DNA, 21 bp, Homo sapiens
tctgggcccatgctgcctcac

SEQ ID NO: 7363118 - DNA, 22 bp, Homo sapiens
tctgggccctaaaccagctcta

SEQ ID NO: 7363119 - DNA, 22 bp, Homo sapiens
tctgggagtttctgtgggagct

SEQ ID NO: 7363120 - DNA, 22 bp, Homo sapiens
tctgattacttgagttatttag

SEQ ID NO: 7363121 - DNA, 22 bp, Homo sapiens
tctgcaacattcctctccccac

SEQ ID NO: 7363122 - DNA, 22 bp, Homo sapiens
tctgatttatatatgcagatac

SEQ ID NO: 7363123 - DNA, 22 bp, Homo sapiens
tctgcaaaagtgttcataaaga

SEQ ID NO: 7363124 - DNA, 22 bp, Homo sapiens
tctgcaacagtgccctgtaaat

SEQ ID NO: 7363125 - DNA, 21 bp, Homo sapiens
tctgatggtagatgagatgtg

SEQ ID NO: 7363126 - DNA, 21 bp, Homo sapiens
tctgatggtagatgagatgtg

SEQ ID NO: 7363127 - DNA, 22 bp, Homo sapiens
tctgatatttcattcaaaagta

SEQ ID NO: 7363128 - DNA, 22 bp, Homo sapiens
tctgatattggggtcagagtag

SEQ ID NO: 7363129 - DNA, 22 bp, Homo sapiens
tctgatatttgaagaccattag

SEQ ID NO: 7363130 - DNA, 22 bp, Homo sapiens
tctgatatttgaagaccattag

SEQ ID NO: 7363131 - DNA, 20 bp, Homo sapiens
tctgaggctgagcccagcgt

SEQ ID NO: 7363132 - DNA, 19 bp, Homo sapiens
tctgagggagcacgaaggc

SEQ ID NO: 7363133 - DNA, 23 bp, Homo sapiens
tctgagggagtgggcagtggcac

SEQ ID NO: 7363134 - DNA, 22 bp, Homo sapiens
tctgagggtgggagaaggagct

SEQ ID NO: 7363135 - DNA, 18 bp, Homo sapiens
tctgagggtgcgggagct

SEQ ID NO: 7363136 - DNA, 18 bp, Homo sapiens
tctgagggtgcgggagct

SEQ ID NO: 7363137 - DNA, 19 bp, Homo sapiens
tctgagggtccagatgcat

SEQ ID NO: 7363138 - DNA, 22 bp, Homo sapiens
tctgagggcttgaggggaagta

SEQ ID NO: 7363139 - DNA, 22 bp, Homo sapiens
tctgagggttgtagagagggac

SEQ ID NO: 7363140 - DNA, 22 bp, Homo sapiens
tctgagggtgggagaaggagct

SEQ ID NO: 7363141 - DNA, 22 bp, Homo sapiens
tctgagggttgtagagagggac

SEQ ID NO: 7363142 - DNA, 22 bp, Homo sapiens
tctgactgaaccaattatttac

SEQ ID NO: 7363143 - DNA, 22 bp, Homo sapiens
tctgacaggtcattttctatag

SEQ ID NO: 7363144 - DNA, 22 bp, Homo sapiens
tctgacagtgtgaatattgact

SEQ ID NO: 7363145 - DNA, 22 bp, Homo sapiens
tctgacagggccaaacatgaca

SEQ ID NO: 7363146 - DNA, 22 bp, Homo sapiens
tctgacaatgaacaatctatag

SEQ ID NO: 7363147 - DNA, 22 bp, Homo sapiens
tctgagaagcaccttctggaca

SEQ ID NO: 7363148 - DNA, 20 bp, Homo sapiens
tctgagaagcaaacaatgtt

SEQ ID NO: 7363149 - DNA, 22 bp, Homo sapiens
tctgagaacatgctttgatcat

SEQ ID NO: 7363150 - DNA, 21 bp, Homo sapiens
tctgagaacttctgctgcagc

SEQ ID NO: 7363151 - DNA, 22 bp, Homo sapiens
tctgagaacatcatttcctaca

SEQ ID NO: 7363152 - DNA, 22 bp, Homo sapiens
tctgagaacataaattgacttc

SEQ ID NO: 7363153 - DNA, 22 bp, Homo sapiens
tctgagaaatttctttgtgatg

SEQ ID NO: 7363154 - DNA, 22 bp, Homo sapiens
tctgagaatgagtgttttctta

SEQ ID NO: 7363155 - DNA, 22 bp, Homo sapiens
tctgagaataaaaattgcattt

SEQ ID NO: 7363156 - DNA, 22 bp, Homo sapiens
tctgagctgtggccattcttcc

SEQ ID NO: 7363157 - DNA, 22 bp, Homo sapiens
tctgagctgcccctttactttg

SEQ ID NO: 7363158 - DNA, 22 bp, Homo sapiens
tctgagcagggcagtgtccatg

SEQ ID NO: 7363159 - DNA, 22 bp, Homo sapiens
tctgagccataagagtacagga

SEQ ID NO: 7363160 - DNA, 22 bp, Homo sapiens
tctgagcagctttgttttgtgt

SEQ ID NO: 7363161 - DNA, 22 bp, Homo sapiens
tctgagacccatacaggcccac

SEQ ID NO: 7363162 - DNA, 20 bp, Homo sapiens
tctgcccaccccggctccca

SEQ ID NO: 7363163 - DNA, 18 bp, Homo sapiens
tctgcccaggacttggac

SEQ ID NO: 7363164 - DNA, 22 bp, Homo sapiens
tctgccctcattgctgcctgga

SEQ ID NO: 7363165 - DNA, 22 bp, Homo sapiens
tctgcctagtgggacagcagcc

SEQ ID NO: 7363166 - DNA, 22 bp, Homo sapiens
tctgcctgccagtctggtcctc

SEQ ID NO: 7363167 - DNA, 22 bp, Homo sapiens
tctgcctgcagtgtggcagggc

SEQ ID NO: 7363168 - DNA, 22 bp, Homo sapiens
tctgcctgagggagctgaggaa

SEQ ID NO: 7363169 - DNA, 22 bp, Homo sapiens
tctgcctggatgatggcagggc

SEQ ID NO: 7363170 - DNA, 22 bp, Homo sapiens
tctgcctgggtgtggagcagag

SEQ ID NO: 7363171 - DNA, 22 bp, Homo sapiens
tctgcctggcggactcccggaa

SEQ ID NO: 7363172 - DNA, 22 bp, Homo sapiens
tctgcctgcgctcacggggccg

SEQ ID NO: 7363173 - DNA, 22 bp, Homo sapiens
tctgcctgctaactcctgcacc

SEQ ID NO: 7363174 - DNA, 22 bp, Homo sapiens
tctgcctgcggctgcaggtggc

SEQ ID NO: 7363175 - DNA, 22 bp, Homo sapiens
tctgcctgttcccgattccatg

SEQ ID NO: 7363176 - DNA, 22 bp, Homo sapiens
tctgcctgttcccgattccatg

SEQ ID NO: 7363177 - DNA, 22 bp, Homo sapiens
tctgcctgttgagcctaaggcc

SEQ ID NO: 7363178 - DNA, 22 bp, Homo sapiens
tctgctcacatggctccatgca

SEQ ID NO: 7363179 - DNA, 22 bp, Homo sapiens
tctgctcacatggctccatgca

SEQ ID NO: 7363180 - DNA, 22 bp, Homo sapiens
tctgctcagccgatctgctccg

SEQ ID NO: 7363181 - DNA, 22 bp, Homo sapiens
tctgctcagccgatctgctccg

SEQ ID NO: 7363182 - DNA, 22 bp, Homo sapiens
tctgctcagccgatctgctccg

SEQ ID NO: 7363183 - DNA, 22 bp, Homo sapiens
tctgctcagggagggtcactac

SEQ ID NO: 7363184 - DNA, 22 bp, Homo sapiens
tctgctcagcatccctctgaga

SEQ ID NO: 7363185 - DNA, 20 bp, Homo sapiens
tctgctcagccctcagtggc

SEQ ID NO: 7363186 - DNA, 22 bp, Homo sapiens
tctgctcagcatccctctgaga

SEQ ID NO: 7363187 - DNA, 22 bp, Homo sapiens
tctgctctagttgcttcctgcc

SEQ ID NO: 7363188 - DNA, 19 bp, Homo sapiens
tctgcccacaagaaaggga

SEQ ID NO: 7363189 - DNA, 21 bp, Homo sapiens
tctgcccacactggccactgc

SEQ ID NO: 7363190 - DNA, 22 bp, Homo sapiens
tctgcaggtgggcccctagaat

SEQ ID NO: 7363191 - DNA, 22 bp, Homo sapiens
tctgcaggtgggcccctagaat

SEQ ID NO: 7363192 - DNA, 22 bp, Homo sapiens
tctgcatggagaggagatgcta

SEQ ID NO: 7363193 - DNA, 22 bp, Homo sapiens
tctgcatgatgaacaaatgagc

SEQ ID NO: 7363194 - DNA, 22 bp, Homo sapiens
tctgcagggtcccagcctcagc

SEQ ID NO: 7363195 - DNA, 17 bp, Homo sapiens
tctgcagggggccgtgt

SEQ ID NO: 7363196 - DNA, 22 bp, Homo sapiens
tctgcagggtcccagcctcagc

SEQ ID NO: 7363197 - DNA, 22 bp, Homo sapiens
tctgcagggatgtgaggggtga

SEQ ID NO: 7363198 - DNA, 22 bp, Homo sapiens
tctgcagggcccttggctcctg

SEQ ID NO: 7363199 - DNA, 22 bp, Homo sapiens
tctgcaggcttataggatgggt

SEQ ID NO: 7363200 - DNA, 22 bp, Homo sapiens
tctgcaggcctcgacaaggcca

SEQ ID NO: 7363201 - DNA, 22 bp, Homo sapiens
tctgcaggatcagagccagagg

SEQ ID NO: 7363202 - DNA, 22 bp, Homo sapiens
tctgcaggaggctggctgcagg

SEQ ID NO: 7363203 - DNA, 22 bp, Homo sapiens
tctgcaggagcagggcgtggag

SEQ ID NO: 7363204 - DNA, 22 bp, Homo sapiens
tctgcaggagagtgccctagag

SEQ ID NO: 7363205 - DNA, 18 bp, Homo sapiens
tctgcaggacctcagggc

SEQ ID NO: 7363206 - DNA, 22 bp, Homo sapiens
tctgcaggactgaggcctgttt

SEQ ID NO: 7363207 - DNA, 22 bp, Homo sapiens
tctgcaggagagtgccctagag

SEQ ID NO: 7363208 - DNA, 22 bp, Homo sapiens
tctgcaggaagctggcggctga

SEQ ID NO: 7363209 - DNA, 18 bp, Homo sapiens
tctgcaggacctcagggc

SEQ ID NO: 7363210 - DNA, 22 bp, Homo sapiens
tctgcagctttcccctgattta

SEQ ID NO: 7363211 - DNA, 20 bp, Homo sapiens
tctgcactcctgcatgtgcc

SEQ ID NO: 7363212 - DNA, 22 bp, Homo sapiens
tctgcacaaaactgtcgcagaa

SEQ ID NO: 7363213 - DNA, 22 bp, Homo sapiens
aaagcctcccaggttatgagta

SEQ ID NO: 7363214 - DNA, 22 bp, Homo sapiens
aaagcctgtctggtcatagcta

SEQ ID NO: 7363215 - DNA, 22 bp, Homo sapiens
aacatttgtttggcttcaatta

SEQ ID NO: 7363216 - DNA, 22 bp, Homo sapiens
aacccacaaaggatttcagctc

SEQ ID NO: 7363217 - DNA, 22 bp, Homo sapiens
aaaggcagtgtgatactgtggt

SEQ ID NO: 7363218 - DNA, 22 bp, Homo sapiens
aaaggcagtgggtatgtggatc

SEQ ID NO: 7363219 - DNA, 22 bp, Homo sapiens
aaaggcagagttgttggaggca

SEQ ID NO: 7363220 - DNA, 18 bp, Homo sapiens
aaaggcagattactggga

SEQ ID NO: 7363221 - DNA, 22 bp, Homo sapiens
aacccgggaggcagaggttgtg

SEQ ID NO: 7363222 - DNA, 22 bp, Homo sapiens
aaccccaggctggaggagtctc

SEQ ID NO: 7363223 - DNA, 22 bp, Homo sapiens
aaccccagtaccccaggatatg

SEQ ID NO: 7363224 - DNA, 22 bp, Homo sapiens
aacccgggaggcagaggttgtg

SEQ ID NO: 7363225 - DNA, 22 bp, Homo sapiens
aaccccgctcaggctgggtgag

SEQ ID NO: 7363226 - DNA, 22 bp, Homo sapiens
aactgtatacaattgtcagaca

SEQ ID NO: 7363227 - DNA, 22 bp, Homo sapiens
aactgtcttaataacaaaagct

SEQ ID NO: 7363228 - DNA, 22 bp, Homo sapiens
aactgtcttgcctactcagcat

SEQ ID NO: 7363229 - DNA, 22 bp, Homo sapiens
aaaggttttgccctgggtattc

SEQ ID NO: 7363230 - DNA, 22 bp, Homo sapiens
aactgtaatttttacatagtaa

SEQ ID NO: 7363231 - DNA, 22 bp, Homo sapiens
aagaacataacagaagctgtgt

SEQ ID NO: 7363232 - DNA, 22 bp, Homo sapiens
aagaacagttgggaggtgagcc

SEQ ID NO: 7363233 - DNA, 22 bp, Homo sapiens
aagaacatgagttatgatgatt

SEQ ID NO: 7363234 - DNA, 22 bp, Homo sapiens
aaaggtttttatttatcctgga

SEQ ID NO: 7363235 - DNA, 22 bp, Homo sapiens
aaagtaagatttgcatttcaga

SEQ ID NO: 7363236 - DNA, 22 bp, Homo sapiens
aaagtaattgcagtttctgcca

SEQ ID NO: 7363237 - DNA, 22 bp, Homo sapiens
aagaaataagacttctctgtcc

SEQ ID NO: 7363238 - DNA, 22 bp, Homo sapiens
aacatagaattgttatattttc

SEQ ID NO: 7363239 - DNA, 22 bp, Homo sapiens
aacatacatatttcagtgtcca

SEQ ID NO: 7363240 - DNA, 22 bp, Homo sapiens
aaagcccatgtggaagtacagg

SEQ ID NO: 7363241 - DNA, 22 bp, Homo sapiens
aaagcctcccaggttatgagta

SEQ ID NO: 7363242 - DNA, 22 bp, Homo sapiens
aaagccattgcagagcaggatt

SEQ ID NO: 7363243 - DNA, 22 bp, Homo sapiens
aaagccattgcagagcaggatt

SEQ ID NO: 7363244 - DNA, 22 bp, Homo sapiens
aaagccattgaactgtacttta

SEQ ID NO: 7363245 - DNA, 22 bp, Homo sapiens
aaagccattgaactgtacttta

SEQ ID NO: 7363246 - DNA, 22 bp, Homo sapiens
aaagccattacaaaatttcata

SEQ ID NO: 7363247 - DNA, 22 bp, Homo sapiens
aacataaatttgaagtggcaaa

SEQ ID NO: 7363248 - DNA, 22 bp, Homo sapiens
aaagcacttcaggagcagtttg

SEQ ID NO: 7363249 - DNA, 23 bp, Homo sapiens
aacacttgcatgaacagctacac

SEQ ID NO: 7363250 - DNA, 23 bp, Homo sapiens
aaagcaaggaattggcaacagag

SEQ ID NO: 7363251 - DNA, 22 bp, Homo sapiens
aaagcaagatgcatccgtcaag

SEQ ID NO: 7363252 - DNA, 22 bp, Homo sapiens
aaagcaagtctctacaaagtac

SEQ ID NO: 7363253 - DNA, 22 bp, Homo sapiens
aaagcaagtctctacaaagtac

SEQ ID NO: 7363254 - DNA, 23 bp, Homo sapiens
aaagcaaggaattggcaacagag

SEQ ID NO: 7363255 - DNA, 22 bp, Homo sapiens
aacacttctcatcactgcaagc

SEQ ID NO: 7363256 - DNA, 22 bp, Homo sapiens
aacacttatccacatttgaaag

SEQ ID NO: 7363257 - DNA, 22 bp, Homo sapiens
aacacttaaggagagatcaaat

SEQ ID NO: 7363258 - DNA, 22 bp, Homo sapiens
aaagatttatgaagttcaatta

SEQ ID NO: 7363259 - DNA, 22 bp, Homo sapiens
aaagatttcagaagcctgtgcc

SEQ ID NO: 7363260 - DNA, 22 bp, Homo sapiens
aaagatttgaaattaggcatca

SEQ ID NO: 7363261 - DNA, 22 bp, Homo sapiens
aaagatttgagttctgcttata

SEQ ID NO: 7363262 - DNA, 22 bp, Homo sapiens
aaagattatggcattgaaatac

SEQ ID NO: 7363263 - DNA, 22 bp, Homo sapiens
aaagattatggcattgaaatac

SEQ ID NO: 7363264 - DNA, 22 bp, Homo sapiens
aaagatgttttataagttatgg

SEQ ID NO: 7363265 - DNA, 22 bp, Homo sapiens
aaagatgttttataagttatgg

SEQ ID NO: 7363266 - DNA, 22 bp, Homo sapiens
aaagattaaatcaaattggtca

SEQ ID NO: 7363267 - DNA, 22 bp, Homo sapiens
aaagattatggaacacacatga

SEQ ID NO: 7363268 - DNA, 22 bp, Homo sapiens
aaagattatggcattgaaatac

SEQ ID NO: 7363269 - DNA, 22 bp, Homo sapiens
aaagattagataagatagattt

SEQ ID NO: 7363270 - DNA, 22 bp, Homo sapiens
aaagattagataagatagattt

SEQ ID NO: 7363271 - DNA, 22 bp, Homo sapiens
aaagattagataagatagattt

SEQ ID NO: 7363272 - DNA, 22 bp, Homo sapiens
aaagattaaggtattgttagct

SEQ ID NO: 7363273 - DNA, 22 bp, Homo sapiens
aagattatggcagataacaatt

SEQ ID NO: 7363274 - DNA, 22 bp, Homo sapiens
aagattcccagagaagttccac

SEQ ID NO: 7363275 - DNA, 22 bp, Homo sapiens
aagattctagaggaacttctta

SEQ ID NO: 7363276 - DNA, 22 bp, Homo sapiens
aagattctagaggaacttctta

SEQ ID NO: 7363277 - DNA, 22 bp, Homo sapiens
aagcagcatatgacagcatcca

SEQ ID NO: 7363278 - DNA, 22 bp, Homo sapiens
aagcaggagatgcaggaatgta

SEQ ID NO: 7363279 - DNA, 22 bp, Homo sapiens
aagcaggagatgcaggaatgta

SEQ ID NO: 7363280 - DNA, 22 bp, Homo sapiens
aagcaggagatgggtgcttttc

SEQ ID NO: 7363281 - DNA, 22 bp, Homo sapiens
aagatcaggcgtggaaaacact

SEQ ID NO: 7363282 - DNA, 22 bp, Homo sapiens
aagatgtttagatttatacaat

SEQ ID NO: 7363283 - DNA, 22 bp, Homo sapiens
aagattactacggaacatgacc

SEQ ID NO: 7363284 - DNA, 22 bp, Homo sapiens
aagcaggccctgggccagggga

SEQ ID NO: 7363285 - DNA, 22 bp, Homo sapiens
aaatctgttgtaatgtttttta

SEQ ID NO: 7363286 - DNA, 22 bp, Homo sapiens
aaatctgtttcaggtatatttg

SEQ ID NO: 7363287 - DNA, 22 bp, Homo sapiens
aagcctggactatcgcgtgtgc

SEQ ID NO: 7363288 - DNA, 22 bp, Homo sapiens
aaatgcatggctgttttaaagc

SEQ ID NO: 7363289 - DNA, 22 bp, Homo sapiens
aaatgcatgtagaataatagag

SEQ ID NO: 7363290 - DNA, 22 bp, Homo sapiens
aagccggctgggccgaggctgc

SEQ ID NO: 7363291 - DNA, 22 bp, Homo sapiens
aagcccttggcagagttcccca

SEQ ID NO: 7363292 - DNA, 22 bp, Homo sapiens
aagccctgttctttctctcacc

SEQ ID NO: 7363293 - DNA, 22 bp, Homo sapiens
aaagtgattatgctgtcaaaga

SEQ ID NO: 7363294 - DNA, 22 bp, Homo sapiens
aaagtgcagaactgttctcact

SEQ ID NO: 7363295 - DNA, 23 bp, Homo sapiens
aagactaattcttaattgcttag

SEQ ID NO: 7363296 - DNA, 22 bp, Homo sapiens
aagactctatctttagagatca

SEQ ID NO: 7363297 - DNA, 22 bp, Homo sapiens
aaagtttacagtgcacatgggt

SEQ ID NO: 7363298 - DNA, 22 bp, Homo sapiens
aaagtttaggctttgaaaccag

SEQ ID NO: 7363299 - DNA, 22 bp, Homo sapiens
aaagtttagtgtcctctaccac

SEQ ID NO: 7363300 - DNA, 22 bp, Homo sapiens
aaagtttatcatagccggggac

SEQ ID NO: 7363301 - DNA, 22 bp, Homo sapiens
aaagtttattttccctggttag

SEQ ID NO: 7363302 - DNA, 22 bp, Homo sapiens
aaagttttagaactaggaagca

SEQ ID NO: 7363303 - DNA, 22 bp, Homo sapiens
aaagttttagaactaggaagca

SEQ ID NO: 7363304 - DNA, 22 bp, Homo sapiens
aagagggctgcaatcttattgc

SEQ ID NO: 7363305 - DNA, 22 bp, Homo sapiens
aagagggctgcaatcttattgc

SEQ ID NO: 7363306 - DNA, 22 bp, Homo sapiens
aagagggaggtgcgggtgcaga

SEQ ID NO: 7363307 - DNA, 22 bp, Homo sapiens
aagagggagggcaaaggcactg

SEQ ID NO: 7363308 - DNA, 22 bp, Homo sapiens
aagagggagggcaaaggcactg

SEQ ID NO: 7363309 - DNA, 22 bp, Homo sapiens
aagagggaagtcacctggaggt

SEQ ID NO: 7363310 - DNA, 22 bp, Homo sapiens
aaatactggttttggagatgct

SEQ ID NO: 7363311 - DNA, 22 bp, Homo sapiens
aagataaactcttgatttctga

SEQ ID NO: 7363312 - DNA, 22 bp, Homo sapiens
aaatactattgaccaggtctct

SEQ ID NO: 7363313 - DNA, 22 bp, Homo sapiens
aaatactagaattcagagttga

SEQ ID NO: 7363314 - DNA, 21 bp, Homo sapiens
aaagaaatctcccattggtag

SEQ ID NO: 7363315 - DNA, 22 bp, Homo sapiens
aaagaaatagatggcatttaaa

SEQ ID NO: 7363316 - DNA, 22 bp, Homo sapiens
aaagaaatagatggcatttaaa

SEQ ID NO: 7363317 - DNA, 22 bp, Homo sapiens
aaagaaatacctttctcagctt

SEQ ID NO: 7363318 - DNA, 22 bp, Homo sapiens
aaagaaatacctttctcagctt

SEQ ID NO: 7363319 - DNA, 22 bp, Homo sapiens
aaagaaatagatggcatttaaa

SEQ ID NO: 7363320 - DNA, 22 bp, Homo sapiens
aaactttttattctaatgtcta

SEQ ID NO: 7363321 - DNA, 22 bp, Homo sapiens
aaagaaacctatcagccacatg

SEQ ID NO: 7363322 - DNA, 22 bp, Homo sapiens
aaagaaatacctttctcagctt

SEQ ID NO: 7363323 - DNA, 22 bp, Homo sapiens
aaagaaatacctttctcagctt

SEQ ID NO: 7363324 - DNA, 22 bp, Homo sapiens
aaatagtcctgggaatagtact

SEQ ID NO: 7363325 - DNA, 22 bp, Homo sapiens
aaatagttagccctgcatatat

SEQ ID NO: 7363326 - DNA, 22 bp, Homo sapiens
aaactttgttcgtctgatgtgg

SEQ ID NO: 7363327 - DNA, 22 bp, Homo sapiens
aaactttggtatgtagcaaaac

SEQ ID NO: 7363328 - DNA, 22 bp, Homo sapiens
aaactttggattgtgattgtgc

SEQ ID NO: 7363329 - DNA, 22 bp, Homo sapiens
aaatagttgtttggatcaataa

SEQ ID NO: 7363330 - DNA, 22 bp, Homo sapiens
aaatagttgtttggatcaataa

SEQ ID NO: 7363331 - DNA, 22 bp, Homo sapiens
aaagacttgggtgaagtaattt

SEQ ID NO: 7363332 - DNA, 22 bp, Homo sapiens
aaagactttcacctagcaaaga

SEQ ID NO: 7363333 - DNA, 22 bp, Homo sapiens
aaagactgcaaaaacgcacaga

SEQ ID NO: 7363334 - DNA, 22 bp, Homo sapiens
aaagactgcaaaaacgcacaga

SEQ ID NO: 7363335 - DNA, 22 bp, Homo sapiens
aaagactgaggggaaagtgatg

SEQ ID NO: 7363336 - DNA, 22 bp, Homo sapiens
aaagactggtgtgttacatata

SEQ ID NO: 7363337 - DNA, 22 bp, Homo sapiens
aaagagcaccctcaatgtctga

SEQ ID NO: 7363338 - DNA, 22 bp, Homo sapiens
aaagatgttatgaaataactat

SEQ ID NO: 7363339 - DNA, 22 bp, Homo sapiens
aaagatgtgtaagaaataaaca

SEQ ID NO: 7363340 - DNA, 22 bp, Homo sapiens
aaagatgtgtaagaaataaaca

SEQ ID NO: 7363341 - DNA, 22 bp, Homo sapiens
aaagagaacttttacccaagaa

SEQ ID NO: 7363342 - DNA, 22 bp, Homo sapiens
aaagagaaaatgatctgtacat

SEQ ID NO: 7363343 - DNA, 22 bp, Homo sapiens
aaacagcaatggagaagccagg

SEQ ID NO: 7363344 - DNA, 22 bp, Homo sapiens
aaacagatgagttataatagcc

SEQ ID NO: 7363345 - DNA, 22 bp, Homo sapiens
aaacagcaatggagaagccagg

SEQ ID NO: 7363346 - DNA, 20 bp, Homo sapiens
aaacagctaaaccagctctc

SEQ ID NO: 7363347 - DNA, 22 bp, Homo sapiens
aaacactgatggatatttttcc

SEQ ID NO: 7363348 - DNA, 22 bp, Homo sapiens
aaacactgaagacctatctggt

SEQ ID NO: 7363349 - DNA, 22 bp, Homo sapiens
aaacactgaaaattttggtcat

SEQ ID NO: 7363350 - DNA, 22 bp, Homo sapiens
aaacagataatgctataaatgg

SEQ ID NO: 7363351 - DNA, 22 bp, Homo sapiens
aaacagataagggacaatttca

SEQ ID NO: 7363352 - DNA, 22 bp, Homo sapiens
aaacactgtgggacatcttact

SEQ ID NO: 7363353 - DNA, 22 bp, Homo sapiens
aaacattccctaatgtgtccgt

SEQ ID NO: 7363354 - DNA, 22 bp, Homo sapiens
aaacattgatgggaagtttaat

SEQ ID NO: 7363355 - DNA, 22 bp, Homo sapiens
aaactgtaaacacagcagtaca

SEQ ID NO: 7363356 - DNA, 22 bp, Homo sapiens
aaactgtagtgcttcgatctga

SEQ ID NO: 7363357 - DNA, 22 bp, Homo sapiens
aaactgtatagggaaaagtaga

SEQ ID NO: 7363358 - DNA, 22 bp, Homo sapiens
aaacattccatttctatgtaag

SEQ ID NO: 7363359 - DNA, 22 bp, Homo sapiens
aaacattagacaccatatgctc

SEQ ID NO: 7363360 - DNA, 22 bp, Homo sapiens
aaacatgttttctgaatatttt

SEQ ID NO: 7363361 - DNA, 22 bp, Homo sapiens
aaacattagacaccatatgctc

SEQ ID NO: 7363362 - DNA, 22 bp, Homo sapiens
aaacatgtaattctgcttaaga

SEQ ID NO: 7363363 - DNA, 22 bp, Homo sapiens
aaacatgcattcaagaaaatct

SEQ ID NO: 7363364 - DNA, 22 bp, Homo sapiens
aaacatgctggatttagaatat

SEQ ID NO: 7363365 - DNA, 22 bp, Homo sapiens
aaaatatgtataactcttctgc

SEQ ID NO: 7363366 - DNA, 22 bp, Homo sapiens
aaaatattttagggccaggaga

SEQ ID NO: 7363367 - DNA, 21 bp, Homo sapiens
aaaatgtgagcgtgatgctta

SEQ ID NO: 7363368 - DNA, 22 bp, Homo sapiens
aaaatactgtggagtgttgaaa

SEQ ID NO: 7363369 - DNA, 22 bp, Homo sapiens
aaaatagttaacgttcagagta

SEQ ID NO: 7363370 - DNA, 22 bp, Homo sapiens
aaaatatgaagttgtcagtatg

SEQ ID NO: 7363371 - DNA, 20 bp, Homo sapiens
aaaatatgtataactcttct

SEQ ID NO: 7363372 - DNA, 20 bp, Homo sapiens
aaaatatgtataactcttct

SEQ ID NO: 7363373 - DNA, 22 bp, Homo sapiens
aaacagtaagttctagtattat

SEQ ID NO: 7363374 - DNA, 22 bp, Homo sapiens
aaacaggtagccctagccttct

SEQ ID NO: 7363375 - DNA, 22 bp, Homo sapiens
aaaattgaggctcatgttaaat

SEQ ID NO: 7363376 - DNA, 22 bp, Homo sapiens
aaaattgagagtcttgtgcaag

SEQ ID NO: 7363377 - DNA, 22 bp, Homo sapiens
aaaattgagagtcttgtgcaag

SEQ ID NO: 7363378 - DNA, 22 bp, Homo sapiens
aaagagcatggaaagttcagga

SEQ ID NO: 7363379 - DNA, 22 bp, Homo sapiens
aaagagcccttccatgactctt

SEQ ID NO: 7363380 - DNA, 22 bp, Homo sapiens
aaaatgtgatctacaaatgcaa

SEQ ID NO: 7363381 - DNA, 22 bp, Homo sapiens
aaacacattttaggaaaatcta

SEQ ID NO: 7363382 - DNA, 22 bp, Homo sapiens
aaacacatcattcatgtcgtca

SEQ ID NO: 7363383 - DNA, 22 bp, Homo sapiens
aaacacattagccctgtggaaa

SEQ ID NO: 7363384 - DNA, 22 bp, Homo sapiens
aaacaccaagagctagctatta

SEQ ID NO: 7363385 - DNA, 22 bp, Homo sapiens
aaacactagcaggaagcactga

SEQ ID NO: 7363386 - DNA, 22 bp, Homo sapiens
aaacaccaagagctagctatta

SEQ ID NO: 7363387 - DNA, 22 bp, Homo sapiens
aaacaccaagagctagctatta

SEQ ID NO: 7363388 - DNA, 22 bp, Homo sapiens
aaacaccagcactgtttacaaa

SEQ ID NO: 7363389 - DNA, 22 bp, Homo sapiens
aaacacaagaggcagggtacag

SEQ ID NO: 7363390 - DNA, 22 bp, Homo sapiens
aaagagctgggacttaaagtgc

SEQ ID NO: 7363391 - DNA, 22 bp, Homo sapiens
aaagagctggcatttatagtct

SEQ ID NO: 7363392 - DNA, 22 bp, Homo sapiens
aaaacataaactgacagcccat

SEQ ID NO: 7363393 - DNA, 22 bp, Homo sapiens
aaaaggcagtgcaagagagggt

SEQ ID NO: 7363394 - DNA, 22 bp, Homo sapiens
aaaaggcatggaggttgatagt

SEQ ID NO: 7363395 - DNA, 22 bp, Homo sapiens
aaaaggcattttgtcaaccata

SEQ ID NO: 7363396 - DNA, 22 bp, Homo sapiens
aaaaggctaatccagagcaact

SEQ ID NO: 7363397 - DNA, 22 bp, Homo sapiens
aaaaggctaattaagttttgga

SEQ ID NO: 7363398 - DNA, 22 bp, Homo sapiens
aaaaggctagctagtaacagaa

SEQ ID NO: 7363399 - DNA, 22 bp, Homo sapiens
aaaacagtttttgctaactgct

SEQ ID NO: 7363400 - DNA, 22 bp, Homo sapiens
aaaaagtttcaactgccaactc

SEQ ID NO: 7363401 - DNA, 22 bp, Homo sapiens
aaaaggaggtcactttattcct

SEQ ID NO: 7363402 - DNA, 21 bp, Homo sapiens
aaaaggaggcaggtgaacagc

SEQ ID NO: 7363403 - DNA, 22 bp, Homo sapiens
aaaaatacttcacttctgggtg

SEQ ID NO: 7363404 - DNA, 22 bp, Homo sapiens
aaaaagcttaaatgagcagttc

SEQ ID NO: 7363405 - DNA, 22 bp, Homo sapiens
aaaaagcttaaatgagcagttc

SEQ ID NO: 7363406 - DNA, 22 bp, Homo sapiens
aaaaaggttgatccagattagg

SEQ ID NO: 7363407 - DNA, 22 bp, Homo sapiens
aaaattatggagtatcccaaag

SEQ ID NO: 7363408 - DNA, 22 bp, Homo sapiens
aaaattattcatggcttttgga

SEQ ID NO: 7363409 - DNA, 22 bp, Homo sapiens
aaaattattcatggcttttgga

SEQ ID NO: 7363410 - DNA, 22 bp, Homo sapiens
aaaattattcatggcttttgga

SEQ ID NO: 7363411 - DNA, 22 bp, Homo sapiens
aaaattaagtgtctgggaagcc

SEQ ID NO: 7363412 - DNA, 22 bp, Homo sapiens
aaaattatagatctagtgcctg

SEQ ID NO: 7363413 - DNA, 22 bp, Homo sapiens
aaaattaagtgtctgggaagcc

SEQ ID NO: 7363414 - DNA, 22 bp, Homo sapiens
aaaattatggagtatcccaaag

SEQ ID NO: 7363415 - DNA, 22 bp, Homo sapiens
aaaattatagatctagtgcctg

SEQ ID NO: 7363416 - DNA, 22 bp, Homo sapiens
aaaattatagatctagtgcctg

SEQ ID NO: 7363417 - DNA, 22 bp, Homo sapiens
aaaattatggagtatcccaaag

SEQ ID NO: 7363418 - DNA, 21 bp, Homo sapiens
aaaatgtttccttgttggtta

SEQ ID NO: 7363419 - DNA, 22 bp, Homo sapiens
aaaactttcagggatacagaaa

SEQ ID NO: 7363420 - DNA, 19 bp, Homo sapiens
aaaaggagagatcagagtt

SEQ ID NO: 7363421 - DNA, 19 bp, Homo sapiens
aaaaggagagatcagagtt

SEQ ID NO: 7363422 - DNA, 22 bp, Homo sapiens
aaaagggactactctcagctcc

SEQ ID NO: 7363423 - DNA, 22 bp, Homo sapiens
aaaaggtagattctccttctat

SEQ ID NO: 7363424 - DNA, 22 bp, Homo sapiens
aaaaggtagttgccaaataagg

SEQ ID NO: 7363425 - DNA, 22 bp, Homo sapiens
aaaagtaatcgcagtttttgcc

SEQ ID NO: 7363426 - DNA, 22 bp, Homo sapiens
aaaagtaattgcaattttgtag

SEQ ID NO: 7363427 - DNA, 22 bp, Homo sapiens
aaaagtaattgcagttttgtca

SEQ ID NO: 7363428 - DNA, 22 bp, Homo sapiens
aaaagtaattgcagtttttgcc

SEQ ID NO: 7363429 - DNA, 22 bp, Homo sapiens
aaaagtaattgcagttttcgcc

SEQ ID NO: 7363430 - DNA, 22 bp, Homo sapiens
aaaagtaattgcggtttttgcc

SEQ ID NO: 7363431 - DNA, 22 bp, Homo sapiens
aaaagtaattgcggtttttgct

SEQ ID NO: 7363432 - DNA, 22 bp, Homo sapiens
aaaagtaattgtggttttggcc

SEQ ID NO: 7363433 - DNA, 22 bp, Homo sapiens
aaaagtaattgtggtttttgcc

SEQ ID NO: 7363434 - DNA, 22 bp, Homo sapiens
aacaatgtctcatcctatgtgg

SEQ ID NO: 7363435 - DNA, 22 bp, Homo sapiens
aaattttaaggctggaacttaa

SEQ ID NO: 7363436 - DNA, 22 bp, Homo sapiens
aaatttgttcaatgtctatttg

SEQ ID NO: 7363437 - DNA, 22 bp, Homo sapiens
aacacacctggttaacctcttt

SEQ ID NO: 7363438 - DNA, 22 bp, Homo sapiens
aacacaggcatactggctccag

SEQ ID NO: 7363439 - DNA, 22 bp, Homo sapiens
aacactttggaatagagatagg

SEQ ID NO: 7363440 - DNA, 22 bp, Homo sapiens
aacagacaactcctgtggctca

SEQ ID NO: 7363441 - DNA, 22 bp, Homo sapiens
aaatgtcaaggtgatagatgca

SEQ ID NO: 7363442 - DNA, 22 bp, Homo sapiens
aaatgtccttagagaaaagtca

SEQ ID NO: 7363443 - DNA, 22 bp, Homo sapiens
aaatgtctactcctgtgtttat

SEQ ID NO: 7363444 - DNA, 22 bp, Homo sapiens
aaatgtctactcctgtgtttat

SEQ ID NO: 7363445 - DNA, 22 bp, Homo sapiens
aaatgcattggtttctacttgt

SEQ ID NO: 7363446 - DNA, 22 bp, Homo sapiens
aaatgcatgtatgtaatatgct

SEQ ID NO: 7363447 - DNA, 22 bp, Homo sapiens
aaggaagacacagatgaagtga

SEQ ID NO: 7363448 - DNA, 22 bp, Homo sapiens
aaggaagacacagatgaagtga

SEQ ID NO: 7363449 - DNA, 22 bp, Homo sapiens
aaggaagagaatccttctcaga

SEQ ID NO: 7363450 - DNA, 22 bp, Homo sapiens
aaggcactgtactagttagtta

SEQ ID NO: 7363451 - DNA, 22 bp, Homo sapiens
aaggcagcaactaatggatctc

SEQ ID NO: 7363452 - DNA, 22 bp, Homo sapiens
aaggcagcacagcaactgctca

SEQ ID NO: 7363453 - DNA, 22 bp, Homo sapiens
aaggcagcaagaattccaggtt

SEQ ID NO: 7363454 - DNA, 22 bp, Homo sapiens
aaggcagcaccgcctcctgaaa

SEQ ID NO: 7363455 - DNA, 22 bp, Homo sapiens
aaggcagcagaggaaaggtgct

SEQ ID NO: 7363456 - DNA, 22 bp, Homo sapiens
aaggcagcagaggaaaggtgct

SEQ ID NO: 7363457 - DNA, 22 bp, Homo sapiens
aaggcagccagatcctttgggt

SEQ ID NO: 7363458 - DNA, 22 bp, Homo sapiens
aaggcagcatgaatccctgtac

SEQ ID NO: 7363459 - DNA, 22 bp, Homo sapiens
aaggcagcagtgcacgactgat

SEQ ID NO: 7363460 - DNA, 19 bp, Homo sapiens
aaggcagcagtagcatcca

SEQ ID NO: 7363461 - DNA, 22 bp, Homo sapiens
aaggcagcaggatttggtgact

SEQ ID NO: 7363462 - DNA, 22 bp, Homo sapiens
aaggcagccatgtgctttgggt

SEQ ID NO: 7363463 - DNA, 22 bp, Homo sapiens
aaggcagccatagcaccatcca

SEQ ID NO: 7363464 - DNA, 22 bp, Homo sapiens
aaggcagccctggctcagcctg

SEQ ID NO: 7363465 - DNA, 22 bp, Homo sapiens
aaattattcaaaaagctgtgtt

SEQ ID NO: 7363466 - DNA, 22 bp, Homo sapiens
aaattattcaaaaagctgtgtt

SEQ ID NO: 7363467 - DNA, 21 bp, Homo sapiens
aaattcacctagtaaaacttc

SEQ ID NO: 7363468 - DNA, 22 bp, Homo sapiens
aaattattctcatgtgtttctt

SEQ ID NO: 7363469 - DNA, 18 bp, Homo sapiens
aaattattcttccttttc

SEQ ID NO: 7363470 - DNA, 23 bp, Homo sapiens
aaattattgctcttcaattgcct

SEQ ID NO: 7363471 - DNA, 22 bp, Homo sapiens
aaattcaatgatcactggctca

SEQ ID NO: 7363472 - DNA, 22 bp, Homo sapiens
aaattcaattaactttcatgct

SEQ ID NO: 7363473 - DNA, 22 bp, Homo sapiens
aaattattttcagaatggagaa

SEQ ID NO: 7363474 - DNA, 22 bp, Homo sapiens
aaattattgggtcccaccccag

SEQ ID NO: 7363475 - DNA, 22 bp, Homo sapiens
aacccttaagcaaactcattta

SEQ ID NO: 7363476 - DNA, 22 bp, Homo sapiens
aacccgggaggtggaggttatg

SEQ ID NO: 7363477 - DNA, 22 bp, Homo sapiens
aacccgggaggcggaggttgtg

SEQ ID NO: 7363478 - DNA, 22 bp, Homo sapiens
aacccgggaggcggaggttgtg

SEQ ID NO: 7363479 - DNA, 22 bp, Homo sapiens
aacctgggcttgaacagtgcct

SEQ ID NO: 7363480 - DNA, 22 bp, Homo sapiens
aacctgctttctcagagaaggg

SEQ ID NO: 7363481 - DNA, 23 bp, Homo sapiens
aacgacagctacaggcatcccac

SEQ ID NO: 7363482 - DNA, 22 bp, Homo sapiens
aacgaatagggatttttctaac

SEQ ID NO: 7363483 - DNA, 22 bp, Homo sapiens
aaccttcttgtgcagaactgta

SEQ ID NO: 7363484 - DNA, 22 bp, Homo sapiens
aactagcagctaagacataatt

SEQ ID NO: 7363485 - DNA, 22 bp, Homo sapiens
aactagtaaaagcaacagtata

SEQ ID NO: 7363486 - DNA, 22 bp, Homo sapiens
aatgctttcaaaaatgtgcagt

SEQ ID NO: 7363487 - DNA, 23 bp, Homo sapiens
aatgacaggcaatgtaattgtgt

SEQ ID NO: 7363488 - DNA, 22 bp, Homo sapiens
aatgacagccagattcttctct

SEQ ID NO: 7363489 - DNA, 22 bp, Homo sapiens
aatgacaatattaatttggagg

SEQ ID NO: 7363490 - DNA, 22 bp, Homo sapiens
aactactctgctcatgtttata

SEQ ID NO: 7363491 - DNA, 22 bp, Homo sapiens
aatgacatgctttttaattata

SEQ ID NO: 7363492 - DNA, 22 bp, Homo sapiens
aatgacagtggcacagtcactt

SEQ ID NO: 7363493 - DNA, 22 bp, Homo sapiens
aatgacagtgttgggccagatg

SEQ ID NO: 7363494 - DNA, 22 bp, Homo sapiens
aacataaatttgaagtggcaaa

SEQ ID NO: 7363495 - DNA, 22 bp, Homo sapiens
aacatatctacggatacgatta

SEQ ID NO: 7363496 - DNA, 22 bp, Homo sapiens
aacagcttcatcacatggcata

SEQ ID NO: 7363497 - DNA, 22 bp, Homo sapiens
aacatatttggctgatattccc

SEQ ID NO: 7363498 - DNA, 22 bp, Homo sapiens
aacatcagaagtagaagactca

SEQ ID NO: 7363499 - DNA, 22 bp, Homo sapiens
aacatcagaatatccatgttgg

SEQ ID NO: 7363500 - DNA, 19 bp, Homo sapiens
aacatcatggctctttcca

SEQ ID NO: 7363501 - DNA, 22 bp, Homo sapiens
aacatcatcatgaacaactaat

SEQ ID NO: 7363502 - DNA, 22 bp, Homo sapiens
aacagcctcagtgagattagga

SEQ ID NO: 7363503 - DNA, 22 bp, Homo sapiens
aagtgcttggattgcaggtatg

SEQ ID NO: 7363504 - DNA, 22 bp, Homo sapiens
aagtgcttggattgcaggtatg

SEQ ID NO: 7363505 - DNA, 22 bp, Homo sapiens
aagtgtacatgaacacatgaca

SEQ ID NO: 7363506 - DNA, 22 bp, Homo sapiens
aatagcaaacactggtaaagtt

SEQ ID NO: 7363507 - DNA, 19 bp, Homo sapiens
aatagattaattatcctct

SEQ ID NO: 7363508 - DNA, 22 bp, Homo sapiens
aatagacaattctagccaacat

SEQ ID NO: 7363509 - DNA, 22 bp, Homo sapiens
aatagaggtggcatgttataga

SEQ ID NO: 7363510 - DNA, 22 bp, Homo sapiens
aacatctagttcctatataata

SEQ ID NO: 7363511 - DNA, 22 bp, Homo sapiens
aacatcttatctgcatgatccc

SEQ ID NO: 7363512 - DNA, 22 bp, Homo sapiens
aacatcttatctgcatgatccc

SEQ ID NO: 7363513 - DNA, 19 bp, Homo sapiens
aacatctttccagtagagg

SEQ ID NO: 7363514 - DNA, 22 bp, Homo sapiens
aatagacaagcaccctggtaaa

SEQ ID NO: 7363515 - DNA, 22 bp, Homo sapiens
aacatctttgccaaattgctat

SEQ ID NO: 7363516 - DNA, 22 bp, Homo sapiens
aacatctttgataaacttagtg

SEQ ID NO: 7363517 - DNA, 22 bp, Homo sapiens
aattccctcaggggactccttt

SEQ ID NO: 7363518 - DNA, 22 bp, Homo sapiens
aagaaagataaggtttgcttgg

SEQ ID NO: 7363519 - DNA, 22 bp, Homo sapiens
aattctataggcaagctatttt

SEQ ID NO: 7363520 - DNA, 22 bp, Homo sapiens
aattctaaatgtaatttagaat

SEQ ID NO: 7363521 - DNA, 22 bp, Homo sapiens
aattctctccagggtaacatca

SEQ ID NO: 7363522 - DNA, 22 bp, Homo sapiens
aattctctccagggtaacatca

SEQ ID NO: 7363523 - DNA, 22 bp, Homo sapiens
aattctatgttcttgagtaaga

SEQ ID NO: 7363524 - DNA, 22 bp, Homo sapiens
aattctcaggaatttcatctgt

SEQ ID NO: 7363525 - DNA, 22 bp, Homo sapiens
aagaaattaatgtgccattact

SEQ ID NO: 7363526 - DNA, 22 bp, Homo sapiens
aagaaatgtgaatattgaatag

SEQ ID NO: 7363527 - DNA, 22 bp, Homo sapiens
aagaaatgtgaatattgaatag

SEQ ID NO: 7363528 - DNA, 22 bp, Homo sapiens
aagaaatgtagagcctagtaaa

SEQ ID NO: 7363529 - DNA, 22 bp, Homo sapiens
aagaaatggcttcatctgagta

SEQ ID NO: 7363530 - DNA, 17 bp, Homo sapiens
aagaacactcaatagca

SEQ ID NO: 7363531 - DNA, 22 bp, Homo sapiens
aagaacaactgctttaaaagca

SEQ ID NO: 7363532 - DNA, 22 bp, Homo sapiens
aatttaagagcatagctccaac

SEQ ID NO: 7363533 - DNA, 22 bp, Homo sapiens
aactggtatctcttcagtgtaa

SEQ ID NO: 7363534 - DNA, 19 bp, Homo sapiens
aactggataatggccacat

SEQ ID NO: 7363535 - DNA, 22 bp, Homo sapiens
aactggagcccctctgccactg

SEQ ID NO: 7363536 - DNA, 22 bp, Homo sapiens
aagaaactggaatatagagagc

SEQ ID NO: 7363537 - DNA, 22 bp, Homo sapiens
aagaaacgtttgagctttgact

SEQ ID NO: 7363538 - DNA, 22 bp, Homo sapiens
aagaaacaaccactgctctcct

SEQ ID NO: 7363539 - DNA, 22 bp, Homo sapiens
aagaaacaaccactgctctcct

SEQ ID NO: 7363540 - DNA, 22 bp, Homo sapiens
aagaaaatcagttctggtcagt

SEQ ID NO: 7363541 - DNA, 22 bp, Homo sapiens
aagaaaaggtaaccgcttatct

SEQ ID NO: 7363542 - DNA, 22 bp, Homo sapiens
aagaaaagatgtttggttttca

SEQ ID NO: 7363543 - DNA, 22 bp, Homo sapiens
aagaaaagaaacctgaggcttt

SEQ ID NO: 7363544 - DNA, 22 bp, Homo sapiens
aagaaaacatgatctaatttaa

SEQ ID NO: 7363545 - DNA, 22 bp, Homo sapiens
aagaaaacaatgacttgccagc

SEQ ID NO: 7363546 - DNA, 22 bp, Homo sapiens
aagaaaagaaacctgaggcttt

SEQ ID NO: 7363547 - DNA, 22 bp, Homo sapiens
aattttatctctaagcaggctt

SEQ ID NO: 7363548 - DNA, 20 bp, Homo sapiens
aattttatctccatcctttg

SEQ ID NO: 7363549 - DNA, 20 bp, Homo sapiens
aagagaagaagtctttgaaa

SEQ ID NO: 7363550 - DNA, 22 bp, Homo sapiens
aagactttctgtaaagctacag

SEQ ID NO: 7363551 - DNA, 22 bp, Homo sapiens
aagactttctgtaaagctacag

SEQ ID NO: 7363552 - DNA, 22 bp, Homo sapiens
aattttatctctaagcaggctt

SEQ ID NO: 7363553 - DNA, 22 bp, Homo sapiens
aagactttctggggtgtaaagg

SEQ ID NO: 7363554 - DNA, 22 bp, Homo sapiens
aagagaaagcagactttgtcat

SEQ ID NO: 7363555 - DNA, 21 bp, Homo sapiens
aatttcagacccattttgcct

SEQ ID NO: 7363556 - DNA, 22 bp, Homo sapiens
aatttcagaacccaaattagcg

SEQ ID NO: 7363557 - DNA, 22 bp, Homo sapiens
aatttcagatgtcataaatata

SEQ ID NO: 7363558 - DNA, 22 bp, Homo sapiens
aattttaagcatatgactggtt

SEQ ID NO: 7363559 - DNA, 22 bp, Homo sapiens
aattttaagcatatgactggtt

SEQ ID NO: 7363560 - DNA, 22 bp, Homo sapiens
aattttaatcagtggtgctgag

SEQ ID NO: 7363561 - DNA, 22 bp, Homo sapiens
aattttaatcagtggtgctgag

SEQ ID NO: 7363562 - DNA, 22 bp, Homo sapiens
aagagcaagtgggtagtgaagc

SEQ ID NO: 7363563 - DNA, 22 bp, Homo sapiens
aagagcaagtgggtagtgaagc

SEQ ID NO: 7363564 - DNA, 22 bp, Homo sapiens
aagagcaacttggaaacactca

SEQ ID NO: 7363565 - DNA, 22 bp, Homo sapiens
aagagcaacttggaaacactca

SEQ ID NO: 7363566 - DNA, 22 bp, Homo sapiens
acacaaagttggatgacaaaat

SEQ ID NO: 7363567 - DNA, 22 bp, Homo sapiens
acacaaagttggatgacaaaat

SEQ ID NO: 7363568 - DNA, 22 bp, Homo sapiens
acacaaacagtctatagcacca

SEQ ID NO: 7363569 - DNA, 21 bp, Homo sapiens
acacaaacctcctcagcctgg

SEQ ID NO: 7363570 - DNA, 21 bp, Homo sapiens
aagagacatttctcatcagca

SEQ ID NO: 7363571 - DNA, 22 bp, Homo sapiens
acacaaaatcaaagtcctaggc

SEQ ID NO: 7363572 - DNA, 22 bp, Homo sapiens
aagagacagagccatgtttcta

SEQ ID NO: 7363573 - DNA, 22 bp, Homo sapiens
aagagaatatcgatagcactct

SEQ ID NO: 7363574 - DNA, 22 bp, Homo sapiens
aagagaatgacaaggagaacct

SEQ ID NO: 7363575 - DNA, 22 bp, Homo sapiens
aagagaaggtgaggaagccggt

SEQ ID NO: 7363576 - DNA, 22 bp, Homo sapiens
aagcaggaagctcaggtccttg

SEQ ID NO: 7363577 - DNA, 22 bp, Homo sapiens
aagcagctgcaggttcaaagga

SEQ ID NO: 7363578 - DNA, 22 bp, Homo sapiens
acagcagaggaaaagtctgata

SEQ ID NO: 7363579 - DNA, 22 bp, Homo sapiens
acagcagagtagttttccaact

SEQ ID NO: 7363580 - DNA, 22 bp, Homo sapiens
acagcagagcctggtacttact

SEQ ID NO: 7363581 - DNA, 22 bp, Homo sapiens
acagcagagcctagcttaatct

SEQ ID NO: 7363582 - DNA, 22 bp, Homo sapiens
acagcagactttctacagctca

SEQ ID NO: 7363583 - DNA, 22 bp, Homo sapiens
acagcagagaactttagagggt

SEQ ID NO: 7363584 - DNA, 22 bp, Homo sapiens
acagcagagacactcaggaggc

SEQ ID NO: 7363585 - DNA, 21 bp, Homo sapiens
acagcagagatcaagactaag

SEQ ID NO: 7363586 - DNA, 22 bp, Homo sapiens
acagcagagcaccagggccact

SEQ ID NO: 7363587 - DNA, 22 bp, Homo sapiens
acagcagagccagtggctctag

SEQ ID NO: 7363588 - DNA, 22 bp, Homo sapiens
aagcagagggtatggccaggtt

SEQ ID NO: 7363589 - DNA, 22 bp, Homo sapiens
aagcagaggtagggtgtgcagt

SEQ ID NO: 7363590 - DNA, 22 bp, Homo sapiens
aagcagagggtatggccaggtt

SEQ ID NO: 7363591 - DNA, 22 bp, Homo sapiens
aagcagaggtagggtgtgcagt

SEQ ID NO: 7363592 - DNA, 22 bp, Homo sapiens
acagcaaaagacaagaacttaa

SEQ ID NO: 7363593 - DNA, 22 bp, Homo sapiens
acagcagaccccagtgccatgg

SEQ ID NO: 7363594 - DNA, 22 bp, Homo sapiens
aagcagaggaccgacggaggga

SEQ ID NO: 7363595 - DNA, 22 bp, Homo sapiens
aagcagaggaccgacggaggga

SEQ ID NO: 7363596 - DNA, 22 bp, Homo sapiens
aagcagaggccacagagtgggc

SEQ ID NO: 7363597 - DNA, 22 bp, Homo sapiens
aagcagaggccacagagtgggc

SEQ ID NO: 7363598 - DNA, 20 bp, Homo sapiens
aagcagaagctgctctcagc

SEQ ID NO: 7363599 - DNA, 22 bp, Homo sapiens
aagcagaactgggaagtagtgg

SEQ ID NO: 7363600 - DNA, 22 bp, Homo sapiens
aagcagaactgggaagtagtgg

SEQ ID NO: 7363601 - DNA, 22 bp, Homo sapiens
aagcagaatagaggcccttccc

SEQ ID NO: 7363602 - DNA, 22 bp, Homo sapiens
aagcagaatttaatagaaaggt

SEQ ID NO: 7363603 - DNA, 22 bp, Homo sapiens
aagcagaatttcccactagttg

SEQ ID NO: 7363604 - DNA, 22 bp, Homo sapiens
aagcagagccaccagctttgga

SEQ ID NO: 7363605 - DNA, 22 bp, Homo sapiens
aagcagagccaccagctttgga

SEQ ID NO: 7363606 - DNA, 22 bp, Homo sapiens
aagcagagcaagcgtatttatt

SEQ ID NO: 7363607 - DNA, 22 bp, Homo sapiens
aagcagagcctgagacagggat

SEQ ID NO: 7363608 - DNA, 22 bp, Homo sapiens
aagcagagcctgagacagggat

SEQ ID NO: 7363609 - DNA, 22 bp, Homo sapiens
aagcagagaaaagcttaggttc

SEQ ID NO: 7363610 - DNA, 22 bp, Homo sapiens
aagcagagaatctgggagcgag

SEQ ID NO: 7363611 - DNA, 22 bp, Homo sapiens
aagcagagaatctgggagcgag

SEQ ID NO: 7363612 - DNA, 22 bp, Homo sapiens
aagcagagagcagaattaagtt

SEQ ID NO: 7363613 - DNA, 22 bp, Homo sapiens
aagcagagaccggctaatggag

SEQ ID NO: 7363614 - DNA, 20 bp, Homo sapiens
aagcaatatagtgcaaatgt

SEQ ID NO: 7363615 - DNA, 20 bp, Homo sapiens
aagcaatatagtgcaaatgt

SEQ ID NO: 7363616 - DNA, 22 bp, Homo sapiens
aagcaatatactgatatgatta

SEQ ID NO: 7363617 - DNA, 19 bp, Homo sapiens
aagcaatgttgtgaatcta

SEQ ID NO: 7363618 - DNA, 22 bp, Homo sapiens
aagcaattggttttagtaaaat

SEQ ID NO: 7363619 - DNA, 22 bp, Homo sapiens
aagcaattcagcaaacctagaa

SEQ ID NO: 7363620 - DNA, 22 bp, Homo sapiens
aagcacacttggctctgtgtac

SEQ ID NO: 7363621 - DNA, 22 bp, Homo sapiens
acacatgaaataatattatgca

SEQ ID NO: 7363622 - DNA, 22 bp, Homo sapiens
acacatatatacatatttgtgc

SEQ ID NO: 7363623 - DNA, 22 bp, Homo sapiens
acacatgagttctcatcttgtg

SEQ ID NO: 7363624 - DNA, 20 bp, Homo sapiens
acacatgcattcatgtgggc

SEQ ID NO: 7363625 - DNA, 22 bp, Homo sapiens
acacattcatgagtgcatgcac

SEQ ID NO: 7363626 - DNA, 22 bp, Homo sapiens
acacattcctgcagacatgatg

SEQ ID NO: 7363627 - DNA, 22 bp, Homo sapiens
acacattgcagacatctcatta

SEQ ID NO: 7363628 - DNA, 22 bp, Homo sapiens
acacattctttaaatgtctgtt

SEQ ID NO: 7363629 - DNA, 22 bp, Homo sapiens
acacatttacatgtttacgtat

SEQ ID NO: 7363630 - DNA, 22 bp, Homo sapiens
acacatttattacatgcatgtg

SEQ ID NO: 7363631 - DNA, 22 bp, Homo sapiens
acacatttctaaatttttaccg

SEQ ID NO: 7363632 - DNA, 22 bp, Homo sapiens
aagcaagaggaaatgtggacct

SEQ ID NO: 7363633 - DNA, 22 bp, Homo sapiens
aagatgttaaatctgtagaatt

SEQ ID NO: 7363634 - DNA, 22 bp, Homo sapiens
aagcaaggcaacctatgtccag

SEQ ID NO: 7363635 - DNA, 22 bp, Homo sapiens
aagcaaggcccagagcatcagc

SEQ ID NO: 7363636 - DNA, 22 bp, Homo sapiens
aagcaaggcccagagcatcagc

SEQ ID NO: 7363637 - DNA, 22 bp, Homo sapiens
aagcaaggccggaaggaaactc

SEQ ID NO: 7363638 - DNA, 22 bp, Homo sapiens
aagcaatagcaacaactttaca

SEQ ID NO: 7363639 - DNA, 22 bp, Homo sapiens
aagcaataatcccaaagtgctg

SEQ ID NO: 7363640 - DNA, 22 bp, Homo sapiens
aagatgcatgctgaagctggct

SEQ ID NO: 7363641 - DNA, 22 bp, Homo sapiens
aagatgcggttgaccatggtgt

SEQ ID NO: 7363642 - DNA, 22 bp, Homo sapiens
aagatgcacaatgtggcaatta

SEQ ID NO: 7363643 - DNA, 22 bp, Homo sapiens
acatttctggagtttctcaaca

SEQ ID NO: 7363644 - DNA, 22 bp, Homo sapiens
acatttctggagtttctcaaca

SEQ ID NO: 7363645 - DNA, 22 bp, Homo sapiens
acatttcttcctaattatccct

SEQ ID NO: 7363646 - DNA, 22 bp, Homo sapiens
acatttcttccctttagcagaa

SEQ ID NO: 7363647 - DNA, 22 bp, Homo sapiens
acatttctcttgatgtctctat

SEQ ID NO: 7363648 - DNA, 22 bp, Homo sapiens
acatttcatgttttccagagca

SEQ ID NO: 7363649 - DNA, 22 bp, Homo sapiens
acattgttgtgcaattatagtt

SEQ ID NO: 7363650 - DNA, 22 bp, Homo sapiens
acattgttgagcctcttgttca

SEQ ID NO: 7363651 - DNA, 22 bp, Homo sapiens
acattgttctacttctagttag

SEQ ID NO: 7363652 - DNA, 22 bp, Homo sapiens
acattgtttgagaatacagatg

SEQ ID NO: 7363653 - DNA, 22 bp, Homo sapiens
acatttaaatacctatgtttct

SEQ ID NO: 7363654 - DNA, 22 bp, Homo sapiens
acatttaaatatgccttatatt

SEQ ID NO: 7363655 - DNA, 19 bp, Homo sapiens
aaggctggagaaggcctct

SEQ ID NO: 7363656 - DNA, 22 bp, Homo sapiens
acatttaaatatgccttatatt

SEQ ID NO: 7363657 - DNA, 22 bp, Homo sapiens
acatttaaatatgccttatatt

SEQ ID NO: 7363658 - DNA, 22 bp, Homo sapiens
aaggcccttggaaaatgcagta

SEQ ID NO: 7363659 - DNA, 22 bp, Homo sapiens
aaggccctttagcagaggaggg

SEQ ID NO: 7363660 - DNA, 22 bp, Homo sapiens
aaggcctcttctctctggagat

SEQ ID NO: 7363661 - DNA, 22 bp, Homo sapiens
aaggccaggggctggcgcctcc

SEQ ID NO: 7363662 - DNA, 22 bp, Homo sapiens
aaggcctttcttatcagtagat

SEQ ID NO: 7363663 - DNA, 22 bp, Homo sapiens
aaggccttgcctgacagcacca

SEQ ID NO: 7363664 - DNA, 22 bp, Homo sapiens
aaggccttgccgaaggatgcca

SEQ ID NO: 7363665 - DNA, 22 bp, Homo sapiens
accgggaagtcctgcactgggc

SEQ ID NO: 7363666 - DNA, 22 bp, Homo sapiens
accctgatggccagattgtgga

SEQ ID NO: 7363667 - DNA, 22 bp, Homo sapiens
accctgagccgccaggaaggcc

SEQ ID NO: 7363668 - DNA, 22 bp, Homo sapiens
accctgagatgccacagcatga

SEQ ID NO: 7363669 - DNA, 22 bp, Homo sapiens
acccctccattctgaaggctgc

SEQ ID NO: 7363670 - DNA, 22 bp, Homo sapiens
acccaggaggtgacacagggct

SEQ ID NO: 7363671 - DNA, 22 bp, Homo sapiens
acccaggagccgtgagaggtta

SEQ ID NO: 7363672 - DNA, 22 bp, Homo sapiens
aaggggaaaaagtgttaggagt

SEQ ID NO: 7363673 - DNA, 22 bp, Homo sapiens
accagggaccgccacactgcaa

SEQ ID NO: 7363674 - DNA, 20 bp, Homo sapiens
acatttgtggatctgagaga

SEQ ID NO: 7363675 - DNA, 22 bp, Homo sapiens
acatttgtttctctagagtagg

SEQ ID NO: 7363676 - DNA, 21 bp, Homo sapiens
acattttctgttttaggaagt

SEQ ID NO: 7363677 - DNA, 22 bp, Homo sapiens
accaggcccaccgcatgctcct

SEQ ID NO: 7363678 - DNA, 22 bp, Homo sapiens
acagggaaagggacagcagcag

SEQ ID NO: 7363679 - DNA, 22 bp, Homo sapiens
aagctcattaattagaagctaa

SEQ ID NO: 7363680 - DNA, 22 bp, Homo sapiens
acagggcagagaggcaggcttg

SEQ ID NO: 7363681 - DNA, 22 bp, Homo sapiens
aagctgctttgtcaggaatatg

SEQ ID NO: 7363682 - DNA, 22 bp, Homo sapiens
aagctgctctcacaacactgtt

SEQ ID NO: 7363683 - DNA, 22 bp, Homo sapiens
aagctgccttgctgaggagaaa

SEQ ID NO: 7363684 - DNA, 22 bp, Homo sapiens
aagctgccttccatgtgaggaa

SEQ ID NO: 7363685 - DNA, 23 bp, Homo sapiens
aagctgccttcgcagttggtctg

SEQ ID NO: 7363686 - DNA, 22 bp, Homo sapiens
aagctgcctgggaggaagggct

SEQ ID NO: 7363687 - DNA, 22 bp, Homo sapiens
aagctgcctgccacgctagata

SEQ ID NO: 7363688 - DNA, 22 bp, Homo sapiens
aagctgccctgtgttagagttc

SEQ ID NO: 7363689 - DNA, 22 bp, Homo sapiens
aagctgcctagagttgaatgtc

SEQ ID NO: 7363690 - DNA, 18 bp, Homo sapiens
aagctgccctcaggcagg

SEQ ID NO: 7363691 - DNA, 22 bp, Homo sapiens
aagctgccctcattcccagtgc

SEQ ID NO: 7363692 - DNA, 22 bp, Homo sapiens
aagcattttagataaagcatca

SEQ ID NO: 7363693 - DNA, 22 bp, Homo sapiens
aagcattttagtaatgaacttg

SEQ ID NO: 7363694 - DNA, 22 bp, Homo sapiens
aagcattttagataaagcatca

SEQ ID NO: 7363695 - DNA, 22 bp, Homo sapiens
aagcatttttcacagcaacagc

SEQ ID NO: 7363696 - DNA, 22 bp, Homo sapiens
aagcattttgttttaagaatga

SEQ ID NO: 7363697 - DNA, 22 bp, Homo sapiens
aagcattttgttttaagaatga

SEQ ID NO: 7363698 - DNA, 19 bp, Homo sapiens
acagcctgttggtggggct

SEQ ID NO: 7363699 - DNA, 22 bp, Homo sapiens
acagcctggcctgagttaaggc

SEQ ID NO: 7363700 - DNA, 21 bp, Homo sapiens
acagcctgtcatctcatggtc

SEQ ID NO: 7363701 - DNA, 22 bp, Homo sapiens
aagcgccatggttcctgcgcag

SEQ ID NO: 7363702 - DNA, 22 bp, Homo sapiens
aagcgcaggactggctcacggc

SEQ ID NO: 7363703 - DNA, 22 bp, Homo sapiens
aagccctgggatgttcagcagt

SEQ ID NO: 7363704 - DNA, 22 bp, Homo sapiens
aagctagattggcattcatttc

SEQ ID NO: 7363705 - DNA, 21 bp, Homo sapiens
aagctacagaaaataatttga

SEQ ID NO: 7363706 - DNA, 22 bp, Homo sapiens
aagctacattaagcagatttac

SEQ ID NO: 7363707 - DNA, 22 bp, Homo sapiens
aagctagataacttttatattt

SEQ ID NO: 7363708 - DNA, 22 bp, Homo sapiens
aaggagagtacaggagttggta

SEQ ID NO: 7363709 - DNA, 22 bp, Homo sapiens
aaggagagtacaggagttggta

SEQ ID NO: 7363710 - DNA, 21 bp, Homo sapiens
aaggagcctaggaggctcagg

SEQ ID NO: 7363711 - DNA, 22 bp, Homo sapiens
aaggaggaaaatattgttgctg

SEQ ID NO: 7363712 - DNA, 20 bp, Homo sapiens
aaggagaatgacacggctgc

SEQ ID NO: 7363713 - DNA, 22 bp, Homo sapiens
acagtctttcagtaataatact

SEQ ID NO: 7363714 - DNA, 22 bp, Homo sapiens
acagtcttatgcatacactatt

SEQ ID NO: 7363715 - DNA, 19 bp, Homo sapiens
acagtcttacaaatgtcca

SEQ ID NO: 7363716 - DNA, 22 bp, Homo sapiens
aaggaggaataaagaggtggtg

SEQ ID NO: 7363717 - DNA, 22 bp, Homo sapiens
aaggaggaataaagaggtggtg

SEQ ID NO: 7363718 - DNA, 22 bp, Homo sapiens
acagtcttgcacttctatcagc

SEQ ID NO: 7363719 - DNA, 22 bp, Homo sapiens
acagtcttgagcatcagccaga

SEQ ID NO: 7363720 - DNA, 22 bp, Homo sapiens
acatatgtgcttatatccatga

SEQ ID NO: 7363721 - DNA, 22 bp, Homo sapiens
acatatgtctatttcatgtaaa

SEQ ID NO: 7363722 - DNA, 22 bp, Homo sapiens
acatatgtgttgtacatgcatg

SEQ ID NO: 7363723 - DNA, 20 bp, Homo sapiens
acatatgtgtgcatatcttt

SEQ ID NO: 7363724 - DNA, 22 bp, Homo sapiens
acatatgtgtctgcacatgccc

SEQ ID NO: 7363725 - DNA, 22 bp, Homo sapiens
acatatgcgatcataggatgca

SEQ ID NO: 7363726 - DNA, 22 bp, Homo sapiens
acatatgtgttgtacatgcatg

SEQ ID NO: 7363727 - DNA, 22 bp, Homo sapiens
aaggaggaatgtagccagctcc

SEQ ID NO: 7363728 - DNA, 22 bp, Homo sapiens
aaggaggaatgtagccagctcc

SEQ ID NO: 7363729 - DNA, 22 bp, Homo sapiens
aaggaggaatttcagggtgaat

SEQ ID NO: 7363730 - DNA, 22 bp, Homo sapiens
aaggaggaatttcagggtgaat

SEQ ID NO: 7363731 - DNA, 22 bp, Homo sapiens
aaggaggacacccaggactggg

SEQ ID NO: 7363732 - DNA, 22 bp, Homo sapiens
aaggaggaatttcagggtgaat

SEQ ID NO: 7363733 - DNA, 22 bp, Homo sapiens
aaggaggaatgtagccagctcc

SEQ ID NO: 7363734 - DNA, 22 bp, Homo sapiens
aaggaggaattctgagttcatg

SEQ ID NO: 7363735 - DNA, 22 bp, Homo sapiens
aaggaggaattctgagttcatg

SEQ ID NO: 7363736 - DNA, 22 bp, Homo sapiens
aaggaggaatttcagggtgaat

SEQ ID NO: 7363737 - DNA, 22 bp, Homo sapiens
aaggaggagattagtgtttagg

SEQ ID NO: 7363738 - DNA, 22 bp, Homo sapiens
aaggaggacacccaggactggg

SEQ ID NO: 7363739 - DNA, 22 bp, Homo sapiens
aaggaggacacccaggactggg

SEQ ID NO: 7363740 - DNA, 22 bp, Homo sapiens
aaggaggagtggggtcctggaa

SEQ ID NO: 7363741 - DNA, 22 bp, Homo sapiens
aaggaggagcggaggcttgttg

SEQ ID NO: 7363742 - DNA, 22 bp, Homo sapiens
aaggaggagcggaggcttgttg

SEQ ID NO: 7363743 - DNA, 22 bp, Homo sapiens
aaggaggcactcgctctcaggg

SEQ ID NO: 7363744 - DNA, 22 bp, Homo sapiens
actcacttcttttactataaaa

SEQ ID NO: 7363745 - DNA, 22 bp, Homo sapiens
actcactcttaatcagactccc

SEQ ID NO: 7363746 - DNA, 22 bp, Homo sapiens
actagttttccataatatagga

SEQ ID NO: 7363747 - DNA, 22 bp, Homo sapiens
actctcagggacagggtctggg

SEQ ID NO: 7363748 - DNA, 22 bp, Homo sapiens
actctattgctgcttgatgtga

SEQ ID NO: 7363749 - DNA, 22 bp, Homo sapiens
actctccctgctatccacttcc

SEQ ID NO: 7363750 - DNA, 22 bp, Homo sapiens
actctcccacgttcgactctaa

SEQ ID NO: 7363751 - DNA, 22 bp, Homo sapiens
aagtctaaacacatatttaaaa

SEQ ID NO: 7363752 - DNA, 22 bp, Homo sapiens
acctagaatgaagcaatgctgt

SEQ ID NO: 7363753 - DNA, 21 bp, Homo sapiens
accgtcagtactagtattgac

SEQ ID NO: 7363754 - DNA, 22 bp, Homo sapiens
acctaagagatcttctggtcca

SEQ ID NO: 7363755 - DNA, 22 bp, Homo sapiens
acggtgccggtggtgatgagcc

SEQ ID NO: 7363756 - DNA, 22 bp, Homo sapiens
acggtgctgggtattggggttc

SEQ ID NO: 7363757 - DNA, 22 bp, Homo sapiens
acgtgcatatgtatacacacat

SEQ ID NO: 7363758 - DNA, 22 bp, Homo sapiens
acctttatgaaacagctgtcgt

SEQ ID NO: 7363759 - DNA, 22 bp, Homo sapiens
acctttatggagaacttgggat

SEQ ID NO: 7363760 - DNA, 22 bp, Homo sapiens
acctttatgattcacaatgtat

SEQ ID NO: 7363761 - DNA, 22 bp, Homo sapiens
actgagtatcacttcttatttt

SEQ ID NO: 7363762 - DNA, 22 bp, Homo sapiens
actgagtggctggggagtggca

SEQ ID NO: 7363763 - DNA, 22 bp, Homo sapiens
actgcactccaacctgggtgac

SEQ ID NO: 7363764 - DNA, 22 bp, Homo sapiens
actgagtgtccactatgagcca

SEQ ID NO: 7363765 - DNA, 22 bp, Homo sapiens
actgagtgggaggtttgtgtga

SEQ ID NO: 7363766 - DNA, 22 bp, Homo sapiens
actgagtgtaggactttgagtt

SEQ ID NO: 7363767 - DNA, 22 bp, Homo sapiens
actgcactccagcctgggtaac

SEQ ID NO: 7363768 - DNA, 22 bp, Homo sapiens
actgcactccagcctcggggtc

SEQ ID NO: 7363769 - DNA, 19 bp, Homo sapiens
actgcactccagcctgggt

SEQ ID NO: 7363770 - DNA, 22 bp, Homo sapiens
actgcactccagcctgggtaac

SEQ ID NO: 7363771 - DNA, 22 bp, Homo sapiens
actgcactccagcctgggtaac

SEQ ID NO: 7363772 - DNA, 22 bp, Homo sapiens
actgcactccagcccgagcaac

SEQ ID NO: 7363773 - DNA, 22 bp, Homo sapiens
actgcactccaacctgggtgac

SEQ ID NO: 7363774 - DNA, 22 bp, Homo sapiens
actgcgtggggagctgtgacta

SEQ ID NO: 7363775 - DNA, 22 bp, Homo sapiens
actgcactccagcctgggtgac

SEQ ID NO: 7363776 - DNA, 22 bp, Homo sapiens
actggacagaggaaatatggag

SEQ ID NO: 7363777 - DNA, 22 bp, Homo sapiens
aataccttccacagtgaccttg

SEQ ID NO: 7363778 - DNA, 22 bp, Homo sapiens
aataccttccaacatcaagaca

SEQ ID NO: 7363779 - DNA, 22 bp, Homo sapiens
aataccttccaacatcaagaca

SEQ ID NO: 7363780 - DNA, 22 bp, Homo sapiens
aataccttttcagtgcacaaaa

SEQ ID NO: 7363781 - DNA, 22 bp, Homo sapiens
aatacctttcctgccattcact

SEQ ID NO: 7363782 - DNA, 22 bp, Homo sapiens
aatacctttcctgccattcact

SEQ ID NO: 7363783 - DNA, 22 bp, Homo sapiens
aataccttgctcatagggctga

SEQ ID NO: 7363784 - DNA, 22 bp, Homo sapiens
aataccttgctgtagccacgca

SEQ ID NO: 7363785 - DNA, 22 bp, Homo sapiens
actggctgagttgcttcagcaa

SEQ ID NO: 7363786 - DNA, 22 bp, Homo sapiens
actggctgaggaagttgccact

SEQ ID NO: 7363787 - DNA, 22 bp, Homo sapiens
actggctgaagtttactttttg

SEQ ID NO: 7363788 - DNA, 22 bp, Homo sapiens
actggcccgggagcagaggcct

SEQ ID NO: 7363789 - DNA, 22 bp, Homo sapiens
actggctgaaagtaaagaacac

SEQ ID NO: 7363790 - DNA, 22 bp, Homo sapiens
aatactgcatacagtttctcat

SEQ ID NO: 7363791 - DNA, 22 bp, Homo sapiens
aatatagttctggtattgttaa

SEQ ID NO: 7363792 - DNA, 22 bp, Homo sapiens
aatatagttctggtattgttaa

SEQ ID NO: 7363793 - DNA, 22 bp, Homo sapiens
aatatagttctggtattgttaa

SEQ ID NO: 7363794 - DNA, 22 bp, Homo sapiens
aatatagctcactataccatgg

SEQ ID NO: 7363795 - DNA, 22 bp, Homo sapiens
aatatagtgttagctcatttga

SEQ ID NO: 7363796 - DNA, 22 bp, Homo sapiens
aatatagtgttagctcatttga

SEQ ID NO: 7363797 - DNA, 22 bp, Homo sapiens
aatatagttctagaaatatttt

SEQ ID NO: 7363798 - DNA, 22 bp, Homo sapiens
aatatagttctagaaatatttt

SEQ ID NO: 7363799 - DNA, 22 bp, Homo sapiens
aatatagttctagaaatatttt

SEQ ID NO: 7363800 - DNA, 22 bp, Homo sapiens
aatatactatactactttctgg

SEQ ID NO: 7363801 - DNA, 22 bp, Homo sapiens
actttcttatccatgatctcac

SEQ ID NO: 7363802 - DNA, 22 bp, Homo sapiens
actttcttggtcccatgtttga

SEQ ID NO: 7363803 - DNA, 22 bp, Homo sapiens
actttcttaggctgtataaatg

SEQ ID NO: 7363804 - DNA, 23 bp, Homo sapiens
actttattgaccccaggtcagtt

SEQ ID NO: 7363805 - DNA, 22 bp, Homo sapiens
actgttctgccaagatcaacgt

SEQ ID NO: 7363806 - DNA, 22 bp, Homo sapiens
actgttctgccaactttggtta

SEQ ID NO: 7363807 - DNA, 19 bp, Homo sapiens
actgttctgtatgttgatt

SEQ ID NO: 7363808 - DNA, 22 bp, Homo sapiens
actgttctgcatgtacctgagg

SEQ ID NO: 7363809 - DNA, 22 bp, Homo sapiens
actgttctgcatgtacctgagg

SEQ ID NO: 7363810 - DNA, 22 bp, Homo sapiens
actgttctgcatgctgtgaggg

SEQ ID NO: 7363811 - DNA, 22 bp, Homo sapiens
actgttctccagcatggctgta

SEQ ID NO: 7363812 - DNA, 19 bp, Homo sapiens
actgttctaacttgcagct

SEQ ID NO: 7363813 - DNA, 22 bp, Homo sapiens
actgttctcctttggctatatc

SEQ ID NO: 7363814 - DNA, 18 bp, Homo sapiens
actgttctctcctgccct

SEQ ID NO: 7363815 - DNA, 19 bp, Homo sapiens
actgttctaacttgcagct

SEQ ID NO: 7363816 - DNA, 22 bp, Homo sapiens
actgttcttcatttagcaaaga

SEQ ID NO: 7363817 - DNA, 22 bp, Homo sapiens
actgttcttcccatttatattg

SEQ ID NO: 7363818 - DNA, 22 bp, Homo sapiens
actgttcttcatttagcaaaga

SEQ ID NO: 7363819 - DNA, 22 bp, Homo sapiens
actgttcttgtaacacttaaat

SEQ ID NO: 7363820 - DNA, 22 bp, Homo sapiens
actgttcttgtaacacttaaat

SEQ ID NO: 7363821 - DNA, 23 bp, Homo sapiens
aatgatttcatgatgatagcagc

SEQ ID NO: 7363822 - DNA, 22 bp, Homo sapiens
aatgatggtttcatcacttgaa

SEQ ID NO: 7363823 - DNA, 22 bp, Homo sapiens
agaagcagaaaagggcactttt

SEQ ID NO: 7363824 - DNA, 22 bp, Homo sapiens
agaagcagaaggaagcagggcc

SEQ ID NO: 7363825 - DNA, 20 bp, Homo sapiens
agaacaagtactaaaggaga

SEQ ID NO: 7363826 - DNA, 22 bp, Homo sapiens
agaaattattagtgaatagtct

SEQ ID NO: 7363827 - DNA, 22 bp, Homo sapiens
agaaattattagtgaatagtct

SEQ ID NO: 7363828 - DNA, 22 bp, Homo sapiens
agaaattatgcagtagttttat

SEQ ID NO: 7363829 - DNA, 22 bp, Homo sapiens
agaaatgacacacatgagacat

SEQ ID NO: 7363830 - DNA, 22 bp, Homo sapiens
agaaatgacacacatgagacat

SEQ ID NO: 7363831 - DNA, 22 bp, Homo sapiens
aatcagaacttctcagggtggg

SEQ ID NO: 7363832 - DNA, 22 bp, Homo sapiens
aatcataattcaaataagctta

SEQ ID NO: 7363833 - DNA, 22 bp, Homo sapiens
agaaatgaagcaggagttatta

SEQ ID NO: 7363834 - DNA, 22 bp, Homo sapiens
agaaatgaagcaggagttatta

SEQ ID NO: 7363835 - DNA, 22 bp, Homo sapiens
agaaatgaaaccaaagcctaga

SEQ ID NO: 7363836 - DNA, 22 bp, Homo sapiens
agaaatactttgtaaatctcac

SEQ ID NO: 7363837 - DNA, 22 bp, Homo sapiens
agaaatctttgaagtgtaatgt

SEQ ID NO: 7363838 - DNA, 22 bp, Homo sapiens
agaaatctttgaagtgtaatgt

SEQ ID NO: 7363839 - DNA, 23 bp, Homo sapiens
acaagcagcccagtgctctgcct

SEQ ID NO: 7363840 - DNA, 22 bp, Homo sapiens
acaagcagaaggtggggtctta

SEQ ID NO: 7363841 - DNA, 22 bp, Homo sapiens
acaagatttaatgcaacccaag

SEQ ID NO: 7363842 - DNA, 22 bp, Homo sapiens
acaagatagcttagaagattca

SEQ ID NO: 7363843 - DNA, 22 bp, Homo sapiens
acaagcatgtggtaaaaagacc

SEQ ID NO: 7363844 - DNA, 22 bp, Homo sapiens
acaatgagtttgatgtagtttg

SEQ ID NO: 7363845 - DNA, 22 bp, Homo sapiens
acaacagagctggactgagagg

SEQ ID NO: 7363846 - DNA, 22 bp, Homo sapiens
acaacaaagacacttgaaatga

SEQ ID NO: 7363847 - DNA, 22 bp, Homo sapiens
acaaattgcctagtctagcatc

SEQ ID NO: 7363848 - DNA, 22 bp, Homo sapiens
acaacaaagacacttgaaatga

SEQ ID NO: 7363849 - DNA, 22 bp, Homo sapiens
acaacacagcaaaaccccatct

SEQ ID NO: 7363850 - DNA, 22 bp, Homo sapiens
agataagatagtccagcacaat

SEQ ID NO: 7363851 - DNA, 22 bp, Homo sapiens
agataactggtttacattattg

SEQ ID NO: 7363852 - DNA, 22 bp, Homo sapiens
agataagagcctgtgtttggaa

SEQ ID NO: 7363853 - DNA, 22 bp, Homo sapiens
agataagctgtttttcaagaat

SEQ ID NO: 7363854 - DNA, 22 bp, Homo sapiens
agataataaatgttttaggttt

SEQ ID NO: 7363855 - DNA, 23 bp, Homo sapiens
acaaccagcactggagggcacca

SEQ ID NO: 7363856 - DNA, 22 bp, Homo sapiens
acaagaatgtagattagttaag

SEQ ID NO: 7363857 - DNA, 22 bp, Homo sapiens
agataatctctaggcttcatgt

SEQ ID NO: 7363858 - DNA, 22 bp, Homo sapiens
agataatgtcaaattctgtctg

SEQ ID NO: 7363859 - DNA, 22 bp, Homo sapiens
agataatggagggatttgcatt

SEQ ID NO: 7363860 - DNA, 22 bp, Homo sapiens
acaagagtaatttcaacagagt

SEQ ID NO: 7363861 - DNA, 22 bp, Homo sapiens
acaagagattatctacagatga

SEQ ID NO: 7363862 - DNA, 22 bp, Homo sapiens
agaggctgagaaaccctcttct

SEQ ID NO: 7363863 - DNA, 22 bp, Homo sapiens
acaaagaaggaattggtcttta

SEQ ID NO: 7363864 - DNA, 22 bp, Homo sapiens
agaggggtgggcacagcgccca

SEQ ID NO: 7363865 - DNA, 22 bp, Homo sapiens
agagggggtgtcagcactgcag

SEQ ID NO: 7363866 - DNA, 22 bp, Homo sapiens
agagggggaaaatagaggtgtt

SEQ ID NO: 7363867 - DNA, 22 bp, Homo sapiens
agagggggcagcggaccagtga

SEQ ID NO: 7363868 - DNA, 22 bp, Homo sapiens
acaaagggggactgcagagggt

SEQ ID NO: 7363869 - DNA, 22 bp, Homo sapiens
acaaagtaagggctaatgagca

SEQ ID NO: 7363870 - DNA, 21 bp, Homo sapiens
agaggccctcggactgggcgt

SEQ ID NO: 7363871 - DNA, 22 bp, Homo sapiens
agaggctctttgagctgggaga

SEQ ID NO: 7363872 - DNA, 22 bp, Homo sapiens
agaggctctttgagctgggaga

SEQ ID NO: 7363873 - DNA, 20 bp, Homo sapiens
aattctgtcttttctgctgc

SEQ ID NO: 7363874 - DNA, 22 bp, Homo sapiens
aattctgtaaagcttgtcatgc

SEQ ID NO: 7363875 - DNA, 22 bp, Homo sapiens
aattctgtaactttactgaatt

SEQ ID NO: 7363876 - DNA, 22 bp, Homo sapiens
aattgacaaatcatacttgtat

SEQ ID NO: 7363877 - DNA, 22 bp, Homo sapiens
aattcttggtcctagtgtataa

SEQ ID NO: 7363878 - DNA, 22 bp, Homo sapiens
aattgaaaatattgtagaccat

SEQ ID NO: 7363879 - DNA, 22 bp, Homo sapiens
aattgacagaaagtttacgagg

SEQ ID NO: 7363880 - DNA, 22 bp, Homo sapiens
aattgagtgctagacatcatga

SEQ ID NO: 7363881 - DNA, 22 bp, Homo sapiens
aattgatggacagagatgaaga

SEQ ID NO: 7363882 - DNA, 22 bp, Homo sapiens
aattgatgattcttatgtgaaa

SEQ ID NO: 7363883 - DNA, 22 bp, Homo sapiens
aattgatgggcactgaaatatt

SEQ ID NO: 7363884 - DNA, 22 bp, Homo sapiens
aattgcatgttaatgactaagt

SEQ ID NO: 7363885 - DNA, 22 bp, Homo sapiens
aatggtcaaaaagatacgtaaa

SEQ ID NO: 7363886 - DNA, 22 bp, Homo sapiens
aatggtcactatgtaaggtgat

SEQ ID NO: 7363887 - DNA, 22 bp, Homo sapiens
aatggtcagggcttttgtaggt

SEQ ID NO: 7363888 - DNA, 22 bp, Homo sapiens
aatggtaatttgcagaaagtcc

SEQ ID NO: 7363889 - DNA, 22 bp, Homo sapiens
aatggttaatatttgtaatatg

SEQ ID NO: 7363890 - DNA, 22 bp, Homo sapiens
aatggtcattggtggttattgg

SEQ ID NO: 7363891 - DNA, 22 bp, Homo sapiens
aatggtttaacatatgcttgag

SEQ ID NO: 7363892 - DNA, 22 bp, Homo sapiens
aatggtttgtacctgtccttgg

SEQ ID NO: 7363893 - DNA, 22 bp, Homo sapiens
aatgtgcaggctcaaaccttgt

SEQ ID NO: 7363894 - DNA, 22 bp, Homo sapiens
aatgtgcagatgaataaacaaa

SEQ ID NO: 7363895 - DNA, 22 bp, Homo sapiens
aatgtgctttgttcagccattt

SEQ ID NO: 7363896 - DNA, 17 bp, Homo sapiens
aatgtggaagtacatgc

SEQ ID NO: 7363897 - DNA, 22 bp, Homo sapiens
aatgtaaaatatcttgtacttg

SEQ ID NO: 7363898 - DNA, 22 bp, Homo sapiens
aatgtcttctcttgttgaattt

SEQ ID NO: 7363899 - DNA, 22 bp, Homo sapiens
aatgtgaactttgtcatgtaac

SEQ ID NO: 7363900 - DNA, 22 bp, Homo sapiens
aatgtcttcagttctgtattgt

SEQ ID NO: 7363901 - DNA, 22 bp, Homo sapiens
aatgtcttccctggcaggccaa

SEQ ID NO: 7363902 - DNA, 22 bp, Homo sapiens
agaagcagcaagcccttcaaag

SEQ ID NO: 7363903 - DNA, 22 bp, Homo sapiens
agacaatatgtatattaagaat

SEQ ID NO: 7363904 - DNA, 22 bp, Homo sapiens
agacaatgaatagatttgagaa

SEQ ID NO: 7363905 - DNA, 21 bp, Homo sapiens
agacaatgctgtaaaattcag

SEQ ID NO: 7363906 - DNA, 22 bp, Homo sapiens
agacaatgtcaaggtgatcatc

SEQ ID NO: 7363907 - DNA, 22 bp, Homo sapiens
aatggcaattcagtgaaattat

SEQ ID NO: 7363908 - DNA, 22 bp, Homo sapiens
aatgggaagtcactactgttac

SEQ ID NO: 7363909 - DNA, 22 bp, Homo sapiens
aatggcactttataaatgttaa

SEQ ID NO: 7363910 - DNA, 22 bp, Homo sapiens
aatggcagaggcaaagatggta

SEQ ID NO: 7363911 - DNA, 22 bp, Homo sapiens
agaccctgcacctctcgtgggc

SEQ ID NO: 7363912 - DNA, 21 bp, Homo sapiens
agaccctgcatatgttcagta

SEQ ID NO: 7363913 - DNA, 22 bp, Homo sapiens
agaccctgcattttccagggtt

SEQ ID NO: 7363914 - DNA, 22 bp, Homo sapiens
agaccctggtaaacactccagg

SEQ ID NO: 7363915 - DNA, 22 bp, Homo sapiens
agaccctggggaaagtcacttc

SEQ ID NO: 7363916 - DNA, 22 bp, Homo sapiens
agaccctggagaatgaaagtgc

SEQ ID NO: 7363917 - DNA, 22 bp, Homo sapiens
agaccctggagaatgaaagtgc

SEQ ID NO: 7363918 - DNA, 18 bp, Homo sapiens
agaccctctaagggcagt

SEQ ID NO: 7363919 - DNA, 22 bp, Homo sapiens
agaccccctttaatggaagtgc

SEQ ID NO: 7363920 - DNA, 22 bp, Homo sapiens
aatgtgtaaaaggttttcttca

SEQ ID NO: 7363921 - DNA, 22 bp, Homo sapiens
agaccctttgggtctgtgcagg

SEQ ID NO: 7363922 - DNA, 22 bp, Homo sapiens
agaccctgttagttccagtctt

SEQ ID NO: 7363923 - DNA, 22 bp, Homo sapiens
agaccctgtcagtgttaggaaa

SEQ ID NO: 7363924 - DNA, 20 bp, Homo sapiens
agaccctgtgtcctgtggcc

SEQ ID NO: 7363925 - DNA, 22 bp, Homo sapiens
aattaaaaaaggagagcttgct

SEQ ID NO: 7363926 - DNA, 22 bp, Homo sapiens
agacctcaataccaggcaccac

SEQ ID NO: 7363927 - DNA, 22 bp, Homo sapiens
aattaacagagggcttattact

SEQ ID NO: 7363928 - DNA, 22 bp, Homo sapiens
agagacaggaatggcattaaga

SEQ ID NO: 7363929 - DNA, 22 bp, Homo sapiens
agagacaggagttctgtttcca

SEQ ID NO: 7363930 - DNA, 22 bp, Homo sapiens
aattaaaaaaggagagcttgct

SEQ ID NO: 7363931 - DNA, 22 bp, Homo sapiens
aattaaaagataacccatgagt

SEQ ID NO: 7363932 - DNA, 22 bp, Homo sapiens
aattaaaagataacccatgagt

SEQ ID NO: 7363933 - DNA, 22 bp, Homo sapiens
agagcctggaggttctgctgaa

SEQ ID NO: 7363934 - DNA, 22 bp, Homo sapiens
agagccagttacaactgtggag

SEQ ID NO: 7363935 - DNA, 22 bp, Homo sapiens
agagccaggtgctgctgtttga

SEQ ID NO: 7363936 - DNA, 22 bp, Homo sapiens
agagccaggctctacctgggtt

SEQ ID NO: 7363937 - DNA, 22 bp, Homo sapiens
agagccaggctcccatggggca

SEQ ID NO: 7363938 - DNA, 22 bp, Homo sapiens
agagacaggatatctgctcatg

SEQ ID NO: 7363939 - DNA, 22 bp, Homo sapiens
acacatcttagactgaaatatg

SEQ ID NO: 7363940 - DNA, 22 bp, Homo sapiens
acacatgtaaaacacttagcaa

SEQ ID NO: 7363941 - DNA, 22 bp, Homo sapiens
agcagctggttcccgagggcgt

SEQ ID NO: 7363942 - DNA, 22 bp, Homo sapiens
agcagctggttcccgagggcgt

SEQ ID NO: 7363943 - DNA, 22 bp, Homo sapiens
acacattaaaacgtctacaatg

SEQ ID NO: 7363944 - DNA, 22 bp, Homo sapiens
acacattaacctttgaaattct

SEQ ID NO: 7363945 - DNA, 22 bp, Homo sapiens
acacatgttcaagaatgttcag

SEQ ID NO: 7363946 - DNA, 22 bp, Homo sapiens
acacatgtacagattagtattt

SEQ ID NO: 7363947 - DNA, 22 bp, Homo sapiens
acacatgtatggcacttacatt

SEQ ID NO: 7363948 - DNA, 22 bp, Homo sapiens
acacatgtatgttttgtatttg

SEQ ID NO: 7363949 - DNA, 22 bp, Homo sapiens
acacatgtgattctaagacagc

SEQ ID NO: 7363950 - DNA, 22 bp, Homo sapiens
acactgagtgagaaaaggaaat

SEQ ID NO: 7363951 - DNA, 22 bp, Homo sapiens
acactgagttttaccaggcaca

SEQ ID NO: 7363952 - DNA, 22 bp, Homo sapiens
acactgagtattgagtagggta

SEQ ID NO: 7363953 - DNA, 22 bp, Homo sapiens
acacttcacccctgctcccagt

SEQ ID NO: 7363954 - DNA, 22 bp, Homo sapiens
acacttcagctccacaaacatt

SEQ ID NO: 7363955 - DNA, 22 bp, Homo sapiens
acacttcagcagtatgcttggg

SEQ ID NO: 7363956 - DNA, 22 bp, Homo sapiens
acacttcagcagtatgcttggg

SEQ ID NO: 7363957 - DNA, 22 bp, Homo sapiens
acactgagcttccaagatgggg

SEQ ID NO: 7363958 - DNA, 22 bp, Homo sapiens
acactgacgcttgacagtcacc

SEQ ID NO: 7363959 - DNA, 22 bp, Homo sapiens
acactgactgggacagaagacc

SEQ ID NO: 7363960 - DNA, 22 bp, Homo sapiens
acactgaagagcactttcaaag

SEQ ID NO: 7363961 - DNA, 22 bp, Homo sapiens
acactgaatcagaaattgttgg

SEQ ID NO: 7363962 - DNA, 22 bp, Homo sapiens
acactgaatatacaatgaatat

SEQ ID NO: 7363963 - DNA, 22 bp, Homo sapiens
acactcaccctcccactgcctg

SEQ ID NO: 7363964 - DNA, 22 bp, Homo sapiens
acactctgtgaggcatgtaatg

SEQ ID NO: 7363965 - DNA, 22 bp, Homo sapiens
acacccaggaataaggactggg

SEQ ID NO: 7363966 - DNA, 22 bp, Homo sapiens
acacccaggctggcgtgcagtg

SEQ ID NO: 7363967 - DNA, 22 bp, Homo sapiens
acacattatagagagtataata

SEQ ID NO: 7363968 - DNA, 22 bp, Homo sapiens
acacattataggcaatcaaaag

SEQ ID NO: 7363969 - DNA, 22 bp, Homo sapiens
acacattataggcaatcaaaag

SEQ ID NO: 7363970 - DNA, 22 bp, Homo sapiens
agcagcaaagaataggccctct

SEQ ID NO: 7363971 - DNA, 22 bp, Homo sapiens
agcagatgtgtctctgcactgt

SEQ ID NO: 7363972 - DNA, 22 bp, Homo sapiens
agcagatgagcctcatgactgg

SEQ ID NO: 7363973 - DNA, 22 bp, Homo sapiens
agcagatgcaaacttaccttga

SEQ ID NO: 7363974 - DNA, 22 bp, Homo sapiens
agcagatgcattatgattgaaa

SEQ ID NO: 7363975 - DNA, 18 bp, Homo sapiens
agcagagcccatgcattc

SEQ ID NO: 7363976 - DNA, 22 bp, Homo sapiens
agcagagcccttccatggcctt

SEQ ID NO: 7363977 - DNA, 22 bp, Homo sapiens
agcagagaggaggtggccctgt

SEQ ID NO: 7363978 - DNA, 18 bp, Homo sapiens
agcagagagtgaatggga

SEQ ID NO: 7363979 - DNA, 19 bp, Homo sapiens
agcagagcaaagtggctga

SEQ ID NO: 7363980 - DNA, 22 bp, Homo sapiens
agcagagcagatagtattatct

SEQ ID NO: 7363981 - DNA, 22 bp, Homo sapiens
agcagctgagccccagctgtga

SEQ ID NO: 7363982 - DNA, 22 bp, Homo sapiens
agcagctgagccccagctgtga

SEQ ID NO: 7363983 - DNA, 22 bp, Homo sapiens
agcagctgggtccggcggagca

SEQ ID NO: 7363984 - DNA, 22 bp, Homo sapiens
agcagctggggcctgtgacgat

SEQ ID NO: 7363985 - DNA, 23 bp, Homo sapiens
agcagctggggtgctcttttgtc

SEQ ID NO: 7363986 - DNA, 17 bp, Homo sapiens
agcagctgggttgatct

SEQ ID NO: 7363987 - DNA, 22 bp, Homo sapiens
agcagctggtgcaactctaaga

SEQ ID NO: 7363988 - DNA, 22 bp, Homo sapiens
agcagctggtgagcaagctcag

SEQ ID NO: 7363989 - DNA, 22 bp, Homo sapiens
agcagctggtaggagtggccac

SEQ ID NO: 7363990 - DNA, 22 bp, Homo sapiens
acacagaggtggccactctttt

SEQ ID NO: 7363991 - DNA, 21 bp, Homo sapiens
acacagaggcatcatcacttt

SEQ ID NO: 7363992 - DNA, 22 bp, Homo sapiens
acacagaggaaagtgtgaaggg

SEQ ID NO: 7363993 - DNA, 22 bp, Homo sapiens
acagaaaatgccagaagggtgg

SEQ ID NO: 7363994 - DNA, 22 bp, Homo sapiens
acagacaagtagttcagacaag

SEQ ID NO: 7363995 - DNA, 22 bp, Homo sapiens
acagaaagataggcacaaggtc

SEQ ID NO: 7363996 - DNA, 22 bp, Homo sapiens
agccagggggacgctttctggc

SEQ ID NO: 7363997 - DNA, 22 bp, Homo sapiens
agccaggggattcatcagggac

SEQ ID NO: 7363998 - DNA, 22 bp, Homo sapiens
acagacagaggctccatgagga

SEQ ID NO: 7363999 - DNA, 22 bp, Homo sapiens
acagacagacagattgcatatg

SEQ ID NO: 7364000 - DNA, 22 bp, Homo sapiens
acagacagacagattgcatatg

SEQ ID NO: 7364001 - DNA, 19 bp, Homo sapiens
agccagggtccagacatgt

SEQ ID NO: 7364002 - DNA, 22 bp, Homo sapiens
agccagggtaaggtacttagta

SEQ ID NO: 7364003 - DNA, 19 bp, Homo sapiens
agccagggtgagaaggagc

SEQ ID NO: 7364004 - DNA, 19 bp, Homo sapiens
agccagggtgagaaggagc

SEQ ID NO: 7364005 - DNA, 21 bp, Homo sapiens
agccagggtggacactgtatg

SEQ ID NO: 7364006 - DNA, 23 bp, Homo sapiens
acagacattccataatgtacacc

SEQ ID NO: 7364007 - DNA, 21 bp, Homo sapiens
acagagaaagagcagcctcct

SEQ ID NO: 7364008 - DNA, 22 bp, Homo sapiens
acagagagctgtgattgagtta

SEQ ID NO: 7364009 - DNA, 22 bp, Homo sapiens
acagagaaagttcctctcaggc

SEQ ID NO: 7364010 - DNA, 22 bp, Homo sapiens
agcctctctgttagtcactggg

SEQ ID NO: 7364011 - DNA, 22 bp, Homo sapiens
agccctgttctgttttagtagc

SEQ ID NO: 7364012 - DNA, 22 bp, Homo sapiens
agccctgtttatgccacatcat

SEQ ID NO: 7364013 - DNA, 22 bp, Homo sapiens
agcctctgatgatcacaggggg

SEQ ID NO: 7364014 - DNA, 22 bp, Homo sapiens
agcctctgatggctcccaagga

SEQ ID NO: 7364015 - DNA, 22 bp, Homo sapiens
acagagctgggatctgaaccca

SEQ ID NO: 7364016 - DNA, 22 bp, Homo sapiens
agctcctgccaacactgatggg

SEQ ID NO: 7364017 - DNA, 22 bp, Homo sapiens
agctcctgctctttgtccctaa

SEQ ID NO: 7364018 - DNA, 22 bp, Homo sapiens
acagcaatgagtaactccttgg

SEQ ID NO: 7364019 - DNA, 22 bp, Homo sapiens
acagattcactgcactggccat

SEQ ID NO: 7364020 - DNA, 22 bp, Homo sapiens
acagatgttacagtatgatctc

SEQ ID NO: 7364021 - DNA, 22 bp, Homo sapiens
acagatggggcacaaagccaca

SEQ ID NO: 7364022 - DNA, 19 bp, Homo sapiens
acagatggaggaatctggg

SEQ ID NO: 7364023 - DNA, 22 bp, Homo sapiens
acagggtggggatggtgagctt

SEQ ID NO: 7364024 - DNA, 22 bp, Homo sapiens
acaggtggaaacatggtgttgg

SEQ ID NO: 7364025 - DNA, 22 bp, Homo sapiens
acagggagtgcaattcatattg

SEQ ID NO: 7364026 - DNA, 18 bp, Homo sapiens
acagggagggcgctgggg

SEQ ID NO: 7364027 - DNA, 22 bp, Homo sapiens
acaggtggtagagtggaaagag

SEQ ID NO: 7364028 - DNA, 21 bp, Homo sapiens
aggagctgtgtgcttcctttc

SEQ ID NO: 7364029 - DNA, 22 bp, Homo sapiens
aggaggaactcagaaagaaggt

SEQ ID NO: 7364030 - DNA, 22 bp, Homo sapiens
aggaggaactcagaaagaaggt

SEQ ID NO: 7364031 - DNA, 23 bp, Homo sapiens
aggaggaaaagttatctgctgag

SEQ ID NO: 7364032 - DNA, 22 bp, Homo sapiens
acagtaacagtctatttctcag

SEQ ID NO: 7364033 - DNA, 22 bp, Homo sapiens
acagtacaagcaatgcattttt

SEQ ID NO: 7364034 - DNA, 22 bp, Homo sapiens
acagtacaagcatgatacataa

SEQ ID NO: 7364035 - DNA, 22 bp, Homo sapiens
aggagtcagatatgggaaagtt

SEQ ID NO: 7364036 - DNA, 22 bp, Homo sapiens
aggagtggaattactgggttct

SEQ ID NO: 7364037 - DNA, 22 bp, Homo sapiens
aggagtctgttgaaatgtctat

SEQ ID NO: 7364038 - DNA, 23 bp, Homo sapiens
acagttatagctgtgaataacat

SEQ ID NO: 7364039 - DNA, 22 bp, Homo sapiens
acagttcaagtcttagacaaca

SEQ ID NO: 7364040 - DNA, 22 bp, Homo sapiens
acagttagggactataatcatt

SEQ ID NO: 7364041 - DNA, 22 bp, Homo sapiens
acagttacattccagcaacatc

SEQ ID NO: 7364042 - DNA, 22 bp, Homo sapiens
acagttaattaacattaagggg

SEQ ID NO: 7364043 - DNA, 22 bp, Homo sapiens
acagttaatatgtgacagaact

SEQ ID NO: 7364044 - DNA, 22 bp, Homo sapiens
acagttaataagtagtaagtca

SEQ ID NO: 7364045 - DNA, 22 bp, Homo sapiens
acagttaagcagtatgatcaca

SEQ ID NO: 7364046 - DNA, 21 bp, Homo sapiens
acagttttaaggagcacatgg

SEQ ID NO: 7364047 - DNA, 22 bp, Homo sapiens
acataaagtactgagagactct

SEQ ID NO: 7364048 - DNA, 22 bp, Homo sapiens
acataaatagattattgggagg

SEQ ID NO: 7364049 - DNA, 22 bp, Homo sapiens
acataaatagattattgggagg

SEQ ID NO: 7364050 - DNA, 22 bp, Homo sapiens
aggcagctggcaaattctagag

SEQ ID NO: 7364051 - DNA, 22 bp, Homo sapiens
aggcagctggaggcagagacta

SEQ ID NO: 7364052 - DNA, 22 bp, Homo sapiens
aggcaggcactccggaagtgtc

SEQ ID NO: 7364053 - DNA, 22 bp, Homo sapiens
aggcaggattgctgacaacaat

SEQ ID NO: 7364054 - DNA, 22 bp, Homo sapiens
aggcagcatgggccccagctcc

SEQ ID NO: 7364055 - DNA, 22 bp, Homo sapiens
acagtttggttgctacagtaaa

SEQ ID NO: 7364056 - DNA, 22 bp, Homo sapiens
aggcagcatgggcccagagtcc

SEQ ID NO: 7364057 - DNA, 22 bp, Homo sapiens
aggcagcatgctctgcttctac

SEQ ID NO: 7364058 - DNA, 21 bp, Homo sapiens
aggcagcatctgatttatatg

SEQ ID NO: 7364059 - DNA, 22 bp, Homo sapiens
acagctgtgaagcaagcactct

SEQ ID NO: 7364060 - DNA, 22 bp, Homo sapiens
acagctgtgaaaatccacagga

SEQ ID NO: 7364061 - DNA, 21 bp, Homo sapiens
acagctgtcttagcttgggct

SEQ ID NO: 7364062 - DNA, 22 bp, Homo sapiens
agctgggtgaaggcagatggct

SEQ ID NO: 7364063 - DNA, 22 bp, Homo sapiens
agctgggtcttgggccaggaga

SEQ ID NO: 7364064 - DNA, 22 bp, Homo sapiens
acagcttagccagtcaagctct

SEQ ID NO: 7364065 - DNA, 22 bp, Homo sapiens
acagctgtgttttataatcagc

SEQ ID NO: 7364066 - DNA, 22 bp, Homo sapiens
acaggcccagctcttcaccaga

SEQ ID NO: 7364067 - DNA, 22 bp, Homo sapiens
acaggcaggtaatttacatatt

SEQ ID NO: 7364068 - DNA, 22 bp, Homo sapiens
acaggcctgacacacagagggc

SEQ ID NO: 7364069 - DNA, 22 bp, Homo sapiens
acaggcctacgaagtcaggtgc

SEQ ID NO: 7364070 - DNA, 22 bp, Homo sapiens
agctttatcagaggagtctcta

SEQ ID NO: 7364071 - DNA, 22 bp, Homo sapiens
agctttatcccttgcccatcga

SEQ ID NO: 7364072 - DNA, 22 bp, Homo sapiens
agctttatcttcacctgggaat

SEQ ID NO: 7364073 - DNA, 22 bp, Homo sapiens
agctttatgaggagaccttagt

SEQ ID NO: 7364074 - DNA, 22 bp, Homo sapiens
agctttatatttaatgaattct

SEQ ID NO: 7364075 - DNA, 22 bp, Homo sapiens
agctttatcacaatattggcta

SEQ ID NO: 7364076 - DNA, 22 bp, Homo sapiens
agctttatatttaatgaattct

SEQ ID NO: 7364077 - DNA, 22 bp, Homo sapiens
agctttatgggagcttagataa

SEQ ID NO: 7364078 - DNA, 22 bp, Homo sapiens
agctttatgcttcctacaagct

SEQ ID NO: 7364079 - DNA, 22 bp, Homo sapiens
aggaatgacaggcctcccgcag

SEQ ID NO: 7364080 - DNA, 22 bp, Homo sapiens
agctgccttccctctcattagg

SEQ ID NO: 7364081 - DNA, 17 bp, Homo sapiens
agctgccttgcttgagc

SEQ ID NO: 7364082 - DNA, 22 bp, Homo sapiens
agctgccttttgagaaagctca

SEQ ID NO: 7364083 - DNA, 21 bp, Homo sapiens
agctgcctttagagagaacca

SEQ ID NO: 7364084 - DNA, 22 bp, Homo sapiens
agctgcctttgcatcactttaa

SEQ ID NO: 7364085 - DNA, 22 bp, Homo sapiens
agctgcctgggcttgtacacct

SEQ ID NO: 7364086 - DNA, 15 bp, Homo sapiens
agctgcctgggtgct

SEQ ID NO: 7364087 - DNA, 22 bp, Homo sapiens
agctgcctgtaaaatgtgtgat

SEQ ID NO: 7364088 - DNA, 22 bp, Homo sapiens
agctgcccaggttcattgggcc

SEQ ID NO: 7364089 - DNA, 19 bp, Homo sapiens
agctgcctgtgcgcgcccg

SEQ ID NO: 7364090 - DNA, 22 bp, Homo sapiens
agctgcctgtgctgggagccca

SEQ ID NO: 7364091 - DNA, 22 bp, Homo sapiens
agctgcctgtcctaggccatca

SEQ ID NO: 7364092 - DNA, 20 bp, Homo sapiens
agctgccttcattttctaga

SEQ ID NO: 7364093 - DNA, 22 bp, Homo sapiens
agctgccttatggagtatgaaa

SEQ ID NO: 7364094 - DNA, 22 bp, Homo sapiens
agctgcctgtgtagaaccatct

SEQ ID NO: 7364095 - DNA, 22 bp, Homo sapiens
agctgccttaaattactttgtg

SEQ ID NO: 7364096 - DNA, 23 bp, Homo sapiens
acagcacccatgtcatctggctc

SEQ ID NO: 7364097 - DNA, 22 bp, Homo sapiens
acagcacttattcagcacagtg

SEQ ID NO: 7364098 - DNA, 22 bp, Homo sapiens
acagcagacacaggcacgctgt

SEQ ID NO: 7364099 - DNA, 22 bp, Homo sapiens
acagcagaataatgagtaatag

SEQ ID NO: 7364100 - DNA, 21 bp, Homo sapiens
acagcagacaggcttaggacc

SEQ ID NO: 7364101 - DNA, 22 bp, Homo sapiens
acagcagacagtcggcttcctg

SEQ ID NO: 7364102 - DNA, 22 bp, Homo sapiens
acagcagacattgggtgattga

SEQ ID NO: 7364103 - DNA, 17 bp, Homo sapiens
agctgccagggagtgtg

SEQ ID NO: 7364104 - DNA, 22 bp, Homo sapiens
agctgccagggactgggcatgg

SEQ ID NO: 7364105 - DNA, 22 bp, Homo sapiens
agctgcccagataggaggaggc

SEQ ID NO: 7364106 - DNA, 22 bp, Homo sapiens
agctgcccaatcctgcagggcg

SEQ ID NO: 7364107 - DNA, 22 bp, Homo sapiens
agctgggtacacgttgtcacaa

SEQ ID NO: 7364108 - DNA, 23 bp, Homo sapiens
acagctgcacctggccgcctggc

SEQ ID NO: 7364109 - DNA, 22 bp, Homo sapiens
acagctgcacttgaagcaggtt

SEQ ID NO: 7364110 - DNA, 22 bp, Homo sapiens
acagctgcatgatggtccagat

SEQ ID NO: 7364111 - DNA, 22 bp, Homo sapiens
acagctgcattcttaacaggaa

SEQ ID NO: 7364112 - DNA, 22 bp, Homo sapiens
acagctgcattcttaacaggaa

SEQ ID NO: 7364113 - DNA, 22 bp, Homo sapiens
acagctgcacactgaacttggt

SEQ ID NO: 7364114 - DNA, 22 bp, Homo sapiens
acagctgcaaattgttagagga

SEQ ID NO: 7364115 - DNA, 22 bp, Homo sapiens
acagctgcaaattgttagagga

SEQ ID NO: 7364116 - DNA, 22 bp, Homo sapiens
acagctcagacatcactgctct

SEQ ID NO: 7364117 - DNA, 22 bp, Homo sapiens
acagctactctgcagataaatc

SEQ ID NO: 7364118 - DNA, 22 bp, Homo sapiens
acagctcactcacagggctagt

SEQ ID NO: 7364119 - DNA, 22 bp, Homo sapiens
acagctatagacgatgtataga

SEQ ID NO: 7364120 - DNA, 22 bp, Homo sapiens
acagctaatccccctagattct

SEQ ID NO: 7364121 - DNA, 22 bp, Homo sapiens
acagctctgcatggcagttatt

SEQ ID NO: 7364122 - DNA, 22 bp, Homo sapiens
acagctgacattggcagctatt

SEQ ID NO: 7364123 - DNA, 22 bp, Homo sapiens
acagctcttaggcagaaccaac

SEQ ID NO: 7364124 - DNA, 22 bp, Homo sapiens
acccaggctggagtgcagtagc

SEQ ID NO: 7364125 - DNA, 22 bp, Homo sapiens
agggcctgggccagcacccttt

SEQ ID NO: 7364126 - DNA, 22 bp, Homo sapiens
accccaggaagtggaggtcatg

SEQ ID NO: 7364127 - DNA, 22 bp, Homo sapiens
accccaggaagtggaggtcatg

SEQ ID NO: 7364128 - DNA, 22 bp, Homo sapiens
acccggagtcggaggttgcagt

SEQ ID NO: 7364129 - DNA, 20 bp, Homo sapiens
agggcagcttgaggagccgg

SEQ ID NO: 7364130 - DNA, 22 bp, Homo sapiens
agggcagcttccatagtctggc

SEQ ID NO: 7364131 - DNA, 22 bp, Homo sapiens
acccacacctccgtatatcact

SEQ ID NO: 7364132 - DNA, 22 bp, Homo sapiens
acccacacctccgtatatcact

SEQ ID NO: 7364133 - DNA, 22 bp, Homo sapiens
accattctgtctctttacaaat

SEQ ID NO: 7364134 - DNA, 22 bp, Homo sapiens
accatgttggccaagctggtct

SEQ ID NO: 7364135 - DNA, 22 bp, Homo sapiens
accatgttggccaagctggtct

SEQ ID NO: 7364136 - DNA, 22 bp, Homo sapiens
accattctggtccatactgttc

SEQ ID NO: 7364137 - DNA, 22 bp, Homo sapiens
accatcagtactggatgctgac

SEQ ID NO: 7364138 - DNA, 22 bp, Homo sapiens
agggagctctaagtagagggac

SEQ ID NO: 7364139 - DNA, 22 bp, Homo sapiens
agggagctctgggggcacacgg

SEQ ID NO: 7364140 - DNA, 22 bp, Homo sapiens
agggagctctttggtcttgccg

SEQ ID NO: 7364141 - DNA, 22 bp, Homo sapiens
agggagctcagttggaagcggt

SEQ ID NO: 7364142 - DNA, 22 bp, Homo sapiens
agggagctcagttggaagcggt

SEQ ID NO: 7364143 - DNA, 22 bp, Homo sapiens
agggagctctaagtagagggac

SEQ ID NO: 7364144 - DNA, 22 bp, Homo sapiens
agggagctcagttggaagcggt

SEQ ID NO: 7364145 - DNA, 22 bp, Homo sapiens
acatttgtcttctttcagatta

SEQ ID NO: 7364146 - DNA, 22 bp, Homo sapiens
accaaaacctgctactaaagga

SEQ ID NO: 7364147 - DNA, 21 bp, Homo sapiens
accaaaacctatactttctgt

SEQ ID NO: 7364148 - DNA, 21 bp, Homo sapiens
accaaaacctatactttctgt

SEQ ID NO: 7364149 - DNA, 22 bp, Homo sapiens
agggaagagcttgcaagaaacc

SEQ ID NO: 7364150 - DNA, 22 bp, Homo sapiens
agggaagagcttgcaagaaacc

SEQ ID NO: 7364151 - DNA, 22 bp, Homo sapiens
aggctttactgcctcaggactc

SEQ ID NO: 7364152 - DNA, 22 bp, Homo sapiens
aggctttactggatttttcgct

SEQ ID NO: 7364153 - DNA, 23 bp, Homo sapiens
aggctttatggtagaaagtttgc

SEQ ID NO: 7364154 - DNA, 22 bp, Homo sapiens
aggctttatttgatctatatgc

SEQ ID NO: 7364155 - DNA, 22 bp, Homo sapiens
agggaagccccgaggaggcacc

SEQ ID NO: 7364156 - DNA, 22 bp, Homo sapiens
agggaagcagcagccgcctgtc

SEQ ID NO: 7364157 - DNA, 22 bp, Homo sapiens
agggaagcaggaatagctctga

SEQ ID NO: 7364158 - DNA, 22 bp, Homo sapiens
agggaagaggcaaggtttatgg

SEQ ID NO: 7364159 - DNA, 22 bp, Homo sapiens
agggaagaggaccagagtctct

SEQ ID NO: 7364160 - DNA, 17 bp, Homo sapiens
agggacagcagtttagg

SEQ ID NO: 7364161 - DNA, 22 bp, Homo sapiens
agggagccttcctggctgtggt

SEQ ID NO: 7364162 - DNA, 22 bp, Homo sapiens
agggagctattgtgttactttg

SEQ ID NO: 7364163 - DNA, 22 bp, Homo sapiens
aggccctgtaaggtgtggagat

SEQ ID NO: 7364164 - DNA, 22 bp, Homo sapiens
aggccctggtcaggtctggctg

SEQ ID NO: 7364165 - DNA, 22 bp, Homo sapiens
aggccctgtaaggtgtggagat

SEQ ID NO: 7364166 - DNA, 22 bp, Homo sapiens
aggccctgcccagagctcctcg

SEQ ID NO: 7364167 - DNA, 22 bp, Homo sapiens
aggccctgtccatggtgctgaa

SEQ ID NO: 7364168 - DNA, 22 bp, Homo sapiens
aggccctgttatgagccactgt

SEQ ID NO: 7364169 - DNA, 22 bp, Homo sapiens
aggccctgtccatggtgctgaa

SEQ ID NO: 7364170 - DNA, 20 bp, Homo sapiens
aggccctgtgcatcttgttt

SEQ ID NO: 7364171 - DNA, 22 bp, Homo sapiens
acatgcagacgggatcctggca

SEQ ID NO: 7364172 - DNA, 22 bp, Homo sapiens
acatgcaggaaaatgcacagat

SEQ ID NO: 7364173 - DNA, 22 bp, Homo sapiens
acatgcaggaaaatgcacagat

SEQ ID NO: 7364174 - DNA, 22 bp, Homo sapiens
acatggagctcaaacatgagtg

SEQ ID NO: 7364175 - DNA, 22 bp, Homo sapiens
aggccctgttgtagcattttgg

SEQ ID NO: 7364176 - DNA, 21 bp, Homo sapiens
acatggaagagaaattaacca

SEQ ID NO: 7364177 - DNA, 22 bp, Homo sapiens
acatggaagataaaaatactca

SEQ ID NO: 7364178 - DNA, 20 bp, Homo sapiens
acatggaaggtcaaactatc

SEQ ID NO: 7364179 - DNA, 22 bp, Homo sapiens
aggcaggcagctgtcaccactc

SEQ ID NO: 7364180 - DNA, 22 bp, Homo sapiens
aggcaggcagggctcactgtct

SEQ ID NO: 7364181 - DNA, 17 bp, Homo sapiens
aggcaggcagagcggga

SEQ ID NO: 7364182 - DNA, 22 bp, Homo sapiens
aggcaggggagctggaagggta

SEQ ID NO: 7364183 - DNA, 22 bp, Homo sapiens
aggcaggggagctggaagggta

SEQ ID NO: 7364184 - DNA, 23 bp, Homo sapiens
acatgatacacaattagcaaacc

SEQ ID NO: 7364185 - DNA, 22 bp, Homo sapiens
acatgaggaactcaggagtcac

SEQ ID NO: 7364186 - DNA, 22 bp, Homo sapiens
acatgagaggctgtggagtaca

SEQ ID NO: 7364187 - DNA, 22 bp, Homo sapiens
acatgagaggctgtggagtaca

SEQ ID NO: 7364188 - DNA, 22 bp, Homo sapiens
acatttcactgttcacagcagg

SEQ ID NO: 7364189 - DNA, 22 bp, Homo sapiens
acatttcactgttcacagcagg

SEQ ID NO: 7364190 - DNA, 22 bp, Homo sapiens
acatttatataactcactagga

SEQ ID NO: 7364191 - DNA, 22 bp, Homo sapiens
acatttatataactcactagga

SEQ ID NO: 7364192 - DNA, 22 bp, Homo sapiens
acatttaatgatcctactgtga

SEQ ID NO: 7364193 - DNA, 22 bp, Homo sapiens
aggctgaggatccctgtgttct

SEQ ID NO: 7364194 - DNA, 22 bp, Homo sapiens
aggctgaggatccctgtgttct

SEQ ID NO: 7364195 - DNA, 19 bp, Homo sapiens
acatttaaattcagatctc

SEQ ID NO: 7364196 - DNA, 22 bp, Homo sapiens
acatttaaccaaactgtttaat

SEQ ID NO: 7364197 - DNA, 22 bp, Homo sapiens
acatttaaccaaactgtttaat

SEQ ID NO: 7364198 - DNA, 22 bp, Homo sapiens
acatttaaccctcaggtttctg

SEQ ID NO: 7364199 - DNA, 22 bp, Homo sapiens
aggctaggcatgtgctaccaca

SEQ ID NO: 7364200 - DNA, 22 bp, Homo sapiens
acattgtatacagacttagtca

SEQ ID NO: 7364201 - DNA, 22 bp, Homo sapiens
aggccttcctcggagacaggga

SEQ ID NO: 7364202 - DNA, 22 bp, Homo sapiens
aggcctgttggcgtgggctcta

SEQ ID NO: 7364203 - DNA, 22 bp, Homo sapiens
aggctagctgattgccttagaa

SEQ ID NO: 7364204 - DNA, 22 bp, Homo sapiens
actgatgaagagtaccactgtt

SEQ ID NO: 7364205 - DNA, 23 bp, Homo sapiens
actgattaacatgtgtgatattc

SEQ ID NO: 7364206 - DNA, 22 bp, Homo sapiens
actgaatagtgctgcattgtac

SEQ ID NO: 7364207 - DNA, 22 bp, Homo sapiens
actgcaacacctcctgggttca

SEQ ID NO: 7364208 - DNA, 23 bp, Homo sapiens
actgcctgtgccgatctctctca

SEQ ID NO: 7364209 - DNA, 22 bp, Homo sapiens
actgcacacctccagggcacta

SEQ ID NO: 7364210 - DNA, 22 bp, Homo sapiens
actgcacacctccagggcacta

SEQ ID NO: 7364211 - DNA, 22 bp, Homo sapiens
actgctgcaggtccagcccctt

SEQ ID NO: 7364212 - DNA, 22 bp, Homo sapiens
actgctcacgcattacttgagc

SEQ ID NO: 7364213 - DNA, 22 bp, Homo sapiens
actgctattgatgtcacacttt

SEQ ID NO: 7364214 - DNA, 22 bp, Homo sapiens
actgctcaaggatctggtaggg

SEQ ID NO: 7364215 - DNA, 22 bp, Homo sapiens
actgcttacttctagaactctt

SEQ ID NO: 7364216 - DNA, 22 bp, Homo sapiens
actgcttcactgcgtcttatct

SEQ ID NO: 7364217 - DNA, 22 bp, Homo sapiens
actgctttagacctagagctct

SEQ ID NO: 7364218 - DNA, 20 bp, Homo sapiens
actgcttctttctctgacct

SEQ ID NO: 7364219 - DNA, 17 bp, Homo sapiens
agtctgggacctgcgtg

SEQ ID NO: 7364220 - DNA, 22 bp, Homo sapiens
actgaagagcgtgctatgctca

SEQ ID NO: 7364221 - DNA, 23 bp, Homo sapiens
actgaagatgtcttagtggccct

SEQ ID NO: 7364222 - DNA, 22 bp, Homo sapiens
actgaaccaggcagagaaaaat

SEQ ID NO: 7364223 - DNA, 22 bp, Homo sapiens
actgaagacattactggtctaa

SEQ ID NO: 7364224 - DNA, 18 bp, Homo sapiens
actgaagatgcaagacct

SEQ ID NO: 7364225 - DNA, 22 bp, Homo sapiens
actgaagagcgtgctatgctca

SEQ ID NO: 7364226 - DNA, 22 bp, Homo sapiens
actgaagagaagcattttctgc

SEQ ID NO: 7364227 - DNA, 22 bp, Homo sapiens
actgaagacctcctgtcagcgg

SEQ ID NO: 7364228 - DNA, 22 bp, Homo sapiens
actgaagaacgcatcagtggtt

SEQ ID NO: 7364229 - DNA, 20 bp, Homo sapiens
agtctctgcaacatagtgca

SEQ ID NO: 7364230 - DNA, 19 bp, Homo sapiens
actcaggcttcctctgagg

SEQ ID NO: 7364231 - DNA, 18 bp, Homo sapiens
actcacagcagaagaagg

SEQ ID NO: 7364232 - DNA, 22 bp, Homo sapiens
actatcttccttatgcctatca

SEQ ID NO: 7364233 - DNA, 22 bp, Homo sapiens
actatataagattggcattttt

SEQ ID NO: 7364234 - DNA, 20 bp, Homo sapiens
actatagcatattcagaaag

SEQ ID NO: 7364235 - DNA, 22 bp, Homo sapiens
actagtttattacagttccact

SEQ ID NO: 7364236 - DNA, 22 bp, Homo sapiens
actagtttgaaaatatctgatt

SEQ ID NO: 7364237 - DNA, 22 bp, Homo sapiens
accttacatgcttttttcctca

SEQ ID NO: 7364238 - DNA, 19 bp, Homo sapiens
accttacagaaacaggcat

SEQ ID NO: 7364239 - DNA, 22 bp, Homo sapiens
accttaaaggccgaagtaaaga

SEQ ID NO: 7364240 - DNA, 22 bp, Homo sapiens
acctgttttcagaaaatgcaga

SEQ ID NO: 7364241 - DNA, 22 bp, Homo sapiens
actaaagaagccaaagttttct

SEQ ID NO: 7364242 - DNA, 22 bp, Homo sapiens
actaaaaactactgccaatagc

SEQ ID NO: 7364243 - DNA, 22 bp, Homo sapiens
agggctgtcagactgaggaggc

SEQ ID NO: 7364244 - DNA, 22 bp, Homo sapiens
agggtgggctagactcttcccc

SEQ ID NO: 7364245 - DNA, 20 bp, Homo sapiens
agggtggggacgttctgact

SEQ ID NO: 7364246 - DNA, 22 bp, Homo sapiens
agggtggggtgctacatcttta

SEQ ID NO: 7364247 - DNA, 22 bp, Homo sapiens
acctgctgtgattctaattggc

SEQ ID NO: 7364248 - DNA, 22 bp, Homo sapiens
acctgctgtcttgggggaatgc

SEQ ID NO: 7364249 - DNA, 22 bp, Homo sapiens
acctgctgaggagggggaatta

SEQ ID NO: 7364250 - DNA, 18 bp, Homo sapiens
acctgctgagtctaagca

SEQ ID NO: 7364251 - DNA, 22 bp, Homo sapiens
acctgccttctcaaggacatga

SEQ ID NO: 7364252 - DNA, 22 bp, Homo sapiens
aggtacagtagacagacagtta

SEQ ID NO: 7364253 - DNA, 22 bp, Homo sapiens
acctggtaactctccaggggag

SEQ ID NO: 7364254 - DNA, 22 bp, Homo sapiens
aggtagctagtcctttaagtta

SEQ ID NO: 7364255 - DNA, 22 bp, Homo sapiens
aggtagcgcaatttcctgggac

SEQ ID NO: 7364256 - DNA, 22 bp, Homo sapiens
aggtagctaaaacaggcttttg

SEQ ID NO: 7364257 - DNA, 22 bp, Homo sapiens
aggtagcatattccagacttgt

SEQ ID NO: 7364258 - DNA, 22 bp, Homo sapiens
aggtagcagcctagcagggact

SEQ ID NO: 7364259 - DNA, 22 bp, Homo sapiens
aggtagcaagacacctgctttt

SEQ ID NO: 7364260 - DNA, 22 bp, Homo sapiens
acttccaagtttattcatgtga

SEQ ID NO: 7364261 - DNA, 22 bp, Homo sapiens
acttccagaattagaatttaag

SEQ ID NO: 7364262 - DNA, 22 bp, Homo sapiens
acttgcatatatccctccacat

SEQ ID NO: 7364263 - DNA, 22 bp, Homo sapiens
acttgcaggtgtctggagttag

SEQ ID NO: 7364264 - DNA, 22 bp, Homo sapiens
acttgcagaaacttcaattctg

SEQ ID NO: 7364265 - DNA, 22 bp, Homo sapiens
acttgcagatagtttacctttg

SEQ ID NO: 7364266 - DNA, 22 bp, Homo sapiens
acttgcagctaccatcattcca

SEQ ID NO: 7364267 - DNA, 22 bp, Homo sapiens
acttcatgtttctattagctca

SEQ ID NO: 7364268 - DNA, 22 bp, Homo sapiens
acttcagtgtggtataaaacgt

SEQ ID NO: 7364269 - DNA, 22 bp, Homo sapiens
acttcatagaatgagcttggaa

SEQ ID NO: 7364270 - DNA, 22 bp, Homo sapiens
acttggctcagataccatgccc

SEQ ID NO: 7364271 - DNA, 22 bp, Homo sapiens
acttggctattttcattcatca

SEQ ID NO: 7364272 - DNA, 21 bp, Homo sapiens
acttggccaggcccccacctg

SEQ ID NO: 7364273 - DNA, 22 bp, Homo sapiens
acttggccttatttccacagaa

SEQ ID NO: 7364274 - DNA, 20 bp, Homo sapiens
acttgcttttgtcaggaaaa

SEQ ID NO: 7364275 - DNA, 22 bp, Homo sapiens
acttgcatgttatttttatagg

SEQ ID NO: 7364276 - DNA, 22 bp, Homo sapiens
acttcacaaagagatcatctaa

SEQ ID NO: 7364277 - DNA, 22 bp, Homo sapiens
acttcaaattttcagaagaaat

SEQ ID NO: 7364278 - DNA, 22 bp, Homo sapiens
acttcaaattttcagaagaaat

SEQ ID NO: 7364279 - DNA, 22 bp, Homo sapiens
acttcacattagctaaaaggga

SEQ ID NO: 7364280 - DNA, 22 bp, Homo sapiens
acttcaaaaataagtgagaggt

SEQ ID NO: 7364281 - DNA, 22 bp, Homo sapiens
acttcaaaatgagtttcctggt

SEQ ID NO: 7364282 - DNA, 22 bp, Homo sapiens
acttcaaacaattaacagagaa

SEQ ID NO: 7364283 - DNA, 22 bp, Homo sapiens
acttcaaatctcttgaaagcaa

SEQ ID NO: 7364284 - DNA, 22 bp, Homo sapiens
acttcaaacaattaacagagaa

SEQ ID NO: 7364285 - DNA, 22 bp, Homo sapiens
acttcaaacaattaacagagaa

SEQ ID NO: 7364286 - DNA, 22 bp, Homo sapiens
acttcaaatgtgacaatgtgaa

SEQ ID NO: 7364287 - DNA, 22 bp, Homo sapiens
acttcaaattctgggggaagag

SEQ ID NO: 7364288 - DNA, 22 bp, Homo sapiens
acttcaaatgtgacaatgtgaa

SEQ ID NO: 7364289 - DNA, 19 bp, Homo sapiens
acttcaaatcttagagaaa

SEQ ID NO: 7364290 - DNA, 22 bp, Homo sapiens
acttcaaatctcttgaaagcaa

SEQ ID NO: 7364291 - DNA, 22 bp, Homo sapiens
actgttagatgctaagcaaatg

SEQ ID NO: 7364292 - DNA, 22 bp, Homo sapiens
actgttagccttccataacaca

SEQ ID NO: 7364293 - DNA, 19 bp, Homo sapiens
actgtgtggaagtgtgatt

SEQ ID NO: 7364294 - DNA, 22 bp, Homo sapiens
actgtgtggaaatttgtgaggg

SEQ ID NO: 7364295 - DNA, 22 bp, Homo sapiens
actgtgtgctggacatgatgtt

SEQ ID NO: 7364296 - DNA, 22 bp, Homo sapiens
actgtgtgccctgacgccaggg

SEQ ID NO: 7364297 - DNA, 22 bp, Homo sapiens
actgtgtgctggacatgatgtt

SEQ ID NO: 7364298 - DNA, 22 bp, Homo sapiens
actgtgtgaggctgggtgagtc

SEQ ID NO: 7364299 - DNA, 22 bp, Homo sapiens
agtttacactatgaaaagacta

SEQ ID NO: 7364300 - DNA, 22 bp, Homo sapiens
agtttactctggtgacaattta

SEQ ID NO: 7364301 - DNA, 22 bp, Homo sapiens
actgtaaattacataagaacag

SEQ ID NO: 7364302 - DNA, 22 bp, Homo sapiens
actgtctgctggcccctggtta

SEQ ID NO: 7364303 - DNA, 22 bp, Homo sapiens
actgtgaaagctaacatcttag

SEQ ID NO: 7364304 - DNA, 22 bp, Homo sapiens
actgtcttgttccaagactaaa

SEQ ID NO: 7364305 - DNA, 22 bp, Homo sapiens
actgtcttgtgttaaagaacca

SEQ ID NO: 7364306 - DNA, 22 bp, Homo sapiens
actgtgagcagcgacctgagga

SEQ ID NO: 7364307 - DNA, 22 bp, Homo sapiens
agtttccactggagacactgtg

SEQ ID NO: 7364308 - DNA, 22 bp, Homo sapiens
agtttccaaatattgttttagc

SEQ ID NO: 7364309 - DNA, 22 bp, Homo sapiens
actgtgtattcctatatagtaa

SEQ ID NO: 7364310 - DNA, 22 bp, Homo sapiens
agaaacaaggtgtaggttgacc

SEQ ID NO: 7364311 - DNA, 22 bp, Homo sapiens
agaaacaacttgtttctcttgc

SEQ ID NO: 7364312 - DNA, 22 bp, Homo sapiens
agaaaatttaaagagacacaca

SEQ ID NO: 7364313 - DNA, 22 bp, Homo sapiens
agaaaattagattttactgtgt

SEQ ID NO: 7364314 - DNA, 22 bp, Homo sapiens
agaaaattagattttactgtgt

SEQ ID NO: 7364315 - DNA, 22 bp, Homo sapiens
agaaaataaattgatggtggaa

SEQ ID NO: 7364316 - DNA, 22 bp, Homo sapiens
atatgaaagtaagcatgtgtgt

SEQ ID NO: 7364317 - DNA, 22 bp, Homo sapiens
atatcttttagagcaagcttgt

SEQ ID NO: 7364318 - DNA, 22 bp, Homo sapiens
atatctttgtttttgccaagat

SEQ ID NO: 7364319 - DNA, 22 bp, Homo sapiens
atatctttgtatggttcagcag

SEQ ID NO: 7364320 - DNA, 22 bp, Homo sapiens
atatctttcaaagccaaaagta

SEQ ID NO: 7364321 - DNA, 22 bp, Homo sapiens
atatgaaaagaagtcaccattg

SEQ ID NO: 7364322 - DNA, 22 bp, Homo sapiens
atatgaaaatgttttagctgta

SEQ ID NO: 7364323 - DNA, 22 bp, Homo sapiens
atatcctttactgtgtcacaga

SEQ ID NO: 7364324 - DNA, 22 bp, Homo sapiens
atatcctttactgtgtcacaga

SEQ ID NO: 7364325 - DNA, 22 bp, Homo sapiens
atatattttgaatagcctctgt

SEQ ID NO: 7364326 - DNA, 22 bp, Homo sapiens
atatattttgaatagcctctgt

SEQ ID NO: 7364327 - DNA, 22 bp, Homo sapiens
atatatttgagaatattcatga

SEQ ID NO: 7364328 - DNA, 22 bp, Homo sapiens
atatatttgagaatattcatga

SEQ ID NO: 7364329 - DNA, 22 bp, Homo sapiens
atatatttgagaatattcatga

SEQ ID NO: 7364330 - DNA, 22 bp, Homo sapiens
atatatttgagaatattcatga

SEQ ID NO: 7364331 - DNA, 22 bp, Homo sapiens
atatatttgagaatattcatga

SEQ ID NO: 7364332 - DNA, 22 bp, Homo sapiens
atatatttgagaatattcatga

SEQ ID NO: 7364333 - DNA, 22 bp, Homo sapiens
atatatttactctcctgttgca

SEQ ID NO: 7364334 - DNA, 22 bp, Homo sapiens
atatatttactctcctgttgca

SEQ ID NO: 7364335 - DNA, 22 bp, Homo sapiens
atatatttactctcctgttgca

SEQ ID NO: 7364336 - DNA, 22 bp, Homo sapiens
atatattgtatctttcatgggg

SEQ ID NO: 7364337 - DNA, 22 bp, Homo sapiens
actttgtataagacaataaaga

SEQ ID NO: 7364338 - DNA, 22 bp, Homo sapiens
atatacaaagggcaacctcgct

SEQ ID NO: 7364339 - DNA, 22 bp, Homo sapiens
atataattctcaggtttgacta

SEQ ID NO: 7364340 - DNA, 22 bp, Homo sapiens
atagtttaccttccagatggct

SEQ ID NO: 7364341 - DNA, 22 bp, Homo sapiens
atcagcaagattgtgtcttgta

SEQ ID NO: 7364342 - DNA, 23 bp, Homo sapiens
atcattctccaatctggagcagg

SEQ ID NO: 7364343 - DNA, 22 bp, Homo sapiens
atcattgaatataagtgctatt

SEQ ID NO: 7364344 - DNA, 22 bp, Homo sapiens
atcattctgatggtcaatgcta

SEQ ID NO: 7364345 - DNA, 22 bp, Homo sapiens
atcatttaaaacaagtctctat

SEQ ID NO: 7364346 - DNA, 22 bp, Homo sapiens
atcatttatgccccaattagat

SEQ ID NO: 7364347 - DNA, 22 bp, Homo sapiens
atcagaggtactttccattttt

SEQ ID NO: 7364348 - DNA, 22 bp, Homo sapiens
atcactgatacctttattttca

SEQ ID NO: 7364349 - DNA, 22 bp, Homo sapiens
atcacgtgctgagagtgttatt

SEQ ID NO: 7364350 - DNA, 22 bp, Homo sapiens
atcaccaggcaaaatgtcagag

SEQ ID NO: 7364351 - DNA, 22 bp, Homo sapiens
agaaacatcctgctttccattt

SEQ ID NO: 7364352 - DNA, 22 bp, Homo sapiens
agaaacagaagggaaagctttt

SEQ ID NO: 7364353 - DNA, 22 bp, Homo sapiens
agaaacatcattggaacacaag

SEQ ID NO: 7364354 - DNA, 22 bp, Homo sapiens
agaaacatattcagtgagtaat

SEQ ID NO: 7364355 - DNA, 22 bp, Homo sapiens
agctcaccacaacctccgcctc

SEQ ID NO: 7364356 - DNA, 22 bp, Homo sapiens
agctcaccacaacctccgcctc

SEQ ID NO: 7364357 - DNA, 22 bp, Homo sapiens
agctcagaaatgccagtaggta

SEQ ID NO: 7364358 - DNA, 22 bp, Homo sapiens
agctcagaagggaggaaatgag

SEQ ID NO: 7364359 - DNA, 22 bp, Homo sapiens
cagcaggataggtttctttgga

SEQ ID NO: 7364360 - DNA, 22 bp, Homo sapiens
cagcaggaggtgagtagcaggt

SEQ ID NO: 7364361 - DNA, 23 bp, Homo sapiens
cagcaggagggtgcctgggctgc

SEQ ID NO: 7364362 - DNA, 22 bp, Homo sapiens
agctcacacctcatcagggtgg

SEQ ID NO: 7364363 - DNA, 22 bp, Homo sapiens
agctcaatgcaacctccgcctc

SEQ ID NO: 7364364 - DNA, 23 bp, Homo sapiens
agccttggaggttgaggctgcag

SEQ ID NO: 7364365 - DNA, 22 bp, Homo sapiens
agccttgttgctaccagatgcc

SEQ ID NO: 7364366 - DNA, 22 bp, Homo sapiens
agcctttaacacttcacattga

SEQ ID NO: 7364367 - DNA, 22 bp, Homo sapiens
agcctttaacacttcacattga

SEQ ID NO: 7364368 - DNA, 22 bp, Homo sapiens
agcctttaactggataaagtgt

SEQ ID NO: 7364369 - DNA, 22 bp, Homo sapiens
agcctttaactggataaagtgt

SEQ ID NO: 7364370 - DNA, 22 bp, Homo sapiens
agcctttaagcagcgcagcatt

SEQ ID NO: 7364371 - DNA, 22 bp, Homo sapiens
agcctttaagcagcgcagcatt

SEQ ID NO: 7364372 - DNA, 22 bp, Homo sapiens
agccttgaatgcgctgcattgg

SEQ ID NO: 7364373 - DNA, 22 bp, Homo sapiens
agccttgatcttggtaacagga

SEQ ID NO: 7364374 - DNA, 22 bp, Homo sapiens
cagcaggaggcatggcttccct

SEQ ID NO: 7364375 - DNA, 22 bp, Homo sapiens
agcctttaagctgccacagctg

SEQ ID NO: 7364376 - DNA, 22 bp, Homo sapiens
agcctttaagctgccacagctg

SEQ ID NO: 7364377 - DNA, 22 bp, Homo sapiens
agcctttaaggaaaatgaataa

SEQ ID NO: 7364378 - DNA, 22 bp, Homo sapiens
agcctttaaggaaaatgaataa

SEQ ID NO: 7364379 - DNA, 22 bp, Homo sapiens
agcctttacaagcattagctca

SEQ ID NO: 7364380 - DNA, 22 bp, Homo sapiens
agcctttacaagcattagctca

SEQ ID NO: 7364381 - DNA, 22 bp, Homo sapiens
agcctttatactgtgtaaggca

SEQ ID NO: 7364382 - DNA, 22 bp, Homo sapiens
agcctttatactgtgtaaggca

SEQ ID NO: 7364383 - DNA, 22 bp, Homo sapiens
agctccctgagatgccacagca

SEQ ID NO: 7364384 - DNA, 22 bp, Homo sapiens
agctccccacgtctctgtcttt

SEQ ID NO: 7364385 - DNA, 22 bp, Homo sapiens
agcctccatctcccatctgtga

SEQ ID NO: 7364386 - DNA, 22 bp, Homo sapiens
cagcagagcttatgttgggtca

SEQ ID NO: 7364387 - DNA, 22 bp, Homo sapiens
cagcagagcttattaactaaaa

SEQ ID NO: 7364388 - DNA, 22 bp, Homo sapiens
cagcagagcttatgttgggtca

SEQ ID NO: 7364389 - DNA, 22 bp, Homo sapiens
cagcagaggcacgtctgtgaat

SEQ ID NO: 7364390 - DNA, 22 bp, Homo sapiens
cagcagaggcacgtctgtgaat

SEQ ID NO: 7364391 - DNA, 22 bp, Homo sapiens
cagcagaggaaagcaaatctaa

SEQ ID NO: 7364392 - DNA, 22 bp, Homo sapiens
cagcagaggtggttcacattgt

SEQ ID NO: 7364393 - DNA, 22 bp, Homo sapiens
cagcagaggttggaacagttct

SEQ ID NO: 7364394 - DNA, 22 bp, Homo sapiens
cagcagaggttggaacagttct

SEQ ID NO: 7364395 - DNA, 22 bp, Homo sapiens
cagcagaggtggttcacattgt

SEQ ID NO: 7364396 - DNA, 22 bp, Homo sapiens
cagcagaggtggttcacattgt

SEQ ID NO: 7364397 - DNA, 22 bp, Homo sapiens
cagcagagggagccattgaaat

SEQ ID NO: 7364398 - DNA, 22 bp, Homo sapiens
cagcagagggagccattgaaat

SEQ ID NO: 7364399 - DNA, 22 bp, Homo sapiens
cagcagcagccccaggaaggtt

SEQ ID NO: 7364400 - DNA, 22 bp, Homo sapiens
cagcagaggttttgctccatga

SEQ ID NO: 7364401 - DNA, 22 bp, Homo sapiens
cagcagcagtgttctagaatct

SEQ ID NO: 7364402 - DNA, 22 bp, Homo sapiens
cagaggcctttctacagtgata

SEQ ID NO: 7364403 - DNA, 22 bp, Homo sapiens
cagaggcgaggcagctgaacct

SEQ ID NO: 7364404 - DNA, 22 bp, Homo sapiens
agccctccatctgtgctcaggc

SEQ ID NO: 7364405 - DNA, 22 bp, Homo sapiens
cagaggctaagatgagtgggtg

SEQ ID NO: 7364406 - DNA, 22 bp, Homo sapiens
cagaggctaagggtagcttggg

SEQ ID NO: 7364407 - DNA, 22 bp, Homo sapiens
cagaggctcaccagcctttcac

SEQ ID NO: 7364408 - DNA, 22 bp, Homo sapiens
cagcacaggcccctctctccca

SEQ ID NO: 7364409 - DNA, 22 bp, Homo sapiens
cagcacagggcttgagaggtgt

SEQ ID NO: 7364410 - DNA, 22 bp, Homo sapiens
agcccggcttccccggttgcta

SEQ ID NO: 7364411 - DNA, 22 bp, Homo sapiens
agccctagagaaccagcctgtg

SEQ ID NO: 7364412 - DNA, 22 bp, Homo sapiens
agccctaaattatctttatttt

SEQ ID NO: 7364413 - DNA, 23 bp, Homo sapiens
cagagctggctcagagctgcctg

SEQ ID NO: 7364414 - DNA, 22 bp, Homo sapiens
agcccagcctgattctacaccc

SEQ ID NO: 7364415 - DNA, 22 bp, Homo sapiens
agcccaggaggtggaggttgca

SEQ ID NO: 7364416 - DNA, 22 bp, Homo sapiens
agccaggttaaaccacagtcaa

SEQ ID NO: 7364417 - DNA, 22 bp, Homo sapiens
agccaggtttctttagctgtca

SEQ ID NO: 7364418 - DNA, 22 bp, Homo sapiens
agccaggtactcttgtgaccat

SEQ ID NO: 7364419 - DNA, 22 bp, Homo sapiens
agccaggtcagctcaccctgct

SEQ ID NO: 7364420 - DNA, 22 bp, Homo sapiens
agccaggtcaggaaaggtccca

SEQ ID NO: 7364421 - DNA, 20 bp, Homo sapiens
agccagggttctggatgcac

SEQ ID NO: 7364422 - DNA, 22 bp, Homo sapiens
agccaggggattcatcagggac

SEQ ID NO: 7364423 - DNA, 22 bp, Homo sapiens
cagacagacctgcaagggcaca

SEQ ID NO: 7364424 - DNA, 22 bp, Homo sapiens
agccagtgatgaagactctgga

SEQ ID NO: 7364425 - DNA, 22 bp, Homo sapiens
cagaaatgacaaagtaagagga

SEQ ID NO: 7364426 - DNA, 22 bp, Homo sapiens
cagaaatgacaaagtaagagga

SEQ ID NO: 7364427 - DNA, 22 bp, Homo sapiens
agccacagcccacaggactctt

SEQ ID NO: 7364428 - DNA, 22 bp, Homo sapiens
agccacagcaacaagtgcaatt

SEQ ID NO: 7364429 - DNA, 19 bp, Homo sapiens
agccacagaacttgcagga

SEQ ID NO: 7364430 - DNA, 22 bp, Homo sapiens
agccacacctgtcctgccagct

SEQ ID NO: 7364431 - DNA, 22 bp, Homo sapiens
agccaaggacacggagcctcct

SEQ ID NO: 7364432 - DNA, 22 bp, Homo sapiens
cagacagaaggctccttgaggt

SEQ ID NO: 7364433 - DNA, 22 bp, Homo sapiens
agccaggatggtctcgatcggc

SEQ ID NO: 7364434 - DNA, 22 bp, Homo sapiens
agccaggacatctctagctgct

SEQ ID NO: 7364435 - DNA, 22 bp, Homo sapiens
agccaggatggtctcgatcggc

SEQ ID NO: 7364436 - DNA, 22 bp, Homo sapiens
agccaggatggtctcgatcggc

SEQ ID NO: 7364437 - DNA, 22 bp, Homo sapiens
agccaggacgttgctcagctcc

SEQ ID NO: 7364438 - DNA, 22 bp, Homo sapiens
agccaggacgttgctcagctcc

SEQ ID NO: 7364439 - DNA, 22 bp, Homo sapiens
agccaggacatctctagctgct

SEQ ID NO: 7364440 - DNA, 22 bp, Homo sapiens
cagaagcctgcctcagatgcac

SEQ ID NO: 7364441 - DNA, 22 bp, Homo sapiens
cagaacttgctggacagcagat

SEQ ID NO: 7364442 - DNA, 22 bp, Homo sapiens
cagaagaaagtggggagacaag

SEQ ID NO: 7364443 - DNA, 22 bp, Homo sapiens
cagaagaaatcattatctggac

SEQ ID NO: 7364444 - DNA, 23 bp, Homo sapiens
cagaagacagtctcaagacaagg

SEQ ID NO: 7364445 - DNA, 22 bp, Homo sapiens
cagaagagatgaaatagtatta

SEQ ID NO: 7364446 - DNA, 22 bp, Homo sapiens
agcagcttcaattttctaagtg

SEQ ID NO: 7364447 - DNA, 22 bp, Homo sapiens
cacaggagccctgaggcctccc

SEQ ID NO: 7364448 - DNA, 22 bp, Homo sapiens
agcagctgttagaaacaggaag

SEQ ID NO: 7364449 - DNA, 22 bp, Homo sapiens
agcagctgttagaaacaggaag

SEQ ID NO: 7364450 - DNA, 22 bp, Homo sapiens
agcagctgtttgttgaattggt

SEQ ID NO: 7364451 - DNA, 20 bp, Homo sapiens
agcagctgtgttttcatcct

SEQ ID NO: 7364452 - DNA, 23 bp, Homo sapiens
agcagctgtggtttaccttagta

SEQ ID NO: 7364453 - DNA, 22 bp, Homo sapiens
agcagctgtggggacaagggta

SEQ ID NO: 7364454 - DNA, 22 bp, Homo sapiens
caatgacatggataatcatatt

SEQ ID NO: 7364455 - DNA, 22 bp, Homo sapiens
agcagctgtactttcatctgtt

SEQ ID NO: 7364456 - DNA, 22 bp, Homo sapiens
agcagctgggctcagagctggg

SEQ ID NO: 7364457 - DNA, 18 bp, Homo sapiens
agcagctgtgccacactg

SEQ ID NO: 7364458 - DNA, 22 bp, Homo sapiens
agcagctgtggaaaagtaacta

SEQ ID NO: 7364459 - DNA, 22 bp, Homo sapiens
agcagctgtgggcaatatgtaa

SEQ ID NO: 7364460 - DNA, 23 bp, Homo sapiens
agcagctgtggagttttgcattt

SEQ ID NO: 7364461 - DNA, 18 bp, Homo sapiens
agcagctgtcagaatgcc

SEQ ID NO: 7364462 - DNA, 19 bp, Homo sapiens
agcagctgtagatagacac

SEQ ID NO: 7364463 - DNA, 22 bp, Homo sapiens
agcagctgtcccttaacatcag

SEQ ID NO: 7364464 - DNA, 22 bp, Homo sapiens
agcaggagagcagtgcgtggtc

SEQ ID NO: 7364465 - DNA, 22 bp, Homo sapiens
agcaggagagcagtgcgtggtc

SEQ ID NO: 7364466 - DNA, 22 bp, Homo sapiens
agcaggagatggggcgtgatgt

SEQ ID NO: 7364467 - DNA, 22 bp, Homo sapiens
cacagggcagtgctgcccactc

SEQ ID NO: 7364468 - DNA, 22 bp, Homo sapiens
cacagggcagtgattgtccaca

SEQ ID NO: 7364469 - DNA, 22 bp, Homo sapiens
agcagggcctgagtgacctaac

SEQ ID NO: 7364470 - DNA, 22 bp, Homo sapiens
agcagggctccatttcactgcc

SEQ ID NO: 7364471 - DNA, 22 bp, Homo sapiens
agcagggctcacattagtggat

SEQ ID NO: 7364472 - DNA, 22 bp, Homo sapiens
cacagtatttgtttttctgagt

SEQ ID NO: 7364473 - DNA, 22 bp, Homo sapiens
cacatcaagcatccatgagttt

SEQ ID NO: 7364474 - DNA, 22 bp, Homo sapiens
cacatctcagggctacaggcag

SEQ ID NO: 7364475 - DNA, 22 bp, Homo sapiens
cacatctagcttacaaaacagg

SEQ ID NO: 7364476 - DNA, 22 bp, Homo sapiens
cacatctgctctgggcagcact

SEQ ID NO: 7364477 - DNA, 22 bp, Homo sapiens
caccagggacaatgctaggggt

SEQ ID NO: 7364478 - DNA, 22 bp, Homo sapiens
agcagtggctgaagatgttcct

SEQ ID NO: 7364479 - DNA, 22 bp, Homo sapiens
agcagttatgttctataaagtc

SEQ ID NO: 7364480 - DNA, 22 bp, Homo sapiens
caccagggctctgagctctgaa

SEQ ID NO: 7364481 - DNA, 22 bp, Homo sapiens
cactctgggctcttgtttcaga

SEQ ID NO: 7364482 - DNA, 22 bp, Homo sapiens
cactctggttctgaacaggatc

SEQ ID NO: 7364483 - DNA, 22 bp, Homo sapiens
caaatgttaaatgtgttaagac

SEQ ID NO: 7364484 - DNA, 22 bp, Homo sapiens
agcacagcttagcacctggcac

SEQ ID NO: 7364485 - DNA, 22 bp, Homo sapiens
caaatgatccttgcaagctgtg

SEQ ID NO: 7364486 - DNA, 22 bp, Homo sapiens
caaatgttttttagtataagta

SEQ ID NO: 7364487 - DNA, 22 bp, Homo sapiens
agcagaagaggtcttgttgctg

SEQ ID NO: 7364488 - DNA, 22 bp, Homo sapiens
agcagaagaggtcttgttgctg

SEQ ID NO: 7364489 - DNA, 22 bp, Homo sapiens
agcagaagaggtcttgttgctg

SEQ ID NO: 7364490 - DNA, 22 bp, Homo sapiens
agcagaagtgccttagcaatca

SEQ ID NO: 7364491 - DNA, 22 bp, Homo sapiens
caaatgttaagacaggatcaag

SEQ ID NO: 7364492 - DNA, 22 bp, Homo sapiens
caaatgtttcttatctattgtt

SEQ ID NO: 7364493 - DNA, 22 bp, Homo sapiens
agcacagagaagatttcaatta

SEQ ID NO: 7364494 - DNA, 22 bp, Homo sapiens
attttctatgttgtaattgtta

SEQ ID NO: 7364495 - DNA, 22 bp, Homo sapiens
attttctattctgctggtttag

SEQ ID NO: 7364496 - DNA, 22 bp, Homo sapiens
attttctatgttgtaattgtta

SEQ ID NO: 7364497 - DNA, 22 bp, Homo sapiens
attttctctttgtatatgctag

SEQ ID NO: 7364498 - DNA, 22 bp, Homo sapiens
agcacaaaaacattcccagagt

SEQ ID NO: 7364499 - DNA, 21 bp, Homo sapiens
agcaatttttcctcctctgca

SEQ ID NO: 7364500 - DNA, 22 bp, Homo sapiens
agcagcagaaagttgatggcag

SEQ ID NO: 7364501 - DNA, 22 bp, Homo sapiens
agcagcagaagggagacccagg

SEQ ID NO: 7364502 - DNA, 22 bp, Homo sapiens
agcagagtgtgaaggcagggct

SEQ ID NO: 7364503 - DNA, 21 bp, Homo sapiens
agcagagtgctttgactttgt

SEQ ID NO: 7364504 - DNA, 22 bp, Homo sapiens
agcagacaccaggagtaaagaa

SEQ ID NO: 7364505 - DNA, 22 bp, Homo sapiens
agcagacaccaggagtaaagaa

SEQ ID NO: 7364506 - DNA, 22 bp, Homo sapiens
agcagaagtgccttagcaatca

SEQ ID NO: 7364507 - DNA, 22 bp, Homo sapiens
caatcttagtggcttacaaaga

SEQ ID NO: 7364508 - DNA, 22 bp, Homo sapiens
caatctgtacttgaaaaattat

SEQ ID NO: 7364509 - DNA, 22 bp, Homo sapiens
caatgaaattgagatccagaga

SEQ ID NO: 7364510 - DNA, 22 bp, Homo sapiens
caatgaaattgagatccagaga

SEQ ID NO: 7364511 - DNA, 22 bp, Homo sapiens
caaggcaggcagttcacttgag

SEQ ID NO: 7364512 - DNA, 22 bp, Homo sapiens
caaggcagtccctactccctgc

SEQ ID NO: 7364513 - DNA, 22 bp, Homo sapiens
atttagcaagagtacaaaataa

SEQ ID NO: 7364514 - DNA, 22 bp, Homo sapiens
atttagtagagaaattaagaaa

SEQ ID NO: 7364515 - DNA, 22 bp, Homo sapiens
atttagtaagtacttgttgaat

SEQ ID NO: 7364516 - DNA, 22 bp, Homo sapiens
atttaggaatgttctgcacaaa

SEQ ID NO: 7364517 - DNA, 22 bp, Homo sapiens
atttattgaacactgactatgt

SEQ ID NO: 7364518 - DNA, 22 bp, Homo sapiens
atttattctccagatggcgaga

SEQ ID NO: 7364519 - DNA, 22 bp, Homo sapiens
agaggtaattatagcctggccg

SEQ ID NO: 7364520 - DNA, 22 bp, Homo sapiens
agaggtagaaaataatggagag

SEQ ID NO: 7364521 - DNA, 22 bp, Homo sapiens
agaggtaagcagtggcaagtgc

SEQ ID NO: 7364522 - DNA, 22 bp, Homo sapiens
agaggtatatattctccatatt

SEQ ID NO: 7364523 - DNA, 22 bp, Homo sapiens
attcttcatacagacaagtcct

SEQ ID NO: 7364524 - DNA, 23 bp, Homo sapiens
attcttcattatcttctagaaaa

SEQ ID NO: 7364525 - DNA, 22 bp, Homo sapiens
attcttcatgttgaagctgtca

SEQ ID NO: 7364526 - DNA, 19 bp, Homo sapiens
attcttctcaaatatccat

SEQ ID NO: 7364527 - DNA, 22 bp, Homo sapiens
atttaaattttctgatggagag

SEQ ID NO: 7364528 - DNA, 18 bp, Homo sapiens
attgttaatagagtactt

SEQ ID NO: 7364529 - DNA, 22 bp, Homo sapiens
atttaacaagacagagaactgg

SEQ ID NO: 7364530 - DNA, 22 bp, Homo sapiens
atttaagaggctgctagagtat

SEQ ID NO: 7364531 - DNA, 22 bp, Homo sapiens
atttaagaggctgctagagtat

SEQ ID NO: 7364532 - DNA, 23 bp, Homo sapiens
atttaatgctgagttgaatgtta

SEQ ID NO: 7364533 - DNA, 22 bp, Homo sapiens
atttaatgggtagacattgtta

SEQ ID NO: 7364534 - DNA, 22 bp, Homo sapiens
atttaagattgcgtattcatgt

SEQ ID NO: 7364535 - DNA, 17 bp, Homo sapiens
agcaaaagtatcaaagc

SEQ ID NO: 7364536 - DNA, 22 bp, Homo sapiens
agcaaacagtgtgctaagaaat

SEQ ID NO: 7364537 - DNA, 22 bp, Homo sapiens
agcaaacagtgtgctaagaaat

SEQ ID NO: 7364538 - DNA, 22 bp, Homo sapiens
agcaaacattcagcagattggc

SEQ ID NO: 7364539 - DNA, 22 bp, Homo sapiens
agcaaaataaggtaatttattg

SEQ ID NO: 7364540 - DNA, 20 bp, Homo sapiens
agcaaacaggctccaccaga

SEQ ID NO: 7364541 - DNA, 22 bp, Homo sapiens
agatgtctgtaattctaagcat

SEQ ID NO: 7364542 - DNA, 22 bp, Homo sapiens
atttgcttatctccacagttgt

SEQ ID NO: 7364543 - DNA, 22 bp, Homo sapiens
atttgcttctagtcagttccat

SEQ ID NO: 7364544 - DNA, 22 bp, Homo sapiens
agatgtagtagtgggtctttta

SEQ ID NO: 7364545 - DNA, 22 bp, Homo sapiens
agatgggcgcgctgctctgatg

SEQ ID NO: 7364546 - DNA, 22 bp, Homo sapiens
agatggtaggtggcaggactga

SEQ ID NO: 7364547 - DNA, 21 bp, Homo sapiens
atttccaagggtacctaagat

SEQ ID NO: 7364548 - DNA, 22 bp, Homo sapiens
atttccaagaaagctttaggat

SEQ ID NO: 7364549 - DNA, 22 bp, Homo sapiens
atttccaaaaccacttattgcc

SEQ ID NO: 7364550 - DNA, 22 bp, Homo sapiens
atttccaatttcatccatgtcc

SEQ ID NO: 7364551 - DNA, 22 bp, Homo sapiens
atttccaaggtaattttgagta

SEQ ID NO: 7364552 - DNA, 22 bp, Homo sapiens
atttccagaatagaaggttctc

SEQ ID NO: 7364553 - DNA, 22 bp, Homo sapiens
atttcattgaagttaattcttc

SEQ ID NO: 7364554 - DNA, 22 bp, Homo sapiens
agatgaagatatctgcaggggc

SEQ ID NO: 7364555 - DNA, 22 bp, Homo sapiens
attaaacaatgtaaagttcttg

SEQ ID NO: 7364556 - DNA, 22 bp, Homo sapiens
attaaagctatccagtcatgaa

SEQ ID NO: 7364557 - DNA, 22 bp, Homo sapiens
attaaagtgaagttctcagatg

SEQ ID NO: 7364558 - DNA, 22 bp, Homo sapiens
attaaagtgaagttctcagatg

SEQ ID NO: 7364559 - DNA, 22 bp, Homo sapiens
attagcatattaaatagtcatt

SEQ ID NO: 7364560 - DNA, 22 bp, Homo sapiens
attagcaattgccctgtgcaat

SEQ ID NO: 7364561 - DNA, 22 bp, Homo sapiens
attagcaattgtttcattgatc

SEQ ID NO: 7364562 - DNA, 22 bp, Homo sapiens
attacagtaacagctacaatgc

SEQ ID NO: 7364563 - DNA, 22 bp, Homo sapiens
atgtcttctaagctctaagctg

SEQ ID NO: 7364564 - DNA, 22 bp, Homo sapiens
atgtgtgctacaggtgtgggaa

SEQ ID NO: 7364565 - DNA, 22 bp, Homo sapiens
atgtttgaggactcagaagacg

SEQ ID NO: 7364566 - DNA, 23 bp, Homo sapiens
atgtttgcagtaacccatcctgg

SEQ ID NO: 7364567 - DNA, 23 bp, Homo sapiens
atgttaagaaggtagttaggata

SEQ ID NO: 7364568 - DNA, 22 bp, Homo sapiens
atgttaaatggtttattattaa

SEQ ID NO: 7364569 - DNA, 22 bp, Homo sapiens
atgttaaatagccatttgtttg

SEQ ID NO: 7364570 - DNA, 22 bp, Homo sapiens
attcagcaaacatttattatct

SEQ ID NO: 7364571 - DNA, 22 bp, Homo sapiens
attcacacacatttagagcaga

SEQ ID NO: 7364572 - DNA, 22 bp, Homo sapiens
attcacactttacttctttcca

SEQ ID NO: 7364573 - DNA, 22 bp, Homo sapiens
attatagagggttacagttaat

SEQ ID NO: 7364574 - DNA, 22 bp, Homo sapiens
attatagagggttacagttaat

SEQ ID NO: 7364575 - DNA, 22 bp, Homo sapiens
attataaatattttctaggggt

SEQ ID NO: 7364576 - DNA, 22 bp, Homo sapiens
attataaagaacatgtgtgtgg

SEQ ID NO: 7364577 - DNA, 22 bp, Homo sapiens
agagggagcccagtcatagctg

SEQ ID NO: 7364578 - DNA, 22 bp, Homo sapiens
agagggagcccagtcatagctg

SEQ ID NO: 7364579 - DNA, 22 bp, Homo sapiens
agagggagcccagtcatagctg

SEQ ID NO: 7364580 - DNA, 22 bp, Homo sapiens
agagggagtgaaatggaataga

SEQ ID NO: 7364581 - DNA, 22 bp, Homo sapiens
agagggagtgaaatggaataga

SEQ ID NO: 7364582 - DNA, 22 bp, Homo sapiens
agagggagctttatttttctgt

SEQ ID NO: 7364583 - DNA, 22 bp, Homo sapiens
agagggagctttatttttctgt

SEQ ID NO: 7364584 - DNA, 22 bp, Homo sapiens
agagggagctttatttttctgt

SEQ ID NO: 7364585 - DNA, 22 bp, Homo sapiens
agagggcaagtgtagtccagta

SEQ ID NO: 7364586 - DNA, 22 bp, Homo sapiens
attcaggagtgtgccaggaagg

SEQ ID NO: 7364587 - DNA, 22 bp, Homo sapiens
attctctgtgcagatttaagac

SEQ ID NO: 7364588 - DNA, 23 bp, Homo sapiens
agagggagatgtttttctcaaga

SEQ ID NO: 7364589 - DNA, 23 bp, Homo sapiens
agagggagatgtttttctcaaga

SEQ ID NO: 7364590 - DNA, 21 bp, Homo sapiens
agagggagagtggcccttcca

SEQ ID NO: 7364591 - DNA, 22 bp, Homo sapiens
attctgtatttctaataagatc

SEQ ID NO: 7364592 - DNA, 22 bp, Homo sapiens
agaagatttaggttgacgctat

SEQ ID NO: 7364593 - DNA, 22 bp, Homo sapiens
atctttactttcagtgctgagc

SEQ ID NO: 7364594 - DNA, 22 bp, Homo sapiens
atctttaggaacctaacctatt

SEQ ID NO: 7364595 - DNA, 22 bp, Homo sapiens
agaagaatttctctcatgattt

SEQ ID NO: 7364596 - DNA, 22 bp, Homo sapiens
agaagacagagtctacattcta

SEQ ID NO: 7364597 - DNA, 22 bp, Homo sapiens
agaagagaaatagtgccactgt

SEQ ID NO: 7364598 - DNA, 22 bp, Homo sapiens
agaagaatacttgatgttcatg

SEQ ID NO: 7364599 - DNA, 20 bp, Homo sapiens
agaagaggatacaaccaggc

SEQ ID NO: 7364600 - DNA, 22 bp, Homo sapiens
agaagaggggtgtccctgtggc

SEQ ID NO: 7364601 - DNA, 20 bp, Homo sapiens
agaagaggatacaaccaggc

SEQ ID NO: 7364602 - DNA, 22 bp, Homo sapiens
agaagatgactttggagttgga

SEQ ID NO: 7364603 - DNA, 22 bp, Homo sapiens
agaagatgtcactgcagacagc

SEQ ID NO: 7364604 - DNA, 22 bp, Homo sapiens
agaagattattagagactttgt

SEQ ID NO: 7364605 - DNA, 22 bp, Homo sapiens
agaagattatgaattagagcag

SEQ ID NO: 7364606 - DNA, 22 bp, Homo sapiens
agaatacagttcagtaatggat

SEQ ID NO: 7364607 - DNA, 22 bp, Homo sapiens
agaatacatcaatctattttct

SEQ ID NO: 7364608 - DNA, 22 bp, Homo sapiens
agaatacatcaatctattttct

SEQ ID NO: 7364609 - DNA, 22 bp, Homo sapiens
agaatacatctagtgctgcatg

SEQ ID NO: 7364610 - DNA, 22 bp, Homo sapiens
agaataccataatatagaaaga

SEQ ID NO: 7364611 - DNA, 22 bp, Homo sapiens
agaatataaagataattctgtt

SEQ ID NO: 7364612 - DNA, 22 bp, Homo sapiens
atctttgtcactctactgtcta

SEQ ID NO: 7364613 - DNA, 22 bp, Homo sapiens
atctttggtgcttggtgctccc

SEQ ID NO: 7364614 - DNA, 22 bp, Homo sapiens
atctttggtgcatgatactttg

SEQ ID NO: 7364615 - DNA, 22 bp, Homo sapiens
atctttggtcttgagtgcatct

SEQ ID NO: 7364616 - DNA, 22 bp, Homo sapiens
atctttggtactattcttatca

SEQ ID NO: 7364617 - DNA, 22 bp, Homo sapiens
atctttgggtacaaacttgcct

SEQ ID NO: 7364618 - DNA, 22 bp, Homo sapiens
atctttggggcatccaggaaaa

SEQ ID NO: 7364619 - DNA, 19 bp, Homo sapiens
atctttgggtcctgaaggg

SEQ ID NO: 7364620 - DNA, 22 bp, Homo sapiens
agaagtttgttatgtaaacaaa

SEQ ID NO: 7364621 - DNA, 22 bp, Homo sapiens
agaagtttggtccttttcaagg

SEQ ID NO: 7364622 - DNA, 22 bp, Homo sapiens
atctttagtagaggaatatatt

SEQ ID NO: 7364623 - DNA, 22 bp, Homo sapiens
agaaggctaaagaaacagattg

SEQ ID NO: 7364624 - DNA, 22 bp, Homo sapiens
agaaggccctgtgtggtctgag

SEQ ID NO: 7364625 - DNA, 22 bp, Homo sapiens
agacaatacatttattcccttt

SEQ ID NO: 7364626 - DNA, 22 bp, Homo sapiens
agacaatatataattttagttg

SEQ ID NO: 7364627 - DNA, 22 bp, Homo sapiens
agaatgctccagagctgaaaga

SEQ ID NO: 7364628 - DNA, 22 bp, Homo sapiens
agaatctttcctcattgctgtc

SEQ ID NO: 7364629 - DNA, 17 bp, Homo sapiens
agaatgcaaagcaggct

SEQ ID NO: 7364630 - DNA, 22 bp, Homo sapiens
agaatgcaagataaactttatt

SEQ ID NO: 7364631 - DNA, 22 bp, Homo sapiens
agaatgcagtttgaaataaggt

SEQ ID NO: 7364632 - DNA, 22 bp, Homo sapiens
agacaggcagggcatggaaaaa

SEQ ID NO: 7364633 - DNA, 22 bp, Homo sapiens
atgcaggctcatgaatctgttt

SEQ ID NO: 7364634 - DNA, 22 bp, Homo sapiens
atgcaggattagaaagttgcct

SEQ ID NO: 7364635 - DNA, 22 bp, Homo sapiens
atgcaggatgtcaacgcatcct

SEQ ID NO: 7364636 - DNA, 22 bp, Homo sapiens
atgcaggagttggaaaaaatga

SEQ ID NO: 7364637 - DNA, 22 bp, Homo sapiens
atgcaggatgcagaggggcccg

SEQ ID NO: 7364638 - DNA, 22 bp, Homo sapiens
atgtctgtttatccttcaagat

SEQ ID NO: 7364639 - DNA, 22 bp, Homo sapiens
atgtctgtcccctagccctgat

SEQ ID NO: 7364640 - DNA, 22 bp, Homo sapiens
atgtacatactgcattttcaaa

SEQ ID NO: 7364641 - DNA, 22 bp, Homo sapiens
atgtaaactcacattttcttca

SEQ ID NO: 7364642 - DNA, 18 bp, Homo sapiens
atggctcaggaatggctt

SEQ ID NO: 7364643 - DNA, 22 bp, Homo sapiens
atggcagccagtgttggaggaa

SEQ ID NO: 7364644 - DNA, 22 bp, Homo sapiens
atggcagcatgggattggtaga

SEQ ID NO: 7364645 - DNA, 22 bp, Homo sapiens
atggcagcagggcttgattatg

SEQ ID NO: 7364646 - DNA, 22 bp, Homo sapiens
atggcagcagtccattgcctca

SEQ ID NO: 7364647 - DNA, 22 bp, Homo sapiens
atggataagtcaaagagtatcc

SEQ ID NO: 7364648 - DNA, 22 bp, Homo sapiens
atggcagatggctggagcaggt

SEQ ID NO: 7364649 - DNA, 22 bp, Homo sapiens
atggcagcaaagaggccttctt

SEQ ID NO: 7364650 - DNA, 22 bp, Homo sapiens
atggagtgctgttgatcaaggt

SEQ ID NO: 7364651 - DNA, 22 bp, Homo sapiens
atggagttctgccagcgctgct

SEQ ID NO: 7364652 - DNA, 22 bp, Homo sapiens
atggaaatacagccagagcaga

SEQ ID NO: 7364653 - DNA, 19 bp, Homo sapiens
atggaaaattgtactcaat

SEQ ID NO: 7364654 - DNA, 19 bp, Homo sapiens
atggaaaatgccagactga

SEQ ID NO: 7364655 - DNA, 22 bp, Homo sapiens
atggaaaagggtctttcatttc

SEQ ID NO: 7364656 - DNA, 22 bp, Homo sapiens
atgcttgctaatagtgggaacc

SEQ ID NO: 7364657 - DNA, 22 bp, Homo sapiens
agacggattacctgaggtcagg

SEQ ID NO: 7364658 - DNA, 22 bp, Homo sapiens
agacggcacctgggcagcttac

SEQ ID NO: 7364659 - DNA, 22 bp, Homo sapiens
agactctgaagtcattgcatga

SEQ ID NO: 7364660 - DNA, 22 bp, Homo sapiens
agactcctgctacataccttcc

SEQ ID NO: 7364661 - DNA, 23 bp, Homo sapiens
agactctgagagtgtgctttgca

SEQ ID NO: 7364662 - DNA, 22 bp, Homo sapiens
agactagagagatataatatgg

SEQ ID NO: 7364663 - DNA, 22 bp, Homo sapiens
cagcttctggcgtggagcctga

SEQ ID NO: 7364664 - DNA, 22 bp, Homo sapiens
cagcttctgtcctagaaactgg

SEQ ID NO: 7364665 - DNA, 22 bp, Homo sapiens
cagcttctgtttctagcccctg

SEQ ID NO: 7364666 - DNA, 21 bp, Homo sapiens
cagcttcttctgtgacctggt

SEQ ID NO: 7364667 - DNA, 21 bp, Homo sapiens
cagcttcttctgtgacctggt

SEQ ID NO: 7364668 - DNA, 21 bp, Homo sapiens
cagcttcttctgtgacctggt

SEQ ID NO: 7364669 - DNA, 22 bp, Homo sapiens
cagctcctgttggtcttgagga

SEQ ID NO: 7364670 - DNA, 22 bp, Homo sapiens
cagctctgaagaaaggtgtcta

SEQ ID NO: 7364671 - DNA, 22 bp, Homo sapiens
agctctgcaggcacagctgagg

SEQ ID NO: 7364672 - DNA, 22 bp, Homo sapiens
agctctgcagcccagcaggtgg

SEQ ID NO: 7364673 - DNA, 22 bp, Homo sapiens
cagctcctgcctgggcagctgt

SEQ ID NO: 7364674 - DNA, 22 bp, Homo sapiens
agctctctcatgacagtgcagt

SEQ ID NO: 7364675 - DNA, 22 bp, Homo sapiens
cagctttgattctttctgccat

SEQ ID NO: 7364676 - DNA, 22 bp, Homo sapiens
cagctttgattctttctgccat

SEQ ID NO: 7364677 - DNA, 22 bp, Homo sapiens
cagctttgccctttgcccaatc

SEQ ID NO: 7364678 - DNA, 22 bp, Homo sapiens
cagctttgcaggctggtcagtg

SEQ ID NO: 7364679 - DNA, 22 bp, Homo sapiens
cagctttgccaagtaaggtctt

SEQ ID NO: 7364680 - DNA, 22 bp, Homo sapiens
cagctttggcccagtcgggagg

SEQ ID NO: 7364681 - DNA, 22 bp, Homo sapiens
cagctttggagtgtgagtgctg

SEQ ID NO: 7364682 - DNA, 16 bp, Homo sapiens
cagctttgtctcctcg

SEQ ID NO: 7364683 - DNA, 22 bp, Homo sapiens
cagctttgtcctgcaaacctga

SEQ ID NO: 7364684 - DNA, 22 bp, Homo sapiens
cagctttgtcatttgatttggg

SEQ ID NO: 7364685 - DNA, 22 bp, Homo sapiens
caggaaaaatgccaggagtcag

SEQ ID NO: 7364686 - DNA, 22 bp, Homo sapiens
cagctttgtggccttgacctcg

SEQ ID NO: 7364687 - DNA, 22 bp, Homo sapiens
cagctttgtgcaatgcagtctc

SEQ ID NO: 7364688 - DNA, 22 bp, Homo sapiens
cagctttgtgacttcggacaag

SEQ ID NO: 7364689 - DNA, 21 bp, Homo sapiens
cagctttgtctgtcttcgggg

SEQ ID NO: 7364690 - DNA, 22 bp, Homo sapiens
cagctttgtctgattcctcttt

SEQ ID NO: 7364691 - DNA, 22 bp, Homo sapiens
cagcttgcacacatattagacg

SEQ ID NO: 7364692 - DNA, 22 bp, Homo sapiens
cagcttgcactatattaaggag

SEQ ID NO: 7364693 - DNA, 22 bp, Homo sapiens
agctgaggcatgatgctatcag

SEQ ID NO: 7364694 - DNA, 22 bp, Homo sapiens
agctgaggcatggacaggctgc

SEQ ID NO: 7364695 - DNA, 21 bp, Homo sapiens
agctgcagccatgtacatggc

SEQ ID NO: 7364696 - DNA, 22 bp, Homo sapiens
agctgctgaatgacactgcaag

SEQ ID NO: 7364697 - DNA, 22 bp, Homo sapiens
agctgctcttgggtgacttcaa

SEQ ID NO: 7364698 - DNA, 22 bp, Homo sapiens
agctgctcgaagccggtggccc

SEQ ID NO: 7364699 - DNA, 22 bp, Homo sapiens
agctgctctacatgatggggaa

SEQ ID NO: 7364700 - DNA, 22 bp, Homo sapiens
caggaaaaatgccaggagtcag

SEQ ID NO: 7364701 - DNA, 22 bp, Homo sapiens
agctgcctggagtcatttcctg

SEQ ID NO: 7364702 - DNA, 21 bp, Homo sapiens
caggaaaagcggaagtctagc

SEQ ID NO: 7364703 - DNA, 21 bp, Homo sapiens
caggaaaagcggaagtctagc

SEQ ID NO: 7364704 - DNA, 22 bp, Homo sapiens
caggaaaaggagactttagcac

SEQ ID NO: 7364705 - DNA, 22 bp, Homo sapiens
agctgcctggccggagccactg

SEQ ID NO: 7364706 - DNA, 21 bp, Homo sapiens
agctgctccagggagctcagg

SEQ ID NO: 7364707 - DNA, 22 bp, Homo sapiens
agctgctccctatcctttcctt

SEQ ID NO: 7364708 - DNA, 22 bp, Homo sapiens
agctggctttgagctgggaggt

SEQ ID NO: 7364709 - DNA, 22 bp, Homo sapiens
agctggctttgagctgggaggt

SEQ ID NO: 7364710 - DNA, 22 bp, Homo sapiens
agctggcttctctgcagacatt

SEQ ID NO: 7364711 - DNA, 22 bp, Homo sapiens
agctggctggccccttcctgcc

SEQ ID NO: 7364712 - DNA, 20 bp, Homo sapiens
agctggccaattctattact

SEQ ID NO: 7364713 - DNA, 22 bp, Homo sapiens
agctggcatctgaagtcagggc

SEQ ID NO: 7364714 - DNA, 22 bp, Homo sapiens
caggaggtgaaggagaaccagt

SEQ ID NO: 7364715 - DNA, 22 bp, Homo sapiens
caggaggttgtaagagcaggcc

SEQ ID NO: 7364716 - DNA, 22 bp, Homo sapiens
caggaggttggtagcagtagat

SEQ ID NO: 7364717 - DNA, 22 bp, Homo sapiens
caggcctcaggggctcaggctg

SEQ ID NO: 7364718 - DNA, 22 bp, Homo sapiens
caggcctcatggtgtgtccttc

SEQ ID NO: 7364719 - DNA, 22 bp, Homo sapiens
caggcctcaggggctcaggctg

SEQ ID NO: 7364720 - DNA, 22 bp, Homo sapiens
agctgtgtgcatttgggtctca

SEQ ID NO: 7364721 - DNA, 22 bp, Homo sapiens
caggcctggctgcagctcgcct

SEQ ID NO: 7364722 - DNA, 22 bp, Homo sapiens
caggcctcccggtgcacactga

SEQ ID NO: 7364723 - DNA, 22 bp, Homo sapiens
caggcctcccggtgcacactga

SEQ ID NO: 7364724 - DNA, 22 bp, Homo sapiens
caggcctggcccccggcacacc

SEQ ID NO: 7364725 - DNA, 22 bp, Homo sapiens
caggcctggcccccggcacacc

SEQ ID NO: 7364726 - DNA, 22 bp, Homo sapiens
agctgtgtgcccatggtggagg

SEQ ID NO: 7364727 - DNA, 22 bp, Homo sapiens
agctgtgtgtttccactgagct

SEQ ID NO: 7364728 - DNA, 22 bp, Homo sapiens
agctgttttcttctaggaagac

SEQ ID NO: 7364729 - DNA, 22 bp, Homo sapiens
agctgtttgtacttagatagta

SEQ ID NO: 7364730 - DNA, 22 bp, Homo sapiens
agctgttgttaattaactcatt

SEQ ID NO: 7364731 - DNA, 22 bp, Homo sapiens
agcttgctgtattttctggagg

SEQ ID NO: 7364732 - DNA, 22 bp, Homo sapiens
agcttgcacagagaatacagta

SEQ ID NO: 7364733 - DNA, 22 bp, Homo sapiens
agcttgccagtcatatctgttt

SEQ ID NO: 7364734 - DNA, 22 bp, Homo sapiens
agcttgtagaaggccacgagca

SEQ ID NO: 7364735 - DNA, 22 bp, Homo sapiens
agcttcttttaccaggaagttg

SEQ ID NO: 7364736 - DNA, 22 bp, Homo sapiens
aggaacctgagtctgatcattt

SEQ ID NO: 7364737 - DNA, 22 bp, Homo sapiens
aggaactgatttataactttag

SEQ ID NO: 7364738 - DNA, 22 bp, Homo sapiens
aggaagctcaaagccatgatgt

SEQ ID NO: 7364739 - DNA, 18 bp, Homo sapiens
aggaagcaggaggaaggc

SEQ ID NO: 7364740 - DNA, 22 bp, Homo sapiens
aggaaattttgaatcagtgtct

SEQ ID NO: 7364741 - DNA, 22 bp, Homo sapiens
aggaaattgagaatcagaataa

SEQ ID NO: 7364742 - DNA, 22 bp, Homo sapiens
aggaaatgtacaaatgaagatg

SEQ ID NO: 7364743 - DNA, 22 bp, Homo sapiens
aggaacaactgattcagtcaac

SEQ ID NO: 7364744 - DNA, 22 bp, Homo sapiens
aggaacaattgataaactcaca

SEQ ID NO: 7364745 - DNA, 22 bp, Homo sapiens
aggaaataggaccagacaaagc

SEQ ID NO: 7364746 - DNA, 22 bp, Homo sapiens
aggaaagatggaaggaggataa

SEQ ID NO: 7364747 - DNA, 22 bp, Homo sapiens
cagggccagagagggctggctg

SEQ ID NO: 7364748 - DNA, 22 bp, Homo sapiens
cagggccagagagggctggctg

SEQ ID NO: 7364749 - DNA, 22 bp, Homo sapiens
cagggccactgtagatgaggag

SEQ ID NO: 7364750 - DNA, 22 bp, Homo sapiens
agcttgttataaatgcagaatg

SEQ ID NO: 7364751 - DNA, 22 bp, Homo sapiens
agcttgttggggaaggagaaag

SEQ ID NO: 7364752 - DNA, 22 bp, Homo sapiens
agctttaaatcaatccagtgag

SEQ ID NO: 7364753 - DNA, 22 bp, Homo sapiens
agctttagaattgttcagcaag

SEQ ID NO: 7364754 - DNA, 22 bp, Homo sapiens
agctttatataaaagagtacat

SEQ ID NO: 7364755 - DNA, 22 bp, Homo sapiens
agctttatagaaaggatcagtg

SEQ ID NO: 7364756 - DNA, 22 bp, Homo sapiens
aggaaagaagtacattctcatg

SEQ ID NO: 7364757 - DNA, 18 bp, Homo sapiens
aggaaagacgaagagggc

SEQ ID NO: 7364758 - DNA, 18 bp, Homo sapiens
aggcagcagcatcttctc

SEQ ID NO: 7364759 - DNA, 22 bp, Homo sapiens
aggcagcagaggttgaggaaag

SEQ ID NO: 7364760 - DNA, 22 bp, Homo sapiens
aggcagccagatggcagcctgc

SEQ ID NO: 7364761 - DNA, 19 bp, Homo sapiens
aggcagcattctggggctt

SEQ ID NO: 7364762 - DNA, 22 bp, Homo sapiens
aggcagcagtcatgaggaaaga

SEQ ID NO: 7364763 - DNA, 22 bp, Homo sapiens
cattatgatggtaattttctct

SEQ ID NO: 7364764 - DNA, 22 bp, Homo sapiens
cattatgtgagtgattaattca

SEQ ID NO: 7364765 - DNA, 22 bp, Homo sapiens
catggccagggcagatggcagg

SEQ ID NO: 7364766 - DNA, 22 bp, Homo sapiens
catggccccaaatcccatgcat

SEQ ID NO: 7364767 - DNA, 21 bp, Homo sapiens
cattcctcggctcatagagga

SEQ ID NO: 7364768 - DNA, 18 bp, Homo sapiens
cattccccatctctgagc

SEQ ID NO: 7364769 - DNA, 22 bp, Homo sapiens
cattcccatgactcctgctcag

SEQ ID NO: 7364770 - DNA, 19 bp, Homo sapiens
aggcagcacccagtccttg

SEQ ID NO: 7364771 - DNA, 16 bp, Homo sapiens
aggcagatattgagtg

SEQ ID NO: 7364772 - DNA, 22 bp, Homo sapiens
cattccaagtatatacatgata

SEQ ID NO: 7364773 - DNA, 22 bp, Homo sapiens
cattcccacgtgttctttgctt

SEQ ID NO: 7364774 - DNA, 22 bp, Homo sapiens
cattcaaaagctccatgtttgt

SEQ ID NO: 7364775 - DNA, 20 bp, Homo sapiens
cattattgtaatcagctgta

SEQ ID NO: 7364776 - DNA, 22 bp, Homo sapiens
cattcaaagcaggaaaggcctt

SEQ ID NO: 7364777 - DNA, 22 bp, Homo sapiens
cattcaaaggcatgtcctattt

SEQ ID NO: 7364778 - DNA, 22 bp, Homo sapiens
aggcaattgtttgtgtaatagg

SEQ ID NO: 7364779 - DNA, 22 bp, Homo sapiens
aggcacagcctcccttcacatg

SEQ ID NO: 7364780 - DNA, 22 bp, Homo sapiens
aggcacaggaacaggaaaagag

SEQ ID NO: 7364781 - DNA, 22 bp, Homo sapiens
aggcacaggaatgtcatccagt

SEQ ID NO: 7364782 - DNA, 22 bp, Homo sapiens
aggcacaggaggtggtaagaag

SEQ ID NO: 7364783 - DNA, 22 bp, Homo sapiens
catgcctgtaatcccagctctt

SEQ ID NO: 7364784 - DNA, 22 bp, Homo sapiens
catgccctccttgccttcactg

SEQ ID NO: 7364785 - DNA, 20 bp, Homo sapiens
catgccatgtctactgaggc

SEQ ID NO: 7364786 - DNA, 22 bp, Homo sapiens
catgaaatctgagtatgtttcc

SEQ ID NO: 7364787 - DNA, 22 bp, Homo sapiens
aggaggcactcactctcagggt

SEQ ID NO: 7364788 - DNA, 23 bp, Homo sapiens
aggagaagagatttccacatgca

SEQ ID NO: 7364789 - DNA, 20 bp, Homo sapiens
aggagaaattcgggacacct

SEQ ID NO: 7364790 - DNA, 22 bp, Homo sapiens
cagtctcttttcagctccatcc

SEQ ID NO: 7364791 - DNA, 22 bp, Homo sapiens
aggacagcagtgctggcacttg

SEQ ID NO: 7364792 - DNA, 18 bp, Homo sapiens
aggagaaagggaccaggg

SEQ ID NO: 7364793 - DNA, 21 bp, Homo sapiens
aggacaggaactggctgaata

SEQ ID NO: 7364794 - DNA, 21 bp, Homo sapiens
aggacagcaggagcatttatt

SEQ ID NO: 7364795 - DNA, 21 bp, Homo sapiens
aggacagcaggagcatttatt

SEQ ID NO: 7364796 - DNA, 20 bp, Homo sapiens
aggacagcagctgccacttg

SEQ ID NO: 7364797 - DNA, 22 bp, Homo sapiens
aggacagcagccattggcagtc

SEQ ID NO: 7364798 - DNA, 22 bp, Homo sapiens
cagtcctgggcacagccctggg

SEQ ID NO: 7364799 - DNA, 22 bp, Homo sapiens
aggacagcaaccgttattcaca

SEQ ID NO: 7364800 - DNA, 22 bp, Homo sapiens
aggacagcaaccgttattcaca

SEQ ID NO: 7364801 - DNA, 22 bp, Homo sapiens
cagtcctgcccaggctgacaga

SEQ ID NO: 7364802 - DNA, 22 bp, Homo sapiens
aggaagctggtgtgaggatgaa

SEQ ID NO: 7364803 - DNA, 22 bp, Homo sapiens
aggaagctgcctgggatgggaa

SEQ ID NO: 7364804 - DNA, 22 bp, Homo sapiens
aggaagctctctgcttttaaga

SEQ ID NO: 7364805 - DNA, 19 bp, Homo sapiens
aggaaggaacctgagtctg

SEQ ID NO: 7364806 - DNA, 22 bp, Homo sapiens
aggaagcttgtgtgtattggtc

SEQ ID NO: 7364807 - DNA, 20 bp, Homo sapiens
aggaaggaagtttgcatgga

SEQ ID NO: 7364808 - DNA, 22 bp, Homo sapiens
aggaaggactgcagcatttggt

SEQ ID NO: 7364809 - DNA, 20 bp, Homo sapiens
aggagctgaattagagggtt

SEQ ID NO: 7364810 - DNA, 22 bp, Homo sapiens
aggagctgataaaagggggtca

SEQ ID NO: 7364811 - DNA, 22 bp, Homo sapiens
aggaggcaaaggtctctgataa

SEQ ID NO: 7364812 - DNA, 22 bp, Homo sapiens
aggaggaggtaagaaaagcata

SEQ ID NO: 7364813 - DNA, 22 bp, Homo sapiens
aggaggaggtgggacacagtga

SEQ ID NO: 7364814 - DNA, 22 bp, Homo sapiens
aggaggactctctgagccagcc

SEQ ID NO: 7364815 - DNA, 22 bp, Homo sapiens
aggaggaggctggagtacaccc

SEQ ID NO: 7364816 - DNA, 22 bp, Homo sapiens
aggaggaggctggagtacaccc

SEQ ID NO: 7364817 - DNA, 21 bp, Homo sapiens
aggaggagagcttggcctacc

SEQ ID NO: 7364818 - DNA, 22 bp, Homo sapiens
aggagagggtggcattaagttt

SEQ ID NO: 7364819 - DNA, 22 bp, Homo sapiens
aggagagaggttttaaatgggg

SEQ ID NO: 7364820 - DNA, 22 bp, Homo sapiens
aggagagaattactgggtgtca

SEQ ID NO: 7364821 - DNA, 22 bp, Homo sapiens
aggagagaatgttccaggcttg

SEQ ID NO: 7364822 - DNA, 22 bp, Homo sapiens
aggagagaatgttccaggcttg

SEQ ID NO: 7364823 - DNA, 22 bp, Homo sapiens
aggagagaatgttccaggcttg

SEQ ID NO: 7364824 - DNA, 22 bp, Homo sapiens
aggagaggctctaactctgtgt

SEQ ID NO: 7364825 - DNA, 22 bp, Homo sapiens
aggagaggggtaggattaattt

SEQ ID NO: 7364826 - DNA, 22 bp, Homo sapiens
aggagaggaatcattattacaa

SEQ ID NO: 7364827 - DNA, 22 bp, Homo sapiens
aggagagcaggccagccgtccc

SEQ ID NO: 7364828 - DNA, 22 bp, Homo sapiens
aggagaggcatcaagaaaatcg

SEQ ID NO: 7364829 - DNA, 22 bp, Homo sapiens
aggagaggcatcaagaaaatcg

SEQ ID NO: 7364830 - DNA, 22 bp, Homo sapiens
aggcccagctgggccaggaaca

SEQ ID NO: 7364831 - DNA, 22 bp, Homo sapiens
aggcccagtgccattagttttg

SEQ ID NO: 7364832 - DNA, 20 bp, Homo sapiens
aggcccagtgaatatattgc

SEQ ID NO: 7364833 - DNA, 22 bp, Homo sapiens
aggcccagtcctctgccgtctg

SEQ ID NO: 7364834 - DNA, 22 bp, Homo sapiens
aggcccagtagtgctgccttta

SEQ ID NO: 7364835 - DNA, 22 bp, Homo sapiens
aggccaggaccattagcccaga

SEQ ID NO: 7364836 - DNA, 22 bp, Homo sapiens
aggcccatagtagctctgggca

SEQ ID NO: 7364837 - DNA, 22 bp, Homo sapiens
aggcccagttatcctacttgtt

SEQ ID NO: 7364838 - DNA, 22 bp, Homo sapiens
aggcccatgtgagtcttgtcct

SEQ ID NO: 7364839 - DNA, 22 bp, Homo sapiens
aggcccagttatcctacttgtt

SEQ ID NO: 7364840 - DNA, 22 bp, Homo sapiens
aggcccagtgtggcttcctgga

SEQ ID NO: 7364841 - DNA, 22 bp, Homo sapiens
aggcccagtgtggcttcctgga

SEQ ID NO: 7364842 - DNA, 22 bp, Homo sapiens
aggcccatgttcacttgctcag

SEQ ID NO: 7364843 - DNA, 22 bp, Homo sapiens
aggcccgaggttcgtgtgcacc

SEQ ID NO: 7364844 - DNA, 22 bp, Homo sapiens
aggccctggtcaggtctggctg

SEQ ID NO: 7364845 - DNA, 22 bp, Homo sapiens
aggccctgaagtcggcccctca

SEQ ID NO: 7364846 - DNA, 22 bp, Homo sapiens
aggccctaatccaacatgactg

SEQ ID NO: 7364847 - DNA, 22 bp, Homo sapiens
aggccctattcaatggggccca

SEQ ID NO: 7364848 - DNA, 22 bp, Homo sapiens
aggccctgaagtcggcccctca

SEQ ID NO: 7364849 - DNA, 22 bp, Homo sapiens
aggccacaagaaaatgcttcat

SEQ ID NO: 7364850 - DNA, 22 bp, Homo sapiens
aggccagctctacccttggact

SEQ ID NO: 7364851 - DNA, 22 bp, Homo sapiens
aggccagcttccagaggggcag

SEQ ID NO: 7364852 - DNA, 22 bp, Homo sapiens
aggccacaaccaccctgtgccc

SEQ ID NO: 7364853 - DNA, 22 bp, Homo sapiens
aggccaagttacttgggaaagc

SEQ ID NO: 7364854 - DNA, 22 bp, Homo sapiens
aggccaagtgctgggacaggtg

SEQ ID NO: 7364855 - DNA, 22 bp, Homo sapiens
aggccaagtgctgggacaggtg

SEQ ID NO: 7364856 - DNA, 22 bp, Homo sapiens
aggccaaagcacagagctggaa

SEQ ID NO: 7364857 - DNA, 22 bp, Homo sapiens
aggccaagctcccagagaagct

SEQ ID NO: 7364858 - DNA, 22 bp, Homo sapiens
aggcattttgttcaagatgaca

SEQ ID NO: 7364859 - DNA, 22 bp, Homo sapiens
aggccaaaccggatggaaaagg

SEQ ID NO: 7364860 - DNA, 20 bp, Homo sapiens
aggccaaacccagcgcgccc

SEQ ID NO: 7364861 - DNA, 20 bp, Homo sapiens
aggccaaacccagcgcgccc

SEQ ID NO: 7364862 - DNA, 22 bp, Homo sapiens
ccactgctgttacttacgcaaa

SEQ ID NO: 7364863 - DNA, 23 bp, Homo sapiens
ccactgctttcattttgtcatgg

SEQ ID NO: 7364864 - DNA, 19 bp, Homo sapiens
ccactggggctccacatta

SEQ ID NO: 7364865 - DNA, 22 bp, Homo sapiens
aggcattacatctaaatattta

SEQ ID NO: 7364866 - DNA, 22 bp, Homo sapiens
aggcatctgctgcccttctgga

SEQ ID NO: 7364867 - DNA, 22 bp, Homo sapiens
aggcatctgagatttttatact

SEQ ID NO: 7364868 - DNA, 22 bp, Homo sapiens
aggcatctatacattatgttca

SEQ ID NO: 7364869 - DNA, 22 bp, Homo sapiens
aggcatctctctgcttctgagc

SEQ ID NO: 7364870 - DNA, 17 bp, Homo sapiens
aggcatgaggcatcact

SEQ ID NO: 7364871 - DNA, 22 bp, Homo sapiens
aggcatgactttggctgaagaa

SEQ ID NO: 7364872 - DNA, 22 bp, Homo sapiens
aggcagttgtagagagggctct

SEQ ID NO: 7364873 - DNA, 22 bp, Homo sapiens
aggcatatactctcagaaaaaa

SEQ ID NO: 7364874 - DNA, 21 bp, Homo sapiens
aggcagttgagcatgttatga

SEQ ID NO: 7364875 - DNA, 22 bp, Homo sapiens
aggcagttgagtggctttttca

SEQ ID NO: 7364876 - DNA, 22 bp, Homo sapiens
aggcagtggcttttgttgtgtt

SEQ ID NO: 7364877 - DNA, 22 bp, Homo sapiens
aggcagcccacaggacacagga

SEQ ID NO: 7364878 - DNA, 22 bp, Homo sapiens
aggcagccctgtgctggatgct

SEQ ID NO: 7364879 - DNA, 22 bp, Homo sapiens
aggcagccatctgcaggaagga

SEQ ID NO: 7364880 - DNA, 22 bp, Homo sapiens
aggcagccatccaggaggctca

SEQ ID NO: 7364881 - DNA, 22 bp, Homo sapiens
aggcagcctggtttgaatggaa

SEQ ID NO: 7364882 - DNA, 22 bp, Homo sapiens
aggcagcctttagacagtctgc

SEQ ID NO: 7364883 - DNA, 22 bp, Homo sapiens
aggcagcctttttggaaacata

SEQ ID NO: 7364884 - DNA, 22 bp, Homo sapiens
aggcaggttggtgagaagactg

SEQ ID NO: 7364885 - DNA, 18 bp, Homo sapiens
aggcaggtgctaatattt

SEQ ID NO: 7364886 - DNA, 22 bp, Homo sapiens
aggcaggtttactcttatttgg

SEQ ID NO: 7364887 - DNA, 22 bp, Homo sapiens
aggcaggttggtgagaagactg

SEQ ID NO: 7364888 - DNA, 23 bp, Homo sapiens
aggcaggtttgggctcttcttgt

SEQ ID NO: 7364889 - DNA, 22 bp, Homo sapiens
aggcagtctatctctggagcct

SEQ ID NO: 7364890 - DNA, 23 bp, Homo sapiens
aggcaggtttgggctcttcttgt

SEQ ID NO: 7364891 - DNA, 22 bp, Homo sapiens
aggcagtgcagagtcctcttct

SEQ ID NO: 7364892 - DNA, 22 bp, Homo sapiens
aggcagtggctgagaccagggg

SEQ ID NO: 7364893 - DNA, 22 bp, Homo sapiens
aggcagtggagctggaataggc

SEQ ID NO: 7364894 - DNA, 22 bp, Homo sapiens
aggcagtggagctggaataggc

SEQ ID NO: 7364895 - DNA, 22 bp, Homo sapiens
aggcagtggaaggagaaagcaa

SEQ ID NO: 7364896 - DNA, 22 bp, Homo sapiens
aggctctgttattctagagggc

SEQ ID NO: 7364897 - DNA, 22 bp, Homo sapiens
aggctgagagcaacgtgtcaga

SEQ ID NO: 7364898 - DNA, 22 bp, Homo sapiens
aggctgagataggtggatcatt

SEQ ID NO: 7364899 - DNA, 22 bp, Homo sapiens
aggctctgcatccaggctttat

SEQ ID NO: 7364900 - DNA, 20 bp, Homo sapiens
aggctctgcatttctgagtg

SEQ ID NO: 7364901 - DNA, 22 bp, Homo sapiens
aggctctgagtctggtgtctgc

SEQ ID NO: 7364902 - DNA, 22 bp, Homo sapiens
aggctctgagtagagctgccag

SEQ ID NO: 7364903 - DNA, 22 bp, Homo sapiens
aggctctgaggcagattttcgt

SEQ ID NO: 7364904 - DNA, 19 bp, Homo sapiens
aggctctgagctcctggag

SEQ ID NO: 7364905 - DNA, 22 bp, Homo sapiens
ccagtgtgcattatcatgtgtc

SEQ ID NO: 7364906 - DNA, 22 bp, Homo sapiens
ccagtttcttaagtaggaagaa

SEQ ID NO: 7364907 - DNA, 23 bp, Homo sapiens
ccagtttatctttagtgtagatc

SEQ ID NO: 7364908 - DNA, 22 bp, Homo sapiens
aggctgaggcaggtggatcatt

SEQ ID NO: 7364909 - DNA, 22 bp, Homo sapiens
aggctgaggcaggtggatcact

SEQ ID NO: 7364910 - DNA, 22 bp, Homo sapiens
ccaggcacttcatcattagggt

SEQ ID NO: 7364911 - DNA, 23 bp, Homo sapiens
ccaggcagtagctattgaagtga

SEQ ID NO: 7364912 - DNA, 22 bp, Homo sapiens
ccaggcagtcagggttgtgtgt

SEQ ID NO: 7364913 - DNA, 22 bp, Homo sapiens
aggcctcctggctccaggcctt

SEQ ID NO: 7364914 - DNA, 21 bp, Homo sapiens
ccaggcatgactgcagagagc

SEQ ID NO: 7364915 - DNA, 22 bp, Homo sapiens
ccaggcatccattgcttcctct

SEQ ID NO: 7364916 - DNA, 22 bp, Homo sapiens
ccaggccaaattcagtcagcag

SEQ ID NO: 7364917 - DNA, 22 bp, Homo sapiens
aggcctcatagtagacctgccc

SEQ ID NO: 7364918 - DNA, 22 bp, Homo sapiens
aggcctcatgtcaaagcagcaa

SEQ ID NO: 7364919 - DNA, 22 bp, Homo sapiens
aggcctcattgcccacctgtgg

SEQ ID NO: 7364920 - DNA, 22 bp, Homo sapiens
aggcctccagccacatgccagt

SEQ ID NO: 7364921 - DNA, 21 bp, Homo sapiens
aggcctccctgttgacagggc

SEQ ID NO: 7364922 - DNA, 17 bp, Homo sapiens
aggcctccctccaggcc

SEQ ID NO: 7364923 - DNA, 22 bp, Homo sapiens
aggcctcagtttccccagttgt

SEQ ID NO: 7364924 - DNA, 22 bp, Homo sapiens
aggcctcagctcagtgtgacag

SEQ ID NO: 7364925 - DNA, 22 bp, Homo sapiens
aggcctcagctcagtgtgacag

SEQ ID NO: 7364926 - DNA, 22 bp, Homo sapiens
aggcctcacacaacagatgcat

SEQ ID NO: 7364927 - DNA, 22 bp, Homo sapiens
ccaggcccttgcaagtcccacc

SEQ ID NO: 7364928 - DNA, 22 bp, Homo sapiens
ccaggcccgttcccttctccag

SEQ ID NO: 7364929 - DNA, 22 bp, Homo sapiens
ccaggcccgttcccttctccag

SEQ ID NO: 7364930 - DNA, 22 bp, Homo sapiens
ccaggccctgctcctcacacca

SEQ ID NO: 7364931 - DNA, 22 bp, Homo sapiens
ccaggccctgcctgtggttcct

SEQ ID NO: 7364932 - DNA, 22 bp, Homo sapiens
ccaggcctcacctgcccaccta

SEQ ID NO: 7364933 - DNA, 22 bp, Homo sapiens
ccaggctctgagaggaatgtga

SEQ ID NO: 7364934 - DNA, 21 bp, Homo sapiens
cctccaggagcagagccctga

SEQ ID NO: 7364935 - DNA, 22 bp, Homo sapiens
cctccaggataagtcagggcct

SEQ ID NO: 7364936 - DNA, 22 bp, Homo sapiens
cctcgctgtgtgaccttgggtg

SEQ ID NO: 7364937 - DNA, 22 bp, Homo sapiens
cctcgacctccccaggctcagg

SEQ ID NO: 7364938 - DNA, 22 bp, Homo sapiens
cctccccacagcccaggagact

SEQ ID NO: 7364939 - DNA, 22 bp, Homo sapiens
cctcagacacagtcaagctttt

SEQ ID NO: 7364940 - DNA, 21 bp, Homo sapiens
cctcaagtgcctcctgctgct

SEQ ID NO: 7364941 - DNA, 22 bp, Homo sapiens
cctcaaattgtcaaataagaat

SEQ ID NO: 7364942 - DNA, 22 bp, Homo sapiens
cctcaagatgcactgaacatat

SEQ ID NO: 7364943 - DNA, 22 bp, Homo sapiens
cccttacatcagctccttcacc

SEQ ID NO: 7364944 - DNA, 17 bp, Homo sapiens
ccctgggtgagttctca

SEQ ID NO: 7364945 - DNA, 22 bp, Homo sapiens
cctagaatgtacttaatagatg

SEQ ID NO: 7364946 - DNA, 19 bp, Homo sapiens
agggccaggattctggaac

SEQ ID NO: 7364947 - DNA, 22 bp, Homo sapiens
agggccaggatcacagccaaga

SEQ ID NO: 7364948 - DNA, 22 bp, Homo sapiens
agggccaggaacacctgaaggg

SEQ ID NO: 7364949 - DNA, 22 bp, Homo sapiens
agggccagctgatgagaatgag

SEQ ID NO: 7364950 - DNA, 22 bp, Homo sapiens
agggccagccgacttccagcct

SEQ ID NO: 7364951 - DNA, 22 bp, Homo sapiens
agggccagggaaacgatcagca

SEQ ID NO: 7364952 - DNA, 22 bp, Homo sapiens
agggccagggaagctgtatttt

SEQ ID NO: 7364953 - DNA, 22 bp, Homo sapiens
agggcagctaaggtgctgactg

SEQ ID NO: 7364954 - DNA, 22 bp, Homo sapiens
agggcagcggtgcttgtgttat

SEQ ID NO: 7364955 - DNA, 22 bp, Homo sapiens
agggcagcggtgcttgtgttat

SEQ ID NO: 7364956 - DNA, 22 bp, Homo sapiens
agggcagcctgagtgctggccc

SEQ ID NO: 7364957 - DNA, 22 bp, Homo sapiens
agggcagcctctcagcctaggt

SEQ ID NO: 7364958 - DNA, 22 bp, Homo sapiens
agggcagcctctcagcctaggt

SEQ ID NO: 7364959 - DNA, 22 bp, Homo sapiens
agggcagctctcacctctggcc

SEQ ID NO: 7364960 - DNA, 22 bp, Homo sapiens
agggcagctggaaggtggcttc

SEQ ID NO: 7364961 - DNA, 22 bp, Homo sapiens
agggcagctgtgagccactgtg

SEQ ID NO: 7364962 - DNA, 22 bp, Homo sapiens
agggccagccgacttccagcct

SEQ ID NO: 7364963 - DNA, 22 bp, Homo sapiens
agggccagccccaccctctctg

SEQ ID NO: 7364964 - DNA, 22 bp, Homo sapiens
agggcagcagctgtccctgaga

SEQ ID NO: 7364965 - DNA, 22 bp, Homo sapiens
agggcagcattgcctttctcca

SEQ ID NO: 7364966 - DNA, 22 bp, Homo sapiens
agggcagcattgcctttctcca

SEQ ID NO: 7364967 - DNA, 22 bp, Homo sapiens
agggcagcagctcctcctagct

SEQ ID NO: 7364968 - DNA, 22 bp, Homo sapiens
agggcagccatgagccttcagg

SEQ ID NO: 7364969 - DNA, 22 bp, Homo sapiens
agggcagcccttctgggagggc

SEQ ID NO: 7364970 - DNA, 22 bp, Homo sapiens
agggaggagtcctcaaagtcat

SEQ ID NO: 7364971 - DNA, 22 bp, Homo sapiens
agggaggagtcctcaaagtcat

SEQ ID NO: 7364972 - DNA, 22 bp, Homo sapiens
agggaggagaatggactccttc

SEQ ID NO: 7364973 - DNA, 18 bp, Homo sapiens
cccagcctctcctttcta

SEQ ID NO: 7364974 - DNA, 22 bp, Homo sapiens
cccagcctgatctcggccagct

SEQ ID NO: 7364975 - DNA, 22 bp, Homo sapiens
cccagctctgccatctacccac

SEQ ID NO: 7364976 - DNA, 22 bp, Homo sapiens
cccagctctcgcacttactagc

SEQ ID NO: 7364977 - DNA, 22 bp, Homo sapiens
cccagctctctgctcttagcct

SEQ ID NO: 7364978 - DNA, 22 bp, Homo sapiens
ccatctccaaataccatcacat

SEQ ID NO: 7364979 - DNA, 20 bp, Homo sapiens
ccagtttctttcccagcctc

SEQ ID NO: 7364980 - DNA, 21 bp, Homo sapiens
ccataaacagatggtaactgt

SEQ ID NO: 7364981 - DNA, 22 bp, Homo sapiens
ccatgacattttaattttcact

SEQ ID NO: 7364982 - DNA, 22 bp, Homo sapiens
agggagcatgggtgaagcaggc

SEQ ID NO: 7364983 - DNA, 22 bp, Homo sapiens
agggagcatgggtgaagcaggc

SEQ ID NO: 7364984 - DNA, 21 bp, Homo sapiens
agggagcatgttagctttcga

SEQ ID NO: 7364985 - DNA, 22 bp, Homo sapiens
agggagcattgtgacatatcac

SEQ ID NO: 7364986 - DNA, 22 bp, Homo sapiens
agggagccagagttgggagctc

SEQ ID NO: 7364987 - DNA, 22 bp, Homo sapiens
agggagccagagttgggagctc

SEQ ID NO: 7364988 - DNA, 22 bp, Homo sapiens
agggagccagagttgggagctc

SEQ ID NO: 7364989 - DNA, 22 bp, Homo sapiens
agggagccctgaaccagagggt

SEQ ID NO: 7364990 - DNA, 22 bp, Homo sapiens
agggagccaggggccagctatt

SEQ ID NO: 7364991 - DNA, 22 bp, Homo sapiens
agggagccaggaacgcaggtcg

SEQ ID NO: 7364992 - DNA, 22 bp, Homo sapiens
agggagcaaaggtttcagggtt

SEQ ID NO: 7364993 - DNA, 22 bp, Homo sapiens
agggagcacagtaagttagtct

SEQ ID NO: 7364994 - DNA, 22 bp, Homo sapiens
agggagcaaaggtttcagggtt

SEQ ID NO: 7364995 - DNA, 22 bp, Homo sapiens
agggagagtttgatgtttcctc

SEQ ID NO: 7364996 - DNA, 22 bp, Homo sapiens
agggagcagcagccacaggatg

SEQ ID NO: 7364997 - DNA, 22 bp, Homo sapiens
agggagcagcagccacaggatg

SEQ ID NO: 7364998 - DNA, 22 bp, Homo sapiens
agggagcagcagccacaggatg

SEQ ID NO: 7364999 - DNA, 18 bp, Homo sapiens
agggagcatctggttgcc

SEQ ID NO: 7365000 - DNA, 18 bp, Homo sapiens
agggagcatctggttgcc

SEQ ID NO: 7365001 - DNA, 22 bp, Homo sapiens
agggagcagggctcctttgggt

SEQ ID NO: 7365002 - DNA, 18 bp, Homo sapiens
agggagcatctggttgcc

SEQ ID NO: 7365003 - DNA, 22 bp, Homo sapiens
agggagcagggctcctttgggt

SEQ ID NO: 7365004 - DNA, 22 bp, Homo sapiens
agggagcagggctcctttgggt

SEQ ID NO: 7365005 - DNA, 22 bp, Homo sapiens
ccccagggactggtttcatgga

SEQ ID NO: 7365006 - DNA, 19 bp, Homo sapiens
ccccagggtaggctagggg

SEQ ID NO: 7365007 - DNA, 22 bp, Homo sapiens
ccccagggactggtttcatgga

SEQ ID NO: 7365008 - DNA, 22 bp, Homo sapiens
ccccagggaagctttgcttact

SEQ ID NO: 7365009 - DNA, 22 bp, Homo sapiens
ccccagggtcagtgtgtggagg

SEQ ID NO: 7365010 - DNA, 22 bp, Homo sapiens
ccccagggtcagtgtgtggagg

SEQ ID NO: 7365011 - DNA, 22 bp, Homo sapiens
ccccagggtcagtgtgtggagg

SEQ ID NO: 7365012 - DNA, 22 bp, Homo sapiens
ccccagggtcagtgtgtggagg

SEQ ID NO: 7365013 - DNA, 19 bp, Homo sapiens
ccccagggtaggctagggg

SEQ ID NO: 7365014 - DNA, 22 bp, Homo sapiens
ccccattctggccagcccagct

SEQ ID NO: 7365015 - DNA, 22 bp, Homo sapiens
ccccatggcaactgctgggggt

SEQ ID NO: 7365016 - DNA, 22 bp, Homo sapiens
agggaggaaggaactccttcta

SEQ ID NO: 7365017 - DNA, 21 bp, Homo sapiens
ccccatggagtacagttgggc

SEQ ID NO: 7365018 - DNA, 22 bp, Homo sapiens
aggcttatagcttatatttaag

SEQ ID NO: 7365019 - DNA, 22 bp, Homo sapiens
agggaaggaaaagctgtcgctt

SEQ ID NO: 7365020 - DNA, 22 bp, Homo sapiens
agggaaggaggttagaacccac

SEQ ID NO: 7365021 - DNA, 22 bp, Homo sapiens
agggaaggaggccatgtgtccc

SEQ ID NO: 7365022 - DNA, 19 bp, Homo sapiens
agggaaggattctgtcatt

SEQ ID NO: 7365023 - DNA, 22 bp, Homo sapiens
agggaaggcttttgacatttcc

SEQ ID NO: 7365024 - DNA, 23 bp, Homo sapiens
agggaagggggcttattccacag

SEQ ID NO: 7365025 - DNA, 22 bp, Homo sapiens
agggaagggaaaaacactcgtc

SEQ ID NO: 7365026 - DNA, 22 bp, Homo sapiens
agggaagggcagggtctatgca

SEQ ID NO: 7365027 - DNA, 22 bp, Homo sapiens
agggaaggtagaggtcaccggc

SEQ ID NO: 7365028 - DNA, 22 bp, Homo sapiens
agggagaggttgaaacctcagt

SEQ ID NO: 7365029 - DNA, 22 bp, Homo sapiens
agggagagtagatatcaggtgt

SEQ ID NO: 7365030 - DNA, 22 bp, Homo sapiens
agggtgaatctcacaactctta

SEQ ID NO: 7365031 - DNA, 20 bp, Homo sapiens
agggtgagacatgagcctcc

SEQ ID NO: 7365032 - DNA, 22 bp, Homo sapiens
cctgccctatgaccagcttcac

SEQ ID NO: 7365033 - DNA, 22 bp, Homo sapiens
cctgccctagagatgacacaat

SEQ ID NO: 7365034 - DNA, 22 bp, Homo sapiens
cctctgccacctcccacgaggc

SEQ ID NO: 7365035 - DNA, 22 bp, Homo sapiens
cctgccaggagctggtgctgca

SEQ ID NO: 7365036 - DNA, 22 bp, Homo sapiens
cctgccaggacattgcttgaag

SEQ ID NO: 7365037 - DNA, 22 bp, Homo sapiens
cctctgcaaagaatttgtctcc

SEQ ID NO: 7365038 - DNA, 22 bp, Homo sapiens
cctctgcatctggctgctgcag

SEQ ID NO: 7365039 - DNA, 22 bp, Homo sapiens
cctctgcatgtgcagtaccgag

SEQ ID NO: 7365040 - DNA, 22 bp, Homo sapiens
cctctgcagcagagagccagag

SEQ ID NO: 7365041 - DNA, 22 bp, Homo sapiens
cctctgcaccatagccttcagc

SEQ ID NO: 7365042 - DNA, 22 bp, Homo sapiens
cctctctccttcctttgccaaa

SEQ ID NO: 7365043 - DNA, 22 bp, Homo sapiens
cctggaaagaggaaggaagcct

SEQ ID NO: 7365044 - DNA, 22 bp, Homo sapiens
cctgctgctatgaaggtgacag

SEQ ID NO: 7365045 - DNA, 22 bp, Homo sapiens
cctgctgaggtcagccacccaa

SEQ ID NO: 7365046 - DNA, 22 bp, Homo sapiens
cctgctgaggtcagccacccaa

SEQ ID NO: 7365047 - DNA, 19 bp, Homo sapiens
cctgctgaagtgatgcagc

SEQ ID NO: 7365048 - DNA, 22 bp, Homo sapiens
cctggcagcgccgaagctggcc

SEQ ID NO: 7365049 - DNA, 22 bp, Homo sapiens
cctggcagcgtgccgagctgcg

SEQ ID NO: 7365050 - DNA, 22 bp, Homo sapiens
cctggaatttctattggttcac

SEQ ID NO: 7365051 - DNA, 22 bp, Homo sapiens
cctggccacccagccttggcca

SEQ ID NO: 7365052 - DNA, 19 bp, Homo sapiens
cctggccagacttctgccc

SEQ ID NO: 7365053 - DNA, 22 bp, Homo sapiens
cctggccacagggctctgcatt

SEQ ID NO: 7365054 - DNA, 22 bp, Homo sapiens
cctggccacccagccttggcca

SEQ ID NO: 7365055 - DNA, 22 bp, Homo sapiens
cctggcagctgtttggcttggc

SEQ ID NO: 7365056 - DNA, 22 bp, Homo sapiens
cctggccagaggcgtgcctgtg

SEQ ID NO: 7365057 - DNA, 22 bp, Homo sapiens
cctggctgctttcactatggag

SEQ ID NO: 7365058 - DNA, 20 bp, Homo sapiens
cctggctggtggaggaaagg

SEQ ID NO: 7365059 - DNA, 22 bp, Homo sapiens
cctggctggtggcagcgacaag

SEQ ID NO: 7365060 - DNA, 22 bp, Homo sapiens
cctgggaaggtcttagcatcta

SEQ ID NO: 7365061 - DNA, 22 bp, Homo sapiens
cctgggaaggtgaggccctgga

SEQ ID NO: 7365062 - DNA, 22 bp, Homo sapiens
ccttgctcaagctagtgacggg

SEQ ID NO: 7365063 - DNA, 22 bp, Homo sapiens
ccttggccctagcctcaggcaa

SEQ ID NO: 7365064 - DNA, 22 bp, Homo sapiens
cctgggagaactgctgggttgg

SEQ ID NO: 7365065 - DNA, 19 bp, Homo sapiens
cctgggacttaggctgggt

SEQ ID NO: 7365066 - DNA, 22 bp, Homo sapiens
cctgggaagttgtggctgcagt

SEQ ID NO: 7365067 - DNA, 22 bp, Homo sapiens
cctgggacctcgcgggaagcgg

SEQ ID NO: 7365068 - DNA, 22 bp, Homo sapiens
aggtgccttccgcggagctcgc

SEQ ID NO: 7365069 - DNA, 22 bp, Homo sapiens
aggtgccttccgcggagctcgc

SEQ ID NO: 7365070 - DNA, 22 bp, Homo sapiens
aggtgccagctctcaggcagga

SEQ ID NO: 7365071 - DNA, 17 bp, Homo sapiens
aggtgccagtgatatac

SEQ ID NO: 7365072 - DNA, 22 bp, Homo sapiens
ccttttaagggagactagagat

SEQ ID NO: 7365073 - DNA, 22 bp, Homo sapiens
cctttgttcactggagagtgga

SEQ ID NO: 7365074 - DNA, 22 bp, Homo sapiens
cctttattcaattagtcctaat

SEQ ID NO: 7365075 - DNA, 22 bp, Homo sapiens
aggtggggctgggaaagattcc

SEQ ID NO: 7365076 - DNA, 22 bp, Homo sapiens
cgaggcaggcaggcggaggata

SEQ ID NO: 7365077 - DNA, 22 bp, Homo sapiens
cgaggcagaggctgaaacggct

SEQ ID NO: 7365078 - DNA, 22 bp, Homo sapiens
cgaggcaatagagcccagaggt

SEQ ID NO: 7365079 - DNA, 22 bp, Homo sapiens
cgaggcagacaaaagttggaag

SEQ ID NO: 7365080 - DNA, 18 bp, Homo sapiens
cgaggcaggcggatcacg

SEQ ID NO: 7365081 - DNA, 22 bp, Homo sapiens
cgaggcagggaagctgcaaaag

SEQ ID NO: 7365082 - DNA, 22 bp, Homo sapiens
cgaggcagggaagctgcaaaag

SEQ ID NO: 7365083 - DNA, 22 bp, Homo sapiens
cggagcagaaggcgccgccggc

SEQ ID NO: 7365084 - DNA, 22 bp, Homo sapiens
cggagcctgcttgttgcagctg

SEQ ID NO: 7365085 - DNA, 22 bp, Homo sapiens
cggagcagagccactcgggccg

SEQ ID NO: 7365086 - DNA, 23 bp, Homo sapiens
cggaggcaaatcggccatttaag

SEQ ID NO: 7365087 - DNA, 22 bp, Homo sapiens
agtatatttgttaagattattc

SEQ ID NO: 7365088 - DNA, 22 bp, Homo sapiens
agtatatttgttaagattattc

SEQ ID NO: 7365089 - DNA, 22 bp, Homo sapiens
agtatattggtgttattcctca

SEQ ID NO: 7365090 - DNA, 22 bp, Homo sapiens
agtatattttgattgtatgtgt

SEQ ID NO: 7365091 - DNA, 22 bp, Homo sapiens
agtatattgctcttaatcatag

SEQ ID NO: 7365092 - DNA, 22 bp, Homo sapiens
agtatattgctcttaatcatag

SEQ ID NO: 7365093 - DNA, 20 bp, Homo sapiens
agtaggtgtccttcaggata

SEQ ID NO: 7365094 - DNA, 22 bp, Homo sapiens
cggccctgaccagaccttagtt

SEQ ID NO: 7365095 - DNA, 22 bp, Homo sapiens
cggccctgctgagcttgtctgg

SEQ ID NO: 7365096 - DNA, 22 bp, Homo sapiens
cggccctggcggaggcgggaga

SEQ ID NO: 7365097 - DNA, 22 bp, Homo sapiens
ctcaggccaataagctccagcc

SEQ ID NO: 7365098 - DNA, 22 bp, Homo sapiens
ctcagggaggcctctgctggtt

SEQ ID NO: 7365099 - DNA, 22 bp, Homo sapiens
ctcagcctgtgaagagcagagg

SEQ ID NO: 7365100 - DNA, 22 bp, Homo sapiens
agtctcagagtacctgagggac

SEQ ID NO: 7365101 - DNA, 21 bp, Homo sapiens
agtgacagaggaaggtgcata

SEQ ID NO: 7365102 - DNA, 22 bp, Homo sapiens
agtgacagctgggaaggtgaaa

SEQ ID NO: 7365103 - DNA, 22 bp, Homo sapiens
agtgacagggaaggataggatt

SEQ ID NO: 7365104 - DNA, 22 bp, Homo sapiens
agtgacaggggaggcaggtgtg

SEQ ID NO: 7365105 - DNA, 22 bp, Homo sapiens
ctccagaagacccatcctcatg

SEQ ID NO: 7365106 - DNA, 22 bp, Homo sapiens
ctcagtggttgagagcctgggc

SEQ ID NO: 7365107 - DNA, 22 bp, Homo sapiens
ctcagtgtcacgttttgcctta

SEQ ID NO: 7365108 - DNA, 22 bp, Homo sapiens
ctcagtgtcttatttgagttct

SEQ ID NO: 7365109 - DNA, 22 bp, Homo sapiens
ctcagtgtcttattgtacacat

SEQ ID NO: 7365110 - DNA, 20 bp, Homo sapiens
ctcagtgtggcctgagtgtt

SEQ ID NO: 7365111 - DNA, 22 bp, Homo sapiens
ctcagtgttaaagactttccag

SEQ ID NO: 7365112 - DNA, 22 bp, Homo sapiens
agtgaatttaaaacactgagga

SEQ ID NO: 7365113 - DNA, 22 bp, Homo sapiens
ctcaaagacaaaaatctgaggt

SEQ ID NO: 7365114 - DNA, 22 bp, Homo sapiens
ctcaaatagaactgatctataa

SEQ ID NO: 7365115 - DNA, 22 bp, Homo sapiens
ctcaaatacctctccatgtgac

SEQ ID NO: 7365116 - DNA, 22 bp, Homo sapiens
ctcaaagataatcctatgtctc

SEQ ID NO: 7365117 - DNA, 22 bp, Homo sapiens
ctcaaatatgtggtcagaaagc

SEQ ID NO: 7365118 - DNA, 21 bp, Homo sapiens
ctcaaatgccagttttattta

SEQ ID NO: 7365119 - DNA, 21 bp, Homo sapiens
ctcaaatgccagttttattta

SEQ ID NO: 7365120 - DNA, 22 bp, Homo sapiens
ctcaaatatgtggtcagaaagc

SEQ ID NO: 7365121 - DNA, 22 bp, Homo sapiens
agtatcatctccatttcactga

SEQ ID NO: 7365122 - DNA, 21 bp, Homo sapiens
agtatcataatgaatagttct

SEQ ID NO: 7365123 - DNA, 22 bp, Homo sapiens
agtatcattttggcattagtat

SEQ ID NO: 7365124 - DNA, 22 bp, Homo sapiens
cgggttcacgccattctcctgc

SEQ ID NO: 7365125 - DNA, 22 bp, Homo sapiens
ctcaccatggatcttccatttc

SEQ ID NO: 7365126 - DNA, 22 bp, Homo sapiens
ctcagactaaaatgggaatgta

SEQ ID NO: 7365127 - DNA, 22 bp, Homo sapiens
ctcagcaaccctagaacatttg

SEQ ID NO: 7365128 - DNA, 19 bp, Homo sapiens
ctcagcaagatagaaatgg

SEQ ID NO: 7365129 - DNA, 22 bp, Homo sapiens
ctcagcaacacggcctattaag

SEQ ID NO: 7365130 - DNA, 22 bp, Homo sapiens
ctcagatgtagaaagattgtga

SEQ ID NO: 7365131 - DNA, 22 bp, Homo sapiens
ctcagatgtttgatattgttat

SEQ ID NO: 7365132 - DNA, 22 bp, Homo sapiens
ctctctcagtgtaatacaggat

SEQ ID NO: 7365133 - DNA, 22 bp, Homo sapiens
ctctccccacaccctctgcatg

SEQ ID NO: 7365134 - DNA, 22 bp, Homo sapiens
ctctccccacaccctctgcatg

SEQ ID NO: 7365135 - DNA, 22 bp, Homo sapiens
ctctcccagtcaggctcaggat

SEQ ID NO: 7365136 - DNA, 22 bp, Homo sapiens
ctcctgagggatgcttaggctt

SEQ ID NO: 7365137 - DNA, 22 bp, Homo sapiens
ctcctgagtctccacgccccgt

SEQ ID NO: 7365138 - DNA, 22 bp, Homo sapiens
ctcctgaggggacaggactcat

SEQ ID NO: 7365139 - DNA, 22 bp, Homo sapiens
ctcctgcatgctcacatatgcc

SEQ ID NO: 7365140 - DNA, 22 bp, Homo sapiens
ctccttttcctactcatactat

SEQ ID NO: 7365141 - DNA, 22 bp, Homo sapiens
ctcgctatgcttttgctctgtg

SEQ ID NO: 7365142 - DNA, 23 bp, Homo sapiens
ctccttggtatgccatgcccagc

SEQ ID NO: 7365143 - DNA, 22 bp, Homo sapiens
ctccttggggtaaattgatgtg

SEQ ID NO: 7365144 - DNA, 22 bp, Homo sapiens
ctctttggctttgactcccatt

SEQ ID NO: 7365145 - DNA, 16 bp, Homo sapiens
ctctttggcttccaag

SEQ ID NO: 7365146 - DNA, 21 bp, Homo sapiens
ctcttgtctttgctcagtagc

SEQ ID NO: 7365147 - DNA, 22 bp, Homo sapiens
ctctttggcgttggcagagcca

SEQ ID NO: 7365148 - DNA, 22 bp, Homo sapiens
ctcttcttgtctctggttagaa

SEQ ID NO: 7365149 - DNA, 22 bp, Homo sapiens
ctcttcttgtctctggttagaa

SEQ ID NO: 7365150 - DNA, 22 bp, Homo sapiens
ctcttcttggcccccatgaggg

SEQ ID NO: 7365151 - DNA, 22 bp, Homo sapiens
agtggtgcccacctgagcctga

SEQ ID NO: 7365152 - DNA, 22 bp, Homo sapiens
agtgtaagtgatcattgatagt

SEQ ID NO: 7365153 - DNA, 22 bp, Homo sapiens
agtgtaaagctgtatatgtgcc

SEQ ID NO: 7365154 - DNA, 22 bp, Homo sapiens
agtggtgtcgtgggagtggaag

SEQ ID NO: 7365155 - DNA, 22 bp, Homo sapiens
agtggtggagccaggaaatgtg

SEQ ID NO: 7365156 - DNA, 22 bp, Homo sapiens
ctctgtcctggtttatactggc

SEQ ID NO: 7365157 - DNA, 22 bp, Homo sapiens
ctctggagaacgctatggatct

SEQ ID NO: 7365158 - DNA, 22 bp, Homo sapiens
agtgggagagaagcaagtagta

SEQ ID NO: 7365159 - DNA, 22 bp, Homo sapiens
agtgggagaatgaataagggcc

SEQ ID NO: 7365160 - DNA, 22 bp, Homo sapiens
agtggctttttagtggcagatg

SEQ ID NO: 7365161 - DNA, 22 bp, Homo sapiens
agtgggaatttcagtgctaaaa

SEQ ID NO: 7365162 - DNA, 22 bp, Homo sapiens
agtgggaccggtgctattccag

SEQ ID NO: 7365163 - DNA, 22 bp, Homo sapiens
agtggcttgtccgtggtcacat

SEQ ID NO: 7365164 - DNA, 22 bp, Homo sapiens
agtggcttgtccgtggtcacat

SEQ ID NO: 7365165 - DNA, 22 bp, Homo sapiens
agtggcttggctgcactacagg

SEQ ID NO: 7365166 - DNA, 22 bp, Homo sapiens
agtggcttttcttgcttctggc

SEQ ID NO: 7365167 - DNA, 22 bp, Homo sapiens
agtggcttatctgggacagcta

SEQ ID NO: 7365168 - DNA, 22 bp, Homo sapiens
agtggcttatgtttagaatcat

SEQ ID NO: 7365169 - DNA, 22 bp, Homo sapiens
agtggcttcatttctgccagaa

SEQ ID NO: 7365170 - DNA, 22 bp, Homo sapiens
atactcaatttgttggaaagca

SEQ ID NO: 7365171 - DNA, 22 bp, Homo sapiens
atacttgttcctgttgctatag

SEQ ID NO: 7365172 - DNA, 22 bp, Homo sapiens
atacagaattcactacagtttc

SEQ ID NO: 7365173 - DNA, 22 bp, Homo sapiens
atacagaatactaattcctgag

SEQ ID NO: 7365174 - DNA, 22 bp, Homo sapiens
atacagaatactaattcctgag

SEQ ID NO: 7365175 - DNA, 22 bp, Homo sapiens
atacaagttaatgagaatgaca

SEQ ID NO: 7365176 - DNA, 22 bp, Homo sapiens
atacaagtgttgtgcctcatca

SEQ ID NO: 7365177 - DNA, 22 bp, Homo sapiens
atacaagttaaatgcagtgccc

SEQ ID NO: 7365178 - DNA, 22 bp, Homo sapiens
atacaagtgctgaccctgggat

SEQ ID NO: 7365179 - DNA, 22 bp, Homo sapiens
atacaagtggccacttgaattc

SEQ ID NO: 7365180 - DNA, 22 bp, Homo sapiens
atacagaattcactacagtttc

SEQ ID NO: 7365181 - DNA, 18 bp, Homo sapiens
ctgcttctgtctgccagt

SEQ ID NO: 7365182 - DNA, 22 bp, Homo sapiens
ctgcttctagcaccaagtccct

SEQ ID NO: 7365183 - DNA, 22 bp, Homo sapiens
ctgcttggcttataacctcagg

SEQ ID NO: 7365184 - DNA, 22 bp, Homo sapiens
ataatatttggataggacagta

SEQ ID NO: 7365185 - DNA, 22 bp, Homo sapiens
ataatatttgcattactgtgat

SEQ ID NO: 7365186 - DNA, 22 bp, Homo sapiens
ataatatttgcattactgtgat

SEQ ID NO: 7365187 - DNA, 22 bp, Homo sapiens
ataatatttgcattactgtgat

SEQ ID NO: 7365188 - DNA, 19 bp, Homo sapiens
atacaagactagcatttac

SEQ ID NO: 7365189 - DNA, 22 bp, Homo sapiens
atacaagtgatataattgtttc

SEQ ID NO: 7365190 - DNA, 22 bp, Homo sapiens
atacaagtcaatccatgtgatt

SEQ ID NO: 7365191 - DNA, 22 bp, Homo sapiens
atacaagtgagaaaactgaaga

SEQ ID NO: 7365192 - DNA, 22 bp, Homo sapiens
ctgctttaactctgggaagcca

SEQ ID NO: 7365193 - DNA, 22 bp, Homo sapiens
ctgctttaatgtaagatatacc

SEQ ID NO: 7365194 - DNA, 22 bp, Homo sapiens
ctgctttaatttagacaaggca

SEQ ID NO: 7365195 - DNA, 22 bp, Homo sapiens
ctgctctgctgatcagtgtctc

SEQ ID NO: 7365196 - DNA, 22 bp, Homo sapiens
ctgctctggggaagccagatgt

SEQ ID NO: 7365197 - DNA, 21 bp, Homo sapiens
ctgctctggggaccggctgtg

SEQ ID NO: 7365198 - DNA, 21 bp, Homo sapiens
ctgctctggggaccggctgtg

SEQ ID NO: 7365199 - DNA, 22 bp, Homo sapiens
ataatacatggttgatcttttc

SEQ ID NO: 7365200 - DNA, 22 bp, Homo sapiens
ataatacatggttaacctcttt

SEQ ID NO: 7365201 - DNA, 22 bp, Homo sapiens
ataaatctattggacatgtgtg

SEQ ID NO: 7365202 - DNA, 22 bp, Homo sapiens
ataaatctattggacatgtgtg

SEQ ID NO: 7365203 - DNA, 18 bp, Homo sapiens
ctgcccagagcacttgtg

SEQ ID NO: 7365204 - DNA, 22 bp, Homo sapiens
ataaagtagccactggaaagct

SEQ ID NO: 7365205 - DNA, 22 bp, Homo sapiens
ataaaagtttccaatcatgcct

SEQ ID NO: 7365206 - DNA, 20 bp, Homo sapiens
ataaaataactgccacaaga

SEQ ID NO: 7365207 - DNA, 20 bp, Homo sapiens
ataaaataactgccacaaga

SEQ ID NO: 7365208 - DNA, 20 bp, Homo sapiens
ataaaataactgccacaaga

SEQ ID NO: 7365209 - DNA, 20 bp, Homo sapiens
ataaaataactgccacaaga

SEQ ID NO: 7365210 - DNA, 22 bp, Homo sapiens
ctgccaggcctcatcccagcca

SEQ ID NO: 7365211 - DNA, 22 bp, Homo sapiens
ctgccaggcagcagagggagaa

SEQ ID NO: 7365212 - DNA, 22 bp, Homo sapiens
ataaaagtaggaccaacttaca

SEQ ID NO: 7365213 - DNA, 22 bp, Homo sapiens
ataaaagtaggaccaacttaca

SEQ ID NO: 7365214 - DNA, 21 bp, Homo sapiens
ctgccaggatagcatgcaggc

SEQ ID NO: 7365215 - DNA, 22 bp, Homo sapiens
ctgcatttcacatttaaacttt

SEQ ID NO: 7365216 - DNA, 22 bp, Homo sapiens
ctgcatttccacctggccacag

SEQ ID NO: 7365217 - DNA, 22 bp, Homo sapiens
ctgccaaaaggtgcacctgctg

SEQ ID NO: 7365218 - DNA, 22 bp, Homo sapiens
ctgccaggcactgggctctgca

SEQ ID NO: 7365219 - DNA, 22 bp, Homo sapiens
agtttggaagagaaaaatattt

SEQ ID NO: 7365220 - DNA, 22 bp, Homo sapiens
agtttggaaaatgagacaagga

SEQ ID NO: 7365221 - DNA, 23 bp, Homo sapiens
agtttctttgagacttgccctgt

SEQ ID NO: 7365222 - DNA, 22 bp, Homo sapiens
ctgaggcctctgttcaccagaa

SEQ ID NO: 7365223 - DNA, 22 bp, Homo sapiens
ctgaggcctctgttcaccagaa

SEQ ID NO: 7365224 - DNA, 23 bp, Homo sapiens
ctgaggcctgctgcgttcaggtt

SEQ ID NO: 7365225 - DNA, 22 bp, Homo sapiens
ctgaggcctctttccttggctt

SEQ ID NO: 7365226 - DNA, 22 bp, Homo sapiens
ctgaggcctctctccttggctt

SEQ ID NO: 7365227 - DNA, 22 bp, Homo sapiens
ctgaggcctctctcctgggctt

SEQ ID NO: 7365228 - DNA, 22 bp, Homo sapiens
ctgaggcctctcccactccagc

SEQ ID NO: 7365229 - DNA, 22 bp, Homo sapiens
ctgaggcagtttaatttttgaa

SEQ ID NO: 7365230 - DNA, 22 bp, Homo sapiens
ctgaggcctaagacatgaatga

SEQ ID NO: 7365231 - DNA, 22 bp, Homo sapiens
ctgaggcctcactgtagtccct

SEQ ID NO: 7365232 - DNA, 22 bp, Homo sapiens
ctgaggcctaagacatgaatga

SEQ ID NO: 7365233 - DNA, 22 bp, Homo sapiens
ctgaggcaggagaattgctgga

SEQ ID NO: 7365234 - DNA, 22 bp, Homo sapiens
ctgaggcaggagagttgcttga

SEQ ID NO: 7365235 - DNA, 22 bp, Homo sapiens
ctgaggcaggatggcctggctg

SEQ ID NO: 7365236 - DNA, 22 bp, Homo sapiens
agttggtcttcttggatctcag

SEQ ID NO: 7365237 - DNA, 22 bp, Homo sapiens
agttggcattcctgcatcctat

SEQ ID NO: 7365238 - DNA, 22 bp, Homo sapiens
agttggcacatagcaaattcgc

SEQ ID NO: 7365239 - DNA, 23 bp, Homo sapiens
agttggcatattcaagcacagtc

SEQ ID NO: 7365240 - DNA, 22 bp, Homo sapiens
agttggagtgaacatgagattg

SEQ ID NO: 7365241 - DNA, 22 bp, Homo sapiens
agttggcaaaggtaggtattct

SEQ ID NO: 7365242 - DNA, 22 bp, Homo sapiens
agttgctttggatataacttct

SEQ ID NO: 7365243 - DNA, 22 bp, Homo sapiens
agttgcttccctattcttagca

SEQ ID NO: 7365244 - DNA, 18 bp, Homo sapiens
agttgcttattctgtgca

SEQ ID NO: 7365245 - DNA, 22 bp, Homo sapiens
ctctttggtcgcatcatccatt

SEQ ID NO: 7365246 - DNA, 22 bp, Homo sapiens
ctctttggtcgcatcatccatt

SEQ ID NO: 7365247 - DNA, 22 bp, Homo sapiens
ctctttggggtgccccactggt

SEQ ID NO: 7365248 - DNA, 22 bp, Homo sapiens
ctctttggggctggaagcctag

SEQ ID NO: 7365249 - DNA, 16 bp, Homo sapiens
ctctttgggcttccag

SEQ ID NO: 7365250 - DNA, 22 bp, Homo sapiens
ctctttgggatgggctctgctg

SEQ ID NO: 7365251 - DNA, 21 bp, Homo sapiens
ctctttgggatctttggaaag

SEQ ID NO: 7365252 - DNA, 22 bp, Homo sapiens
ctctttggtgcaccttgcagtc

SEQ ID NO: 7365253 - DNA, 22 bp, Homo sapiens
agttgctgattctgtctgtgat

SEQ ID NO: 7365254 - DNA, 22 bp, Homo sapiens
atcattctagtccttatggtct

SEQ ID NO: 7365255 - DNA, 22 bp, Homo sapiens
atcattctagctgttgtgttga

SEQ ID NO: 7365256 - DNA, 22 bp, Homo sapiens
atcatgttgctcaaaattaaac

SEQ ID NO: 7365257 - DNA, 22 bp, Homo sapiens
atcatgttttaattagcaaact

SEQ ID NO: 7365258 - DNA, 22 bp, Homo sapiens
atcattttgtgacaatgcctgt

SEQ ID NO: 7365259 - DNA, 22 bp, Homo sapiens
atcatttttaagagactcttct

SEQ ID NO: 7365260 - DNA, 22 bp, Homo sapiens
atcattctattgttgagctgcc

SEQ ID NO: 7365261 - DNA, 18 bp, Homo sapiens
atccaaaaagatggaagt

SEQ ID NO: 7365262 - DNA, 18 bp, Homo sapiens
atccaaaaagatggaagt

SEQ ID NO: 7365263 - DNA, 22 bp, Homo sapiens
atccaaaatttactgtagcatt

SEQ ID NO: 7365264 - DNA, 22 bp, Homo sapiens
atccaaaggtgacacagaatac

SEQ ID NO: 7365265 - DNA, 22 bp, Homo sapiens
atcctaaaattgttcaatttct

SEQ ID NO: 7365266 - DNA, 22 bp, Homo sapiens
atcctaaagaaatatttattaa

SEQ ID NO: 7365267 - DNA, 22 bp, Homo sapiens
atcctcagacctcagcaaagcc

SEQ ID NO: 7365268 - DNA, 22 bp, Homo sapiens
atcctcagcatctagcatgaag

SEQ ID NO: 7365269 - DNA, 22 bp, Homo sapiens
atcctctctgttttcgtgtatg

SEQ ID NO: 7365270 - DNA, 22 bp, Homo sapiens
atctaattttcactcatttgct

SEQ ID NO: 7365271 - DNA, 22 bp, Homo sapiens
atccccctgtatctggaagaat

SEQ ID NO: 7365272 - DNA, 22 bp, Homo sapiens
atccatttgtaaatgttagagt

SEQ ID NO: 7365273 - DNA, 22 bp, Homo sapiens
atccaccctgtggtggctttct

SEQ ID NO: 7365274 - DNA, 17 bp, Homo sapiens
atccccagcatctagaa

SEQ ID NO: 7365275 - DNA, 22 bp, Homo sapiens
atcacatctcaccactgcaacc

SEQ ID NO: 7365276 - DNA, 22 bp, Homo sapiens
atcacatggaatgattttagac

SEQ ID NO: 7365277 - DNA, 22 bp, Homo sapiens
atcacatcacaggttgagctag

SEQ ID NO: 7365278 - DNA, 22 bp, Homo sapiens
atcacagtctttttcttaagta

SEQ ID NO: 7365279 - DNA, 22 bp, Homo sapiens
atcacagttactcaaataatga

SEQ ID NO: 7365280 - DNA, 22 bp, Homo sapiens
ctgtcctcaacccatccttctc

SEQ ID NO: 7365281 - DNA, 22 bp, Homo sapiens
ctgtcctcaacccatccttctc

SEQ ID NO: 7365282 - DNA, 22 bp, Homo sapiens
ctgtcctcaccttggcaggggg

SEQ ID NO: 7365283 - DNA, 22 bp, Homo sapiens
ctgtcctccggccacctacagt

SEQ ID NO: 7365284 - DNA, 22 bp, Homo sapiens
ctgtcttctcctttgtttcagg

SEQ ID NO: 7365285 - DNA, 20 bp, Homo sapiens
ctgtcttgtgggcttcccct

SEQ ID NO: 7365286 - DNA, 22 bp, Homo sapiens
ctgtcttctaccttcaacctcc

SEQ ID NO: 7365287 - DNA, 22 bp, Homo sapiens
ctgtctgttttaccttctccag

SEQ ID NO: 7365288 - DNA, 19 bp, Homo sapiens
atcacatgtcaagagcagg

SEQ ID NO: 7365289 - DNA, 22 bp, Homo sapiens
ctgtcttttcttctcattgatg

SEQ ID NO: 7365290 - DNA, 22 bp, Homo sapiens
ctgtcttttcttctcattgatg

SEQ ID NO: 7365291 - DNA, 18 bp, Homo sapiens
ctgtgcagcaaactgagc

SEQ ID NO: 7365292 - DNA, 22 bp, Homo sapiens
ctgtgcacacgtgcccaacagt

SEQ ID NO: 7365293 - DNA, 22 bp, Homo sapiens
ctgtgcactaaccacacccacg

SEQ ID NO: 7365294 - DNA, 22 bp, Homo sapiens
ctgtgcaaaggccttatgtttt

SEQ ID NO: 7365295 - DNA, 22 bp, Homo sapiens
ctgtgcaagacttactttaata

SEQ ID NO: 7365296 - DNA, 23 bp, Homo sapiens
ctgtgcaatatcccatggtatga

SEQ ID NO: 7365297 - DNA, 22 bp, Homo sapiens
ctgtgcaatattataaaggcca

SEQ ID NO: 7365298 - DNA, 22 bp, Homo sapiens
ctgtgcaagcccaagataaaac

SEQ ID NO: 7365299 - DNA, 22 bp, Homo sapiens
atcatgctgacacagtttatct

SEQ ID NO: 7365300 - DNA, 22 bp, Homo sapiens
atatatatcgagttcatgtctc

SEQ ID NO: 7365301 - DNA, 22 bp, Homo sapiens
atatatactttgacacattctg

SEQ ID NO: 7365302 - DNA, 22 bp, Homo sapiens
atatatagagctagatgttaaa

SEQ ID NO: 7365303 - DNA, 22 bp, Homo sapiens
atatatacaactagattaaaag

SEQ ID NO: 7365304 - DNA, 22 bp, Homo sapiens
ctgggagacaagagagggctga

SEQ ID NO: 7365305 - DNA, 22 bp, Homo sapiens
ctgggagagaagcgaagctggg

SEQ ID NO: 7365306 - DNA, 22 bp, Homo sapiens
ctgggagagcctttcctgagtc

SEQ ID NO: 7365307 - DNA, 22 bp, Homo sapiens
atatatatcgagttcatgtctc

SEQ ID NO: 7365308 - DNA, 22 bp, Homo sapiens
atatatatgctgatggctgcca

SEQ ID NO: 7365309 - DNA, 20 bp, Homo sapiens
ctgggcacctgtctgcagtt

SEQ ID NO: 7365310 - DNA, 22 bp, Homo sapiens
ctgggaagggagtcaagatact

SEQ ID NO: 7365311 - DNA, 22 bp, Homo sapiens
atataagttagtggtcatgttt

SEQ ID NO: 7365312 - DNA, 22 bp, Homo sapiens
ctgggacacagccttacctggg

SEQ ID NO: 7365313 - DNA, 19 bp, Homo sapiens
ctgggacaatgaaagcatc

SEQ ID NO: 7365314 - DNA, 22 bp, Homo sapiens
ctgggacaagctctgtctagct

SEQ ID NO: 7365315 - DNA, 22 bp, Homo sapiens
atataacatacatacagaaaag

SEQ ID NO: 7365316 - DNA, 22 bp, Homo sapiens
atataacatacatacagaaaag

SEQ ID NO: 7365317 - DNA, 22 bp, Homo sapiens
atatatacaactagattaaaag

SEQ ID NO: 7365318 - DNA, 22 bp, Homo sapiens
atataatacaacctgctaagtg

SEQ ID NO: 7365319 - DNA, 22 bp, Homo sapiens
atatacttggagactatcattg

SEQ ID NO: 7365320 - DNA, 22 bp, Homo sapiens
ctgggcaggatacttcatggga

SEQ ID NO: 7365321 - DNA, 22 bp, Homo sapiens
ctgggcaggatacttcatggga

SEQ ID NO: 7365322 - DNA, 22 bp, Homo sapiens
ctgggcagtggtggcccttccc

SEQ ID NO: 7365323 - DNA, 22 bp, Homo sapiens
atatgcttacactacaagatga

SEQ ID NO: 7365324 - DNA, 22 bp, Homo sapiens
atatgacagaatgtgtgtgtat

SEQ ID NO: 7365325 - DNA, 22 bp, Homo sapiens
atatgaatttggctggaaaggt

SEQ ID NO: 7365326 - DNA, 22 bp, Homo sapiens
atatgattccactattgtatgg

SEQ ID NO: 7365327 - DNA, 22 bp, Homo sapiens
atatatcatgagtaaaacttga

SEQ ID NO: 7365328 - DNA, 22 bp, Homo sapiens
atatatattgcccaggctggtt

SEQ ID NO: 7365329 - DNA, 22 bp, Homo sapiens
atatatatgctgatggctgcca

SEQ ID NO: 7365330 - DNA, 22 bp, Homo sapiens
atatatgcatgtgtacttatgt

SEQ ID NO: 7365331 - DNA, 22 bp, Homo sapiens
atatatgcgcaggcacccagct

SEQ ID NO: 7365332 - DNA, 22 bp, Homo sapiens
atatatgcgcaggcacccagct

SEQ ID NO: 7365333 - DNA, 22 bp, Homo sapiens
atatttcttgagcacctggtat

SEQ ID NO: 7365334 - DNA, 22 bp, Homo sapiens
atatgttttgtgcttcattggt

SEQ ID NO: 7365335 - DNA, 22 bp, Homo sapiens
atatgttttgtgcttcattggt

SEQ ID NO: 7365336 - DNA, 22 bp, Homo sapiens
atatgtttcagtattcaagtca

SEQ ID NO: 7365337 - DNA, 22 bp, Homo sapiens
atatttctctcagacatggaag

SEQ ID NO: 7365338 - DNA, 22 bp, Homo sapiens
atatgtttttcacaggtttaag

SEQ ID NO: 7365339 - DNA, 22 bp, Homo sapiens
atatgtttttggaaagaacaca

SEQ ID NO: 7365340 - DNA, 18 bp, Homo sapiens
atatgttaattaggtagg

SEQ ID NO: 7365341 - DNA, 22 bp, Homo sapiens
atatgtcataattgtgtctgta

SEQ ID NO: 7365342 - DNA, 22 bp, Homo sapiens
atatgtcctcggcacataatgt

SEQ ID NO: 7365343 - DNA, 22 bp, Homo sapiens
atatgtatgtacgcacatattc

SEQ ID NO: 7365344 - DNA, 22 bp, Homo sapiens
cagaagtctttctgtttcacct

SEQ ID NO: 7365345 - DNA, 18 bp, Homo sapiens
cagaagtccttcaaggcc

SEQ ID NO: 7365346 - DNA, 22 bp, Homo sapiens
cagaaggtgaaggcagaacctt

SEQ ID NO: 7365347 - DNA, 22 bp, Homo sapiens
gggaaagagaggtggacgcagg

SEQ ID NO: 7365348 - DNA, 22 bp, Homo sapiens
gggaaactgtccagttctcccc

SEQ ID NO: 7365349 - DNA, 22 bp, Homo sapiens
cagaaggcctgaatctttgttc

SEQ ID NO: 7365350 - DNA, 22 bp, Homo sapiens
cagaaggctggcagattgagat

SEQ ID NO: 7365351 - DNA, 22 bp, Homo sapiens
cagaagcagtgagagatgtgca

SEQ ID NO: 7365352 - DNA, 22 bp, Homo sapiens
cagaaggcaaacaaaaggattt

SEQ ID NO: 7365353 - DNA, 22 bp, Homo sapiens
cagaaggcaaggcctgccacgc

SEQ ID NO: 7365354 - DNA, 22 bp, Homo sapiens
cagaaggcagcaaatgaaaacc

SEQ ID NO: 7365355 - DNA, 22 bp, Homo sapiens
cagaaggcaaggcctgccacgc

SEQ ID NO: 7365356 - DNA, 22 bp, Homo sapiens
cagaaggcatagatgaaggcct

SEQ ID NO: 7365357 - DNA, 22 bp, Homo sapiens
cactggctaaagataagctcaa

SEQ ID NO: 7365358 - DNA, 22 bp, Homo sapiens
cactggctccctgatttgaagc

SEQ ID NO: 7365359 - DNA, 22 bp, Homo sapiens
cactgggacctaggactgagct

SEQ ID NO: 7365360 - DNA, 22 bp, Homo sapiens
gggacagacccatgggccaggt

SEQ ID NO: 7365361 - DNA, 22 bp, Homo sapiens
gggaaggaggtggacctgcccc

SEQ ID NO: 7365362 - DNA, 22 bp, Homo sapiens
gggaaggagcctgcttgctaga

SEQ ID NO: 7365363 - DNA, 22 bp, Homo sapiens
gggaaggaaagttattagcaga

SEQ ID NO: 7365364 - DNA, 22 bp, Homo sapiens
cagacaggctagccagactcac

SEQ ID NO: 7365365 - DNA, 22 bp, Homo sapiens
gggcacaaaatttcagaaagct

SEQ ID NO: 7365366 - DNA, 20 bp, Homo sapiens
gggaggccagcctcagagaa

SEQ ID NO: 7365367 - DNA, 20 bp, Homo sapiens
gggaggccagcctcagagaa

SEQ ID NO: 7365368 - DNA, 22 bp, Homo sapiens
gggagcagttaaaatgattcct

SEQ ID NO: 7365369 - DNA, 22 bp, Homo sapiens
gggagcagttaaaatgattcct

SEQ ID NO: 7365370 - DNA, 19 bp, Homo sapiens
gggagcacaagcgttaaga

SEQ ID NO: 7365371 - DNA, 22 bp, Homo sapiens
gggagcaagccggaggtactgt

SEQ ID NO: 7365372 - DNA, 22 bp, Homo sapiens
gggagcacacagaggtgccctt

SEQ ID NO: 7365373 - DNA, 22 bp, Homo sapiens
gggagcaggacataatagcaat

SEQ ID NO: 7365374 - DNA, 22 bp, Homo sapiens
gggagcaggacataatagcaat

SEQ ID NO: 7365375 - DNA, 22 bp, Homo sapiens
gggagcaggagcctgcctgcca

SEQ ID NO: 7365376 - DNA, 22 bp, Homo sapiens
gggagcaggagcctgcctgcca

SEQ ID NO: 7365377 - DNA, 22 bp, Homo sapiens
gggagcaggagcctgcctgcca

SEQ ID NO: 7365378 - DNA, 19 bp, Homo sapiens
gggagcaggaaagctgtgg

SEQ ID NO: 7365379 - DNA, 22 bp, Homo sapiens
gggagcagcctgcctcccacct

SEQ ID NO: 7365380 - DNA, 19 bp, Homo sapiens
gggagcaggaaagctgtgg

SEQ ID NO: 7365381 - DNA, 22 bp, Homo sapiens
gggagcactaaggcagtcgctt

SEQ ID NO: 7365382 - DNA, 22 bp, Homo sapiens
gggagcacccgtggcctcaagg

SEQ ID NO: 7365383 - DNA, 22 bp, Homo sapiens
gggagcacatctgagcacccgg

SEQ ID NO: 7365384 - DNA, 22 bp, Homo sapiens
gggagcactgagaggcaggtag

SEQ ID NO: 7365385 - DNA, 22 bp, Homo sapiens
gggagcagcctgcctcccacct

SEQ ID NO: 7365386 - DNA, 22 bp, Homo sapiens
cagaagttggagctttccatca

SEQ ID NO: 7365387 - DNA, 22 bp, Homo sapiens
cagaagttagtgtctgccagta

SEQ ID NO: 7365388 - DNA, 22 bp, Homo sapiens
cagaagttttgctctcttgggt

SEQ ID NO: 7365389 - DNA, 22 bp, Homo sapiens
cagaataaaaactcctatgtct

SEQ ID NO: 7365390 - DNA, 22 bp, Homo sapiens
gggacttaatgcagagagggac

SEQ ID NO: 7365391 - DNA, 22 bp, Homo sapiens
gggactgggagatcctcctggc

SEQ ID NO: 7365392 - DNA, 22 bp, Homo sapiens
gggactgtcctctgtgtctgtg

SEQ ID NO: 7365393 - DNA, 22 bp, Homo sapiens
cagaagtggatattagagtaat

SEQ ID NO: 7365394 - DNA, 22 bp, Homo sapiens
cagaagtgcaatttaaattagg

SEQ ID NO: 7365395 - DNA, 22 bp, Homo sapiens
cagaagtggtattaattagatt

SEQ ID NO: 7365396 - DNA, 22 bp, Homo sapiens
gggtgcagggtctccagcagct

SEQ ID NO: 7365397 - DNA, 22 bp, Homo sapiens
cagaggccttgtcttctttgct

SEQ ID NO: 7365398 - DNA, 22 bp, Homo sapiens
gggtgccacagagcttccactt

SEQ ID NO: 7365399 - DNA, 22 bp, Homo sapiens
gggtgcagtggttcacgcctgt

SEQ ID NO: 7365400 - DNA, 22 bp, Homo sapiens
cagaggctggatggacttgcct

SEQ ID NO: 7365401 - DNA, 22 bp, Homo sapiens
cagaggcttggcattatcatgc

SEQ ID NO: 7365402 - DNA, 22 bp, Homo sapiens
cagaggcttatacctgattagg

SEQ ID NO: 7365403 - DNA, 22 bp, Homo sapiens
cagaggtggggagtatttcaag

SEQ ID NO: 7365404 - DNA, 22 bp, Homo sapiens
cagaggccagggggctcacaaa

SEQ ID NO: 7365405 - DNA, 22 bp, Homo sapiens
cagaggccaggctgcctgactg

SEQ ID NO: 7365406 - DNA, 22 bp, Homo sapiens
cagaggccaggctgcctgactg

SEQ ID NO: 7365407 - DNA, 22 bp, Homo sapiens
cagaggccacctgtggccactg

SEQ ID NO: 7365408 - DNA, 22 bp, Homo sapiens
cagaggcctcacttccagccag

SEQ ID NO: 7365409 - DNA, 21 bp, Homo sapiens
cagaggcctcatgctctgtgc

SEQ ID NO: 7365410 - DNA, 20 bp, Homo sapiens
ggggaagaaaaggatgtgat

SEQ ID NO: 7365411 - DNA, 22 bp, Homo sapiens
cagagctgtcatttgccagtga

SEQ ID NO: 7365412 - DNA, 20 bp, Homo sapiens
cagaggcattttcagactct

SEQ ID NO: 7365413 - DNA, 20 bp, Homo sapiens
cagaggcattttcagactct

SEQ ID NO: 7365414 - DNA, 22 bp, Homo sapiens
cagagccccccttctgatcaca

SEQ ID NO: 7365415 - DNA, 22 bp, Homo sapiens
cagagccctgtgtgccatgtga

SEQ ID NO: 7365416 - DNA, 22 bp, Homo sapiens
cagagccctgggcacatggtag

SEQ ID NO: 7365417 - DNA, 22 bp, Homo sapiens
cagagccctgcatgctccatct

SEQ ID NO: 7365418 - DNA, 22 bp, Homo sapiens
cagagccctcaaggccgatgca

SEQ ID NO: 7365419 - DNA, 22 bp, Homo sapiens
gggccttctagttagccccaat

SEQ ID NO: 7365420 - DNA, 22 bp, Homo sapiens
gggccttccgactcccaaggcc

SEQ ID NO: 7365421 - DNA, 22 bp, Homo sapiens
gggccttcagccttggactgag

SEQ ID NO: 7365422 - DNA, 22 bp, Homo sapiens
gggcacagagggtcttgaagaa

SEQ ID NO: 7365423 - DNA, 22 bp, Homo sapiens
gggcactgtgctgggtgcttta

SEQ ID NO: 7365424 - DNA, 22 bp, Homo sapiens
gggcactgtgttcagagtgcag

SEQ ID NO: 7365425 - DNA, 22 bp, Homo sapiens
gggcagagaaatggacagttgg

SEQ ID NO: 7365426 - DNA, 22 bp, Homo sapiens
cagagcccagggcctacgtccc

SEQ ID NO: 7365427 - DNA, 22 bp, Homo sapiens
cagagcccatggcacatgtgga

SEQ ID NO: 7365428 - DNA, 22 bp, Homo sapiens
cagagcccatcctatactctcc

SEQ ID NO: 7365429 - DNA, 22 bp, Homo sapiens
cagagctgcaaatgcccctccg

SEQ ID NO: 7365430 - DNA, 22 bp, Homo sapiens
cagagctgcagattgaaggcat

SEQ ID NO: 7365431 - DNA, 21 bp, Homo sapiens
cagagctgaagggtgtagtgt

SEQ ID NO: 7365432 - DNA, 22 bp, Homo sapiens
cagagctgacccaaggattgaa

SEQ ID NO: 7365433 - DNA, 22 bp, Homo sapiens
cagagctgagaatgttgatgct

SEQ ID NO: 7365434 - DNA, 22 bp, Homo sapiens
cagagcctgctgccttctgaag

SEQ ID NO: 7365435 - DNA, 22 bp, Homo sapiens
gggcgcagccaatcctggccct

SEQ ID NO: 7365436 - DNA, 22 bp, Homo sapiens
gggcgcatcacctgaggtcagg

SEQ ID NO: 7365437 - DNA, 22 bp, Homo sapiens
cagagctgctcatggtggccag

SEQ ID NO: 7365438 - DNA, 22 bp, Homo sapiens
gggctttttacattgaacattt

SEQ ID NO: 7365439 - DNA, 21 bp, Homo sapiens
gggctttttatttagcactgt

SEQ ID NO: 7365440 - DNA, 22 bp, Homo sapiens
ggggaaaggccatggcaagaac

SEQ ID NO: 7365441 - DNA, 22 bp, Homo sapiens
ggggaaaggccatggcaagaac

SEQ ID NO: 7365442 - DNA, 22 bp, Homo sapiens
ggggaaagtgaattgtgtagtg

SEQ ID NO: 7365443 - DNA, 21 bp, Homo sapiens
cagcccagcccattgacagtg

SEQ ID NO: 7365444 - DNA, 22 bp, Homo sapiens
cagcatgcttgggggagggagc

SEQ ID NO: 7365445 - DNA, 22 bp, Homo sapiens
cagcatttatcttgtagcagga

SEQ ID NO: 7365446 - DNA, 22 bp, Homo sapiens
gtattttaagtgactactaggt

SEQ ID NO: 7365447 - DNA, 22 bp, Homo sapiens
gtattttactgctcaaagctct

SEQ ID NO: 7365448 - DNA, 22 bp, Homo sapiens
gtattttaagtgactactaggt

SEQ ID NO: 7365449 - DNA, 22 bp, Homo sapiens
gtattttactgctcaaagctct

SEQ ID NO: 7365450 - DNA, 22 bp, Homo sapiens
cagccactggtgccaggctgtt

SEQ ID NO: 7365451 - DNA, 22 bp, Homo sapiens
cagccacttcccctctatgggt

SEQ ID NO: 7365452 - DNA, 22 bp, Homo sapiens
cagccactgaactcctggctat

SEQ ID NO: 7365453 - DNA, 22 bp, Homo sapiens
cagcagcaacaacggaagcctt

SEQ ID NO: 7365454 - DNA, 22 bp, Homo sapiens
cagcagagtaattctcacctct

SEQ ID NO: 7365455 - DNA, 22 bp, Homo sapiens
cagcagagtaattctcacctct

SEQ ID NO: 7365456 - DNA, 21 bp, Homo sapiens
cagcagagtaatgcattcgta

SEQ ID NO: 7365457 - DNA, 22 bp, Homo sapiens
cagcagagtaggtgctacttct

SEQ ID NO: 7365458 - DNA, 22 bp, Homo sapiens
cagcagagtttggcttctaatg

SEQ ID NO: 7365459 - DNA, 22 bp, Homo sapiens
cagcagagtatggcactcaact

SEQ ID NO: 7365460 - DNA, 22 bp, Homo sapiens
cagcagagtatggcactcaact

SEQ ID NO: 7365461 - DNA, 22 bp, Homo sapiens
cagcagcaaggtgagggtggag

SEQ ID NO: 7365462 - DNA, 22 bp, Homo sapiens
gtatctttccacatcttcagta

SEQ ID NO: 7365463 - DNA, 22 bp, Homo sapiens
gtatctatgatcctttatatct

SEQ ID NO: 7365464 - DNA, 22 bp, Homo sapiens
gtatcctccccgctggccttca

SEQ ID NO: 7365465 - DNA, 22 bp, Homo sapiens
gtatccatgggggattggttcc

SEQ ID NO: 7365466 - DNA, 22 bp, Homo sapiens
gtatcatatgcatcaggcttgc

SEQ ID NO: 7365467 - DNA, 22 bp, Homo sapiens
gtatattttgatcaccctctat

SEQ ID NO: 7365468 - DNA, 22 bp, Homo sapiens
gtatcacttttgagagtgagaa

SEQ ID NO: 7365469 - DNA, 22 bp, Homo sapiens
gtatattttgatcaccctctat

SEQ ID NO: 7365470 - DNA, 19 bp, Homo sapiens
gtatatttatatggctgta

SEQ ID NO: 7365471 - DNA, 22 bp, Homo sapiens
gtatatgtgtgggcctgcatat

SEQ ID NO: 7365472 - DNA, 22 bp, Homo sapiens
cagcaggcaagaggttttatca

SEQ ID NO: 7365473 - DNA, 22 bp, Homo sapiens
cagcaggatttgaaaggaagag

SEQ ID NO: 7365474 - DNA, 22 bp, Homo sapiens
cagcaggatatggtggagagag

SEQ ID NO: 7365475 - DNA, 22 bp, Homo sapiens
cagcaggatttgaaaggaagag

SEQ ID NO: 7365476 - DNA, 22 bp, Homo sapiens
cagcaggcaggtgggccaagtc

SEQ ID NO: 7365477 - DNA, 22 bp, Homo sapiens
cagcaggccatgctgcttttca

SEQ ID NO: 7365478 - DNA, 22 bp, Homo sapiens
cagcaggcagccatttcactgt

SEQ ID NO: 7365479 - DNA, 22 bp, Homo sapiens
cagcaggcccaggtgctggtga

SEQ ID NO: 7365480 - DNA, 22 bp, Homo sapiens
cagcaggcccagagtttcatgg

SEQ ID NO: 7365481 - DNA, 22 bp, Homo sapiens
cagcagcctggagggggccacg

SEQ ID NO: 7365482 - DNA, 22 bp, Homo sapiens
cagcagcctgccttgggagctt

SEQ ID NO: 7365483 - DNA, 22 bp, Homo sapiens
cagcaggaccattgaggcatca

SEQ ID NO: 7365484 - DNA, 22 bp, Homo sapiens
cagcagcctcaagtttattttc

SEQ ID NO: 7365485 - DNA, 22 bp, Homo sapiens
gtatcttttggtggaaaaataa

SEQ ID NO: 7365486 - DNA, 22 bp, Homo sapiens
gtatgaaggcgagagcccacta

SEQ ID NO: 7365487 - DNA, 22 bp, Homo sapiens
gggtgggatctgtggagcctca

SEQ ID NO: 7365488 - DNA, 22 bp, Homo sapiens
gggtgggagtctggccctcaaa

SEQ ID NO: 7365489 - DNA, 22 bp, Homo sapiens
gggtgggactctttggcctgag

SEQ ID NO: 7365490 - DNA, 22 bp, Homo sapiens
cagcaaggccattggatgcagt

SEQ ID NO: 7365491 - DNA, 22 bp, Homo sapiens
cagcaaggcattctgtggatta

SEQ ID NO: 7365492 - DNA, 22 bp, Homo sapiens
cagcaaggtctgtcaatagtgg

SEQ ID NO: 7365493 - DNA, 22 bp, Homo sapiens
cagcaagggttatatcaaagat

SEQ ID NO: 7365494 - DNA, 22 bp, Homo sapiens
cagcaagggataaagagttact

SEQ ID NO: 7365495 - DNA, 22 bp, Homo sapiens
cagcaagggataaacaaggacg

SEQ ID NO: 7365496 - DNA, 22 bp, Homo sapiens
cagcaatggcaggcggagagtg

SEQ ID NO: 7365497 - DNA, 22 bp, Homo sapiens
ggttccttctgaggtccctgta

SEQ ID NO: 7365498 - DNA, 22 bp, Homo sapiens
ggttccttctgaggtccctgta

SEQ ID NO: 7365499 - DNA, 19 bp, Homo sapiens
ggttcctcacgctaagggc

SEQ ID NO: 7365500 - DNA, 22 bp, Homo sapiens
ggttccccaggcggcccttgga

SEQ ID NO: 7365501 - DNA, 22 bp, Homo sapiens
ggttccagagtatttcatttca

SEQ ID NO: 7365502 - DNA, 22 bp, Homo sapiens
gtaaaattctagcatctgaaag

SEQ ID NO: 7365503 - DNA, 22 bp, Homo sapiens
gtaaaattgcaattacttttgc

SEQ ID NO: 7365504 - DNA, 22 bp, Homo sapiens
gtaaaattgcaattacttttgc

SEQ ID NO: 7365505 - DNA, 22 bp, Homo sapiens
gtaaacaagtctaccattagaa

SEQ ID NO: 7365506 - DNA, 22 bp, Homo sapiens
gtaaacaacacaaatcatttga

SEQ ID NO: 7365507 - DNA, 22 bp, Homo sapiens
cagcagagctgtgtgggaaggg

SEQ ID NO: 7365508 - DNA, 22 bp, Homo sapiens
gtaaaatagaataacgtggcta

SEQ ID NO: 7365509 - DNA, 22 bp, Homo sapiens
cactggcaaatggagagaatgt

SEQ ID NO: 7365510 - DNA, 22 bp, Homo sapiens
cactggaggtcagtggagcact

SEQ ID NO: 7365511 - DNA, 22 bp, Homo sapiens
cactgcttttttggctatgtac

SEQ ID NO: 7365512 - DNA, 22 bp, Homo sapiens
cactgcttttttggctatgtac

SEQ ID NO: 7365513 - DNA, 22 bp, Homo sapiens
cactggaagttcattctcagaa

SEQ ID NO: 7365514 - DNA, 22 bp, Homo sapiens
cactgcctgctggctgtcactt

SEQ ID NO: 7365515 - DNA, 22 bp, Homo sapiens
cactgcttttcagacagttatt

SEQ ID NO: 7365516 - DNA, 22 bp, Homo sapiens
ggctagtaagaaagaccaagct

SEQ ID NO: 7365517 - DNA, 22 bp, Homo sapiens
cactgcagtaactctaggactg

SEQ ID NO: 7365518 - DNA, 22 bp, Homo sapiens
cactgcagtaactctaggactg

SEQ ID NO: 7365519 - DNA, 22 bp, Homo sapiens
ggcctcggcccactgctgcggt

SEQ ID NO: 7365520 - DNA, 22 bp, Homo sapiens
ggcctcgcggcttctggtggct

SEQ ID NO: 7365521 - DNA, 22 bp, Homo sapiens
cactgagcagtggtgaaaatct

SEQ ID NO: 7365522 - DNA, 22 bp, Homo sapiens
cactgagccaggagcaatatca

SEQ ID NO: 7365523 - DNA, 22 bp, Homo sapiens
cactgaagctttcattctcttg

SEQ ID NO: 7365524 - DNA, 22 bp, Homo sapiens
cactgagagatgtgtcacagca

SEQ ID NO: 7365525 - DNA, 22 bp, Homo sapiens
cactgactccaaaaataaagaa

SEQ ID NO: 7365526 - DNA, 22 bp, Homo sapiens
cactgactaggtcggtgacctc

SEQ ID NO: 7365527 - DNA, 18 bp, Homo sapiens
caccctccgcggctgccc

SEQ ID NO: 7365528 - DNA, 22 bp, Homo sapiens
cacccctgtggagcatggtggc

SEQ ID NO: 7365529 - DNA, 22 bp, Homo sapiens
cacccctacctgagtcaggagt

SEQ ID NO: 7365530 - DNA, 20 bp, Homo sapiens
cactgaagacttcttgctca

SEQ ID NO: 7365531 - DNA, 22 bp, Homo sapiens
caccctggctggaggtgcagtg

SEQ ID NO: 7365532 - DNA, 22 bp, Homo sapiens
caccctggctggaggtgcagtg

SEQ ID NO: 7365533 - DNA, 22 bp, Homo sapiens
caccctggcctcgctctctgca

SEQ ID NO: 7365534 - DNA, 22 bp, Homo sapiens
ggcatatgtagcgtgtgttctg

SEQ ID NO: 7365535 - DNA, 22 bp, Homo sapiens
cacccaggctagagtgcagtgg

SEQ ID NO: 7365536 - DNA, 22 bp, Homo sapiens
caccccagcttctcaggataga

SEQ ID NO: 7365537 - DNA, 22 bp, Homo sapiens
caccccaagttctgtccactgc

SEQ ID NO: 7365538 - DNA, 22 bp, Homo sapiens
caccccagtctaaaaccagcct

SEQ ID NO: 7365539 - DNA, 22 bp, Homo sapiens
cacccaggttggagtgcagtgg

SEQ ID NO: 7365540 - DNA, 22 bp, Homo sapiens
cacccaggttggagtgcagtgg

SEQ ID NO: 7365541 - DNA, 22 bp, Homo sapiens
ggcagctgattagcatcaagga

SEQ ID NO: 7365542 - DNA, 22 bp, Homo sapiens
ggcagctgagcatggctacctt

SEQ ID NO: 7365543 - DNA, 22 bp, Homo sapiens
ggcagctgacctagcaccatcc

SEQ ID NO: 7365544 - DNA, 22 bp, Homo sapiens
ggcagctgagatcatgctgttg

SEQ ID NO: 7365545 - DNA, 21 bp, Homo sapiens
ggcagctgaccgcgcggtgca

SEQ ID NO: 7365546 - DNA, 22 bp, Homo sapiens
ggcagctgaagaggaactttgg

SEQ ID NO: 7365547 - DNA, 22 bp, Homo sapiens
cacccactgagctcatgtccca

SEQ ID NO: 7365548 - DNA, 22 bp, Homo sapiens
cacccacattccatcactctgc

SEQ ID NO: 7365549 - DNA, 22 bp, Homo sapiens
caccatctggtaggcattagtg

SEQ ID NO: 7365550 - DNA, 22 bp, Homo sapiens
cacccagagcctgagagggata

SEQ ID NO: 7365551 - DNA, 22 bp, Homo sapiens
ggcactgggagaggtgagacgg

SEQ ID NO: 7365552 - DNA, 22 bp, Homo sapiens
ggcactgggaatgcagtgatga

SEQ ID NO: 7365553 - DNA, 22 bp, Homo sapiens
ggcactgcttcctgagcctgag

SEQ ID NO: 7365554 - DNA, 20 bp, Homo sapiens
ggcactggaagcacacagga

SEQ ID NO: 7365555 - DNA, 16 bp, Homo sapiens
ggcactggcaggtcct

SEQ ID NO: 7365556 - DNA, 22 bp, Homo sapiens
ggcactggcaaagcaaagtctg

SEQ ID NO: 7365557 - DNA, 22 bp, Homo sapiens
ggcactggaaggatcatgtgag

SEQ ID NO: 7365558 - DNA, 22 bp, Homo sapiens
ggcactggaagtcccattgtct

SEQ ID NO: 7365559 - DNA, 22 bp, Homo sapiens
ggcactggagactgttatgaga

SEQ ID NO: 7365560 - DNA, 22 bp, Homo sapiens
ggcagagctctggactgagaac

SEQ ID NO: 7365561 - DNA, 22 bp, Homo sapiens
ggcagcatcttgatattggttt

SEQ ID NO: 7365562 - DNA, 22 bp, Homo sapiens
ggcagcatatattcagtgggca

SEQ ID NO: 7365563 - DNA, 22 bp, Homo sapiens
ggcagcatgggtgcctttgtga

SEQ ID NO: 7365564 - DNA, 22 bp, Homo sapiens
ggcagcagtggctgctattgtc

SEQ ID NO: 7365565 - DNA, 22 bp, Homo sapiens
ggcagatggaagaggctgggtc

SEQ ID NO: 7365566 - DNA, 22 bp, Homo sapiens
ggaggccttgcctgcaggcaca

SEQ ID NO: 7365567 - DNA, 22 bp, Homo sapiens
ggaggccaaggcgggcggatca

SEQ ID NO: 7365568 - DNA, 22 bp, Homo sapiens
ggaggccaaggcaggtggatcg

SEQ ID NO: 7365569 - DNA, 22 bp, Homo sapiens
cacagctgtgagaagggagcct

SEQ ID NO: 7365570 - DNA, 22 bp, Homo sapiens
cacagcttccattagaatgaga

SEQ ID NO: 7365571 - DNA, 22 bp, Homo sapiens
cacactgataggcttgacaggc

SEQ ID NO: 7365572 - DNA, 22 bp, Homo sapiens
cacactgccacattcactcttc

SEQ ID NO: 7365573 - DNA, 22 bp, Homo sapiens
cacactgccacattcactcttc

SEQ ID NO: 7365574 - DNA, 22 bp, Homo sapiens
ggatgggctgaaaggtagcccc

SEQ ID NO: 7365575 - DNA, 22 bp, Homo sapiens
ggatgggcccgggacggcgctg

SEQ ID NO: 7365576 - DNA, 22 bp, Homo sapiens
ggatgttctggggttctcttgt

SEQ ID NO: 7365577 - DNA, 22 bp, Homo sapiens
cacagggaggcagccatgctcc

SEQ ID NO: 7365578 - DNA, 22 bp, Homo sapiens
cacagggagaggaacagcgcag

SEQ ID NO: 7365579 - DNA, 22 bp, Homo sapiens
cacagggagttacagaagcact

SEQ ID NO: 7365580 - DNA, 22 bp, Homo sapiens
cacagggagttacagaagcact

SEQ ID NO: 7365581 - DNA, 22 bp, Homo sapiens
ggagggagggctagaccaaaga

SEQ ID NO: 7365582 - DNA, 22 bp, Homo sapiens
ggagggagggctagaccaaaga

SEQ ID NO: 7365583 - DNA, 22 bp, Homo sapiens
ggagggaggttagattcaagct

SEQ ID NO: 7365584 - DNA, 22 bp, Homo sapiens
ggagggaggttagattcaagct

SEQ ID NO: 7365585 - DNA, 22 bp, Homo sapiens
ggagggaggttagattcaagct

SEQ ID NO: 7365586 - DNA, 22 bp, Homo sapiens
ggagggagcatccccttgctga

SEQ ID NO: 7365587 - DNA, 22 bp, Homo sapiens
ggagggagcatccccttgctga

SEQ ID NO: 7365588 - DNA, 22 bp, Homo sapiens
ggagggagcatccccttgctga

SEQ ID NO: 7365589 - DNA, 23 bp, Homo sapiens
ggatgggcaagcctagtgcctac

SEQ ID NO: 7365590 - DNA, 22 bp, Homo sapiens
ggagggagtcagctgattagaa

SEQ ID NO: 7365591 - DNA, 22 bp, Homo sapiens
ggagggagtcagctgattagaa

SEQ ID NO: 7365592 - DNA, 22 bp, Homo sapiens
ggagggagtttcattcctgccc

SEQ ID NO: 7365593 - DNA, 22 bp, Homo sapiens
ggagggagtttcattcctgccc

SEQ ID NO: 7365594 - DNA, 22 bp, Homo sapiens
caaagtatgaaccagtttctct

SEQ ID NO: 7365595 - DNA, 22 bp, Homo sapiens
caaagtatgaaccagtttctct

SEQ ID NO: 7365596 - DNA, 22 bp, Homo sapiens
caaaggtttcacagtagcccat

SEQ ID NO: 7365597 - DNA, 22 bp, Homo sapiens
caaaggttatgaaccacttgta

SEQ ID NO: 7365598 - DNA, 22 bp, Homo sapiens
caacagtttatagtgttatctt

SEQ ID NO: 7365599 - DNA, 22 bp, Homo sapiens
caacagttcagttgagctcaac

SEQ ID NO: 7365600 - DNA, 22 bp, Homo sapiens
caacagtgattctgcatgagga

SEQ ID NO: 7365601 - DNA, 22 bp, Homo sapiens
caacatatgattttgtatataa

SEQ ID NO: 7365602 - DNA, 22 bp, Homo sapiens
caacatcagtcctcatgagaca

SEQ ID NO: 7365603 - DNA, 22 bp, Homo sapiens
caacatatttttatgtaggtca

SEQ ID NO: 7365604 - DNA, 21 bp, Homo sapiens
gctgcatcaatctacccaggg

SEQ ID NO: 7365605 - DNA, 22 bp, Homo sapiens
gctgcagtgagccaagatcgtg

SEQ ID NO: 7365606 - DNA, 19 bp, Homo sapiens
gctgcattcatggtgagtg

SEQ ID NO: 7365607 - DNA, 22 bp, Homo sapiens
caacactgattatggctgagct

SEQ ID NO: 7365608 - DNA, 21 bp, Homo sapiens
caagctgcctgagggtggttg

SEQ ID NO: 7365609 - DNA, 22 bp, Homo sapiens
caaggacaacttcatattgtgg

SEQ ID NO: 7365610 - DNA, 22 bp, Homo sapiens
caaggacagcgtcaggtgcaac

SEQ ID NO: 7365611 - DNA, 22 bp, Homo sapiens
caaggacactgatgttcatcct

SEQ ID NO: 7365612 - DNA, 22 bp, Homo sapiens
caaggagaaaacggcttctgaa

SEQ ID NO: 7365613 - DNA, 22 bp, Homo sapiens
caaggaggaagatgcaggggac

SEQ ID NO: 7365614 - DNA, 22 bp, Homo sapiens
caagagttgagggatgtcagtt

SEQ ID NO: 7365615 - DNA, 22 bp, Homo sapiens
caagagttgaggttcaaatggg

SEQ ID NO: 7365616 - DNA, 22 bp, Homo sapiens
caagatatcaatgacatagtat

SEQ ID NO: 7365617 - DNA, 22 bp, Homo sapiens
gctgccttgaacatcctaagta

SEQ ID NO: 7365618 - DNA, 22 bp, Homo sapiens
gctgccttcttctgactctatt

SEQ ID NO: 7365619 - DNA, 22 bp, Homo sapiens
gctgccttctgagaagttaaat

SEQ ID NO: 7365620 - DNA, 22 bp, Homo sapiens
gctgccttctggaggaagtgaa

SEQ ID NO: 7365621 - DNA, 18 bp, Homo sapiens
gctgccttcccagtcaag

SEQ ID NO: 7365622 - DNA, 22 bp, Homo sapiens
gctgccttcccaggcctttgct

SEQ ID NO: 7365623 - DNA, 22 bp, Homo sapiens
gctgccttccctgttctttcag

SEQ ID NO: 7365624 - DNA, 22 bp, Homo sapiens
gctgccttcccggaatgtcatc

SEQ ID NO: 7365625 - DNA, 22 bp, Homo sapiens
gctgccttggtagtgaccatct

SEQ ID NO: 7365626 - DNA, 20 bp, Homo sapiens
gctgccttgtcctgcttggt

SEQ ID NO: 7365627 - DNA, 22 bp, Homo sapiens
gctgcctttagggggtgctcag

SEQ ID NO: 7365628 - DNA, 22 bp, Homo sapiens
gctgccttgccctcttcccata

SEQ ID NO: 7365629 - DNA, 22 bp, Homo sapiens
gctgccttgcttactccactgc

SEQ ID NO: 7365630 - DNA, 20 bp, Homo sapiens
gctgccttggatggctacac

SEQ ID NO: 7365631 - DNA, 22 bp, Homo sapiens
gctgccttgccaggggcagaaa

SEQ ID NO: 7365632 - DNA, 22 bp, Homo sapiens
gctgccttgaacttggcctggg

SEQ ID NO: 7365633 - DNA, 22 bp, Homo sapiens
gctgccttccataatgtacgta

SEQ ID NO: 7365634 - DNA, 22 bp, Homo sapiens
gctgccttccaaagagttttat

SEQ ID NO: 7365635 - DNA, 22 bp, Homo sapiens
caacctctatcggtcaggaagc

SEQ ID NO: 7365636 - DNA, 22 bp, Homo sapiens
gctgctggaagcatgcgatgaa

SEQ ID NO: 7365637 - DNA, 22 bp, Homo sapiens
gctgccttttgctcctcccacc

SEQ ID NO: 7365638 - DNA, 22 bp, Homo sapiens
gctgcctttgtgagccaagggg

SEQ ID NO: 7365639 - DNA, 22 bp, Homo sapiens
gctgccttttaaagcctcgctt

SEQ ID NO: 7365640 - DNA, 22 bp, Homo sapiens
caagacaagatctaagcatgct

SEQ ID NO: 7365641 - DNA, 22 bp, Homo sapiens
caagacaatgggtaagtgtaac

SEQ ID NO: 7365642 - DNA, 22 bp, Homo sapiens
caagagctgcaaatagcgtgac

SEQ ID NO: 7365643 - DNA, 22 bp, Homo sapiens
caaggcagaattcagactcagg

SEQ ID NO: 7365644 - DNA, 20 bp, Homo sapiens
caaggcagaccagagtgagt

SEQ ID NO: 7365645 - DNA, 22 bp, Homo sapiens
caaggcagcgttcctttctgga

SEQ ID NO: 7365646 - DNA, 22 bp, Homo sapiens
caaggcagctattgtctccata

SEQ ID NO: 7365647 - DNA, 22 bp, Homo sapiens
caaggcagctattgtctccata

SEQ ID NO: 7365648 - DNA, 22 bp, Homo sapiens
cacaaaagtaggaggcaggcgg

SEQ ID NO: 7365649 - DNA, 22 bp, Homo sapiens
gcttctcctcccgctcccaggc

SEQ ID NO: 7365650 - DNA, 22 bp, Homo sapiens
gcttctccagaccttcatcccc

SEQ ID NO: 7365651 - DNA, 22 bp, Homo sapiens
cacacattaatatcaaaggctc

SEQ ID NO: 7365652 - DNA, 22 bp, Homo sapiens
cacaatttccaagtcatgttat

SEQ ID NO: 7365653 - DNA, 22 bp, Homo sapiens
cacaattatagaagaaagcata

SEQ ID NO: 7365654 - DNA, 23 bp, Homo sapiens
cacacccatcactaagagctcct

SEQ ID NO: 7365655 - DNA, 22 bp, Homo sapiens
cacacccaaatttctctctcag

SEQ ID NO: 7365656 - DNA, 22 bp, Homo sapiens
cacaccttaggcctgagcgctt

SEQ ID NO: 7365657 - DNA, 22 bp, Homo sapiens
cacacctgcctgccgtgtgctg

SEQ ID NO: 7365658 - DNA, 22 bp, Homo sapiens
cacaccagatggcagcgtggga

SEQ ID NO: 7365659 - DNA, 23 bp, Homo sapiens
cacaccaggagccgtctgggcca

SEQ ID NO: 7365660 - DNA, 22 bp, Homo sapiens
cacacattccaaaatcaagggt

SEQ ID NO: 7365661 - DNA, 22 bp, Homo sapiens
cacacattgagcagctgtttgt

SEQ ID NO: 7365662 - DNA, 22 bp, Homo sapiens
cacacattgagcagctgtttgt

SEQ ID NO: 7365663 - DNA, 22 bp, Homo sapiens
cacacattgaattcattcttgt

SEQ ID NO: 7365664 - DNA, 22 bp, Homo sapiens
cacacattgaattcattcttgt

SEQ ID NO: 7365665 - DNA, 22 bp, Homo sapiens
cacaactttaggaaccacattc

SEQ ID NO: 7365666 - DNA, 22 bp, Homo sapiens
ggaaaatactgattcatgccat

SEQ ID NO: 7365667 - DNA, 17 bp, Homo sapiens
ggaaaaggatgatacag

SEQ ID NO: 7365668 - DNA, 22 bp, Homo sapiens
cacaataaatgtttgctgatga

SEQ ID NO: 7365669 - DNA, 22 bp, Homo sapiens
cacaatgcagcatgtaaatgca

SEQ ID NO: 7365670 - DNA, 22 bp, Homo sapiens
cacaaaatatcaagcactttta

SEQ ID NO: 7365671 - DNA, 22 bp, Homo sapiens
cacaaaatatcaagcactttta

SEQ ID NO: 7365672 - DNA, 22 bp, Homo sapiens
cacaaaatatcaagcactttta

SEQ ID NO: 7365673 - DNA, 22 bp, Homo sapiens
cacaaaatctttctcgattatt

SEQ ID NO: 7365674 - DNA, 22 bp, Homo sapiens
cacaaagtgttagatgccactc

SEQ ID NO: 7365675 - DNA, 22 bp, Homo sapiens
ggaaaactgaggctctcagcag

SEQ ID NO: 7365676 - DNA, 22 bp, Homo sapiens
atgcagaagactgaaaagctga

SEQ ID NO: 7365677 - DNA, 22 bp, Homo sapiens
atgcagaagcagaacttacaca

SEQ ID NO: 7365678 - DNA, 22 bp, Homo sapiens
atgcagaagcagaacttacaca

SEQ ID NO: 7365679 - DNA, 22 bp, Homo sapiens
atgcagagcttccagtggcctg

SEQ ID NO: 7365680 - DNA, 23 bp, Homo sapiens
atgcagagaataacaaatgccat

SEQ ID NO: 7365681 - DNA, 22 bp, Homo sapiens
atgcagataagaatcaggtttg

SEQ ID NO: 7365682 - DNA, 22 bp, Homo sapiens
atgcaaacatgtttcctctaag

SEQ ID NO: 7365683 - DNA, 22 bp, Homo sapiens
atgcaaaagtagttgcagtttt

SEQ ID NO: 7365684 - DNA, 22 bp, Homo sapiens
atgcaaataaagcaactataca

SEQ ID NO: 7365685 - DNA, 22 bp, Homo sapiens
atgcattcagcggaatgcttag

SEQ ID NO: 7365686 - DNA, 22 bp, Homo sapiens
atgcattcagcggaatgcttag

SEQ ID NO: 7365687 - DNA, 22 bp, Homo sapiens
atgcattcatgaagattgcaca

SEQ ID NO: 7365688 - DNA, 22 bp, Homo sapiens
atgcatgtgtgagagcaagagg

SEQ ID NO: 7365689 - DNA, 22 bp, Homo sapiens
atgcatgtattatctagatgag

SEQ ID NO: 7365690 - DNA, 22 bp, Homo sapiens
atgcatttatgtgtgtacattg

SEQ ID NO: 7365691 - DNA, 22 bp, Homo sapiens
atgcatttgacgggatatattt

SEQ ID NO: 7365692 - DNA, 22 bp, Homo sapiens
atgcattgaggatgacatgagt

SEQ ID NO: 7365693 - DNA, 22 bp, Homo sapiens
atgcattctgtagagcatttat

SEQ ID NO: 7365694 - DNA, 22 bp, Homo sapiens
atgcattctagcctggacaaca

SEQ ID NO: 7365695 - DNA, 22 bp, Homo sapiens
atgcattcattcattctttcta

SEQ ID NO: 7365696 - DNA, 21 bp, Homo sapiens
atgcattcctcccctttcctc

SEQ ID NO: 7365697 - DNA, 22 bp, Homo sapiens
atgcattctggaaagtagcaat

SEQ ID NO: 7365698 - DNA, 22 bp, Homo sapiens
atgcatatgccgtagaataagt

SEQ ID NO: 7365699 - DNA, 22 bp, Homo sapiens
atgcatgcattgtttatcatgg

SEQ ID NO: 7365700 - DNA, 22 bp, Homo sapiens
atgcatgcttcttatagtactt

SEQ ID NO: 7365701 - DNA, 22 bp, Homo sapiens
atgcaggaagtcggggagcggg

SEQ ID NO: 7365702 - DNA, 22 bp, Homo sapiens
atgcaggaagagccctggagct

SEQ ID NO: 7365703 - DNA, 22 bp, Homo sapiens
atgcaggacataagcatcgaca

SEQ ID NO: 7365704 - DNA, 23 bp, Homo sapiens
atgcaggacttataaggtaaggt

SEQ ID NO: 7365705 - DNA, 22 bp, Homo sapiens
atgcagcttcaggattatgatg

SEQ ID NO: 7365706 - DNA, 22 bp, Homo sapiens
atgcagctgctgacagctttca

SEQ ID NO: 7365707 - DNA, 22 bp, Homo sapiens
atgcagctgctcttcctctatt

SEQ ID NO: 7365708 - DNA, 20 bp, Homo sapiens
atgcagctggagttggggtg

SEQ ID NO: 7365709 - DNA, 22 bp, Homo sapiens
atgcagctgacattttcatgtt

SEQ ID NO: 7365710 - DNA, 22 bp, Homo sapiens
atgcagctgagggtagtggagc

SEQ ID NO: 7365711 - DNA, 22 bp, Homo sapiens
atgataagaacacagtatgggg

SEQ ID NO: 7365712 - DNA, 22 bp, Homo sapiens
atgataagccatgtcgtggtca

SEQ ID NO: 7365713 - DNA, 22 bp, Homo sapiens
atgagttgaagctacaagaggc

SEQ ID NO: 7365714 - DNA, 23 bp, Homo sapiens
atgataatgccattaactttgat

SEQ ID NO: 7365715 - DNA, 22 bp, Homo sapiens
atgattcagcccaatttttcta

SEQ ID NO: 7365716 - DNA, 22 bp, Homo sapiens
atgaggtattcgtaatatttcc

SEQ ID NO: 7365717 - DNA, 19 bp, Homo sapiens
atgaggtagcagctggtgc

SEQ ID NO: 7365718 - DNA, 22 bp, Homo sapiens
atgaggtaacagcttatcaaca

SEQ ID NO: 7365719 - DNA, 22 bp, Homo sapiens
atgaggtactagtatatacgta

SEQ ID NO: 7365720 - DNA, 22 bp, Homo sapiens
atgaggccagaccactctgcat

SEQ ID NO: 7365721 - DNA, 19 bp, Homo sapiens
atgaggaactgaggctcag

SEQ ID NO: 7365722 - DNA, 22 bp, Homo sapiens
atgaagcagatttattactcac

SEQ ID NO: 7365723 - DNA, 22 bp, Homo sapiens
atgaagcagcgttgtagagtga

SEQ ID NO: 7365724 - DNA, 22 bp, Homo sapiens
atgaagcagcctcttccctctg

SEQ ID NO: 7365725 - DNA, 22 bp, Homo sapiens
atgaggcagagggctgtgccag

SEQ ID NO: 7365726 - DNA, 22 bp, Homo sapiens
atgaggcagcccttcccttctc

SEQ ID NO: 7365727 - DNA, 22 bp, Homo sapiens
atgaagcagactcaggtggtgc

SEQ ID NO: 7365728 - DNA, 22 bp, Homo sapiens
atgaagcagaatttcccactct

SEQ ID NO: 7365729 - DNA, 22 bp, Homo sapiens
atgaagatttcccagagacatg

SEQ ID NO: 7365730 - DNA, 22 bp, Homo sapiens
atgaagcaacagccctcctatt

SEQ ID NO: 7365731 - DNA, 22 bp, Homo sapiens
atgaagatttataattgccttt

SEQ ID NO: 7365732 - DNA, 22 bp, Homo sapiens
atgaagattctatttatcactt

SEQ ID NO: 7365733 - DNA, 22 bp, Homo sapiens
atgaagataagaccaggctgga

SEQ ID NO: 7365734 - DNA, 22 bp, Homo sapiens
atgaagatgtgaaggctggatt

SEQ ID NO: 7365735 - DNA, 22 bp, Homo sapiens
atgaagatggttcaactggcct

SEQ ID NO: 7365736 - DNA, 21 bp, Homo sapiens
atgaagatgacaatttgagag

SEQ ID NO: 7365737 - DNA, 22 bp, Homo sapiens
atgaagatacaggcagggccat

SEQ ID NO: 7365738 - DNA, 22 bp, Homo sapiens
atgaggcaggtggaggctgcca

SEQ ID NO: 7365739 - DNA, 22 bp, Homo sapiens
atgaggcaggtggaggctgcca

SEQ ID NO: 7365740 - DNA, 22 bp, Homo sapiens
atgaggcaggatattaactttt

SEQ ID NO: 7365741 - DNA, 22 bp, Homo sapiens
atgaggcaggagcggggaccct

SEQ ID NO: 7365742 - DNA, 22 bp, Homo sapiens
atgaggcaggagtgcagtggca

SEQ ID NO: 7365743 - DNA, 22 bp, Homo sapiens
atgaggcagctggctttctccc

SEQ ID NO: 7365744 - DNA, 22 bp, Homo sapiens
gaaagcaagttgactgcagaat

SEQ ID NO: 7365745 - DNA, 22 bp, Homo sapiens
gaaagcaatttgtgtaatctgt

SEQ ID NO: 7365746 - DNA, 22 bp, Homo sapiens
cttggctccaatcccagctctg

SEQ ID NO: 7365747 - DNA, 22 bp, Homo sapiens
cttggcccagttgccaaggaaa

SEQ ID NO: 7365748 - DNA, 22 bp, Homo sapiens
cttggcccggagccccatgaag

SEQ ID NO: 7365749 - DNA, 22 bp, Homo sapiens
cttggcccagttgccaaggaaa

SEQ ID NO: 7365750 - DNA, 22 bp, Homo sapiens
atcttgaaggttctaccataca

SEQ ID NO: 7365751 - DNA, 22 bp, Homo sapiens
atcttgaaatactttctagaat

SEQ ID NO: 7365752 - DNA, 22 bp, Homo sapiens
atcttgaaggttctaccataca

SEQ ID NO: 7365753 - DNA, 22 bp, Homo sapiens
atcttgaaatactttctagaat

SEQ ID NO: 7365754 - DNA, 22 bp, Homo sapiens
atcttctcaagcagcatcctgt

SEQ ID NO: 7365755 - DNA, 22 bp, Homo sapiens
cttgctaatcactcggtgtcat

SEQ ID NO: 7365756 - DNA, 22 bp, Homo sapiens
cttgcctttgtcttcaaaggct

SEQ ID NO: 7365757 - DNA, 22 bp, Homo sapiens
cttgccttcttttcctatagaa

SEQ ID NO: 7365758 - DNA, 22 bp, Homo sapiens
cttgccttctgttcctatagaa

SEQ ID NO: 7365759 - DNA, 22 bp, Homo sapiens
cttgccttctctggggtggcag

SEQ ID NO: 7365760 - DNA, 22 bp, Homo sapiens
cttgatattttaaacatacagt

SEQ ID NO: 7365761 - DNA, 22 bp, Homo sapiens
atctatgtgcctttgtatagaa

SEQ ID NO: 7365762 - DNA, 22 bp, Homo sapiens
atctatgtgcctttgtatagaa

SEQ ID NO: 7365763 - DNA, 22 bp, Homo sapiens
atctagaacaattattgtcaca

SEQ ID NO: 7365764 - DNA, 22 bp, Homo sapiens
atctagaacaattattgtcaca

SEQ ID NO: 7365765 - DNA, 22 bp, Homo sapiens
atctacatgttgatttaaagaa

SEQ ID NO: 7365766 - DNA, 22 bp, Homo sapiens
cttttcaaacgctgatgtcagt

SEQ ID NO: 7365767 - DNA, 22 bp, Homo sapiens
cttttcaaacgctgatgtcagt

SEQ ID NO: 7365768 - DNA, 19 bp, Homo sapiens
cttttcaagccatcagttt

SEQ ID NO: 7365769 - DNA, 22 bp, Homo sapiens
atgaaatatcttgaagaaattc

SEQ ID NO: 7365770 - DNA, 22 bp, Homo sapiens
atgaaatatttcagagcagagt

SEQ ID NO: 7365771 - DNA, 22 bp, Homo sapiens
atctttgggcaatgatgaggga

SEQ ID NO: 7365772 - DNA, 22 bp, Homo sapiens
atctttgttttgatgcagatct

SEQ ID NO: 7365773 - DNA, 22 bp, Homo sapiens
atgaaaacggaccagagctatt

SEQ ID NO: 7365774 - DNA, 22 bp, Homo sapiens
cttgtttaataataccttagca

SEQ ID NO: 7365775 - DNA, 22 bp, Homo sapiens
atgaaaagttcgatctagaagg

SEQ ID NO: 7365776 - DNA, 22 bp, Homo sapiens
atggagcagcagaaggggcttg

SEQ ID NO: 7365777 - DNA, 22 bp, Homo sapiens
atggagcaaatggggctgcagg

SEQ ID NO: 7365778 - DNA, 22 bp, Homo sapiens
atggagactgcgtctgccatcc

SEQ ID NO: 7365779 - DNA, 22 bp, Homo sapiens
gagaaatagattcatggtagat

SEQ ID NO: 7365780 - DNA, 22 bp, Homo sapiens
gagaaagggataatttgaagag

SEQ ID NO: 7365781 - DNA, 22 bp, Homo sapiens
gagaaagggataatttgaagag

SEQ ID NO: 7365782 - DNA, 22 bp, Homo sapiens
gagaaaggtactattccctcca

SEQ ID NO: 7365783 - DNA, 22 bp, Homo sapiens
atggactaggaaagataaagat

SEQ ID NO: 7365784 - DNA, 22 bp, Homo sapiens
atggactagccataagagaact

SEQ ID NO: 7365785 - DNA, 22 bp, Homo sapiens
atggaagaaagagacaatttga

SEQ ID NO: 7365786 - DNA, 21 bp, Homo sapiens
atggaaattggcaaatgctac

SEQ ID NO: 7365787 - DNA, 22 bp, Homo sapiens
atggaaaaggctgatttcatta

SEQ ID NO: 7365788 - DNA, 22 bp, Homo sapiens
gacagaggcaagaccagaagcc

SEQ ID NO: 7365789 - DNA, 22 bp, Homo sapiens
gagccagccttcttctgaggtc

SEQ ID NO: 7365790 - DNA, 22 bp, Homo sapiens
gagccagccttcttctgaggtc

SEQ ID NO: 7365791 - DNA, 22 bp, Homo sapiens
gagccagcctccgcctctctcc

SEQ ID NO: 7365792 - DNA, 22 bp, Homo sapiens
gagccagcctccgcctctctcc

SEQ ID NO: 7365793 - DNA, 22 bp, Homo sapiens
gagcagtgactggagcatgaga

SEQ ID NO: 7365794 - DNA, 22 bp, Homo sapiens
atggccctgaccttgatgacct

SEQ ID NO: 7365795 - DNA, 22 bp, Homo sapiens
atggcccaagtgccctgacctg

SEQ ID NO: 7365796 - DNA, 22 bp, Homo sapiens
atggcccaaactgcaattactt

SEQ ID NO: 7365797 - DNA, 22 bp, Homo sapiens
atggcccaaaacctcctccctc

SEQ ID NO: 7365798 - DNA, 22 bp, Homo sapiens
atggcccactctggtcccggca

SEQ ID NO: 7365799 - DNA, 22 bp, Homo sapiens
atggcccagaagtttggaaagg

SEQ ID NO: 7365800 - DNA, 22 bp, Homo sapiens
atggcccagactcagactggtg

SEQ ID NO: 7365801 - DNA, 22 bp, Homo sapiens
atggcccaggcaggctggtact

SEQ ID NO: 7365802 - DNA, 22 bp, Homo sapiens
atggcccaggccaggatccagc

SEQ ID NO: 7365803 - DNA, 22 bp, Homo sapiens
atggcccaggcctcctgtggct

SEQ ID NO: 7365804 - DNA, 22 bp, Homo sapiens
atggccagtgtttccctcagtt

SEQ ID NO: 7365805 - DNA, 19 bp, Homo sapiens
atggccagtttagaggttt

SEQ ID NO: 7365806 - DNA, 22 bp, Homo sapiens
gagccagcgccttgcctctggg

SEQ ID NO: 7365807 - DNA, 22 bp, Homo sapiens
gagccagctgagctgcactgtc

SEQ ID NO: 7365808 - DNA, 22 bp, Homo sapiens
gagccagctgagctgcactgtc

SEQ ID NO: 7365809 - DNA, 22 bp, Homo sapiens
atggccagtcaagcctctggct

SEQ ID NO: 7365810 - DNA, 22 bp, Homo sapiens
gagaggaactcccagtgcctgg

SEQ ID NO: 7365811 - DNA, 22 bp, Homo sapiens
gagagctgtgttcattctacca

SEQ ID NO: 7365812 - DNA, 22 bp, Homo sapiens
atggcagctttgaatttcttga

SEQ ID NO: 7365813 - DNA, 22 bp, Homo sapiens
atggcagagggattgaacagct

SEQ ID NO: 7365814 - DNA, 22 bp, Homo sapiens
atgtacattttcctaatgtttt

SEQ ID NO: 7365815 - DNA, 22 bp, Homo sapiens
atgtacattcttctcaccgaag

SEQ ID NO: 7365816 - DNA, 22 bp, Homo sapiens
gaggagctgcagggggagtcta

SEQ ID NO: 7365817 - DNA, 22 bp, Homo sapiens
gaggagctgatatttataatga

SEQ ID NO: 7365818 - DNA, 22 bp, Homo sapiens
gaggagctgaggctgaggcctc

SEQ ID NO: 7365819 - DNA, 19 bp, Homo sapiens
atgtacccagtgtcaatcc

SEQ ID NO: 7365820 - DNA, 22 bp, Homo sapiens
gaggccagggatgcaatgagag

SEQ ID NO: 7365821 - DNA, 22 bp, Homo sapiens
gaggagctgggctgagagggtc

SEQ ID NO: 7365822 - DNA, 22 bp, Homo sapiens
gaggagctgggaccctgtcatc

SEQ ID NO: 7365823 - DNA, 22 bp, Homo sapiens
gaggagctggcgctatttatga

SEQ ID NO: 7365824 - DNA, 22 bp, Homo sapiens
gaggagctggctgtcgggaggc

SEQ ID NO: 7365825 - DNA, 22 bp, Homo sapiens
atggtcacaccactgtactcca

SEQ ID NO: 7365826 - DNA, 22 bp, Homo sapiens
atgtacatctttataacaagct

SEQ ID NO: 7365827 - DNA, 22 bp, Homo sapiens
atggtaaccagaagactatgac

SEQ ID NO: 7365828 - DNA, 21 bp, Homo sapiens
atggtcaattcattagaaaga

SEQ ID NO: 7365829 - DNA, 22 bp, Homo sapiens
atggtcaaagataaagtgatct

SEQ ID NO: 7365830 - DNA, 22 bp, Homo sapiens
atggtcaaatatttgaaatttg

SEQ ID NO: 7365831 - DNA, 22 bp, Homo sapiens
gaggggagaaggcactaaccag

SEQ ID NO: 7365832 - DNA, 22 bp, Homo sapiens
gaggggagaggcttatggatca

SEQ ID NO: 7365833 - DNA, 22 bp, Homo sapiens
gaggggagaggcttatggatca

SEQ ID NO: 7365834 - DNA, 22 bp, Homo sapiens
gaggggagacagggaaatcagt

SEQ ID NO: 7365835 - DNA, 22 bp, Homo sapiens
atgtctttataaatgtataatg

SEQ ID NO: 7365836 - DNA, 22 bp, Homo sapiens
atgtctttataaatgtataatg

SEQ ID NO: 7365837 - DNA, 22 bp, Homo sapiens
gaggcctgggttacctactcgt

SEQ ID NO: 7365838 - DNA, 22 bp, Homo sapiens
gaggcctggctgggaggaggtg

SEQ ID NO: 7365839 - DNA, 22 bp, Homo sapiens
gaggcctgggagcctgtcctcc

SEQ ID NO: 7365840 - DNA, 22 bp, Homo sapiens
gaggctgctgccatcattaggt

SEQ ID NO: 7365841 - DNA, 22 bp, Homo sapiens
gaggctgctgagagccctgttt

SEQ ID NO: 7365842 - DNA, 22 bp, Homo sapiens
atgtctttgccatagttcatat

SEQ ID NO: 7365843 - DNA, 22 bp, Homo sapiens
atgtctttcttgtgtcccaaga

SEQ ID NO: 7365844 - DNA, 22 bp, Homo sapiens
atgtctttgccatagttcatat

SEQ ID NO: 7365845 - DNA, 22 bp, Homo sapiens
atgtctttcttgtgtcccaaga

SEQ ID NO: 7365846 - DNA, 22 bp, Homo sapiens
atgtctttcttatggtctgttg

SEQ ID NO: 7365847 - DNA, 22 bp, Homo sapiens
gcctccccaggggtgtcatgag

SEQ ID NO: 7365848 - DNA, 22 bp, Homo sapiens
gcctccccaagcagcagggatt

SEQ ID NO: 7365849 - DNA, 22 bp, Homo sapiens
gcctccccaaagtgctgacagc

SEQ ID NO: 7365850 - DNA, 21 bp, Homo sapiens
gcctctccaaatcctgccttc

SEQ ID NO: 7365851 - DNA, 21 bp, Homo sapiens
gcctctccaaatcctgccttc

SEQ ID NO: 7365852 - DNA, 22 bp, Homo sapiens
gcctctcctggagaaggcaggg

SEQ ID NO: 7365853 - DNA, 22 bp, Homo sapiens
gcctctcctcttaataccatta

SEQ ID NO: 7365854 - DNA, 22 bp, Homo sapiens
gcctctccgagccactgcctct

SEQ ID NO: 7365855 - DNA, 22 bp, Homo sapiens
gcctctcctcttaataccatta

SEQ ID NO: 7365856 - DNA, 22 bp, Homo sapiens
gcctctccgagccactgcctct

SEQ ID NO: 7365857 - DNA, 22 bp, Homo sapiens
gcctctcctggagaaggcaggg

SEQ ID NO: 7365858 - DNA, 22 bp, Homo sapiens
atttctcactgagcagataaaa

SEQ ID NO: 7365859 - DNA, 22 bp, Homo sapiens
atttctcactgagcagataaaa

SEQ ID NO: 7365860 - DNA, 22 bp, Homo sapiens
atttctcactcacagtccatgt

SEQ ID NO: 7365861 - DNA, 22 bp, Homo sapiens
atttctcacagtggaatctctg

SEQ ID NO: 7365862 - DNA, 22 bp, Homo sapiens
atttctcacaaagttgcttatc

SEQ ID NO: 7365863 - DNA, 22 bp, Homo sapiens
atttctcacaaagttgcttatc

SEQ ID NO: 7365864 - DNA, 22 bp, Homo sapiens
atttctcaaccaggtcaaaaag

SEQ ID NO: 7365865 - DNA, 22 bp, Homo sapiens
gcctccagcccacgcaggcctg

SEQ ID NO: 7365866 - DNA, 22 bp, Homo sapiens
atttctcagtgaaatgacaggc

SEQ ID NO: 7365867 - DNA, 22 bp, Homo sapiens
atttctcagtgaaatgacaggc

SEQ ID NO: 7365868 - DNA, 21 bp, Homo sapiens
gcctcaccatgtcaagccagg

SEQ ID NO: 7365869 - DNA, 22 bp, Homo sapiens
atttctcagtgtacattatgtt

SEQ ID NO: 7365870 - DNA, 18 bp, Homo sapiens
gcctgggaggaggaaatg

SEQ ID NO: 7365871 - DNA, 22 bp, Homo sapiens
gcctgggagcacatcggggtcc

SEQ ID NO: 7365872 - DNA, 22 bp, Homo sapiens
gcctgggagattaattaggaag

SEQ ID NO: 7365873 - DNA, 22 bp, Homo sapiens
gcctgggagatgcgttgtggcc

SEQ ID NO: 7365874 - DNA, 22 bp, Homo sapiens
gcctgggagagggatagtgcag

SEQ ID NO: 7365875 - DNA, 22 bp, Homo sapiens
gcctgctgggagacacccccag

SEQ ID NO: 7365876 - DNA, 22 bp, Homo sapiens
gcctgctggctgtccattgcag

SEQ ID NO: 7365877 - DNA, 22 bp, Homo sapiens
gcctgctggatgtggccaggcc

SEQ ID NO: 7365878 - DNA, 22 bp, Homo sapiens
gcctgctggatcaagcttatgc

SEQ ID NO: 7365879 - DNA, 22 bp, Homo sapiens
gcctgctggaggagcctcaggg

SEQ ID NO: 7365880 - DNA, 22 bp, Homo sapiens
gcctgctggctggaaattctcc

SEQ ID NO: 7365881 - DNA, 22 bp, Homo sapiens
gcctgctggatgtggccaggcc

SEQ ID NO: 7365882 - DNA, 22 bp, Homo sapiens
gcctgctgcatccaggctattg

SEQ ID NO: 7365883 - DNA, 22 bp, Homo sapiens
gcctgctgccaccctggctccg

SEQ ID NO: 7365884 - DNA, 22 bp, Homo sapiens
gcctgctgccaccctggctccg

SEQ ID NO: 7365885 - DNA, 21 bp, Homo sapiens
gcctgctgcctgtggccggtc

SEQ ID NO: 7365886 - DNA, 22 bp, Homo sapiens
gcctgctgccagaggcaaacac

SEQ ID NO: 7365887 - DNA, 21 bp, Homo sapiens
gcctgctgcctgtggccggtc

SEQ ID NO: 7365888 - DNA, 22 bp, Homo sapiens
gcctgctggaggagcctcaggg

SEQ ID NO: 7365889 - DNA, 22 bp, Homo sapiens
gcctgctggacattggccggcc

SEQ ID NO: 7365890 - DNA, 22 bp, Homo sapiens
gcctgctggacattggccggcc

SEQ ID NO: 7365891 - DNA, 22 bp, Homo sapiens
gcctgctgaagccagagtgtgt

SEQ ID NO: 7365892 - DNA, 22 bp, Homo sapiens
gcctgctgagggaagttgggca

SEQ ID NO: 7365893 - DNA, 22 bp, Homo sapiens
gcctgctgagggaagttgggca

SEQ ID NO: 7365894 - DNA, 22 bp, Homo sapiens
gcctgctgaagccagagtgtgt

SEQ ID NO: 7365895 - DNA, 22 bp, Homo sapiens
gcctgctgaacctcatgcagtc

SEQ ID NO: 7365896 - DNA, 22 bp, Homo sapiens
gctcaggcaaatttctggtgaa

SEQ ID NO: 7365897 - DNA, 22 bp, Homo sapiens
caaaggcaacatatacttgttt

SEQ ID NO: 7365898 - DNA, 22 bp, Homo sapiens
caaaggcaatcttgttctctgg

SEQ ID NO: 7365899 - DNA, 22 bp, Homo sapiens
caaaggcacacatacctttctg

SEQ ID NO: 7365900 - DNA, 22 bp, Homo sapiens
caaaggcaggccccctgtgcag

SEQ ID NO: 7365901 - DNA, 22 bp, Homo sapiens
caaaggcacacatacctttctg

SEQ ID NO: 7365902 - DNA, 22 bp, Homo sapiens
gctcaggcaggagtgcagtggc

SEQ ID NO: 7365903 - DNA, 22 bp, Homo sapiens
gctcaggaaatagtttagtgtt

SEQ ID NO: 7365904 - DNA, 22 bp, Homo sapiens
gctcagcttgggagcgcccggt

SEQ ID NO: 7365905 - DNA, 22 bp, Homo sapiens
caaacttgtctatctaggaatc

SEQ ID NO: 7365906 - DNA, 22 bp, Homo sapiens
caaacttggtggattagtacag

SEQ ID NO: 7365907 - DNA, 22 bp, Homo sapiens
caaactttcagttataacatga

SEQ ID NO: 7365908 - DNA, 22 bp, Homo sapiens
caaactttgcaaaacttacagt

SEQ ID NO: 7365909 - DNA, 22 bp, Homo sapiens
caaacattgcactttctgctat

SEQ ID NO: 7365910 - DNA, 22 bp, Homo sapiens
gcgcaggacgcccagttgcctt

SEQ ID NO: 7365911 - DNA, 22 bp, Homo sapiens
gcgagggcacgcggttgaaggc

SEQ ID NO: 7365912 - DNA, 23 bp, Homo sapiens
gcctgggagttgcgatctgcccg

SEQ ID NO: 7365913 - DNA, 22 bp, Homo sapiens
gcctgggagtgcacagtgaggt

SEQ ID NO: 7365914 - DNA, 22 bp, Homo sapiens
gcctgggagggcagcagtgtgg

SEQ ID NO: 7365915 - DNA, 16 bp, Homo sapiens
gcctgggagggaacag

SEQ ID NO: 7365916 - DNA, 23 bp, Homo sapiens
gcctgtgcctatgcccagctctg

SEQ ID NO: 7365917 - DNA, 22 bp, Homo sapiens
gcctgtcctcccctgcgctgag

SEQ ID NO: 7365918 - DNA, 22 bp, Homo sapiens
gcctgtcctggatgctctgcaa

SEQ ID NO: 7365919 - DNA, 22 bp, Homo sapiens
caaaacattctctgcagcaggg

SEQ ID NO: 7365920 - DNA, 22 bp, Homo sapiens
caaaactgtctagagagagaag

SEQ ID NO: 7365921 - DNA, 22 bp, Homo sapiens
gcgagcagacagctgtcctgga

SEQ ID NO: 7365922 - DNA, 22 bp, Homo sapiens
gcgagcagacccccatcttctc

SEQ ID NO: 7365923 - DNA, 22 bp, Homo sapiens
gcctgtgcctcagcctgcagcc

SEQ ID NO: 7365924 - DNA, 22 bp, Homo sapiens
caaaaaacacagatgtctgtgt

SEQ ID NO: 7365925 - DNA, 22 bp, Homo sapiens
caaaaaacacctgtgtgagtat

SEQ ID NO: 7365926 - DNA, 22 bp, Homo sapiens
caaaaaacacctgtgtgagtat

SEQ ID NO: 7365927 - DNA, 22 bp, Homo sapiens
caaaaactgcaattacttttac

SEQ ID NO: 7365928 - DNA, 22 bp, Homo sapiens
caaaaaacacctgtgtgagtat

SEQ ID NO: 7365929 - DNA, 22 bp, Homo sapiens
atttagaaattccaaaagtatt

SEQ ID NO: 7365930 - DNA, 22 bp, Homo sapiens
atttactgaggtaaataaactg

SEQ ID NO: 7365931 - DNA, 22 bp, Homo sapiens
atttactactgctatctagaag

SEQ ID NO: 7365932 - DNA, 22 bp, Homo sapiens
atttactcgtgtctccagtgct

SEQ ID NO: 7365933 - DNA, 22 bp, Homo sapiens
gccaggagtgtcccactcattt

SEQ ID NO: 7365934 - DNA, 20 bp, Homo sapiens
gccaggagggtgtgatgagc

SEQ ID NO: 7365935 - DNA, 17 bp, Homo sapiens
gccaggaggtttgagct

SEQ ID NO: 7365936 - DNA, 22 bp, Homo sapiens
gccaggaggtcagcccctcaac

SEQ ID NO: 7365937 - DNA, 22 bp, Homo sapiens
gccaggaggtcagcccctcaac

SEQ ID NO: 7365938 - DNA, 22 bp, Homo sapiens
atttacaccttcttcgattctc

SEQ ID NO: 7365939 - DNA, 22 bp, Homo sapiens
atttacactggttctcagagct

SEQ ID NO: 7365940 - DNA, 22 bp, Homo sapiens
atttacagaaacttaatcatag

SEQ ID NO: 7365941 - DNA, 22 bp, Homo sapiens
gccaggaggcttaactggacag

SEQ ID NO: 7365942 - DNA, 19 bp, Homo sapiens
gccaggagggctctggctg

SEQ ID NO: 7365943 - DNA, 22 bp, Homo sapiens
gccaggagggaaaggacaattt

SEQ ID NO: 7365944 - DNA, 22 bp, Homo sapiens
attgcttgatgattcatagtaa

SEQ ID NO: 7365945 - DNA, 22 bp, Homo sapiens
attgcttgaattaccatgtaat

SEQ ID NO: 7365946 - DNA, 22 bp, Homo sapiens
attgcttttcagacaatgaggc

SEQ ID NO: 7365947 - DNA, 22 bp, Homo sapiens
attggaaatgctacaagttaga

SEQ ID NO: 7365948 - DNA, 22 bp, Homo sapiens
attggaaataggccttgtacag

SEQ ID NO: 7365949 - DNA, 22 bp, Homo sapiens
attggaaagtgtctagtgtggt

SEQ ID NO: 7365950 - DNA, 22 bp, Homo sapiens
attggaaagttcttaagggata

SEQ ID NO: 7365951 - DNA, 22 bp, Homo sapiens
attggaaatactgagagataaa

SEQ ID NO: 7365952 - DNA, 22 bp, Homo sapiens
atttaatttggagagagaaacc

SEQ ID NO: 7365953 - DNA, 22 bp, Homo sapiens
atttaatttggagagagaaacc

SEQ ID NO: 7365954 - DNA, 22 bp, Homo sapiens
attggcaatagagaataaattg

SEQ ID NO: 7365955 - DNA, 22 bp, Homo sapiens
atttaatgtcgagctattgtag

SEQ ID NO: 7365956 - DNA, 22 bp, Homo sapiens
atttaatgtcgagctattgtag

SEQ ID NO: 7365957 - DNA, 22 bp, Homo sapiens
atttaatttacatttgacagag

SEQ ID NO: 7365958 - DNA, 22 bp, Homo sapiens
atttctaaagagggtggtttgg

SEQ ID NO: 7365959 - DNA, 22 bp, Homo sapiens
atttccttgcaagtttctgtaa

SEQ ID NO: 7365960 - DNA, 22 bp, Homo sapiens
atttccttgcaacttaggcatg

SEQ ID NO: 7365961 - DNA, 16 bp, Homo sapiens
atttccttgtgagttt

SEQ ID NO: 7365962 - DNA, 22 bp, Homo sapiens
atttcctttgcaaagactgtgc

SEQ ID NO: 7365963 - DNA, 22 bp, Homo sapiens
atttccttcccagatttggttc

SEQ ID NO: 7365964 - DNA, 22 bp, Homo sapiens
atttccttcggacagtttgggt

SEQ ID NO: 7365965 - DNA, 22 bp, Homo sapiens
atttcatgagttattatagtgg

SEQ ID NO: 7365966 - DNA, 21 bp, Homo sapiens
atttcatggtgcttttaagaa

SEQ ID NO: 7365967 - DNA, 22 bp, Homo sapiens
atttcagtgttttaagagttca

SEQ ID NO: 7365968 - DNA, 20 bp, Homo sapiens
atttcagtgtttgcaatttc

SEQ ID NO: 7365969 - DNA, 21 bp, Homo sapiens
atttcagagcacacaagtaaa

SEQ ID NO: 7365970 - DNA, 22 bp, Homo sapiens
atttcagattcagaaatgtagg

SEQ ID NO: 7365971 - DNA, 22 bp, Homo sapiens
atttcagatgaccaaatggaaa

SEQ ID NO: 7365972 - DNA, 22 bp, Homo sapiens
atttcagagtgagagtgctcaa

SEQ ID NO: 7365973 - DNA, 22 bp, Homo sapiens
gccaggccctgggcacttcgtg

SEQ ID NO: 7365974 - DNA, 22 bp, Homo sapiens
gccaggcctgcaagtgctggtg

SEQ ID NO: 7365975 - DNA, 22 bp, Homo sapiens
gccaggcatttgttaggtgctg

SEQ ID NO: 7365976 - DNA, 22 bp, Homo sapiens
atttattgagcctttcctatgt

SEQ ID NO: 7365977 - DNA, 22 bp, Homo sapiens
atttattggatgcttacttggg

SEQ ID NO: 7365978 - DNA, 22 bp, Homo sapiens
atttattgagacttaacaaccc

SEQ ID NO: 7365979 - DNA, 22 bp, Homo sapiens
atttattgagagggaggggaat

SEQ ID NO: 7365980 - DNA, 22 bp, Homo sapiens
gatgaggctcatgcaccctgcg

SEQ ID NO: 7365981 - DNA, 22 bp, Homo sapiens
gatgaggccacacggggtgggc

SEQ ID NO: 7365982 - DNA, 22 bp, Homo sapiens
gatgaggcaagccagaggactg

SEQ ID NO: 7365983 - DNA, 22 bp, Homo sapiens
gatgaggctgtgtctgcacaag

SEQ ID NO: 7365984 - DNA, 18 bp, Homo sapiens
gatgaggctgtctgagaa

SEQ ID NO: 7365985 - DNA, 18 bp, Homo sapiens
gatgaggctgtctgagaa

SEQ ID NO: 7365986 - DNA, 22 bp, Homo sapiens
gatgaggctgtagagggtggca

SEQ ID NO: 7365987 - DNA, 22 bp, Homo sapiens
gatgagttctttctattctatt

SEQ ID NO: 7365988 - DNA, 22 bp, Homo sapiens
attaaatgttggcatattttgt

SEQ ID NO: 7365989 - DNA, 22 bp, Homo sapiens
attaaatgttccttaaattata

SEQ ID NO: 7365990 - DNA, 22 bp, Homo sapiens
attaaatgttccttaaattata

SEQ ID NO: 7365991 - DNA, 22 bp, Homo sapiens
attaaatgttccttaaattata

SEQ ID NO: 7365992 - DNA, 22 bp, Homo sapiens
gatgaggcaagccagaggactg

SEQ ID NO: 7365993 - DNA, 22 bp, Homo sapiens
attaaattagcaaactgtgaaa

SEQ ID NO: 7365994 - DNA, 22 bp, Homo sapiens
attaaattagcaaactgtgaaa

SEQ ID NO: 7365995 - DNA, 22 bp, Homo sapiens
attaaattaagtggctaattta

SEQ ID NO: 7365996 - DNA, 22 bp, Homo sapiens
attaaaagcttcccaagagtta

SEQ ID NO: 7365997 - DNA, 22 bp, Homo sapiens
attaaaattccaaggtatgcca

SEQ ID NO: 7365998 - DNA, 22 bp, Homo sapiens
attaaatgatggcatgtcttat

SEQ ID NO: 7365999 - DNA, 22 bp, Homo sapiens
attaaatactgcaggctaagca

SEQ ID NO: 7366000 - DNA, 22 bp, Homo sapiens
atgtttttcataccagtgttgg

SEQ ID NO: 7366001 - DNA, 22 bp, Homo sapiens
atgtttttaaatagacttacag

SEQ ID NO: 7366002 - DNA, 22 bp, Homo sapiens
atgtttttaaatagacttacag

SEQ ID NO: 7366003 - DNA, 22 bp, Homo sapiens
atgtttttggcttcaagtttct

SEQ ID NO: 7366004 - DNA, 22 bp, Homo sapiens
atgtttttgagatacaaacaga

SEQ ID NO: 7366005 - DNA, 22 bp, Homo sapiens
atgttttccccaaatgatcttc

SEQ ID NO: 7366006 - DNA, 22 bp, Homo sapiens
atgttttcaaagtaaacttgta

SEQ ID NO: 7366007 - DNA, 22 bp, Homo sapiens
atgttttctagagtttaaaatc

SEQ ID NO: 7366008 - DNA, 22 bp, Homo sapiens
atgtgttgcagaagattaagct

SEQ ID NO: 7366009 - DNA, 22 bp, Homo sapiens
attacaataaggtttatttgta

SEQ ID NO: 7366010 - DNA, 22 bp, Homo sapiens
attacaagtagactaactttca

SEQ ID NO: 7366011 - DNA, 22 bp, Homo sapiens
attaatttttctgacagccaca

SEQ ID NO: 7366012 - DNA, 22 bp, Homo sapiens
attaatttttctgacagccaca

SEQ ID NO: 7366013 - DNA, 22 bp, Homo sapiens
attacaaaagaagggagaaggt

SEQ ID NO: 7366014 - DNA, 22 bp, Homo sapiens
attacaaaagaagggagaaggt

SEQ ID NO: 7366015 - DNA, 22 bp, Homo sapiens
attaattttacctttgtaaaca

SEQ ID NO: 7366016 - DNA, 22 bp, Homo sapiens
attaatttccaggcactgtgct

SEQ ID NO: 7366017 - DNA, 22 bp, Homo sapiens
gatgatctgcaagaactacatg

SEQ ID NO: 7366018 - DNA, 22 bp, Homo sapiens
attaatatgagaaagtggcaga

SEQ ID NO: 7366019 - DNA, 19 bp, Homo sapiens
gcaaggttcactcccagag

SEQ ID NO: 7366020 - DNA, 22 bp, Homo sapiens
gcaaggtgttttataggcagga

SEQ ID NO: 7366021 - DNA, 17 bp, Homo sapiens
gcaagggatgggagatt

SEQ ID NO: 7366022 - DNA, 22 bp, Homo sapiens
attattcagtcttgtaaggagt

SEQ ID NO: 7366023 - DNA, 22 bp, Homo sapiens
attattcaatcatattaaaagt

SEQ ID NO: 7366024 - DNA, 22 bp, Homo sapiens
attattcaatcatattaaaagt

SEQ ID NO: 7366025 - DNA, 22 bp, Homo sapiens
attattcagtcttgtaaggagt

SEQ ID NO: 7366026 - DNA, 22 bp, Homo sapiens
attattcattggtaggcaagct

SEQ ID NO: 7366027 - DNA, 22 bp, Homo sapiens
gcagagctggtacttgagcctg

SEQ ID NO: 7366028 - DNA, 22 bp, Homo sapiens
gcagagctgggtctgtatccaa

SEQ ID NO: 7366029 - DNA, 22 bp, Homo sapiens
gcagagctgggatttgtactgg

SEQ ID NO: 7366030 - DNA, 21 bp, Homo sapiens
gcagagctggaaccaggaccc

SEQ ID NO: 7366031 - DNA, 22 bp, Homo sapiens
attcagttagatcatcctaatt

SEQ ID NO: 7366032 - DNA, 22 bp, Homo sapiens
attcagttactctagacacttc

SEQ ID NO: 7366033 - DNA, 22 bp, Homo sapiens
attcagtgtatcaatgaatgct

SEQ ID NO: 7366034 - DNA, 19 bp, Homo sapiens
attcagtgtctctgacttc

SEQ ID NO: 7366035 - DNA, 22 bp, Homo sapiens
attatttatcctcttggtctat

SEQ ID NO: 7366036 - DNA, 22 bp, Homo sapiens
attatttatcctcttggtctat

SEQ ID NO: 7366037 - DNA, 22 bp, Homo sapiens
attatttagaaatcgattgaaa

SEQ ID NO: 7366038 - DNA, 22 bp, Homo sapiens
attatttacagtgtgctcgaag

SEQ ID NO: 7366039 - DNA, 22 bp, Homo sapiens
attattgtcatcttaatcttaa

SEQ ID NO: 7366040 - DNA, 22 bp, Homo sapiens
attattggtacaccgtagtcat

SEQ ID NO: 7366041 - DNA, 22 bp, Homo sapiens
attattggacacttcttctgca

SEQ ID NO: 7366042 - DNA, 22 bp, Homo sapiens
gcagcaggcttttcataccttg

SEQ ID NO: 7366043 - DNA, 22 bp, Homo sapiens
gcagcagggtgccagctttgca

SEQ ID NO: 7366044 - DNA, 22 bp, Homo sapiens
attcctttggactcctccttgc

SEQ ID NO: 7366045 - DNA, 22 bp, Homo sapiens
attccttgtttcactgaaaagg

SEQ ID NO: 7366046 - DNA, 22 bp, Homo sapiens
attcctttggactcctccttgc

SEQ ID NO: 7366047 - DNA, 22 bp, Homo sapiens
gcagcaggcatggccgccctgg

SEQ ID NO: 7366048 - DNA, 22 bp, Homo sapiens
attcctaaagtaatacactaga

SEQ ID NO: 7366049 - DNA, 22 bp, Homo sapiens
attcctcaaaggtagcccatta

SEQ ID NO: 7366050 - DNA, 20 bp, Homo sapiens
attcccttctccctgtttga

SEQ ID NO: 7366051 - DNA, 16 bp, Homo sapiens
gcagaggaaaggggag

SEQ ID NO: 7366052 - DNA, 22 bp, Homo sapiens
attgctgtttaggcaagtgtat

SEQ ID NO: 7366053 - DNA, 22 bp, Homo sapiens
attgaagaaacccaaataatgg

SEQ ID NO: 7366054 - DNA, 22 bp, Homo sapiens
attgaagagaagctaaatagag

SEQ ID NO: 7366055 - DNA, 22 bp, Homo sapiens
attgaagagaagctaaatagag

SEQ ID NO: 7366056 - DNA, 22 bp, Homo sapiens
attgaagaaacccaaataatgg

SEQ ID NO: 7366057 - DNA, 22 bp, Homo sapiens
attgaagagttgattattatct

SEQ ID NO: 7366058 - DNA, 22 bp, Homo sapiens
attgaagagaagctaaatagag

SEQ ID NO: 7366059 - DNA, 22 bp, Homo sapiens
attgaagattctgacatcagaa

SEQ ID NO: 7366060 - DNA, 22 bp, Homo sapiens
attgacaaatctgaacatacgg

SEQ ID NO: 7366061 - DNA, 22 bp, Homo sapiens
attcttcactgtttcagaatga

SEQ ID NO: 7366062 - DNA, 22 bp, Homo sapiens
attcttcagatcagcagggcct

SEQ ID NO: 7366063 - DNA, 22 bp, Homo sapiens
attgaaattgatgaaattcttg

SEQ ID NO: 7366064 - DNA, 22 bp, Homo sapiens
attctcaaacaagtggtttgat

SEQ ID NO: 7366065 - DNA, 22 bp, Homo sapiens
attctattttttaagaagtagt

SEQ ID NO: 7366066 - DNA, 22 bp, Homo sapiens
attctgtgatagttgatcctta

SEQ ID NO: 7366067 - DNA, 22 bp, Homo sapiens
attctgtctttttaaaataata

SEQ ID NO: 7366068 - DNA, 20 bp, Homo sapiens
attctcacatggctccgggc

SEQ ID NO: 7366069 - DNA, 22 bp, Homo sapiens
attcttattaaatagccagaag

SEQ ID NO: 7366070 - DNA, 22 bp, Homo sapiens
attcttacaaagcagagtctgt

SEQ ID NO: 7366071 - DNA, 22 bp, Homo sapiens
attcttacaaatgaaactgcaa

SEQ ID NO: 7366072 - DNA, 22 bp, Homo sapiens
attcttactccatagaatgaat

SEQ ID NO: 7366073 - DNA, 22 bp, Homo sapiens
attcttacaaagcagagtctgt

SEQ ID NO: 7366074 - DNA, 22 bp, Homo sapiens
attcttcacaaatatatagaag

SEQ ID NO: 7366075 - DNA, 22 bp, Homo sapiens
attcttcacacctgttcctgtt

SEQ ID NO: 7366076 - DNA, 22 bp, Homo sapiens
attcttcacaaatatatagaag

SEQ ID NO: 7366077 - DNA, 22 bp, Homo sapiens
attcttcaaagagtgtcaaagt

SEQ ID NO: 7366078 - DNA, 22 bp, Homo sapiens
attcttcaccatggataatttg

SEQ ID NO: 7366079 - DNA, 22 bp, Homo sapiens
attcttcactgtttcagaatga

SEQ ID NO: 7366080 - DNA, 22 bp, Homo sapiens
attcttcacctgagtcagtcta

SEQ ID NO: 7366081 - DNA, 22 bp, Homo sapiens
attcttcacatggataggatct

SEQ ID NO: 7366082 - DNA, 22 bp, Homo sapiens
catataatgtttgaagatgtgg

SEQ ID NO: 7366083 - DNA, 22 bp, Homo sapiens
catagacaaagatcagaagagt

SEQ ID NO: 7366084 - DNA, 22 bp, Homo sapiens
tcaggaagtggtaaaggatgtt

SEQ ID NO: 7366085 - DNA, 22 bp, Homo sapiens
catatcttatggttttctaagt

SEQ ID NO: 7366086 - DNA, 22 bp, Homo sapiens
catatcttctgacatgatcagg

SEQ ID NO: 7366087 - DNA, 22 bp, Homo sapiens
catatgaagttcaacagagatg

SEQ ID NO: 7366088 - DNA, 22 bp, Homo sapiens
catatcttctgacatgatcagg

SEQ ID NO: 7366089 - DNA, 22 bp, Homo sapiens
catatacacttccacctctgtg

SEQ ID NO: 7366090 - DNA, 22 bp, Homo sapiens
catatattctggttttcactgg

SEQ ID NO: 7366091 - DNA, 22 bp, Homo sapiens
catatattctggttttcactgg

SEQ ID NO: 7366092 - DNA, 20 bp, Homo sapiens
catatatacctagaagtgga

SEQ ID NO: 7366093 - DNA, 22 bp, Homo sapiens
catatattatggactgcagaat

SEQ ID NO: 7366094 - DNA, 22 bp, Homo sapiens
catcacagaaataaacatacct

SEQ ID NO: 7366095 - DNA, 22 bp, Homo sapiens
tcagggcccagagctcaggcaa

SEQ ID NO: 7366096 - DNA, 19 bp, Homo sapiens
tcagggccatgagcgccac

SEQ ID NO: 7366097 - DNA, 22 bp, Homo sapiens
tcagggccacaacaccagagtc

SEQ ID NO: 7366098 - DNA, 22 bp, Homo sapiens
catatgtactgtttgctttcaa

SEQ ID NO: 7366099 - DNA, 22 bp, Homo sapiens
catcacagtttgtcagaaatca

SEQ ID NO: 7366100 - DNA, 22 bp, Homo sapiens
catcacagtttgtcagaaatca

SEQ ID NO: 7366101 - DNA, 22 bp, Homo sapiens
catcacagtttgtcagaaatca

SEQ ID NO: 7366102 - DNA, 22 bp, Homo sapiens
tcagctgcactgttctgaccca

SEQ ID NO: 7366103 - DNA, 22 bp, Homo sapiens
tcagctgagttctagagcactc

SEQ ID NO: 7366104 - DNA, 22 bp, Homo sapiens
tcagccctggcactgtctccca

SEQ ID NO: 7366105 - DNA, 22 bp, Homo sapiens
tcagccctgaggacagaggcag

SEQ ID NO: 7366106 - DNA, 22 bp, Homo sapiens
tcagccctagaaagtctaagca

SEQ ID NO: 7366107 - DNA, 22 bp, Homo sapiens
catagaaaagagtaggtaatgt

SEQ ID NO: 7366108 - DNA, 22 bp, Homo sapiens
catagaaaagagtaggtaatgt

SEQ ID NO: 7366109 - DNA, 22 bp, Homo sapiens
catacttttgccctgacattct

SEQ ID NO: 7366110 - DNA, 22 bp, Homo sapiens
catacctttctcaagcacatgt

SEQ ID NO: 7366111 - DNA, 22 bp, Homo sapiens
tcagctgcagcaggcaccattt

SEQ ID NO: 7366112 - DNA, 22 bp, Homo sapiens
tcagctgcataacaaagtatga

SEQ ID NO: 7366113 - DNA, 22 bp, Homo sapiens
tcagctgcataacaaagtatga

SEQ ID NO: 7366114 - DNA, 22 bp, Homo sapiens
tcagctgcagtttcacaagcac

SEQ ID NO: 7366115 - DNA, 22 bp, Homo sapiens
tcagctgcataagtcaccttgc

SEQ ID NO: 7366116 - DNA, 22 bp, Homo sapiens
catacattgctcattcagtatc

SEQ ID NO: 7366117 - DNA, 22 bp, Homo sapiens
tcagcagtgagaattaatgttg

SEQ ID NO: 7366118 - DNA, 22 bp, Homo sapiens
tcagcagtgcagggtgaggcag

SEQ ID NO: 7366119 - DNA, 22 bp, Homo sapiens
tcagcagtgagaattaatgttg

SEQ ID NO: 7366120 - DNA, 22 bp, Homo sapiens
tcagcagtggctctcatgcagt

SEQ ID NO: 7366121 - DNA, 22 bp, Homo sapiens
cagtttgtatttattactcata

SEQ ID NO: 7366122 - DNA, 22 bp, Homo sapiens
cagtttgcataacaagagattc

SEQ ID NO: 7366123 - DNA, 17 bp, Homo sapiens
cagtttcttccccctct

SEQ ID NO: 7366124 - DNA, 22 bp, Homo sapiens
cagtttcttaagactgagatct

SEQ ID NO: 7366125 - DNA, 22 bp, Homo sapiens
cagtttctgttttaaatagcag

SEQ ID NO: 7366126 - DNA, 22 bp, Homo sapiens
cagtttcttcatctgcagaatc

SEQ ID NO: 7366127 - DNA, 22 bp, Homo sapiens
cagtttcttcatcagttaagca

SEQ ID NO: 7366128 - DNA, 22 bp, Homo sapiens
cagtttcttcaattcagacact

SEQ ID NO: 7366129 - DNA, 22 bp, Homo sapiens
cagtttctgtctgttcttatcc

SEQ ID NO: 7366130 - DNA, 22 bp, Homo sapiens
cagtttctgggaggaaaggaag

SEQ ID NO: 7366131 - DNA, 22 bp, Homo sapiens
cagtttctgagccctgtcattt

SEQ ID NO: 7366132 - DNA, 22 bp, Homo sapiens
tcagaagtcacttaggaaaggg

SEQ ID NO: 7366133 - DNA, 22 bp, Homo sapiens
tcagaagtccccagtcaaggag

SEQ ID NO: 7366134 - DNA, 22 bp, Homo sapiens
catgattttgtcttgtgttaat

SEQ ID NO: 7366135 - DNA, 22 bp, Homo sapiens
tcatttttagcgcgcaaaagtt

SEQ ID NO: 7366136 - DNA, 22 bp, Homo sapiens
catgcaaaggtcaagatcagga

SEQ ID NO: 7366137 - DNA, 22 bp, Homo sapiens
catgtcttaggaaagcagagga

SEQ ID NO: 7366138 - DNA, 22 bp, Homo sapiens
catgtcttatatcctgtcttca

SEQ ID NO: 7366139 - DNA, 22 bp, Homo sapiens
catgtcttatgcggaactttca

SEQ ID NO: 7366140 - DNA, 22 bp, Homo sapiens
catgtcttaattggagcccaga

SEQ ID NO: 7366141 - DNA, 22 bp, Homo sapiens
catgtgcagactctgacaggct

SEQ ID NO: 7366142 - DNA, 22 bp, Homo sapiens
catgtctttcaaaccacacagt

SEQ ID NO: 7366143 - DNA, 22 bp, Homo sapiens
catgtctttcaaaccacacagt

SEQ ID NO: 7366144 - DNA, 22 bp, Homo sapiens
catgtcttccttgcacacacac

SEQ ID NO: 7366145 - DNA, 22 bp, Homo sapiens
catgtcttgccctgattagtag

SEQ ID NO: 7366146 - DNA, 22 bp, Homo sapiens
catgtcttggcttaggcacaga

SEQ ID NO: 7366147 - DNA, 21 bp, Homo sapiens
catgtcttccacactgtagta

SEQ ID NO: 7366148 - DNA, 22 bp, Homo sapiens
catgtcttatttatgcttctta

SEQ ID NO: 7366149 - DNA, 22 bp, Homo sapiens
catgtctttctcatcacatcta

SEQ ID NO: 7366150 - DNA, 22 bp, Homo sapiens
catgtctttgttatgctcacca

SEQ ID NO: 7366151 - DNA, 22 bp, Homo sapiens
catgtgcattggggccagggag

SEQ ID NO: 7366152 - DNA, 22 bp, Homo sapiens
tccaggcaaagggactagcagg

SEQ ID NO: 7366153 - DNA, 22 bp, Homo sapiens
tccaggcacagagttggtcagt

SEQ ID NO: 7366154 - DNA, 22 bp, Homo sapiens
tcagttcttagtaatgcagtct

SEQ ID NO: 7366155 - DNA, 22 bp, Homo sapiens
tcagttctgaagttctgcctcc

SEQ ID NO: 7366156 - DNA, 21 bp, Homo sapiens
tcagttctctgcctgtgcttg

SEQ ID NO: 7366157 - DNA, 22 bp, Homo sapiens
catctttaacaatttacaatgt

SEQ ID NO: 7366158 - DNA, 22 bp, Homo sapiens
catctttaaaggggagacaccc

SEQ ID NO: 7366159 - DNA, 22 bp, Homo sapiens
catctttaaaggggagacaccc

SEQ ID NO: 7366160 - DNA, 22 bp, Homo sapiens
catccccaattagcgcccagct

SEQ ID NO: 7366161 - DNA, 22 bp, Homo sapiens
tcatttgttgctgttacctgag

SEQ ID NO: 7366162 - DNA, 17 bp, Homo sapiens
tcatttgttgtgactag

SEQ ID NO: 7366163 - DNA, 22 bp, Homo sapiens
tcatttgttgaactttagtgcg

SEQ ID NO: 7366164 - DNA, 22 bp, Homo sapiens
tcatttgttgaactttagtgcg

SEQ ID NO: 7366165 - DNA, 22 bp, Homo sapiens
tcatgtctctatgtgcctatta

SEQ ID NO: 7366166 - DNA, 19 bp, Homo sapiens
tcatgtctctcatctgtga

SEQ ID NO: 7366167 - DNA, 22 bp, Homo sapiens
catgatttactaaaatttgttt

SEQ ID NO: 7366168 - DNA, 22 bp, Homo sapiens
tcagtttcacagtctgtgcaga

SEQ ID NO: 7366169 - DNA, 22 bp, Homo sapiens
catgataattgttaacaaagta

SEQ ID NO: 7366170 - DNA, 21 bp, Homo sapiens
catgataatgaaggtgttatt

SEQ ID NO: 7366171 - DNA, 22 bp, Homo sapiens
tcacattctttatttgccatcc

SEQ ID NO: 7366172 - DNA, 22 bp, Homo sapiens
tcacattgaatggaagaataga

SEQ ID NO: 7366173 - DNA, 22 bp, Homo sapiens
tcaccaggctggaatgcagtgg

SEQ ID NO: 7366174 - DNA, 22 bp, Homo sapiens
tcaccagtctttcttaccattg

SEQ ID NO: 7366175 - DNA, 22 bp, Homo sapiens
tcaccagttaaaataacagtaa

SEQ ID NO: 7366176 - DNA, 22 bp, Homo sapiens
tcaccaggctggagtgcagtgg

SEQ ID NO: 7366177 - DNA, 22 bp, Homo sapiens
tcaccagggaggcttaacttat

SEQ ID NO: 7366178 - DNA, 22 bp, Homo sapiens
tcagaaataatgaatgatgggg

SEQ ID NO: 7366179 - DNA, 22 bp, Homo sapiens
tcagaaatacaaaacacttact

SEQ ID NO: 7366180 - DNA, 22 bp, Homo sapiens
tcactcagtttttggcctctgc

SEQ ID NO: 7366181 - DNA, 22 bp, Homo sapiens
tcacttctgaaggtagttggca

SEQ ID NO: 7366182 - DNA, 22 bp, Homo sapiens
tcactcctcaggctagcatcat

SEQ ID NO: 7366183 - DNA, 22 bp, Homo sapiens
tcactcagagatagcctcattt

SEQ ID NO: 7366184 - DNA, 22 bp, Homo sapiens
cagtcctttctgaaatcctata

SEQ ID NO: 7366185 - DNA, 22 bp, Homo sapiens
cagtctcaccctggaggcccca

SEQ ID NO: 7366186 - DNA, 22 bp, Homo sapiens
cagtgcaacttttgcctcccgg

SEQ ID NO: 7366187 - DNA, 22 bp, Homo sapiens
cagtcctggggaccaggctgag

SEQ ID NO: 7366188 - DNA, 22 bp, Homo sapiens
tatttacttttaaattgagaac

SEQ ID NO: 7366189 - DNA, 19 bp, Homo sapiens
tatttacttcttgattgca

SEQ ID NO: 7366190 - DNA, 22 bp, Homo sapiens
tatttagttatctttcataaaa

SEQ ID NO: 7366191 - DNA, 22 bp, Homo sapiens
tatttagatgcatttggattgc

SEQ ID NO: 7366192 - DNA, 22 bp, Homo sapiens
tattgggcagacatcaggctta

SEQ ID NO: 7366193 - DNA, 22 bp, Homo sapiens
tattgggtaaagatccagtttt

SEQ ID NO: 7366194 - DNA, 22 bp, Homo sapiens
tattgggaaaagggcgatggct

SEQ ID NO: 7366195 - DNA, 22 bp, Homo sapiens
tattggatcttttattgctcag

SEQ ID NO: 7366196 - DNA, 22 bp, Homo sapiens
tattggagtatggggctggagt

SEQ ID NO: 7366197 - DNA, 22 bp, Homo sapiens
tattggagtactgcgagctgcc

SEQ ID NO: 7366198 - DNA, 22 bp, Homo sapiens
cagggtggaaaagctagttgga

SEQ ID NO: 7366199 - DNA, 22 bp, Homo sapiens
cagggtggaacaggcaatactt

SEQ ID NO: 7366200 - DNA, 22 bp, Homo sapiens
cagggtggaacaggcaatactt

SEQ ID NO: 7366201 - DNA, 22 bp, Homo sapiens
cagggtggaagctgtagagtgg

SEQ ID NO: 7366202 - DNA, 22 bp, Homo sapiens
tataatattccttgttgtaggt

SEQ ID NO: 7366203 - DNA, 22 bp, Homo sapiens
caggggcaagaatgctgtcagc

SEQ ID NO: 7366204 - DNA, 22 bp, Homo sapiens
tataatattccttgttgtaggt

SEQ ID NO: 7366205 - DNA, 22 bp, Homo sapiens
tataagaagtgaagaagagtta

SEQ ID NO: 7366206 - DNA, 22 bp, Homo sapiens
tataagaatgcttgtttggggt

SEQ ID NO: 7366207 - DNA, 22 bp, Homo sapiens
tataagaaattgccaacctgtt

SEQ ID NO: 7366208 - DNA, 22 bp, Homo sapiens
tataagaaattgccaacctgtt

SEQ ID NO: 7366209 - DNA, 22 bp, Homo sapiens
tacatgtgggttaaaaacactc

SEQ ID NO: 7366210 - DNA, 22 bp, Homo sapiens
tatctattccaaatatcagcgt

SEQ ID NO: 7366211 - DNA, 22 bp, Homo sapiens
tatacagttaagtttcttcagt

SEQ ID NO: 7366212 - DNA, 22 bp, Homo sapiens
tatacagttaagtttcttcagt

SEQ ID NO: 7366213 - DNA, 22 bp, Homo sapiens
tatacagtcttttgctatattc

SEQ ID NO: 7366214 - DNA, 22 bp, Homo sapiens
tatacagtcttttgctatattc

SEQ ID NO: 7366215 - DNA, 22 bp, Homo sapiens
cagggtggcacatcacagcatt

SEQ ID NO: 7366216 - DNA, 22 bp, Homo sapiens
cagggtggaagctgtagagtgg

SEQ ID NO: 7366217 - DNA, 22 bp, Homo sapiens
cagggtggaatggaatgctggc

SEQ ID NO: 7366218 - DNA, 22 bp, Homo sapiens
cagggtggcacatcacagcatt

SEQ ID NO: 7366219 - DNA, 22 bp, Homo sapiens
tattaaagggaagttatgcatg

SEQ ID NO: 7366220 - DNA, 22 bp, Homo sapiens
tattaaagagagaatcatcatc

SEQ ID NO: 7366221 - DNA, 22 bp, Homo sapiens
tattcctggtccctaccacaga

SEQ ID NO: 7366222 - DNA, 22 bp, Homo sapiens
tattcctgggttccagcccaga

SEQ ID NO: 7366223 - DNA, 22 bp, Homo sapiens
tattgctgctattgtcagttca

SEQ ID NO: 7366224 - DNA, 22 bp, Homo sapiens
tattgcttttatttctatggac

SEQ ID NO: 7366225 - DNA, 22 bp, Homo sapiens
tattgctggggtgggccatgtt

SEQ ID NO: 7366226 - DNA, 22 bp, Homo sapiens
tatgtgtacagtatactggttt

SEQ ID NO: 7366227 - DNA, 22 bp, Homo sapiens
tatgtgctgccaccagggagag

SEQ ID NO: 7366228 - DNA, 22 bp, Homo sapiens
tatgtactaactttcattctag

SEQ ID NO: 7366229 - DNA, 22 bp, Homo sapiens
tatgttttaggaattaattgtt

SEQ ID NO: 7366230 - DNA, 21 bp, Homo sapiens
tatctgctttttaaggctcac

SEQ ID NO: 7366231 - DNA, 22 bp, Homo sapiens
tatctggtttagtatgatgtta

SEQ ID NO: 7366232 - DNA, 22 bp, Homo sapiens
tatctggttcctttgaggagat

SEQ ID NO: 7366233 - DNA, 22 bp, Homo sapiens
tatggagattcaaaagcatctt

SEQ ID NO: 7366234 - DNA, 22 bp, Homo sapiens
tatggatataatcagactggaa

SEQ ID NO: 7366235 - DNA, 22 bp, Homo sapiens
tatggcaattgtctaagtttta

SEQ ID NO: 7366236 - DNA, 22 bp, Homo sapiens
tatctctttattgacaataaaa

SEQ ID NO: 7366237 - DNA, 22 bp, Homo sapiens
tatctgagaaagaagcaccaga

SEQ ID NO: 7366238 - DNA, 17 bp, Homo sapiens
tatctctgcttcatggt

SEQ ID NO: 7366239 - DNA, 22 bp, Homo sapiens
ccagcctcatcatattcctgct

SEQ ID NO: 7366240 - DNA, 22 bp, Homo sapiens
tctgagtgtgactggttaatga

SEQ ID NO: 7366241 - DNA, 22 bp, Homo sapiens
tctgagtgcactaggaggggca

SEQ ID NO: 7366242 - DNA, 23 bp, Homo sapiens
tctgagtgattagcctctggggt

SEQ ID NO: 7366243 - DNA, 22 bp, Homo sapiens
tctgagtggactgtcctgcagg

SEQ ID NO: 7366244 - DNA, 22 bp, Homo sapiens
tctgagtgggaactctcatgac

SEQ ID NO: 7366245 - DNA, 22 bp, Homo sapiens
tctgagtgtcttaataggctct

SEQ ID NO: 7366246 - DNA, 22 bp, Homo sapiens
tctgagtgatgttgagtcagaa

SEQ ID NO: 7366247 - DNA, 22 bp, Homo sapiens
tctgagtgatcagatgcattgc

SEQ ID NO: 7366248 - DNA, 22 bp, Homo sapiens
tctgagtgacgtcctgacagga

SEQ ID NO: 7366249 - DNA, 22 bp, Homo sapiens
tctgagtgagggtgtgagatat

SEQ ID NO: 7366250 - DNA, 22 bp, Homo sapiens
tctgagtgagcacatggttaga

SEQ ID NO: 7366251 - DNA, 22 bp, Homo sapiens
tctgagtgagtgtaggcctgac

SEQ ID NO: 7366252 - DNA, 19 bp, Homo sapiens
tctgagtgagggttatcct

SEQ ID NO: 7366253 - DNA, 22 bp, Homo sapiens
tctgcctcgctaacagcagcca

SEQ ID NO: 7366254 - DNA, 21 bp, Homo sapiens
tctgccagctgaagaggtgga

SEQ ID NO: 7366255 - DNA, 22 bp, Homo sapiens
tctgccagcttctggtggttgc

SEQ ID NO: 7366256 - DNA, 22 bp, Homo sapiens
tctgccaggcattgtgctgctc

SEQ ID NO: 7366257 - DNA, 22 bp, Homo sapiens
tctgccagaagccagggtctgg

SEQ ID NO: 7366258 - DNA, 20 bp, Homo sapiens
tctgccactttttctgtcac

SEQ ID NO: 7366259 - DNA, 22 bp, Homo sapiens
tctgccagaagttctgagagta

SEQ ID NO: 7366260 - DNA, 22 bp, Homo sapiens
tctgccagctctgtgggtctcg

SEQ ID NO: 7366261 - DNA, 22 bp, Homo sapiens
tctgccagccctgtgagtcttg

SEQ ID NO: 7366262 - DNA, 22 bp, Homo sapiens
tctgccagacctgactcagtag

SEQ ID NO: 7366263 - DNA, 22 bp, Homo sapiens
tctgccagcaccatgatccttc

SEQ ID NO: 7366264 - DNA, 22 bp, Homo sapiens
ccagctcctcttcccagtgtca

SEQ ID NO: 7366265 - DNA, 22 bp, Homo sapiens
ccagctctcaaggctccctggg

SEQ ID NO: 7366266 - DNA, 22 bp, Homo sapiens
ccagctctcagcgggagactca

SEQ ID NO: 7366267 - DNA, 22 bp, Homo sapiens
ccagctctaaacggctctgtgg

SEQ ID NO: 7366268 - DNA, 22 bp, Homo sapiens
tctcttaactggttcagcaatt

SEQ ID NO: 7366269 - DNA, 22 bp, Homo sapiens
tctcttggaaagcttgcccact

SEQ ID NO: 7366270 - DNA, 22 bp, Homo sapiens
tctcttggacatgtggctctgc

SEQ ID NO: 7366271 - DNA, 22 bp, Homo sapiens
tctcttggaggttcttcctgtt

SEQ ID NO: 7366272 - DNA, 22 bp, Homo sapiens
tctctcttgaagtattagctag

SEQ ID NO: 7366273 - DNA, 23 bp, Homo sapiens
tctctcttagctatgcttatggc

SEQ ID NO: 7366274 - DNA, 22 bp, Homo sapiens
tctcttggtgatagtctttctt

SEQ ID NO: 7366275 - DNA, 22 bp, Homo sapiens
tctgaaatctgtaagcactagc

SEQ ID NO: 7366276 - DNA, 22 bp, Homo sapiens
ccagccagtcccgcatgaccgc

SEQ ID NO: 7366277 - DNA, 22 bp, Homo sapiens
ccagcccctatcctcgctccac

SEQ ID NO: 7366278 - DNA, 22 bp, Homo sapiens
tctgaggcagcttgccactcta

SEQ ID NO: 7366279 - DNA, 22 bp, Homo sapiens
tctgaggagtgaccctcttgca

SEQ ID NO: 7366280 - DNA, 22 bp, Homo sapiens
tctgaggccctaccctgagcct

SEQ ID NO: 7366281 - DNA, 22 bp, Homo sapiens
tctgaggccccagccctgcaca

SEQ ID NO: 7366282 - DNA, 22 bp, Homo sapiens
tctgaggcatttaattatgacc

SEQ ID NO: 7366283 - DNA, 22 bp, Homo sapiens
tctgaggcatacccaggccccc

SEQ ID NO: 7366284 - DNA, 22 bp, Homo sapiens
ccagctgtcactcagaaaggcc

SEQ ID NO: 7366285 - DNA, 22 bp, Homo sapiens
ccagctgtgcctaggagcaggg

SEQ ID NO: 7366286 - DNA, 22 bp, Homo sapiens
tctggctgttgttaggttcctg

SEQ ID NO: 7366287 - DNA, 22 bp, Homo sapiens
tctggagcgaggtccctgtctg

SEQ ID NO: 7366288 - DNA, 22 bp, Homo sapiens
ccagctgctttttgtcacatgg

SEQ ID NO: 7366289 - DNA, 22 bp, Homo sapiens
ccagctgcttgggaaaatgtct

SEQ ID NO: 7366290 - DNA, 22 bp, Homo sapiens
tctgccttttcactgccactaa

SEQ ID NO: 7366291 - DNA, 22 bp, Homo sapiens
tctgccttttactagctggatg

SEQ ID NO: 7366292 - DNA, 22 bp, Homo sapiens
tctgcctttgtggtcgggagaa

SEQ ID NO: 7366293 - DNA, 22 bp, Homo sapiens
tctgcctttgctttggctgtca

SEQ ID NO: 7366294 - DNA, 22 bp, Homo sapiens
tctgcctttcccaggctactgt

SEQ ID NO: 7366295 - DNA, 22 bp, Homo sapiens
tctgcctttctcaagggcaaaa

SEQ ID NO: 7366296 - DNA, 22 bp, Homo sapiens
tctgccttgttgcaggcgctat

SEQ ID NO: 7366297 - DNA, 22 bp, Homo sapiens
tctgccttgtttgagctttgac

SEQ ID NO: 7366298 - DNA, 22 bp, Homo sapiens
tctgcctttcacacagacggcc

SEQ ID NO: 7366299 - DNA, 22 bp, Homo sapiens
tctgccttggaaatttcaacag

SEQ ID NO: 7366300 - DNA, 22 bp, Homo sapiens
tctgccttggcaaccacagctt

SEQ ID NO: 7366301 - DNA, 22 bp, Homo sapiens
tctgccttgccgaattccaggc

SEQ ID NO: 7366302 - DNA, 19 bp, Homo sapiens
tctgcctctggtcaggctc

SEQ ID NO: 7366303 - DNA, 22 bp, Homo sapiens
tctgtcttcatcagcatgtgat

SEQ ID NO: 7366304 - DNA, 22 bp, Homo sapiens
tctgtcttagcatctttgctca

SEQ ID NO: 7366305 - DNA, 22 bp, Homo sapiens
tctgtcttctgtagctaataat

SEQ ID NO: 7366306 - DNA, 22 bp, Homo sapiens
tctgtcttcatcagcatgtgat

SEQ ID NO: 7366307 - DNA, 21 bp, Homo sapiens
tctgtcttcctcagcctaagg

SEQ ID NO: 7366308 - DNA, 22 bp, Homo sapiens
tctgtcttcttcattgcctata

SEQ ID NO: 7366309 - DNA, 22 bp, Homo sapiens
tctgtcttctgtagctaataat

SEQ ID NO: 7366310 - DNA, 22 bp, Homo sapiens
tctgtcttggccagccatctgg

SEQ ID NO: 7366311 - DNA, 17 bp, Homo sapiens
tctgtcttgactgtcac

SEQ ID NO: 7366312 - DNA, 22 bp, Homo sapiens
ccaggaggcggaggttgcagcg

SEQ ID NO: 7366313 - DNA, 22 bp, Homo sapiens
tctgtcacccctgtttctggct

SEQ ID NO: 7366314 - DNA, 22 bp, Homo sapiens
ccaggaggcagaggttacagtg

SEQ ID NO: 7366315 - DNA, 22 bp, Homo sapiens
ccaggaggcagaggttgtagtg

SEQ ID NO: 7366316 - DNA, 22 bp, Homo sapiens
ccaggaggcggaaggtacagtg

SEQ ID NO: 7366317 - DNA, 22 bp, Homo sapiens
tctgtcactattggccagaaca

SEQ ID NO: 7366318 - DNA, 22 bp, Homo sapiens
tctgtcactctagagatggcag

SEQ ID NO: 7366319 - DNA, 22 bp, Homo sapiens
tctgtcactccctgatgatgaa

SEQ ID NO: 7366320 - DNA, 22 bp, Homo sapiens
tctgtcacccgagcaggcgaga

SEQ ID NO: 7366321 - DNA, 22 bp, Homo sapiens
tctgtcaccgagggcatccaaa

SEQ ID NO: 7366322 - DNA, 23 bp, Homo sapiens
tctgtcacctatggctgctcttc

SEQ ID NO: 7366323 - DNA, 23 bp, Homo sapiens
tctgtcactttctgctgtggagt

SEQ ID NO: 7366324 - DNA, 22 bp, Homo sapiens
tctgtcacttattaagatggat

SEQ ID NO: 7366325 - DNA, 22 bp, Homo sapiens
tctgtcacttaagaattgccta

SEQ ID NO: 7366326 - DNA, 22 bp, Homo sapiens
tctgtcacttaagaattgccta

SEQ ID NO: 7366327 - DNA, 22 bp, Homo sapiens
tctgtcactgagctcaggattc

SEQ ID NO: 7366328 - DNA, 19 bp, Homo sapiens
tctgtcactgggggtattc

SEQ ID NO: 7366329 - DNA, 22 bp, Homo sapiens
tctgtcacttttatttactgaa

SEQ ID NO: 7366330 - DNA, 22 bp, Homo sapiens
tctgtcataaacacacacaagc

SEQ ID NO: 7366331 - DNA, 22 bp, Homo sapiens
ccaggaggcagaagttgcagtg

SEQ ID NO: 7366332 - DNA, 22 bp, Homo sapiens
ccaggaggcaatatcaagtcca

SEQ ID NO: 7366333 - DNA, 22 bp, Homo sapiens
ccaggaggatgattttaagagg

SEQ ID NO: 7366334 - DNA, 22 bp, Homo sapiens
ccaggaggatggttgttaggtg

SEQ ID NO: 7366335 - DNA, 22 bp, Homo sapiens
ccaggaagctctgctccacggg

SEQ ID NO: 7366336 - DNA, 22 bp, Homo sapiens
ccaggaagcggtgagggctgcc

SEQ ID NO: 7366337 - DNA, 22 bp, Homo sapiens
ccaggaaagaggaagaacgcat

SEQ ID NO: 7366338 - DNA, 22 bp, Homo sapiens
catttggaaagagactagagaa

SEQ ID NO: 7366339 - DNA, 22 bp, Homo sapiens
catttgcaagagataaatgttt

SEQ ID NO: 7366340 - DNA, 22 bp, Homo sapiens
catttgcaaaccaacaagatga

SEQ ID NO: 7366341 - DNA, 22 bp, Homo sapiens
catttgaaattcttagaacaaa

SEQ ID NO: 7366342 - DNA, 22 bp, Homo sapiens
catttctcataatattagcact

SEQ ID NO: 7366343 - DNA, 22 bp, Homo sapiens
catttgaacctggatgttctta

SEQ ID NO: 7366344 - DNA, 22 bp, Homo sapiens
catttgaactaataactgtgct

SEQ ID NO: 7366345 - DNA, 21 bp, Homo sapiens
tccctgctttctggcccagtc

SEQ ID NO: 7366346 - DNA, 22 bp, Homo sapiens
ccaaaaattagatacacatata

SEQ ID NO: 7366347 - DNA, 22 bp, Homo sapiens
ccaaagtgctgggattacaggc

SEQ ID NO: 7366348 - DNA, 22 bp, Homo sapiens
ccaaagtgctgagattacaggt

SEQ ID NO: 7366349 - DNA, 22 bp, Homo sapiens
ccaaagtgctaggattacaggt

SEQ ID NO: 7366350 - DNA, 22 bp, Homo sapiens
ccaaagtgctaggattacaggc

SEQ ID NO: 7366351 - DNA, 22 bp, Homo sapiens
catttattagttagttcgatgt

SEQ ID NO: 7366352 - DNA, 22 bp, Homo sapiens
tcccagggcactcaccctccct

SEQ ID NO: 7366353 - DNA, 22 bp, Homo sapiens
tcccagggcagctgtccagaag

SEQ ID NO: 7366354 - DNA, 22 bp, Homo sapiens
tcccagggccgcaaacgagttt

SEQ ID NO: 7366355 - DNA, 21 bp, Homo sapiens
tcccagggccaggtgccatca

SEQ ID NO: 7366356 - DNA, 21 bp, Homo sapiens
tcccagggccaggtgccatca

SEQ ID NO: 7366357 - DNA, 22 bp, Homo sapiens
tcccagggtcagtggtgaggcc

SEQ ID NO: 7366358 - DNA, 22 bp, Homo sapiens
tcccagggtatcctgtagtaaa

SEQ ID NO: 7366359 - DNA, 22 bp, Homo sapiens
catttctcactccagcaacttt

SEQ ID NO: 7366360 - DNA, 22 bp, Homo sapiens
tcccagggtcagtggtgaggcc

SEQ ID NO: 7366361 - DNA, 22 bp, Homo sapiens
tcccagggtcagtggtgaggcc

SEQ ID NO: 7366362 - DNA, 22 bp, Homo sapiens
tcccagggcttttctcatgctt

SEQ ID NO: 7366363 - DNA, 22 bp, Homo sapiens
tcccagggggatgaacactgcc

SEQ ID NO: 7366364 - DNA, 22 bp, Homo sapiens
tcccagggcttttctcatgctt

SEQ ID NO: 7366365 - DNA, 22 bp, Homo sapiens
tcccagggctctagagtgctgg

SEQ ID NO: 7366366 - DNA, 22 bp, Homo sapiens
tcccagggctctagagtgctgg

SEQ ID NO: 7366367 - DNA, 22 bp, Homo sapiens
catttagttatactaaaacatt

SEQ ID NO: 7366368 - DNA, 22 bp, Homo sapiens
ccaaatattaacaaagtaattt

SEQ ID NO: 7366369 - DNA, 22 bp, Homo sapiens
ccaaatattaacaaagtaattt

SEQ ID NO: 7366370 - DNA, 22 bp, Homo sapiens
ccaaagtgtgggagaagaggta

SEQ ID NO: 7366371 - DNA, 22 bp, Homo sapiens
ccaaagtgctgggattacaggt

SEQ ID NO: 7366372 - DNA, 20 bp, Homo sapiens
ccaaatgtggagaaaaagta

SEQ ID NO: 7366373 - DNA, 22 bp, Homo sapiens
ccaaatgtgcctgtttcaacaa

SEQ ID NO: 7366374 - DNA, 22 bp, Homo sapiens
tcctcccacataggacaatggg

SEQ ID NO: 7366375 - DNA, 22 bp, Homo sapiens
tcctcccacataggacaatggg

SEQ ID NO: 7366376 - DNA, 22 bp, Homo sapiens
tcctgcagtgtgtctcctgcac

SEQ ID NO: 7366377 - DNA, 22 bp, Homo sapiens
tcctgcagttacatcccagcca

SEQ ID NO: 7366378 - DNA, 22 bp, Homo sapiens
ccacagaatgatgacacttcag

SEQ ID NO: 7366379 - DNA, 22 bp, Homo sapiens
ccacagaggacaactgcctggc

SEQ ID NO: 7366380 - DNA, 22 bp, Homo sapiens
ccacagcacctgcagccagttg

SEQ ID NO: 7366381 - DNA, 18 bp, Homo sapiens
ccacagcagagttcttac

SEQ ID NO: 7366382 - DNA, 22 bp, Homo sapiens
ccacagcatgcaggcctgacac

SEQ ID NO: 7366383 - DNA, 22 bp, Homo sapiens
ccacagctgacaatggatagac

SEQ ID NO: 7366384 - DNA, 23 bp, Homo sapiens
ccacagctatagggtagtgcagt

SEQ ID NO: 7366385 - DNA, 22 bp, Homo sapiens
ccactctgctgtgctccatgat

SEQ ID NO: 7366386 - DNA, 17 bp, Homo sapiens
ccactgactctgacttc

SEQ ID NO: 7366387 - DNA, 22 bp, Homo sapiens
ccactctgattttggctccact

SEQ ID NO: 7366388 - DNA, 22 bp, Homo sapiens
ccactctgatttcaagggagat

SEQ ID NO: 7366389 - DNA, 22 bp, Homo sapiens
ccacagggtcagccactctgca

SEQ ID NO: 7366390 - DNA, 18 bp, Homo sapiens
tcctggtggagaagtggt

SEQ ID NO: 7366391 - DNA, 22 bp, Homo sapiens
tcctggtctacactgcattggg

SEQ ID NO: 7366392 - DNA, 22 bp, Homo sapiens
tcctggtgaggctagaagtgtc

SEQ ID NO: 7366393 - DNA, 22 bp, Homo sapiens
ccactgcacttcagcctgggtg

SEQ ID NO: 7366394 - DNA, 22 bp, Homo sapiens
ccactgcctctccagggccatc

SEQ ID NO: 7366395 - DNA, 22 bp, Homo sapiens
ccagaaaaggagctgcaggatg

SEQ ID NO: 7366396 - DNA, 22 bp, Homo sapiens
ccagaaaagcatctggttcttt

SEQ ID NO: 7366397 - DNA, 22 bp, Homo sapiens
ccagaatcatcatctgaagcct

SEQ ID NO: 7366398 - DNA, 22 bp, Homo sapiens
ccagaagcttctacacaggaga

SEQ ID NO: 7366399 - DNA, 22 bp, Homo sapiens
ccagaagagatcacagttcttg

SEQ ID NO: 7366400 - DNA, 22 bp, Homo sapiens
ccagagctgatgggcccagggt

SEQ ID NO: 7366401 - DNA, 22 bp, Homo sapiens
ccagaatgtgtgaaatttgatg

SEQ ID NO: 7366402 - DNA, 22 bp, Homo sapiens
ccagaatgttctagagccaccc

SEQ ID NO: 7366403 - DNA, 22 bp, Homo sapiens
ccagagctgattcctgggactt

SEQ ID NO: 7366404 - DNA, 18 bp, Homo sapiens
ccagagctggctcctcgc

SEQ ID NO: 7366405 - DNA, 22 bp, Homo sapiens
ccagagctgcatccagcaggtt

SEQ ID NO: 7366406 - DNA, 22 bp, Homo sapiens
ccagagcttcggggcggctgta

SEQ ID NO: 7366407 - DNA, 22 bp, Homo sapiens
ccagaggaaaaatatctcccta

SEQ ID NO: 7366408 - DNA, 22 bp, Homo sapiens
tctctaaataacacttattgaa

SEQ ID NO: 7366409 - DNA, 22 bp, Homo sapiens
tctcccaaggcacagaaagagt

SEQ ID NO: 7366410 - DNA, 22 bp, Homo sapiens
tctcccaagggcacattcaagg

SEQ ID NO: 7366411 - DNA, 22 bp, Homo sapiens
tctctagtataatatagcaaaa

SEQ ID NO: 7366412 - DNA, 22 bp, Homo sapiens
ccagaggacttgggggctgaat

SEQ ID NO: 7366413 - DNA, 22 bp, Homo sapiens
gtggcttcttctgccagaagga

SEQ ID NO: 7366414 - DNA, 22 bp, Homo sapiens
gtgggacaaggatgaagatatt

SEQ ID NO: 7366415 - DNA, 22 bp, Homo sapiens
gtgggacacatagaaaaataag

SEQ ID NO: 7366416 - DNA, 19 bp, Homo sapiens
gtgggacagacattacata

SEQ ID NO: 7366417 - DNA, 22 bp, Homo sapiens
gtggctcacacctgtaatccca

SEQ ID NO: 7366418 - DNA, 22 bp, Homo sapiens
gtggctcacagcaatgtttcct

SEQ ID NO: 7366419 - DNA, 22 bp, Homo sapiens
gtggctcacgcctgtaatccca

SEQ ID NO: 7366420 - DNA, 22 bp, Homo sapiens
gtggcttctgcggtgtgcgcag

SEQ ID NO: 7366421 - DNA, 22 bp, Homo sapiens
gtggctcacgtctgtcatctca

SEQ ID NO: 7366422 - DNA, 22 bp, Homo sapiens
gtgggcagtggggtcttctgcc

SEQ ID NO: 7366423 - DNA, 22 bp, Homo sapiens
gtgggacagtcagaagtgagca

SEQ ID NO: 7366424 - DNA, 22 bp, Homo sapiens
gtgggacagcggggtgggacag

SEQ ID NO: 7366425 - DNA, 22 bp, Homo sapiens
gtgggacaggtcaaatcttaaa

SEQ ID NO: 7366426 - DNA, 22 bp, Homo sapiens
gtgggacagctggagggtccct

SEQ ID NO: 7366427 - DNA, 22 bp, Homo sapiens
gtgggacagctttccgttgagg

SEQ ID NO: 7366428 - DNA, 22 bp, Homo sapiens
cagctctgttcatagatggtgc

SEQ ID NO: 7366429 - DNA, 22 bp, Homo sapiens
gtggcagagatagaactggaat

SEQ ID NO: 7366430 - DNA, 22 bp, Homo sapiens
gtggccagtcccgatgcttgtt

SEQ ID NO: 7366431 - DNA, 22 bp, Homo sapiens
gtggcccacacagacagcatct

SEQ ID NO: 7366432 - DNA, 22 bp, Homo sapiens
cagctctgctggtggtgccagg

SEQ ID NO: 7366433 - DNA, 22 bp, Homo sapiens
cagctctgctggtggtgccagg

SEQ ID NO: 7366434 - DNA, 22 bp, Homo sapiens
cagctggctccacctctgggct

SEQ ID NO: 7366435 - DNA, 22 bp, Homo sapiens
cagctggcgcctggggaccaga

SEQ ID NO: 7366436 - DNA, 22 bp, Homo sapiens
cagctggcgtggagtgattgca

SEQ ID NO: 7366437 - DNA, 22 bp, Homo sapiens
cagctggccaatcagggcgccc

SEQ ID NO: 7366438 - DNA, 22 bp, Homo sapiens
cagctggcctgagcggtggcgg

SEQ ID NO: 7366439 - DNA, 19 bp, Homo sapiens
cagctgccttttctttgca

SEQ ID NO: 7366440 - DNA, 22 bp, Homo sapiens
cagctgccttctgcgggaagtc

SEQ ID NO: 7366441 - DNA, 22 bp, Homo sapiens
cagctgcctgtctggaggcaat

SEQ ID NO: 7366442 - DNA, 22 bp, Homo sapiens
cagctgcctgtattgtcctcat

SEQ ID NO: 7366443 - DNA, 22 bp, Homo sapiens
cagctgctgagaagcctccctt

SEQ ID NO: 7366444 - DNA, 22 bp, Homo sapiens
cagctgctgatggcctgacaga

SEQ ID NO: 7366445 - DNA, 22 bp, Homo sapiens
cagctgctggctccgggctaag

SEQ ID NO: 7366446 - DNA, 22 bp, Homo sapiens
cagctgctgcccttggctgcag

SEQ ID NO: 7366447 - DNA, 22 bp, Homo sapiens
cagctgctgttactgcttatta

SEQ ID NO: 7366448 - DNA, 22 bp, Homo sapiens
cagctgctttagttttccatcc

SEQ ID NO: 7366449 - DNA, 22 bp, Homo sapiens
cagctgcttctcctccagagct

SEQ ID NO: 7366450 - DNA, 22 bp, Homo sapiens
gtggggctggaagatgggtact

SEQ ID NO: 7366451 - DNA, 22 bp, Homo sapiens
gtggggctgagtggagccagaa

SEQ ID NO: 7366452 - DNA, 22 bp, Homo sapiens
cagctgcaggagaaacagaggc

SEQ ID NO: 7366453 - DNA, 22 bp, Homo sapiens
cagctgcagaaagcaagcaggt

SEQ ID NO: 7366454 - DNA, 19 bp, Homo sapiens
cagctgcaccgtgaccatc

SEQ ID NO: 7366455 - DNA, 22 bp, Homo sapiens
cagctgccacaggactttctga

SEQ ID NO: 7366456 - DNA, 22 bp, Homo sapiens
cagctgccacacctctttctct

SEQ ID NO: 7366457 - DNA, 22 bp, Homo sapiens
cagctgccaagaatcttttcta

SEQ ID NO: 7366458 - DNA, 22 bp, Homo sapiens
cagctgcattaattttagtgaa

SEQ ID NO: 7366459 - DNA, 22 bp, Homo sapiens
cagctgcatgtctgtggtggtc

SEQ ID NO: 7366460 - DNA, 22 bp, Homo sapiens
cagctgcagtgggggaccacaa

SEQ ID NO: 7366461 - DNA, 22 bp, Homo sapiens
cagctgcagtgggggaccacaa

SEQ ID NO: 7366462 - DNA, 22 bp, Homo sapiens
cagctgcaggctgtgcaggaag

SEQ ID NO: 7366463 - DNA, 18 bp, Homo sapiens
cagctgcaggctcaggac

SEQ ID NO: 7366464 - DNA, 22 bp, Homo sapiens
cagctgcaggagctgagcactt

SEQ ID NO: 7366465 - DNA, 22 bp, Homo sapiens
cagctgccctgccttgccctta

SEQ ID NO: 7366466 - DNA, 22 bp, Homo sapiens
cagctgcccctccagggctggg

SEQ ID NO: 7366467 - DNA, 22 bp, Homo sapiens
cagctgcctatgacctagcctc

SEQ ID NO: 7366468 - DNA, 20 bp, Homo sapiens
cagctgcctggctctgggat

SEQ ID NO: 7366469 - DNA, 22 bp, Homo sapiens
cagctgcctgcaacacaagctt

SEQ ID NO: 7366470 - DNA, 22 bp, Homo sapiens
cagctgtctggggagtgctcgc

SEQ ID NO: 7366471 - DNA, 22 bp, Homo sapiens
cagctgggcctcctgagccctg

SEQ ID NO: 7366472 - DNA, 22 bp, Homo sapiens
cagctggctgcggtgaggggac

SEQ ID NO: 7366473 - DNA, 22 bp, Homo sapiens
cagctggcttgtttgttcttga

SEQ ID NO: 7366474 - DNA, 22 bp, Homo sapiens
gtgtggaatggagtttttgccc

SEQ ID NO: 7366475 - DNA, 22 bp, Homo sapiens
gtgtggaaccaaataacctaaa

SEQ ID NO: 7366476 - DNA, 22 bp, Homo sapiens
gtgtctgcatattcaaacttgt

SEQ ID NO: 7366477 - DNA, 22 bp, Homo sapiens
gtgtagatagtttagatttcaa

SEQ ID NO: 7366478 - DNA, 22 bp, Homo sapiens
gtgtagatgcttgtgtacaact

SEQ ID NO: 7366479 - DNA, 22 bp, Homo sapiens
caggaaaggtagtcacaatgta

SEQ ID NO: 7366480 - DNA, 22 bp, Homo sapiens
caggaaaggtgtgtcatgatgg

SEQ ID NO: 7366481 - DNA, 22 bp, Homo sapiens
caggaaagtctgtaaaggaacc

SEQ ID NO: 7366482 - DNA, 22 bp, Homo sapiens
caggaaagggatgggctgccac

SEQ ID NO: 7366483 - DNA, 22 bp, Homo sapiens
caggaaagccgagtgccatagg

SEQ ID NO: 7366484 - DNA, 22 bp, Homo sapiens
gttggctcattttatagacagc

SEQ ID NO: 7366485 - DNA, 22 bp, Homo sapiens
caggaaataaaaagtatcttct

SEQ ID NO: 7366486 - DNA, 22 bp, Homo sapiens
caggaaatggctgaataaattc

SEQ ID NO: 7366487 - DNA, 22 bp, Homo sapiens
gttcctaaccagcagagaaaca

SEQ ID NO: 7366488 - DNA, 22 bp, Homo sapiens
gttccgcttcatatttggagtc

SEQ ID NO: 7366489 - DNA, 22 bp, Homo sapiens
gttcacagttaggacaactgct

SEQ ID NO: 7366490 - DNA, 22 bp, Homo sapiens
gttggaaatgcagagtctcaga

SEQ ID NO: 7366491 - DNA, 22 bp, Homo sapiens
gttgcttgttagtggtgaggtt

SEQ ID NO: 7366492 - DNA, 22 bp, Homo sapiens
gttcttaaagattcatcaagca

SEQ ID NO: 7366493 - DNA, 22 bp, Homo sapiens
gtttacaacatcttgtccttca

SEQ ID NO: 7366494 - DNA, 22 bp, Homo sapiens
gtttacatgcagaaaatcaatg

SEQ ID NO: 7366495 - DNA, 22 bp, Homo sapiens
caggaacaatcttactactatt

SEQ ID NO: 7366496 - DNA, 22 bp, Homo sapiens
caggaacacaagttcagggatg

SEQ ID NO: 7366497 - DNA, 22 bp, Homo sapiens
caggaagaggtatcaccgagca

SEQ ID NO: 7366498 - DNA, 22 bp, Homo sapiens
caggaacatgttggaaagaaat

SEQ ID NO: 7366499 - DNA, 19 bp, Homo sapiens
gtttccttgggtgtaggga

SEQ ID NO: 7366500 - DNA, 22 bp, Homo sapiens
gtttcctttctattgccttgat

SEQ ID NO: 7366501 - DNA, 22 bp, Homo sapiens
gtttcctttaatagtgatattg

SEQ ID NO: 7366502 - DNA, 22 bp, Homo sapiens
gtttcaaaagtcaggctattct

SEQ ID NO: 7366503 - DNA, 22 bp, Homo sapiens
gtttattgggtattgtggagcc

SEQ ID NO: 7366504 - DNA, 22 bp, Homo sapiens
gtttattgataaaagctggaca

SEQ ID NO: 7366505 - DNA, 22 bp, Homo sapiens
gtttacattaagtattagcatc

SEQ ID NO: 7366506 - DNA, 22 bp, Homo sapiens
cagctgtgctgattgctcagta

SEQ ID NO: 7366507 - DNA, 22 bp, Homo sapiens
cagctgtggggagcttgggcca

SEQ ID NO: 7366508 - DNA, 22 bp, Homo sapiens
cagctgtggctgccactgctcc

SEQ ID NO: 7366509 - DNA, 22 bp, Homo sapiens
cagcttcaccagggccatggtt

SEQ ID NO: 7366510 - DNA, 22 bp, Homo sapiens
cagcttccgaccgggggctgca

SEQ ID NO: 7366511 - DNA, 22 bp, Homo sapiens
gtgtgtgcaagaggtttattga

SEQ ID NO: 7366512 - DNA, 22 bp, Homo sapiens
gtgtgtgccaactttatgtgca

SEQ ID NO: 7366513 - DNA, 22 bp, Homo sapiens
gttacaaatgtaaattctgggg

SEQ ID NO: 7366514 - DNA, 22 bp, Homo sapiens
gttacaaatgccaaagctgaga

SEQ ID NO: 7366515 - DNA, 21 bp, Homo sapiens
caggaaagaaaacgtacatat

SEQ ID NO: 7366516 - DNA, 21 bp, Homo sapiens
caggaaagaaaacgtacatat

SEQ ID NO: 7366517 - DNA, 22 bp, Homo sapiens
caggaaaatgtcaatggaaagc

SEQ ID NO: 7366518 - DNA, 22 bp, Homo sapiens
gttcacaagctgattgtctttc

SEQ ID NO: 7366519 - DNA, 22 bp, Homo sapiens
gttcacaatttttactgattgg

SEQ ID NO: 7366520 - DNA, 22 bp, Homo sapiens
cagctttgattcactgcctagt

SEQ ID NO: 7366521 - DNA, 22 bp, Homo sapiens
cagctttgaaacatggctctag

SEQ ID NO: 7366522 - DNA, 22 bp, Homo sapiens
cagctttgacctaaagtaggaa

SEQ ID NO: 7366523 - DNA, 22 bp, Homo sapiens
cagctttgagagttgcatttta

SEQ ID NO: 7366524 - DNA, 22 bp, Homo sapiens
cagctttgagcagccagtggca

SEQ ID NO: 7366525 - DNA, 22 bp, Homo sapiens
caggaaaatggaatcacctgta

SEQ ID NO: 7366526 - DNA, 22 bp, Homo sapiens
caggaaaatggaatcacctgta

SEQ ID NO: 7366527 - DNA, 22 bp, Homo sapiens
cagctttaggactcataataaa

SEQ ID NO: 7366528 - DNA, 22 bp, Homo sapiens
cagctttagagaaaacatattt

SEQ ID NO: 7366529 - DNA, 22 bp, Homo sapiens
cagcttgctaattttgacttca

SEQ ID NO: 7366530 - DNA, 22 bp, Homo sapiens
cagcttgctaactggtaggggt

SEQ ID NO: 7366531 - DNA, 22 bp, Homo sapiens
cagcttctgctatcgaacatct

SEQ ID NO: 7366532 - DNA, 22 bp, Homo sapiens
cagcttgcagtacttgtttttg

SEQ ID NO: 7366533 - DNA, 22 bp, Homo sapiens
cagcttgctcaaggttatagat

SEQ ID NO: 7366534 - DNA, 20 bp, Homo sapiens
cagcttgctttgggacattt

SEQ ID NO: 7366535 - DNA, 22 bp, Homo sapiens
cagcttggcttcacattctgta

SEQ ID NO: 7366536 - DNA, 22 bp, Homo sapiens
cagcttgggggcgctggcctca

SEQ ID NO: 7366537 - DNA, 22 bp, Homo sapiens
cagcttctccattcttctggct

SEQ ID NO: 7366538 - DNA, 22 bp, Homo sapiens
cagcttctcgggagcgcatgtg

SEQ ID NO: 7366539 - DNA, 22 bp, Homo sapiens
cagcttctccagatgaccctca

SEQ ID NO: 7366540 - DNA, 22 bp, Homo sapiens
gttattctaccactatgtacag

SEQ ID NO: 7366541 - DNA, 22 bp, Homo sapiens
gttattctttgtatggtacatc

SEQ ID NO: 7366542 - DNA, 22 bp, Homo sapiens
cagcttctaccatcaggaaatt

SEQ ID NO: 7366543 - DNA, 22 bp, Homo sapiens
gttattgaggtggagtctcact

SEQ ID NO: 7366544 - DNA, 22 bp, Homo sapiens
gttattcaatggcttataagga

SEQ ID NO: 7366545 - DNA, 22 bp, Homo sapiens
gttattctacagtcattgaagt

SEQ ID NO: 7366546 - DNA, 22 bp, Homo sapiens
taaagcatgtactgtgtgctag

SEQ ID NO: 7366547 - DNA, 22 bp, Homo sapiens
taaagcagtgcaaaagcgtttt

SEQ ID NO: 7366548 - DNA, 22 bp, Homo sapiens
caggagcctcctgattccaatt

SEQ ID NO: 7366549 - DNA, 22 bp, Homo sapiens
caggagcccgttgctccggcgg

SEQ ID NO: 7366550 - DNA, 22 bp, Homo sapiens
caggagcccgttgctccggcgg

SEQ ID NO: 7366551 - DNA, 22 bp, Homo sapiens
caggagaggctgtacgtttctc

SEQ ID NO: 7366552 - DNA, 22 bp, Homo sapiens
caggagatgacagggaagaacc

SEQ ID NO: 7366553 - DNA, 19 bp, Homo sapiens
caggagagcatgcactttg

SEQ ID NO: 7366554 - DNA, 22 bp, Homo sapiens
caggagactcagcatccaggat

SEQ ID NO: 7366555 - DNA, 22 bp, Homo sapiens
caggagagatatgagtccccac

SEQ ID NO: 7366556 - DNA, 22 bp, Homo sapiens
taaagccaacactttactgctc

SEQ ID NO: 7366557 - DNA, 22 bp, Homo sapiens
taaagccaatatacctagcata

SEQ ID NO: 7366558 - DNA, 22 bp, Homo sapiens
taaagccaatatacctagcata

SEQ ID NO: 7366559 - DNA, 22 bp, Homo sapiens
taaagcatgtgttagaagtgca

SEQ ID NO: 7366560 - DNA, 22 bp, Homo sapiens
taaagccacgctggaaatcagg

SEQ ID NO: 7366561 - DNA, 22 bp, Homo sapiens
taaagtcatctttaaacatgcc

SEQ ID NO: 7366562 - DNA, 22 bp, Homo sapiens
taaagtcatctttacatctttg

SEQ ID NO: 7366563 - DNA, 22 bp, Homo sapiens
taaagtcagatatctgggttga

SEQ ID NO: 7366564 - DNA, 22 bp, Homo sapiens
taaatgcttagattcatagaaa

SEQ ID NO: 7366565 - DNA, 22 bp, Homo sapiens
taaatcacaaattttctcattt

SEQ ID NO: 7366566 - DNA, 22 bp, Homo sapiens
taaatatcagtccagctcttcc

SEQ ID NO: 7366567 - DNA, 22 bp, Homo sapiens
taaatatcagtccagctcttcc

SEQ ID NO: 7366568 - DNA, 18 bp, Homo sapiens
taaatatatttccccctt

SEQ ID NO: 7366569 - DNA, 22 bp, Homo sapiens
taaatagaatctaaactgctca

SEQ ID NO: 7366570 - DNA, 22 bp, Homo sapiens
taaagtgagtacaaaatgaggg

SEQ ID NO: 7366571 - DNA, 22 bp, Homo sapiens
caggagtgtctccacacagcaa

SEQ ID NO: 7366572 - DNA, 22 bp, Homo sapiens
caggagtgtcgggtcactaggt

SEQ ID NO: 7366573 - DNA, 22 bp, Homo sapiens
caggagtggcacccttttccct

SEQ ID NO: 7366574 - DNA, 22 bp, Homo sapiens
caggagtggtgtgagggactcc

SEQ ID NO: 7366575 - DNA, 22 bp, Homo sapiens
caggagtgcaggtggtgaggca

SEQ ID NO: 7366576 - DNA, 22 bp, Homo sapiens
caggagtgagttggggtctaca

SEQ ID NO: 7366577 - DNA, 22 bp, Homo sapiens
caggagtgagatgcgatcactt

SEQ ID NO: 7366578 - DNA, 22 bp, Homo sapiens
caggagtgtttgctacagtttc

SEQ ID NO: 7366579 - DNA, 22 bp, Homo sapiens
caggagtgttgattgctcagga

SEQ ID NO: 7366580 - DNA, 22 bp, Homo sapiens
caggagtgttgattgctcagga

SEQ ID NO: 7366581 - DNA, 22 bp, Homo sapiens
caggatagaaaggccatggagt

SEQ ID NO: 7366582 - DNA, 22 bp, Homo sapiens
caggataaatagtaaatgtaag

SEQ ID NO: 7366583 - DNA, 22 bp, Homo sapiens
caggatactacaacaggactgt

SEQ ID NO: 7366584 - DNA, 22 bp, Homo sapiens
taacaaaggttgccaaactaag

SEQ ID NO: 7366585 - DNA, 22 bp, Homo sapiens
taacaaagtaccatagattggg

SEQ ID NO: 7366586 - DNA, 22 bp, Homo sapiens
taacaaagtaccatagactgga

SEQ ID NO: 7366587 - DNA, 22 bp, Homo sapiens
caggagggcccgagactcttcc

SEQ ID NO: 7366588 - DNA, 22 bp, Homo sapiens
caggagggcccgagactcttcc

SEQ ID NO: 7366589 - DNA, 22 bp, Homo sapiens
caggaggctcctagggctctgt

SEQ ID NO: 7366590 - DNA, 22 bp, Homo sapiens
caggaggcccggccacagccca

SEQ ID NO: 7366591 - DNA, 23 bp, Homo sapiens
caggagggaatgaagttagacaa

SEQ ID NO: 7366592 - DNA, 22 bp, Homo sapiens
caggaggcccacaggcccctgc

SEQ ID NO: 7366593 - DNA, 22 bp, Homo sapiens
caggaggcccaaagggcgcaga

SEQ ID NO: 7366594 - DNA, 22 bp, Homo sapiens
caggaggcccggccacagccca

SEQ ID NO: 7366595 - DNA, 22 bp, Homo sapiens
caggaggccaactgtgggactt

SEQ ID NO: 7366596 - DNA, 22 bp, Homo sapiens
taaatgtaccttctgccttact

SEQ ID NO: 7366597 - DNA, 22 bp, Homo sapiens
taaatgtataggcactaaacct

SEQ ID NO: 7366598 - DNA, 22 bp, Homo sapiens
taaatgtcaatgtgatttataa

SEQ ID NO: 7366599 - DNA, 22 bp, Homo sapiens
taaatgtctgttaacatgaatg

SEQ ID NO: 7366600 - DNA, 22 bp, Homo sapiens
taaatgtctcccgtgagcctca

SEQ ID NO: 7366601 - DNA, 22 bp, Homo sapiens
taaatgtctttgtcacgttggg

SEQ ID NO: 7366602 - DNA, 22 bp, Homo sapiens
caggaggcaggtgcattttgag

SEQ ID NO: 7366603 - DNA, 22 bp, Homo sapiens
caggaggcagtttcagaagtca

SEQ ID NO: 7366604 - DNA, 22 bp, Homo sapiens
caggaggcagtttcagaagtca

SEQ ID NO: 7366605 - DNA, 22 bp, Homo sapiens
caggaggcagaggttgcagcga

SEQ ID NO: 7366606 - DNA, 22 bp, Homo sapiens
caggaggcagcgctctcaggac

SEQ ID NO: 7366607 - DNA, 22 bp, Homo sapiens
caggaggcagaggatgcccagt

SEQ ID NO: 7366608 - DNA, 20 bp, Homo sapiens
caggaggcaaggtcaaggtc

SEQ ID NO: 7366609 - DNA, 20 bp, Homo sapiens
caggaggcaaggtcaaggtc

SEQ ID NO: 7366610 - DNA, 22 bp, Homo sapiens
caggaggaaatgtgaccctgct

SEQ ID NO: 7366611 - DNA, 22 bp, Homo sapiens
caggaggaaagttccactcaac

SEQ ID NO: 7366612 - DNA, 22 bp, Homo sapiens
caggaggaacaagaggttctgg

SEQ ID NO: 7366613 - DNA, 22 bp, Homo sapiens
caggacccaacctccctgctct

SEQ ID NO: 7366614 - DNA, 22 bp, Homo sapiens
caggacccatcagccaggcact

SEQ ID NO: 7366615 - DNA, 22 bp, Homo sapiens
caggaccccatattcactgaac

SEQ ID NO: 7366616 - DNA, 22 bp, Homo sapiens
taaacatttgttattcttgttt

SEQ ID NO: 7366617 - DNA, 22 bp, Homo sapiens
taaacatttgttattcttgttt

SEQ ID NO: 7366618 - DNA, 22 bp, Homo sapiens
taaaccaagtgtccatattagt

SEQ ID NO: 7366619 - DNA, 22 bp, Homo sapiens
taaacatttgttattcttgttt

SEQ ID NO: 7366620 - DNA, 22 bp, Homo sapiens
taaacatttgttattcttgttt

SEQ ID NO: 7366621 - DNA, 22 bp, Homo sapiens
taaaccttatttgaataccaac

SEQ ID NO: 7366622 - DNA, 22 bp, Homo sapiens
taaaccttcatgatggtcatta

SEQ ID NO: 7366623 - DNA, 18 bp, Homo sapiens
taaacctttcttgtggca

SEQ ID NO: 7366624 - DNA, 22 bp, Homo sapiens
taaactatctgtgtttgaagtt

SEQ ID NO: 7366625 - DNA, 22 bp, Homo sapiens
taaactatctgtgtttgaagtt

SEQ ID NO: 7366626 - DNA, 19 bp, Homo sapiens
taaaaactgaaggaagcag

SEQ ID NO: 7366627 - DNA, 22 bp, Homo sapiens
gttttcttcctgcaattggcat

SEQ ID NO: 7366628 - DNA, 22 bp, Homo sapiens
taaaaaacattactctgtcctg

SEQ ID NO: 7366629 - DNA, 22 bp, Homo sapiens
taaaaaacattactctgtcctg

SEQ ID NO: 7366630 - DNA, 22 bp, Homo sapiens
taaaaaacattactctgtcctg

SEQ ID NO: 7366631 - DNA, 22 bp, Homo sapiens
gttttctaccagggaagagagt

SEQ ID NO: 7366632 - DNA, 22 bp, Homo sapiens
taaaatcattctggtgtcagta

SEQ ID NO: 7366633 - DNA, 22 bp, Homo sapiens
taaaatcaccaaaagcaggtgg

SEQ ID NO: 7366634 - DNA, 22 bp, Homo sapiens
taaaatagcttatgtcttttga

SEQ ID NO: 7366635 - DNA, 22 bp, Homo sapiens
taaaatagccagtgcccctctg

SEQ ID NO: 7366636 - DNA, 22 bp, Homo sapiens
taaaatagcatgtgcagtgaaa

SEQ ID NO: 7366637 - DNA, 22 bp, Homo sapiens
taaaaagttgaaaggacttatc

SEQ ID NO: 7366638 - DNA, 22 bp, Homo sapiens
taaaaagtagtgagaatggcgc

SEQ ID NO: 7366639 - DNA, 22 bp, Homo sapiens
taaaaatcttatgaatggcaag

SEQ ID NO: 7366640 - DNA, 22 bp, Homo sapiens
gtttggaagttaagtgcagcag

SEQ ID NO: 7366641 - DNA, 22 bp, Homo sapiens
gtttggaatagcagtaaacatt

SEQ ID NO: 7366642 - DNA, 22 bp, Homo sapiens
caggaagtgcctggtgagagga

SEQ ID NO: 7366643 - DNA, 22 bp, Homo sapiens
caggacagtataggctttagga

SEQ ID NO: 7366644 - DNA, 22 bp, Homo sapiens
caggaatgatctgctgagtgat

SEQ ID NO: 7366645 - DNA, 22 bp, Homo sapiens
caggacactaaaaagccaagct

SEQ ID NO: 7366646 - DNA, 22 bp, Homo sapiens
caggaatgtttgtgctccttta

SEQ ID NO: 7366647 - DNA, 22 bp, Homo sapiens
taacttgtgttacattactctt

SEQ ID NO: 7366648 - DNA, 19 bp, Homo sapiens
taacttgtagatatgaagt

SEQ ID NO: 7366649 - DNA, 22 bp, Homo sapiens
taagaaacatgatacttttcct

SEQ ID NO: 7366650 - DNA, 22 bp, Homo sapiens
taacttttctaggtgtgataat

SEQ ID NO: 7366651 - DNA, 22 bp, Homo sapiens
taactttgaagggaattttact

SEQ ID NO: 7366652 - DNA, 22 bp, Homo sapiens
caggatgagaggcccagggaag

SEQ ID NO: 7366653 - DNA, 22 bp, Homo sapiens
caggatgagaagggctcttacg

SEQ ID NO: 7366654 - DNA, 22 bp, Homo sapiens
caggatgaccatatgttccagt

SEQ ID NO: 7366655 - DNA, 22 bp, Homo sapiens
caggatgaagggcaaaggcaag

SEQ ID NO: 7366656 - DNA, 22 bp, Homo sapiens
caggatgaggtagaggcagata

SEQ ID NO: 7366657 - DNA, 22 bp, Homo sapiens
caggatattagttttcttgtta

SEQ ID NO: 7366658 - DNA, 22 bp, Homo sapiens
taagaaacatttttatgacagt

SEQ ID NO: 7366659 - DNA, 20 bp, Homo sapiens
caggatgattggacacgatg

SEQ ID NO: 7366660 - DNA, 22 bp, Homo sapiens
caggatgatgagtagagtgtga

SEQ ID NO: 7366661 - DNA, 18 bp, Homo sapiens
caggatgagtgatgggga

SEQ ID NO: 7366662 - DNA, 19 bp, Homo sapiens
caggatgatcccatgacac

SEQ ID NO: 7366663 - DNA, 21 bp, Homo sapiens
caggatgatgataattcatgg

SEQ ID NO: 7366664 - DNA, 21 bp, Homo sapiens
caggatgatgggaaggtggtg

SEQ ID NO: 7366665 - DNA, 22 bp, Homo sapiens
caggatgatgttaattgaagtt

SEQ ID NO: 7366666 - DNA, 22 bp, Homo sapiens
caggatggagagtgaggggtca

SEQ ID NO: 7366667 - DNA, 22 bp, Homo sapiens
caggatggtggcatgatcagaa

SEQ ID NO: 7366668 - DNA, 22 bp, Homo sapiens
taacagaaatagaaatgagagt

SEQ ID NO: 7366669 - DNA, 22 bp, Homo sapiens
taacatttaaatttttcacata

SEQ ID NO: 7366670 - DNA, 22 bp, Homo sapiens
taacattaggtagacataagcc

SEQ ID NO: 7366671 - DNA, 22 bp, Homo sapiens
taacagaaaggggacagaaata

SEQ ID NO: 7366672 - DNA, 22 bp, Homo sapiens
taacacttgggggcatccttag

SEQ ID NO: 7366673 - DNA, 22 bp, Homo sapiens
taacactttggattaaaattct

SEQ ID NO: 7366674 - DNA, 22 bp, Homo sapiens
taacacttgaagccatttttgc

SEQ ID NO: 7366675 - DNA, 22 bp, Homo sapiens
taacacttcagatgattttgtt

SEQ ID NO: 7366676 - DNA, 22 bp, Homo sapiens
taacaatacccattctaattac

SEQ ID NO: 7366677 - DNA, 22 bp, Homo sapiens
taacaatacccattctaattac

SEQ ID NO: 7366678 - DNA, 22 bp, Homo sapiens
taacaatacccattctaattac

SEQ ID NO: 7366679 - DNA, 22 bp, Homo sapiens
taacaatacccattctaattac

SEQ ID NO: 7366680 - DNA, 22 bp, Homo sapiens
taacaagatatatgacttggat

SEQ ID NO: 7366681 - DNA, 22 bp, Homo sapiens
taacaacttgcttttatcttag

SEQ ID NO: 7366682 - DNA, 22 bp, Homo sapiens
caggcacagtggggtcctctct

SEQ ID NO: 7366683 - DNA, 22 bp, Homo sapiens
caggcacagctgggcaattgcg

SEQ ID NO: 7366684 - DNA, 22 bp, Homo sapiens
caggcacagtgttgctgttcaa

SEQ ID NO: 7366685 - DNA, 22 bp, Homo sapiens
taagacaattcttcagtcacaa

SEQ ID NO: 7366686 - DNA, 22 bp, Homo sapiens
caggatggtgtgagtgtgagga

SEQ ID NO: 7366687 - DNA, 22 bp, Homo sapiens
caggatggtgtgagtgtgagga

SEQ ID NO: 7366688 - DNA, 22 bp, Homo sapiens
taagcaaaggattttgatcttt

SEQ ID NO: 7366689 - DNA, 22 bp, Homo sapiens
taagatttttaaaatgtcctca

SEQ ID NO: 7366690 - DNA, 22 bp, Homo sapiens
taagcaaaagtcgagtgtgagc

SEQ ID NO: 7366691 - DNA, 22 bp, Homo sapiens
taagcaaaagtcgagtgtgagc

SEQ ID NO: 7366692 - DNA, 22 bp, Homo sapiens
taagcaaaagtcgagtgtgagc

SEQ ID NO: 7366693 - DNA, 22 bp, Homo sapiens
taagcaaagtttataaggctct

SEQ ID NO: 7366694 - DNA, 22 bp, Homo sapiens
taagcaaataatgcatcaaggg

SEQ ID NO: 7366695 - DNA, 22 bp, Homo sapiens
taagattatacttaaagagaaa

SEQ ID NO: 7366696 - DNA, 22 bp, Homo sapiens
taagattatttggaggccaaga

SEQ ID NO: 7366697 - DNA, 22 bp, Homo sapiens
taaggcacacagttgctgcatg

SEQ ID NO: 7366698 - DNA, 22 bp, Homo sapiens
taaggcaccataatatatttaa

SEQ ID NO: 7366699 - DNA, 22 bp, Homo sapiens
taaggcacccatgttcatacag

SEQ ID NO: 7366700 - DNA, 22 bp, Homo sapiens
taagcaaatagctagatcagag

SEQ ID NO: 7366701 - DNA, 22 bp, Homo sapiens
taagcaaatagctagatcagag

SEQ ID NO: 7366702 - DNA, 22 bp, Homo sapiens
taagcaaatagctagatcagag

SEQ ID NO: 7366703 - DNA, 22 bp, Homo sapiens
taaggcacccttctgagtagag

SEQ ID NO: 7366704 - DNA, 22 bp, Homo sapiens
taaggcacccgtgagctgccag

SEQ ID NO: 7366705 - DNA, 22 bp, Homo sapiens
taaggcacctgtccaggctggg

SEQ ID NO: 7366706 - DNA, 22 bp, Homo sapiens
taaggcacgcataagagggggc

SEQ ID NO: 7366707 - DNA, 22 bp, Homo sapiens
taaggcacttcaatgtttagaa

SEQ ID NO: 7366708 - DNA, 22 bp, Homo sapiens
taaggcacgcggtgaatgccaa

SEQ ID NO: 7366709 - DNA, 22 bp, Homo sapiens
taaggcagaaatatgagcaggg

SEQ ID NO: 7366710 - DNA, 22 bp, Homo sapiens
caggcactcagtctggatccct

SEQ ID NO: 7366711 - DNA, 19 bp, Homo sapiens
taaggcagcagtgacaggc

SEQ ID NO: 7366712 - DNA, 22 bp, Homo sapiens
taaggcagccgctcagagaggt

SEQ ID NO: 7366713 - DNA, 22 bp, Homo sapiens
taatttactcagatgttcaatc

SEQ ID NO: 7366714 - DNA, 22 bp, Homo sapiens
taattgttttcaatgttaatga

SEQ ID NO: 7366715 - DNA, 22 bp, Homo sapiens
taattgttttcaatgttaatga

SEQ ID NO: 7366716 - DNA, 22 bp, Homo sapiens
taatttaattccatggattcta

SEQ ID NO: 7366717 - DNA, 22 bp, Homo sapiens
taattgggcaatttaggactag

SEQ ID NO: 7366718 - DNA, 22 bp, Homo sapiens
taattggtgagagagctgagtc

SEQ ID NO: 7366719 - DNA, 22 bp, Homo sapiens
caggcagagcaactggtccaga

SEQ ID NO: 7366720 - DNA, 22 bp, Homo sapiens
caggcagaaggaagtaccaggc

SEQ ID NO: 7366721 - DNA, 22 bp, Homo sapiens
caggcagaaggaagtaccaggc

SEQ ID NO: 7366722 - DNA, 22 bp, Homo sapiens
caggcagaagaagtggaaggac

SEQ ID NO: 7366723 - DNA, 22 bp, Homo sapiens
caggcagagaactcatccgtga

SEQ ID NO: 7366724 - DNA, 22 bp, Homo sapiens
caggcagactttgagaatgatg

SEQ ID NO: 7366725 - DNA, 22 bp, Homo sapiens
caggcagagacgtcagtgtagg

SEQ ID NO: 7366726 - DNA, 22 bp, Homo sapiens
caggcagctgctgggttcagcc

SEQ ID NO: 7366727 - DNA, 22 bp, Homo sapiens
caggcagctgcgacaagagagc

SEQ ID NO: 7366728 - DNA, 22 bp, Homo sapiens
caggcagctgaggactttgcta

SEQ ID NO: 7366729 - DNA, 22 bp, Homo sapiens
caggcagctgctgggttcagcc

SEQ ID NO: 7366730 - DNA, 22 bp, Homo sapiens
caggcagctgggtcaccgtccc

SEQ ID NO: 7366731 - DNA, 22 bp, Homo sapiens
caggcaggagacatttggttgg

SEQ ID NO: 7366732 - DNA, 23 bp, Homo sapiens
caggcaggatgaggactacactc

SEQ ID NO: 7366733 - DNA, 22 bp, Homo sapiens
caggcaggctgctttttgttca

SEQ ID NO: 7366734 - DNA, 22 bp, Homo sapiens
caggcagccctgcaccaagtgt

SEQ ID NO: 7366735 - DNA, 22 bp, Homo sapiens
caggcagccaggggacctgtcc

SEQ ID NO: 7366736 - DNA, 22 bp, Homo sapiens
caggcagcctgagggatctggg

SEQ ID NO: 7366737 - DNA, 22 bp, Homo sapiens
caggcagctcgatgccttgttg

SEQ ID NO: 7366738 - DNA, 22 bp, Homo sapiens
caggcagctctaatggaaagtg

SEQ ID NO: 7366739 - DNA, 22 bp, Homo sapiens
caggcagctctaatggaaagtg

SEQ ID NO: 7366740 - DNA, 22 bp, Homo sapiens
caggcagctgactgtcagatat

SEQ ID NO: 7366741 - DNA, 22 bp, Homo sapiens
caggcagctctgcttttcctaa

SEQ ID NO: 7366742 - DNA, 22 bp, Homo sapiens
caggcagcatcagtctgctgta

SEQ ID NO: 7366743 - DNA, 22 bp, Homo sapiens
caggcagcatttactctgatga

SEQ ID NO: 7366744 - DNA, 22 bp, Homo sapiens
caggcagcagccactctggtat

SEQ ID NO: 7366745 - DNA, 22 bp, Homo sapiens
taatttacttgcaaataacaat

SEQ ID NO: 7366746 - DNA, 22 bp, Homo sapiens
caggcagcaggagccctgctcg

SEQ ID NO: 7366747 - DNA, 22 bp, Homo sapiens
tacaaattaatgggcatgttta

SEQ ID NO: 7366748 - DNA, 22 bp, Homo sapiens
tacaaattaatgggcatgttta

SEQ ID NO: 7366749 - DNA, 20 bp, Homo sapiens
tacaaattttccatgtttcc

SEQ ID NO: 7366750 - DNA, 22 bp, Homo sapiens
caggcagggagctggaaaggat

SEQ ID NO: 7366751 - DNA, 22 bp, Homo sapiens
tacaagtgtgcaccaccatgtc

SEQ ID NO: 7366752 - DNA, 22 bp, Homo sapiens
tacaagtgtggctcctctgtct

SEQ ID NO: 7366753 - DNA, 22 bp, Homo sapiens
caggccctgggcaggcacagag

SEQ ID NO: 7366754 - DNA, 22 bp, Homo sapiens
caggccctgggcaggatcagcc

SEQ ID NO: 7366755 - DNA, 22 bp, Homo sapiens
caggccctggcagggctgagtc

SEQ ID NO: 7366756 - DNA, 18 bp, Homo sapiens
caggccctgtctggcctc

SEQ ID NO: 7366757 - DNA, 22 bp, Homo sapiens
caggccctgtgctgggtgatgt

SEQ ID NO: 7366758 - DNA, 22 bp, Homo sapiens
caggccctttcctgggcatagg

SEQ ID NO: 7366759 - DNA, 22 bp, Homo sapiens
caggccctgctgctgagacctt

SEQ ID NO: 7366760 - DNA, 19 bp, Homo sapiens
caggccctggacccatctg

SEQ ID NO: 7366761 - DNA, 22 bp, Homo sapiens
tacatgtgataaattgattaaa

SEQ ID NO: 7366762 - DNA, 22 bp, Homo sapiens
tacatcatggcttcatgctgca

SEQ ID NO: 7366763 - DNA, 22 bp, Homo sapiens
tacatgtggagataactgaagc

SEQ ID NO: 7366764 - DNA, 22 bp, Homo sapiens
tacatgtggagttttctagtca

SEQ ID NO: 7366765 - DNA, 22 bp, Homo sapiens
tacatgtgctgggttcttggcc

SEQ ID NO: 7366766 - DNA, 22 bp, Homo sapiens
tacatcaagataaaaactgtca

SEQ ID NO: 7366767 - DNA, 22 bp, Homo sapiens
tacatcaagataaaaactgtca

SEQ ID NO: 7366768 - DNA, 22 bp, Homo sapiens
tacatcataataatacttagaa

SEQ ID NO: 7366769 - DNA, 21 bp, Homo sapiens
tacatcagttttcttggctca

SEQ ID NO: 7366770 - DNA, 22 bp, Homo sapiens
tacatatagacagttactctag

SEQ ID NO: 7366771 - DNA, 22 bp, Homo sapiens
tacatatttgtctttgtactgt

SEQ ID NO: 7366772 - DNA, 22 bp, Homo sapiens
tacatattcaacgttcagtatt

SEQ ID NO: 7366773 - DNA, 22 bp, Homo sapiens
tacatattcaacgttcagtatt

SEQ ID NO: 7366774 - DNA, 22 bp, Homo sapiens
ttgtatttgattgtcatatcgt

SEQ ID NO: 7366775 - DNA, 22 bp, Homo sapiens
ttgtatttgggtagtatagaga

SEQ ID NO: 7366776 - DNA, 22 bp, Homo sapiens
ttgggtgctgtcatggggcacg

SEQ ID NO: 7366777 - DNA, 22 bp, Homo sapiens
ttgggtgggtcaggactcggag

SEQ ID NO: 7366778 - DNA, 22 bp, Homo sapiens
ttggtagaatgaacattcattg

SEQ ID NO: 7366779 - DNA, 22 bp, Homo sapiens
ttggtattttacaatgtcagtg

SEQ ID NO: 7366780 - DNA, 22 bp, Homo sapiens
ttgtttcatggggatgtttatt

SEQ ID NO: 7366781 - DNA, 22 bp, Homo sapiens
tttaaaaaactagtctgagtct

SEQ ID NO: 7366782 - DNA, 22 bp, Homo sapiens
tttaaaaaactagtctgagtct

SEQ ID NO: 7366783 - DNA, 22 bp, Homo sapiens
tttaaaaaactagtctgagtct

SEQ ID NO: 7366784 - DNA, 22 bp, Homo sapiens
ctccagtcatagcctcttgagt

SEQ ID NO: 7366785 - DNA, 22 bp, Homo sapiens
ttgttacagcacttaacctttt

SEQ ID NO: 7366786 - DNA, 22 bp, Homo sapiens
ttgttacacataataacatttt

SEQ ID NO: 7366787 - DNA, 22 bp, Homo sapiens
ctcataaacattattcattatt

SEQ ID NO: 7366788 - DNA, 22 bp, Homo sapiens
ctcataatgtgactgtatttga

SEQ ID NO: 7366789 - DNA, 22 bp, Homo sapiens
ctcatcagaaatacctgacaaa

SEQ ID NO: 7366790 - DNA, 22 bp, Homo sapiens
ttggccagaggtttctctcatg

SEQ ID NO: 7366791 - DNA, 22 bp, Homo sapiens
ctcagtttctgacattaaaatc

SEQ ID NO: 7366792 - DNA, 22 bp, Homo sapiens
ctcagtttctggataagctggg

SEQ ID NO: 7366793 - DNA, 22 bp, Homo sapiens
ctcagtttttgtgggcatcagc

SEQ ID NO: 7366794 - DNA, 22 bp, Homo sapiens
ctcagtttttttaagagccatg

SEQ ID NO: 7366795 - DNA, 22 bp, Homo sapiens
ctcagttttgaaaaggtaagct

SEQ ID NO: 7366796 - DNA, 22 bp, Homo sapiens
ctcagtttcctcaactgcaaaa

SEQ ID NO: 7366797 - DNA, 20 bp, Homo sapiens
ctcagtgctttcattgcctc

SEQ ID NO: 7366798 - DNA, 22 bp, Homo sapiens
ttgatacccaagtgttatgggt

SEQ ID NO: 7366799 - DNA, 22 bp, Homo sapiens
ttgatattcccgatttaaggta

SEQ ID NO: 7366800 - DNA, 22 bp, Homo sapiens
ttgatattagagtatttgtttg

SEQ ID NO: 7366801 - DNA, 22 bp, Homo sapiens
ttgcttttaatctttgtacatc

SEQ ID NO: 7366802 - DNA, 22 bp, Homo sapiens
ttgctttgtggtggttcttcca

SEQ ID NO: 7366803 - DNA, 22 bp, Homo sapiens
ttgcttttccctgtctctgatt

SEQ ID NO: 7366804 - DNA, 22 bp, Homo sapiens
ttgcttttaattaatcattgct

SEQ ID NO: 7366805 - DNA, 17 bp, Homo sapiens
ttgcttttgaaattgtc

SEQ ID NO: 7366806 - DNA, 22 bp, Homo sapiens
ttggatgaggttgagaatcatt

SEQ ID NO: 7366807 - DNA, 22 bp, Homo sapiens
ttggcatttattctaaggtcaa

SEQ ID NO: 7366808 - DNA, 22 bp, Homo sapiens
ctctccctggccagctgtgcag

SEQ ID NO: 7366809 - DNA, 22 bp, Homo sapiens
ctctccctggccagctgtgcag

SEQ ID NO: 7366810 - DNA, 22 bp, Homo sapiens
ctctcccttgggtgggctttgg

SEQ ID NO: 7366811 - DNA, 22 bp, Homo sapiens
ctctcctcagaacaggccctct

SEQ ID NO: 7366812 - DNA, 22 bp, Homo sapiens
ctctccctcattgggttccatt

SEQ ID NO: 7366813 - DNA, 22 bp, Homo sapiens
ctctccctaggttagcggtcag

SEQ ID NO: 7366814 - DNA, 22 bp, Homo sapiens
ctctcccccacagcagccttct

SEQ ID NO: 7366815 - DNA, 20 bp, Homo sapiens
tttcagttggttaatggcat

SEQ ID NO: 7366816 - DNA, 22 bp, Homo sapiens
tttcagttcagtttattatatc

SEQ ID NO: 7366817 - DNA, 22 bp, Homo sapiens
tttcagtgttatgactttcatt

SEQ ID NO: 7366818 - DNA, 22 bp, Homo sapiens
tttcagttactgctatatcatt

SEQ ID NO: 7366819 - DNA, 22 bp, Homo sapiens
tttacatggaatattgtcttgt

SEQ ID NO: 7366820 - DNA, 17 bp, Homo sapiens
tttagaatacaatgttt

SEQ ID NO: 7366821 - DNA, 17 bp, Homo sapiens
tttagaatacaatgttt

SEQ ID NO: 7366822 - DNA, 22 bp, Homo sapiens
tttacattgcattaggtattat

SEQ ID NO: 7366823 - DNA, 22 bp, Homo sapiens
tttacatttccctctgtcagtt

SEQ ID NO: 7366824 - DNA, 22 bp, Homo sapiens
tttacagttaagaaatgttacc

SEQ ID NO: 7366825 - DNA, 22 bp, Homo sapiens
tttaaaaaactagtctgagtct

SEQ ID NO: 7366826 - DNA, 22 bp, Homo sapiens
tttaaaaggggtattaagtcca

SEQ ID NO: 7366827 - DNA, 22 bp, Homo sapiens
tttaaaaggcagcttcttttgt

SEQ ID NO: 7366828 - DNA, 22 bp, Homo sapiens
tttaaatttagaagaaacactg

SEQ ID NO: 7366829 - DNA, 22 bp, Homo sapiens
tttaaattatagttaatgtctg

SEQ ID NO: 7366830 - DNA, 22 bp, Homo sapiens
tttaaattctgtctgccgctta

SEQ ID NO: 7366831 - DNA, 22 bp, Homo sapiens
tttaaatttagaagaaacactg

SEQ ID NO: 7366832 - DNA, 22 bp, Homo sapiens
tttaaatttgtgtttagagggt

SEQ ID NO: 7366833 - DNA, 22 bp, Homo sapiens
ctcctctgggtcctggtggcca

SEQ ID NO: 7366834 - DNA, 22 bp, Homo sapiens
ctcctctgtctggccctgagcc

SEQ ID NO: 7366835 - DNA, 22 bp, Homo sapiens
ctcctctggcttcctggaggca

SEQ ID NO: 7366836 - DNA, 22 bp, Homo sapiens
ctcctctgcccaaatttgtata

SEQ ID NO: 7366837 - DNA, 22 bp, Homo sapiens
tttagacacactttgtatattt

SEQ ID NO: 7366838 - DNA, 22 bp, Homo sapiens
ttccatttattcttgtccagat

SEQ ID NO: 7366839 - DNA, 22 bp, Homo sapiens
ttcccaatattctgcttttatg

SEQ ID NO: 7366840 - DNA, 22 bp, Homo sapiens
ttcccaagtctccaatgtggga

SEQ ID NO: 7366841 - DNA, 22 bp, Homo sapiens
ttccaaagtgctggaattacat

SEQ ID NO: 7366842 - DNA, 22 bp, Homo sapiens
ttccaaagaagttcacatttac

SEQ ID NO: 7366843 - DNA, 22 bp, Homo sapiens
ttcccttctagttttgagagac

SEQ ID NO: 7366844 - DNA, 22 bp, Homo sapiens
ctaagaaaatagaagcatgcta

SEQ ID NO: 7366845 - DNA, 22 bp, Homo sapiens
ttcccttaaattatggcatcta

SEQ ID NO: 7366846 - DNA, 22 bp, Homo sapiens
ttcccttcaaggtggcctaaag

SEQ ID NO: 7366847 - DNA, 22 bp, Homo sapiens
ctaagttaattttctaaaacta

SEQ ID NO: 7366848 - DNA, 22 bp, Homo sapiens
ctaattttcccaaggccttcta

SEQ ID NO: 7366849 - DNA, 22 bp, Homo sapiens
ctaatttttgttctgcattgaa

SEQ ID NO: 7366850 - DNA, 22 bp, Homo sapiens
ctacaaaagtaattgtggtttt

SEQ ID NO: 7366851 - DNA, 22 bp, Homo sapiens
ctaattctgtatttggtcattg

SEQ ID NO: 7366852 - DNA, 22 bp, Homo sapiens
ctaattctttggagacaatctg

SEQ ID NO: 7366853 - DNA, 22 bp, Homo sapiens
ctaattctcagcatgaactggt

SEQ ID NO: 7366854 - DNA, 22 bp, Homo sapiens
ctaattctgaaacagtgtcaat

SEQ ID NO: 7366855 - DNA, 22 bp, Homo sapiens
ctacaaaagtaattgtggtttt

SEQ ID NO: 7366856 - DNA, 22 bp, Homo sapiens
ttcacatataatgtctttaaaa

SEQ ID NO: 7366857 - DNA, 22 bp, Homo sapiens
ttcacagtggtagtgcatttag

SEQ ID NO: 7366858 - DNA, 22 bp, Homo sapiens
cggctgaggatctccaggcctg

SEQ ID NO: 7366859 - DNA, 22 bp, Homo sapiens
cggctgagacggccatagacac

SEQ ID NO: 7366860 - DNA, 22 bp, Homo sapiens
ttcactgtttcatcctacttct

SEQ ID NO: 7366861 - DNA, 22 bp, Homo sapiens
ttcagaaaaagaccattgcaat

SEQ ID NO: 7366862 - DNA, 22 bp, Homo sapiens
ttcagaaaaagaccattgcaat

SEQ ID NO: 7366863 - DNA, 22 bp, Homo sapiens
ttcattcttgggatcagagagt

SEQ ID NO: 7366864 - DNA, 22 bp, Homo sapiens
ttcattcttatttgtgatctgg

SEQ ID NO: 7366865 - DNA, 22 bp, Homo sapiens
ttcattcttcagagctgcgctt

SEQ ID NO: 7366866 - DNA, 22 bp, Homo sapiens
ttcattcttatttgtgatctgg

SEQ ID NO: 7366867 - DNA, 22 bp, Homo sapiens
ttccaaaatgccttgatatgat

SEQ ID NO: 7366868 - DNA, 22 bp, Homo sapiens
ttccaaaatgccttgatatgat

SEQ ID NO: 7366869 - DNA, 19 bp, Homo sapiens
ttcattctcttattgttgt

SEQ ID NO: 7366870 - DNA, 19 bp, Homo sapiens
ttcattctcttattgttgt

SEQ ID NO: 7366871 - DNA, 22 bp, Homo sapiens
ttcattctcttagcatagtcct

SEQ ID NO: 7366872 - DNA, 22 bp, Homo sapiens
ttcattctgggctctaaggaac

SEQ ID NO: 7366873 - DNA, 22 bp, Homo sapiens
ttcattctgtttggaaaggtgg

SEQ ID NO: 7366874 - DNA, 22 bp, Homo sapiens
ttcattctgcagttctcagctc

SEQ ID NO: 7366875 - DNA, 22 bp, Homo sapiens
ttcagaaaggtaaatggatttc

SEQ ID NO: 7366876 - DNA, 22 bp, Homo sapiens
ctcagcagagaccagggaggaa

SEQ ID NO: 7366877 - DNA, 20 bp, Homo sapiens
ctcagcagattcttctagaa

SEQ ID NO: 7366878 - DNA, 22 bp, Homo sapiens
ctcagcagctgctgctggtggg

SEQ ID NO: 7366879 - DNA, 22 bp, Homo sapiens
ctcagcagctgctgctggtggg

SEQ ID NO: 7366880 - DNA, 22 bp, Homo sapiens
ctcagcagcagggaagaggtca

SEQ ID NO: 7366881 - DNA, 17 bp, Homo sapiens
ctcagcagggctcactt

SEQ ID NO: 7366882 - DNA, 22 bp, Homo sapiens
ctcagcaggcactgtgccttac

SEQ ID NO: 7366883 - DNA, 22 bp, Homo sapiens
ctcagcaggtcttgggtagggg

SEQ ID NO: 7366884 - DNA, 22 bp, Homo sapiens
ctcagcaggtaccacatgatct

SEQ ID NO: 7366885 - DNA, 23 bp, Homo sapiens
ctcagcaggtcaggccccttcct

SEQ ID NO: 7366886 - DNA, 22 bp, Homo sapiens
ctcagcaggtaccacatgatct

SEQ ID NO: 7366887 - DNA, 22 bp, Homo sapiens
ctcagaggggatgcttggagaa

SEQ ID NO: 7366888 - DNA, 22 bp, Homo sapiens
ctattttaagaggccattaggt

SEQ ID NO: 7366889 - DNA, 22 bp, Homo sapiens
ctattttaagaggccattaggt

SEQ ID NO: 7366890 - DNA, 22 bp, Homo sapiens
ttcttgtatataaaaatcattt

SEQ ID NO: 7366891 - DNA, 22 bp, Homo sapiens
ttcttggcatcatgaaaaatta

SEQ ID NO: 7366892 - DNA, 22 bp, Homo sapiens
ttcttgtatgtatgcaaaatca

SEQ ID NO: 7366893 - DNA, 22 bp, Homo sapiens
ttcttgtctttgttatgtagga

SEQ ID NO: 7366894 - DNA, 18 bp, Homo sapiens
ttgataaacaatttcatt

SEQ ID NO: 7366895 - DNA, 22 bp, Homo sapiens
ttgataaaatgatgaaatcact

SEQ ID NO: 7366896 - DNA, 22 bp, Homo sapiens
ttgataaaatgatgaaatcact

SEQ ID NO: 7366897 - DNA, 20 bp, Homo sapiens
ttgagcttttagtacagaca

SEQ ID NO: 7366898 - DNA, 20 bp, Homo sapiens
ttgagcttttagtacagaca

SEQ ID NO: 7366899 - DNA, 22 bp, Homo sapiens
ttgaggaggtagtacagagtat

SEQ ID NO: 7366900 - DNA, 22 bp, Homo sapiens
ttgaggagtagaagctttgaat

SEQ ID NO: 7366901 - DNA, 22 bp, Homo sapiens
ttgagctttgaagttcaatatt

SEQ ID NO: 7366902 - DNA, 22 bp, Homo sapiens
ttgagctttgatgcatggcagg

SEQ ID NO: 7366903 - DNA, 22 bp, Homo sapiens
ttgacttgaagctgtggaaaaa

SEQ ID NO: 7366904 - DNA, 22 bp, Homo sapiens
ctcagcagtatactctgaagat

SEQ ID NO: 7366905 - DNA, 22 bp, Homo sapiens
ctcagcagtatactctgaagat

SEQ ID NO: 7366906 - DNA, 22 bp, Homo sapiens
ttgacccaaggccctggaattg

SEQ ID NO: 7366907 - DNA, 22 bp, Homo sapiens
ctcagcagtaaacgtccggaac

SEQ ID NO: 7366908 - DNA, 22 bp, Homo sapiens
ttgacctatgtttcttcatctg

SEQ ID NO: 7366909 - DNA, 22 bp, Homo sapiens
ctatttctaaacctataagtga

SEQ ID NO: 7366910 - DNA, 22 bp, Homo sapiens
ctatttgtacagcattagtaat

SEQ ID NO: 7366911 - DNA, 22 bp, Homo sapiens
ctatttggccaagctgcccaca

SEQ ID NO: 7366912 - DNA, 22 bp, Homo sapiens
ctatttggggtagaagatggat

SEQ ID NO: 7366913 - DNA, 22 bp, Homo sapiens
ctatttctgcctaatgacctgt

SEQ ID NO: 7366914 - DNA, 22 bp, Homo sapiens
ctatttggatgttagcctcagt

SEQ ID NO: 7366915 - DNA, 22 bp, Homo sapiens
ctatttattgtgggtatccagg

SEQ ID NO: 7366916 - DNA, 22 bp, Homo sapiens
ctattttaacttgattacctct

SEQ ID NO: 7366917 - DNA, 22 bp, Homo sapiens
ctattttaacttgattacctct

SEQ ID NO: 7366918 - DNA, 22 bp, Homo sapiens
ctattttaacttgattacctct

SEQ ID NO: 7366919 - DNA, 22 bp, Homo sapiens
ctattttaacttgattacctct

SEQ ID NO: 7366920 - DNA, 22 bp, Homo sapiens
ttcctttctctggactgcagcc

SEQ ID NO: 7366921 - DNA, 22 bp, Homo sapiens
ttccttttagaatcatgaagac

SEQ ID NO: 7366922 - DNA, 22 bp, Homo sapiens
ttcctttcacgttttaatgcac

SEQ ID NO: 7366923 - DNA, 22 bp, Homo sapiens
ttcctttccctcacagcctcgg

SEQ ID NO: 7366924 - DNA, 22 bp, Homo sapiens
ctggcccaggagagcaggcatt

SEQ ID NO: 7366925 - DNA, 22 bp, Homo sapiens
ctggcccaggaagacgtgtccc

SEQ ID NO: 7366926 - DNA, 22 bp, Homo sapiens
ctggcccagagctctggccttt

SEQ ID NO: 7366927 - DNA, 23 bp, Homo sapiens
ctggcccaggtgagaggttggtg

SEQ ID NO: 7366928 - DNA, 22 bp, Homo sapiens
ctggcccaggctcctggggcac

SEQ ID NO: 7366929 - DNA, 21 bp, Homo sapiens
ctggcccagggatctgcattt

SEQ ID NO: 7366930 - DNA, 20 bp, Homo sapiens
ctggcccaggatgatggcgc

SEQ ID NO: 7366931 - DNA, 22 bp, Homo sapiens
ctggcccaggctcctggggcac

SEQ ID NO: 7366932 - DNA, 22 bp, Homo sapiens
ctggcccagagagcagagctta

SEQ ID NO: 7366933 - DNA, 22 bp, Homo sapiens
ctggccatgttgcctctgagac

SEQ ID NO: 7366934 - DNA, 22 bp, Homo sapiens
ctggcctgagaatgctaccctt

SEQ ID NO: 7366935 - DNA, 22 bp, Homo sapiens
ctggcccaggtggtcgttgagg

SEQ ID NO: 7366936 - DNA, 22 bp, Homo sapiens
ctggcctgatctcatgctgtcc

SEQ ID NO: 7366937 - DNA, 22 bp, Homo sapiens
ctggctccctctccctgagtca

SEQ ID NO: 7366938 - DNA, 22 bp, Homo sapiens
ctggctccctggacatggggcc

SEQ ID NO: 7366939 - DNA, 22 bp, Homo sapiens
ctggctcctcagtattccactt

SEQ ID NO: 7366940 - DNA, 22 bp, Homo sapiens
ctggcctgggagctgctagcgt

SEQ ID NO: 7366941 - DNA, 22 bp, Homo sapiens
ctggcctggtctggcctctcca

SEQ ID NO: 7366942 - DNA, 22 bp, Homo sapiens
ctggctctgggcctcagacact

SEQ ID NO: 7366943 - DNA, 22 bp, Homo sapiens
ctggccaggcggcccctgcatg

SEQ ID NO: 7366944 - DNA, 22 bp, Homo sapiens
ctggccaggcggcccctgcatg

SEQ ID NO: 7366945 - DNA, 22 bp, Homo sapiens
ctggccagtgcctgtgggcccc

SEQ ID NO: 7366946 - DNA, 22 bp, Homo sapiens
ctggcatgaaatggcatctcat

SEQ ID NO: 7366947 - DNA, 22 bp, Homo sapiens
ctggcaagaaatatatatctta

SEQ ID NO: 7366948 - DNA, 22 bp, Homo sapiens
ctggatgttttgctaaggactc

SEQ ID NO: 7366949 - DNA, 22 bp, Homo sapiens
ctggcacatgtgagccacatca

SEQ ID NO: 7366950 - DNA, 22 bp, Homo sapiens
ctggcacatgtgagccacatca

SEQ ID NO: 7366951 - DNA, 22 bp, Homo sapiens
ctggcacatagtcagcactcaa

SEQ ID NO: 7366952 - DNA, 22 bp, Homo sapiens
ctggcacatagtcagcactcaa

SEQ ID NO: 7366953 - DNA, 22 bp, Homo sapiens
ctggcacatagtaggtgcacag

SEQ ID NO: 7366954 - DNA, 22 bp, Homo sapiens
ctggaggagaacttgaggaagg

SEQ ID NO: 7366955 - DNA, 22 bp, Homo sapiens
ctggaggaatcacagaaggctt

SEQ ID NO: 7366956 - DNA, 22 bp, Homo sapiens
ctggaggaccacagaagctggt

SEQ ID NO: 7366957 - DNA, 22 bp, Homo sapiens
ctggacatttcgcacccttcca

SEQ ID NO: 7366958 - DNA, 22 bp, Homo sapiens
ctggaccagcctccgccttcac

SEQ ID NO: 7366959 - DNA, 23 bp, Homo sapiens
ctgcttccttgcttcattgctgg

SEQ ID NO: 7366960 - DNA, 19 bp, Homo sapiens
ctgcttccttccctcactg

SEQ ID NO: 7366961 - DNA, 22 bp, Homo sapiens
ctgctttttctaggaggacaat

SEQ ID NO: 7366962 - DNA, 22 bp, Homo sapiens
ctggaaaatgaagaagcagagg

SEQ ID NO: 7366963 - DNA, 22 bp, Homo sapiens
ctggaaaccaggcagttaagag

SEQ ID NO: 7366964 - DNA, 20 bp, Homo sapiens
ctggaaaccctgctgatggt

SEQ ID NO: 7366965 - DNA, 22 bp, Homo sapiens
ctggaagtggagagtggccctc

SEQ ID NO: 7366966 - DNA, 23 bp, Homo sapiens
ctggaagtgcttttatagctttg

SEQ ID NO: 7366967 - DNA, 22 bp, Homo sapiens
ctgcagatcttgtgtacttgtc

SEQ ID NO: 7366968 - DNA, 22 bp, Homo sapiens
ctgcagcagtactcagcagcca

SEQ ID NO: 7366969 - DNA, 22 bp, Homo sapiens
ctgcagcaagagaagtgctgac

SEQ ID NO: 7366970 - DNA, 21 bp, Homo sapiens
ctgcagcaaaactttgctcct

SEQ ID NO: 7366971 - DNA, 22 bp, Homo sapiens
ctgccaggcctccgctgtcccc

SEQ ID NO: 7366972 - DNA, 22 bp, Homo sapiens
ctgccaggcctggggtgctgtc

SEQ ID NO: 7366973 - DNA, 22 bp, Homo sapiens
ctgccaggggcctcacaggcca

SEQ ID NO: 7366974 - DNA, 22 bp, Homo sapiens
ctgccagggcatcctgtggtgg

SEQ ID NO: 7366975 - DNA, 22 bp, Homo sapiens
ctgccagggccctactcagttt

SEQ ID NO: 7366976 - DNA, 22 bp, Homo sapiens
ctgccagggaggctgggaagtt

SEQ ID NO: 7366977 - DNA, 22 bp, Homo sapiens
ctgccaggcgatggattggctg

SEQ ID NO: 7366978 - DNA, 22 bp, Homo sapiens
ctgcctccaggctcaccttgac

SEQ ID NO: 7366979 - DNA, 22 bp, Homo sapiens
ctgcctcctcacgtccacagtg

SEQ ID NO: 7366980 - DNA, 22 bp, Homo sapiens
ctgcctcctggctgatgggtag

SEQ ID NO: 7366981 - DNA, 22 bp, Homo sapiens
ctgcctcctgccgtgcagcttc

SEQ ID NO: 7366982 - DNA, 22 bp, Homo sapiens
ctgcctatcaaatggggagggc

SEQ ID NO: 7366983 - DNA, 22 bp, Homo sapiens
ctgcctatctacaaagtgggat

SEQ ID NO: 7366984 - DNA, 22 bp, Homo sapiens
ctgcctattccctgggccgaga

SEQ ID NO: 7366985 - DNA, 22 bp, Homo sapiens
ctgccatgctcaagaagtcttt

SEQ ID NO: 7366986 - DNA, 22 bp, Homo sapiens
ctgccaggtgagctccaggcct

SEQ ID NO: 7366987 - DNA, 22 bp, Homo sapiens
ctgccaggttggcgctcgctct

SEQ ID NO: 7366988 - DNA, 22 bp, Homo sapiens
ctgccaggtgcctttgtgcagt

SEQ ID NO: 7366989 - DNA, 22 bp, Homo sapiens
ctgagagagtaaagtagaatta

SEQ ID NO: 7366990 - DNA, 22 bp, Homo sapiens
ctgagagaagagcgcagtttgt

SEQ ID NO: 7366991 - DNA, 22 bp, Homo sapiens
ctgagacccagacacctgagga

SEQ ID NO: 7366992 - DNA, 21 bp, Homo sapiens
ctgagacctgcattagagagg

SEQ ID NO: 7366993 - DNA, 22 bp, Homo sapiens
ctgagacacggagaggctgtgt

SEQ ID NO: 7366994 - DNA, 22 bp, Homo sapiens
ctgaggcactggtaatgggcat

SEQ ID NO: 7366995 - DNA, 22 bp, Homo sapiens
ctgattctctgactcttggctt

SEQ ID NO: 7366996 - DNA, 22 bp, Homo sapiens
ctgattgagaaggaaggggatc

SEQ ID NO: 7366997 - DNA, 22 bp, Homo sapiens
ctgcagaaagctgagatgatta

SEQ ID NO: 7366998 - DNA, 22 bp, Homo sapiens
ctgcaaaagtaattgcaggttt

SEQ ID NO: 7366999 - DNA, 22 bp, Homo sapiens
ctgaggcagagaatgagtttgt

SEQ ID NO: 7367000 - DNA, 22 bp, Homo sapiens
ctgatgaccttggcaagtcaca

SEQ ID NO: 7367001 - DNA, 22 bp, Homo sapiens
ctgatgagcccaggtgaccatg

SEQ ID NO: 7367002 - DNA, 22 bp, Homo sapiens
ctgatgagtcggctgccaccag

SEQ ID NO: 7367003 - DNA, 22 bp, Homo sapiens
ctgatggagagtgtgatttggg

SEQ ID NO: 7367004 - DNA, 22 bp, Homo sapiens
ctgatggagactccactgtgat

SEQ ID NO: 7367005 - DNA, 22 bp, Homo sapiens
ctgaagagcaaaccaactggac

SEQ ID NO: 7367006 - DNA, 22 bp, Homo sapiens
ctgaagaggacgcagcagcaag

SEQ ID NO: 7367007 - DNA, 22 bp, Homo sapiens
ctgactgtctcttctcccatga

SEQ ID NO: 7367008 - DNA, 22 bp, Homo sapiens
ctgaagatgatgatactaagga

SEQ ID NO: 7367009 - DNA, 22 bp, Homo sapiens
ctgaagatgtctgagatgctca

SEQ ID NO: 7367010 - DNA, 22 bp, Homo sapiens
ctgaagaatagcaggtgggcac

SEQ ID NO: 7367011 - DNA, 22 bp, Homo sapiens
ctgaacttattgagtgcttgct

SEQ ID NO: 7367012 - DNA, 22 bp, Homo sapiens
ctgaagagaaatgtacacatgg

SEQ ID NO: 7367013 - DNA, 20 bp, Homo sapiens
ctgaacacagaataagcaca

SEQ ID NO: 7367014 - DNA, 22 bp, Homo sapiens
ctgaaattgatgacagggatgg

SEQ ID NO: 7367015 - DNA, 22 bp, Homo sapiens
ctgaaagcaaatacatgaatct

SEQ ID NO: 7367016 - DNA, 22 bp, Homo sapiens
tttttaatgcagtctgagacat

SEQ ID NO: 7367017 - DNA, 22 bp, Homo sapiens
ctcttttcaaacctgtttatgg

SEQ ID NO: 7367018 - DNA, 17 bp, Homo sapiens
ctcttttgtcttcttcc

SEQ ID NO: 7367019 - DNA, 19 bp, Homo sapiens
ctgaaaaacattctcagga

SEQ ID NO: 7367020 - DNA, 22 bp, Homo sapiens
tttttaacctaccttaagagca

SEQ ID NO: 7367021 - DNA, 22 bp, Homo sapiens
ctctttggcccccgatgattca

SEQ ID NO: 7367022 - DNA, 21 bp, Homo sapiens
ctctttgtggcaatgtatttt

SEQ ID NO: 7367023 - DNA, 22 bp, Homo sapiens
ctctttgtggaacggcagtgtc

SEQ ID NO: 7367024 - DNA, 21 bp, Homo sapiens
ttttattgatgaatggccact

SEQ ID NO: 7367025 - DNA, 22 bp, Homo sapiens
tttgtctttcccctcctcattg

SEQ ID NO: 7367026 - DNA, 22 bp, Homo sapiens
tttgtcttgtaagttaaattca

SEQ ID NO: 7367027 - DNA, 22 bp, Homo sapiens
tttgtcttgtgtccttaggacc

SEQ ID NO: 7367028 - DNA, 22 bp, Homo sapiens
ctctggctgtttgcagctcaag

SEQ ID NO: 7367029 - DNA, 19 bp, Homo sapiens
ctctggcttccaaagcatc

SEQ ID NO: 7367030 - DNA, 19 bp, Homo sapiens
ctctggcttccaaagcatc

SEQ ID NO: 7367031 - DNA, 22 bp, Homo sapiens
ctctggctggcacctgatctga

SEQ ID NO: 7367032 - DNA, 23 bp, Homo sapiens
ctctgggcgggcaggtcagcctc

SEQ ID NO: 7367033 - DNA, 22 bp, Homo sapiens
ctctgggcggcccaggccaacc

SEQ ID NO: 7367034 - DNA, 23 bp, Homo sapiens
ttttattgatatgtagctgttgt

SEQ ID NO: 7367035 - DNA, 23 bp, Homo sapiens
ttttattgatatgtagctgttgt

SEQ ID NO: 7367036 - DNA, 22 bp, Homo sapiens
tggccctgcttatgtctctctt

SEQ ID NO: 7367037 - DNA, 22 bp, Homo sapiens
tggccctgctgggtcagagctg

SEQ ID NO: 7367038 - DNA, 22 bp, Homo sapiens
tggccctgctggccaaaggcta

SEQ ID NO: 7367039 - DNA, 22 bp, Homo sapiens
tggccctgctgggtcagagctg

SEQ ID NO: 7367040 - DNA, 22 bp, Homo sapiens
tggccctgctgtatcatctgct

SEQ ID NO: 7367041 - DNA, 22 bp, Homo sapiens
tggccctgctgtatcatctgct

SEQ ID NO: 7367042 - DNA, 22 bp, Homo sapiens
tggctcagtttctgcccagctg

SEQ ID NO: 7367043 - DNA, 22 bp, Homo sapiens
tggctcatctttttagacttat

SEQ ID NO: 7367044 - DNA, 22 bp, Homo sapiens
tggctcatgcatcttttctaca

SEQ ID NO: 7367045 - DNA, 22 bp, Homo sapiens
tggctcatgcctgtaatcttag

SEQ ID NO: 7367046 - DNA, 22 bp, Homo sapiens
tggctcatattgagtgatttct

SEQ ID NO: 7367047 - DNA, 22 bp, Homo sapiens
tggccctgctggccaaaggcta

SEQ ID NO: 7367048 - DNA, 22 bp, Homo sapiens
tggccctgctggacacgcctgc

SEQ ID NO: 7367049 - DNA, 22 bp, Homo sapiens
tggccctgctggacacgcctgc

SEQ ID NO: 7367050 - DNA, 22 bp, Homo sapiens
tggccctgctatgatcctgcaa

SEQ ID NO: 7367051 - DNA, 22 bp, Homo sapiens
tggccctgctatgatcctgcaa

SEQ ID NO: 7367052 - DNA, 22 bp, Homo sapiens
tggccctgctatgatcctgcaa

SEQ ID NO: 7367053 - DNA, 22 bp, Homo sapiens
tggcccgccggaagaagatgtc

SEQ ID NO: 7367054 - DNA, 22 bp, Homo sapiens
tggccctgccgccacgacgtct

SEQ ID NO: 7367055 - DNA, 22 bp, Homo sapiens
tggcccctgaggagcatcagcc

SEQ ID NO: 7367056 - DNA, 22 bp, Homo sapiens
tggcccctgaggagcgtcagcc

SEQ ID NO: 7367057 - DNA, 22 bp, Homo sapiens
tggcccgacctctgctcatgca

SEQ ID NO: 7367058 - DNA, 22 bp, Homo sapiens
tggcccctggcacacggaggat

SEQ ID NO: 7367059 - DNA, 18 bp, Homo sapiens
tggccccttatcagtcct

SEQ ID NO: 7367060 - DNA, 20 bp, Homo sapiens
tggcccagtggggcagggtg

SEQ ID NO: 7367061 - DNA, 20 bp, Homo sapiens
tggcccagtggggcagggtg

SEQ ID NO: 7367062 - DNA, 22 bp, Homo sapiens
tggccccattttacagatgaaa

SEQ ID NO: 7367063 - DNA, 22 bp, Homo sapiens
tggcccagtgcttatgctctga

SEQ ID NO: 7367064 - DNA, 22 bp, Homo sapiens
tggcccagtgcttatgctctga

SEQ ID NO: 7367065 - DNA, 22 bp, Homo sapiens
cctcctggtccagcatctcttt

SEQ ID NO: 7367066 - DNA, 22 bp, Homo sapiens
tggctgaggtctggggcttctg

SEQ ID NO: 7367067 - DNA, 22 bp, Homo sapiens
cctccctgtctacctgttgtgg

SEQ ID NO: 7367068 - DNA, 22 bp, Homo sapiens
cctccctgtctacctgttgtgg

SEQ ID NO: 7367069 - DNA, 22 bp, Homo sapiens
tggctgagggggcagttcagga

SEQ ID NO: 7367070 - DNA, 22 bp, Homo sapiens
cctctggctgtaccactggcac

SEQ ID NO: 7367071 - DNA, 21 bp, Homo sapiens
tggctgcctacatgctgcagg

SEQ ID NO: 7367072 - DNA, 23 bp, Homo sapiens
cctctccagacactgggccttgt

SEQ ID NO: 7367073 - DNA, 22 bp, Homo sapiens
cctctccagcggcctcagggcc

SEQ ID NO: 7367074 - DNA, 22 bp, Homo sapiens
cctctcccgggtgccgctgggc

SEQ ID NO: 7367075 - DNA, 22 bp, Homo sapiens
cctctctgtgtggcctctccat

SEQ ID NO: 7367076 - DNA, 22 bp, Homo sapiens
ccctggatttacatcattctga

SEQ ID NO: 7367077 - DNA, 20 bp, Homo sapiens
ccctggcctgtttcatgccc

SEQ ID NO: 7367078 - DNA, 23 bp, Homo sapiens
ccctggccttggggcacaggctg

SEQ ID NO: 7367079 - DNA, 22 bp, Homo sapiens
ccctgctgacaacttgattttg

SEQ ID NO: 7367080 - DNA, 22 bp, Homo sapiens
ccctgctgatgccttgattttg

SEQ ID NO: 7367081 - DNA, 22 bp, Homo sapiens
ccctgctgcagagagctttcca

SEQ ID NO: 7367082 - DNA, 22 bp, Homo sapiens
ccctgctgcaggcttcaggagg

SEQ ID NO: 7367083 - DNA, 22 bp, Homo sapiens
ccctgctgcagagagctttcca

SEQ ID NO: 7367084 - DNA, 22 bp, Homo sapiens
ccctccagccatggacccaggt

SEQ ID NO: 7367085 - DNA, 22 bp, Homo sapiens
ccctggagatcgggagaggaag

SEQ ID NO: 7367086 - DNA, 20 bp, Homo sapiens
ccctggagagaagctccacg

SEQ ID NO: 7367087 - DNA, 20 bp, Homo sapiens
ccctggagagaagctccacg

SEQ ID NO: 7367088 - DNA, 22 bp, Homo sapiens
ccctggagaggactcacccctg

SEQ ID NO: 7367089 - DNA, 22 bp, Homo sapiens
tggcagctttttgtttcaggct

SEQ ID NO: 7367090 - DNA, 15 bp, Homo sapiens
tggcagcttgttaag

SEQ ID NO: 7367091 - DNA, 22 bp, Homo sapiens
tggcagcttgaatgcagtcttt

SEQ ID NO: 7367092 - DNA, 22 bp, Homo sapiens
tggccacacccacctagaggag

SEQ ID NO: 7367093 - DNA, 22 bp, Homo sapiens
tggcagctgtctgtggggtctc

SEQ ID NO: 7367094 - DNA, 22 bp, Homo sapiens
tggcagctgtgcttcattcttt

SEQ ID NO: 7367095 - DNA, 23 bp, Homo sapiens
tggcagctgtgtaagagaaagca

SEQ ID NO: 7367096 - DNA, 22 bp, Homo sapiens
tggcagctgtcagaatgcaaat

SEQ ID NO: 7367097 - DNA, 22 bp, Homo sapiens
tggcagctggtacagtgggtct

SEQ ID NO: 7367098 - DNA, 22 bp, Homo sapiens
tggcagctggctctgcgcaggc

SEQ ID NO: 7367099 - DNA, 22 bp, Homo sapiens
tggcagcttcctgctcatagga

SEQ ID NO: 7367100 - DNA, 22 bp, Homo sapiens
tggcagctgtgtccaggtagaa

SEQ ID NO: 7367101 - DNA, 22 bp, Homo sapiens
tggcagctgttaatgttttgtt

SEQ ID NO: 7367102 - DNA, 22 bp, Homo sapiens
tggcagctggagggcaatggcc

SEQ ID NO: 7367103 - DNA, 22 bp, Homo sapiens
tggcagctggatcccaaggcag

SEQ ID NO: 7367104 - DNA, 22 bp, Homo sapiens
tggcaaggctgtgggggcagag

SEQ ID NO: 7367105 - DNA, 22 bp, Homo sapiens
tggcacaggagcactgccctgg

SEQ ID NO: 7367106 - DNA, 22 bp, Homo sapiens
cccagcctactctgccatagca

SEQ ID NO: 7367107 - DNA, 22 bp, Homo sapiens
cccagccttccaccctggacta

SEQ ID NO: 7367108 - DNA, 22 bp, Homo sapiens
cccagctcaagcagagagctaa

SEQ ID NO: 7367109 - DNA, 22 bp, Homo sapiens
cccagctacctctgctaggaga

SEQ ID NO: 7367110 - DNA, 22 bp, Homo sapiens
tgcagggaggccccgcagccct

SEQ ID NO: 7367111 - DNA, 18 bp, Homo sapiens
cccagctggtgggtcagt

SEQ ID NO: 7367112 - DNA, 22 bp, Homo sapiens
cccaggaaacccgaaggcgacc

SEQ ID NO: 7367113 - DNA, 22 bp, Homo sapiens
tgcattaagtgtctgcatatgg

SEQ ID NO: 7367114 - DNA, 22 bp, Homo sapiens
tgcattaaggccattgaaattt

SEQ ID NO: 7367115 - DNA, 22 bp, Homo sapiens
tgcattaaatataatctgttga

SEQ ID NO: 7367116 - DNA, 22 bp, Homo sapiens
tgcattcaaatcctgatcctgc

SEQ ID NO: 7367117 - DNA, 22 bp, Homo sapiens
tgcattatctttaatgttctca

SEQ ID NO: 7367118 - DNA, 22 bp, Homo sapiens
tgcattcacgtgattggggtag

SEQ ID NO: 7367119 - DNA, 22 bp, Homo sapiens
tgcattcaatacagtaagaata

SEQ ID NO: 7367120 - DNA, 22 bp, Homo sapiens
tgcattcaatgtgccagggaaa

SEQ ID NO: 7367121 - DNA, 22 bp, Homo sapiens
tgcattcaaatctccaggctca

SEQ ID NO: 7367122 - DNA, 22 bp, Homo sapiens
tgcattcagttggtcagctttt

SEQ ID NO: 7367123 - DNA, 22 bp, Homo sapiens
tgcattcatcatttgaaagccc

SEQ ID NO: 7367124 - DNA, 22 bp, Homo sapiens
tgccacactcacttctgtggac

SEQ ID NO: 7367125 - DNA, 22 bp, Homo sapiens
cccaggaggtgtagctgcgtgg

SEQ ID NO: 7367126 - DNA, 22 bp, Homo sapiens
tgccaggcctcaggagtctcca

SEQ ID NO: 7367127 - DNA, 22 bp, Homo sapiens
cccaggaggtggaggttgcagt

SEQ ID NO: 7367128 - DNA, 22 bp, Homo sapiens
cccaggaggtggaggttgcagc

SEQ ID NO: 7367129 - DNA, 22 bp, Homo sapiens
cccaggcagccccagaagcttg

SEQ ID NO: 7367130 - DNA, 22 bp, Homo sapiens
cccaggcagcggggtctccttg

SEQ ID NO: 7367131 - DNA, 22 bp, Homo sapiens
cccaggcagtgtgtgcatgcgt

SEQ ID NO: 7367132 - DNA, 22 bp, Homo sapiens
cccaggcagtagaaagaagagg

SEQ ID NO: 7367133 - DNA, 22 bp, Homo sapiens
cccaggcaggagtgtggtggct

SEQ ID NO: 7367134 - DNA, 22 bp, Homo sapiens
cccaggcagggacgtgctctgg

SEQ ID NO: 7367135 - DNA, 22 bp, Homo sapiens
cccaggcagaattagtgtttca

SEQ ID NO: 7367136 - DNA, 22 bp, Homo sapiens
cccaggcactcttggtcatttt

SEQ ID NO: 7367137 - DNA, 22 bp, Homo sapiens
cccaggcagagagctggtgagc

SEQ ID NO: 7367138 - DNA, 22 bp, Homo sapiens
cccaggcacactgaagtgacat

SEQ ID NO: 7367139 - DNA, 22 bp, Homo sapiens
cccaggatgtcgaggctgcagt

SEQ ID NO: 7367140 - DNA, 22 bp, Homo sapiens
cccaggatgtcgaggctgcagt

SEQ ID NO: 7367141 - DNA, 22 bp, Homo sapiens
tgccaggcgtggtggtgcgcac

SEQ ID NO: 7367142 - DNA, 22 bp, Homo sapiens
cccctcctggccacactgtcag

SEQ ID NO: 7367143 - DNA, 22 bp, Homo sapiens
cccctctccctcacttatcaat

SEQ ID NO: 7367144 - DNA, 22 bp, Homo sapiens
ccctaggaattctatggccaag

SEQ ID NO: 7367145 - DNA, 22 bp, Homo sapiens
ccctcaggagatgtcagctgga

SEQ ID NO: 7367146 - DNA, 22 bp, Homo sapiens
ccctcaggatgcagtggaagtg

SEQ ID NO: 7367147 - DNA, 22 bp, Homo sapiens
ccctcagggaccactgacttca

SEQ ID NO: 7367148 - DNA, 19 bp, Homo sapiens
ccctcaggtctgagcagtc

SEQ ID NO: 7367149 - DNA, 22 bp, Homo sapiens
cccccaggctctgacacaggag

SEQ ID NO: 7367150 - DNA, 22 bp, Homo sapiens
cccccaggggctccgcctcgtg

SEQ ID NO: 7367151 - DNA, 22 bp, Homo sapiens
cccccaggggctccgcctcgtg

SEQ ID NO: 7367152 - DNA, 22 bp, Homo sapiens
cccccaggctctgacacaggag

SEQ ID NO: 7367153 - DNA, 22 bp, Homo sapiens
cccccaggggctccgcctcgtg

SEQ ID NO: 7367154 - DNA, 22 bp, Homo sapiens
tgctgcagcggcatggtctttg

SEQ ID NO: 7367155 - DNA, 22 bp, Homo sapiens
tgctgcagctttgtcacatgca

SEQ ID NO: 7367156 - DNA, 23 bp, Homo sapiens
ccccactaccgtgatgtgcgagg

SEQ ID NO: 7367157 - DNA, 22 bp, Homo sapiens
ccccagccagcaggacctctga

SEQ ID NO: 7367158 - DNA, 22 bp, Homo sapiens
ccccagccagcttgtagtagaa

SEQ ID NO: 7367159 - DNA, 22 bp, Homo sapiens
ccccagggaagctttgcttact

SEQ ID NO: 7367160 - DNA, 22 bp, Homo sapiens
ccccagcccacaagcatattaa

SEQ ID NO: 7367161 - DNA, 22 bp, Homo sapiens
ccccagccttccatgggaattg

SEQ ID NO: 7367162 - DNA, 22 bp, Homo sapiens
cccagggattataaaggtgaaa

SEQ ID NO: 7367163 - DNA, 22 bp, Homo sapiens
cccagggaggtagcaggagaaa

SEQ ID NO: 7367164 - DNA, 22 bp, Homo sapiens
cccagggaggtagcaggagaaa

SEQ ID NO: 7367165 - DNA, 22 bp, Homo sapiens
cccagggaggtagcaggagaaa

SEQ ID NO: 7367166 - DNA, 22 bp, Homo sapiens
cccagggatgtggcagatgtta

SEQ ID NO: 7367167 - DNA, 22 bp, Homo sapiens
cccagggatgtggcagatgtta

SEQ ID NO: 7367168 - DNA, 22 bp, Homo sapiens
cccagggaggcccaggctctgc

SEQ ID NO: 7367169 - DNA, 22 bp, Homo sapiens
cccagggagcttggagaacggg

SEQ ID NO: 7367170 - DNA, 20 bp, Homo sapiens
cccagggacctgagctccat

SEQ ID NO: 7367171 - DNA, 19 bp, Homo sapiens
tgctgactgggcctcaccg

SEQ ID NO: 7367172 - DNA, 22 bp, Homo sapiens
tgctgagatagctgactaggca

SEQ ID NO: 7367173 - DNA, 22 bp, Homo sapiens
tgcctgctctgtgccacagttg

SEQ ID NO: 7367174 - DNA, 22 bp, Homo sapiens
tgcctgggacatgctgtggact

SEQ ID NO: 7367175 - DNA, 22 bp, Homo sapiens
tgcctgggactgtactaaattt

SEQ ID NO: 7367176 - DNA, 22 bp, Homo sapiens
tgcctgggccttcccacctctg

SEQ ID NO: 7367177 - DNA, 22 bp, Homo sapiens
tgcctgggagtgaccaagactc

SEQ ID NO: 7367178 - DNA, 22 bp, Homo sapiens
tgctcagtaagtaaacagtaac

SEQ ID NO: 7367179 - DNA, 22 bp, Homo sapiens
tgtctcagtatacgaaacactt

SEQ ID NO: 7367180 - DNA, 22 bp, Homo sapiens
tgtctcttggctctatcactta

SEQ ID NO: 7367181 - DNA, 22 bp, Homo sapiens
tgtctcttgagctgcctgatgc

SEQ ID NO: 7367182 - DNA, 18 bp, Homo sapiens
tgtctcaggctgaaacag

SEQ ID NO: 7367183 - DNA, 22 bp, Homo sapiens
tgtctcagaggcaggaagagcc

SEQ ID NO: 7367184 - DNA, 22 bp, Homo sapiens
tgtctatttgaattatcctaat

SEQ ID NO: 7367185 - DNA, 22 bp, Homo sapiens
tgtcctgcaattaaggaagaca

SEQ ID NO: 7367186 - DNA, 19 bp, Homo sapiens
cctggccctgctgcgcggg

SEQ ID NO: 7367187 - DNA, 22 bp, Homo sapiens
cctggctccctgcacagggctc

SEQ ID NO: 7367188 - DNA, 22 bp, Homo sapiens
cctggcaggtggaggttgcagt

SEQ ID NO: 7367189 - DNA, 22 bp, Homo sapiens
cctggcaggtagcattgaggag

SEQ ID NO: 7367190 - DNA, 22 bp, Homo sapiens
cctggcaggctggggacagtgc

SEQ ID NO: 7367191 - DNA, 23 bp, Homo sapiens
cctggcagcaaacgaggaggtta

SEQ ID NO: 7367192 - DNA, 22 bp, Homo sapiens
cctggccagggtctgggctgct

SEQ ID NO: 7367193 - DNA, 22 bp, Homo sapiens
cctggccagtttccaggccctg

SEQ ID NO: 7367194 - DNA, 22 bp, Homo sapiens
cctggccaggcatggagtcaca

SEQ ID NO: 7367195 - DNA, 22 bp, Homo sapiens
cctggccagctaattgcccatc

SEQ ID NO: 7367196 - DNA, 22 bp, Homo sapiens
cctggccagcgccggctgctcg

SEQ ID NO: 7367197 - DNA, 22 bp, Homo sapiens
cctggccatttgaacttcagac

SEQ ID NO: 7367198 - DNA, 22 bp, Homo sapiens
cctggccatagggcccaggaaa

SEQ ID NO: 7367199 - DNA, 22 bp, Homo sapiens
tgtccataaattcacaagtgta

SEQ ID NO: 7367200 - DNA, 22 bp, Homo sapiens
tgtcccactgacttcacatcca

SEQ ID NO: 7367201 - DNA, 22 bp, Homo sapiens
tggtgctgcaggtgggcacagt

SEQ ID NO: 7367202 - DNA, 22 bp, Homo sapiens
tggtgctgccaggctcctgcca

SEQ ID NO: 7367203 - DNA, 22 bp, Homo sapiens
tggtgctgccacctcctctgct

SEQ ID NO: 7367204 - DNA, 22 bp, Homo sapiens
cctggaaacacatgatgatgaa

SEQ ID NO: 7367205 - DNA, 22 bp, Homo sapiens
cctggaaagagaatgaatgagc

SEQ ID NO: 7367206 - DNA, 22 bp, Homo sapiens
cctggagagctcgggccaggca

SEQ ID NO: 7367207 - DNA, 22 bp, Homo sapiens
tgtaaacagtaggactaaagag

SEQ ID NO: 7367208 - DNA, 22 bp, Homo sapiens
cctggagacgaggctggaccat

SEQ ID NO: 7367209 - DNA, 19 bp, Homo sapiens
tggtgcgctgttcctgagc

SEQ ID NO: 7367210 - DNA, 22 bp, Homo sapiens
cctgccagtgaagctgacgggc

SEQ ID NO: 7367211 - DNA, 22 bp, Homo sapiens
cctgccagtgcctcccactggt

SEQ ID NO: 7367212 - DNA, 22 bp, Homo sapiens
cctgccatcagaaacactcaaa

SEQ ID NO: 7367213 - DNA, 22 bp, Homo sapiens
cctgccatggtagacttccagg

SEQ ID NO: 7367214 - DNA, 22 bp, Homo sapiens
tggtcccattgttctgcccagg

SEQ ID NO: 7367215 - DNA, 18 bp, Homo sapiens
tggtccagttcagatata

SEQ ID NO: 7367216 - DNA, 22 bp, Homo sapiens
tggtccagtcgttcctttcctt

SEQ ID NO: 7367217 - DNA, 22 bp, Homo sapiens
tggtccagtaagggtggagaga

SEQ ID NO: 7367218 - DNA, 22 bp, Homo sapiens
cctggaggtggaggttgcagtg

SEQ ID NO: 7367219 - DNA, 22 bp, Homo sapiens
tgtataaaccatggacagcttt

SEQ ID NO: 7367220 - DNA, 22 bp, Homo sapiens
tgtagtaagtgcgcaataaata

SEQ ID NO: 7367221 - DNA, 22 bp, Homo sapiens
tgtagtagcattcacgaagtgt

SEQ ID NO: 7367222 - DNA, 22 bp, Homo sapiens
cctggagattatttggtccaat

SEQ ID NO: 7367223 - DNA, 22 bp, Homo sapiens
cctggagaggcgctgcagagga

SEQ ID NO: 7367224 - DNA, 23 bp, Homo sapiens
tgtaggtctgccttatctgctgc

SEQ ID NO: 7367225 - DNA, 22 bp, Homo sapiens
tgtaggtaaaagcatctagtgt

SEQ ID NO: 7367226 - DNA, 22 bp, Homo sapiens
tgtaggcatattcatagagttg

SEQ ID NO: 7367227 - DNA, 22 bp, Homo sapiens
tgtaaactcagtatgttttact

SEQ ID NO: 7367228 - DNA, 22 bp, Homo sapiens
tgtaaactggatttgagggtgg

SEQ ID NO: 7367229 - DNA, 22 bp, Homo sapiens
tgtcatgtctgtaaatacacca

SEQ ID NO: 7367230 - DNA, 22 bp, Homo sapiens
tgtcaggagcaatgataaattt

SEQ ID NO: 7367231 - DNA, 22 bp, Homo sapiens
tgtattatcaagtaaatacatg

SEQ ID NO: 7367232 - DNA, 22 bp, Homo sapiens
tgtattatcaagtaaatacatg

SEQ ID NO: 7367233 - DNA, 22 bp, Homo sapiens
tgtattatcaagtaaatacatg

SEQ ID NO: 7367234 - DNA, 22 bp, Homo sapiens
tgtattatcaagtaaatacatg

SEQ ID NO: 7367235 - DNA, 22 bp, Homo sapiens
tgtattaacattaataaaatgg

SEQ ID NO: 7367236 - DNA, 22 bp, Homo sapiens
cctgggagagctgcccgggtga

SEQ ID NO: 7367237 - DNA, 21 bp, Homo sapiens
cctgggagatcagctgccttc

SEQ ID NO: 7367238 - DNA, 22 bp, Homo sapiens
tgtgcttctcacatcactgttg

SEQ ID NO: 7367239 - DNA, 21 bp, Homo sapiens
tgtgccagggatggggagccc

SEQ ID NO: 7367240 - DNA, 22 bp, Homo sapiens
tgtgccaggccctggggaccaa

SEQ ID NO: 7367241 - DNA, 22 bp, Homo sapiens
tgtgcccatccctctggagtgt

SEQ ID NO: 7367242 - DNA, 22 bp, Homo sapiens
tgtgcccagactgcctcagtga

SEQ ID NO: 7367243 - DNA, 19 bp, Homo sapiens
cctggctgtgaagcctgca

SEQ ID NO: 7367244 - DNA, 22 bp, Homo sapiens
cctggctgtgcattgccggccc

SEQ ID NO: 7367245 - DNA, 22 bp, Homo sapiens
cctggctgtgtgaccttggcaa

SEQ ID NO: 7367246 - DNA, 22 bp, Homo sapiens
tgtctttagcccatatagactt

SEQ ID NO: 7367247 - DNA, 22 bp, Homo sapiens
tgtctttacttagaagttcagg

SEQ ID NO: 7367248 - DNA, 22 bp, Homo sapiens
tgtctgtatatcacttttgtcc

SEQ ID NO: 7367249 - DNA, 22 bp, Homo sapiens
cctggctgaggggccaaggacc

SEQ ID NO: 7367250 - DNA, 22 bp, Homo sapiens
cctggctgagcctccaggaaga

SEQ ID NO: 7367251 - DNA, 22 bp, Homo sapiens
tgtctttctgcaccacctcaca

SEQ ID NO: 7367252 - DNA, 22 bp, Homo sapiens
tgtctttctatctctagattta

SEQ ID NO: 7367253 - DNA, 20 bp, Homo sapiens
cctggctgcattcaggacgg

SEQ ID NO: 7367254 - DNA, 22 bp, Homo sapiens
tgtgaggagtaggctgagggtg

SEQ ID NO: 7367255 - DNA, 19 bp, Homo sapiens
cctgggaggcggaggttgc

SEQ ID NO: 7367256 - DNA, 22 bp, Homo sapiens
cctgggagctgtggaaaggctg

SEQ ID NO: 7367257 - DNA, 22 bp, Homo sapiens
tgtggctgtgccgtcacacgtg

SEQ ID NO: 7367258 - DNA, 18 bp, Homo sapiens
tgtggctggtccacactg

SEQ ID NO: 7367259 - DNA, 22 bp, Homo sapiens
tgtgcttttctctgctcctgga

SEQ ID NO: 7367260 - DNA, 22 bp, Homo sapiens
tgtggggccaaagcccagccac

SEQ ID NO: 7367261 - DNA, 22 bp, Homo sapiens
tgtgtggggaaggaaggagctg

SEQ ID NO: 7367262 - DNA, 22 bp, Homo sapiens
tgtgtgggtacagatgattgtt

SEQ ID NO: 7367263 - DNA, 23 bp, Homo sapiens
tgtgtctgtttagggaggatgtg

SEQ ID NO: 7367264 - DNA, 23 bp, Homo sapiens
cctgggcattggctgcagcttct

SEQ ID NO: 7367265 - DNA, 23 bp, Homo sapiens
tgtgttctcacacagatgcagta

SEQ ID NO: 7367266 - DNA, 22 bp, Homo sapiens
tgtgttcatgttgattcatagc

SEQ ID NO: 7367267 - DNA, 22 bp, Homo sapiens
cctggggctcaagatggcgccg

SEQ ID NO: 7367268 - DNA, 22 bp, Homo sapiens
tgtgttcaatccctagtctcag

SEQ ID NO: 7367269 - DNA, 22 bp, Homo sapiens
tgtgttcagtatgacattcaca

SEQ ID NO: 7367270 - DNA, 22 bp, Homo sapiens
tgtgttcaatgacttcatcttt

SEQ ID NO: 7367271 - DNA, 22 bp, Homo sapiens
tgtgttcaccaaagtgtagaaa

SEQ ID NO: 7367272 - DNA, 22 bp, Homo sapiens
tgtgttcatgtatgtatacata

SEQ ID NO: 7367273 - DNA, 23 bp, Homo sapiens
tgtgttcagtcaaggatcagagt

SEQ ID NO: 7367274 - DNA, 22 bp, Homo sapiens
cctgggtgaaatagtcctcaag

SEQ ID NO: 7367275 - DNA, 19 bp, Homo sapiens
tgtgtgggtttagagtagt

SEQ ID NO: 7367276 - DNA, 22 bp, Homo sapiens
cctgggcctctcaaagtgctgg

SEQ ID NO: 7367277 - DNA, 22 bp, Homo sapiens
cctgggcctcacccagctcttg

SEQ ID NO: 7367278 - DNA, 22 bp, Homo sapiens
tgtgtgtcatttagggtggagc

SEQ ID NO: 7367279 - DNA, 20 bp, Homo sapiens
cctgggctcaaagcatcctc

SEQ ID NO: 7367280 - DNA, 22 bp, Homo sapiens
cctgggccttgacctcgtgggc

SEQ ID NO: 7367281 - DNA, 22 bp, Homo sapiens
cctggggaatcttgcaggggaa

SEQ ID NO: 7367282 - DNA, 22 bp, Homo sapiens
gacccagggtttctgcacaggg

SEQ ID NO: 7367283 - DNA, 22 bp, Homo sapiens
gacccagggtttctgcacaggg

SEQ ID NO: 7367284 - DNA, 22 bp, Homo sapiens
gacttcaaagcgtgataaagat

SEQ ID NO: 7367285 - DNA, 17 bp, Homo sapiens
gacttcaacttctgctg

SEQ ID NO: 7367286 - DNA, 18 bp, Homo sapiens
gactttaaaacactgctc

SEQ ID NO: 7367287 - DNA, 21 bp, Homo sapiens
gacaggcaaggagtcacttag

SEQ ID NO: 7367288 - DNA, 22 bp, Homo sapiens
gacaggaggcagagctcaggtg

SEQ ID NO: 7367289 - DNA, 22 bp, Homo sapiens
gacaggaggcagagctcaggtg

SEQ ID NO: 7367290 - DNA, 22 bp, Homo sapiens
gaccatcctggccaacgtggta

SEQ ID NO: 7367291 - DNA, 22 bp, Homo sapiens
gaccatcctggccaacgtggta

SEQ ID NO: 7367292 - DNA, 22 bp, Homo sapiens
gacaggcagacctgtgccctgg

SEQ ID NO: 7367293 - DNA, 18 bp, Homo sapiens
gagagctgctacctagct

SEQ ID NO: 7367294 - DNA, 22 bp, Homo sapiens
gagacagatctcggctccatgc

SEQ ID NO: 7367295 - DNA, 22 bp, Homo sapiens
gagacagagtgttttttaaggt

SEQ ID NO: 7367296 - DNA, 22 bp, Homo sapiens
gagacacaggcacagaagaggc

SEQ ID NO: 7367297 - DNA, 22 bp, Homo sapiens
gagaaaatcttgggtcaagaat

SEQ ID NO: 7367298 - DNA, 20 bp, Homo sapiens
gactttacatcagcactctt

SEQ ID NO: 7367299 - DNA, 22 bp, Homo sapiens
gaatttaagaggatgaatctgt

SEQ ID NO: 7367300 - DNA, 22 bp, Homo sapiens
gaattagtgttgaaatcagggc

SEQ ID NO: 7367301 - DNA, 19 bp, Homo sapiens
gaattatttttatgggatg

SEQ ID NO: 7367302 - DNA, 19 bp, Homo sapiens
gacaggaaggctaccagta

SEQ ID NO: 7367303 - DNA, 19 bp, Homo sapiens
gacaggacgaagggaagtt

SEQ ID NO: 7367304 - DNA, 20 bp, Homo sapiens
gacaggagagttaggtaggt

SEQ ID NO: 7367305 - DNA, 20 bp, Homo sapiens
gacaggagagttaggtaggt

SEQ ID NO: 7367306 - DNA, 22 bp, Homo sapiens
gacagctgtgcaggagaagggg

SEQ ID NO: 7367307 - DNA, 22 bp, Homo sapiens
gacacaggggggcgctagaaga

SEQ ID NO: 7367308 - DNA, 22 bp, Homo sapiens
gaaggagaggattgtgaggctg

SEQ ID NO: 7367309 - DNA, 22 bp, Homo sapiens
gaaggagagggtcaaggataat

SEQ ID NO: 7367310 - DNA, 22 bp, Homo sapiens
gaaggccctgttttccctattt

SEQ ID NO: 7367311 - DNA, 22 bp, Homo sapiens
gaaggcccgccctgagcaaggg

SEQ ID NO: 7367312 - DNA, 22 bp, Homo sapiens
gaaggccctggtattcttgagg

SEQ ID NO: 7367313 - DNA, 22 bp, Homo sapiens
gaactgtagttaatactacaca

SEQ ID NO: 7367314 - DNA, 22 bp, Homo sapiens
gaaggaagattctgttggaatc

SEQ ID NO: 7367315 - DNA, 22 bp, Homo sapiens
gaaggaaggaaaaatatattta

SEQ ID NO: 7367316 - DNA, 20 bp, Homo sapiens
gaaggaagggggcaaggtga

SEQ ID NO: 7367317 - DNA, 22 bp, Homo sapiens
gaaggaagtcattagtgcagac

SEQ ID NO: 7367318 - DNA, 22 bp, Homo sapiens
gaagtcttttcttccacccaaa

SEQ ID NO: 7367319 - DNA, 22 bp, Homo sapiens
gaagtgcaacctgaaatactag

SEQ ID NO: 7367320 - DNA, 20 bp, Homo sapiens
gaaggcttggacagtgacag

SEQ ID NO: 7367321 - DNA, 22 bp, Homo sapiens
gaaggcttgccgggaagcggca

SEQ ID NO: 7367322 - DNA, 22 bp, Homo sapiens
gaaggcttgcaagtggttcata

SEQ ID NO: 7367323 - DNA, 22 bp, Homo sapiens
gaaggcttgcagctctgtggca

SEQ ID NO: 7367324 - DNA, 22 bp, Homo sapiens
gaaggctttttgggtaattgta

SEQ ID NO: 7367325 - DNA, 19 bp, Homo sapiens
gaaggcttttggtatgttt

SEQ ID NO: 7367326 - DNA, 22 bp, Homo sapiens
gaaggcttggttttttcaacac

SEQ ID NO: 7367327 - DNA, 22 bp, Homo sapiens
gaaggctttagagagatataaa

SEQ ID NO: 7367328 - DNA, 22 bp, Homo sapiens
gaaggcttttctaccagatctt

SEQ ID NO: 7367329 - DNA, 22 bp, Homo sapiens
gaaggcttattttctttgtaaa

SEQ ID NO: 7367330 - DNA, 22 bp, Homo sapiens
gaaggcttcaaaaggtgtaatt

SEQ ID NO: 7367331 - DNA, 22 bp, Homo sapiens
gaaggcttcccacctgatattt

SEQ ID NO: 7367332 - DNA, 22 bp, Homo sapiens
gaaggcttcctgatgccaacca

SEQ ID NO: 7367333 - DNA, 22 bp, Homo sapiens
gaaggcttcctggaggaggtgg

SEQ ID NO: 7367334 - DNA, 22 bp, Homo sapiens
gaaggcttctccagggcttact

SEQ ID NO: 7367335 - DNA, 21 bp, Homo sapiens
gaaggcttctgcctggaggag

SEQ ID NO: 7367336 - DNA, 22 bp, Homo sapiens
gaaggcttgattgaggaatgcc

SEQ ID NO: 7367337 - DNA, 22 bp, Homo sapiens
gaaaacatccagagatagacct

SEQ ID NO: 7367338 - DNA, 22 bp, Homo sapiens
gaaaagagtcctgtgtgaggag

SEQ ID NO: 7367339 - DNA, 21 bp, Homo sapiens
gaaaagcaagggagtagaaca

SEQ ID NO: 7367340 - DNA, 22 bp, Homo sapiens
gaaaagggcaagagagagggca

SEQ ID NO: 7367341 - DNA, 22 bp, Homo sapiens
gaaaagtacacagcccaaacat

SEQ ID NO: 7367342 - DNA, 22 bp, Homo sapiens
gaaaaggccactcctaggagct

SEQ ID NO: 7367343 - DNA, 22 bp, Homo sapiens
gaaaaggaaatttatagagatc

SEQ ID NO: 7367344 - DNA, 22 bp, Homo sapiens
gaaaaggattggtaaaatatct

SEQ ID NO: 7367345 - DNA, 22 bp, Homo sapiens
cttttaatgggagcagtatttg

SEQ ID NO: 7367346 - DNA, 22 bp, Homo sapiens
cttttaagggataataagatgt

SEQ ID NO: 7367347 - DNA, 22 bp, Homo sapiens
cttttaagggataataagatgt

SEQ ID NO: 7367348 - DNA, 22 bp, Homo sapiens
ctttgtttatatttctcctcga

SEQ ID NO: 7367349 - DNA, 22 bp, Homo sapiens
ctttgttgttaattggcgctta

SEQ ID NO: 7367350 - DNA, 22 bp, Homo sapiens
ctttgttctgcacacacagaca

SEQ ID NO: 7367351 - DNA, 22 bp, Homo sapiens
gaaagggagtgaagatggtata

SEQ ID NO: 7367352 - DNA, 22 bp, Homo sapiens
gaaaggccatttctgagggttt

SEQ ID NO: 7367353 - DNA, 22 bp, Homo sapiens
gaaaggccagctcacagatgag

SEQ ID NO: 7367354 - DNA, 22 bp, Homo sapiens
gaaaggcatcttcagtctctga

SEQ ID NO: 7367355 - DNA, 22 bp, Homo sapiens
gaaaggccaccatgccagggac

SEQ ID NO: 7367356 - DNA, 22 bp, Homo sapiens
gaaaggccacgtgccaagatta

SEQ ID NO: 7367357 - DNA, 22 bp, Homo sapiens
gaaaggcagtacagctgagcct

SEQ ID NO: 7367358 - DNA, 22 bp, Homo sapiens
gaaagggcatgggcatgacaac

SEQ ID NO: 7367359 - DNA, 22 bp, Homo sapiens
gaaaggggcatgtagggatcac

SEQ ID NO: 7367360 - DNA, 22 bp, Homo sapiens
gaaagttcaaattatagaaggt

SEQ ID NO: 7367361 - DNA, 22 bp, Homo sapiens
gaaagttatatcatgattttag

SEQ ID NO: 7367362 - DNA, 22 bp, Homo sapiens
gaaataagagtccatgccaggt

SEQ ID NO: 7367363 - DNA, 22 bp, Homo sapiens
gaaatacaaagccagccatttt

SEQ ID NO: 7367364 - DNA, 22 bp, Homo sapiens
gaacacaactcagaatgctggt

SEQ ID NO: 7367365 - DNA, 22 bp, Homo sapiens
gaaatttacaactttctcatgg

SEQ ID NO: 7367366 - DNA, 22 bp, Homo sapiens
gaaatacaattttgtcccagct

SEQ ID NO: 7367367 - DNA, 22 bp, Homo sapiens
gaaatacaaatgcctagatcct

SEQ ID NO: 7367368 - DNA, 22 bp, Homo sapiens
gaacactgagaaagtcagcttt

SEQ ID NO: 7367369 - DNA, 22 bp, Homo sapiens
gaacactgagagagatgggcag

SEQ ID NO: 7367370 - DNA, 22 bp, Homo sapiens
gaacactgacattttcctgact

SEQ ID NO: 7367371 - DNA, 22 bp, Homo sapiens
gaacactgagaaagtcagcttt

SEQ ID NO: 7367372 - DNA, 22 bp, Homo sapiens
gaacacatttctctgactgtag

SEQ ID NO: 7367373 - DNA, 22 bp, Homo sapiens
gaacacatgattataaatgcta

SEQ ID NO: 7367374 - DNA, 22 bp, Homo sapiens
gaacccggggaggttgcagtga

SEQ ID NO: 7367375 - DNA, 22 bp, Homo sapiens
gaacccggggaggttgcagtga

SEQ ID NO: 7367376 - DNA, 22 bp, Homo sapiens
gaacagagctgactacaaggca

SEQ ID NO: 7367377 - DNA, 22 bp, Homo sapiens
gaacacttgctgttaataagtg

SEQ ID NO: 7367378 - DNA, 22 bp, Homo sapiens
gaacactttaacattccttttc

SEQ ID NO: 7367379 - DNA, 22 bp, Homo sapiens
gaacactgtttcttcgtgaaca

SEQ ID NO: 7367380 - DNA, 22 bp, Homo sapiens
gaacactgctgttgggttctga

SEQ ID NO: 7367381 - DNA, 22 bp, Homo sapiens
gaacactggggtatcattgagc

SEQ ID NO: 7367382 - DNA, 22 bp, Homo sapiens
gaacactgctgttgggttctga

SEQ ID NO: 7367383 - DNA, 22 bp, Homo sapiens
gaacactgaggacactgagaat

SEQ ID NO: 7367384 - DNA, 22 bp, Homo sapiens
gaactcattagcctgctttcag

SEQ ID NO: 7367385 - DNA, 22 bp, Homo sapiens
cttggctgtctataggaaagag

SEQ ID NO: 7367386 - DNA, 22 bp, Homo sapiens
cttgaagagtaaattggtacac

SEQ ID NO: 7367387 - DNA, 22 bp, Homo sapiens
cttgaagattgatccagtttga

SEQ ID NO: 7367388 - DNA, 17 bp, Homo sapiens
cttggcacctctgccat

SEQ ID NO: 7367389 - DNA, 22 bp, Homo sapiens
cttgggagacacaagaagacat

SEQ ID NO: 7367390 - DNA, 22 bp, Homo sapiens
cttggggaagccactgatccct

SEQ ID NO: 7367391 - DNA, 22 bp, Homo sapiens
cttgggggccattaaggggcct

SEQ ID NO: 7367392 - DNA, 22 bp, Homo sapiens
ctttagatttctatgtatcact

SEQ ID NO: 7367393 - DNA, 21 bp, Homo sapiens
ctttagtgaaaaggggctaac

SEQ ID NO: 7367394 - DNA, 22 bp, Homo sapiens
ctttagtgagtgtggagctaga

SEQ ID NO: 7367395 - DNA, 22 bp, Homo sapiens
ctttagttgtatcagtcaagtt

SEQ ID NO: 7367396 - DNA, 22 bp, Homo sapiens
ctttagttgtctcctcaagggt

SEQ ID NO: 7367397 - DNA, 22 bp, Homo sapiens
ctttagaagggtaacggaatta

SEQ ID NO: 7367398 - DNA, 22 bp, Homo sapiens
ctttatatattcccaggctgcc

SEQ ID NO: 7367399 - DNA, 22 bp, Homo sapiens
ctttatcgcaaacactgggtaa

SEQ ID NO: 7367400 - DNA, 22 bp, Homo sapiens
ctttatgaaggaacaatgctcc

SEQ ID NO: 7367401 - DNA, 22 bp, Homo sapiens
ctttatgactgagttgtcaatt

SEQ ID NO: 7367402 - DNA, 22 bp, Homo sapiens
cttctcagttgcaagtgtcaga

SEQ ID NO: 7367403 - DNA, 22 bp, Homo sapiens
cttctctccctggcactcagac

SEQ ID NO: 7367404 - DNA, 22 bp, Homo sapiens
cttctcttcccagggacacagg

SEQ ID NO: 7367405 - DNA, 22 bp, Homo sapiens
cttctctggctcctcagcgccc

SEQ ID NO: 7367406 - DNA, 22 bp, Homo sapiens
cttctcttcctttgtcaactga

SEQ ID NO: 7367407 - DNA, 22 bp, Homo sapiens
cttctctgacagtctgtttcac

SEQ ID NO: 7367408 - DNA, 22 bp, Homo sapiens
cttctctctgcataggcatggg

SEQ ID NO: 7367409 - DNA, 22 bp, Homo sapiens
cttctctctgcataggcatggg

SEQ ID NO: 7367410 - DNA, 18 bp, Homo sapiens
cttgaagaattttgcagt

SEQ ID NO: 7367411 - DNA, 22 bp, Homo sapiens
cttcttttgaagggcgttgtgt

SEQ ID NO: 7367412 - DNA, 22 bp, Homo sapiens
cttcttttcatggcttgggaag

SEQ ID NO: 7367413 - DNA, 22 bp, Homo sapiens
cttctttcccaggcatgtttta

SEQ ID NO: 7367414 - DNA, 22 bp, Homo sapiens
cttcttttacaggtcttgggtt

SEQ ID NO: 7367415 - DNA, 22 bp, Homo sapiens
gagagtgctgaacggcaagggt

SEQ ID NO: 7367416 - DNA, 22 bp, Homo sapiens
gagagtggaaagcaagctgagt

SEQ ID NO: 7367417 - DNA, 22 bp, Homo sapiens
gagatatttattcatactgtca

SEQ ID NO: 7367418 - DNA, 22 bp, Homo sapiens
gagctggaggaccaggactggg

SEQ ID NO: 7367419 - DNA, 22 bp, Homo sapiens
gagctggaggcagtgctgaggt

SEQ ID NO: 7367420 - DNA, 22 bp, Homo sapiens
gaggaagagagctctgccttgt

SEQ ID NO: 7367421 - DNA, 22 bp, Homo sapiens
gaggacaaagcccaggtgctgg

SEQ ID NO: 7367422 - DNA, 22 bp, Homo sapiens
gaggaatgttattaaaggagct

SEQ ID NO: 7367423 - DNA, 22 bp, Homo sapiens
gaggaatgtcagcacaggcctc

SEQ ID NO: 7367424 - DNA, 21 bp, Homo sapiens
gaggaatggtttgcaaagcac

SEQ ID NO: 7367425 - DNA, 21 bp, Homo sapiens
gaggaatggtttgcaaagcac

SEQ ID NO: 7367426 - DNA, 22 bp, Homo sapiens
gaggaggctgtttctctgcatt

SEQ ID NO: 7367427 - DNA, 22 bp, Homo sapiens
gaggaggctgtttctctgcatt

SEQ ID NO: 7367428 - DNA, 22 bp, Homo sapiens
gaggaggctgtttctctgcatt

SEQ ID NO: 7367429 - DNA, 22 bp, Homo sapiens
gaggaggctgaacaatgccctg

SEQ ID NO: 7367430 - DNA, 22 bp, Homo sapiens
gaggaggctggcgccgcctgcc

SEQ ID NO: 7367431 - DNA, 22 bp, Homo sapiens
gaggaggctggcgccgcctgcc

SEQ ID NO: 7367432 - DNA, 22 bp, Homo sapiens
gaggaggcttccgggaggcacg

SEQ ID NO: 7367433 - DNA, 22 bp, Homo sapiens
gaggaggcttccgggaggcacg

SEQ ID NO: 7367434 - DNA, 19 bp, Homo sapiens
gaggaggcttcagctttct

SEQ ID NO: 7367435 - DNA, 22 bp, Homo sapiens
gaggaggcttccgggaggcacg

SEQ ID NO: 7367436 - DNA, 23 bp, Homo sapiens
gaggagggtctgacaagtgtagc

SEQ ID NO: 7367437 - DNA, 23 bp, Homo sapiens
gaggagggtctgacaagtgtagc

SEQ ID NO: 7367438 - DNA, 22 bp, Homo sapiens
gaggagggagctggaagctctt

SEQ ID NO: 7367439 - DNA, 22 bp, Homo sapiens
gaggagggagaattaggcttaa

SEQ ID NO: 7367440 - DNA, 22 bp, Homo sapiens
gaggagggagctggaagctctt

SEQ ID NO: 7367441 - DNA, 22 bp, Homo sapiens
gaggagggttggccttaggtag

SEQ ID NO: 7367442 - DNA, 22 bp, Homo sapiens
gaggagggttggccttaggtag

SEQ ID NO: 7367443 - DNA, 22 bp, Homo sapiens
gaggagggttggccttaggtag

SEQ ID NO: 7367444 - DNA, 22 bp, Homo sapiens
gaggaggtggagtcatgcagag

SEQ ID NO: 7367445 - DNA, 22 bp, Homo sapiens
gaggcagaggttgttgcagtga

SEQ ID NO: 7367446 - DNA, 22 bp, Homo sapiens
gaggcagagtgcaccccaggag

SEQ ID NO: 7367447 - DNA, 22 bp, Homo sapiens
gaggcagcaaaatatatcataa

SEQ ID NO: 7367448 - DNA, 22 bp, Homo sapiens
gaggcagcaataaaaagaattt

SEQ ID NO: 7367449 - DNA, 22 bp, Homo sapiens
gaggccctggtaggtcagagtg

SEQ ID NO: 7367450 - DNA, 22 bp, Homo sapiens
gaggccctgaagacagctgggg

SEQ ID NO: 7367451 - DNA, 20 bp, Homo sapiens
gaggcctcagcctcagctcc

SEQ ID NO: 7367452 - DNA, 22 bp, Homo sapiens
gaggccctccagctgtcagctg

SEQ ID NO: 7367453 - DNA, 22 bp, Homo sapiens
gaggccctcttgccacaatgaa

SEQ ID NO: 7367454 - DNA, 22 bp, Homo sapiens
gaggcctgaggctgcctggagc

SEQ ID NO: 7367455 - DNA, 22 bp, Homo sapiens
gaggcctctgtcccgccaggga

SEQ ID NO: 7367456 - DNA, 22 bp, Homo sapiens
gaggcctctgtcccaccaggga

SEQ ID NO: 7367457 - DNA, 22 bp, Homo sapiens
gaggcagcagaacatggaagag

SEQ ID NO: 7367458 - DNA, 18 bp, Homo sapiens
gaggcagctagcaatttt

SEQ ID NO: 7367459 - DNA, 22 bp, Homo sapiens
gaggcagcaggctgaggaggat

SEQ ID NO: 7367460 - DNA, 22 bp, Homo sapiens
gaggcagctgaagcttcaaaga

SEQ ID NO: 7367461 - DNA, 22 bp, Homo sapiens
gaggcagctcttctgaatgggg

SEQ ID NO: 7367462 - DNA, 18 bp, Homo sapiens
gaggcagctagcaatttt

SEQ ID NO: 7367463 - DNA, 23 bp, Homo sapiens
gaggcagctcctgcagtgccctg

SEQ ID NO: 7367464 - DNA, 22 bp, Homo sapiens
gaggcagctgggctggtggttt

SEQ ID NO: 7367465 - DNA, 22 bp, Homo sapiens
gaggcagctgggctggtggttt

SEQ ID NO: 7367466 - DNA, 22 bp, Homo sapiens
gaggcagctgaaggagtgacag

SEQ ID NO: 7367467 - DNA, 22 bp, Homo sapiens
gaggcagctgggatacaaggga

SEQ ID NO: 7367468 - DNA, 22 bp, Homo sapiens
gagggatggtagttgacactga

SEQ ID NO: 7367469 - DNA, 22 bp, Homo sapiens
gaggctgcccaactggagtgga

SEQ ID NO: 7367470 - DNA, 22 bp, Homo sapiens
gaggcctggaattccagcctgg

SEQ ID NO: 7367471 - DNA, 20 bp, Homo sapiens
gagggcaggcacccatttca

SEQ ID NO: 7367472 - DNA, 22 bp, Homo sapiens
gagggccaatggatttcaactg

SEQ ID NO: 7367473 - DNA, 22 bp, Homo sapiens
gaggtcaggctcaagctgggcc

SEQ ID NO: 7367474 - DNA, 22 bp, Homo sapiens
gaggtcaaggtcaagagacaga

SEQ ID NO: 7367475 - DNA, 22 bp, Homo sapiens
gaggtatgtatgctacattctt

SEQ ID NO: 7367476 - DNA, 22 bp, Homo sapiens
gaggtatggatatctggagagg

SEQ ID NO: 7367477 - DNA, 22 bp, Homo sapiens
gaggtatgttatttcttgaaac

SEQ ID NO: 7367478 - DNA, 22 bp, Homo sapiens
gaggtattggccattgtctgtt

SEQ ID NO: 7367479 - DNA, 22 bp, Homo sapiens
gaggtatttgatcctctgcagt

SEQ ID NO: 7367480 - DNA, 22 bp, Homo sapiens
gagtcacatactatgtaataga

SEQ ID NO: 7367481 - DNA, 22 bp, Homo sapiens
gagtcagaaactcactctatag

SEQ ID NO: 7367482 - DNA, 22 bp, Homo sapiens
gagtcagaaagtagtgtgccta

SEQ ID NO: 7367483 - DNA, 19 bp, Homo sapiens
gaggtgggtccccgcagcc

SEQ ID NO: 7367484 - DNA, 22 bp, Homo sapiens
gaggtgggtgtatcacaggtca

SEQ ID NO: 7367485 - DNA, 22 bp, Homo sapiens
gagtcagctagtctccttcttt

SEQ ID NO: 7367486 - DNA, 22 bp, Homo sapiens
gagtcagaagaaactatttaca

SEQ ID NO: 7367487 - DNA, 22 bp, Homo sapiens
gagtcagaatgtcctcctgcgg

SEQ ID NO: 7367488 - DNA, 22 bp, Homo sapiens
gagtcccaggatatgtgctgtt

SEQ ID NO: 7367489 - DNA, 22 bp, Homo sapiens
gagtcatttgggggcttcttga

SEQ ID NO: 7367490 - DNA, 22 bp, Homo sapiens
gagtccaagctagagccactca

SEQ ID NO: 7367491 - DNA, 22 bp, Homo sapiens
gagtcattgttggtccctcccc

SEQ ID NO: 7367492 - DNA, 22 bp, Homo sapiens
gagtcattgcacactagctcag

SEQ ID NO: 7367493 - DNA, 22 bp, Homo sapiens
gagtcaggctagggtgacaggc

SEQ ID NO: 7367494 - DNA, 22 bp, Homo sapiens
gatatttttaggtgatgcaggc

SEQ ID NO: 7367495 - DNA, 22 bp, Homo sapiens
gatattttcgcagggagaattc

SEQ ID NO: 7367496 - DNA, 22 bp, Homo sapiens
gatatttacattaagcacattg

SEQ ID NO: 7367497 - DNA, 22 bp, Homo sapiens
gatatatttggaccagagcatt

SEQ ID NO: 7367498 - DNA, 18 bp, Homo sapiens
gatatataggaggaaagt

SEQ ID NO: 7367499 - DNA, 22 bp, Homo sapiens
gatatacagagcattctttgat

SEQ ID NO: 7367500 - DNA, 22 bp, Homo sapiens
gatatacataggtttctatgca

SEQ ID NO: 7367501 - DNA, 19 bp, Homo sapiens
gatcagagtgtcagcttgt

SEQ ID NO: 7367502 - DNA, 22 bp, Homo sapiens
gatcagagtggctagagccttg

SEQ ID NO: 7367503 - DNA, 22 bp, Homo sapiens
gatcagagagctctttatggcc

SEQ ID NO: 7367504 - DNA, 20 bp, Homo sapiens
gatacacagcttcactgttg

SEQ ID NO: 7367505 - DNA, 22 bp, Homo sapiens
gataaggactttggggtctaca

SEQ ID NO: 7367506 - DNA, 23 bp, Homo sapiens
gatacactccctgctgggcactg

SEQ ID NO: 7367507 - DNA, 22 bp, Homo sapiens
gatacactggagcttcctgaca

SEQ ID NO: 7367508 - DNA, 22 bp, Homo sapiens
gatagctgctgggatattttta

SEQ ID NO: 7367509 - DNA, 22 bp, Homo sapiens
gatatacaatccacagttgatt

SEQ ID NO: 7367510 - DNA, 22 bp, Homo sapiens
gatataaattaatcaagtgcaa

SEQ ID NO: 7367511 - DNA, 22 bp, Homo sapiens
gatataaattaatcaagtgcaa

SEQ ID NO: 7367512 - DNA, 22 bp, Homo sapiens
gataccttttgttggaatttcc

SEQ ID NO: 7367513 - DNA, 22 bp, Homo sapiens
gatagaaagaatatagattcca

SEQ ID NO: 7367514 - DNA, 22 bp, Homo sapiens
gatagaaagagtggttcttttt

SEQ ID NO: 7367515 - DNA, 22 bp, Homo sapiens
gatagataaaactatattttca

SEQ ID NO: 7367516 - DNA, 22 bp, Homo sapiens
gatcttctatgtaatgaagtgt

SEQ ID NO: 7367517 - DNA, 22 bp, Homo sapiens
gatcttctctttagtagaaaca

SEQ ID NO: 7367518 - DNA, 22 bp, Homo sapiens
gatcttctgaactggagtatct

SEQ ID NO: 7367519 - DNA, 22 bp, Homo sapiens
gatcccttgggccaaggagttg

SEQ ID NO: 7367520 - DNA, 22 bp, Homo sapiens
gatcctcttttcctaggaaggt

SEQ ID NO: 7367521 - DNA, 22 bp, Homo sapiens
gatcatttcagtccagtaaata

SEQ ID NO: 7367522 - DNA, 22 bp, Homo sapiens
gatcatttgactttataaggct

SEQ ID NO: 7367523 - DNA, 22 bp, Homo sapiens
gatgaaaaattgctgtgtcata

SEQ ID NO: 7367524 - DNA, 22 bp, Homo sapiens
gatgaaaatcttgagatgtcga

SEQ ID NO: 7367525 - DNA, 22 bp, Homo sapiens
gatgcaaaccttacatggacct

SEQ ID NO: 7367526 - DNA, 22 bp, Homo sapiens
gatgatttttgccagtgtgatg

SEQ ID NO: 7367527 - DNA, 22 bp, Homo sapiens
gatgattttgttggtgattcaa

SEQ ID NO: 7367528 - DNA, 22 bp, Homo sapiens
gatgattttgatgcagtaaaga

SEQ ID NO: 7367529 - DNA, 22 bp, Homo sapiens
gatgatttctccattcccttct

SEQ ID NO: 7367530 - DNA, 22 bp, Homo sapiens
gatgatttaagtggccaaagta

SEQ ID NO: 7367531 - DNA, 22 bp, Homo sapiens
gatgattttagttgactaaact

SEQ ID NO: 7367532 - DNA, 22 bp, Homo sapiens
gatgatttgaggatttcatgag

SEQ ID NO: 7367533 - DNA, 22 bp, Homo sapiens
gatgattttatgtcttgtcatt

SEQ ID NO: 7367534 - DNA, 22 bp, Homo sapiens
gatgattttctgtgttagaaga

SEQ ID NO: 7367535 - DNA, 22 bp, Homo sapiens
gatgcacggtcatgtcttttca

SEQ ID NO: 7367536 - DNA, 22 bp, Homo sapiens
gatgcatgtatggagtgagggt

SEQ ID NO: 7367537 - DNA, 22 bp, Homo sapiens
gatgagaaatggacaggagtgg

SEQ ID NO: 7367538 - DNA, 22 bp, Homo sapiens
gatgagaaatggacaggagtgg

SEQ ID NO: 7367539 - DNA, 22 bp, Homo sapiens
gatgagaaggctcagatccaaa

SEQ ID NO: 7367540 - DNA, 22 bp, Homo sapiens
gatgaggaatgctcagctcaat

SEQ ID NO: 7367541 - DNA, 22 bp, Homo sapiens
gagtgggtgacagaaggaggta

SEQ ID NO: 7367542 - DNA, 22 bp, Homo sapiens
gagtgtctatgtttagtctttc

SEQ ID NO: 7367543 - DNA, 22 bp, Homo sapiens
gagtggggtctgggcatcagtc

SEQ ID NO: 7367544 - DNA, 22 bp, Homo sapiens
gagtggggggtccgtctcagtg

SEQ ID NO: 7367545 - DNA, 22 bp, Homo sapiens
gagtgggtccacagaggtgaca

SEQ ID NO: 7367546 - DNA, 22 bp, Homo sapiens
gagtgggtaccggagcaggtgc

SEQ ID NO: 7367547 - DNA, 22 bp, Homo sapiens
gagttctcaagcaatcaaagag

SEQ ID NO: 7367548 - DNA, 22 bp, Homo sapiens
gagttaaaagccctctcagcag

SEQ ID NO: 7367549 - DNA, 22 bp, Homo sapiens
gagttaaagtacctttgtatgt

SEQ ID NO: 7367550 - DNA, 22 bp, Homo sapiens
gagttaaaagccctctcagcag

SEQ ID NO: 7367551 - DNA, 22 bp, Homo sapiens
gagtgtctgtgacagctcatga

SEQ ID NO: 7367552 - DNA, 23 bp, Homo sapiens
gagtttcttccaggagccctggg

SEQ ID NO: 7367553 - DNA, 22 bp, Homo sapiens
gataaaataactatggaatact

SEQ ID NO: 7367554 - DNA, 22 bp, Homo sapiens
gataaaataactatggaatact

SEQ ID NO: 7367555 - DNA, 22 bp, Homo sapiens
gataaaagaggaaatttgttca

SEQ ID NO: 7367556 - DNA, 22 bp, Homo sapiens
gagtttcttaacaggtggaagc

SEQ ID NO: 7367557 - DNA, 22 bp, Homo sapiens
gataaaattcttattttacccg

SEQ ID NO: 7367558 - DNA, 22 bp, Homo sapiens
gataaacatgaagttctgtgta

SEQ ID NO: 7367559 - DNA, 22 bp, Homo sapiens
gataaacactaaggtcgctgaa

SEQ ID NO: 7367560 - DNA, 22 bp, Homo sapiens
gataaacatgggagaaaggaat

SEQ ID NO: 7367561 - DNA, 22 bp, Homo sapiens
gataaacattcttgcacatgtg

SEQ ID NO: 7367562 - DNA, 21 bp, Homo sapiens
gataaaatgggccttggtcct

SEQ ID NO: 7367563 - DNA, 22 bp, Homo sapiens
gataaattgcactttttcttac

SEQ ID NO: 7367564 - DNA, 22 bp, Homo sapiens
gataaagcaggtaggagaagat

SEQ ID NO: 7367565 - DNA, 20 bp, Homo sapiens
gataaagcattgagtaaatt

SEQ ID NO: 7367566 - DNA, 21 bp, Homo sapiens
gataaagcagcttgcctaagg

SEQ ID NO: 7367567 - DNA, 22 bp, Homo sapiens
gataaagcaaggatgactgaag

SEQ ID NO: 7367568 - DNA, 22 bp, Homo sapiens
gagtggagatcgtgccactgca

SEQ ID NO: 7367569 - DNA, 22 bp, Homo sapiens
gagtggagcaaaagaggtagat

SEQ ID NO: 7367570 - DNA, 22 bp, Homo sapiens
gagtggggctttaaaggctcag

SEQ ID NO: 7367571 - DNA, 22 bp, Homo sapiens
gagtgcagttggggtgagggga

SEQ ID NO: 7367572 - DNA, 22 bp, Homo sapiens
gagtgccaagagaagaggctgg

SEQ ID NO: 7367573 - DNA, 22 bp, Homo sapiens
gagtcctgatccttagctctcc

SEQ ID NO: 7367574 - DNA, 22 bp, Homo sapiens
gagtcctgttgtcccagatggg

SEQ ID NO: 7367575 - DNA, 22 bp, Homo sapiens
gagtctatctcactcccccagg

SEQ ID NO: 7367576 - DNA, 22 bp, Homo sapiens
gcacccagtttgtctcagggtt

SEQ ID NO: 7367577 - DNA, 22 bp, Homo sapiens
gcacccagggcaggaagtgagg

SEQ ID NO: 7367578 - DNA, 22 bp, Homo sapiens
gcacccaggcttgggcagcaac

SEQ ID NO: 7367579 - DNA, 22 bp, Homo sapiens
gcacccagggacttggctggcc

SEQ ID NO: 7367580 - DNA, 22 bp, Homo sapiens
gcacccaggccggcgactgcag

SEQ ID NO: 7367581 - DNA, 22 bp, Homo sapiens
gcacaattccatgggacagccc

SEQ ID NO: 7367582 - DNA, 22 bp, Homo sapiens
gcacaagggtggtctctggagc

SEQ ID NO: 7367583 - DNA, 22 bp, Homo sapiens
gcacaataacagccaaggttat

SEQ ID NO: 7367584 - DNA, 22 bp, Homo sapiens
gcacacacatgtgagtacatgc

SEQ ID NO: 7367585 - DNA, 22 bp, Homo sapiens
gcactttaaagtttggtggcat

SEQ ID NO: 7367586 - DNA, 22 bp, Homo sapiens
gcacctcattttgcaggtagaa

SEQ ID NO: 7367587 - DNA, 22 bp, Homo sapiens
gcacctgattgatttcactgct

SEQ ID NO: 7367588 - DNA, 22 bp, Homo sapiens
gcacctgaacgacctgctccag

SEQ ID NO: 7367589 - DNA, 22 bp, Homo sapiens
gcaccctgtttatcctgagttc

SEQ ID NO: 7367590 - DNA, 19 bp, Homo sapiens
gcaccctggccactcccac

SEQ ID NO: 7367591 - DNA, 22 bp, Homo sapiens
gcaccctgctctatccttgcta

SEQ ID NO: 7367592 - DNA, 19 bp, Homo sapiens
gcaccctgaggtcatggcc

SEQ ID NO: 7367593 - DNA, 22 bp, Homo sapiens
gcaccctgagtgttcagctcca

SEQ ID NO: 7367594 - DNA, 22 bp, Homo sapiens
gcaccctctgagctccgctccg

SEQ ID NO: 7367595 - DNA, 22 bp, Homo sapiens
gcaccctctgagctccgctccg

SEQ ID NO: 7367596 - DNA, 23 bp, Homo sapiens
gcaccccagatgtgattagttag

SEQ ID NO: 7367597 - DNA, 22 bp, Homo sapiens
gcagaagcagaggagcctatga

SEQ ID NO: 7367598 - DNA, 22 bp, Homo sapiens
gcagaagcagggcaggggcaaa

SEQ ID NO: 7367599 - DNA, 22 bp, Homo sapiens
gcagaagcccggtcagcgcacg

SEQ ID NO: 7367600 - DNA, 22 bp, Homo sapiens
gcagaagcccggtcagcgcacg

SEQ ID NO: 7367601 - DNA, 22 bp, Homo sapiens
gcagaacatggaaagagaacta

SEQ ID NO: 7367602 - DNA, 22 bp, Homo sapiens
gcagaagcacaggtgacgggcc

SEQ ID NO: 7367603 - DNA, 22 bp, Homo sapiens
gcagaagaccatggtggaaaga

SEQ ID NO: 7367604 - DNA, 22 bp, Homo sapiens
gcagagccccattgctggcggg

SEQ ID NO: 7367605 - DNA, 22 bp, Homo sapiens
gcagagcccctcaagccagcct

SEQ ID NO: 7367606 - DNA, 22 bp, Homo sapiens
gcagagcatttcggttgcttcc

SEQ ID NO: 7367607 - DNA, 22 bp, Homo sapiens
gattttatctttgtgtgcagta

SEQ ID NO: 7367608 - DNA, 22 bp, Homo sapiens
gattttatctttgtgtgcagta

SEQ ID NO: 7367609 - DNA, 22 bp, Homo sapiens
gattttatcgtcatccttctgg

SEQ ID NO: 7367610 - DNA, 22 bp, Homo sapiens
gattttattagcccaaactttg

SEQ ID NO: 7367611 - DNA, 22 bp, Homo sapiens
gattttatatggcatactgtgg

SEQ ID NO: 7367612 - DNA, 22 bp, Homo sapiens
gattttatatggcatactgtgg

SEQ ID NO: 7367613 - DNA, 22 bp, Homo sapiens
gattttatagtcaggaaaaaga

SEQ ID NO: 7367614 - DNA, 22 bp, Homo sapiens
gattttaattataggaggtcct

SEQ ID NO: 7367615 - DNA, 21 bp, Homo sapiens
gattttaaagagactgccaca

SEQ ID NO: 7367616 - DNA, 22 bp, Homo sapiens
gatttgtctatattcaaatatg

SEQ ID NO: 7367617 - DNA, 22 bp, Homo sapiens
gatttctgtggcttgtacatat

SEQ ID NO: 7367618 - DNA, 22 bp, Homo sapiens
gatttctgttgagaaacatggg

SEQ ID NO: 7367619 - DNA, 22 bp, Homo sapiens
gattttctgagccttcaaattt

SEQ ID NO: 7367620 - DNA, 22 bp, Homo sapiens
gattttcttgggaaacaatgag

SEQ ID NO: 7367621 - DNA, 22 bp, Homo sapiens
gcaaactggcaaacctgtctgt

SEQ ID NO: 7367622 - DNA, 22 bp, Homo sapiens
gcaaactgcattctatagcttg

SEQ ID NO: 7367623 - DNA, 22 bp, Homo sapiens
gcaaactgatttccaagtccgt

SEQ ID NO: 7367624 - DNA, 22 bp, Homo sapiens
gcacaaagatgaatacagaatg

SEQ ID NO: 7367625 - DNA, 22 bp, Homo sapiens
gcacaacaccaagggaggtatc

SEQ ID NO: 7367626 - DNA, 22 bp, Homo sapiens
gcacaagaataaccatatttaa

SEQ ID NO: 7367627 - DNA, 19 bp, Homo sapiens
gcaattcagtagtacaaaa

SEQ ID NO: 7367628 - DNA, 22 bp, Homo sapiens
gcaattatatcaccagagatct

SEQ ID NO: 7367629 - DNA, 22 bp, Homo sapiens
gcaatgcaatcagatgattatt

SEQ ID NO: 7367630 - DNA, 22 bp, Homo sapiens
gcaatgaggagtggtagggata

SEQ ID NO: 7367631 - DNA, 22 bp, Homo sapiens
gcaatgagcacccagagggcag

SEQ ID NO: 7367632 - DNA, 22 bp, Homo sapiens
gatgccttccaggattttggct

SEQ ID NO: 7367633 - DNA, 22 bp, Homo sapiens
gatgctggcctggccatctggg

SEQ ID NO: 7367634 - DNA, 18 bp, Homo sapiens
gatgggagcaagagaaga

SEQ ID NO: 7367635 - DNA, 22 bp, Homo sapiens
gatgggcacggcagtctgagag

SEQ ID NO: 7367636 - DNA, 22 bp, Homo sapiens
gatggaggagatggcagggtgc

SEQ ID NO: 7367637 - DNA, 22 bp, Homo sapiens
gatgtcttaagcccagaagttc

SEQ ID NO: 7367638 - DNA, 22 bp, Homo sapiens
gatgtcttcagatggcaagaga

SEQ ID NO: 7367639 - DNA, 22 bp, Homo sapiens
gatgtcttaggtaacattctat

SEQ ID NO: 7367640 - DNA, 22 bp, Homo sapiens
gatgtcttactaactagccttt

SEQ ID NO: 7367641 - DNA, 22 bp, Homo sapiens
gatgtacatgcaagcacttaga

SEQ ID NO: 7367642 - DNA, 22 bp, Homo sapiens
gatgtacaggagtttttcaagg

SEQ ID NO: 7367643 - DNA, 22 bp, Homo sapiens
gatggtgcaggtgaagtgctgg

SEQ ID NO: 7367644 - DNA, 22 bp, Homo sapiens
gatgtacaaagagaggatttca

SEQ ID NO: 7367645 - DNA, 17 bp, Homo sapiens
gatggggctgacatcag

SEQ ID NO: 7367646 - DNA, 22 bp, Homo sapiens
gatgttttaggtccctgtagct

SEQ ID NO: 7367647 - DNA, 22 bp, Homo sapiens
gatgtttcccgttaagagaaaa

SEQ ID NO: 7367648 - DNA, 22 bp, Homo sapiens
gatgttgagtatcaatgcttta

SEQ ID NO: 7367649 - DNA, 22 bp, Homo sapiens
gattacattctccttgtattag

SEQ ID NO: 7367650 - DNA, 22 bp, Homo sapiens
gattcaaagttaatgaagatgc

SEQ ID NO: 7367651 - DNA, 22 bp, Homo sapiens
gattcaaagacagactcatttc

SEQ ID NO: 7367652 - DNA, 22 bp, Homo sapiens
gattctttggcctttattgaca

SEQ ID NO: 7367653 - DNA, 22 bp, Homo sapiens
gattgtctgtgatcatgagcaa

SEQ ID NO: 7367654 - DNA, 22 bp, Homo sapiens
gattgtctttattttatggcta

SEQ ID NO: 7367655 - DNA, 19 bp, Homo sapiens
gatttaaacgtggctctat

SEQ ID NO: 7367656 - DNA, 22 bp, Homo sapiens
gatttaaagtagacctttgttt

SEQ ID NO: 7367657 - DNA, 22 bp, Homo sapiens
gattgtaattttcaagaggtaa

SEQ ID NO: 7367658 - DNA, 22 bp, Homo sapiens
gattgtacacatctggtgcctt

SEQ ID NO: 7367659 - DNA, 22 bp, Homo sapiens
gattgtacttattgagctaaac

SEQ ID NO: 7367660 - DNA, 22 bp, Homo sapiens
gattgggggtcaggctcaggtc

SEQ ID NO: 7367661 - DNA, 22 bp, Homo sapiens
gattggggggcaggagaagtgt

SEQ ID NO: 7367662 - DNA, 22 bp, Homo sapiens
gattggggaaggttttactgac

SEQ ID NO: 7367663 - DNA, 22 bp, Homo sapiens
gatttatttttaatcagcaggg

SEQ ID NO: 7367664 - DNA, 22 bp, Homo sapiens
gatttattggtctttcattggt

SEQ ID NO: 7367665 - DNA, 22 bp, Homo sapiens
gatttattgtccctgtcctgct

SEQ ID NO: 7367666 - DNA, 22 bp, Homo sapiens
gcaggggctactctgagcttcc

SEQ ID NO: 7367667 - DNA, 22 bp, Homo sapiens
gcaggggctgctgggaactcgg

SEQ ID NO: 7367668 - DNA, 22 bp, Homo sapiens
gcagggcagacctccagcctat

SEQ ID NO: 7367669 - DNA, 22 bp, Homo sapiens
gcagggcacagacagtgccaag

SEQ ID NO: 7367670 - DNA, 22 bp, Homo sapiens
gcagggcacaaggacgcacagg

SEQ ID NO: 7367671 - DNA, 22 bp, Homo sapiens
gcagggcaaatgtggaaaggag

SEQ ID NO: 7367672 - DNA, 22 bp, Homo sapiens
gcagggacgccagggacagcaa

SEQ ID NO: 7367673 - DNA, 22 bp, Homo sapiens
gcaggctgccctcttgtgttga

SEQ ID NO: 7367674 - DNA, 22 bp, Homo sapiens
gcaggcagaggtggaggagaca

SEQ ID NO: 7367675 - DNA, 22 bp, Homo sapiens
gcagagccgtgaatggatttca

SEQ ID NO: 7367676 - DNA, 22 bp, Homo sapiens
gcagagcctgtgtctgagcaaa

SEQ ID NO: 7367677 - DNA, 22 bp, Homo sapiens
gcagagcggtgatcaggcgcag

SEQ ID NO: 7367678 - DNA, 22 bp, Homo sapiens
gcagagccttgcgtcatgtgcc

SEQ ID NO: 7367679 - DNA, 22 bp, Homo sapiens
gcagagcctgggggtctgcgga

SEQ ID NO: 7367680 - DNA, 21 bp, Homo sapiens
gcagagcctgaggttcttgag

SEQ ID NO: 7367681 - DNA, 22 bp, Homo sapiens
gcagcgtgatcccgcatttagg

SEQ ID NO: 7367682 - DNA, 18 bp, Homo sapiens
gcagctagccaggggggc

SEQ ID NO: 7367683 - DNA, 22 bp, Homo sapiens
gcagagctcatgcctgcacctc

SEQ ID NO: 7367684 - DNA, 22 bp, Homo sapiens
gcagagctccccaagacaccaa

SEQ ID NO: 7367685 - DNA, 22 bp, Homo sapiens
gcagcctctgcagttcaggagg

SEQ ID NO: 7367686 - DNA, 22 bp, Homo sapiens
gcagagctcaaggtgttcagct

SEQ ID NO: 7367687 - DNA, 22 bp, Homo sapiens
gcagctcccatcagggcacaga

SEQ ID NO: 7367688 - DNA, 22 bp, Homo sapiens
gcagctagtccagttatgtggc

SEQ ID NO: 7367689 - DNA, 18 bp, Homo sapiens
gcagctgacactggagtt

SEQ ID NO: 7367690 - DNA, 22 bp, Homo sapiens
gcaggagaacaaagcaagctgc

SEQ ID NO: 7367691 - DNA, 22 bp, Homo sapiens
gcaggacaggcgttggtccagt

SEQ ID NO: 7367692 - DNA, 22 bp, Homo sapiens
gcagctgacatctggctgggcc

SEQ ID NO: 7367693 - DNA, 22 bp, Homo sapiens
gcaggagagccagcaggcttcc

SEQ ID NO: 7367694 - DNA, 22 bp, Homo sapiens
gcaggagctcgtttccaggctg

SEQ ID NO: 7367695 - DNA, 22 bp, Homo sapiens
gccagaggctcaggttgccatg

SEQ ID NO: 7367696 - DNA, 22 bp, Homo sapiens
gccacaggctccagcatcagta

SEQ ID NO: 7367697 - DNA, 20 bp, Homo sapiens
gccagaggccggcaggggct

SEQ ID NO: 7367698 - DNA, 22 bp, Homo sapiens
gccacagctcacgttccccatt

SEQ ID NO: 7367699 - DNA, 22 bp, Homo sapiens
gccacagcggggccgctagagc

SEQ ID NO: 7367700 - DNA, 22 bp, Homo sapiens
gccacaggaaagcaccctggag

SEQ ID NO: 7367701 - DNA, 22 bp, Homo sapiens
gccacaggcacttaagggctgg

SEQ ID NO: 7367702 - DNA, 19 bp, Homo sapiens
gccacaggatgaagtttgg

SEQ ID NO: 7367703 - DNA, 22 bp, Homo sapiens
gccagcagccacagaagtcact

SEQ ID NO: 7367704 - DNA, 22 bp, Homo sapiens
gcatgtaatcactctaggaagg

SEQ ID NO: 7367705 - DNA, 17 bp, Homo sapiens
gcatgtagtacatgtaa

SEQ ID NO: 7367706 - DNA, 22 bp, Homo sapiens
gccacagcccgagcaccatgag

SEQ ID NO: 7367707 - DNA, 22 bp, Homo sapiens
gccacagcagggccctctcagg

SEQ ID NO: 7367708 - DNA, 22 bp, Homo sapiens
gccaatagcaatttctaggccc

SEQ ID NO: 7367709 - DNA, 22 bp, Homo sapiens
gccaataggaagagaaagatgg

SEQ ID NO: 7367710 - DNA, 22 bp, Homo sapiens
gcaggtgggagccgctgcctga

SEQ ID NO: 7367711 - DNA, 22 bp, Homo sapiens
gcaggtggagcagtagtctggt

SEQ ID NO: 7367712 - DNA, 22 bp, Homo sapiens
gcagggtgatagtgaggctcag

SEQ ID NO: 7367713 - DNA, 22 bp, Homo sapiens
gcagggtgccgacttcagggat

SEQ ID NO: 7367714 - DNA, 22 bp, Homo sapiens
gcagggtggatggcagggccag

SEQ ID NO: 7367715 - DNA, 22 bp, Homo sapiens
gcaggtggtggcgcgcgccctg

SEQ ID NO: 7367716 - DNA, 22 bp, Homo sapiens
gcaggtggtccccgtggagtgg

SEQ ID NO: 7367717 - DNA, 22 bp, Homo sapiens
gcagtggggaatgctggggaga

SEQ ID NO: 7367718 - DNA, 22 bp, Homo sapiens
gcagtggggaatgctggggaga

SEQ ID NO: 7367719 - DNA, 22 bp, Homo sapiens
gcagtggggaatgctggggaga

SEQ ID NO: 7367720 - DNA, 22 bp, Homo sapiens
gcagtgtagactttagttgatg

SEQ ID NO: 7367721 - DNA, 22 bp, Homo sapiens
gcagtagcagcctagatgccat

SEQ ID NO: 7367722 - DNA, 22 bp, Homo sapiens
gcagtagagcagagattttcct

SEQ ID NO: 7367723 - DNA, 22 bp, Homo sapiens
gcagtaggagggacaactacct

SEQ ID NO: 7367724 - DNA, 22 bp, Homo sapiens
gcagtaggagaagaggatgctt

SEQ ID NO: 7367725 - DNA, 22 bp, Homo sapiens
gcagtaggagggacaactacct

SEQ ID NO: 7367726 - DNA, 22 bp, Homo sapiens
gcagtgggcaacaagagctgga

SEQ ID NO: 7367727 - DNA, 22 bp, Homo sapiens
gcagtagagcttcttttgatga

SEQ ID NO: 7367728 - DNA, 22 bp, Homo sapiens
gctccagctccggctccgaagc

SEQ ID NO: 7367729 - DNA, 22 bp, Homo sapiens
gctccagctcgtggctcccagc

SEQ ID NO: 7367730 - DNA, 22 bp, Homo sapiens
gctccaggagagggaagcagat

SEQ ID NO: 7367731 - DNA, 22 bp, Homo sapiens
gctccaggagctcacagctcgc

SEQ ID NO: 7367732 - DNA, 22 bp, Homo sapiens
gctccaggagctcacagctcgc

SEQ ID NO: 7367733 - DNA, 22 bp, Homo sapiens
gctccaggaggatgaccttcct

SEQ ID NO: 7367734 - DNA, 22 bp, Homo sapiens
gctcagacagatatttcgagat

SEQ ID NO: 7367735 - DNA, 22 bp, Homo sapiens
gccttaatacagatgggtggtg

SEQ ID NO: 7367736 - DNA, 22 bp, Homo sapiens
gccttagcatcttaaagctgtg

SEQ ID NO: 7367737 - DNA, 17 bp, Homo sapiens
gctctgccaggaaagag

SEQ ID NO: 7367738 - DNA, 22 bp, Homo sapiens
gctctgccagcccaaggcgcag

SEQ ID NO: 7367739 - DNA, 17 bp, Homo sapiens
gctctgccaggaaagag

SEQ ID NO: 7367740 - DNA, 19 bp, Homo sapiens
gctctgccagtggtaacat

SEQ ID NO: 7367741 - DNA, 22 bp, Homo sapiens
gctctgccagacactgtggcca

SEQ ID NO: 7367742 - DNA, 20 bp, Homo sapiens
gctctgccacttagaagctg

SEQ ID NO: 7367743 - DNA, 21 bp, Homo sapiens
gctctgccacttaccagattt

SEQ ID NO: 7367744 - DNA, 22 bp, Homo sapiens
gctctgcccaatgtccctacac

SEQ ID NO: 7367745 - DNA, 22 bp, Homo sapiens
gctctgcccaaagctgtggctg

SEQ ID NO: 7367746 - DNA, 22 bp, Homo sapiens
gctctgcccaggaccgtccttg

SEQ ID NO: 7367747 - DNA, 22 bp, Homo sapiens
gctctgtttatccctgacaatt

SEQ ID NO: 7367748 - DNA, 22 bp, Homo sapiens
gctcttctaaagaatgtacagg

SEQ ID NO: 7367749 - DNA, 22 bp, Homo sapiens
gctcttctaaagaatgtacagg

SEQ ID NO: 7367750 - DNA, 22 bp, Homo sapiens
gctcttctcagattgtacactc

SEQ ID NO: 7367751 - DNA, 22 bp, Homo sapiens
gctgagagtgggtgcagtgctt

SEQ ID NO: 7367752 - DNA, 20 bp, Homo sapiens
gctgaagaagtagcatgtac

SEQ ID NO: 7367753 - DNA, 22 bp, Homo sapiens
gctgaagacaatggaattgact

SEQ ID NO: 7367754 - DNA, 21 bp, Homo sapiens
gctgaagacaaattctcttag

SEQ ID NO: 7367755 - DNA, 22 bp, Homo sapiens
gctgaagacaatggaattgact

SEQ ID NO: 7367756 - DNA, 22 bp, Homo sapiens
gctgaagaccccagctccccag

SEQ ID NO: 7367757 - DNA, 21 bp, Homo sapiens
gctgaagaactctttattttc

SEQ ID NO: 7367758 - DNA, 22 bp, Homo sapiens
gctctgccaacagtttgggcaa

SEQ ID NO: 7367759 - DNA, 22 bp, Homo sapiens
gctctgccaaggacccattctc

SEQ ID NO: 7367760 - DNA, 23 bp, Homo sapiens
gctctgccacttaatagctgtgt

SEQ ID NO: 7367761 - DNA, 22 bp, Homo sapiens
gctcctggctctctgagggctg

SEQ ID NO: 7367762 - DNA, 22 bp, Homo sapiens
gctctctttaaactgcatggct

SEQ ID NO: 7367763 - DNA, 22 bp, Homo sapiens
gctgagctagctatctcagtct

SEQ ID NO: 7367764 - DNA, 22 bp, Homo sapiens
gctgaggatatagcaggaacaa

SEQ ID NO: 7367765 - DNA, 22 bp, Homo sapiens
gctgcctgatcatacaccaggg

SEQ ID NO: 7367766 - DNA, 22 bp, Homo sapiens
gctgcctggagctcagcctgcc

SEQ ID NO: 7367767 - DNA, 22 bp, Homo sapiens
gctgcctggctttagtccactt

SEQ ID NO: 7367768 - DNA, 22 bp, Homo sapiens
gctgcctgatgtccagcaggac

SEQ ID NO: 7367769 - DNA, 22 bp, Homo sapiens
gctgcctgcttcatgtgggaga

SEQ ID NO: 7367770 - DNA, 22 bp, Homo sapiens
gctgcctggaataacggctggc

SEQ ID NO: 7367771 - DNA, 22 bp, Homo sapiens
gctgcctgctcggctcctggga

SEQ ID NO: 7367772 - DNA, 22 bp, Homo sapiens
gctgcctgctcggctcctggga

SEQ ID NO: 7367773 - DNA, 22 bp, Homo sapiens
gctgctgcgcttgtctactgtt

SEQ ID NO: 7367774 - DNA, 19 bp, Homo sapiens
gctgctgctcctccctcgc

SEQ ID NO: 7367775 - DNA, 22 bp, Homo sapiens
gctgctgctggtctggggccac

SEQ ID NO: 7367776 - DNA, 21 bp, Homo sapiens
gctgctgcccctagtgaggcc

SEQ ID NO: 7367777 - DNA, 22 bp, Homo sapiens
gctgctgccgcggccgctggga

SEQ ID NO: 7367778 - DNA, 22 bp, Homo sapiens
gctgctgcaagagccagctctt

SEQ ID NO: 7367779 - DNA, 22 bp, Homo sapiens
gctgctgcaagagccagctctt

SEQ ID NO: 7367780 - DNA, 22 bp, Homo sapiens
gctgctcttgaggggctcactg

SEQ ID NO: 7367781 - DNA, 21 bp, Homo sapiens
gctgctcgagatccagtgctt

SEQ ID NO: 7367782 - DNA, 22 bp, Homo sapiens
gctgcctggtttctcagctgca

SEQ ID NO: 7367783 - DNA, 22 bp, Homo sapiens
gctgcctgggcaggaggcgctg

SEQ ID NO: 7367784 - DNA, 22 bp, Homo sapiens
gctgctctctccctaagttggg

SEQ ID NO: 7367785 - DNA, 22 bp, Homo sapiens
gctggcctcctgctagatggaa

SEQ ID NO: 7367786 - DNA, 22 bp, Homo sapiens
gctggcctgaccagccacaggc

SEQ ID NO: 7367787 - DNA, 22 bp, Homo sapiens
gctggcctgaccagccacaggc

SEQ ID NO: 7367788 - DNA, 22 bp, Homo sapiens
gctggcctgagggccgaggctc

SEQ ID NO: 7367789 - DNA, 22 bp, Homo sapiens
gctggcctgacctgaggctggg

SEQ ID NO: 7367790 - DNA, 22 bp, Homo sapiens
gctggcctctacaggccggcca

SEQ ID NO: 7367791 - DNA, 22 bp, Homo sapiens
gctggcctcgcaggcaggatgt

SEQ ID NO: 7367792 - DNA, 22 bp, Homo sapiens
gctggcctctacaggccggcca

SEQ ID NO: 7367793 - DNA, 22 bp, Homo sapiens
gctggcctctggagaagggctt

SEQ ID NO: 7367794 - DNA, 22 bp, Homo sapiens
gctggagatgctatgcagaggg

SEQ ID NO: 7367795 - DNA, 22 bp, Homo sapiens
gctggcctgggcagaggctatg

SEQ ID NO: 7367796 - DNA, 22 bp, Homo sapiens
gctggcctgctgggcaccaccg

SEQ ID NO: 7367797 - DNA, 22 bp, Homo sapiens
gctggcctgcgagggcaggctg

SEQ ID NO: 7367798 - DNA, 22 bp, Homo sapiens
gctggcctgcgagggcaggctg

SEQ ID NO: 7367799 - DNA, 18 bp, Homo sapiens
gcctgcctagagcttgcc

SEQ ID NO: 7367800 - DNA, 20 bp, Homo sapiens
gcctgcctcagctagctgag

SEQ ID NO: 7367801 - DNA, 23 bp, Homo sapiens
gcctgccatatacctggaaacag

SEQ ID NO: 7367802 - DNA, 22 bp, Homo sapiens
gcctgccagtgtttgaggattg

SEQ ID NO: 7367803 - DNA, 22 bp, Homo sapiens
gcctgccagtgtttgaggattg

SEQ ID NO: 7367804 - DNA, 19 bp, Homo sapiens
gcctgccagcctgaatctg

SEQ ID NO: 7367805 - DNA, 22 bp, Homo sapiens
gcctgccagccacagtggcagc

SEQ ID NO: 7367806 - DNA, 17 bp, Homo sapiens
gcctctgcttgtgtcat

SEQ ID NO: 7367807 - DNA, 22 bp, Homo sapiens
gcctgccttcggtgcgcagcgg

SEQ ID NO: 7367808 - DNA, 19 bp, Homo sapiens
gcctgcctgggtttctgag

SEQ ID NO: 7367809 - DNA, 22 bp, Homo sapiens
gcctgcctgttggctgaggtgc

SEQ ID NO: 7367810 - DNA, 22 bp, Homo sapiens
gcctgcctggagcttgaggtga

SEQ ID NO: 7367811 - DNA, 22 bp, Homo sapiens
gcctgcctgctgtcatctgcct

SEQ ID NO: 7367812 - DNA, 22 bp, Homo sapiens
gcctggagggatagaatgcaag

SEQ ID NO: 7367813 - DNA, 22 bp, Homo sapiens
gcctggagcctcagcaaggagg

SEQ ID NO: 7367814 - DNA, 22 bp, Homo sapiens
gcctgccttttggaggcacatt

SEQ ID NO: 7367815 - DNA, 22 bp, Homo sapiens
gcctgccttttggaggcacatt

SEQ ID NO: 7367816 - DNA, 22 bp, Homo sapiens
gcctgctcagacctagcaggcc

SEQ ID NO: 7367817 - DNA, 22 bp, Homo sapiens
gcctgctcccagttggcgcctc

SEQ ID NO: 7367818 - DNA, 23 bp, Homo sapiens
gcctgctggtcacctaatctgcc

SEQ ID NO: 7367819 - DNA, 23 bp, Homo sapiens
gcctgctgtcacagcgggcccag

SEQ ID NO: 7367820 - DNA, 22 bp, Homo sapiens
gcctgctctgacatccatccca

SEQ ID NO: 7367821 - DNA, 22 bp, Homo sapiens
gcctgctgggagacacccccag

SEQ ID NO: 7367822 - DNA, 22 bp, Homo sapiens
gcctgcttcctagccttccaag

SEQ ID NO: 7367823 - DNA, 22 bp, Homo sapiens
gcctggaagacgtcttggcttc

SEQ ID NO: 7367824 - DNA, 22 bp, Homo sapiens
gcctggaaattgaggcacagtt

SEQ ID NO: 7367825 - DNA, 22 bp, Homo sapiens
gcctggaagtccagagtacatt

SEQ ID NO: 7367826 - DNA, 22 bp, Homo sapiens
gcctgctgttgagggaagagct

SEQ ID NO: 7367827 - DNA, 21 bp, Homo sapiens
gcctgctgttcaccctgccac

SEQ ID NO: 7367828 - DNA, 22 bp, Homo sapiens
gcctgctgttgagggaagagct

SEQ ID NO: 7367829 - DNA, 22 bp, Homo sapiens
gcctgctgtcctgattcccatg

SEQ ID NO: 7367830 - DNA, 21 bp, Homo sapiens
gcctgctgttcaccctgccac

SEQ ID NO: 7367831 - DNA, 22 bp, Homo sapiens
gcctgctgttaactgcaggaat

SEQ ID NO: 7367832 - DNA, 22 bp, Homo sapiens
gcctggagtagcatggcaagcc

SEQ ID NO: 7367833 - DNA, 22 bp, Homo sapiens
gcctgggaaatggtggggtcag

SEQ ID NO: 7367834 - DNA, 21 bp, Homo sapiens
gcctgggaaatctgggaagcc

SEQ ID NO: 7367835 - DNA, 22 bp, Homo sapiens
gcctgggaaagagtagggaaat

SEQ ID NO: 7367836 - DNA, 22 bp, Homo sapiens
gcctggccgctccgagctccgc

SEQ ID NO: 7367837 - DNA, 23 bp, Homo sapiens
gcctgggactggtagtgtgacct

SEQ ID NO: 7367838 - DNA, 22 bp, Homo sapiens
gcctgggactggatgtgtttgt

SEQ ID NO: 7367839 - DNA, 22 bp, Homo sapiens
gcctgggactgcagatccccag

SEQ ID NO: 7367840 - DNA, 23 bp, Homo sapiens
gcctgggactcaggaggagctca

SEQ ID NO: 7367841 - DNA, 22 bp, Homo sapiens
gcctgggacccttagctcttgg

SEQ ID NO: 7367842 - DNA, 21 bp, Homo sapiens
gcctgggaagagaaaggtaag

SEQ ID NO: 7367843 - DNA, 22 bp, Homo sapiens
gcctgggaagactaagtgggag

SEQ ID NO: 7367844 - DNA, 22 bp, Homo sapiens
gcctgggaactctgatctcctg

SEQ ID NO: 7367845 - DNA, 19 bp, Homo sapiens
gcctgggatgggcagaact

SEQ ID NO: 7367846 - DNA, 21 bp, Homo sapiens
gcctgggatagtggcctccgg

SEQ ID NO: 7367847 - DNA, 22 bp, Homo sapiens
gcctgggagaatgacctccaac

SEQ ID NO: 7367848 - DNA, 18 bp, Homo sapiens
gcctgggagaagtttcac

SEQ ID NO: 7367849 - DNA, 22 bp, Homo sapiens
gcctgggatagaggcaatgcat

SEQ ID NO: 7367850 - DNA, 22 bp, Homo sapiens
gcctgggattcccagaggggca

SEQ ID NO: 7367851 - DNA, 20 bp, Homo sapiens
gcctgggattatccactggt

SEQ ID NO: 7367852 - DNA, 22 bp, Homo sapiens
gcctgggattctcaaaggggtg

SEQ ID NO: 7367853 - DNA, 22 bp, Homo sapiens
gcctgtcaattttgtgtacaat

SEQ ID NO: 7367854 - DNA, 22 bp, Homo sapiens
gcctgggattgtgtaagtgaat

SEQ ID NO: 7367855 - DNA, 22 bp, Homo sapiens
gcctgttccttagtggcttcac

SEQ ID NO: 7367856 - DNA, 18 bp, Homo sapiens
gcctgttccctactatcc

SEQ ID NO: 7367857 - DNA, 20 bp, Homo sapiens
gcctgttcacaggcttcttg

SEQ ID NO: 7367858 - DNA, 22 bp, Homo sapiens
gcctgttaaacatgcggctcaa

SEQ ID NO: 7367859 - DNA, 22 bp, Homo sapiens
gcctgttctgccctgagagcct

SEQ ID NO: 7367860 - DNA, 22 bp, Homo sapiens
gccatatacccactgtctccat

SEQ ID NO: 7367861 - DNA, 22 bp, Homo sapiens
gccagtttccacctaggcaatt

SEQ ID NO: 7367862 - DNA, 22 bp, Homo sapiens
gccataaaatgtggatgaggga

SEQ ID NO: 7367863 - DNA, 22 bp, Homo sapiens
gccataaatgaaggaaaggtat

SEQ ID NO: 7367864 - DNA, 22 bp, Homo sapiens
gccaggctgctggctgctgtcc

SEQ ID NO: 7367865 - DNA, 22 bp, Homo sapiens
gccatgtcctgggcatctgcca

SEQ ID NO: 7367866 - DNA, 22 bp, Homo sapiens
gcccaggctggagtgcagtggc

SEQ ID NO: 7367867 - DNA, 22 bp, Homo sapiens
gcccaggctggagtgcagtagc

SEQ ID NO: 7367868 - DNA, 22 bp, Homo sapiens
gcccaggctggagtgcagtagc

SEQ ID NO: 7367869 - DNA, 22 bp, Homo sapiens
gcccaggctagcgtagagtgca

SEQ ID NO: 7367870 - DNA, 22 bp, Homo sapiens
gcccaggctagcgtagagtgca

SEQ ID NO: 7367871 - DNA, 22 bp, Homo sapiens
gcccaggctggagtgcagtggc

SEQ ID NO: 7367872 - DNA, 22 bp, Homo sapiens
gcccaggctggagtgcagtggt

SEQ ID NO: 7367873 - DNA, 22 bp, Homo sapiens
gccctctcttctgcagcctcca

SEQ ID NO: 7367874 - DNA, 20 bp, Homo sapiens
gcccttatgcagtgatggga

SEQ ID NO: 7367875 - DNA, 22 bp, Homo sapiens
gccctttattagagctgccatt

SEQ ID NO: 7367876 - DNA, 22 bp, Homo sapiens
gccctgttctggacaggcacaa

SEQ ID NO: 7367877 - DNA, 22 bp, Homo sapiens
gccctgttgtcggacgtcaagg

SEQ ID NO: 7367878 - DNA, 22 bp, Homo sapiens
gccctgttttgaaacttgcata

SEQ ID NO: 7367879 - DNA, 22 bp, Homo sapiens
gcccttacagggtggtcagcca

SEQ ID NO: 7367880 - DNA, 22 bp, Homo sapiens
gcctctgcggagctgtacatca

SEQ ID NO: 7367881 - DNA, 22 bp, Homo sapiens
gcctctgcggggcccgagcccg

SEQ ID NO: 7367882 - DNA, 22 bp, Homo sapiens
gcctctgctcggactttgcctc

SEQ ID NO: 7367883 - DNA, 22 bp, Homo sapiens
gcctctgcgcctcagccgacct

SEQ ID NO: 7367884 - DNA, 22 bp, Homo sapiens
gcctctgccctcctgggactgc

SEQ ID NO: 7367885 - DNA, 22 bp, Homo sapiens
gcctctgcccatccaccatcag

SEQ ID NO: 7367886 - DNA, 19 bp, Homo sapiens
gcctctgctggggacaggc

SEQ ID NO: 7367887 - DNA, 21 bp, Homo sapiens
gcctctgctgtcttattgtga

SEQ ID NO: 7367888 - DNA, 22 bp, Homo sapiens
gcctctgctgcaagcctggttg

SEQ ID NO: 7367889 - DNA, 22 bp, Homo sapiens
gcctctgctgacaagatggaca

SEQ ID NO: 7367890 - DNA, 22 bp, Homo sapiens
gcctctgctctcaggtagcctc

SEQ ID NO: 7367891 - DNA, 23 bp, Homo sapiens
gcctctgctctgcgttggggact

SEQ ID NO: 7367892 - DNA, 22 bp, Homo sapiens
gcctctgcaactccgccttggt

SEQ ID NO: 7367893 - DNA, 22 bp, Homo sapiens
gcctctgcaattacattgtgcc

SEQ ID NO: 7367894 - DNA, 22 bp, Homo sapiens
gcctctgcaccagtactgtgcc

SEQ ID NO: 7367895 - DNA, 22 bp, Homo sapiens
gcctctgcactgtggcacacca

SEQ ID NO: 7367896 - DNA, 23 bp, Homo sapiens
gcctctgcagcctagttagtgtc

SEQ ID NO: 7367897 - DNA, 22 bp, Homo sapiens
gcctctgcaggtgcggttatcc

SEQ ID NO: 7367898 - DNA, 22 bp, Homo sapiens
gcctctgccaagggggctgcgg

SEQ ID NO: 7367899 - DNA, 22 bp, Homo sapiens
gcctctgcatgctcagcaccca

SEQ ID NO: 7367900 - DNA, 22 bp, Homo sapiens
gcctctgcatcttcgccgcact

SEQ ID NO: 7367901 - DNA, 22 bp, Homo sapiens
gcctctgcatcatcactccagc

SEQ ID NO: 7367902 - DNA, 22 bp, Homo sapiens
gccgaggctctgcccagctgct

SEQ ID NO: 7367903 - DNA, 22 bp, Homo sapiens
gccgggttcaagccattctcct

SEQ ID NO: 7367904 - DNA, 22 bp, Homo sapiens
gcctcctgtcccaggctgagga

SEQ ID NO: 7367905 - DNA, 22 bp, Homo sapiens
ggctcctgggcagctgctccct

SEQ ID NO: 7367906 - DNA, 22 bp, Homo sapiens
ggctcctggaaagccctcgctc

SEQ ID NO: 7367907 - DNA, 22 bp, Homo sapiens
ggctcctggaggcaccactggt

SEQ ID NO: 7367908 - DNA, 19 bp, Homo sapiens
ggctcctggggctcagccc

SEQ ID NO: 7367909 - DNA, 22 bp, Homo sapiens
ggctggctacattggaggaagg

SEQ ID NO: 7367910 - DNA, 22 bp, Homo sapiens
ggctgccttccctgagccccgg

SEQ ID NO: 7367911 - DNA, 22 bp, Homo sapiens
ggctgccttccctgagccccgg

SEQ ID NO: 7367912 - DNA, 22 bp, Homo sapiens
ggctgccttccctgagccccgg

SEQ ID NO: 7367913 - DNA, 19 bp, Homo sapiens
ggctgccttctgctcatct

SEQ ID NO: 7367914 - DNA, 19 bp, Homo sapiens
ggctgccttctgctcatct

SEQ ID NO: 7367915 - DNA, 22 bp, Homo sapiens
ggctgcctgttgagtatgtccc

SEQ ID NO: 7367916 - DNA, 18 bp, Homo sapiens
ggctgcctgttcctgaag

SEQ ID NO: 7367917 - DNA, 22 bp, Homo sapiens
ggctgcctgtgcccaggcacac

SEQ ID NO: 7367918 - DNA, 22 bp, Homo sapiens
ggctgccttcagactccagctt

SEQ ID NO: 7367919 - DNA, 22 bp, Homo sapiens
ggctgccttcatagaccatggg

SEQ ID NO: 7367920 - DNA, 22 bp, Homo sapiens
ggctgccttcatagaccatggg

SEQ ID NO: 7367921 - DNA, 21 bp, Homo sapiens
ggctgcctgggaagaagaaga

SEQ ID NO: 7367922 - DNA, 22 bp, Homo sapiens
ggctgcctgggagccctcctct

SEQ ID NO: 7367923 - DNA, 22 bp, Homo sapiens
ggctgcctgggagccctcctct

SEQ ID NO: 7367924 - DNA, 22 bp, Homo sapiens
ggctgcctggtttcttgtaagg

SEQ ID NO: 7367925 - DNA, 22 bp, Homo sapiens
ggctgcctggtttagtgctgac

SEQ ID NO: 7367926 - DNA, 22 bp, Homo sapiens
ggctgcctgtgcccaggcacac

SEQ ID NO: 7367927 - DNA, 22 bp, Homo sapiens
ggctgcctgtgcccaggcacac

SEQ ID NO: 7367928 - DNA, 19 bp, Homo sapiens
ggctgcctggagcgagggc

SEQ ID NO: 7367929 - DNA, 22 bp, Homo sapiens
ggctggcttgccaagctcaggg

SEQ ID NO: 7367930 - DNA, 22 bp, Homo sapiens
ggctggctggcttagcagagga

SEQ ID NO: 7367931 - DNA, 22 bp, Homo sapiens
ggctggctggctggtagacaag

SEQ ID NO: 7367932 - DNA, 22 bp, Homo sapiens
ggctggctgtgccctgtactct

SEQ ID NO: 7367933 - DNA, 22 bp, Homo sapiens
ggctggctggcttagcagagga

SEQ ID NO: 7367934 - DNA, 22 bp, Homo sapiens
ggctggctgataaagggttgag

SEQ ID NO: 7367935 - DNA, 22 bp, Homo sapiens
ggctggctcagggcttgagaga

SEQ ID NO: 7367936 - DNA, 22 bp, Homo sapiens
ggctggctatctgtggttgcct

SEQ ID NO: 7367937 - DNA, 22 bp, Homo sapiens
ggctggctccacctaggtagct

SEQ ID NO: 7367938 - DNA, 22 bp, Homo sapiens
ggcttccccacaaagcacacaa

SEQ ID NO: 7367939 - DNA, 22 bp, Homo sapiens
gggaaccacccctctgccctga

SEQ ID NO: 7367940 - DNA, 22 bp, Homo sapiens
gggaacagggcctgagctgggg

SEQ ID NO: 7367941 - DNA, 22 bp, Homo sapiens
gggaacagagtgccagactgac

SEQ ID NO: 7367942 - DNA, 22 bp, Homo sapiens
gggaacagcttgggctctgcca

SEQ ID NO: 7367943 - DNA, 22 bp, Homo sapiens
gggaagagaggaggtggtttcg

SEQ ID NO: 7367944 - DNA, 22 bp, Homo sapiens
gggaagagaccgtaccctggcc

SEQ ID NO: 7367945 - DNA, 22 bp, Homo sapiens
gggaccaggtcagggctctgac

SEQ ID NO: 7367946 - DNA, 23 bp, Homo sapiens
gggaccaggcccttcctggtttg

SEQ ID NO: 7367947 - DNA, 22 bp, Homo sapiens
gggaagagatttccacatcatt

SEQ ID NO: 7367948 - DNA, 18 bp, Homo sapiens
gggaagaggatctggccc

SEQ ID NO: 7367949 - DNA, 22 bp, Homo sapiens
gggaagagatttccacatcatt

SEQ ID NO: 7367950 - DNA, 22 bp, Homo sapiens
gggaagagatttccacatcatt

SEQ ID NO: 7367951 - DNA, 22 bp, Homo sapiens
gggaaaggatcagtgggaggct

SEQ ID NO: 7367952 - DNA, 22 bp, Homo sapiens
ggccctgagctgaagtactgtg

SEQ ID NO: 7367953 - DNA, 22 bp, Homo sapiens
ggccctgatacaagtaaggtct

SEQ ID NO: 7367954 - DNA, 22 bp, Homo sapiens
ggccctgcaaggtacccaggcc

SEQ ID NO: 7367955 - DNA, 22 bp, Homo sapiens
ggccctctggcttccgcatggg

SEQ ID NO: 7367956 - DNA, 22 bp, Homo sapiens
ggccctctgtggctgccatgga

SEQ ID NO: 7367957 - DNA, 22 bp, Homo sapiens
ggccctgaagtgattgtgagtt

SEQ ID NO: 7367958 - DNA, 22 bp, Homo sapiens
ggccctctgagtagctgcaaac

SEQ ID NO: 7367959 - DNA, 22 bp, Homo sapiens
ggccctctgcctgtgctggcga

SEQ ID NO: 7367960 - DNA, 22 bp, Homo sapiens
ggccttccatctgcctctgttt

SEQ ID NO: 7367961 - DNA, 22 bp, Homo sapiens
ggccttccttcccagcctactg

SEQ ID NO: 7367962 - DNA, 22 bp, Homo sapiens
ggccttcctgttgtgtccaccg

SEQ ID NO: 7367963 - DNA, 21 bp, Homo sapiens
ggccttcccctgcagtctccg

SEQ ID NO: 7367964 - DNA, 22 bp, Homo sapiens
ggctcagcttatctgggcaggc

SEQ ID NO: 7367965 - DNA, 22 bp, Homo sapiens
ggctcagcttggtgcgcagaaa

SEQ ID NO: 7367966 - DNA, 23 bp, Homo sapiens
ggctcctgcttcatgtcccacct

SEQ ID NO: 7367967 - DNA, 19 bp, Homo sapiens
ggctcagtggcaccatcct

SEQ ID NO: 7367968 - DNA, 22 bp, Homo sapiens
ggcccagccggcgagtctcgcg

SEQ ID NO: 7367969 - DNA, 22 bp, Homo sapiens
ggcccacttgaaatggagctca

SEQ ID NO: 7367970 - DNA, 20 bp, Homo sapiens
ggccatgggttgcctgaggt

SEQ ID NO: 7367971 - DNA, 22 bp, Homo sapiens
ggccatgtttggcagaaggatt

SEQ ID NO: 7367972 - DNA, 17 bp, Homo sapiens
ggccatggtgcaaggtt

SEQ ID NO: 7367973 - DNA, 22 bp, Homo sapiens
ggcccagcctcagacatgccct

SEQ ID NO: 7367974 - DNA, 22 bp, Homo sapiens
ggcccagcctggcaacaatgac

SEQ ID NO: 7367975 - DNA, 22 bp, Homo sapiens
ggcccagccttggggtttcttt

SEQ ID NO: 7367976 - DNA, 22 bp, Homo sapiens
ggccccagcagaccctcctctg

SEQ ID NO: 7367977 - DNA, 22 bp, Homo sapiens
ggccccacgggggagtcctagt

SEQ ID NO: 7367978 - DNA, 22 bp, Homo sapiens
ggcccagcgaggccacctacag

SEQ ID NO: 7367979 - DNA, 21 bp, Homo sapiens
ggccccgcagacccagcacgt

SEQ ID NO: 7367980 - DNA, 22 bp, Homo sapiens
ggccccagttcactcctggccg

SEQ ID NO: 7367981 - DNA, 22 bp, Homo sapiens
ggccagagggagggcacaaatc

SEQ ID NO: 7367982 - DNA, 22 bp, Homo sapiens
ggcaggtgctctgtgggcctgg

SEQ ID NO: 7367983 - DNA, 22 bp, Homo sapiens
gggctggagacaagtgagccgc

SEQ ID NO: 7367984 - DNA, 22 bp, Homo sapiens
ggggaagggagtccaagtgtta

SEQ ID NO: 7367985 - DNA, 22 bp, Homo sapiens
gggtgagagtcaggcagagatt

SEQ ID NO: 7367986 - DNA, 20 bp, Homo sapiens
gggtgagatgtaggagaggg

SEQ ID NO: 7367987 - DNA, 22 bp, Homo sapiens
gggtgagacagaaagagcaaaa

SEQ ID NO: 7367988 - DNA, 22 bp, Homo sapiens
gggtgacatttcccaatgagcc

SEQ ID NO: 7367989 - DNA, 22 bp, Homo sapiens
gggtgacatagtgatggggcat

SEQ ID NO: 7367990 - DNA, 19 bp, Homo sapiens
gggtgaggaagagcgttgc

SEQ ID NO: 7367991 - DNA, 23 bp, Homo sapiens
gggtgggccaaattaggtagcct

SEQ ID NO: 7367992 - DNA, 17 bp, Homo sapiens
gggtgggcactgctggc

SEQ ID NO: 7367993 - DNA, 22 bp, Homo sapiens
gggtgggcccagcccagagaag

SEQ ID NO: 7367994 - DNA, 22 bp, Homo sapiens
gggtgggccccaggtatctgta

SEQ ID NO: 7367995 - DNA, 22 bp, Homo sapiens
gggtgggccactgagcagcgtg

SEQ ID NO: 7367996 - DNA, 22 bp, Homo sapiens
ggggggcagctgtcctggccat

SEQ ID NO: 7367997 - DNA, 22 bp, Homo sapiens
gggggtaggcagacaaggacat

SEQ ID NO: 7367998 - DNA, 22 bp, Homo sapiens
gggggctcctcccagctgccag

SEQ ID NO: 7367999 - DNA, 22 bp, Homo sapiens
gggctactgagctggaactggg

SEQ ID NO: 7368000 - DNA, 22 bp, Homo sapiens
gggcggatcacctgaggtcagg

SEQ ID NO: 7368001 - DNA, 22 bp, Homo sapiens
gggcggatcatttgaggtcagg

SEQ ID NO: 7368002 - DNA, 22 bp, Homo sapiens
gggcccagcgtggttccatctg

SEQ ID NO: 7368003 - DNA, 19 bp, Homo sapiens
gggcccagcatggagggtt

SEQ ID NO: 7368004 - DNA, 22 bp, Homo sapiens
gggcccagccctctgctcactg

SEQ ID NO: 7368005 - DNA, 22 bp, Homo sapiens
gggcccagcactggctgggatc

SEQ ID NO: 7368006 - DNA, 23 bp, Homo sapiens
gggcccagcacaggacctggcag

SEQ ID NO: 7368007 - DNA, 22 bp, Homo sapiens
gggcagctcagccaccatgcag

SEQ ID NO: 7368008 - DNA, 20 bp, Homo sapiens
gggcagctcccctcattctg

SEQ ID NO: 7368009 - DNA, 22 bp, Homo sapiens
gggcagctcagccaccatgcag

SEQ ID NO: 7368010 - DNA, 22 bp, Homo sapiens
gggcagctagccctctagccca

SEQ ID NO: 7368011 - DNA, 22 bp, Homo sapiens
gggcagctcggaagtgggaaag

SEQ ID NO: 7368012 - DNA, 22 bp, Homo sapiens
gggcagctcctgtggaatccac

SEQ ID NO: 7368013 - DNA, 22 bp, Homo sapiens
gggcagctctcacagcagccaa

SEQ ID NO: 7368014 - DNA, 22 bp, Homo sapiens
gggccaggtggaccccagcctc

SEQ ID NO: 7368015 - DNA, 22 bp, Homo sapiens
gggccaggtatcgtctttagta

SEQ ID NO: 7368016 - DNA, 22 bp, Homo sapiens
gggccaggtcggtgaatggtca

SEQ ID NO: 7368017 - DNA, 22 bp, Homo sapiens
gggcagcacgtttcaggaggat

SEQ ID NO: 7368018 - DNA, 22 bp, Homo sapiens
gggcagcagaattggacagaaa

SEQ ID NO: 7368019 - DNA, 22 bp, Homo sapiens
gggcagcaaatctgagtctggt

SEQ ID NO: 7368020 - DNA, 22 bp, Homo sapiens
gggcagcacagacagtgaaggc

SEQ ID NO: 7368021 - DNA, 18 bp, Homo sapiens
gggcagcacagcagcctc

SEQ ID NO: 7368022 - DNA, 22 bp, Homo sapiens
gggatgcagtcagagcccctgt

SEQ ID NO: 7368023 - DNA, 22 bp, Homo sapiens
gggatgcagtcagagcccctgt

SEQ ID NO: 7368024 - DNA, 22 bp, Homo sapiens
gggatggactgacggtagcgcg

SEQ ID NO: 7368025 - DNA, 19 bp, Homo sapiens
gggatgcactctgaccact

SEQ ID NO: 7368026 - DNA, 22 bp, Homo sapiens
gggatgcagactacagggctta

SEQ ID NO: 7368027 - DNA, 22 bp, Homo sapiens
gggagggacacaaagagttccc

SEQ ID NO: 7368028 - DNA, 22 bp, Homo sapiens
gggagggaaggaccttatgaat

SEQ ID NO: 7368029 - DNA, 22 bp, Homo sapiens
gggagggaaggaggcgccgtgt

SEQ ID NO: 7368030 - DNA, 22 bp, Homo sapiens
gggagggaaggtacctgtgtga

SEQ ID NO: 7368031 - DNA, 22 bp, Homo sapiens
gggagggaaagcttgatctgtc

SEQ ID NO: 7368032 - DNA, 22 bp, Homo sapiens
gggcagaggggcgcttccctct

SEQ ID NO: 7368033 - DNA, 22 bp, Homo sapiens
gggagaaggagctagttcttga

SEQ ID NO: 7368034 - DNA, 22 bp, Homo sapiens
gggagaaggaggactgtgctgt

SEQ ID NO: 7368035 - DNA, 18 bp, Homo sapiens
gggaggccccagcaggag

SEQ ID NO: 7368036 - DNA, 22 bp, Homo sapiens
gggacgacaggctctgtggtag

SEQ ID NO: 7368037 - DNA, 22 bp, Homo sapiens
gggacctgaggccctgctccac

SEQ ID NO: 7368038 - DNA, 22 bp, Homo sapiens
gggacctgaggccctgctccac

SEQ ID NO: 7368039 - DNA, 22 bp, Homo sapiens
gggacctgcgccactcactgtc

SEQ ID NO: 7368040 - DNA, 22 bp, Homo sapiens
gggaccctcaacatctgcttct

SEQ ID NO: 7368041 - DNA, 22 bp, Homo sapiens
gggaccaggtgggtgcattccg

SEQ ID NO: 7368042 - DNA, 22 bp, Homo sapiens
gcttctatccctccactgcact

SEQ ID NO: 7368043 - DNA, 22 bp, Homo sapiens
gcttcctgggacaggctatgtg

SEQ ID NO: 7368044 - DNA, 22 bp, Homo sapiens
gcttccttattgttgccatagt

SEQ ID NO: 7368045 - DNA, 17 bp, Homo sapiens
gcttcctgtgctgggga

SEQ ID NO: 7368046 - DNA, 22 bp, Homo sapiens
gcttccttccttacattggtgg

SEQ ID NO: 7368047 - DNA, 20 bp, Homo sapiens
gcttccttcccagcccccac

SEQ ID NO: 7368048 - DNA, 22 bp, Homo sapiens
gcttccttggtcctggtctaag

SEQ ID NO: 7368049 - DNA, 22 bp, Homo sapiens
gcttccttgggaaaattagatg

SEQ ID NO: 7368050 - DNA, 22 bp, Homo sapiens
gcttccttgggaaaattagatg

SEQ ID NO: 7368051 - DNA, 22 bp, Homo sapiens
gcttccttctaccacatcatgc

SEQ ID NO: 7368052 - DNA, 22 bp, Homo sapiens
gcttccttccttacattggtgg

SEQ ID NO: 7368053 - DNA, 22 bp, Homo sapiens
gcttcattaatagaattagtat

SEQ ID NO: 7368054 - DNA, 22 bp, Homo sapiens
gcttcagtttaggggttaattg

SEQ ID NO: 7368055 - DNA, 22 bp, Homo sapiens
gcttcctggaacaactgttgct

SEQ ID NO: 7368056 - DNA, 22 bp, Homo sapiens
gcttcagattcttttcatgtct

SEQ ID NO: 7368057 - DNA, 22 bp, Homo sapiens
gctgggctgagctagacttggc

SEQ ID NO: 7368058 - DNA, 22 bp, Homo sapiens
gcttattttcaccttctctcag

SEQ ID NO: 7368059 - DNA, 21 bp, Homo sapiens
gcttatagaaacatcaccaga

SEQ ID NO: 7368060 - DNA, 22 bp, Homo sapiens
gcttagagcagctcacaacatg

SEQ ID NO: 7368061 - DNA, 22 bp, Homo sapiens
gcttaatgagcagagaatctac

SEQ ID NO: 7368062 - DNA, 22 bp, Homo sapiens
gcttacaaacaacagaaattaa

SEQ ID NO: 7368063 - DNA, 22 bp, Homo sapiens
ggaaggtgctccctggacagag

SEQ ID NO: 7368064 - DNA, 17 bp, Homo sapiens
ggaagaaaaggatcatc

SEQ ID NO: 7368065 - DNA, 22 bp, Homo sapiens
ggaagaaagcacacaaacttga

SEQ ID NO: 7368066 - DNA, 22 bp, Homo sapiens
ggaagaaagacatttattttga

SEQ ID NO: 7368067 - DNA, 22 bp, Homo sapiens
ggaagaaagtagaaaaccgtgg

SEQ ID NO: 7368068 - DNA, 20 bp, Homo sapiens
ggaaaaatgcatgctcaaga

SEQ ID NO: 7368069 - DNA, 22 bp, Homo sapiens
ggaaaacaagagaatgatgttt

SEQ ID NO: 7368070 - DNA, 22 bp, Homo sapiens
ggaaaccaggactgcaccgtct

SEQ ID NO: 7368071 - DNA, 22 bp, Homo sapiens
ggaaacagagggcacctgagcc

SEQ ID NO: 7368072 - DNA, 22 bp, Homo sapiens
ggaaacagctctttggggctgt

SEQ ID NO: 7368073 - DNA, 19 bp, Homo sapiens
ggaaacaggggccagagga

SEQ ID NO: 7368074 - DNA, 22 bp, Homo sapiens
ggaaacatattctgatgtgcat

SEQ ID NO: 7368075 - DNA, 20 bp, Homo sapiens
ggaaacatttttatttccat

SEQ ID NO: 7368076 - DNA, 22 bp, Homo sapiens
ggaaagaatcaagtgatcctgt

SEQ ID NO: 7368077 - DNA, 23 bp, Homo sapiens
ggaaagagaggagttgtgcatag

SEQ ID NO: 7368078 - DNA, 22 bp, Homo sapiens
ggaaagagaagttgggaggaat

SEQ ID NO: 7368079 - DNA, 22 bp, Homo sapiens
ggaaagaatagagactttatca

SEQ ID NO: 7368080 - DNA, 21 bp, Homo sapiens
ggaaagaaggcaaggctcagg

SEQ ID NO: 7368081 - DNA, 22 bp, Homo sapiens
ggaaagaggatagtgggtaggt

SEQ ID NO: 7368082 - DNA, 22 bp, Homo sapiens
ggagcggagggagggccactgt

SEQ ID NO: 7368083 - DNA, 22 bp, Homo sapiens
ggagcgagcccgatagcgctgg

SEQ ID NO: 7368084 - DNA, 22 bp, Homo sapiens
ggagctagcctgtctctgttta

SEQ ID NO: 7368085 - DNA, 22 bp, Homo sapiens
ggagcctgtgcccaagcccaga

SEQ ID NO: 7368086 - DNA, 22 bp, Homo sapiens
ggagagggtgtggaaagttatc

SEQ ID NO: 7368087 - DNA, 22 bp, Homo sapiens
ggagaggcttggcccagcctgg

SEQ ID NO: 7368088 - DNA, 22 bp, Homo sapiens
ggagaggggaacttgttgcttg

SEQ ID NO: 7368089 - DNA, 22 bp, Homo sapiens
ggagaggggcaagtttatctag

SEQ ID NO: 7368090 - DNA, 22 bp, Homo sapiens
ggagagggggctccctgcttgg

SEQ ID NO: 7368091 - DNA, 23 bp, Homo sapiens
ggagaggggtgtgggcatcttta

SEQ ID NO: 7368092 - DNA, 22 bp, Homo sapiens
ggagagggtaggggtcctgccc

SEQ ID NO: 7368093 - DNA, 22 bp, Homo sapiens
ggagaagccaggtgataagcaa

SEQ ID NO: 7368094 - DNA, 22 bp, Homo sapiens
ggagaagcaggtgctttgggtc

SEQ ID NO: 7368095 - DNA, 22 bp, Homo sapiens
ggaagtttgggagctggtaatc

SEQ ID NO: 7368096 - DNA, 22 bp, Homo sapiens
ggaagtttgagcatctgtttcc

SEQ ID NO: 7368097 - DNA, 18 bp, Homo sapiens
ggaagtttgggtcccctg

SEQ ID NO: 7368098 - DNA, 22 bp, Homo sapiens
ggaagtttctggtgaggacgag

SEQ ID NO: 7368099 - DNA, 22 bp, Homo sapiens
ggaagtttgtagatgtttctta

SEQ ID NO: 7368100 - DNA, 22 bp, Homo sapiens
ggaagtttgtatactggcctct

SEQ ID NO: 7368101 - DNA, 22 bp, Homo sapiens
ggaataaaaattgtttactgta

SEQ ID NO: 7368102 - DNA, 22 bp, Homo sapiens
ggaaggtttttctcctggtggg

SEQ ID NO: 7368103 - DNA, 22 bp, Homo sapiens
ggaagtttcaggaatctgcatt

SEQ ID NO: 7368104 - DNA, 22 bp, Homo sapiens
ggaagtttattgagttcaagta

SEQ ID NO: 7368105 - DNA, 17 bp, Homo sapiens
ggagacagggtctttaa

SEQ ID NO: 7368106 - DNA, 22 bp, Homo sapiens
ggagaaggaatattggagtagg

SEQ ID NO: 7368107 - DNA, 22 bp, Homo sapiens
ggagaaggaagaaagctactat

SEQ ID NO: 7368108 - DNA, 22 bp, Homo sapiens
ggaggccagggtgggtggatcg

SEQ ID NO: 7368109 - DNA, 22 bp, Homo sapiens
ggaggccatctggctggaggct

SEQ ID NO: 7368110 - DNA, 22 bp, Homo sapiens
ggaggccatcagggagggcatt

SEQ ID NO: 7368111 - DNA, 22 bp, Homo sapiens
ggaggccagtcctggccgggct

SEQ ID NO: 7368112 - DNA, 22 bp, Homo sapiens
ggaggccatagtttgggagtca

SEQ ID NO: 7368113 - DNA, 22 bp, Homo sapiens
ggaggccagaatctgtgttgga

SEQ ID NO: 7368114 - DNA, 22 bp, Homo sapiens
ggaggccaattttctaactgca

SEQ ID NO: 7368115 - DNA, 22 bp, Homo sapiens
ggaggccaagtcactgacctgg

SEQ ID NO: 7368116 - DNA, 22 bp, Homo sapiens
ggaggccaaggtgggcggatca

SEQ ID NO: 7368117 - DNA, 22 bp, Homo sapiens
ggaggcagaatagagtgtgggt

SEQ ID NO: 7368118 - DNA, 22 bp, Homo sapiens
ggaggcagaatagagtgtgggt

SEQ ID NO: 7368119 - DNA, 22 bp, Homo sapiens
ggaggaggcggcagaagttcct

SEQ ID NO: 7368120 - DNA, 22 bp, Homo sapiens
ggagctgaaccccatcgtgctg

SEQ ID NO: 7368121 - DNA, 22 bp, Homo sapiens
ggagctgagacccagtggctga

SEQ ID NO: 7368122 - DNA, 22 bp, Homo sapiens
ggagctgagtgggtttattgat

SEQ ID NO: 7368123 - DNA, 22 bp, Homo sapiens
ggagctgagttcttcagccggg

SEQ ID NO: 7368124 - DNA, 22 bp, Homo sapiens
ggagctgaggaatagctttgat

SEQ ID NO: 7368125 - DNA, 22 bp, Homo sapiens
ggagctgagagtagtccctttt

SEQ ID NO: 7368126 - DNA, 22 bp, Homo sapiens
ggagctgaggacactacatttt

SEQ ID NO: 7368127 - DNA, 22 bp, Homo sapiens
ggagctgcaagtgttgagagct

SEQ ID NO: 7368128 - DNA, 22 bp, Homo sapiens
ggaggagcatgagagggtagtg

SEQ ID NO: 7368129 - DNA, 22 bp, Homo sapiens
ggaggagcccactcaaagggga

SEQ ID NO: 7368130 - DNA, 22 bp, Homo sapiens
ggaggagctgctgtgggggccc

SEQ ID NO: 7368131 - DNA, 22 bp, Homo sapiens
ggaggacaggggctgcagcaca

SEQ ID NO: 7368132 - DNA, 22 bp, Homo sapiens
ggaggaaatccttagtaaggca

SEQ ID NO: 7368133 - DNA, 22 bp, Homo sapiens
ggcagctggggcagtgccctgt

SEQ ID NO: 7368134 - DNA, 23 bp, Homo sapiens
ggcagctgggcagcactcatggg

SEQ ID NO: 7368135 - DNA, 22 bp, Homo sapiens
ggcagctgggtcacaccgatct

SEQ ID NO: 7368136 - DNA, 22 bp, Homo sapiens
ggcagctgggtgcctaataatg

SEQ ID NO: 7368137 - DNA, 22 bp, Homo sapiens
ggcagctgggttggccagaaac

SEQ ID NO: 7368138 - DNA, 22 bp, Homo sapiens
ggcagctgtaagatgagtgaat

SEQ ID NO: 7368139 - DNA, 22 bp, Homo sapiens
ggcagctggttctttccattaa

SEQ ID NO: 7368140 - DNA, 22 bp, Homo sapiens
ggcagctgtctcattcacacct

SEQ ID NO: 7368141 - DNA, 22 bp, Homo sapiens
ggcagctgtctctgagttagca

SEQ ID NO: 7368142 - DNA, 22 bp, Homo sapiens
ggcagctgtgaagtgcctcaca

SEQ ID NO: 7368143 - DNA, 22 bp, Homo sapiens
ggcaggcagatggctgcaccaa

SEQ ID NO: 7368144 - DNA, 22 bp, Homo sapiens
ggcagaggaagctggaagtggg

SEQ ID NO: 7368145 - DNA, 22 bp, Homo sapiens
ggcagaggaagctggaagtggg

SEQ ID NO: 7368146 - DNA, 20 bp, Homo sapiens
ggcagctctagtcgaggccc

SEQ ID NO: 7368147 - DNA, 22 bp, Homo sapiens
ggcagaggaagctggaagtggg

SEQ ID NO: 7368148 - DNA, 22 bp, Homo sapiens
ggcagaggaagctggaagtggg

SEQ ID NO: 7368149 - DNA, 22 bp, Homo sapiens
ggcagctctgctccttggctcc

SEQ ID NO: 7368150 - DNA, 22 bp, Homo sapiens
ggcagctctgctaattgagcct

SEQ ID NO: 7368151 - DNA, 17 bp, Homo sapiens
ggcagctgccacttttt

SEQ ID NO: 7368152 - DNA, 22 bp, Homo sapiens
ggcagctgcacgttgtcccgtc

SEQ ID NO: 7368153 - DNA, 22 bp, Homo sapiens
ggcagctggcctcctcgcccac

SEQ ID NO: 7368154 - DNA, 22 bp, Homo sapiens
ggcagctgctgcattacgttgt

SEQ ID NO: 7368155 - DNA, 19 bp, Homo sapiens
ggcagctggacgctgttca

SEQ ID NO: 7368156 - DNA, 17 bp, Homo sapiens
ggcaggtgcggggccgc

SEQ ID NO: 7368157 - DNA, 17 bp, Homo sapiens
ggcaggtgcggggccgc

SEQ ID NO: 7368158 - DNA, 22 bp, Homo sapiens
ggcaggtgctaagagaggtaaa

SEQ ID NO: 7368159 - DNA, 22 bp, Homo sapiens
ggcaggtgagttcattatctgc

SEQ ID NO: 7368160 - DNA, 22 bp, Homo sapiens
ggcaggctggctttgttccagg

SEQ ID NO: 7368161 - DNA, 22 bp, Homo sapiens
ggcaggctgcttgggtcatgtc

SEQ ID NO: 7368162 - DNA, 22 bp, Homo sapiens
ggcaggcgtggtggcctcagaa

SEQ ID NO: 7368163 - DNA, 18 bp, Homo sapiens
ggcaggctctctgggtca

SEQ ID NO: 7368164 - DNA, 22 bp, Homo sapiens
ggcaggctcttggccttatgag

SEQ ID NO: 7368165 - DNA, 22 bp, Homo sapiens
ggcaggctccgtgttccattcc

SEQ ID NO: 7368166 - DNA, 22 bp, Homo sapiens
ggcaggctccagagccctctcc

SEQ ID NO: 7368167 - DNA, 22 bp, Homo sapiens
ggcaggctcagcagccaaggag

SEQ ID NO: 7368168 - DNA, 22 bp, Homo sapiens
ggagtggtgtcactgagaggaa

SEQ ID NO: 7368169 - DNA, 22 bp, Homo sapiens
ggagttgattttggatatatta

SEQ ID NO: 7368170 - DNA, 22 bp, Homo sapiens
ggagttgattttggatatatta

SEQ ID NO: 7368171 - DNA, 22 bp, Homo sapiens
ggagttccagaccagactggcc

SEQ ID NO: 7368172 - DNA, 22 bp, Homo sapiens
ggagttccagaatctgcttttt

SEQ ID NO: 7368173 - DNA, 22 bp, Homo sapiens
ggagttgattttggatatatta

SEQ ID NO: 7368174 - DNA, 19 bp, Homo sapiens
ggagtgggtagttagtggt

SEQ ID NO: 7368175 - DNA, 22 bp, Homo sapiens
ggagtggcactctgaggcgggg

SEQ ID NO: 7368176 - DNA, 20 bp, Homo sapiens
ggcagacctgctgagagccc

SEQ ID NO: 7368177 - DNA, 21 bp, Homo sapiens
ggcagagaagctggaagttgg

SEQ ID NO: 7368178 - DNA, 22 bp, Homo sapiens
ggcagagaatctggctgtttac

SEQ ID NO: 7368179 - DNA, 22 bp, Homo sapiens
ggcagacctctccagccccaca

SEQ ID NO: 7368180 - DNA, 22 bp, Homo sapiens
ggcagacctctccagccccaca

SEQ ID NO: 7368181 - DNA, 22 bp, Homo sapiens
ggcacagcacagtggacccagg

SEQ ID NO: 7368182 - DNA, 22 bp, Homo sapiens
ggagggcatcaatcaggcctgg

SEQ ID NO: 7368183 - DNA, 20 bp, Homo sapiens
ggagggcagctgagagttgg

SEQ ID NO: 7368184 - DNA, 21 bp, Homo sapiens
ggagggcagcccagactggct

SEQ ID NO: 7368185 - DNA, 22 bp, Homo sapiens
ggagggagcagagaacccaacc

SEQ ID NO: 7368186 - DNA, 22 bp, Homo sapiens
ggagggagcagagaacccaacc

SEQ ID NO: 7368187 - DNA, 22 bp, Homo sapiens
ggagggagagtgaccctaccaa

SEQ ID NO: 7368188 - DNA, 22 bp, Homo sapiens
ggagggagagtgaccctaccaa

SEQ ID NO: 7368189 - DNA, 22 bp, Homo sapiens
ggagggagagtgaccctaccaa

SEQ ID NO: 7368190 - DNA, 22 bp, Homo sapiens
ggaggcctcctgggggaggttc

SEQ ID NO: 7368191 - DNA, 22 bp, Homo sapiens
ggaggcccagagaggtgaagtg

SEQ ID NO: 7368192 - DNA, 22 bp, Homo sapiens
ggaggcccagaaggaagcccag

SEQ ID NO: 7368193 - DNA, 22 bp, Homo sapiens
ggaggcctagccagctccagtt

SEQ ID NO: 7368194 - DNA, 22 bp, Homo sapiens
ggaggtggtggcagtgacaatt

SEQ ID NO: 7368195 - DNA, 22 bp, Homo sapiens
ggagtaggccccgggagagagt

SEQ ID NO: 7368196 - DNA, 22 bp, Homo sapiens
ggaggtgggctaaggactctct

SEQ ID NO: 7368197 - DNA, 22 bp, Homo sapiens
ggaggtcccaggcctggcagca

SEQ ID NO: 7368198 - DNA, 22 bp, Homo sapiens
ggaggtatttgtcaatctgttt

SEQ ID NO: 7368199 - DNA, 22 bp, Homo sapiens
taaaactagaccgtgagtctaa

SEQ ID NO: 7368200 - DNA, 22 bp, Homo sapiens
taaagctctgggtttctagatc

SEQ ID NO: 7368201 - DNA, 22 bp, Homo sapiens
taaagctgcaggctcagaaaac

SEQ ID NO: 7368202 - DNA, 22 bp, Homo sapiens
taaaggaacagaggactcattt

SEQ ID NO: 7368203 - DNA, 22 bp, Homo sapiens
taaagcttgtattgcaatattt

SEQ ID NO: 7368204 - DNA, 22 bp, Homo sapiens
taaaggaatcagttttagagat

SEQ ID NO: 7368205 - DNA, 18 bp, Homo sapiens
taaaggaagtgggagagg

SEQ ID NO: 7368206 - DNA, 22 bp, Homo sapiens
taaaggaactgctgctatggaa

SEQ ID NO: 7368207 - DNA, 19 bp, Homo sapiens
taaaggaagaagggaggat

SEQ ID NO: 7368208 - DNA, 19 bp, Homo sapiens
taaaggaagaggaagggaa

SEQ ID NO: 7368209 - DNA, 22 bp, Homo sapiens
taaaggaagaattctctgtgat

SEQ ID NO: 7368210 - DNA, 22 bp, Homo sapiens
taaaggcaaactctccaaggat

SEQ ID NO: 7368211 - DNA, 22 bp, Homo sapiens
taaaggcactgcgtccctcaaa

SEQ ID NO: 7368212 - DNA, 22 bp, Homo sapiens
taaaggcacggagttgttatgg

SEQ ID NO: 7368213 - DNA, 22 bp, Homo sapiens
taaaggcaaatgtgtgtttgtg

SEQ ID NO: 7368214 - DNA, 22 bp, Homo sapiens
taaaggcaattcagcaagccac

SEQ ID NO: 7368215 - DNA, 22 bp, Homo sapiens
taaaggccagggcctgagtgct

SEQ ID NO: 7368216 - DNA, 22 bp, Homo sapiens
taaaggccatgatggaggatca

SEQ ID NO: 7368217 - DNA, 22 bp, Homo sapiens
taaaggcctagtaagttgagac

SEQ ID NO: 7368218 - DNA, 22 bp, Homo sapiens
taaaggcagttggagttgagga

SEQ ID NO: 7368219 - DNA, 22 bp, Homo sapiens
taaaggcatgcaggtgaatgta

SEQ ID NO: 7368220 - DNA, 22 bp, Homo sapiens
taaaggcagcctaggaagtgtt

SEQ ID NO: 7368221 - DNA, 22 bp, Homo sapiens
taaaggcagccactgagctcaa

SEQ ID NO: 7368222 - DNA, 22 bp, Homo sapiens
taaaggcagtaattcctgagtt

SEQ ID NO: 7368223 - DNA, 22 bp, Homo sapiens
taaaggcagttctgattaggtc

SEQ ID NO: 7368224 - DNA, 22 bp, Homo sapiens
taaaacacctgtagtgtctgcc

SEQ ID NO: 7368225 - DNA, 22 bp, Homo sapiens
taaaaaacattactctgtcctg

SEQ ID NO: 7368226 - DNA, 22 bp, Homo sapiens
taaaacacataaactctctatt

SEQ ID NO: 7368227 - DNA, 22 bp, Homo sapiens
gttttttgggtgtatatcttct

SEQ ID NO: 7368228 - DNA, 22 bp, Homo sapiens
gtttaaataattaggggcctgt

SEQ ID NO: 7368229 - DNA, 22 bp, Homo sapiens
gtttaactgggagtgtgggaaa

SEQ ID NO: 7368230 - DNA, 22 bp, Homo sapiens
taaatcagggagtcatctgcga

SEQ ID NO: 7368231 - DNA, 22 bp, Homo sapiens
taaatcactcctaataatcagt

SEQ ID NO: 7368232 - DNA, 22 bp, Homo sapiens
taaatcactgtactttattcct

SEQ ID NO: 7368233 - DNA, 22 bp, Homo sapiens
taaatctttaggaagctcaaac

SEQ ID NO: 7368234 - DNA, 22 bp, Homo sapiens
taaatcttgtggcaatgcttct

SEQ ID NO: 7368235 - DNA, 22 bp, Homo sapiens
taaatcttctacatcatcataa

SEQ ID NO: 7368236 - DNA, 22 bp, Homo sapiens
taaatcttctacatcatcataa

SEQ ID NO: 7368237 - DNA, 22 bp, Homo sapiens
taaatgaagaaatggagattgt

SEQ ID NO: 7368238 - DNA, 22 bp, Homo sapiens
taacactggcttttgctgaggc

SEQ ID NO: 7368239 - DNA, 22 bp, Homo sapiens
taacactggagagttggttgtg

SEQ ID NO: 7368240 - DNA, 22 bp, Homo sapiens
taacactggttatccctgtgca

SEQ ID NO: 7368241 - DNA, 22 bp, Homo sapiens
taacactggtatttcatttagt

SEQ ID NO: 7368242 - DNA, 22 bp, Homo sapiens
taacactggtatttcatttagt

SEQ ID NO: 7368243 - DNA, 22 bp, Homo sapiens
taacactgcttcattttggaga

SEQ ID NO: 7368244 - DNA, 22 bp, Homo sapiens
taacactggagagttggttgtg

SEQ ID NO: 7368245 - DNA, 22 bp, Homo sapiens
taacactgccatgctggagtca

SEQ ID NO: 7368246 - DNA, 22 bp, Homo sapiens
taacactgatttgttctcaggg

SEQ ID NO: 7368247 - DNA, 22 bp, Homo sapiens
taacactgaaaatgatgcatgt

SEQ ID NO: 7368248 - DNA, 22 bp, Homo sapiens
taacactgaaaatgatgcatgt

SEQ ID NO: 7368249 - DNA, 22 bp, Homo sapiens
taaatgagggctgacatgattg

SEQ ID NO: 7368250 - DNA, 22 bp, Homo sapiens
taacactgtggtgttctttgtc

SEQ ID NO: 7368251 - DNA, 22 bp, Homo sapiens
taacactgtgcccagagtccca

SEQ ID NO: 7368252 - DNA, 22 bp, Homo sapiens
taacactgtccaaagaattcca

SEQ ID NO: 7368253 - DNA, 22 bp, Homo sapiens
taacactgtaaacctagatgtt

SEQ ID NO: 7368254 - DNA, 22 bp, Homo sapiens
taacagaatagcagaaacagaa

SEQ ID NO: 7368255 - DNA, 22 bp, Homo sapiens
taacactgtgtctgccatatcc

SEQ ID NO: 7368256 - DNA, 22 bp, Homo sapiens
taacactgtggtgttctttgtc

SEQ ID NO: 7368257 - DNA, 20 bp, Homo sapiens
taagaacaagactaggaagc

SEQ ID NO: 7368258 - DNA, 22 bp, Homo sapiens
taagaaatttagttatagaatg

SEQ ID NO: 7368259 - DNA, 22 bp, Homo sapiens
gtgggcagcaccagggaagtgt

SEQ ID NO: 7368260 - DNA, 22 bp, Homo sapiens
gtgggcagccccttcaaggcca

SEQ ID NO: 7368261 - DNA, 22 bp, Homo sapiens
gtgggcagacatgatagaagga

SEQ ID NO: 7368262 - DNA, 22 bp, Homo sapiens
gtgggcagaggagagaacatta

SEQ ID NO: 7368263 - DNA, 22 bp, Homo sapiens
gtgggcagttggtgattctcgt

SEQ ID NO: 7368264 - DNA, 22 bp, Homo sapiens
gtgggcagcctgtccggagacc

SEQ ID NO: 7368265 - DNA, 22 bp, Homo sapiens
gtgggcagcctgtccggagacc

SEQ ID NO: 7368266 - DNA, 22 bp, Homo sapiens
gtgggccttgcagggtgcaggg

SEQ ID NO: 7368267 - DNA, 22 bp, Homo sapiens
gtgggctggaccctcctgctcc

SEQ ID NO: 7368268 - DNA, 22 bp, Homo sapiens
gtggggctggaagatgggtact

SEQ ID NO: 7368269 - DNA, 22 bp, Homo sapiens
gtggggaggcctaagcaagttg

SEQ ID NO: 7368270 - DNA, 22 bp, Homo sapiens
gtgggggctggaaatcttgcca

SEQ ID NO: 7368271 - DNA, 22 bp, Homo sapiens
gtgggggcagtgggcttcgagc

SEQ ID NO: 7368272 - DNA, 22 bp, Homo sapiens
gtgggggctggaaatcttgcca

SEQ ID NO: 7368273 - DNA, 22 bp, Homo sapiens
gtgggggcaggcagtgctagga

SEQ ID NO: 7368274 - DNA, 21 bp, Homo sapiens
gtggttctagagaaacagaat

SEQ ID NO: 7368275 - DNA, 22 bp, Homo sapiens
gtgtaagtggaatcatatagta

SEQ ID NO: 7368276 - DNA, 17 bp, Homo sapiens
gtgtacaagcagaaggc

SEQ ID NO: 7368277 - DNA, 22 bp, Homo sapiens
gtggtcaggcagtgggagagaa

SEQ ID NO: 7368278 - DNA, 22 bp, Homo sapiens
gtggtcagccccggtgagccct

SEQ ID NO: 7368279 - DNA, 22 bp, Homo sapiens
gtggtcagttaaggttgaaacg

SEQ ID NO: 7368280 - DNA, 22 bp, Homo sapiens
gtggtcagttaggcaatcatgt

SEQ ID NO: 7368281 - DNA, 22 bp, Homo sapiens
gtggtcagcagcagtgggagtg

SEQ ID NO: 7368282 - DNA, 22 bp, Homo sapiens
gtggtcagaatggagcccagga

SEQ ID NO: 7368283 - DNA, 22 bp, Homo sapiens
gtggtcaaagcatcagagacct

SEQ ID NO: 7368284 - DNA, 22 bp, Homo sapiens
gtgggtgctgtcaggcagggaa

SEQ ID NO: 7368285 - DNA, 22 bp, Homo sapiens
gtgggtgcggggagccgaggcg

SEQ ID NO: 7368286 - DNA, 18 bp, Homo sapiens
gtggggtgttgtgaggat

SEQ ID NO: 7368287 - DNA, 22 bp, Homo sapiens
gtgggggctggctcgtcctgtg

SEQ ID NO: 7368288 - DNA, 22 bp, Homo sapiens
gtgggggctggctcgtcctgtg

SEQ ID NO: 7368289 - DNA, 22 bp, Homo sapiens
gtgggggtggaaaggcaagttg

SEQ ID NO: 7368290 - DNA, 22 bp, Homo sapiens
gtgtgcaagggcatgtacattg

SEQ ID NO: 7368291 - DNA, 22 bp, Homo sapiens
gtgtgcagggggccagcgcagc

SEQ ID NO: 7368292 - DNA, 22 bp, Homo sapiens
gtgtggggaggagagagccctt

SEQ ID NO: 7368293 - DNA, 22 bp, Homo sapiens
gtgtgtagatgtgagaggactg

SEQ ID NO: 7368294 - DNA, 22 bp, Homo sapiens
gtgtggtcgaagttctcccgga

SEQ ID NO: 7368295 - DNA, 22 bp, Homo sapiens
gtgtcgtgcttgccatgggtac

SEQ ID NO: 7368296 - DNA, 22 bp, Homo sapiens
gtgtccttgcagtttgaagaaa

SEQ ID NO: 7368297 - DNA, 22 bp, Homo sapiens
gtgtcctgcaggccaggaatgg

SEQ ID NO: 7368298 - DNA, 22 bp, Homo sapiens
gtgtcctcttattgctcttggc

SEQ ID NO: 7368299 - DNA, 22 bp, Homo sapiens
gtgtcctcttattgctcttggc

SEQ ID NO: 7368300 - DNA, 22 bp, Homo sapiens
gttgtttataaaaatatctagc

SEQ ID NO: 7368301 - DNA, 22 bp, Homo sapiens
gttctcagggataacttccccc

SEQ ID NO: 7368302 - DNA, 22 bp, Homo sapiens
gttctccttgtggctgcagcag

SEQ ID NO: 7368303 - DNA, 22 bp, Homo sapiens
gttctctctgcttccaagatgg

SEQ ID NO: 7368304 - DNA, 22 bp, Homo sapiens
gttctgagtcctcctttgaagg

SEQ ID NO: 7368305 - DNA, 22 bp, Homo sapiens
gttctgaatgtgcctgtactct

SEQ ID NO: 7368306 - DNA, 22 bp, Homo sapiens
gttctaagggcttgaaatgtat

SEQ ID NO: 7368307 - DNA, 22 bp, Homo sapiens
gttcaagaccagcctggccaac

SEQ ID NO: 7368308 - DNA, 22 bp, Homo sapiens
gttattttatctctgagaggtt

SEQ ID NO: 7368309 - DNA, 22 bp, Homo sapiens
gttattttcattggctcagact

SEQ ID NO: 7368310 - DNA, 22 bp, Homo sapiens
gttattttcattggctcagact

SEQ ID NO: 7368311 - DNA, 21 bp, Homo sapiens
gttattttaagtgagctttgc

SEQ ID NO: 7368312 - DNA, 22 bp, Homo sapiens
gttattttaacttctcagtaat

SEQ ID NO: 7368313 - DNA, 22 bp, Homo sapiens
gttattttaacttctcagtaat

SEQ ID NO: 7368314 - DNA, 22 bp, Homo sapiens
gtggaggaagggattcagacca

SEQ ID NO: 7368315 - DNA, 22 bp, Homo sapiens
gtggaggagaggcgccttgcgg

SEQ ID NO: 7368316 - DNA, 22 bp, Homo sapiens
gtggcaagatgactactcactg

SEQ ID NO: 7368317 - DNA, 22 bp, Homo sapiens
gtggcagccgcaggccctgtgt

SEQ ID NO: 7368318 - DNA, 22 bp, Homo sapiens
gtggcagctacatttaatgcaa

SEQ ID NO: 7368319 - DNA, 22 bp, Homo sapiens
gtggcagctcatgttgttttaa

SEQ ID NO: 7368320 - DNA, 22 bp, Homo sapiens
gtggcagcaaaatcctgcattc

SEQ ID NO: 7368321 - DNA, 19 bp, Homo sapiens
gtggcagcagatttggtgt

SEQ ID NO: 7368322 - DNA, 22 bp, Homo sapiens
gtggcagagggtgagctggact

SEQ ID NO: 7368323 - DNA, 22 bp, Homo sapiens
gtggcagagttgctgactagaa

SEQ ID NO: 7368324 - DNA, 22 bp, Homo sapiens
gtggaagaggcaagatagctct

SEQ ID NO: 7368325 - DNA, 22 bp, Homo sapiens
gtggaaaagaaagtcttccttg

SEQ ID NO: 7368326 - DNA, 22 bp, Homo sapiens
gtgcctttgtgtctaaaacagc

SEQ ID NO: 7368327 - DNA, 22 bp, Homo sapiens
gtgccttttcttcatagttact

SEQ ID NO: 7368328 - DNA, 22 bp, Homo sapiens
gtgcctttgagaagtttctctg

SEQ ID NO: 7368329 - DNA, 23 bp, Homo sapiens
gtgcgccaggacaacctgacgga

SEQ ID NO: 7368330 - DNA, 22 bp, Homo sapiens
gtgacagaaacagggctagaat

SEQ ID NO: 7368331 - DNA, 22 bp, Homo sapiens
gtgacaatattagctcaggggc

SEQ ID NO: 7368332 - DNA, 22 bp, Homo sapiens
gtgacaaggaaagacagactgt

SEQ ID NO: 7368333 - DNA, 22 bp, Homo sapiens
gtgacattttttaagcccttgt

SEQ ID NO: 7368334 - DNA, 22 bp, Homo sapiens
gtgacatttacgaatcttatcc

SEQ ID NO: 7368335 - DNA, 22 bp, Homo sapiens
gtgacattcaggatatcaatgg

SEQ ID NO: 7368336 - DNA, 22 bp, Homo sapiens
gtgacattgctaggaacagatt

SEQ ID NO: 7368337 - DNA, 22 bp, Homo sapiens
gtgacagtcaaagacatgactt

SEQ ID NO: 7368338 - DNA, 22 bp, Homo sapiens
gtggctcagcggagctctgcac

SEQ ID NO: 7368339 - DNA, 22 bp, Homo sapiens
gtggcctggcgagctggcgcgg

SEQ ID NO: 7368340 - DNA, 22 bp, Homo sapiens
gtggcctggcgagctggcgcgg

SEQ ID NO: 7368341 - DNA, 19 bp, Homo sapiens
gtggctcatgtagtgggcc

SEQ ID NO: 7368342 - DNA, 22 bp, Homo sapiens
gtggctcatctttgggaagtaa

SEQ ID NO: 7368343 - DNA, 22 bp, Homo sapiens
gtggctcagttaacttccatgt

SEQ ID NO: 7368344 - DNA, 22 bp, Homo sapiens
gtggcctctgttggctcctagg

SEQ ID NO: 7368345 - DNA, 22 bp, Homo sapiens
gtggcctctgtgctcctgccta

SEQ ID NO: 7368346 - DNA, 20 bp, Homo sapiens
gtggcctctcacattctgag

SEQ ID NO: 7368347 - DNA, 22 bp, Homo sapiens
gtgggagctgctacctccttcc

SEQ ID NO: 7368348 - DNA, 22 bp, Homo sapiens
gtgggagcttcatcaagcagtt

SEQ ID NO: 7368349 - DNA, 22 bp, Homo sapiens
gtgggagctgcggaggcctggg

SEQ ID NO: 7368350 - DNA, 22 bp, Homo sapiens
gtgggagctgcggaggcctggg

SEQ ID NO: 7368351 - DNA, 22 bp, Homo sapiens
gtgggagaaattagctctagtt

SEQ ID NO: 7368352 - DNA, 22 bp, Homo sapiens
gtgggagaaattagctctagtt

SEQ ID NO: 7368353 - DNA, 22 bp, Homo sapiens
gtgggagccctcagggaggtgc

SEQ ID NO: 7368354 - DNA, 22 bp, Homo sapiens
gtgggagccctcagggaggtgc

SEQ ID NO: 7368355 - DNA, 22 bp, Homo sapiens
gtgggagcatggtcccagtgcc

SEQ ID NO: 7368356 - DNA, 22 bp, Homo sapiens
gtggcccaggttggagtgcagt

SEQ ID NO: 7368357 - DNA, 22 bp, Homo sapiens
gtggcccatcacgtttcgcctt

SEQ ID NO: 7368358 - DNA, 22 bp, Homo sapiens
gtggcccaggctggagtgcagt

SEQ ID NO: 7368359 - DNA, 22 bp, Homo sapiens
gtggcccaggcttggcgctggc

SEQ ID NO: 7368360 - DNA, 22 bp, Homo sapiens
gtggcccaggcaccctgatgac

SEQ ID NO: 7368361 - DNA, 22 bp, Homo sapiens
gtggcccacttacgtcatgtgt

SEQ ID NO: 7368362 - DNA, 22 bp, Homo sapiens
gtggcccagccctacagaggac

SEQ ID NO: 7368363 - DNA, 22 bp, Homo sapiens
gtggcattaggccaggtgcata

SEQ ID NO: 7368364 - DNA, 22 bp, Homo sapiens
gtggcattctcggcaccatctg

SEQ ID NO: 7368365 - DNA, 22 bp, Homo sapiens
gtggcagctgtgttgcagtttt

SEQ ID NO: 7368366 - DNA, 22 bp, Homo sapiens
gtcaggcagtggaaattaaaaa

SEQ ID NO: 7368367 - DNA, 18 bp, Homo sapiens
gtcaggcatgaatctggg

SEQ ID NO: 7368368 - DNA, 22 bp, Homo sapiens
gtcaggccctggcagccgtgac

SEQ ID NO: 7368369 - DNA, 21 bp, Homo sapiens
gtcaggcccatagcagtgcct

SEQ ID NO: 7368370 - DNA, 22 bp, Homo sapiens
gtcaggccaatactctccagca

SEQ ID NO: 7368371 - DNA, 22 bp, Homo sapiens
gtcaggccaatactctccagca

SEQ ID NO: 7368372 - DNA, 21 bp, Homo sapiens
gtcaggcccatagcagtgcct

SEQ ID NO: 7368373 - DNA, 22 bp, Homo sapiens
gtcaggagagatcaggacagca

SEQ ID NO: 7368374 - DNA, 22 bp, Homo sapiens
gtcagctgcagtgggcacagcc

SEQ ID NO: 7368375 - DNA, 22 bp, Homo sapiens
gtcagctgcacaggtgggagct

SEQ ID NO: 7368376 - DNA, 22 bp, Homo sapiens
gtcagaggggcagctgccaggc

SEQ ID NO: 7368377 - DNA, 21 bp, Homo sapiens
gtcagctgtgtgtgaggaccc

SEQ ID NO: 7368378 - DNA, 22 bp, Homo sapiens
gtatgtcaaaatctgcatgata

SEQ ID NO: 7368379 - DNA, 22 bp, Homo sapiens
gtattacatttagtaattaggc

SEQ ID NO: 7368380 - DNA, 22 bp, Homo sapiens
gtcccagaaacatattgctggt

SEQ ID NO: 7368381 - DNA, 22 bp, Homo sapiens
gtccagggggcttaagcaaact

SEQ ID NO: 7368382 - DNA, 22 bp, Homo sapiens
gtccagtgtcttctacataaca

SEQ ID NO: 7368383 - DNA, 22 bp, Homo sapiens
gtcccataagtagtgcaacttg

SEQ ID NO: 7368384 - DNA, 22 bp, Homo sapiens
gtcctgttggggtgttgcagtc

SEQ ID NO: 7368385 - DNA, 22 bp, Homo sapiens
gtcctgtgtaagtacttgctca

SEQ ID NO: 7368386 - DNA, 22 bp, Homo sapiens
gtccttccccagccagctctgg

SEQ ID NO: 7368387 - DNA, 22 bp, Homo sapiens
gtcctttcttaaattcctgctt

SEQ ID NO: 7368388 - DNA, 22 bp, Homo sapiens
gtccttggaggtgtggaatctg

SEQ ID NO: 7368389 - DNA, 18 bp, Homo sapiens
gtctgccaacaactatca

SEQ ID NO: 7368390 - DNA, 22 bp, Homo sapiens
gtctgccagcaccataaattag

SEQ ID NO: 7368391 - DNA, 22 bp, Homo sapiens
gtctgccatgtggagaaagcca

SEQ ID NO: 7368392 - DNA, 22 bp, Homo sapiens
gtctgcacggggaggatgggct

SEQ ID NO: 7368393 - DNA, 22 bp, Homo sapiens
gtctgcacgtgccagggagggg

SEQ ID NO: 7368394 - DNA, 22 bp, Homo sapiens
gtctgcaaagattggaagccac

SEQ ID NO: 7368395 - DNA, 22 bp, Homo sapiens
ggtggcagcatggtcccagtgt

SEQ ID NO: 7368396 - DNA, 22 bp, Homo sapiens
ggtgcaggagcggggtgctcgg

SEQ ID NO: 7368397 - DNA, 22 bp, Homo sapiens
ggtgagtttcatggttgtttac

SEQ ID NO: 7368398 - DNA, 22 bp, Homo sapiens
gggtgggcctgtctggccatgt

SEQ ID NO: 7368399 - DNA, 22 bp, Homo sapiens
ggtgtagaaaagggaagggttt

SEQ ID NO: 7368400 - DNA, 22 bp, Homo sapiens
ggtgtagataatgatgctctcc

SEQ ID NO: 7368401 - DNA, 22 bp, Homo sapiens
gtacacaaataataaagttaca

SEQ ID NO: 7368402 - DNA, 22 bp, Homo sapiens
gtaaataactggtaattggggt

SEQ ID NO: 7368403 - DNA, 22 bp, Homo sapiens
gtacacaaagtgagacttgata

SEQ ID NO: 7368404 - DNA, 18 bp, Homo sapiens
gtacacaaagtcaaagta

SEQ ID NO: 7368405 - DNA, 22 bp, Homo sapiens
gtaaagctccttggccagtgcc

SEQ ID NO: 7368406 - DNA, 22 bp, Homo sapiens
gtaaagctctcatttaatatca

SEQ ID NO: 7368407 - DNA, 22 bp, Homo sapiens
gtaaagctggagaggtctttta

SEQ ID NO: 7368408 - DNA, 22 bp, Homo sapiens
gtaaagctgtttctccaccgtc

SEQ ID NO: 7368409 - DNA, 22 bp, Homo sapiens
gtaaagtttctcagtgatgttc

SEQ ID NO: 7368410 - DNA, 22 bp, Homo sapiens
gtaaagttctactagaatcaac

SEQ ID NO: 7368411 - DNA, 22 bp, Homo sapiens
gtaaagttctatttgaatttag

SEQ ID NO: 7368412 - DNA, 23 bp, Homo sapiens
gtaaaatacgcagtgcagtgtga

SEQ ID NO: 7368413 - DNA, 22 bp, Homo sapiens
gtacattctgtggacttggaca

SEQ ID NO: 7368414 - DNA, 22 bp, Homo sapiens
gtacatttaggattcattgaaa

SEQ ID NO: 7368415 - DNA, 22 bp, Homo sapiens
gtacatttactgatgaaaagta

SEQ ID NO: 7368416 - DNA, 22 bp, Homo sapiens
gtacatattataaaatacagct

SEQ ID NO: 7368417 - DNA, 22 bp, Homo sapiens
gtacatctttaaattgttcagt

SEQ ID NO: 7368418 - DNA, 18 bp, Homo sapiens
gtatggtatggaagcatg

SEQ ID NO: 7368419 - DNA, 22 bp, Homo sapiens
gtatatatgtgtgaacatgtat

SEQ ID NO: 7368420 - DNA, 22 bp, Homo sapiens
gtatatatgtgtgaacatgtat

SEQ ID NO: 7368421 - DNA, 22 bp, Homo sapiens
gtatatatgtgtgaacatgtat

SEQ ID NO: 7368422 - DNA, 22 bp, Homo sapiens
gtatatatgtgtgaacatgtat

SEQ ID NO: 7368423 - DNA, 22 bp, Homo sapiens
gtatatatcggcactattttaa

SEQ ID NO: 7368424 - DNA, 22 bp, Homo sapiens
gtatatatcggcactattttaa

SEQ ID NO: 7368425 - DNA, 22 bp, Homo sapiens
gtatacttgcagacatttatat

SEQ ID NO: 7368426 - DNA, 22 bp, Homo sapiens
tctgcaatgttttcccatcctg

SEQ ID NO: 7368427 - DNA, 22 bp, Homo sapiens
tctgcacaccgccaggctgact

SEQ ID NO: 7368428 - DNA, 22 bp, Homo sapiens
tctgcacccacgtaccttggct

SEQ ID NO: 7368429 - DNA, 22 bp, Homo sapiens
tctgcacataggtaggctggaa

SEQ ID NO: 7368430 - DNA, 21 bp, Homo sapiens
tctgcacagccccgcaggagg

SEQ ID NO: 7368431 - DNA, 22 bp, Homo sapiens
tctgcacaggagggccgtggtg

SEQ ID NO: 7368432 - DNA, 18 bp, Homo sapiens
tctgcactcctgagagag

SEQ ID NO: 7368433 - DNA, 20 bp, Homo sapiens
tctgcactcctgcatgtgcc

SEQ ID NO: 7368434 - DNA, 22 bp, Homo sapiens
tctgcagaaactgtgactatgt

SEQ ID NO: 7368435 - DNA, 22 bp, Homo sapiens
tctgcaccccgcagggtcaggt

SEQ ID NO: 7368436 - DNA, 22 bp, Homo sapiens
tctgcaccctgtggtcctctag

SEQ ID NO: 7368437 - DNA, 22 bp, Homo sapiens
tctgcacccttctgggttggaa

SEQ ID NO: 7368438 - DNA, 22 bp, Homo sapiens
tctgcagaactttatgagcaaa

SEQ ID NO: 7368439 - DNA, 22 bp, Homo sapiens
tctgcagatttatcagcagctg

SEQ ID NO: 7368440 - DNA, 22 bp, Homo sapiens
tctgcagcacttaatgtttcgt

SEQ ID NO: 7368441 - DNA, 22 bp, Homo sapiens
tctgcaggaaaaaagtgcctgg

SEQ ID NO: 7368442 - DNA, 18 bp, Homo sapiens
tctgcaggacctcagggc

SEQ ID NO: 7368443 - DNA, 18 bp, Homo sapiens
tctgcaggacctcagggc

SEQ ID NO: 7368444 - DNA, 22 bp, Homo sapiens
tctgcaggagagtgccctagag

SEQ ID NO: 7368445 - DNA, 22 bp, Homo sapiens
tctgcaggactgaggcctgttt

SEQ ID NO: 7368446 - DNA, 22 bp, Homo sapiens
tctgcaggactgaggcctgttt

SEQ ID NO: 7368447 - DNA, 22 bp, Homo sapiens
tctgcaggagcagggcgtggag

SEQ ID NO: 7368448 - DNA, 22 bp, Homo sapiens
tctgcaggatcagagccagagg

SEQ ID NO: 7368449 - DNA, 22 bp, Homo sapiens
tctgcaggatgcaaagtgtaca

SEQ ID NO: 7368450 - DNA, 22 bp, Homo sapiens
tctgcaggcctcgacaaggcca

SEQ ID NO: 7368451 - DNA, 22 bp, Homo sapiens
tctgcaggcttggagtggcagc

SEQ ID NO: 7368452 - DNA, 22 bp, Homo sapiens
tctgcaggctgtacaggaagca

SEQ ID NO: 7368453 - DNA, 22 bp, Homo sapiens
tctgcaggctctagatgaggtt

SEQ ID NO: 7368454 - DNA, 22 bp, Homo sapiens
tctgcaggcttataggatgggt

SEQ ID NO: 7368455 - DNA, 17 bp, Homo sapiens
tctgcagggggccgtgt

SEQ ID NO: 7368456 - DNA, 22 bp, Homo sapiens
tctgcagggatgtgaggggtga

SEQ ID NO: 7368457 - DNA, 22 bp, Homo sapiens
tctgcagggcccttggctcctg

SEQ ID NO: 7368458 - DNA, 22 bp, Homo sapiens
tctgcagggtcccagcctcagc

SEQ ID NO: 7368459 - DNA, 22 bp, Homo sapiens
tctgcaggtagagctcaggaat

SEQ ID NO: 7368460 - DNA, 22 bp, Homo sapiens
tctgcaggtgggcccctagaat

SEQ ID NO: 7368461 - DNA, 22 bp, Homo sapiens
tctgcaggtcacgctccagcct

SEQ ID NO: 7368462 - DNA, 22 bp, Homo sapiens
tctgcaggtgttggaagggtca

SEQ ID NO: 7368463 - DNA, 22 bp, Homo sapiens
tctgcccaaggctgtcactaga

SEQ ID NO: 7368464 - DNA, 23 bp, Homo sapiens
tctgccagtgtgtgccaggagcc

SEQ ID NO: 7368465 - DNA, 23 bp, Homo sapiens
tctgccagttccttgatcatgga

SEQ ID NO: 7368466 - DNA, 22 bp, Homo sapiens
tctgccaggggcacttgcggct

SEQ ID NO: 7368467 - DNA, 16 bp, Homo sapiens
tctgccagggacaggc

SEQ ID NO: 7368468 - DNA, 22 bp, Homo sapiens
tctgccaggcctgcttccgggg

SEQ ID NO: 7368469 - DNA, 22 bp, Homo sapiens
tctgccaggcttggtgctagat

SEQ ID NO: 7368470 - DNA, 22 bp, Homo sapiens
tctgccagtgccagagtacata

SEQ ID NO: 7368471 - DNA, 22 bp, Homo sapiens
tctgccagtgagcggggaatta

SEQ ID NO: 7368472 - DNA, 22 bp, Homo sapiens
tctgccagtggtttggccctga

SEQ ID NO: 7368473 - DNA, 21 bp, Homo sapiens
tctgccaggttagattgacta

SEQ ID NO: 7368474 - DNA, 22 bp, Homo sapiens
tctgccaggtggggagaggcca

SEQ ID NO: 7368475 - DNA, 20 bp, Homo sapiens
tctgctcagccctcagtggc

SEQ ID NO: 7368476 - DNA, 22 bp, Homo sapiens
tctgctcactattacatggaca

SEQ ID NO: 7368477 - DNA, 22 bp, Homo sapiens
tctgccttgaggtcctcagctc

SEQ ID NO: 7368478 - DNA, 22 bp, Homo sapiens
tctgccttgatggcattgagaa

SEQ ID NO: 7368479 - DNA, 22 bp, Homo sapiens
tctgccttcgctgctccctgaa

SEQ ID NO: 7368480 - DNA, 22 bp, Homo sapiens
tctgccttctatcttttgtctg

SEQ ID NO: 7368481 - DNA, 22 bp, Homo sapiens
tctgccttcttttagtcatctt

SEQ ID NO: 7368482 - DNA, 20 bp, Homo sapiens
tctgccttagggggagcctc

SEQ ID NO: 7368483 - DNA, 22 bp, Homo sapiens
tctgccttagcaattgtcaagg

SEQ ID NO: 7368484 - DNA, 22 bp, Homo sapiens
tctgccttagcaattgtcaagg

SEQ ID NO: 7368485 - DNA, 20 bp, Homo sapiens
tctgccttatgaccttcgcc

SEQ ID NO: 7368486 - DNA, 22 bp, Homo sapiens
tctgccttccccataatctgat

SEQ ID NO: 7368487 - DNA, 22 bp, Homo sapiens
tctgcctgcttcttcatagtct

SEQ ID NO: 7368488 - DNA, 18 bp, Homo sapiens
tctgccctgccattcact

SEQ ID NO: 7368489 - DNA, 22 bp, Homo sapiens
tctgccctcagggtaatgatca

SEQ ID NO: 7368490 - DNA, 22 bp, Homo sapiens
tctgccctcattgctgcctgga

SEQ ID NO: 7368491 - DNA, 22 bp, Homo sapiens
tctgcccaggacacctgccact

SEQ ID NO: 7368492 - DNA, 22 bp, Homo sapiens
tctgagacaacttagccctcga

SEQ ID NO: 7368493 - DNA, 22 bp, Homo sapiens
tctgagactttaacctggggcc

SEQ ID NO: 7368494 - DNA, 22 bp, Homo sapiens
tctgagacttctgaagctagaa

SEQ ID NO: 7368495 - DNA, 22 bp, Homo sapiens
tctgagcagatgctcgctctcc

SEQ ID NO: 7368496 - DNA, 22 bp, Homo sapiens
tctgagccagggtctcctccct

SEQ ID NO: 7368497 - DNA, 22 bp, Homo sapiens
tctgagccagccacctccttca

SEQ ID NO: 7368498 - DNA, 22 bp, Homo sapiens
tctgagccacctgagcccatgg

SEQ ID NO: 7368499 - DNA, 22 bp, Homo sapiens
tctgagccacctgagcccatgg

SEQ ID NO: 7368500 - DNA, 22 bp, Homo sapiens
tctgagctgtaagtagacaagg

SEQ ID NO: 7368501 - DNA, 21 bp, Homo sapiens
tctgagctgagtcctctaggt

SEQ ID NO: 7368502 - DNA, 22 bp, Homo sapiens
tctgagccctcttttgcagccc

SEQ ID NO: 7368503 - DNA, 22 bp, Homo sapiens
tctgagccctgctgtttattga

SEQ ID NO: 7368504 - DNA, 22 bp, Homo sapiens
tctgacattttgagaatgacat

SEQ ID NO: 7368505 - DNA, 22 bp, Homo sapiens
tctgaggctgtctctgggctcc

SEQ ID NO: 7368506 - DNA, 20 bp, Homo sapiens
tctgaggctgagcccagcgt

SEQ ID NO: 7368507 - DNA, 22 bp, Homo sapiens
tctgaggctgaatggactccgt

SEQ ID NO: 7368508 - DNA, 17 bp, Homo sapiens
tctgaggcctctaggag

SEQ ID NO: 7368509 - DNA, 22 bp, Homo sapiens
tctgaggccttggcagctaagg

SEQ ID NO: 7368510 - DNA, 22 bp, Homo sapiens
tctgaggctatgttcaggctaa

SEQ ID NO: 7368511 - DNA, 22 bp, Homo sapiens
tctgatgataaagcatccttta

SEQ ID NO: 7368512 - DNA, 22 bp, Homo sapiens
tctgatctgtgccttaggcctg

SEQ ID NO: 7368513 - DNA, 17 bp, Homo sapiens
tctgatgactagaggaa

SEQ ID NO: 7368514 - DNA, 21 bp, Homo sapiens
tctgatggtagatgagatgtg

SEQ ID NO: 7368515 - DNA, 22 bp, Homo sapiens
tctgcaaaagtgttcataaaga

SEQ ID NO: 7368516 - DNA, 22 bp, Homo sapiens
tctgggcacacaccatgcccac

SEQ ID NO: 7368517 - DNA, 21 bp, Homo sapiens
tctgggcccatgctgcctcac

SEQ ID NO: 7368518 - DNA, 23 bp, Homo sapiens
tctgggccacttgtctgcacttc

SEQ ID NO: 7368519 - DNA, 22 bp, Homo sapiens
tctgggacattctctccatagt

SEQ ID NO: 7368520 - DNA, 22 bp, Homo sapiens
tctggctggctcggccgggagt

SEQ ID NO: 7368521 - DNA, 23 bp, Homo sapiens
tctggctgctcctttcaatgctc

SEQ ID NO: 7368522 - DNA, 22 bp, Homo sapiens
tctggctgtgtaaggtagcacc

SEQ ID NO: 7368523 - DNA, 22 bp, Homo sapiens
tctggctgtcattggaggcccc

SEQ ID NO: 7368524 - DNA, 22 bp, Homo sapiens
tctggctgaattagccttgggt

SEQ ID NO: 7368525 - DNA, 22 bp, Homo sapiens
tctggctgaaattagaaggttc

SEQ ID NO: 7368526 - DNA, 22 bp, Homo sapiens
tctggctctcaacaaatattta

SEQ ID NO: 7368527 - DNA, 22 bp, Homo sapiens
tctggccccgcatgcactttat

SEQ ID NO: 7368528 - DNA, 22 bp, Homo sapiens
tctggccctatggcatgtacct

SEQ ID NO: 7368529 - DNA, 20 bp, Homo sapiens
tctggccccttcctgtcctg

SEQ ID NO: 7368530 - DNA, 22 bp, Homo sapiens
tctggctccctggagctccaca

SEQ ID NO: 7368531 - DNA, 21 bp, Homo sapiens
tctggccctcacagtcacacc

SEQ ID NO: 7368532 - DNA, 22 bp, Homo sapiens
tctggagggggatgcctcatcc

SEQ ID NO: 7368533 - DNA, 22 bp, Homo sapiens
tctggcaaaggcaaccacagtt

SEQ ID NO: 7368534 - DNA, 22 bp, Homo sapiens
tctggatgaagacccagaggct

SEQ ID NO: 7368535 - DNA, 22 bp, Homo sapiens
tctggatgacagaatggtcata

SEQ ID NO: 7368536 - DNA, 22 bp, Homo sapiens
tctggatgctctgagcccaagg

SEQ ID NO: 7368537 - DNA, 22 bp, Homo sapiens
tctggcccatcttctgccacca

SEQ ID NO: 7368538 - DNA, 22 bp, Homo sapiens
tctggcccagcccctgatccca

SEQ ID NO: 7368539 - DNA, 22 bp, Homo sapiens
tctggcaccactgagtctgcag

SEQ ID NO: 7368540 - DNA, 22 bp, Homo sapiens
tctgctgctgaccaacactgtg

SEQ ID NO: 7368541 - DNA, 22 bp, Homo sapiens
tctgctgctgagcacactccta

SEQ ID NO: 7368542 - DNA, 22 bp, Homo sapiens
tctggaataggtcctgagtatt

SEQ ID NO: 7368543 - DNA, 22 bp, Homo sapiens
tctggagaatctgtcagtgtgg

SEQ ID NO: 7368544 - DNA, 22 bp, Homo sapiens
tctggagaggggcctagaattt

SEQ ID NO: 7368545 - DNA, 22 bp, Homo sapiens
tctggagataagacagacagat

SEQ ID NO: 7368546 - DNA, 22 bp, Homo sapiens
tctggagagtcacagtgccaga

SEQ ID NO: 7368547 - DNA, 22 bp, Homo sapiens
tctgtgttttaaacagtagaaa

SEQ ID NO: 7368548 - DNA, 22 bp, Homo sapiens
tctgttagagaggtagttcttg

SEQ ID NO: 7368549 - DNA, 22 bp, Homo sapiens
tctgttagctgtcaaagtgttt

SEQ ID NO: 7368550 - DNA, 22 bp, Homo sapiens
tctgtttaatgggaatgatact

SEQ ID NO: 7368551 - DNA, 22 bp, Homo sapiens
tctgttcttggtgcagctggga

SEQ ID NO: 7368552 - DNA, 22 bp, Homo sapiens
tctgttcttggtgcagctggga

SEQ ID NO: 7368553 - DNA, 22 bp, Homo sapiens
tctgttcttgtccccacttcag

SEQ ID NO: 7368554 - DNA, 23 bp, Homo sapiens
tctgttcttttagctgatcattt

SEQ ID NO: 7368555 - DNA, 23 bp, Homo sapiens
tctgttcttttagctgatcattt

SEQ ID NO: 7368556 - DNA, 22 bp, Homo sapiens
tctgttctttagcctgcttgag

SEQ ID NO: 7368557 - DNA, 22 bp, Homo sapiens
tctgttctttagcctgcttgag

SEQ ID NO: 7368558 - DNA, 22 bp, Homo sapiens
tctgttctttccaacaagacag

SEQ ID NO: 7368559 - DNA, 22 bp, Homo sapiens
tctgttctttccaacaagacag

SEQ ID NO: 7368560 - DNA, 22 bp, Homo sapiens
tcttagcatgcatgtataaata

SEQ ID NO: 7368561 - DNA, 22 bp, Homo sapiens
tcttaagaaagtgacaaatagg

SEQ ID NO: 7368562 - DNA, 22 bp, Homo sapiens
tcttaagcagagaagaagttga

SEQ ID NO: 7368563 - DNA, 22 bp, Homo sapiens
tcttaagaaagtgacaaatagg

SEQ ID NO: 7368564 - DNA, 22 bp, Homo sapiens
tcttagaattgaagtcagaggg

SEQ ID NO: 7368565 - DNA, 22 bp, Homo sapiens
tcttagaattgaagtcagaggg

SEQ ID NO: 7368566 - DNA, 22 bp, Homo sapiens
tcttaatgaaagtgaaatatca

SEQ ID NO: 7368567 - DNA, 22 bp, Homo sapiens
tcttaaatgactgataagagga

SEQ ID NO: 7368568 - DNA, 20 bp, Homo sapiens
tcttaaatccccagggccat

SEQ ID NO: 7368569 - DNA, 20 bp, Homo sapiens
tcttaaatccccagggccat

SEQ ID NO: 7368570 - DNA, 22 bp, Homo sapiens
tctgtttatgtgtctaaataaa

SEQ ID NO: 7368571 - DNA, 22 bp, Homo sapiens
tcttaaagagcgcaatttgagg

SEQ ID NO: 7368572 - DNA, 22 bp, Homo sapiens
tctgttttgtaccagatacagc

SEQ ID NO: 7368573 - DNA, 22 bp, Homo sapiens
tctgttttgtaccagatacagc

SEQ ID NO: 7368574 - DNA, 22 bp, Homo sapiens
tctgtctgcacctaagcacagt

SEQ ID NO: 7368575 - DNA, 22 bp, Homo sapiens
tctgtctttagaggcctgtgct

SEQ ID NO: 7368576 - DNA, 22 bp, Homo sapiens
tctgtctttgtcaggaccagag

SEQ ID NO: 7368577 - DNA, 22 bp, Homo sapiens
tctgtgataggaaaataaatgg

SEQ ID NO: 7368578 - DNA, 22 bp, Homo sapiens
tctgtgtctgcagaagttcagc

SEQ ID NO: 7368579 - DNA, 22 bp, Homo sapiens
tctgtgctttccctgccttctt

SEQ ID NO: 7368580 - DNA, 22 bp, Homo sapiens
tctgtgctaggcagcctggccc

SEQ ID NO: 7368581 - DNA, 22 bp, Homo sapiens
tctgtgctcattcagtcattca

SEQ ID NO: 7368582 - DNA, 22 bp, Homo sapiens
tctgtgctagcacgcagcaagg

SEQ ID NO: 7368583 - DNA, 22 bp, Homo sapiens
tctgtaaagactccaaaagcca

SEQ ID NO: 7368584 - DNA, 22 bp, Homo sapiens
tctgtagtaggttgtagttctt

SEQ ID NO: 7368585 - DNA, 22 bp, Homo sapiens
tctgtagtctgtgccatagctg

SEQ ID NO: 7368586 - DNA, 22 bp, Homo sapiens
tctgtcacaagtaatccttttc

SEQ ID NO: 7368587 - DNA, 22 bp, Homo sapiens
tctgtcaaaagttttcaataaa

SEQ ID NO: 7368588 - DNA, 22 bp, Homo sapiens
tctgtcacccaggctggagtgc

SEQ ID NO: 7368589 - DNA, 22 bp, Homo sapiens
tctgtcacatacacttttcagg

SEQ ID NO: 7368590 - DNA, 22 bp, Homo sapiens
tctgtcacaatttgcttactct

SEQ ID NO: 7368591 - DNA, 22 bp, Homo sapiens
tctgtcaccattcagcttgaat

SEQ ID NO: 7368592 - DNA, 22 bp, Homo sapiens
tctgtcacccagagtgcagtgg

SEQ ID NO: 7368593 - DNA, 17 bp, Homo sapiens
tctgtccagggagtgtg

SEQ ID NO: 7368594 - DNA, 22 bp, Homo sapiens
tctgtcctccacactgtaagtt

SEQ ID NO: 7368595 - DNA, 22 bp, Homo sapiens
tctgtccacaagcacaggctct

SEQ ID NO: 7368596 - DNA, 22 bp, Homo sapiens
tctgtcatgtttccattacatg

SEQ ID NO: 7368597 - DNA, 22 bp, Homo sapiens
tctgtcattgcaataaaatttc

SEQ ID NO: 7368598 - DNA, 22 bp, Homo sapiens
tctgtctctttgttctgtgagt

SEQ ID NO: 7368599 - DNA, 22 bp, Homo sapiens
tctgggggttaagtgaggacaa

SEQ ID NO: 7368600 - DNA, 22 bp, Homo sapiens
tctgggggcgaccagggactgc

SEQ ID NO: 7368601 - DNA, 22 bp, Homo sapiens
tctgggggaggaggcatggccc

SEQ ID NO: 7368602 - DNA, 20 bp, Homo sapiens
tctttagttcctggcccttt

SEQ ID NO: 7368603 - DNA, 22 bp, Homo sapiens
tctttagtgaccatctcattct

SEQ ID NO: 7368604 - DNA, 22 bp, Homo sapiens
tctttagctagaaatactctaa

SEQ ID NO: 7368605 - DNA, 22 bp, Homo sapiens
tctttataaaagtcattatgtc

SEQ ID NO: 7368606 - DNA, 22 bp, Homo sapiens
tctttataaaagtcattatgtc

SEQ ID NO: 7368607 - DNA, 22 bp, Homo sapiens
tctttatgagaaaaagattgta

SEQ ID NO: 7368608 - DNA, 22 bp, Homo sapiens
tctttatgagaaaaagattgta

SEQ ID NO: 7368609 - DNA, 22 bp, Homo sapiens
tctttatgcctacctgggaaga

SEQ ID NO: 7368610 - DNA, 22 bp, Homo sapiens
tctttcaatgagcattctttcc

SEQ ID NO: 7368611 - DNA, 22 bp, Homo sapiens
tctttcaatgagcattctttcc

SEQ ID NO: 7368612 - DNA, 22 bp, Homo sapiens
tctttattgctactggtttgtc

SEQ ID NO: 7368613 - DNA, 22 bp, Homo sapiens
tctttcagctcttcaggaccca

SEQ ID NO: 7368614 - DNA, 22 bp, Homo sapiens
tctttccagaggaatttttaga

SEQ ID NO: 7368615 - DNA, 22 bp, Homo sapiens
tctttccagaggaatttttaga

SEQ ID NO: 7368616 - DNA, 22 bp, Homo sapiens
tctttcccgccagagcatgagt

SEQ ID NO: 7368617 - DNA, 22 bp, Homo sapiens
tctttccacattctctgtttag

SEQ ID NO: 7368618 - DNA, 23 bp, Homo sapiens
tctttcctcagcacacaccaaga

SEQ ID NO: 7368619 - DNA, 22 bp, Homo sapiens
tctttcctaggtgatatgcaat

SEQ ID NO: 7368620 - DNA, 22 bp, Homo sapiens
tctttgaatacaggaagcatga

SEQ ID NO: 7368621 - DNA, 22 bp, Homo sapiens
tctttgaagttcccctggaaga

SEQ ID NO: 7368622 - DNA, 22 bp, Homo sapiens
tctttgaatcctttacatctga

SEQ ID NO: 7368623 - DNA, 22 bp, Homo sapiens
tctttcttattagccattgttc

SEQ ID NO: 7368624 - DNA, 22 bp, Homo sapiens
tcttggactcaaaattgcctta

SEQ ID NO: 7368625 - DNA, 22 bp, Homo sapiens
tcttggccaggtgtggtgcctc

SEQ ID NO: 7368626 - DNA, 22 bp, Homo sapiens
tcttgagaagcggctgtctcag

SEQ ID NO: 7368627 - DNA, 22 bp, Homo sapiens
tcttgctaggagctatggaaga

SEQ ID NO: 7368628 - DNA, 22 bp, Homo sapiens
tcttgctaaagaccaacacatt

SEQ ID NO: 7368629 - DNA, 22 bp, Homo sapiens
tcttgctagaatcatttggaga

SEQ ID NO: 7368630 - DNA, 22 bp, Homo sapiens
tcttgaaagtatcttattttgt

SEQ ID NO: 7368631 - DNA, 22 bp, Homo sapiens
tcttgaataagtttcatgagct

SEQ ID NO: 7368632 - DNA, 22 bp, Homo sapiens
tcttgaataagtttcatgagct

SEQ ID NO: 7368633 - DNA, 22 bp, Homo sapiens
tcttgacattgcaatcttcaga

SEQ ID NO: 7368634 - DNA, 22 bp, Homo sapiens
tcttgacattgttgttagcagg

SEQ ID NO: 7368635 - DNA, 22 bp, Homo sapiens
tcttgacattgttgttagcagg

SEQ ID NO: 7368636 - DNA, 22 bp, Homo sapiens
tcttgaattgtactcccataag

SEQ ID NO: 7368637 - DNA, 22 bp, Homo sapiens
tcttgaatctaatgcagtttct

SEQ ID NO: 7368638 - DNA, 22 bp, Homo sapiens
tcttgaattgtactcccataag

SEQ ID NO: 7368639 - DNA, 23 bp, Homo sapiens
tctttacagcagcaggatttgga

SEQ ID NO: 7368640 - DNA, 21 bp, Homo sapiens
tcttggggaggagggctgcac

SEQ ID NO: 7368641 - DNA, 22 bp, Homo sapiens
tcttgggcatgtgtttgatttc

SEQ ID NO: 7368642 - DNA, 22 bp, Homo sapiens
tcttcaatatgtgtttaatatt

SEQ ID NO: 7368643 - DNA, 22 bp, Homo sapiens
tcttcaagttccaaagtgcagg

SEQ ID NO: 7368644 - DNA, 22 bp, Homo sapiens
tcttcaaatacagtcatattga

SEQ ID NO: 7368645 - DNA, 22 bp, Homo sapiens
tcttcaaatacagtcatattga

SEQ ID NO: 7368646 - DNA, 22 bp, Homo sapiens
tcttcaaatcctacagtgtctg

SEQ ID NO: 7368647 - DNA, 22 bp, Homo sapiens
tcttcaaatgctagtaatatca

SEQ ID NO: 7368648 - DNA, 22 bp, Homo sapiens
tcttcaaatgctagtaatatca

SEQ ID NO: 7368649 - DNA, 22 bp, Homo sapiens
tcttcacagatgcatatacttc

SEQ ID NO: 7368650 - DNA, 22 bp, Homo sapiens
tcttattttgttagatgctgta

SEQ ID NO: 7368651 - DNA, 22 bp, Homo sapiens
tcttattgtgatgatgaagaac

SEQ ID NO: 7368652 - DNA, 22 bp, Homo sapiens
tcttcaaaaatacaggttttca

SEQ ID NO: 7368653 - DNA, 22 bp, Homo sapiens
tcttcaaaattgattggagaag

SEQ ID NO: 7368654 - DNA, 22 bp, Homo sapiens
tcttcaaaattgattggagaag

SEQ ID NO: 7368655 - DNA, 22 bp, Homo sapiens
tcttcaaaccctggttttgtga

SEQ ID NO: 7368656 - DNA, 22 bp, Homo sapiens
tcttcaaaaaatatccatcagt

SEQ ID NO: 7368657 - DNA, 22 bp, Homo sapiens
tcttcaaaaatacaggttttca

SEQ ID NO: 7368658 - DNA, 22 bp, Homo sapiens
tcttcaaaaactgcaccttgct

SEQ ID NO: 7368659 - DNA, 22 bp, Homo sapiens
tcttcaaagcatatgcaggcat

SEQ ID NO: 7368660 - DNA, 22 bp, Homo sapiens
tcttcaaagaattttagtaatt

SEQ ID NO: 7368661 - DNA, 22 bp, Homo sapiens
tcttcaaagaattttagtaatt

SEQ ID NO: 7368662 - DNA, 22 bp, Homo sapiens
tcttcagtgcatgttacctata

SEQ ID NO: 7368663 - DNA, 22 bp, Homo sapiens
tcttcagtgcacctgatgtctt

SEQ ID NO: 7368664 - DNA, 22 bp, Homo sapiens
tcttcaggctctggctgccttt

SEQ ID NO: 7368665 - DNA, 22 bp, Homo sapiens
tcttcagggtctgccccagggg

SEQ ID NO: 7368666 - DNA, 22 bp, Homo sapiens
tcttcaggaagggaaatcatcc

SEQ ID NO: 7368667 - DNA, 22 bp, Homo sapiens
tcttcataacctagagatagca

SEQ ID NO: 7368668 - DNA, 18 bp, Homo sapiens
tcttccaacactgacacc

SEQ ID NO: 7368669 - DNA, 22 bp, Homo sapiens
tcttccttaaatgtttggtaga

SEQ ID NO: 7368670 - DNA, 22 bp, Homo sapiens
tcttccttctttgatgacaagg

SEQ ID NO: 7368671 - DNA, 22 bp, Homo sapiens
tcttccttcgcccttgctgttt

SEQ ID NO: 7368672 - DNA, 22 bp, Homo sapiens
tcttccttttgtaccttctgaa

SEQ ID NO: 7368673 - DNA, 16 bp, Homo sapiens
tcttccttttgatttt

SEQ ID NO: 7368674 - DNA, 22 bp, Homo sapiens
tcttcctttcattcatgtgtta

SEQ ID NO: 7368675 - DNA, 22 bp, Homo sapiens
tcttctcaaaaaatgtaggtgg

SEQ ID NO: 7368676 - DNA, 22 bp, Homo sapiens
tcttctaatggttcagatatat

SEQ ID NO: 7368677 - DNA, 22 bp, Homo sapiens
tcttcgtagcatcgtgctggct

SEQ ID NO: 7368678 - DNA, 22 bp, Homo sapiens
tcttctagtaggccaagaagct

SEQ ID NO: 7368679 - DNA, 22 bp, Homo sapiens
tcttccttgtaagggctttaga

SEQ ID NO: 7368680 - DNA, 22 bp, Homo sapiens
tcttccttgctccttgtcactt

SEQ ID NO: 7368681 - DNA, 22 bp, Homo sapiens
tcttcctttcattcatgtgtta

SEQ ID NO: 7368682 - DNA, 22 bp, Homo sapiens
tcttccttgccttgcttcatca

SEQ ID NO: 7368683 - DNA, 22 bp, Homo sapiens
tcttccttgccttgcttcatca

SEQ ID NO: 7368684 - DNA, 22 bp, Homo sapiens
tcttccttctttgatgacaagg

SEQ ID NO: 7368685 - DNA, 22 bp, Homo sapiens
tcttctccataatcaacactct

SEQ ID NO: 7368686 - DNA, 21 bp, Homo sapiens
tcttgaaaagttagattctct

SEQ ID NO: 7368687 - DNA, 22 bp, Homo sapiens
tcttctttgaatcatagtgacc

SEQ ID NO: 7368688 - DNA, 22 bp, Homo sapiens
tcttctttggatgaaagaatat

SEQ ID NO: 7368689 - DNA, 22 bp, Homo sapiens
tcttcttttatttcaagggtgt

SEQ ID NO: 7368690 - DNA, 20 bp, Homo sapiens
tcttctgttgccttgttctg

SEQ ID NO: 7368691 - DNA, 22 bp, Homo sapiens
tcttcttcccatccctcaaatg

SEQ ID NO: 7368692 - DNA, 21 bp, Homo sapiens
taagaacattatcttcttcct

SEQ ID NO: 7368693 - DNA, 22 bp, Homo sapiens
taagaatagtccctagatgtgt

SEQ ID NO: 7368694 - DNA, 22 bp, Homo sapiens
taagaatacctctcagctcttt

SEQ ID NO: 7368695 - DNA, 23 bp, Homo sapiens
taagaacagacaagcatttacat

SEQ ID NO: 7368696 - DNA, 22 bp, Homo sapiens
taagaacagtagaacagtaggt

SEQ ID NO: 7368697 - DNA, 22 bp, Homo sapiens
taagaacagtagaacagtaggt

SEQ ID NO: 7368698 - DNA, 22 bp, Homo sapiens
taagaacagtgacagccaacat

SEQ ID NO: 7368699 - DNA, 22 bp, Homo sapiens
taagaacagtgtctgtctcaca

SEQ ID NO: 7368700 - DNA, 22 bp, Homo sapiens
taagaatcggtcgcaacagagg

SEQ ID NO: 7368701 - DNA, 22 bp, Homo sapiens
taagaatattgggaatggatgg

SEQ ID NO: 7368702 - DNA, 22 bp, Homo sapiens
taagaatagtgtttgcctttgg

SEQ ID NO: 7368703 - DNA, 22 bp, Homo sapiens
taagacaaatactatttcaaga

SEQ ID NO: 7368704 - DNA, 22 bp, Homo sapiens
tcctgctggattgtgtctggtg

SEQ ID NO: 7368705 - DNA, 22 bp, Homo sapiens
taagaattatctcatggataat

SEQ ID NO: 7368706 - DNA, 22 bp, Homo sapiens
tcctgctgggtctaactctggt

SEQ ID NO: 7368707 - DNA, 21 bp, Homo sapiens
tcctgctgggtcaaccgtttt

SEQ ID NO: 7368708 - DNA, 22 bp, Homo sapiens
tcctgctgggcctgctttagga

SEQ ID NO: 7368709 - DNA, 22 bp, Homo sapiens
tcctgctggattgtgtctggtg

SEQ ID NO: 7368710 - DNA, 22 bp, Homo sapiens
tcctgctggcaaggaagggact

SEQ ID NO: 7368711 - DNA, 22 bp, Homo sapiens
tcctgctggtgatggttaaggt

SEQ ID NO: 7368712 - DNA, 22 bp, Homo sapiens
tcctgctgtgcttattatcctg

SEQ ID NO: 7368713 - DNA, 22 bp, Homo sapiens
tcctgctgtgtctagctggttc

SEQ ID NO: 7368714 - DNA, 19 bp, Homo sapiens
tcctgctgtgtgaagggga

SEQ ID NO: 7368715 - DNA, 22 bp, Homo sapiens
tcctgctgtttacctacaatgg

SEQ ID NO: 7368716 - DNA, 22 bp, Homo sapiens
tcctgctgttttctggcccaca

SEQ ID NO: 7368717 - DNA, 22 bp, Homo sapiens
tcctgctgttttctggcccaca

SEQ ID NO: 7368718 - DNA, 22 bp, Homo sapiens
tcctggaagatctctgtgagat

SEQ ID NO: 7368719 - DNA, 22 bp, Homo sapiens
tcctggatttaaccctggctct

SEQ ID NO: 7368720 - DNA, 22 bp, Homo sapiens
tcctggattctgccctgaaggc

SEQ ID NO: 7368721 - DNA, 22 bp, Homo sapiens
tcctggattaatagggagctgt

SEQ ID NO: 7368722 - DNA, 22 bp, Homo sapiens
tcctggatggcctgcaggcggt

SEQ ID NO: 7368723 - DNA, 22 bp, Homo sapiens
tcctggatggagctgccctcgc

SEQ ID NO: 7368724 - DNA, 22 bp, Homo sapiens
tcctggatcagcgggggcaggc

SEQ ID NO: 7368725 - DNA, 17 bp, Homo sapiens
tcctggatccatggtgg

SEQ ID NO: 7368726 - DNA, 22 bp, Homo sapiens
tcctggctctctacaaaccaga

SEQ ID NO: 7368727 - DNA, 18 bp, Homo sapiens
tcctgggaaaggcataca

SEQ ID NO: 7368728 - DNA, 22 bp, Homo sapiens
tcctgggaggcggaggttgcag

SEQ ID NO: 7368729 - DNA, 22 bp, Homo sapiens
tcctgggacaccccaatatgag

SEQ ID NO: 7368730 - DNA, 22 bp, Homo sapiens
tcctgggatgcataaaatatgt

SEQ ID NO: 7368731 - DNA, 22 bp, Homo sapiens
tcctggggaggtcgaggctgag

SEQ ID NO: 7368732 - DNA, 22 bp, Homo sapiens
tccttaaatatttactgttaac

SEQ ID NO: 7368733 - DNA, 22 bp, Homo sapiens
tcctgtgccatctctagagact

SEQ ID NO: 7368734 - DNA, 22 bp, Homo sapiens
tcctgtgcctccacctgctccg

SEQ ID NO: 7368735 - DNA, 22 bp, Homo sapiens
tcctgtgaagaatagcactcaa

SEQ ID NO: 7368736 - DNA, 22 bp, Homo sapiens
tcctgtgaccagcttccatgct

SEQ ID NO: 7368737 - DNA, 22 bp, Homo sapiens
tcctgtatttgttcatctgtac

SEQ ID NO: 7368738 - DNA, 22 bp, Homo sapiens
tcctggttttcctgggacaggg

SEQ ID NO: 7368739 - DNA, 22 bp, Homo sapiens
tcctggggttttggccgcagct

SEQ ID NO: 7368740 - DNA, 22 bp, Homo sapiens
tcctgggtgtgatattcataga

SEQ ID NO: 7368741 - DNA, 22 bp, Homo sapiens
tccttctgtagtccctgtccct

SEQ ID NO: 7368742 - DNA, 22 bp, Homo sapiens
tccttctgaaaaatgcacacga

SEQ ID NO: 7368743 - DNA, 20 bp, Homo sapiens
tccttctgaggtgaggagga

SEQ ID NO: 7368744 - DNA, 22 bp, Homo sapiens
tccttctggaggctctaagggg

SEQ ID NO: 7368745 - DNA, 22 bp, Homo sapiens
tccttgagagccactgtcttgg

SEQ ID NO: 7368746 - DNA, 22 bp, Homo sapiens
tccttgaggaggtgacactgga

SEQ ID NO: 7368747 - DNA, 22 bp, Homo sapiens
tccttggaagagcattcccagg

SEQ ID NO: 7368748 - DNA, 22 bp, Homo sapiens
tccttgcatatctgaaaatgtt

SEQ ID NO: 7368749 - DNA, 22 bp, Homo sapiens
tccttaggcaatttgggagagt

SEQ ID NO: 7368750 - DNA, 22 bp, Homo sapiens
tccttacagaaagcagtagaca

SEQ ID NO: 7368751 - DNA, 22 bp, Homo sapiens
tccttacaggttacagaaagca

SEQ ID NO: 7368752 - DNA, 22 bp, Homo sapiens
tccttacactggggaaggtgta

SEQ ID NO: 7368753 - DNA, 22 bp, Homo sapiens
tccttacaacttgttatttttc

SEQ ID NO: 7368754 - DNA, 22 bp, Homo sapiens
tccttaaatgtgatctagattt

SEQ ID NO: 7368755 - DNA, 22 bp, Homo sapiens
tccttacatagtgctgaaatat

SEQ ID NO: 7368756 - DNA, 22 bp, Homo sapiens
tccttacatgcttccttataca

SEQ ID NO: 7368757 - DNA, 22 bp, Homo sapiens
tccttacagttaaaatgggagt

SEQ ID NO: 7368758 - DNA, 22 bp, Homo sapiens
tcctttgttaaggaggtttgtt

SEQ ID NO: 7368759 - DNA, 22 bp, Homo sapiens
tcctttgttgagataaattggg

SEQ ID NO: 7368760 - DNA, 23 bp, Homo sapiens
tcctttgtctttgcatagatggt

SEQ ID NO: 7368761 - DNA, 22 bp, Homo sapiens
tccttttctctagtaagcttta

SEQ ID NO: 7368762 - DNA, 22 bp, Homo sapiens
tcctttgcttctgtcattctcc

SEQ ID NO: 7368763 - DNA, 22 bp, Homo sapiens
tcctttgcttctgtcattctcc

SEQ ID NO: 7368764 - DNA, 22 bp, Homo sapiens
tcgcaccattgcactccagcca

SEQ ID NO: 7368765 - DNA, 22 bp, Homo sapiens
tcctttccctttccatcctggc

SEQ ID NO: 7368766 - DNA, 22 bp, Homo sapiens
tcctttccctttccatcctggc

SEQ ID NO: 7368767 - DNA, 22 bp, Homo sapiens
tcctttccctttccatcctggc

SEQ ID NO: 7368768 - DNA, 22 bp, Homo sapiens
tcctttccatgcttctagaggc

SEQ ID NO: 7368769 - DNA, 18 bp, Homo sapiens
tcctttctccctcatctt

SEQ ID NO: 7368770 - DNA, 22 bp, Homo sapiens
tcctttctgtctttactctgga

SEQ ID NO: 7368771 - DNA, 19 bp, Homo sapiens
tcctttctgttcctgagat

SEQ ID NO: 7368772 - DNA, 22 bp, Homo sapiens
tcctttctgtctttactctgga

SEQ ID NO: 7368773 - DNA, 22 bp, Homo sapiens
tcctttcttcttctgcccatgg

SEQ ID NO: 7368774 - DNA, 22 bp, Homo sapiens
tcctttcttcttctgcccatgg

SEQ ID NO: 7368775 - DNA, 22 bp, Homo sapiens
tcctttcttcttctgcccatgg

SEQ ID NO: 7368776 - DNA, 22 bp, Homo sapiens
tcgcccagctcatctcccacaa

SEQ ID NO: 7368777 - DNA, 22 bp, Homo sapiens
tcgtgatctgtccacctcggcc

SEQ ID NO: 7368778 - DNA, 22 bp, Homo sapiens
tctaaaatgcagatctactggt

SEQ ID NO: 7368779 - DNA, 22 bp, Homo sapiens
tctaaaaaagtctgttcacttg

SEQ ID NO: 7368780 - DNA, 22 bp, Homo sapiens
tctaaagtatgctaatatgtga

SEQ ID NO: 7368781 - DNA, 22 bp, Homo sapiens
tctaaagatgtttattgacata

SEQ ID NO: 7368782 - DNA, 19 bp, Homo sapiens
tctacaaagtggcatcagg

SEQ ID NO: 7368783 - DNA, 22 bp, Homo sapiens
tctacaatgagaaatgatcagt

SEQ ID NO: 7368784 - DNA, 22 bp, Homo sapiens
tctacaggtggggcctggcaat

SEQ ID NO: 7368785 - DNA, 22 bp, Homo sapiens
tctacagggtaaggggcttgcc

SEQ ID NO: 7368786 - DNA, 22 bp, Homo sapiens
tctacagggtcagagtttcatg

SEQ ID NO: 7368787 - DNA, 22 bp, Homo sapiens
tctaaatgtggtagtcataaga

SEQ ID NO: 7368788 - DNA, 22 bp, Homo sapiens
tctaacttgaactcatgactgt

SEQ ID NO: 7368789 - DNA, 22 bp, Homo sapiens
tctaagaaagattaagaaattt

SEQ ID NO: 7368790 - DNA, 22 bp, Homo sapiens
tctaagaaagattaagaaattt

SEQ ID NO: 7368791 - DNA, 22 bp, Homo sapiens
tctaacttgtatgtatagtttt

SEQ ID NO: 7368792 - DNA, 22 bp, Homo sapiens
tctacaaagaagaattaatgtc

SEQ ID NO: 7368793 - DNA, 22 bp, Homo sapiens
tctacaaagccattcaggatct

SEQ ID NO: 7368794 - DNA, 22 bp, Homo sapiens
tctagaaaaccaatattacatg

SEQ ID NO: 7368795 - DNA, 22 bp, Homo sapiens
tctagaaaaacaaagtatctga

SEQ ID NO: 7368796 - DNA, 22 bp, Homo sapiens
tctagaaaaacaaagtatctga

SEQ ID NO: 7368797 - DNA, 22 bp, Homo sapiens
tctactgccacttaagacattt

SEQ ID NO: 7368798 - DNA, 22 bp, Homo sapiens
tctagcaggtggcggccagcga

SEQ ID NO: 7368799 - DNA, 22 bp, Homo sapiens
tctagcagggaaagcagagaat

SEQ ID NO: 7368800 - DNA, 22 bp, Homo sapiens
tctagcagagggaagaggcttt

SEQ ID NO: 7368801 - DNA, 19 bp, Homo sapiens
tctagcaacccactgcatg

SEQ ID NO: 7368802 - DNA, 23 bp, Homo sapiens
tctcacagcgatctaggaagagg

SEQ ID NO: 7368803 - DNA, 22 bp, Homo sapiens
tctcacagggctaggccctgcc

SEQ ID NO: 7368804 - DNA, 22 bp, Homo sapiens
tctcacagcattatccagggca

SEQ ID NO: 7368805 - DNA, 22 bp, Homo sapiens
tctcacagaggcttgggctcat

SEQ ID NO: 7368806 - DNA, 20 bp, Homo sapiens
tctcaattgtggcatcactg

SEQ ID NO: 7368807 - DNA, 22 bp, Homo sapiens
tctcaaatggacaatattgtgg

SEQ ID NO: 7368808 - DNA, 22 bp, Homo sapiens
tctcaaatgtaaagcatgattt

SEQ ID NO: 7368809 - DNA, 22 bp, Homo sapiens
tctcaaactacactgtaaattg

SEQ ID NO: 7368810 - DNA, 23 bp, Homo sapiens
tctcaaacagtgagttcaccaga

SEQ ID NO: 7368811 - DNA, 22 bp, Homo sapiens
tctatttttatagttgaagtgc

SEQ ID NO: 7368812 - DNA, 22 bp, Homo sapiens
tctattttgtttccagctctac

SEQ ID NO: 7368813 - DNA, 22 bp, Homo sapiens
tctattttgtttccagctctac

SEQ ID NO: 7368814 - DNA, 22 bp, Homo sapiens
tctattttcttgccaaaactgc

SEQ ID NO: 7368815 - DNA, 22 bp, Homo sapiens
tctattttatactcaaatcttc

SEQ ID NO: 7368816 - DNA, 22 bp, Homo sapiens
tctattttatactcaaatcttc

SEQ ID NO: 7368817 - DNA, 22 bp, Homo sapiens
tctattttatactcaaatcttc

SEQ ID NO: 7368818 - DNA, 22 bp, Homo sapiens
tctattttcttgccaaaactgc

SEQ ID NO: 7368819 - DNA, 22 bp, Homo sapiens
tctattttatactcaaatcttc

SEQ ID NO: 7368820 - DNA, 22 bp, Homo sapiens
tctattggtaggggctgaggca

SEQ ID NO: 7368821 - DNA, 22 bp, Homo sapiens
tctattgggactctgcggtgag

SEQ ID NO: 7368822 - DNA, 22 bp, Homo sapiens
tctatctggccccttttatata

SEQ ID NO: 7368823 - DNA, 22 bp, Homo sapiens
tctatctgaggaggtgacattt

SEQ ID NO: 7368824 - DNA, 22 bp, Homo sapiens
tctatattttgaaaggtattta

SEQ ID NO: 7368825 - DNA, 19 bp, Homo sapiens
tctatgtggcagtgatggc

SEQ ID NO: 7368826 - DNA, 22 bp, Homo sapiens
tctattagattattctcaagga

SEQ ID NO: 7368827 - DNA, 22 bp, Homo sapiens
tctatgtcagcatctttctacc

SEQ ID NO: 7368828 - DNA, 22 bp, Homo sapiens
tctatgtcctttctcccattcc

SEQ ID NO: 7368829 - DNA, 22 bp, Homo sapiens
tctatgtctccaccttcgcaga

SEQ ID NO: 7368830 - DNA, 22 bp, Homo sapiens
tctataaaactcaagagcaatt

SEQ ID NO: 7368831 - DNA, 20 bp, Homo sapiens
tctcccaggctcagggaaga

SEQ ID NO: 7368832 - DNA, 22 bp, Homo sapiens
tctccccagctgagctgccctt

SEQ ID NO: 7368833 - DNA, 22 bp, Homo sapiens
tctccccaaaggactcactctc

SEQ ID NO: 7368834 - DNA, 22 bp, Homo sapiens
tctcccctactctaaatctgca

SEQ ID NO: 7368835 - DNA, 22 bp, Homo sapiens
tctcccctagtgcattaaagtg

SEQ ID NO: 7368836 - DNA, 22 bp, Homo sapiens
tctcccctccctggaccagtgc

SEQ ID NO: 7368837 - DNA, 22 bp, Homo sapiens
tctcccctggtctcgcgcgctg

SEQ ID NO: 7368838 - DNA, 22 bp, Homo sapiens
tctcccctgttggccaggtttt

SEQ ID NO: 7368839 - DNA, 23 bp, Homo sapiens
tctccaggccttactccaggcct

SEQ ID NO: 7368840 - DNA, 22 bp, Homo sapiens
tctccaggcttaatctcagctt

SEQ ID NO: 7368841 - DNA, 22 bp, Homo sapiens
tctccagggactgaggctggag

SEQ ID NO: 7368842 - DNA, 22 bp, Homo sapiens
tctccagggactgaggctggag

SEQ ID NO: 7368843 - DNA, 22 bp, Homo sapiens
tctcccagaggatcccagtgga

SEQ ID NO: 7368844 - DNA, 22 bp, Homo sapiens
tctccttcgaggcccagctccc

SEQ ID NO: 7368845 - DNA, 22 bp, Homo sapiens
tctcgatctcctgaccttgtga

SEQ ID NO: 7368846 - DNA, 22 bp, Homo sapiens
tctcgctctgtcgcccaggctg

SEQ ID NO: 7368847 - DNA, 22 bp, Homo sapiens
tctcctgtgcaccctccctgtg

SEQ ID NO: 7368848 - DNA, 22 bp, Homo sapiens
tctcctgtcttctcagcacccc

SEQ ID NO: 7368849 - DNA, 22 bp, Homo sapiens
tctcctggtcacctcagaagtc

SEQ ID NO: 7368850 - DNA, 22 bp, Homo sapiens
tctcctggatggaccttctctt

SEQ ID NO: 7368851 - DNA, 22 bp, Homo sapiens
tctcctggagcaggaaggtggg

SEQ ID NO: 7368852 - DNA, 20 bp, Homo sapiens
tctcaggccccctccttgct

SEQ ID NO: 7368853 - DNA, 22 bp, Homo sapiens
tctcaggctcttggaacctgtt

SEQ ID NO: 7368854 - DNA, 22 bp, Homo sapiens
tctcagggcctccctctgtttc

SEQ ID NO: 7368855 - DNA, 22 bp, Homo sapiens
tctcagggaggttccccgttct

SEQ ID NO: 7368856 - DNA, 22 bp, Homo sapiens
tctcagggagttgaggctgcct

SEQ ID NO: 7368857 - DNA, 22 bp, Homo sapiens
tctcagggcaattctcagcgac

SEQ ID NO: 7368858 - DNA, 22 bp, Homo sapiens
tctcagggagggcgagtcagcg

SEQ ID NO: 7368859 - DNA, 22 bp, Homo sapiens
tctcagggagagctgctggcat

SEQ ID NO: 7368860 - DNA, 22 bp, Homo sapiens
tctcaggcttcctggtgctgtg

SEQ ID NO: 7368861 - DNA, 22 bp, Homo sapiens
tctcagagtttgaatctggagt

SEQ ID NO: 7368862 - DNA, 22 bp, Homo sapiens
tctcagcagccagatccagagc

SEQ ID NO: 7368863 - DNA, 22 bp, Homo sapiens
tctcagagtaattctttaaggt

SEQ ID NO: 7368864 - DNA, 22 bp, Homo sapiens
tctcagagtggtggtccctctg

SEQ ID NO: 7368865 - DNA, 22 bp, Homo sapiens
tctcagagagatgaaacttcca

SEQ ID NO: 7368866 - DNA, 22 bp, Homo sapiens
tctcagagcctaactaacctaa

SEQ ID NO: 7368867 - DNA, 22 bp, Homo sapiens
tctcactgggtcacagcagagg

SEQ ID NO: 7368868 - DNA, 22 bp, Homo sapiens
tctcactgatttgagaccaagg

SEQ ID NO: 7368869 - DNA, 22 bp, Homo sapiens
tctcacagttgtccactgaaaa

SEQ ID NO: 7368870 - DNA, 22 bp, Homo sapiens
tctcacaggtgcacgtggctgt

SEQ ID NO: 7368871 - DNA, 22 bp, Homo sapiens
tctcataatagcatttctcacc

SEQ ID NO: 7368872 - DNA, 22 bp, Homo sapiens
tctcagttttttcaaccataat

SEQ ID NO: 7368873 - DNA, 22 bp, Homo sapiens
tctcagtggacgtgtctgtctt

SEQ ID NO: 7368874 - DNA, 22 bp, Homo sapiens
tctcagtgctatccatattcca

SEQ ID NO: 7368875 - DNA, 22 bp, Homo sapiens
tctcatggcttaacaagcccac

SEQ ID NO: 7368876 - DNA, 22 bp, Homo sapiens
tctcatgctgtagtgcactaac

SEQ ID NO: 7368877 - DNA, 22 bp, Homo sapiens
tctcaggggcctggagtcctgg

SEQ ID NO: 7368878 - DNA, 22 bp, Homo sapiens
tctcagggcttttcttttgaat

SEQ ID NO: 7368879 - DNA, 22 bp, Homo sapiens
tctcagggctcagagctcaggc

SEQ ID NO: 7368880 - DNA, 20 bp, Homo sapiens
tctcagggttcagcaaagta

SEQ ID NO: 7368881 - DNA, 23 bp, Homo sapiens
tctcagtgaatctcagaattcgc

SEQ ID NO: 7368882 - DNA, 22 bp, Homo sapiens
tctcagtgacactcttcataca

SEQ ID NO: 7368883 - DNA, 23 bp, Homo sapiens
tctcagtgaatctcagaattcgc

SEQ ID NO: 7368884 - DNA, 22 bp, Homo sapiens
tctcagtgcagagaggctatct

SEQ ID NO: 7368885 - DNA, 22 bp, Homo sapiens
tctcagtgagcttttctatgtt

SEQ ID NO: 7368886 - DNA, 22 bp, Homo sapiens
tctcagtgatggcccatttgga

SEQ ID NO: 7368887 - DNA, 19 bp, Homo sapiens
tctccaggcaggtgagcga

SEQ ID NO: 7368888 - DNA, 17 bp, Homo sapiens
tctccaggacgagctca

SEQ ID NO: 7368889 - DNA, 22 bp, Homo sapiens
tctcatgtgattcccgtgcatg

SEQ ID NO: 7368890 - DNA, 22 bp, Homo sapiens
tctcatgtgattcccgtgcatg

SEQ ID NO: 7368891 - DNA, 18 bp, Homo sapiens
tctcattacaatctttgt

SEQ ID NO: 7368892 - DNA, 22 bp, Homo sapiens
tctcatgttttacctgtcctca

SEQ ID NO: 7368893 - DNA, 22 bp, Homo sapiens
tctcattcataccctacatgct

SEQ ID NO: 7368894 - DNA, 22 bp, Homo sapiens
tctcatttacttccacaggctg

SEQ ID NO: 7368895 - DNA, 22 bp, Homo sapiens
tctcattgtccaattgaattta

SEQ ID NO: 7368896 - DNA, 22 bp, Homo sapiens
tctcatttgcctcatctataaa

SEQ ID NO: 7368897 - DNA, 22 bp, Homo sapiens
tctcatttgcctcatctataaa

SEQ ID NO: 7368898 - DNA, 22 bp, Homo sapiens
tctcatttgcctcatctataaa

SEQ ID NO: 7368899 - DNA, 22 bp, Homo sapiens
tctcatttggctttgttttaaa

SEQ ID NO: 7368900 - DNA, 22 bp, Homo sapiens
tctcatttgtgtgcaattcaga

SEQ ID NO: 7368901 - DNA, 22 bp, Homo sapiens
tctcatttgtgtgcaattcaga

SEQ ID NO: 7368902 - DNA, 22 bp, Homo sapiens
tctcattttgagtcagacacta

SEQ ID NO: 7368903 - DNA, 22 bp, Homo sapiens
tctctgaggttgtttccagcac

SEQ ID NO: 7368904 - DNA, 22 bp, Homo sapiens
tctctgagatcagccactgact

SEQ ID NO: 7368905 - DNA, 22 bp, Homo sapiens
tctctgagacagtagcctctgc

SEQ ID NO: 7368906 - DNA, 22 bp, Homo sapiens
tctctgagcccctgcctctttc

SEQ ID NO: 7368907 - DNA, 21 bp, Homo sapiens
tctctgagcccaccaggatct

SEQ ID NO: 7368908 - DNA, 23 bp, Homo sapiens
tctctgagccatagcagtcccaa

SEQ ID NO: 7368909 - DNA, 22 bp, Homo sapiens
tctctctttttaatcatgtaat

SEQ ID NO: 7368910 - DNA, 22 bp, Homo sapiens
tctctctttttaatcatgtaat

SEQ ID NO: 7368911 - DNA, 22 bp, Homo sapiens
tctctgaaagcagctgctcatc

SEQ ID NO: 7368912 - DNA, 22 bp, Homo sapiens
tctctgaagatatttattatta

SEQ ID NO: 7368913 - DNA, 22 bp, Homo sapiens
tctctgagaatatcccataaga

SEQ ID NO: 7368914 - DNA, 22 bp, Homo sapiens
tctctgaaggggagctgtttaa

SEQ ID NO: 7368915 - DNA, 18 bp, Homo sapiens
tctctgaatattttatgt

SEQ ID NO: 7368916 - DNA, 22 bp, Homo sapiens
tctctgaattgtttaagttatt

SEQ ID NO: 7368917 - DNA, 22 bp, Homo sapiens
tctctgaattctgatgcaagtg

SEQ ID NO: 7368918 - DNA, 22 bp, Homo sapiens
tctctcaggctggagtgcagtg

SEQ ID NO: 7368919 - DNA, 22 bp, Homo sapiens
tctctcagctttgagacctgct

SEQ ID NO: 7368920 - DNA, 22 bp, Homo sapiens
tctctcagatggggcactagta

SEQ ID NO: 7368921 - DNA, 22 bp, Homo sapiens
tctctcaggctggagtgcagtg

SEQ ID NO: 7368922 - DNA, 22 bp, Homo sapiens
tctctcagggggaaggctgaag

SEQ ID NO: 7368923 - DNA, 22 bp, Homo sapiens
tctctcagactccccatggttt

SEQ ID NO: 7368924 - DNA, 22 bp, Homo sapiens
tctctcagaaagcccatgtctg

SEQ ID NO: 7368925 - DNA, 22 bp, Homo sapiens
tctctcagaactgcagctgcag

SEQ ID NO: 7368926 - DNA, 22 bp, Homo sapiens
tctctcagaaagcccatgtctg

SEQ ID NO: 7368927 - DNA, 22 bp, Homo sapiens
tctctggctggcaccccaggga

SEQ ID NO: 7368928 - DNA, 22 bp, Homo sapiens
tctctgagttctcctccagccc

SEQ ID NO: 7368929 - DNA, 22 bp, Homo sapiens
tctctgcccatgagcaatctgc

SEQ ID NO: 7368930 - DNA, 19 bp, Homo sapiens
tctctgccgatcagggccc

SEQ ID NO: 7368931 - DNA, 22 bp, Homo sapiens
tctctggcagaggccctatccc

SEQ ID NO: 7368932 - DNA, 20 bp, Homo sapiens
tctctggccagaaacaacag

SEQ ID NO: 7368933 - DNA, 22 bp, Homo sapiens
tctctgtgaagctcccgttagg

SEQ ID NO: 7368934 - DNA, 22 bp, Homo sapiens
tctctgtgagatttgtattaag

SEQ ID NO: 7368935 - DNA, 22 bp, Homo sapiens
tctcttcttgtgttttcctgcc

SEQ ID NO: 7368936 - DNA, 20 bp, Homo sapiens
tctcttctggggagataaaa

SEQ ID NO: 7368937 - DNA, 22 bp, Homo sapiens
tctcttcttgattttcactgga

SEQ ID NO: 7368938 - DNA, 20 bp, Homo sapiens
tctcttctggggagataaaa

SEQ ID NO: 7368939 - DNA, 22 bp, Homo sapiens
tctcttctatttgagactattt

SEQ ID NO: 7368940 - DNA, 22 bp, Homo sapiens
tctcttctctagtgagcaactg

SEQ ID NO: 7368941 - DNA, 22 bp, Homo sapiens
tctcttctgaaacctgtcttta

SEQ ID NO: 7368942 - DNA, 22 bp, Homo sapiens
tctcttctatttgagactattt

SEQ ID NO: 7368943 - DNA, 22 bp, Homo sapiens
tctcttctaacactagaaattc

SEQ ID NO: 7368944 - DNA, 22 bp, Homo sapiens
tctcttaggagaaattcataaa

SEQ ID NO: 7368945 - DNA, 22 bp, Homo sapiens
tctgaaataaatgcactgttag

SEQ ID NO: 7368946 - DNA, 22 bp, Homo sapiens
tctgaaagaaagattttgtttc

SEQ ID NO: 7368947 - DNA, 20 bp, Homo sapiens
tctcttttagcttacagctg

SEQ ID NO: 7368948 - DNA, 22 bp, Homo sapiens
tctctttaaaaatagtgaaata

SEQ ID NO: 7368949 - DNA, 22 bp, Homo sapiens
tctctttaagtataatcttata

SEQ ID NO: 7368950 - DNA, 22 bp, Homo sapiens
tctctttaaagactcagagatt

SEQ ID NO: 7368951 - DNA, 18 bp, Homo sapiens
tctgaaggaatgattcca

SEQ ID NO: 7368952 - DNA, 17 bp, Homo sapiens
tctgaagccagtctgct

SEQ ID NO: 7368953 - DNA, 22 bp, Homo sapiens
tctgaagaagggtgccaggctg

SEQ ID NO: 7368954 - DNA, 19 bp, Homo sapiens
tctgaagaattagagagca

SEQ ID NO: 7368955 - DNA, 22 bp, Homo sapiens
tctgaagagaacaccagtagtt

SEQ ID NO: 7368956 - DNA, 19 bp, Homo sapiens
tctgaagaattagagagca

SEQ ID NO: 7368957 - DNA, 22 bp, Homo sapiens
tctgaagagtcatctttgggtg

SEQ ID NO: 7368958 - DNA, 22 bp, Homo sapiens
tctgaagacatatgatatggtg

SEQ ID NO: 7368959 - DNA, 22 bp, Homo sapiens
tctgaagagaatgctgctgaac

SEQ ID NO: 7368960 - DNA, 22 bp, Homo sapiens
tctgaagagctttggaagtatg

SEQ ID NO: 7368961 - DNA, 22 bp, Homo sapiens
tctgaagaggctcttgataaga

SEQ ID NO: 7368962 - DNA, 22 bp, Homo sapiens
tctgaagattctttccactatt

SEQ ID NO: 7368963 - DNA, 22 bp, Homo sapiens
tctgaagattaccagctaaatg

SEQ ID NO: 7368964 - DNA, 22 bp, Homo sapiens
tctgaagattaccagctaaatg

SEQ ID NO: 7368965 - DNA, 22 bp, Homo sapiens
tctgaagatggaggaacttaga

SEQ ID NO: 7368966 - DNA, 23 bp, Homo sapiens
tctgaagatgctgtttccagtga

SEQ ID NO: 7368967 - DNA, 22 bp, Homo sapiens
tctgaagagtcttgcaagaaag

SEQ ID NO: 7368968 - DNA, 22 bp, Homo sapiens
tctgaagatatgagctttatga

SEQ ID NO: 7368969 - DNA, 22 bp, Homo sapiens
tctgaagaataggatgttgtgt

SEQ ID NO: 7368970 - DNA, 22 bp, Homo sapiens
tctgaagaactgtctagagaac

SEQ ID NO: 7368971 - DNA, 22 bp, Homo sapiens
tctgaagaactgtctagagaac

SEQ ID NO: 7368972 - DNA, 22 bp, Homo sapiens
tctgaagaactgagtaaacatg

SEQ ID NO: 7368973 - DNA, 20 bp, Homo sapiens
tctgaagaaagacagggact

SEQ ID NO: 7368974 - DNA, 22 bp, Homo sapiens
tctgaagaaatacagctggggt

SEQ ID NO: 7368975 - DNA, 22 bp, Homo sapiens
tctgaaatggggctgaagcact

SEQ ID NO: 7368976 - DNA, 22 bp, Homo sapiens
tgcagcctttagaagttcagat

SEQ ID NO: 7368977 - DNA, 22 bp, Homo sapiens
tgcagctgacccactccagtcc

SEQ ID NO: 7368978 - DNA, 22 bp, Homo sapiens
tgcagctgaccagcaagtcctg

SEQ ID NO: 7368979 - DNA, 21 bp, Homo sapiens
tgcagctgacactggtatgcc

SEQ ID NO: 7368980 - DNA, 22 bp, Homo sapiens
tgcagctgaaaggactgaatga

SEQ ID NO: 7368981 - DNA, 22 bp, Homo sapiens
tgcagctgaacctagagtctgt

SEQ ID NO: 7368982 - DNA, 21 bp, Homo sapiens
tgcagctgacaccctttggga

SEQ ID NO: 7368983 - DNA, 21 bp, Homo sapiens
tgcagctgggttctggtttgc

SEQ ID NO: 7368984 - DNA, 22 bp, Homo sapiens
tgcagctggtatcccatggatt

SEQ ID NO: 7368985 - DNA, 22 bp, Homo sapiens
tgcagctggtttagaactagat

SEQ ID NO: 7368986 - DNA, 22 bp, Homo sapiens
tgcagctgcttgattcatcttg

SEQ ID NO: 7368987 - DNA, 22 bp, Homo sapiens
tgcagctggaacttagaggaga

SEQ ID NO: 7368988 - DNA, 22 bp, Homo sapiens
tgcagctgggtctgccctggct

SEQ ID NO: 7368989 - DNA, 22 bp, Homo sapiens
tgcagctgggtctgccctggct

SEQ ID NO: 7368990 - DNA, 22 bp, Homo sapiens
tgcagctgggacatttttgata

SEQ ID NO: 7368991 - DNA, 22 bp, Homo sapiens
tgcagctggatttatcttttcc

SEQ ID NO: 7368992 - DNA, 22 bp, Homo sapiens
tgcagctgaggccagctatgcc

SEQ ID NO: 7368993 - DNA, 22 bp, Homo sapiens
tgcagctgagtcacccagccat

SEQ ID NO: 7368994 - DNA, 22 bp, Homo sapiens
tgcagctgataattacatgttc

SEQ ID NO: 7368995 - DNA, 22 bp, Homo sapiens
tgcagctgatgatacccccatg

SEQ ID NO: 7368996 - DNA, 17 bp, Homo sapiens
tgcagctgatggggaaa

SEQ ID NO: 7368997 - DNA, 17 bp, Homo sapiens
tgcagctgctcccaggc

SEQ ID NO: 7368998 - DNA, 22 bp, Homo sapiens
tgcagctgctggcccaggtgct

SEQ ID NO: 7368999 - DNA, 22 bp, Homo sapiens
tgcagctgctcttcatttcccc

SEQ ID NO: 7369000 - DNA, 22 bp, Homo sapiens
tgcagctgctggtggctgaaag

SEQ ID NO: 7369001 - DNA, 22 bp, Homo sapiens
tgcagcagggacctctatgtga

SEQ ID NO: 7369002 - DNA, 22 bp, Homo sapiens
tgcagcagggcccaggcacaga

SEQ ID NO: 7369003 - DNA, 22 bp, Homo sapiens
tgcagcagggcccaggcacaga

SEQ ID NO: 7369004 - DNA, 22 bp, Homo sapiens
tgcagcagggcccaggcacaga

SEQ ID NO: 7369005 - DNA, 22 bp, Homo sapiens
tgcagcaggagccaggcctggt

SEQ ID NO: 7369006 - DNA, 22 bp, Homo sapiens
tgcagcagcctcatctggtttc

SEQ ID NO: 7369007 - DNA, 22 bp, Homo sapiens
tgcagcagcagggaggaggctc

SEQ ID NO: 7369008 - DNA, 22 bp, Homo sapiens
tgcagcagccaaggttctgtgc

SEQ ID NO: 7369009 - DNA, 22 bp, Homo sapiens
tgcagcagcagggaggaggctc

SEQ ID NO: 7369010 - DNA, 22 bp, Homo sapiens
tgcagcagacataatgtggatt

SEQ ID NO: 7369011 - DNA, 22 bp, Homo sapiens
tgcagcagactgagtatgagaa

SEQ ID NO: 7369012 - DNA, 21 bp, Homo sapiens
tgcagcagagtaagcagggga

SEQ ID NO: 7369013 - DNA, 18 bp, Homo sapiens
tgcagcctgtagtcttgt

SEQ ID NO: 7369014 - DNA, 22 bp, Homo sapiens
tgcagcctggtggtcactggag

SEQ ID NO: 7369015 - DNA, 22 bp, Homo sapiens
tgcagcctctctgcttcaggaa

SEQ ID NO: 7369016 - DNA, 22 bp, Homo sapiens
tgcagcctagacattctggtca

SEQ ID NO: 7369017 - DNA, 22 bp, Homo sapiens
tgcagccagactttgtgcgaaa

SEQ ID NO: 7369018 - DNA, 23 bp, Homo sapiens
tgcagcagggtggtctacttctc

SEQ ID NO: 7369019 - DNA, 22 bp, Homo sapiens
tgcagccatctttcttggagga

SEQ ID NO: 7369020 - DNA, 22 bp, Homo sapiens
tgcagctgtaacagaggcctca

SEQ ID NO: 7369021 - DNA, 20 bp, Homo sapiens
tgcagctggtttcacaggga

SEQ ID NO: 7369022 - DNA, 19 bp, Homo sapiens
tgcagctgtatgagcttaa

SEQ ID NO: 7369023 - DNA, 19 bp, Homo sapiens
tgcagctgtctctatatta

SEQ ID NO: 7369024 - DNA, 22 bp, Homo sapiens
tgcagctgtaacagaggcctca

SEQ ID NO: 7369025 - DNA, 22 bp, Homo sapiens
tgcagctgtgcctgaaaagtac

SEQ ID NO: 7369026 - DNA, 22 bp, Homo sapiens
tgcagctgtgaaagggaaccaa

SEQ ID NO: 7369027 - DNA, 22 bp, Homo sapiens
tgcagctgtgggagaatctctg

SEQ ID NO: 7369028 - DNA, 22 bp, Homo sapiens
tgcagctgttacggaccctgtc

SEQ ID NO: 7369029 - DNA, 22 bp, Homo sapiens
tgcagctgttacggaccctgtc

SEQ ID NO: 7369030 - DNA, 22 bp, Homo sapiens
tgcaggagacataatagggact

SEQ ID NO: 7369031 - DNA, 22 bp, Homo sapiens
tgcaggagagtgagtcagtagg

SEQ ID NO: 7369032 - DNA, 22 bp, Homo sapiens
tgcaggagagtgagtcagtagg

SEQ ID NO: 7369033 - DNA, 22 bp, Homo sapiens
tgcaggagagctggtctggccc

SEQ ID NO: 7369034 - DNA, 22 bp, Homo sapiens
tgcaggagagctggtctggccc

SEQ ID NO: 7369035 - DNA, 22 bp, Homo sapiens
tgcaggagcagagatggctgga

SEQ ID NO: 7369036 - DNA, 22 bp, Homo sapiens
tgcaggagcagagatggctgga

SEQ ID NO: 7369037 - DNA, 22 bp, Homo sapiens
tgcaggagcaccagctcaccct

SEQ ID NO: 7369038 - DNA, 18 bp, Homo sapiens
tgcaggagtgaccccggc

SEQ ID NO: 7369039 - DNA, 21 bp, Homo sapiens
tgcaggagtctgtgagtcagg

SEQ ID NO: 7369040 - DNA, 22 bp, Homo sapiens
tgcaggagttaagtgctctcct

SEQ ID NO: 7369041 - DNA, 22 bp, Homo sapiens
tgcaggagttaagtgctctcct

SEQ ID NO: 7369042 - DNA, 22 bp, Homo sapiens
tgcaggagttcccctctgcctg

SEQ ID NO: 7369043 - DNA, 21 bp, Homo sapiens
tgcaggattccaggtcagtat

SEQ ID NO: 7369044 - DNA, 22 bp, Homo sapiens
tgcaggcaccattctgcctctc

SEQ ID NO: 7369045 - DNA, 22 bp, Homo sapiens
tgcaggcagctgaaaggtgcct

SEQ ID NO: 7369046 - DNA, 22 bp, Homo sapiens
tgcaggaggccccatggaaccg

SEQ ID NO: 7369047 - DNA, 22 bp, Homo sapiens
tgcaggaggctttattcaggat

SEQ ID NO: 7369048 - DNA, 22 bp, Homo sapiens
tgcaggaggattttgtggagct

SEQ ID NO: 7369049 - DNA, 22 bp, Homo sapiens
tgcaggagtccaatcaggagac

SEQ ID NO: 7369050 - DNA, 22 bp, Homo sapiens
tgcaggagggagggttacagtt

SEQ ID NO: 7369051 - DNA, 22 bp, Homo sapiens
tgcaggagggagggttacagtt

SEQ ID NO: 7369052 - DNA, 22 bp, Homo sapiens
tgcaggagtccaatcaggagac

SEQ ID NO: 7369053 - DNA, 22 bp, Homo sapiens
tgcaggagtccaatcaggagac

SEQ ID NO: 7369054 - DNA, 22 bp, Homo sapiens
tgcaggagctgctgtcctgctc

SEQ ID NO: 7369055 - DNA, 22 bp, Homo sapiens
tgcaggagctgctgtcctgctc

SEQ ID NO: 7369056 - DNA, 22 bp, Homo sapiens
tgcaggagctgtgcggtgaggg

SEQ ID NO: 7369057 - DNA, 22 bp, Homo sapiens
tgcaggagcttggctctgtccc

SEQ ID NO: 7369058 - DNA, 19 bp, Homo sapiens
tgcaggaggactgagcaga

SEQ ID NO: 7369059 - DNA, 19 bp, Homo sapiens
tgcaggaggactgagcaga

SEQ ID NO: 7369060 - DNA, 22 bp, Homo sapiens
tgcagcaagtaaccatcttcct

SEQ ID NO: 7369061 - DNA, 20 bp, Homo sapiens
tgcagcacgggccctttcca

SEQ ID NO: 7369062 - DNA, 22 bp, Homo sapiens
tgcagcaccacacctggctaat

SEQ ID NO: 7369063 - DNA, 20 bp, Homo sapiens
tgcagcagaagcccatgctc

SEQ ID NO: 7369064 - DNA, 21 bp, Homo sapiens
tgcagcagaagtctctgtgtc

SEQ ID NO: 7369065 - DNA, 21 bp, Homo sapiens
tgcagcagaagtctctgtgtc

SEQ ID NO: 7369066 - DNA, 22 bp, Homo sapiens
tgcagcagaagtgttcttctct

SEQ ID NO: 7369067 - DNA, 22 bp, Homo sapiens
tgcagagggaaaaggtgctcct

SEQ ID NO: 7369068 - DNA, 22 bp, Homo sapiens
tgcagagggacagccacagctc

SEQ ID NO: 7369069 - DNA, 22 bp, Homo sapiens
tgcagagggacagccacagctc

SEQ ID NO: 7369070 - DNA, 23 bp, Homo sapiens
tgcagagggactgaagccagctt

SEQ ID NO: 7369071 - DNA, 23 bp, Homo sapiens
tgcagagggactgaagccagctt

SEQ ID NO: 7369072 - DNA, 22 bp, Homo sapiens
tgcagagggagtgacggttcac

SEQ ID NO: 7369073 - DNA, 19 bp, Homo sapiens
tgcagagggtaggaaggcc

SEQ ID NO: 7369074 - DNA, 19 bp, Homo sapiens
tgcagagggtaggaaggcc

SEQ ID NO: 7369075 - DNA, 22 bp, Homo sapiens
tgcagaggagctggaaggctgg

SEQ ID NO: 7369076 - DNA, 22 bp, Homo sapiens
tgcagaggaccattgtcctgga

SEQ ID NO: 7369077 - DNA, 22 bp, Homo sapiens
tgcagaggcatttattgatgta

SEQ ID NO: 7369078 - DNA, 22 bp, Homo sapiens
tgcagaggcccagcggttcttc

SEQ ID NO: 7369079 - DNA, 23 bp, Homo sapiens
tgcagaggcatgatcactgctca

SEQ ID NO: 7369080 - DNA, 21 bp, Homo sapiens
tgcagaggcacaaacaagccc

SEQ ID NO: 7369081 - DNA, 22 bp, Homo sapiens
tgcagaggctggctcgccgggt

SEQ ID NO: 7369082 - DNA, 22 bp, Homo sapiens
tgcagaggcgccgtgggtgggg

SEQ ID NO: 7369083 - DNA, 22 bp, Homo sapiens
tgcagaggagctggaaggctgg

SEQ ID NO: 7369084 - DNA, 22 bp, Homo sapiens
tgcagaggagctggaaggctgg

SEQ ID NO: 7369085 - DNA, 22 bp, Homo sapiens
tgcagaggagtcagcctgggca

SEQ ID NO: 7369086 - DNA, 22 bp, Homo sapiens
tgcacaggtgagactcaggaag

SEQ ID NO: 7369087 - DNA, 22 bp, Homo sapiens
tgcacagtatgtggtcctttgt

SEQ ID NO: 7369088 - DNA, 22 bp, Homo sapiens
tgcacagtaaacatgactggag

SEQ ID NO: 7369089 - DNA, 22 bp, Homo sapiens
tgcacatggcaatgctgctccc

SEQ ID NO: 7369090 - DNA, 22 bp, Homo sapiens
tgcacatggcctgagtgcctga

SEQ ID NO: 7369091 - DNA, 22 bp, Homo sapiens
tgcacatggcaatgctgctccc

SEQ ID NO: 7369092 - DNA, 22 bp, Homo sapiens
tgcacatgtgcctgtggcacat

SEQ ID NO: 7369093 - DNA, 22 bp, Homo sapiens
tgcaccacccgtgggaggactg

SEQ ID NO: 7369094 - DNA, 22 bp, Homo sapiens
tgcaccctcatcagtcaaatgg

SEQ ID NO: 7369095 - DNA, 22 bp, Homo sapiens
tgcacccatagcacacactcct

SEQ ID NO: 7369096 - DNA, 22 bp, Homo sapiens
tgcacacagtggacaagtcttg

SEQ ID NO: 7369097 - DNA, 23 bp, Homo sapiens
tgcacaggacggccttataagta

SEQ ID NO: 7369098 - DNA, 20 bp, Homo sapiens
tgcacagggtgggaagcaac

SEQ ID NO: 7369099 - DNA, 22 bp, Homo sapiens
tgcacaggccttgaagggagag

SEQ ID NO: 7369100 - DNA, 22 bp, Homo sapiens
tgcacagggagggggccagctc

SEQ ID NO: 7369101 - DNA, 21 bp, Homo sapiens
tgcacagggcccaggagagcc

SEQ ID NO: 7369102 - DNA, 22 bp, Homo sapiens
tgcacagggagggggccagctc

SEQ ID NO: 7369103 - DNA, 22 bp, Homo sapiens
tgcagaagaatgtaggcataag

SEQ ID NO: 7369104 - DNA, 22 bp, Homo sapiens
tgcagaagaatgtaggcataag

SEQ ID NO: 7369105 - DNA, 22 bp, Homo sapiens
tgcagaagaatgtaggcataag

SEQ ID NO: 7369106 - DNA, 22 bp, Homo sapiens
tgcagaagacacaaggtaacgt

SEQ ID NO: 7369107 - DNA, 19 bp, Homo sapiens
tgcagaagacacagtggtg

SEQ ID NO: 7369108 - DNA, 20 bp, Homo sapiens
tgcagaagaacgttctggtt

SEQ ID NO: 7369109 - DNA, 22 bp, Homo sapiens
tgcagaaggcctgacattgcac

SEQ ID NO: 7369110 - DNA, 22 bp, Homo sapiens
tgcagaagtgagtcatgaggaa

SEQ ID NO: 7369111 - DNA, 22 bp, Homo sapiens
tgcagaagtattccaggcccca

SEQ ID NO: 7369112 - DNA, 22 bp, Homo sapiens
tgcagaaggaggaggaaatcca

SEQ ID NO: 7369113 - DNA, 22 bp, Homo sapiens
tgcagaagctgcaggtcagtgg

SEQ ID NO: 7369114 - DNA, 22 bp, Homo sapiens
tgcagaagatggtctgagcacc

SEQ ID NO: 7369115 - DNA, 22 bp, Homo sapiens
tgcagaagatggtctgagcacc

SEQ ID NO: 7369116 - DNA, 22 bp, Homo sapiens
tgcagaagaccttccagggctg

SEQ ID NO: 7369117 - DNA, 22 bp, Homo sapiens
tgcagaagcagagagttgccaa

SEQ ID NO: 7369118 - DNA, 22 bp, Homo sapiens
tgcagaagcagagccggtggcc

SEQ ID NO: 7369119 - DNA, 22 bp, Homo sapiens
tgcagaaacaagccatcattca

SEQ ID NO: 7369120 - DNA, 22 bp, Homo sapiens
tgcagaaacaagccatcattca

SEQ ID NO: 7369121 - DNA, 22 bp, Homo sapiens
tgcactactgtgatacacagcc

SEQ ID NO: 7369122 - DNA, 22 bp, Homo sapiens
tgcagaaataactcatattgca

SEQ ID NO: 7369123 - DNA, 22 bp, Homo sapiens
tgcagaaataactcatattgca

SEQ ID NO: 7369124 - DNA, 22 bp, Homo sapiens
tgcaagtaaccatcactatctc

SEQ ID NO: 7369125 - DNA, 22 bp, Homo sapiens
tgcaagcaatccaggaaggcta

SEQ ID NO: 7369126 - DNA, 22 bp, Homo sapiens
tgcacacagctgggcctggctg

SEQ ID NO: 7369127 - DNA, 22 bp, Homo sapiens
tgcacacactctgcatatactt

SEQ ID NO: 7369128 - DNA, 19 bp, Homo sapiens
tgcacacagataagtatct

SEQ ID NO: 7369129 - DNA, 22 bp, Homo sapiens
tgcacacacatgaagtagcatg

SEQ ID NO: 7369130 - DNA, 22 bp, Homo sapiens
tgcacacacatgcagagggaga

SEQ ID NO: 7369131 - DNA, 22 bp, Homo sapiens
tgcacacacacgtagagaaaag

SEQ ID NO: 7369132 - DNA, 22 bp, Homo sapiens
tgcacacacggagataggcttt

SEQ ID NO: 7369133 - DNA, 22 bp, Homo sapiens
tgcacaagtcagagtaacattt

SEQ ID NO: 7369134 - DNA, 22 bp, Homo sapiens
tgcacaaacacagagaatagat

SEQ ID NO: 7369135 - DNA, 22 bp, Homo sapiens
tgcaatttggggaagaaagaga

SEQ ID NO: 7369136 - DNA, 22 bp, Homo sapiens
tgcaattttaatacattagagg

SEQ ID NO: 7369137 - DNA, 22 bp, Homo sapiens
tgcaatctcggcactttgggag

SEQ ID NO: 7369138 - DNA, 22 bp, Homo sapiens
tgcaattaatttacatgcttaa

SEQ ID NO: 7369139 - DNA, 22 bp, Homo sapiens
tgcaattagcgtattagtttat

SEQ ID NO: 7369140 - DNA, 22 bp, Homo sapiens
tgcaatttcaaatatcagaaag

SEQ ID NO: 7369141 - DNA, 22 bp, Homo sapiens
tgcaatttgacgtcagcacagt

SEQ ID NO: 7369142 - DNA, 22 bp, Homo sapiens
tgcaatttggggaagaaagaga

SEQ ID NO: 7369143 - DNA, 22 bp, Homo sapiens
tgcaatttcaaatatcagaaag

SEQ ID NO: 7369144 - DNA, 22 bp, Homo sapiens
tgcaaacaggagagtaagtata

SEQ ID NO: 7369145 - DNA, 22 bp, Homo sapiens
tgcaaacagccttgaaagaggg

SEQ ID NO: 7369146 - DNA, 22 bp, Homo sapiens
tgcaaacaggcatttcacaaac

SEQ ID NO: 7369147 - DNA, 22 bp, Homo sapiens
tgcaaagaaaacactgcaagac

SEQ ID NO: 7369148 - DNA, 23 bp, Homo sapiens
tgcaaagaaatctgggtcattgt

SEQ ID NO: 7369149 - DNA, 22 bp, Homo sapiens
tgcaaacaatttcctataaagt

SEQ ID NO: 7369150 - DNA, 23 bp, Homo sapiens
tgcaaaatttgcagagttcgatg

SEQ ID NO: 7369151 - DNA, 22 bp, Homo sapiens
tgcaaacagaaaagctactttg

SEQ ID NO: 7369152 - DNA, 20 bp, Homo sapiens
tgcaaacacagagtgtatga

SEQ ID NO: 7369153 - DNA, 22 bp, Homo sapiens
tgcaaatgagttgcagatcagg

SEQ ID NO: 7369154 - DNA, 22 bp, Homo sapiens
tgcaaatgcccatttattttct

SEQ ID NO: 7369155 - DNA, 22 bp, Homo sapiens
tgcaaagaaggggaggaggatt

SEQ ID NO: 7369156 - DNA, 22 bp, Homo sapiens
tgcaaagaagggctgaggagca

SEQ ID NO: 7369157 - DNA, 22 bp, Homo sapiens
tgcaaagatatgagaagctgta

SEQ ID NO: 7369158 - DNA, 22 bp, Homo sapiens
tgcaaatgggcatctccaagtg

SEQ ID NO: 7369159 - DNA, 22 bp, Homo sapiens
tgcaaatgggcatctccaagtg

SEQ ID NO: 7369160 - DNA, 22 bp, Homo sapiens
tgcaaattgcatgatgtgtatc

SEQ ID NO: 7369161 - DNA, 22 bp, Homo sapiens
tgattttctccattgtaaattc

SEQ ID NO: 7369162 - DNA, 22 bp, Homo sapiens
tgatttttagctattctgaaga

SEQ ID NO: 7369163 - DNA, 22 bp, Homo sapiens
tgcaaaagaatatagatattgt

SEQ ID NO: 7369164 - DNA, 22 bp, Homo sapiens
tgcaaaagaatatagatattgt

SEQ ID NO: 7369165 - DNA, 22 bp, Homo sapiens
tgcaaaaattgctggaatcttt

SEQ ID NO: 7369166 - DNA, 22 bp, Homo sapiens
tgcaaaaattgctggaatcttt

SEQ ID NO: 7369167 - DNA, 22 bp, Homo sapiens
tgcaaaaacagccttgaggcct

SEQ ID NO: 7369168 - DNA, 22 bp, Homo sapiens
tgcaaaaactgcaattgctttt

SEQ ID NO: 7369169 - DNA, 22 bp, Homo sapiens
tgatttatgcattatactgttg

SEQ ID NO: 7369170 - DNA, 22 bp, Homo sapiens
tgatttcatagtatatacatga

SEQ ID NO: 7369171 - DNA, 22 bp, Homo sapiens
tgatttatgaccaagttagaat

SEQ ID NO: 7369172 - DNA, 22 bp, Homo sapiens
tgatttacttctggataaatcc

SEQ ID NO: 7369173 - DNA, 22 bp, Homo sapiens
tgatttaaaagaaacattgtct

SEQ ID NO: 7369174 - DNA, 22 bp, Homo sapiens
tgatttaaaagaaacattgtct

SEQ ID NO: 7369175 - DNA, 22 bp, Homo sapiens
tgatttacacacctatgattta

SEQ ID NO: 7369176 - DNA, 22 bp, Homo sapiens
tgattgtataggggttattaat

SEQ ID NO: 7369177 - DNA, 22 bp, Homo sapiens
tgattgtatgattgaaatattt

SEQ ID NO: 7369178 - DNA, 22 bp, Homo sapiens
tgattaaattaattaagatgag

SEQ ID NO: 7369179 - DNA, 22 bp, Homo sapiens
tgatgtcaggcaagatacttaa

SEQ ID NO: 7369180 - DNA, 22 bp, Homo sapiens
tgattaaaggtggaaggcaggt

SEQ ID NO: 7369181 - DNA, 22 bp, Homo sapiens
tgattaaaatttaacttagtta

SEQ ID NO: 7369182 - DNA, 22 bp, Homo sapiens
tgattaaaatttaacttagtta

SEQ ID NO: 7369183 - DNA, 22 bp, Homo sapiens
tgatgcaatcctttagaagtaa

SEQ ID NO: 7369184 - DNA, 22 bp, Homo sapiens
tgatgcttcacgctgaatatgc

SEQ ID NO: 7369185 - DNA, 22 bp, Homo sapiens
tgatggagcatgtgtgcttcct

SEQ ID NO: 7369186 - DNA, 22 bp, Homo sapiens
tgatggaggacccagcgtggga

SEQ ID NO: 7369187 - DNA, 22 bp, Homo sapiens
tgatggaggacccagcgtggga

SEQ ID NO: 7369188 - DNA, 18 bp, Homo sapiens
tgatggaggagggctggt

SEQ ID NO: 7369189 - DNA, 22 bp, Homo sapiens
tgatggtattaggaggtgaggc

SEQ ID NO: 7369190 - DNA, 22 bp, Homo sapiens
tgagttataatgaatatttgaa

SEQ ID NO: 7369191 - DNA, 22 bp, Homo sapiens
tgagttatatatactggctctg

SEQ ID NO: 7369192 - DNA, 22 bp, Homo sapiens
tgagttataacatattcgtagt

SEQ ID NO: 7369193 - DNA, 22 bp, Homo sapiens
tgagttataatgaatatttgaa

SEQ ID NO: 7369194 - DNA, 22 bp, Homo sapiens
tgagttattgcagcttcctcct

SEQ ID NO: 7369195 - DNA, 22 bp, Homo sapiens
tgagtgtatatgaaggttgtaa

SEQ ID NO: 7369196 - DNA, 22 bp, Homo sapiens
tgagtgagacatcctgtcttaa

SEQ ID NO: 7369197 - DNA, 22 bp, Homo sapiens
tgagtgatgagcatgattttag

SEQ ID NO: 7369198 - DNA, 22 bp, Homo sapiens
tgatatttaagcaaaaatatgg

SEQ ID NO: 7369199 - DNA, 22 bp, Homo sapiens
tgagttctgactgtgatgccag

SEQ ID NO: 7369200 - DNA, 22 bp, Homo sapiens
tgatacatgattggtatggcga

SEQ ID NO: 7369201 - DNA, 22 bp, Homo sapiens
tgatataagaagtagtatggat

SEQ ID NO: 7369202 - DNA, 22 bp, Homo sapiens
tgatataagaagtagtatggat

SEQ ID NO: 7369203 - DNA, 22 bp, Homo sapiens
tgatagtattggtgatttatag

SEQ ID NO: 7369204 - DNA, 22 bp, Homo sapiens
tgatagtattggtgatttatag

SEQ ID NO: 7369205 - DNA, 22 bp, Homo sapiens
tgatagtatctgattatttcac

SEQ ID NO: 7369206 - DNA, 22 bp, Homo sapiens
tgatagaaaggaaattaattgg

SEQ ID NO: 7369207 - DNA, 22 bp, Homo sapiens
tgatagaagcagaagcatacca

SEQ ID NO: 7369208 - DNA, 22 bp, Homo sapiens
tgatcagcatcttcccagctcg

SEQ ID NO: 7369209 - DNA, 22 bp, Homo sapiens
tgatcaaaacattactccacca

SEQ ID NO: 7369210 - DNA, 22 bp, Homo sapiens
tgcaggtacttgacaacttggg

SEQ ID NO: 7369211 - DNA, 22 bp, Homo sapiens
tgcaggtgtgggcaggggagca

SEQ ID NO: 7369212 - DNA, 23 bp, Homo sapiens
tgcagtgtttaacaatgacttga

SEQ ID NO: 7369213 - DNA, 22 bp, Homo sapiens
tgcagtgtagaaaaagagtgag

SEQ ID NO: 7369214 - DNA, 22 bp, Homo sapiens
tgcagtggttgagagcccagac

SEQ ID NO: 7369215 - DNA, 22 bp, Homo sapiens
tgcagtggtgtccaggtgtact

SEQ ID NO: 7369216 - DNA, 21 bp, Homo sapiens
tgcagtatgtatttgtatcca

SEQ ID NO: 7369217 - DNA, 22 bp, Homo sapiens
tgcataaacagatacttcatgt

SEQ ID NO: 7369218 - DNA, 22 bp, Homo sapiens
tgcataaaatatgagaaatgta

SEQ ID NO: 7369219 - DNA, 22 bp, Homo sapiens
tgcataaaatatgagaaatgta

SEQ ID NO: 7369220 - DNA, 22 bp, Homo sapiens
tgcataaaatatgagaaatgta

SEQ ID NO: 7369221 - DNA, 21 bp, Homo sapiens
tgcataaagaaatacaaatac

SEQ ID NO: 7369222 - DNA, 19 bp, Homo sapiens
tgcataaattatatacttt

SEQ ID NO: 7369223 - DNA, 22 bp, Homo sapiens
tgcataaaaaccacatacaagg

SEQ ID NO: 7369224 - DNA, 22 bp, Homo sapiens
tgcataaaacaccagcagggtg

SEQ ID NO: 7369225 - DNA, 22 bp, Homo sapiens
tgcagttttccttcaacattgt

SEQ ID NO: 7369226 - DNA, 22 bp, Homo sapiens
tgcagttttatcacatatatag

SEQ ID NO: 7369227 - DNA, 18 bp, Homo sapiens
tgcatatactgcctatct

SEQ ID NO: 7369228 - DNA, 18 bp, Homo sapiens
tgcatatactgcctatct

SEQ ID NO: 7369229 - DNA, 22 bp, Homo sapiens
tgcatctgattctcaggcagaa

SEQ ID NO: 7369230 - DNA, 19 bp, Homo sapiens
tgcataaattatatacttt

SEQ ID NO: 7369231 - DNA, 22 bp, Homo sapiens
tgcatacacaagcatacatgta

SEQ ID NO: 7369232 - DNA, 19 bp, Homo sapiens
tgcatacatgttaacatgt

SEQ ID NO: 7369233 - DNA, 22 bp, Homo sapiens
tgcatatacccgcatttacata

SEQ ID NO: 7369234 - DNA, 22 bp, Homo sapiens
tgcatgtgtgacaaggacagtt

SEQ ID NO: 7369235 - DNA, 22 bp, Homo sapiens
tgcatgtacgcgtgtgcacata

SEQ ID NO: 7369236 - DNA, 22 bp, Homo sapiens
tgcatggaggaagatgaatgca

SEQ ID NO: 7369237 - DNA, 22 bp, Homo sapiens
tgcatgtatgtaaatgtgagcg

SEQ ID NO: 7369238 - DNA, 22 bp, Homo sapiens
tgcatgctctgtagaaagcagg

SEQ ID NO: 7369239 - DNA, 22 bp, Homo sapiens
tgcatgctctgtagaaagcagg

SEQ ID NO: 7369240 - DNA, 21 bp, Homo sapiens
tgcatgctcataggaaaatag

SEQ ID NO: 7369241 - DNA, 22 bp, Homo sapiens
tgcatgctttattttcatgtgt

SEQ ID NO: 7369242 - DNA, 23 bp, Homo sapiens
tgcatgctaacacagtgcacagg

SEQ ID NO: 7369243 - DNA, 22 bp, Homo sapiens
tgcatctttttccaagtttatt

SEQ ID NO: 7369244 - DNA, 22 bp, Homo sapiens
tgcatttaagaaaacatgagtc

SEQ ID NO: 7369245 - DNA, 22 bp, Homo sapiens
tgcatttaagaaaacatgagtc

SEQ ID NO: 7369246 - DNA, 22 bp, Homo sapiens
tgcatttacctggaggtcattt

SEQ ID NO: 7369247 - DNA, 22 bp, Homo sapiens
tgcattggaaactcagcagcac

SEQ ID NO: 7369248 - DNA, 22 bp, Homo sapiens
tgcattgggttgacatactaaa

SEQ ID NO: 7369249 - DNA, 23 bp, Homo sapiens
tgccaaagtttacctaacactgg

SEQ ID NO: 7369250 - DNA, 22 bp, Homo sapiens
tgccaaatgccaccacagctgc

SEQ ID NO: 7369251 - DNA, 22 bp, Homo sapiens
tgccaaaatggccaaaagctag

SEQ ID NO: 7369252 - DNA, 22 bp, Homo sapiens
tgcattttcttccaccaatatc

SEQ ID NO: 7369253 - DNA, 22 bp, Homo sapiens
tgcatttattaccaggctttca

SEQ ID NO: 7369254 - DNA, 22 bp, Homo sapiens
tgcatttagttttaataaagga

SEQ ID NO: 7369255 - DNA, 22 bp, Homo sapiens
tgcatttagttttaataaagga

SEQ ID NO: 7369256 - DNA, 22 bp, Homo sapiens
tgcatttgaagtcagacaggct

SEQ ID NO: 7369257 - DNA, 22 bp, Homo sapiens
tgcatttgagttgggagcaggc

SEQ ID NO: 7369258 - DNA, 22 bp, Homo sapiens
tgccacagttgtttgtgctcta

SEQ ID NO: 7369259 - DNA, 22 bp, Homo sapiens
tgccaccaggagaaccagtgca

SEQ ID NO: 7369260 - DNA, 22 bp, Homo sapiens
tgccagaacagctcatctggcc

SEQ ID NO: 7369261 - DNA, 22 bp, Homo sapiens
tgccactggctcaatggtgcag

SEQ ID NO: 7369262 - DNA, 22 bp, Homo sapiens
tgccagagatttcacactgcta

SEQ ID NO: 7369263 - DNA, 23 bp, Homo sapiens
tgccagaggcagtcacagtggtg

SEQ ID NO: 7369264 - DNA, 22 bp, Homo sapiens
tgccagcaagaatagacagtaa

SEQ ID NO: 7369265 - DNA, 22 bp, Homo sapiens
tgcctgcttgtttacctactcc

SEQ ID NO: 7369266 - DNA, 22 bp, Homo sapiens
tgcctgctttctcctcaactca

SEQ ID NO: 7369267 - DNA, 22 bp, Homo sapiens
tgcctgccaatgatgcttgtgt

SEQ ID NO: 7369268 - DNA, 22 bp, Homo sapiens
tgcctgcatcttggaggcccca

SEQ ID NO: 7369269 - DNA, 17 bp, Homo sapiens
tgcctgccagcattgga

SEQ ID NO: 7369270 - DNA, 22 bp, Homo sapiens
tgcctggatggctctgagcagg

SEQ ID NO: 7369271 - DNA, 22 bp, Homo sapiens
tgcctggcaatgccagaagcca

SEQ ID NO: 7369272 - DNA, 22 bp, Homo sapiens
tgcctggcaactgtggtgggct

SEQ ID NO: 7369273 - DNA, 22 bp, Homo sapiens
tgcctggcaccccagtctgcac

SEQ ID NO: 7369274 - DNA, 22 bp, Homo sapiens
tgcctggcacagagcaggtggc

SEQ ID NO: 7369275 - DNA, 22 bp, Homo sapiens
tgcctggcacagagcaggtggc

SEQ ID NO: 7369276 - DNA, 19 bp, Homo sapiens
tgcctggcaccagctccac

SEQ ID NO: 7369277 - DNA, 22 bp, Homo sapiens
tgcctggcactcctggagctca

SEQ ID NO: 7369278 - DNA, 22 bp, Homo sapiens
tgcctgagtgatgtggcagcca

SEQ ID NO: 7369279 - DNA, 22 bp, Homo sapiens
tgcctgagtttaaccctcagag

SEQ ID NO: 7369280 - DNA, 22 bp, Homo sapiens
tgcctcttggagcctttcctct

SEQ ID NO: 7369281 - DNA, 22 bp, Homo sapiens
tgcctgaagaaaacttgcagca

SEQ ID NO: 7369282 - DNA, 22 bp, Homo sapiens
tgcctctgtggaaatggtggtc

SEQ ID NO: 7369283 - DNA, 22 bp, Homo sapiens
tgcctccctggcaagtctctcc

SEQ ID NO: 7369284 - DNA, 22 bp, Homo sapiens
tgcctccctggcaagtctctcc

SEQ ID NO: 7369285 - DNA, 22 bp, Homo sapiens
tgcctcaggcacctggcaggtt

SEQ ID NO: 7369286 - DNA, 22 bp, Homo sapiens
tgcctcagctgaggccgctcca

SEQ ID NO: 7369287 - DNA, 22 bp, Homo sapiens
tgcccctgacctcaggcgaagg

SEQ ID NO: 7369288 - DNA, 22 bp, Homo sapiens
tgccctggaaatgagaggtgtg

SEQ ID NO: 7369289 - DNA, 17 bp, Homo sapiens
tgccctgtgcctggtgt

SEQ ID NO: 7369290 - DNA, 22 bp, Homo sapiens
tgccctgttcacttcatggttc

SEQ ID NO: 7369291 - DNA, 22 bp, Homo sapiens
tgccctgtgggtatctgatggc

SEQ ID NO: 7369292 - DNA, 22 bp, Homo sapiens
tgcccttatgaaagaggcccaa

SEQ ID NO: 7369293 - DNA, 22 bp, Homo sapiens
tgcccttataaaggaggcctga

SEQ ID NO: 7369294 - DNA, 22 bp, Homo sapiens
tgccctttatttctggggcaga

SEQ ID NO: 7369295 - DNA, 22 bp, Homo sapiens
tgccctgtctaagctgtcagta

SEQ ID NO: 7369296 - DNA, 22 bp, Homo sapiens
tgcctcaagccctccactgcac

SEQ ID NO: 7369297 - DNA, 20 bp, Homo sapiens
tgcctataaagggccaggta

SEQ ID NO: 7369298 - DNA, 21 bp, Homo sapiens
tgcctatatgaaaggggtgtt

SEQ ID NO: 7369299 - DNA, 22 bp, Homo sapiens
tgccaggctgccctccagtctg

SEQ ID NO: 7369300 - DNA, 20 bp, Homo sapiens
tgccagggccagcagaggct

SEQ ID NO: 7369301 - DNA, 21 bp, Homo sapiens
tgccagggatttacagagcct

SEQ ID NO: 7369302 - DNA, 22 bp, Homo sapiens
tgccagggaccctgtcggccct

SEQ ID NO: 7369303 - DNA, 22 bp, Homo sapiens
tgccagggagccctgctgacca

SEQ ID NO: 7369304 - DNA, 23 bp, Homo sapiens
tgccagggccctgtgtgcaatgc

SEQ ID NO: 7369305 - DNA, 23 bp, Homo sapiens
tgccagggccctgtgtgcaatgc

SEQ ID NO: 7369306 - DNA, 22 bp, Homo sapiens
tgccagggccatagggagtcta

SEQ ID NO: 7369307 - DNA, 22 bp, Homo sapiens
tgccaggggacctagggatgtc

SEQ ID NO: 7369308 - DNA, 22 bp, Homo sapiens
tgccagggtcctgagggccttg

SEQ ID NO: 7369309 - DNA, 22 bp, Homo sapiens
tgccagggtgtcaggagagcta

SEQ ID NO: 7369310 - DNA, 22 bp, Homo sapiens
tgccaggccaatgaaggcaggg

SEQ ID NO: 7369311 - DNA, 22 bp, Homo sapiens
tgccaggccctgtgctggatgc

SEQ ID NO: 7369312 - DNA, 22 bp, Homo sapiens
tgccaggccctcccacagatta

SEQ ID NO: 7369313 - DNA, 22 bp, Homo sapiens
tgccaggcaactgcccagccat

SEQ ID NO: 7369314 - DNA, 20 bp, Homo sapiens
tgccccaggcctgcacctgc

SEQ ID NO: 7369315 - DNA, 22 bp, Homo sapiens
tgcccagcactgtgccagtcac

SEQ ID NO: 7369316 - DNA, 22 bp, Homo sapiens
tgcccagccaatttgttatgtt

SEQ ID NO: 7369317 - DNA, 22 bp, Homo sapiens
tgcccagcagggagctacctgg

SEQ ID NO: 7369318 - DNA, 22 bp, Homo sapiens
tgcccagcaataaaccagaaga

SEQ ID NO: 7369319 - DNA, 22 bp, Homo sapiens
tgcccagcacccagcatgatgc

SEQ ID NO: 7369320 - DNA, 20 bp, Homo sapiens
tgcccagcaagagtgcagtt

SEQ ID NO: 7369321 - DNA, 22 bp, Homo sapiens
tgccatttttgagtggggcctc

SEQ ID NO: 7369322 - DNA, 23 bp, Homo sapiens
tgccatttggaagttgggggtct

SEQ ID NO: 7369323 - DNA, 22 bp, Homo sapiens
tgccatgtttaaagttgaaggg

SEQ ID NO: 7369324 - DNA, 22 bp, Homo sapiens
tgccattatgacaattgaggaa

SEQ ID NO: 7369325 - DNA, 22 bp, Homo sapiens
tgccatttataaccagtggcct

SEQ ID NO: 7369326 - DNA, 22 bp, Homo sapiens
tgaaagaaacaggtatattggg

SEQ ID NO: 7369327 - DNA, 22 bp, Homo sapiens
tgaaaccattctcaggtacact

SEQ ID NO: 7369328 - DNA, 22 bp, Homo sapiens
tgaaagaagtgtcacattgcca

SEQ ID NO: 7369329 - DNA, 22 bp, Homo sapiens
tgaaagaactagcatcttcaag

SEQ ID NO: 7369330 - DNA, 22 bp, Homo sapiens
tgaaagaagccttcgaggctcg

SEQ ID NO: 7369331 - DNA, 22 bp, Homo sapiens
tgaaacaaaccagtaattttgt

SEQ ID NO: 7369332 - DNA, 19 bp, Homo sapiens
tgaaacaaacttaaaagga

SEQ ID NO: 7369333 - DNA, 22 bp, Homo sapiens
tgaaacaggcaaaactgcagat

SEQ ID NO: 7369334 - DNA, 22 bp, Homo sapiens
tgaaacagtgcttcactcagcc

SEQ ID NO: 7369335 - DNA, 22 bp, Homo sapiens
tgaaacagtattctcaaccttt

SEQ ID NO: 7369336 - DNA, 23 bp, Homo sapiens
tgaaacatttagggtagaatttc

SEQ ID NO: 7369337 - DNA, 22 bp, Homo sapiens
tgaaacatttgatgatctttgg

SEQ ID NO: 7369338 - DNA, 22 bp, Homo sapiens
tgaaacattgcactgtatgaat

SEQ ID NO: 7369339 - DNA, 22 bp, Homo sapiens
tgaaacattatagaatatttat

SEQ ID NO: 7369340 - DNA, 22 bp, Homo sapiens
tgaaacataaagttatcttcag

SEQ ID NO: 7369341 - DNA, 22 bp, Homo sapiens
tgaaaacttgacaagtgaggta

SEQ ID NO: 7369342 - DNA, 22 bp, Homo sapiens
tgaaaagtcttatattgtctga

SEQ ID NO: 7369343 - DNA, 20 bp, Homo sapiens
tgaaaaggtcaggagacatg

SEQ ID NO: 7369344 - DNA, 22 bp, Homo sapiens
tgaaaatatagttttccagact

SEQ ID NO: 7369345 - DNA, 22 bp, Homo sapiens
tgaaaatatagttttccagact

SEQ ID NO: 7369346 - DNA, 22 bp, Homo sapiens
tgaaaatttccatcagttatat

SEQ ID NO: 7369347 - DNA, 22 bp, Homo sapiens
tgaaaatttccatcagttatat

SEQ ID NO: 7369348 - DNA, 22 bp, Homo sapiens
tgaaaaaacaagttggcccatt

SEQ ID NO: 7369349 - DNA, 22 bp, Homo sapiens
tctttttatattgacaaaaggt

SEQ ID NO: 7369350 - DNA, 22 bp, Homo sapiens
tcttttgttgcctacttattaa

SEQ ID NO: 7369351 - DNA, 22 bp, Homo sapiens
tcttttgttgcctacttattaa

SEQ ID NO: 7369352 - DNA, 22 bp, Homo sapiens
tgaaaaaacaagttggcccatt

SEQ ID NO: 7369353 - DNA, 22 bp, Homo sapiens
tgaaaaaacaagttggcccatt

SEQ ID NO: 7369354 - DNA, 22 bp, Homo sapiens
tctttggaagctttcagagaag

SEQ ID NO: 7369355 - DNA, 22 bp, Homo sapiens
tctttggaaaaaatggacaatc

SEQ ID NO: 7369356 - DNA, 22 bp, Homo sapiens
tctttggcatttaggagcagga

SEQ ID NO: 7369357 - DNA, 22 bp, Homo sapiens
tctttggcatcagggccagcta

SEQ ID NO: 7369358 - DNA, 20 bp, Homo sapiens
tctttgtgtcagatggacag

SEQ ID NO: 7369359 - DNA, 22 bp, Homo sapiens
tctttgtctgaacagggacatt

SEQ ID NO: 7369360 - DNA, 22 bp, Homo sapiens
tctttggatcccaactggctgg

SEQ ID NO: 7369361 - DNA, 22 bp, Homo sapiens
tctttggatctcaaggtggcag

SEQ ID NO: 7369362 - DNA, 22 bp, Homo sapiens
tctttggaatgctagcattcta

SEQ ID NO: 7369363 - DNA, 22 bp, Homo sapiens
tcttttctagcaaatccaggag

SEQ ID NO: 7369364 - DNA, 22 bp, Homo sapiens
tctttgtgttcaggagccacgt

SEQ ID NO: 7369365 - DNA, 20 bp, Homo sapiens
tctttgtgtcagatggacag

SEQ ID NO: 7369366 - DNA, 22 bp, Homo sapiens
tcttttaaaagccctgctgtct

SEQ ID NO: 7369367 - DNA, 18 bp, Homo sapiens
tctttgtttccttcttgc

SEQ ID NO: 7369368 - DNA, 22 bp, Homo sapiens
tcttttaacctaactagcttgg

SEQ ID NO: 7369369 - DNA, 21 bp, Homo sapiens
tcttttaacaccaggaattcc

SEQ ID NO: 7369370 - DNA, 22 bp, Homo sapiens
tcttttaagcctctggcatagg

SEQ ID NO: 7369371 - DNA, 22 bp, Homo sapiens
tcttttagtaataaatatttgt

SEQ ID NO: 7369372 - DNA, 22 bp, Homo sapiens
tcttttatagtgaattttcttg

SEQ ID NO: 7369373 - DNA, 22 bp, Homo sapiens
tgaacacacacatcttaataat

SEQ ID NO: 7369374 - DNA, 22 bp, Homo sapiens
tgaacacaaatattttggggtt

SEQ ID NO: 7369375 - DNA, 22 bp, Homo sapiens
tgaaattatgcattgttgtacc

SEQ ID NO: 7369376 - DNA, 22 bp, Homo sapiens
tgaaattagaaatatgtatggg

SEQ ID NO: 7369377 - DNA, 22 bp, Homo sapiens
tgaaattatgcattgttgtacc

SEQ ID NO: 7369378 - DNA, 22 bp, Homo sapiens
tgaacattgtcacattcctagc

SEQ ID NO: 7369379 - DNA, 22 bp, Homo sapiens
tgaacattggcacaaggcagca

SEQ ID NO: 7369380 - DNA, 22 bp, Homo sapiens
tgaacatacaattattaagaac

SEQ ID NO: 7369381 - DNA, 22 bp, Homo sapiens
tgaacttgaattttggaaatac

SEQ ID NO: 7369382 - DNA, 22 bp, Homo sapiens
tgaagcaggaaccagcagcatt

SEQ ID NO: 7369383 - DNA, 22 bp, Homo sapiens
tgaagattttgtagctttcagc

SEQ ID NO: 7369384 - DNA, 20 bp, Homo sapiens
tgaagattttgtgtttagaa

SEQ ID NO: 7369385 - DNA, 22 bp, Homo sapiens
tgaagaaacgcagagaggtagg

SEQ ID NO: 7369386 - DNA, 22 bp, Homo sapiens
tgaagaataagatagatggagc

SEQ ID NO: 7369387 - DNA, 22 bp, Homo sapiens
tgaaatgctgtagagactgtat

SEQ ID NO: 7369388 - DNA, 22 bp, Homo sapiens
tgaaatgaaacagaacatatca

SEQ ID NO: 7369389 - DNA, 21 bp, Homo sapiens
tgaaatctgatgggacaaatg

SEQ ID NO: 7369390 - DNA, 22 bp, Homo sapiens
tgaaattagaaatatgtatggg

SEQ ID NO: 7369391 - DNA, 22 bp, Homo sapiens
tgaaatcagtatgtctttctca

SEQ ID NO: 7369392 - DNA, 22 bp, Homo sapiens
tgaaatacacaaatttagtaag

SEQ ID NO: 7369393 - DNA, 22 bp, Homo sapiens
tgaaataacttttgggtgagtt

SEQ ID NO: 7369394 - DNA, 22 bp, Homo sapiens
tgaaagataagttattatgtac

SEQ ID NO: 7369395 - DNA, 22 bp, Homo sapiens
tgaaagcacaagttctaacagg

SEQ ID NO: 7369396 - DNA, 22 bp, Homo sapiens
tgaaagtagcgcatttcactca

SEQ ID NO: 7369397 - DNA, 22 bp, Homo sapiens
tgaaagtatttgatttctatta

SEQ ID NO: 7369398 - DNA, 22 bp, Homo sapiens
tgaaagttaggatgtagtaatt

SEQ ID NO: 7369399 - DNA, 22 bp, Homo sapiens
tgacagtgacagccaaaggctt

SEQ ID NO: 7369400 - DNA, 22 bp, Homo sapiens
tgacagcagccacctctcaccc

SEQ ID NO: 7369401 - DNA, 22 bp, Homo sapiens
tgacagcataacactggtcttg

SEQ ID NO: 7369402 - DNA, 22 bp, Homo sapiens
tgacaggaggcttgaggccagg

SEQ ID NO: 7369403 - DNA, 22 bp, Homo sapiens
tgacaggaaacatgcagtgatt

SEQ ID NO: 7369404 - DNA, 22 bp, Homo sapiens
tgacaggcagtgctgggcatgt

SEQ ID NO: 7369405 - DNA, 22 bp, Homo sapiens
tgacaggatgatgagcaggggg

SEQ ID NO: 7369406 - DNA, 22 bp, Homo sapiens
tgacaggagggttgtggcaggg

SEQ ID NO: 7369407 - DNA, 22 bp, Homo sapiens
tgacacactgccaggcgctcgg

SEQ ID NO: 7369408 - DNA, 18 bp, Homo sapiens
tgacagaacctggagcct

SEQ ID NO: 7369409 - DNA, 16 bp, Homo sapiens
tgacagaaagatctat

SEQ ID NO: 7369410 - DNA, 22 bp, Homo sapiens
tgactcctggtatggatgacag

SEQ ID NO: 7369411 - DNA, 22 bp, Homo sapiens
tgactacaacctccacctcccg

SEQ ID NO: 7369412 - DNA, 22 bp, Homo sapiens
tgacctctgtcctgcagtctgg

SEQ ID NO: 7369413 - DNA, 22 bp, Homo sapiens
tgacctgacatgaattaaaaac

SEQ ID NO: 7369414 - DNA, 22 bp, Homo sapiens
tgacctcttgtcggagctccag

SEQ ID NO: 7369415 - DNA, 22 bp, Homo sapiens
tgacctctgtcctgcagtctgg

SEQ ID NO: 7369416 - DNA, 20 bp, Homo sapiens
tgacttcttcatgctgtact

SEQ ID NO: 7369417 - DNA, 20 bp, Homo sapiens
tgacttctgggatttgtggt

SEQ ID NO: 7369418 - DNA, 22 bp, Homo sapiens
tgactgtgccgtgcccctagga

SEQ ID NO: 7369419 - DNA, 22 bp, Homo sapiens
tgactgccgattgtccttctct

SEQ ID NO: 7369420 - DNA, 22 bp, Homo sapiens
tgactgccccttccattcctgc

SEQ ID NO: 7369421 - DNA, 22 bp, Homo sapiens
tgactgaggtttgatatatacc

SEQ ID NO: 7369422 - DNA, 21 bp, Homo sapiens
tgacatttccaatataaagcc

SEQ ID NO: 7369423 - DNA, 18 bp, Homo sapiens
tgacatttccagagtgta

SEQ ID NO: 7369424 - DNA, 22 bp, Homo sapiens
tgacatttcagatatggtattt

SEQ ID NO: 7369425 - DNA, 22 bp, Homo sapiens
tgacatttcagatatggtattt

SEQ ID NO: 7369426 - DNA, 22 bp, Homo sapiens
tgacatttatcaaagaaatggt

SEQ ID NO: 7369427 - DNA, 21 bp, Homo sapiens
tgacatttagtagcattgtca

SEQ ID NO: 7369428 - DNA, 21 bp, Homo sapiens
tgacatttagtagcattgtca

SEQ ID NO: 7369429 - DNA, 22 bp, Homo sapiens
tgacatttactattcctggtta

SEQ ID NO: 7369430 - DNA, 22 bp, Homo sapiens
tgaccctgcttcttggtgcagg

SEQ ID NO: 7369431 - DNA, 22 bp, Homo sapiens
tgacatttttataagagtcaaa

SEQ ID NO: 7369432 - DNA, 21 bp, Homo sapiens
tgacatttggattcatagtaa

SEQ ID NO: 7369433 - DNA, 22 bp, Homo sapiens
tgaccctggcctggtggcggaa

SEQ ID NO: 7369434 - DNA, 22 bp, Homo sapiens
tgaccctggcctggtggcggaa

SEQ ID NO: 7369435 - DNA, 22 bp, Homo sapiens
tgaccgaacacgtcataaatgc

SEQ ID NO: 7369436 - DNA, 22 bp, Homo sapiens
tgacatttgagagagatataca

SEQ ID NO: 7369437 - DNA, 22 bp, Homo sapiens
tgacatttcctagtgctttgtg

SEQ ID NO: 7369438 - DNA, 22 bp, Homo sapiens
tgacatttcctagtgctttgtg

SEQ ID NO: 7369439 - DNA, 22 bp, Homo sapiens
tgaatccttcgcacttagacat

SEQ ID NO: 7369440 - DNA, 22 bp, Homo sapiens
tgaatgtgatgctaaacatatg

SEQ ID NO: 7369441 - DNA, 22 bp, Homo sapiens
tgaatgtgatgctaaacatatg

SEQ ID NO: 7369442 - DNA, 19 bp, Homo sapiens
tgaattaaagattaaagtc

SEQ ID NO: 7369443 - DNA, 19 bp, Homo sapiens
tgaattaaagattaaagtc

SEQ ID NO: 7369444 - DNA, 22 bp, Homo sapiens
tgaatagatttttaacatataa

SEQ ID NO: 7369445 - DNA, 22 bp, Homo sapiens
tgaatagatggtgacagtatga

SEQ ID NO: 7369446 - DNA, 22 bp, Homo sapiens
tgaatacaggaaaatatactga

SEQ ID NO: 7369447 - DNA, 22 bp, Homo sapiens
tgaattcctaatctaaactaag

SEQ ID NO: 7369448 - DNA, 22 bp, Homo sapiens
tgaattcaggtagcacctcccc

SEQ ID NO: 7369449 - DNA, 22 bp, Homo sapiens
tgaattgaattgaattgaattg

SEQ ID NO: 7369450 - DNA, 22 bp, Homo sapiens
tgaatttaaaataaatgtagtt

SEQ ID NO: 7369451 - DNA, 21 bp, Homo sapiens
tgaatttccctctatcattct

SEQ ID NO: 7369452 - DNA, 22 bp, Homo sapiens
tgaatttggcttgaggcagata

SEQ ID NO: 7369453 - DNA, 22 bp, Homo sapiens
tgacaaatacaataagatctgt

SEQ ID NO: 7369454 - DNA, 23 bp, Homo sapiens
tgacaaagtcatctctccttctt

SEQ ID NO: 7369455 - DNA, 22 bp, Homo sapiens
tgacaaagtgaggtcttcagta

SEQ ID NO: 7369456 - DNA, 22 bp, Homo sapiens
tgaagtttttccagacaagtcc

SEQ ID NO: 7369457 - DNA, 22 bp, Homo sapiens
tgaagttttctggttgattaag

SEQ ID NO: 7369458 - DNA, 22 bp, Homo sapiens
tgaagttttactaggtgaattt

SEQ ID NO: 7369459 - DNA, 22 bp, Homo sapiens
tgaagtttggtggaaatttcct

SEQ ID NO: 7369460 - DNA, 22 bp, Homo sapiens
tgaagttttacatcctctccaa

SEQ ID NO: 7369461 - DNA, 22 bp, Homo sapiens
tgaagtttataacatagcctcc

SEQ ID NO: 7369462 - DNA, 22 bp, Homo sapiens
tgaagtttaattttggacatga

SEQ ID NO: 7369463 - DNA, 22 bp, Homo sapiens
tgaagtttaaggttagataagt

SEQ ID NO: 7369464 - DNA, 22 bp, Homo sapiens
tgaagtttcacgcgtcattcaa

SEQ ID NO: 7369465 - DNA, 22 bp, Homo sapiens
tgaagtttcctctgaggccagt

SEQ ID NO: 7369466 - DNA, 22 bp, Homo sapiens
tgaagtttcttgaatcttggag

SEQ ID NO: 7369467 - DNA, 22 bp, Homo sapiens
tgaagtttgaactgtgttgctg

SEQ ID NO: 7369468 - DNA, 22 bp, Homo sapiens
tgaaggtaatggaatctcctga

SEQ ID NO: 7369469 - DNA, 22 bp, Homo sapiens
tgaaggggttcagcatgggggt

SEQ ID NO: 7369470 - DNA, 22 bp, Homo sapiens
tgaaggctgggctcagccagct

SEQ ID NO: 7369471 - DNA, 22 bp, Homo sapiens
tgaaggctttttaaagcatttg

SEQ ID NO: 7369472 - DNA, 22 bp, Homo sapiens
tgaaggctttttaaagcatttg

SEQ ID NO: 7369473 - DNA, 22 bp, Homo sapiens
tgaaggcaactgagaaaaagca

SEQ ID NO: 7369474 - DNA, 17 bp, Homo sapiens
tgaagcgtgcctttgaa

SEQ ID NO: 7369475 - DNA, 19 bp, Homo sapiens
tgaagcgtcgctcctcttc

SEQ ID NO: 7369476 - DNA, 22 bp, Homo sapiens
tgaagcgtgacccctcacctct

SEQ ID NO: 7369477 - DNA, 22 bp, Homo sapiens
tgagccaggttttccatcattc

SEQ ID NO: 7369478 - DNA, 22 bp, Homo sapiens
tgagccaggtctcactcacctt

SEQ ID NO: 7369479 - DNA, 22 bp, Homo sapiens
tgagccaggttaagacaggagc

SEQ ID NO: 7369480 - DNA, 22 bp, Homo sapiens
tgagccagtctgtctgggtgaa

SEQ ID NO: 7369481 - DNA, 22 bp, Homo sapiens
tgagccagtggaagatggcagt

SEQ ID NO: 7369482 - DNA, 22 bp, Homo sapiens
tgagcccatgctctttctacga

SEQ ID NO: 7369483 - DNA, 22 bp, Homo sapiens
tgagcccatgtagcacttccat

SEQ ID NO: 7369484 - DNA, 22 bp, Homo sapiens
tgagccctaagggtcaagcagg

SEQ ID NO: 7369485 - DNA, 22 bp, Homo sapiens
tgagcctggagcccagatgttt

SEQ ID NO: 7369486 - DNA, 22 bp, Homo sapiens
tgagcctggagtcgtggagggg

SEQ ID NO: 7369487 - DNA, 22 bp, Homo sapiens
tgagcctgcctgcaggtgtgct

SEQ ID NO: 7369488 - DNA, 22 bp, Homo sapiens
tgagcctgcaataagcacagcc

SEQ ID NO: 7369489 - DNA, 22 bp, Homo sapiens
tgagctcatagctcttattatg

SEQ ID NO: 7369490 - DNA, 22 bp, Homo sapiens
tgagcctggttgcagtgtctgg

SEQ ID NO: 7369491 - DNA, 22 bp, Homo sapiens
tgagctggaggacaggagggta

SEQ ID NO: 7369492 - DNA, 22 bp, Homo sapiens
tgagctggtcttgagtgtagct

SEQ ID NO: 7369493 - DNA, 22 bp, Homo sapiens
tgaggaaacttacaaggcagaa

SEQ ID NO: 7369494 - DNA, 22 bp, Homo sapiens
tgagcttttaatatacaggtgt

SEQ ID NO: 7369495 - DNA, 22 bp, Homo sapiens
tgaggaaaacgtattgaaagga

SEQ ID NO: 7369496 - DNA, 22 bp, Homo sapiens
tgagccaggctccatgccacct

SEQ ID NO: 7369497 - DNA, 22 bp, Homo sapiens
tgagccaggctcaagtgatcct

SEQ ID NO: 7369498 - DNA, 22 bp, Homo sapiens
tgagccaggagtttgaggctgt

SEQ ID NO: 7369499 - DNA, 22 bp, Homo sapiens
tgagccagccttgcagctgtgc

SEQ ID NO: 7369500 - DNA, 22 bp, Homo sapiens
tgagccagcaggcctccagtgg

SEQ ID NO: 7369501 - DNA, 22 bp, Homo sapiens
tgagccaagttcacaccattgc

SEQ ID NO: 7369502 - DNA, 22 bp, Homo sapiens
tgagcattacctgaggccactg

SEQ ID NO: 7369503 - DNA, 22 bp, Homo sapiens
tgagccagataagggctcacgc

SEQ ID NO: 7369504 - DNA, 22 bp, Homo sapiens
tgagcagggagctgggctgagc

SEQ ID NO: 7369505 - DNA, 22 bp, Homo sapiens
tgagcagggactttggagtctg

SEQ ID NO: 7369506 - DNA, 22 bp, Homo sapiens
tgagcagggactttggagtctg

SEQ ID NO: 7369507 - DNA, 19 bp, Homo sapiens
tgagcacacctgtacaccc

SEQ ID NO: 7369508 - DNA, 22 bp, Homo sapiens
tgagcaagagaaactgactgta

SEQ ID NO: 7369509 - DNA, 22 bp, Homo sapiens
tgagcagagcaataggactctc

SEQ ID NO: 7369510 - DNA, 22 bp, Homo sapiens
tgagcagagcaggctgcgccct

SEQ ID NO: 7369511 - DNA, 21 bp, Homo sapiens
tgagcaccagctgcatgcccc

SEQ ID NO: 7369512 - DNA, 22 bp, Homo sapiens
tgagcacatttcacatgacagg

SEQ ID NO: 7369513 - DNA, 22 bp, Homo sapiens
tgagcagagatgactgggcatt

SEQ ID NO: 7369514 - DNA, 22 bp, Homo sapiens
tgagcagagcagtaacaggagc

SEQ ID NO: 7369515 - DNA, 22 bp, Homo sapiens
tgagcagagcagtaacaggagc

SEQ ID NO: 7369516 - DNA, 22 bp, Homo sapiens
tgagcagaggaggctgccaact

SEQ ID NO: 7369517 - DNA, 22 bp, Homo sapiens
tgagcagaggccagcacctggg

SEQ ID NO: 7369518 - DNA, 22 bp, Homo sapiens
tgagcagaggagtgacgtaggt

SEQ ID NO: 7369519 - DNA, 18 bp, Homo sapiens
tgagcagagtaaggcttt

SEQ ID NO: 7369520 - DNA, 22 bp, Homo sapiens
tgagcagagtcgctccagagtg

SEQ ID NO: 7369521 - DNA, 22 bp, Homo sapiens
tgagcagagttgtttctcctga

SEQ ID NO: 7369522 - DNA, 22 bp, Homo sapiens
tgagcagatggaggcttctgca

SEQ ID NO: 7369523 - DNA, 22 bp, Homo sapiens
tgagcaggactcactgcagcct

SEQ ID NO: 7369524 - DNA, 22 bp, Homo sapiens
tgagcagcttctgtctgaaggc

SEQ ID NO: 7369525 - DNA, 22 bp, Homo sapiens
tgagcagcaggatcttctggta

SEQ ID NO: 7369526 - DNA, 22 bp, Homo sapiens
tgagcagcccttcctccggcca

SEQ ID NO: 7369527 - DNA, 22 bp, Homo sapiens
tgagcagcaactgtccatggca

SEQ ID NO: 7369528 - DNA, 22 bp, Homo sapiens
tgagcagatttgttctaggggt

SEQ ID NO: 7369529 - DNA, 22 bp, Homo sapiens
tgagcagatgtctaacttttac

SEQ ID NO: 7369530 - DNA, 22 bp, Homo sapiens
tgagcagatgtgccaaactgta

SEQ ID NO: 7369531 - DNA, 22 bp, Homo sapiens
tgagcaggcgcagcaggaggtc

SEQ ID NO: 7369532 - DNA, 22 bp, Homo sapiens
tgagcaggcaaacaatggttat

SEQ ID NO: 7369533 - DNA, 22 bp, Homo sapiens
tgagcagggactttgagtgtag

SEQ ID NO: 7369534 - DNA, 18 bp, Homo sapiens
tgagaggctattttttgc

SEQ ID NO: 7369535 - DNA, 22 bp, Homo sapiens
tgagagggcccagagcacacca

SEQ ID NO: 7369536 - DNA, 21 bp, Homo sapiens
tgagagagtagcaggacatat

SEQ ID NO: 7369537 - DNA, 22 bp, Homo sapiens
tgagagagcctgaatctcttac

SEQ ID NO: 7369538 - DNA, 22 bp, Homo sapiens
tgagagaaacgttccttacatc

SEQ ID NO: 7369539 - DNA, 18 bp, Homo sapiens
tgagagaatgttcatgct

SEQ ID NO: 7369540 - DNA, 22 bp, Homo sapiens
tgagataatacttcttagctgg

SEQ ID NO: 7369541 - DNA, 22 bp, Homo sapiens
tgagataatcatgtgatttcat

SEQ ID NO: 7369542 - DNA, 22 bp, Homo sapiens
tgagataattaaatcaaaacct

SEQ ID NO: 7369543 - DNA, 22 bp, Homo sapiens
tgagatgctgctgtaacaaata

SEQ ID NO: 7369544 - DNA, 21 bp, Homo sapiens
tgagatgctagaaggcaggga

SEQ ID NO: 7369545 - DNA, 22 bp, Homo sapiens
tgagatgctgggaacaaggaag

SEQ ID NO: 7369546 - DNA, 22 bp, Homo sapiens
tgagatggaaggtgaggcagta

SEQ ID NO: 7369547 - DNA, 22 bp, Homo sapiens
tgagatggagttctgctcttgt

SEQ ID NO: 7369548 - DNA, 19 bp, Homo sapiens
tgagatttcttaggtgatt

SEQ ID NO: 7369549 - DNA, 22 bp, Homo sapiens
tgagatttggaaaatttgatat

SEQ ID NO: 7369550 - DNA, 22 bp, Homo sapiens
tgagattttaatattgagaaaa

SEQ ID NO: 7369551 - DNA, 20 bp, Homo sapiens
tgagatttgtattataagtc

SEQ ID NO: 7369552 - DNA, 22 bp, Homo sapiens
tgagattttcagcatcacttca

SEQ ID NO: 7369553 - DNA, 22 bp, Homo sapiens
tgagattttcctaaatataatg

SEQ ID NO: 7369554 - DNA, 22 bp, Homo sapiens
tgagatggttcacagagaaggc

SEQ ID NO: 7369555 - DNA, 22 bp, Homo sapiens
tgagatgggtgtccagggagga

SEQ ID NO: 7369556 - DNA, 22 bp, Homo sapiens
tgagatggcaacaccagctttg

SEQ ID NO: 7369557 - DNA, 22 bp, Homo sapiens
tgagatggggtcatgctttgtc

SEQ ID NO: 7369558 - DNA, 22 bp, Homo sapiens
tgagatgggtcatcaggtttgg

SEQ ID NO: 7369559 - DNA, 20 bp, Homo sapiens
tgagaaagtagagactcagg

SEQ ID NO: 7369560 - DNA, 22 bp, Homo sapiens
tgagaaatggcagcattactgg

SEQ ID NO: 7369561 - DNA, 22 bp, Homo sapiens
tgagaaatggcagcattactgg

SEQ ID NO: 7369562 - DNA, 22 bp, Homo sapiens
tgagaaatgggtctgctgaaga

SEQ ID NO: 7369563 - DNA, 22 bp, Homo sapiens
tgagaaaattactataattgtc

SEQ ID NO: 7369564 - DNA, 22 bp, Homo sapiens
tgagaaaatccagaggctagtt

SEQ ID NO: 7369565 - DNA, 22 bp, Homo sapiens
tgagaaagacagacattcctaa

SEQ ID NO: 7369566 - DNA, 22 bp, Homo sapiens
tgagaaacatatgagagatttg

SEQ ID NO: 7369567 - DNA, 22 bp, Homo sapiens
tgagacagtcaccaggcaggcc

SEQ ID NO: 7369568 - DNA, 17 bp, Homo sapiens
tgagacagggcaggccc

SEQ ID NO: 7369569 - DNA, 20 bp, Homo sapiens
tgagaagctcctgtctcctc

SEQ ID NO: 7369570 - DNA, 22 bp, Homo sapiens
tgagaatttgcatttctaacaa

SEQ ID NO: 7369571 - DNA, 22 bp, Homo sapiens
tgagaattttttgtcatgcatt

SEQ ID NO: 7369572 - DNA, 22 bp, Homo sapiens
tgagacaaaattgacagacaaa

SEQ ID NO: 7369573 - DNA, 22 bp, Homo sapiens
tgagacaatatcctttgtaacc

SEQ ID NO: 7369574 - DNA, 23 bp, Homo sapiens
tgagacactcattcatggagtat

SEQ ID NO: 7369575 - DNA, 22 bp, Homo sapiens
tgaggccacttccccacagccc

SEQ ID NO: 7369576 - DNA, 22 bp, Homo sapiens
tgaggccaggacccccagcagg

SEQ ID NO: 7369577 - DNA, 21 bp, Homo sapiens
tgaggcctctcctgggctggc

SEQ ID NO: 7369578 - DNA, 22 bp, Homo sapiens
tgaggcctcatttagggagagg

SEQ ID NO: 7369579 - DNA, 22 bp, Homo sapiens
tgaggcctcataatgagatttc

SEQ ID NO: 7369580 - DNA, 21 bp, Homo sapiens
tgaggcctgccagtctcagaa

SEQ ID NO: 7369581 - DNA, 22 bp, Homo sapiens
tgaggcctgcattgaactagaa

SEQ ID NO: 7369582 - DNA, 17 bp, Homo sapiens
tgaggcctgcatcagtg

SEQ ID NO: 7369583 - DNA, 22 bp, Homo sapiens
tgaggcctgaagcctggagcct

SEQ ID NO: 7369584 - DNA, 22 bp, Homo sapiens
tgaggcctgacagaccaagcct

SEQ ID NO: 7369585 - DNA, 18 bp, Homo sapiens
tgaggcctctgctgggcc

SEQ ID NO: 7369586 - DNA, 22 bp, Homo sapiens
tgaggcctgaagcctgaagtga

SEQ ID NO: 7369587 - DNA, 22 bp, Homo sapiens
tgaggcctcttggtatggtgtg

SEQ ID NO: 7369588 - DNA, 22 bp, Homo sapiens
tgaggcaggaggttgagaactg

SEQ ID NO: 7369589 - DNA, 22 bp, Homo sapiens
tgaggcaggaggattgcaggat

SEQ ID NO: 7369590 - DNA, 22 bp, Homo sapiens
tgaggcaggagaatggcgggaa

SEQ ID NO: 7369591 - DNA, 20 bp, Homo sapiens
tgaggcaggagaatggcatg

SEQ ID NO: 7369592 - DNA, 22 bp, Homo sapiens
tgaggcaggatgcttgcacagg

SEQ ID NO: 7369593 - DNA, 22 bp, Homo sapiens
tgaggcaggagttcaggctgcg

SEQ ID NO: 7369594 - DNA, 22 bp, Homo sapiens
tgaggcaggagttaatgtgctc

SEQ ID NO: 7369595 - DNA, 22 bp, Homo sapiens
tgaggcagttgagcttcctgag

SEQ ID NO: 7369596 - DNA, 22 bp, Homo sapiens
tgaggcagttgagcttcctgag

SEQ ID NO: 7369597 - DNA, 22 bp, Homo sapiens
tgaggccaactagggagatgga

SEQ ID NO: 7369598 - DNA, 22 bp, Homo sapiens
tgaggcagttcttacttgtatt

SEQ ID NO: 7369599 - DNA, 21 bp, Homo sapiens
tgaggcaggggtgcttttgtc

SEQ ID NO: 7369600 - DNA, 21 bp, Homo sapiens
tgaggcaggggtgcttttgtc

SEQ ID NO: 7369601 - DNA, 22 bp, Homo sapiens
tgaggcagggagtttaattgtc

SEQ ID NO: 7369602 - DNA, 23 bp, Homo sapiens
tgaggcaggcggatcacgaggtc

SEQ ID NO: 7369603 - DNA, 22 bp, Homo sapiens
tgaggcagggagagtggatatg

SEQ ID NO: 7369604 - DNA, 22 bp, Homo sapiens
tgaggcaggagaatcaccggaa

SEQ ID NO: 7369605 - DNA, 22 bp, Homo sapiens
tgaggcaggagaatcacatgaa

SEQ ID NO: 7369606 - DNA, 22 bp, Homo sapiens
tgaggcaggacttgcataaagt

SEQ ID NO: 7369607 - DNA, 22 bp, Homo sapiens
tgaggcaggactgagcgggatg

SEQ ID NO: 7369608 - DNA, 22 bp, Homo sapiens
tgaggcagctttttctgtgtgt

SEQ ID NO: 7369609 - DNA, 22 bp, Homo sapiens
tgaggcaggacatggacaactg

SEQ ID NO: 7369610 - DNA, 22 bp, Homo sapiens
tgaggcaggaagttatataatg

SEQ ID NO: 7369611 - DNA, 22 bp, Homo sapiens
tgaggcaggaatggggaaaagt

SEQ ID NO: 7369612 - DNA, 19 bp, Homo sapiens
tgaggcaagatggctctgg

SEQ ID NO: 7369613 - DNA, 22 bp, Homo sapiens
tgaggcaagctgggcccatgga

SEQ ID NO: 7369614 - DNA, 22 bp, Homo sapiens
tgaggcaaggctgaatgaaggc

SEQ ID NO: 7369615 - DNA, 22 bp, Homo sapiens
tgaggcaagggatggccccgtg

SEQ ID NO: 7369616 - DNA, 19 bp, Homo sapiens
tgaggcaagctttttcttg

SEQ ID NO: 7369617 - DNA, 22 bp, Homo sapiens
tgaggcaagtactttccctttt

SEQ ID NO: 7369618 - DNA, 22 bp, Homo sapiens
tgaggcaagtactttccctttt

SEQ ID NO: 7369619 - DNA, 21 bp, Homo sapiens
tgaggcaagtccttttatagc

SEQ ID NO: 7369620 - DNA, 22 bp, Homo sapiens
tgaggcaagtctcaatctttga

SEQ ID NO: 7369621 - DNA, 22 bp, Homo sapiens
tgaggcaattggaaattttaac

SEQ ID NO: 7369622 - DNA, 22 bp, Homo sapiens
tgaggcaatccctagggtaagg

SEQ ID NO: 7369623 - DNA, 22 bp, Homo sapiens
tgaggcaatgtccttcatcctt

SEQ ID NO: 7369624 - DNA, 22 bp, Homo sapiens
tgaggcaaaaacactgattagg

SEQ ID NO: 7369625 - DNA, 22 bp, Homo sapiens
tgaggatttctatggttctttc

SEQ ID NO: 7369626 - DNA, 22 bp, Homo sapiens
tgaggcaaaagttatgtggtag

SEQ ID NO: 7369627 - DNA, 22 bp, Homo sapiens
tgaggcaaagacaaagcagcat

SEQ ID NO: 7369628 - DNA, 22 bp, Homo sapiens
tgaggcaaagttcaagctgaaa

SEQ ID NO: 7369629 - DNA, 22 bp, Homo sapiens
tgaggcaacagaaagggccaat

SEQ ID NO: 7369630 - DNA, 17 bp, Homo sapiens
tgaggcaaccatcacta

SEQ ID NO: 7369631 - DNA, 22 bp, Homo sapiens
tgaggcaagagtttgattagag

SEQ ID NO: 7369632 - DNA, 19 bp, Homo sapiens
tgaggagcagctggttgat

SEQ ID NO: 7369633 - DNA, 22 bp, Homo sapiens
tgaggagccactctagcagtca

SEQ ID NO: 7369634 - DNA, 22 bp, Homo sapiens
tgaggatggaatgctgtgcaag

SEQ ID NO: 7369635 - DNA, 22 bp, Homo sapiens
tgaggaagttgatctcatcagt

SEQ ID NO: 7369636 - DNA, 22 bp, Homo sapiens
tgaggaagtggttgtatggttt

SEQ ID NO: 7369637 - DNA, 22 bp, Homo sapiens
tgaggaagccaaacagctacac

SEQ ID NO: 7369638 - DNA, 22 bp, Homo sapiens
tgaggcttgtctcagatggggg

SEQ ID NO: 7369639 - DNA, 22 bp, Homo sapiens
tgagggagcacacactgaagtg

SEQ ID NO: 7369640 - DNA, 22 bp, Homo sapiens
tgagggagcacacactgaagtg

SEQ ID NO: 7369641 - DNA, 22 bp, Homo sapiens
tgagggagcacacactgaagtg

SEQ ID NO: 7369642 - DNA, 22 bp, Homo sapiens
tgagggagagggcgaaaatgaa

SEQ ID NO: 7369643 - DNA, 22 bp, Homo sapiens
tgagggagagggcgaaaatgaa

SEQ ID NO: 7369644 - DNA, 22 bp, Homo sapiens
tgagggaggccctttgagcaga

SEQ ID NO: 7369645 - DNA, 22 bp, Homo sapiens
tgagggaggccctttgagcaga

SEQ ID NO: 7369646 - DNA, 22 bp, Homo sapiens
tgagggaggccctttgagcaga

SEQ ID NO: 7369647 - DNA, 22 bp, Homo sapiens
tgagggagctgacctttctgtg

SEQ ID NO: 7369648 - DNA, 22 bp, Homo sapiens
tgagggagctgacctttctgtg

SEQ ID NO: 7369649 - DNA, 22 bp, Homo sapiens
tgagggaggcctccatctgcca

SEQ ID NO: 7369650 - DNA, 22 bp, Homo sapiens
tgagggaggcctccatctgcca

SEQ ID NO: 7369651 - DNA, 22 bp, Homo sapiens
tgagggaggcctccatctgcca

SEQ ID NO: 7369652 - DNA, 20 bp, Homo sapiens
tgagggagtattgatttccc

SEQ ID NO: 7369653 - DNA, 20 bp, Homo sapiens
tgagggagtattgatttccc

SEQ ID NO: 7369654 - DNA, 22 bp, Homo sapiens
tgagggagtcatgattaaggaa

SEQ ID NO: 7369655 - DNA, 22 bp, Homo sapiens
tgagggagtcatgattaaggaa

SEQ ID NO: 7369656 - DNA, 22 bp, Homo sapiens
tgagggagttgggtgtatagga

SEQ ID NO: 7369657 - DNA, 22 bp, Homo sapiens
tgagggagttgggtgtatagga

SEQ ID NO: 7369658 - DNA, 22 bp, Homo sapiens
tgagggagtgtggatacagtag

SEQ ID NO: 7369659 - DNA, 22 bp, Homo sapiens
tgagggagtgtggatacagtag

SEQ ID NO: 7369660 - DNA, 22 bp, Homo sapiens
tgaggctgccttgggaagaggg

SEQ ID NO: 7369661 - DNA, 22 bp, Homo sapiens
tgaggctggatgggatgcctcc

SEQ ID NO: 7369662 - DNA, 21 bp, Homo sapiens
tgaggctgttgtaccagggag

SEQ ID NO: 7369663 - DNA, 22 bp, Homo sapiens
tgaggctggcaaggctggtatt

SEQ ID NO: 7369664 - DNA, 22 bp, Homo sapiens
tgaggcttccaacatgtgagaa

SEQ ID NO: 7369665 - DNA, 22 bp, Homo sapiens
tgaggcttagagaagatgggat

SEQ ID NO: 7369666 - DNA, 22 bp, Homo sapiens
tgaggcctgtcattgtcttgtt

SEQ ID NO: 7369667 - DNA, 22 bp, Homo sapiens
tgaggcctgggcacataacctc

SEQ ID NO: 7369668 - DNA, 22 bp, Homo sapiens
tgaggccttttctgtctggcta

SEQ ID NO: 7369669 - DNA, 22 bp, Homo sapiens
tgaggctcaagaatagacagta

SEQ ID NO: 7369670 - DNA, 22 bp, Homo sapiens
tgaggcctgcttggaattgaat

SEQ ID NO: 7369671 - DNA, 22 bp, Homo sapiens
tgaggcctgccctggggaagtt

SEQ ID NO: 7369672 - DNA, 22 bp, Homo sapiens
tgaggcctggactctgcatgga

SEQ ID NO: 7369673 - DNA, 22 bp, Homo sapiens
tgaggcctggagggaggagttt

SEQ ID NO: 7369674 - DNA, 22 bp, Homo sapiens
tgagtaaaaattctacatttcc

SEQ ID NO: 7369675 - DNA, 17 bp, Homo sapiens
tgagtaaagcacatggt

SEQ ID NO: 7369676 - DNA, 22 bp, Homo sapiens
tgagtaaatatttatgactaga

SEQ ID NO: 7369677 - DNA, 22 bp, Homo sapiens
tgagtctgtatgtccagattta

SEQ ID NO: 7369678 - DNA, 22 bp, Homo sapiens
tgagtattttaagttctcaatc

SEQ ID NO: 7369679 - DNA, 22 bp, Homo sapiens
tgaggtaggagggtgatcagca

SEQ ID NO: 7369680 - DNA, 22 bp, Homo sapiens
tgaggtaggaatttgtattggg

SEQ ID NO: 7369681 - DNA, 22 bp, Homo sapiens
tgaggtagctgctatttgtagt

SEQ ID NO: 7369682 - DNA, 22 bp, Homo sapiens
tgaggtagagattgtgactgta

SEQ ID NO: 7369683 - DNA, 22 bp, Homo sapiens
tgaggtagaaaaagcttgtagt

SEQ ID NO: 7369684 - DNA, 22 bp, Homo sapiens
tggaagaccagacttcccgaac

SEQ ID NO: 7369685 - DNA, 22 bp, Homo sapiens
tggaagagacacttacattcag

SEQ ID NO: 7369686 - DNA, 22 bp, Homo sapiens
tggaagaggtggaagtggcttc

SEQ ID NO: 7369687 - DNA, 22 bp, Homo sapiens
tggaagatcaaccaggattgac

SEQ ID NO: 7369688 - DNA, 19 bp, Homo sapiens
tggaagaggaagggaaata

SEQ ID NO: 7369689 - DNA, 22 bp, Homo sapiens
tggaaggagactgggaagtgtg

SEQ ID NO: 7369690 - DNA, 22 bp, Homo sapiens
tggaaggggagctggaaagggg

SEQ ID NO: 7369691 - DNA, 22 bp, Homo sapiens
tggaaggggccaggcgcggagt

SEQ ID NO: 7369692 - DNA, 19 bp, Homo sapiens
tggaatcagcaagaatatt

SEQ ID NO: 7369693 - DNA, 22 bp, Homo sapiens
tggaagtgtcctcttctgagtc

SEQ ID NO: 7369694 - DNA, 23 bp, Homo sapiens
tggaagtggcagggagacaaagc

SEQ ID NO: 7369695 - DNA, 22 bp, Homo sapiens
tggaataaaatgtcagttctta

SEQ ID NO: 7369696 - DNA, 22 bp, Homo sapiens
tggaagtgattacaatgtagta

SEQ ID NO: 7369697 - DNA, 22 bp, Homo sapiens
tggaagtgctcttctgaccaac

SEQ ID NO: 7369698 - DNA, 22 bp, Homo sapiens
tggaagtgcttgccgactgaca

SEQ ID NO: 7369699 - DNA, 22 bp, Homo sapiens
tggacaatcaatggaggtaagt

SEQ ID NO: 7369700 - DNA, 22 bp, Homo sapiens
tggacaggatagtgcagtacgc

SEQ ID NO: 7369701 - DNA, 22 bp, Homo sapiens
tggaccagcagccccagtgcct

SEQ ID NO: 7369702 - DNA, 22 bp, Homo sapiens
tggaccagggtcccagagtatg

SEQ ID NO: 7369703 - DNA, 22 bp, Homo sapiens
tggacccaccccagggcctgct

SEQ ID NO: 7369704 - DNA, 22 bp, Homo sapiens
tggacatttggaatactatatt

SEQ ID NO: 7369705 - DNA, 20 bp, Homo sapiens
tggacaggggcataggttgc

SEQ ID NO: 7369706 - DNA, 22 bp, Homo sapiens
tggacctgcgtaggtgctgggc

SEQ ID NO: 7369707 - DNA, 22 bp, Homo sapiens
tggacccaggcaggtctgtcct

SEQ ID NO: 7369708 - DNA, 22 bp, Homo sapiens
tggaccctacccggccctcggc

SEQ ID NO: 7369709 - DNA, 22 bp, Homo sapiens
tggaccctggactgccctggcc

SEQ ID NO: 7369710 - DNA, 22 bp, Homo sapiens
tggaccctgaagcaacagggag

SEQ ID NO: 7369711 - DNA, 23 bp, Homo sapiens
tggaccctgcacaccagctctac

SEQ ID NO: 7369712 - DNA, 22 bp, Homo sapiens
tggactgctttgtaatttaaaa

SEQ ID NO: 7369713 - DNA, 22 bp, Homo sapiens
tgctttaacataagatatcttt

SEQ ID NO: 7369714 - DNA, 22 bp, Homo sapiens
tgctttaacataagatatcttt

SEQ ID NO: 7369715 - DNA, 22 bp, Homo sapiens
tgcttgctctgctccaccaaga

SEQ ID NO: 7369716 - DNA, 22 bp, Homo sapiens
tgcttgctgaaaggcatttaga

SEQ ID NO: 7369717 - DNA, 22 bp, Homo sapiens
tgcttgctatgcatcctgaact

SEQ ID NO: 7369718 - DNA, 22 bp, Homo sapiens
tgcttgctccctcacactgtcc

SEQ ID NO: 7369719 - DNA, 22 bp, Homo sapiens
tgcttgctccggccggggttgc

SEQ ID NO: 7369720 - DNA, 22 bp, Homo sapiens
tgcttgctcgccgcctgctgac

SEQ ID NO: 7369721 - DNA, 22 bp, Homo sapiens
tgcttgctctccggactctaat

SEQ ID NO: 7369722 - DNA, 19 bp, Homo sapiens
tgcttgaggtgtgctagag

SEQ ID NO: 7369723 - DNA, 22 bp, Homo sapiens
tgcttcttcctccatgtgttct

SEQ ID NO: 7369724 - DNA, 22 bp, Homo sapiens
tgcttctttactataggcaatt

SEQ ID NO: 7369725 - DNA, 22 bp, Homo sapiens
tgcttctttatgatgtatgatt

SEQ ID NO: 7369726 - DNA, 22 bp, Homo sapiens
tgcttctttactataggcaatt

SEQ ID NO: 7369727 - DNA, 22 bp, Homo sapiens
tgcttcttcctccatgtgttct

SEQ ID NO: 7369728 - DNA, 22 bp, Homo sapiens
tgcttctttaaatgatagtcaa

SEQ ID NO: 7369729 - DNA, 22 bp, Homo sapiens
tgctttatggatttgtgtcctg

SEQ ID NO: 7369730 - DNA, 21 bp, Homo sapiens
tgctttatgggaaaaatgtca

SEQ ID NO: 7369731 - DNA, 22 bp, Homo sapiens
tgctttatgtggctgatactca

SEQ ID NO: 7369732 - DNA, 21 bp, Homo sapiens
tgctttatgggaaaaatgtca

SEQ ID NO: 7369733 - DNA, 22 bp, Homo sapiens
tgctttatgtggctgatactca

SEQ ID NO: 7369734 - DNA, 22 bp, Homo sapiens
tgctttatggagcccatctcat

SEQ ID NO: 7369735 - DNA, 18 bp, Homo sapiens
tgctttatgcttatataa

SEQ ID NO: 7369736 - DNA, 20 bp, Homo sapiens
tgctttatgctatactttgt

SEQ ID NO: 7369737 - DNA, 22 bp, Homo sapiens
tgctttataggggattgcaggc

SEQ ID NO: 7369738 - DNA, 22 bp, Homo sapiens
tgctttatatctctcttcttag

SEQ ID NO: 7369739 - DNA, 22 bp, Homo sapiens
tgctttatcaaagctatagtga

SEQ ID NO: 7369740 - DNA, 22 bp, Homo sapiens
tgctttatctgacttggcgctg

SEQ ID NO: 7369741 - DNA, 22 bp, Homo sapiens
tgctttatctgacttggcgctg

SEQ ID NO: 7369742 - DNA, 22 bp, Homo sapiens
tgctttatctgtgagaacctga

SEQ ID NO: 7369743 - DNA, 22 bp, Homo sapiens
tgctttataacttagtttatgg

SEQ ID NO: 7369744 - DNA, 22 bp, Homo sapiens
tgctttataaccatttctgtgg

SEQ ID NO: 7369745 - DNA, 22 bp, Homo sapiens
tgctttataacttagtttatgg

SEQ ID NO: 7369746 - DNA, 22 bp, Homo sapiens
tgctttatagacaaggaagtag

SEQ ID NO: 7369747 - DNA, 22 bp, Homo sapiens
tgctttataggggattgcaggc

SEQ ID NO: 7369748 - DNA, 22 bp, Homo sapiens
tgctttattcccttctgatgtg

SEQ ID NO: 7369749 - DNA, 22 bp, Homo sapiens
tgctttattcagtctctgccat

SEQ ID NO: 7369750 - DNA, 19 bp, Homo sapiens
tgctttctaaacacatgca

SEQ ID NO: 7369751 - DNA, 22 bp, Homo sapiens
tgctttattcgacatctggtag

SEQ ID NO: 7369752 - DNA, 22 bp, Homo sapiens
tgctttatgttatcagaagggt

SEQ ID NO: 7369753 - DNA, 22 bp, Homo sapiens
tgctttattaagagagaaattt

SEQ ID NO: 7369754 - DNA, 22 bp, Homo sapiens
tgctttattcagggtttacccc

SEQ ID NO: 7369755 - DNA, 22 bp, Homo sapiens
tgctttctgctctggaaacagg

SEQ ID NO: 7369756 - DNA, 22 bp, Homo sapiens
tggaaacacccacgcatgcata

SEQ ID NO: 7369757 - DNA, 22 bp, Homo sapiens
tggaaacactgcatgttcaccc

SEQ ID NO: 7369758 - DNA, 22 bp, Homo sapiens
tggaaacactcaagcttatatt

SEQ ID NO: 7369759 - DNA, 22 bp, Homo sapiens
tggaaacactcaagcttatatt

SEQ ID NO: 7369760 - DNA, 22 bp, Homo sapiens
tggaaacaggagaatatcttct

SEQ ID NO: 7369761 - DNA, 22 bp, Homo sapiens
tggaaacaggagaatatcttct

SEQ ID NO: 7369762 - DNA, 22 bp, Homo sapiens
tggaaacactgcatgttcaccc

SEQ ID NO: 7369763 - DNA, 22 bp, Homo sapiens
tggaaacatctctgcctttatt

SEQ ID NO: 7369764 - DNA, 22 bp, Homo sapiens
tggaaaatgtgactattctaaa

SEQ ID NO: 7369765 - DNA, 22 bp, Homo sapiens
tggaaacaaagctggatgtagt

SEQ ID NO: 7369766 - DNA, 22 bp, Homo sapiens
tggaaacaaagtcataagctca

SEQ ID NO: 7369767 - DNA, 22 bp, Homo sapiens
tggaaacaaagtcataagctca

SEQ ID NO: 7369768 - DNA, 22 bp, Homo sapiens
tgcttttaggagattaaaatta

SEQ ID NO: 7369769 - DNA, 22 bp, Homo sapiens
tgcttttagctagtaactagta

SEQ ID NO: 7369770 - DNA, 21 bp, Homo sapiens
tgctttgggaattctcagtct

SEQ ID NO: 7369771 - DNA, 22 bp, Homo sapiens
tgctttgctggcactcctggct

SEQ ID NO: 7369772 - DNA, 20 bp, Homo sapiens
tgcttttatacctataatga

SEQ ID NO: 7369773 - DNA, 22 bp, Homo sapiens
tgcttttatttaatatcttgca

SEQ ID NO: 7369774 - DNA, 22 bp, Homo sapiens
tggaaaacaaagctctcattat

SEQ ID NO: 7369775 - DNA, 22 bp, Homo sapiens
tggaaaaactgagacttagaca

SEQ ID NO: 7369776 - DNA, 22 bp, Homo sapiens
tggaaatatgctccattctttt

SEQ ID NO: 7369777 - DNA, 22 bp, Homo sapiens
tggaaatagatagtatcattca

SEQ ID NO: 7369778 - DNA, 22 bp, Homo sapiens
tggaaatagttgtgagtcaggc

SEQ ID NO: 7369779 - DNA, 22 bp, Homo sapiens
tggaaatacttgccataaaact

SEQ ID NO: 7369780 - DNA, 22 bp, Homo sapiens
tggaaatacaagaagtatgtca

SEQ ID NO: 7369781 - DNA, 23 bp, Homo sapiens
tggaaagcggacctggggcagag

SEQ ID NO: 7369782 - DNA, 22 bp, Homo sapiens
tggaaagcgaggagttggcatt

SEQ ID NO: 7369783 - DNA, 22 bp, Homo sapiens
tggaaaggacagttgctgatag

SEQ ID NO: 7369784 - DNA, 23 bp, Homo sapiens
tggaagaaaatggtttggctgtg

SEQ ID NO: 7369785 - DNA, 22 bp, Homo sapiens
tggaacgtcgtaatgttggtta

SEQ ID NO: 7369786 - DNA, 22 bp, Homo sapiens
tggaacacatctaaggaagcag

SEQ ID NO: 7369787 - DNA, 19 bp, Homo sapiens
tggaggcaagacatggagg

SEQ ID NO: 7369788 - DNA, 22 bp, Homo sapiens
tggaggcagatacactgtaaaa

SEQ ID NO: 7369789 - DNA, 22 bp, Homo sapiens
tggaggcaggtggaggagtgaa

SEQ ID NO: 7369790 - DNA, 22 bp, Homo sapiens
tggaggcctaggttgatgtgtg

SEQ ID NO: 7369791 - DNA, 22 bp, Homo sapiens
tggaggccggactgagaggcat

SEQ ID NO: 7369792 - DNA, 22 bp, Homo sapiens
tggaggccgcgtagtctgagca

SEQ ID NO: 7369793 - DNA, 22 bp, Homo sapiens
tggaggcccccaggcaacagca

SEQ ID NO: 7369794 - DNA, 22 bp, Homo sapiens
tggaggccatgccagagcccta

SEQ ID NO: 7369795 - DNA, 22 bp, Homo sapiens
tggaggcccacactgggtagat

SEQ ID NO: 7369796 - DNA, 22 bp, Homo sapiens
tggaggccagtgaaagtagatt

SEQ ID NO: 7369797 - DNA, 22 bp, Homo sapiens
tggaggcagtaactgagcaaca

SEQ ID NO: 7369798 - DNA, 22 bp, Homo sapiens
tggaggagggctggtgtctgta

SEQ ID NO: 7369799 - DNA, 22 bp, Homo sapiens
tggaggagggctggtgtctgta

SEQ ID NO: 7369800 - DNA, 22 bp, Homo sapiens
tggaggaggatgcatttgttgt

SEQ ID NO: 7369801 - DNA, 22 bp, Homo sapiens
tggaggaggaacttcttatctc

SEQ ID NO: 7369802 - DNA, 22 bp, Homo sapiens
tggaggaggaacttcttatctc

SEQ ID NO: 7369803 - DNA, 19 bp, Homo sapiens
tggaggagaggaaaagtca

SEQ ID NO: 7369804 - DNA, 22 bp, Homo sapiens
tggaggagaccgcattttattt

SEQ ID NO: 7369805 - DNA, 22 bp, Homo sapiens
tggaggagaatttatggtcgaa

SEQ ID NO: 7369806 - DNA, 22 bp, Homo sapiens
tggaggagaatttatggtcgaa

SEQ ID NO: 7369807 - DNA, 22 bp, Homo sapiens
tggaggagaccattccactcag

SEQ ID NO: 7369808 - DNA, 22 bp, Homo sapiens
tggaggagaccattccactcag

SEQ ID NO: 7369809 - DNA, 22 bp, Homo sapiens
tggaggagtagattttcagagg

SEQ ID NO: 7369810 - DNA, 22 bp, Homo sapiens
tggaggagtgtgattgtctgcc

SEQ ID NO: 7369811 - DNA, 22 bp, Homo sapiens
tggaggagtgtgattgtctgcc

SEQ ID NO: 7369812 - DNA, 22 bp, Homo sapiens
tggaggagtgtgattgtctgcc

SEQ ID NO: 7369813 - DNA, 22 bp, Homo sapiens
tggaggattaatctggaaagat

SEQ ID NO: 7369814 - DNA, 22 bp, Homo sapiens
tggaggatgcctggggaggcct

SEQ ID NO: 7369815 - DNA, 22 bp, Homo sapiens
tggaggattccacttacatgag

SEQ ID NO: 7369816 - DNA, 22 bp, Homo sapiens
tggagtgggcaatgtaggcaag

SEQ ID NO: 7369817 - DNA, 22 bp, Homo sapiens
tggataaactcactgtaagttg

SEQ ID NO: 7369818 - DNA, 22 bp, Homo sapiens
tggataaaatctgtaaggctca

SEQ ID NO: 7369819 - DNA, 22 bp, Homo sapiens
tggaggtgtccaactcgtgggt

SEQ ID NO: 7369820 - DNA, 22 bp, Homo sapiens
tggagggctctttcacctggta

SEQ ID NO: 7369821 - DNA, 22 bp, Homo sapiens
tggagggaacaaaggagtccca

SEQ ID NO: 7369822 - DNA, 22 bp, Homo sapiens
tggagggaacaaaggagtccca

SEQ ID NO: 7369823 - DNA, 22 bp, Homo sapiens
tggagggatacaaagatgaaaa

SEQ ID NO: 7369824 - DNA, 22 bp, Homo sapiens
tggagggaacccaggctgctct

SEQ ID NO: 7369825 - DNA, 20 bp, Homo sapiens
tggagggattgttggcaaat

SEQ ID NO: 7369826 - DNA, 22 bp, Homo sapiens
tggagggcatctgtggtcaggc

SEQ ID NO: 7369827 - DNA, 22 bp, Homo sapiens
tggagggcgcttagatggaggg

SEQ ID NO: 7369828 - DNA, 22 bp, Homo sapiens
tggagcccagggtgagaaggag

SEQ ID NO: 7369829 - DNA, 22 bp, Homo sapiens
tggagccaggctggccctgcca

SEQ ID NO: 7369830 - DNA, 22 bp, Homo sapiens
tggagccagtgttgcccaacac

SEQ ID NO: 7369831 - DNA, 22 bp, Homo sapiens
tggagccagtgttgcccaacac

SEQ ID NO: 7369832 - DNA, 18 bp, Homo sapiens
tggagccattgccaccat

SEQ ID NO: 7369833 - DNA, 22 bp, Homo sapiens
tggagcccagacactggcattg

SEQ ID NO: 7369834 - DNA, 18 bp, Homo sapiens
tggagccattgccaccat

SEQ ID NO: 7369835 - DNA, 22 bp, Homo sapiens
tggagcccacggatgtcgcttt

SEQ ID NO: 7369836 - DNA, 22 bp, Homo sapiens
tggagccagcccaggcccctct

SEQ ID NO: 7369837 - DNA, 22 bp, Homo sapiens
tggagccagcgagccgaggcgg

SEQ ID NO: 7369838 - DNA, 22 bp, Homo sapiens
tggagccaggctggccctgcca

SEQ ID NO: 7369839 - DNA, 22 bp, Homo sapiens
tggagccagcccaggcccctct

SEQ ID NO: 7369840 - DNA, 22 bp, Homo sapiens
tggagccagagcgcagcctggg

SEQ ID NO: 7369841 - DNA, 22 bp, Homo sapiens
tggagcaggtgctcagggtaat

SEQ ID NO: 7369842 - DNA, 22 bp, Homo sapiens
tggagcagtggtcctggagatg

SEQ ID NO: 7369843 - DNA, 22 bp, Homo sapiens
tggagcagtggtcctggagatg

SEQ ID NO: 7369844 - DNA, 22 bp, Homo sapiens
tggagcaggtgggatgtcgtga

SEQ ID NO: 7369845 - DNA, 22 bp, Homo sapiens
tggagcaggtcggcaccatttg

SEQ ID NO: 7369846 - DNA, 22 bp, Homo sapiens
tggagcaggacggggagtggta

SEQ ID NO: 7369847 - DNA, 22 bp, Homo sapiens
tggagcaggaagtctatggctg

SEQ ID NO: 7369848 - DNA, 22 bp, Homo sapiens
tggagcaggtgctcagggtaat

SEQ ID NO: 7369849 - DNA, 22 bp, Homo sapiens
tggagcaggtgccaggtgtgtg

SEQ ID NO: 7369850 - DNA, 22 bp, Homo sapiens
tggagcagctaagcctctgaga

SEQ ID NO: 7369851 - DNA, 22 bp, Homo sapiens
tggagcagctctagcgggcgcc

SEQ ID NO: 7369852 - DNA, 22 bp, Homo sapiens
tggagcagctctagcgggcgcc

SEQ ID NO: 7369853 - DNA, 22 bp, Homo sapiens
tggagcagctgaacagagttga

SEQ ID NO: 7369854 - DNA, 18 bp, Homo sapiens
tggagcaggaagcctggc

SEQ ID NO: 7369855 - DNA, 22 bp, Homo sapiens
tggagcaggaaacatctagagg

SEQ ID NO: 7369856 - DNA, 22 bp, Homo sapiens
tggagaggtttaaacaaaagtt

SEQ ID NO: 7369857 - DNA, 22 bp, Homo sapiens
tggagcagaaatttgaagccat

SEQ ID NO: 7369858 - DNA, 22 bp, Homo sapiens
tggagcagagatgggagcccaa

SEQ ID NO: 7369859 - DNA, 22 bp, Homo sapiens
tggagcagaggaagaaggcttt

SEQ ID NO: 7369860 - DNA, 22 bp, Homo sapiens
tggagcagagatggtggccttc

SEQ ID NO: 7369861 - DNA, 22 bp, Homo sapiens
tggagcagaggctgaggttggg

SEQ ID NO: 7369862 - DNA, 22 bp, Homo sapiens
tggagcagagttcagcggggag

SEQ ID NO: 7369863 - DNA, 22 bp, Homo sapiens
tggagcagccttttctaagcaa

SEQ ID NO: 7369864 - DNA, 22 bp, Homo sapiens
tggagcagccatgatgacagag

SEQ ID NO: 7369865 - DNA, 22 bp, Homo sapiens
tggagcagcatcactttgagct

SEQ ID NO: 7369866 - DNA, 22 bp, Homo sapiens
tggagcagcacaagaaagggga

SEQ ID NO: 7369867 - DNA, 22 bp, Homo sapiens
tggagcagcattcatccagcag

SEQ ID NO: 7369868 - DNA, 22 bp, Homo sapiens
tggagaatctggaaactgttga

SEQ ID NO: 7369869 - DNA, 22 bp, Homo sapiens
tggagagaagaggcagtgtgct

SEQ ID NO: 7369870 - DNA, 22 bp, Homo sapiens
tggagagaacagtgtctgaaag

SEQ ID NO: 7369871 - DNA, 22 bp, Homo sapiens
tggagagaagaggcagtgtgct

SEQ ID NO: 7369872 - DNA, 22 bp, Homo sapiens
tggagaaggacagcctgagaaa

SEQ ID NO: 7369873 - DNA, 22 bp, Homo sapiens
tggagaaggccggccaggagtg

SEQ ID NO: 7369874 - DNA, 22 bp, Homo sapiens
tgctctgtaggggaaagagagc

SEQ ID NO: 7369875 - DNA, 22 bp, Homo sapiens
tgctctgtcaagaaaagatgcc

SEQ ID NO: 7369876 - DNA, 18 bp, Homo sapiens
tgctctgtttaatgattt

SEQ ID NO: 7369877 - DNA, 22 bp, Homo sapiens
tgctgagcgcatccggcggccg

SEQ ID NO: 7369878 - DNA, 22 bp, Homo sapiens
tgctgcagggccttccctgcat

SEQ ID NO: 7369879 - DNA, 19 bp, Homo sapiens
tgctgcagtcaggcgaggg

SEQ ID NO: 7369880 - DNA, 22 bp, Homo sapiens
tgctgcagttcaccctgccgtc

SEQ ID NO: 7369881 - DNA, 20 bp, Homo sapiens
tgctgaggttgacatgccca

SEQ ID NO: 7369882 - DNA, 22 bp, Homo sapiens
tgctcctggatgaggtactcca

SEQ ID NO: 7369883 - DNA, 17 bp, Homo sapiens
tgctcctgggacaagga

SEQ ID NO: 7369884 - DNA, 22 bp, Homo sapiens
tgctctcctgctcctcagccca

SEQ ID NO: 7369885 - DNA, 22 bp, Homo sapiens
tgcctgtgtatgtgcatgcaca

SEQ ID NO: 7369886 - DNA, 22 bp, Homo sapiens
tgccttttgttagggctgccag

SEQ ID NO: 7369887 - DNA, 22 bp, Homo sapiens
tgccttttgtatgcaggccatg

SEQ ID NO: 7369888 - DNA, 22 bp, Homo sapiens
tgccttttctgtagctctggaa

SEQ ID NO: 7369889 - DNA, 22 bp, Homo sapiens
tgcctttggtttgctacatgcc

SEQ ID NO: 7369890 - DNA, 22 bp, Homo sapiens
tgcctttgcaattgaggaggat

SEQ ID NO: 7369891 - DNA, 22 bp, Homo sapiens
tgcctttataagccagcagcaa

SEQ ID NO: 7369892 - DNA, 22 bp, Homo sapiens
tgccttgtccttcgtcagggct

SEQ ID NO: 7369893 - DNA, 22 bp, Homo sapiens
tgcctttaaaaaggaagtcatt

SEQ ID NO: 7369894 - DNA, 22 bp, Homo sapiens
tgcctttaaactgatcatcagg

SEQ ID NO: 7369895 - DNA, 22 bp, Homo sapiens
tgcctttaacaagatctccaga

SEQ ID NO: 7369896 - DNA, 22 bp, Homo sapiens
tgcctttaaccagtctagacag

SEQ ID NO: 7369897 - DNA, 22 bp, Homo sapiens
tgcctttaacttaaagcatgac

SEQ ID NO: 7369898 - DNA, 22 bp, Homo sapiens
tgcctttaaggaatcattcttg

SEQ ID NO: 7369899 - DNA, 22 bp, Homo sapiens
tgcctttactataaaggatctg

SEQ ID NO: 7369900 - DNA, 22 bp, Homo sapiens
tgcctttactgattagctgtgt

SEQ ID NO: 7369901 - DNA, 22 bp, Homo sapiens
tgcctttagggaaaagcaagct

SEQ ID NO: 7369902 - DNA, 22 bp, Homo sapiens
tgcctttaggggcctctccctc

SEQ ID NO: 7369903 - DNA, 22 bp, Homo sapiens
tgcctgggttcccaccccaaag

SEQ ID NO: 7369904 - DNA, 22 bp, Homo sapiens
tgcctgtaataatgctaagcac

SEQ ID NO: 7369905 - DNA, 22 bp, Homo sapiens
tgcctggggattgctctgggcc

SEQ ID NO: 7369906 - DNA, 22 bp, Homo sapiens
tgcctggccctgacagccctgg

SEQ ID NO: 7369907 - DNA, 20 bp, Homo sapiens
tgcctggcctttctctgccc

SEQ ID NO: 7369908 - DNA, 22 bp, Homo sapiens
tgcctggctctatcagtggtgg

SEQ ID NO: 7369909 - DNA, 22 bp, Homo sapiens
tgcctggctgaggtgacaggtt

SEQ ID NO: 7369910 - DNA, 22 bp, Homo sapiens
tgctcagtgagtctgtgacagg

SEQ ID NO: 7369911 - DNA, 22 bp, Homo sapiens
tgctcatcaacatgatgatcat

SEQ ID NO: 7369912 - DNA, 22 bp, Homo sapiens
tgctcagtagcagtgtgctgct

SEQ ID NO: 7369913 - DNA, 22 bp, Homo sapiens
tgctcagtatagaaaatgatat

SEQ ID NO: 7369914 - DNA, 23 bp, Homo sapiens
tgctcagtctaaagaagaataac

SEQ ID NO: 7369915 - DNA, 22 bp, Homo sapiens
tgctcattggcgatctgaggga

SEQ ID NO: 7369916 - DNA, 22 bp, Homo sapiens
tgctcattggcgatctgaggga

SEQ ID NO: 7369917 - DNA, 22 bp, Homo sapiens
tgctccacctcccagctaacat

SEQ ID NO: 7369918 - DNA, 22 bp, Homo sapiens
tgctcacaattatcagaagtat

SEQ ID NO: 7369919 - DNA, 22 bp, Homo sapiens
tgctcagagctccagctctcct

SEQ ID NO: 7369920 - DNA, 22 bp, Homo sapiens
tgctatttttatcttgatcaaa

SEQ ID NO: 7369921 - DNA, 22 bp, Homo sapiens
tgctatttctatctcatttaaa

SEQ ID NO: 7369922 - DNA, 22 bp, Homo sapiens
tgctattattgtcaccactgta

SEQ ID NO: 7369923 - DNA, 22 bp, Homo sapiens
tgcgcccagccaagtctggcac

SEQ ID NO: 7369924 - DNA, 22 bp, Homo sapiens
tgcggaaggcagcgcagggtgg

SEQ ID NO: 7369925 - DNA, 16 bp, Homo sapiens
tgcggcaacttgcggc

SEQ ID NO: 7369926 - DNA, 22 bp, Homo sapiens
tgctaaataacttacatagtgg

SEQ ID NO: 7369927 - DNA, 22 bp, Homo sapiens
tgctaaataagtggaatagaca

SEQ ID NO: 7369928 - DNA, 22 bp, Homo sapiens
tgctggaggccagaagtctgag

SEQ ID NO: 7369929 - DNA, 22 bp, Homo sapiens
tgctggaggccgagaagcagca

SEQ ID NO: 7369930 - DNA, 22 bp, Homo sapiens
tgctggagtaacaagacactca

SEQ ID NO: 7369931 - DNA, 23 bp, Homo sapiens
tgctggagtttactcaggccagc

SEQ ID NO: 7369932 - DNA, 22 bp, Homo sapiens
tgctggagtgagtggtttctta

SEQ ID NO: 7369933 - DNA, 22 bp, Homo sapiens
tgctggctcagtttgcagactc

SEQ ID NO: 7369934 - DNA, 22 bp, Homo sapiens
tgctggccaacaaggctccaag

SEQ ID NO: 7369935 - DNA, 22 bp, Homo sapiens
tgctggctctgggccaagcagg

SEQ ID NO: 7369936 - DNA, 22 bp, Homo sapiens
tgctggctcccaggagccgctg

SEQ ID NO: 7369937 - DNA, 22 bp, Homo sapiens
tgctggctgaggcctgagcggg

SEQ ID NO: 7369938 - DNA, 23 bp, Homo sapiens
tgctggctgaaacagccaaagga

SEQ ID NO: 7369939 - DNA, 22 bp, Homo sapiens
tgctggctgccaggttccctgt

SEQ ID NO: 7369940 - DNA, 22 bp, Homo sapiens
tgctggctgtatatgtgagagt

SEQ ID NO: 7369941 - DNA, 22 bp, Homo sapiens
tgctggcttagatatcactgcc

SEQ ID NO: 7369942 - DNA, 23 bp, Homo sapiens
tgctggcttccagctgctccctc

SEQ ID NO: 7369943 - DNA, 23 bp, Homo sapiens
tgctggctgtgttattgccaaca

SEQ ID NO: 7369944 - DNA, 22 bp, Homo sapiens
tgctgctcctgcctggctccca

SEQ ID NO: 7369945 - DNA, 22 bp, Homo sapiens
tgctgcctctgctgatatggcc

SEQ ID NO: 7369946 - DNA, 22 bp, Homo sapiens
tgctgcctaacagaactctttc

SEQ ID NO: 7369947 - DNA, 22 bp, Homo sapiens
tgctgcctaataagtcgagggt

SEQ ID NO: 7369948 - DNA, 20 bp, Homo sapiens
tgctgcctactaagccctca

SEQ ID NO: 7369949 - DNA, 22 bp, Homo sapiens
tgctgcctaggaatctgtattt

SEQ ID NO: 7369950 - DNA, 22 bp, Homo sapiens
tgctgcctccttcctgccagga

SEQ ID NO: 7369951 - DNA, 22 bp, Homo sapiens
tgctgcctccaactcctgggct

SEQ ID NO: 7369952 - DNA, 22 bp, Homo sapiens
tgctgcctcaactgtcaggaac

SEQ ID NO: 7369953 - DNA, 22 bp, Homo sapiens
tgctgcctcagcttcctgggct

SEQ ID NO: 7369954 - DNA, 22 bp, Homo sapiens
tgctggagaagctcctgggact

SEQ ID NO: 7369955 - DNA, 22 bp, Homo sapiens
tgctgctgtttcctacatctca

SEQ ID NO: 7369956 - DNA, 22 bp, Homo sapiens
tgcttcatgcttctgacaatag

SEQ ID NO: 7369957 - DNA, 22 bp, Homo sapiens
tgcttattaacatgtatatctc

SEQ ID NO: 7369958 - DNA, 22 bp, Homo sapiens
tgcttattctttccacaattca

SEQ ID NO: 7369959 - DNA, 22 bp, Homo sapiens
tgcttatttaggtagatattaa

SEQ ID NO: 7369960 - DNA, 22 bp, Homo sapiens
tgcttcagagacatcctactca

SEQ ID NO: 7369961 - DNA, 22 bp, Homo sapiens
tgcttccctcacttcacctggc

SEQ ID NO: 7369962 - DNA, 22 bp, Homo sapiens
tgcttcccaaggtttcatgtgc

SEQ ID NO: 7369963 - DNA, 22 bp, Homo sapiens
tgctgtgaggttgagaaggaag

SEQ ID NO: 7369964 - DNA, 22 bp, Homo sapiens
tgcttaaaaacagtatggtagt

SEQ ID NO: 7369965 - DNA, 22 bp, Homo sapiens
tgcttaaaatagttcatttttg

SEQ ID NO: 7369966 - DNA, 22 bp, Homo sapiens
tgcttaaaatgatgattatttt

SEQ ID NO: 7369967 - DNA, 22 bp, Homo sapiens
tgcttaaaatagttcatttttg

SEQ ID NO: 7369968 - DNA, 22 bp, Homo sapiens
tgcttaaaatgatgattatttt

SEQ ID NO: 7369969 - DNA, 19 bp, Homo sapiens
tgctgtcctcagagtaagt

SEQ ID NO: 7369970 - DNA, 22 bp, Homo sapiens
tgctgtcctgctgagggatgtg

SEQ ID NO: 7369971 - DNA, 22 bp, Homo sapiens
tgctgtcccccgtgtctgggct

SEQ ID NO: 7369972 - DNA, 22 bp, Homo sapiens
tgctgtcctgttttggagtaat

SEQ ID NO: 7369973 - DNA, 22 bp, Homo sapiens
tgcttataatgttactgacaac

SEQ ID NO: 7369974 - DNA, 22 bp, Homo sapiens
tgcttataatgttactgacaac

SEQ ID NO: 7369975 - DNA, 22 bp, Homo sapiens
tgcttattaaacatgcatattc

SEQ ID NO: 7369976 - DNA, 22 bp, Homo sapiens
tgcttagctcataggaaacact

SEQ ID NO: 7369977 - DNA, 22 bp, Homo sapiens
tgcttaatcaagaagcctattt

SEQ ID NO: 7369978 - DNA, 22 bp, Homo sapiens
tgcttaataggagttgaacatt

SEQ ID NO: 7369979 - DNA, 22 bp, Homo sapiens
tgcttaaagtagtggattgtta

SEQ ID NO: 7369980 - DNA, 22 bp, Homo sapiens
tgcttaaaccctgatcatgtgt

SEQ ID NO: 7369981 - DNA, 22 bp, Homo sapiens
tgcttaaacatccagacagtat

SEQ ID NO: 7369982 - DNA, 22 bp, Homo sapiens
tgcttaaaccctgatcatgtgt

SEQ ID NO: 7369983 - DNA, 22 bp, Homo sapiens
tgcttaaacatactatttatat

SEQ ID NO: 7369984 - DNA, 22 bp, Homo sapiens
tgcttaaacatactatttatat

SEQ ID NO: 7369985 - DNA, 22 bp, Homo sapiens
tgcttaaacacatacatacata

SEQ ID NO: 7369986 - DNA, 22 bp, Homo sapiens
tgcttaaacacatacatacata

SEQ ID NO: 7369987 - DNA, 22 bp, Homo sapiens
tgctgggcatttatgcagatgg

SEQ ID NO: 7369988 - DNA, 20 bp, Homo sapiens
tgctgggccatcttgcatgc

SEQ ID NO: 7369989 - DNA, 22 bp, Homo sapiens
tgctggcttggaaggaaagcgc

SEQ ID NO: 7369990 - DNA, 22 bp, Homo sapiens
tgctggcttcctgtgcacagca

SEQ ID NO: 7369991 - DNA, 23 bp, Homo sapiens
tgctgggtaaatagctgagtaac

SEQ ID NO: 7369992 - DNA, 22 bp, Homo sapiens
tgctgtcaaggttacatgcttt

SEQ ID NO: 7369993 - DNA, 22 bp, Homo sapiens
tgctgtagccctgcacagtgca

SEQ ID NO: 7369994 - DNA, 22 bp, Homo sapiens
tgctgtagtcaaagcaaagctg

SEQ ID NO: 7369995 - DNA, 17 bp, Homo sapiens
tgctgtagctctaaagc

SEQ ID NO: 7369996 - DNA, 23 bp, Homo sapiens
tgctggtgtttttgggaccaggg

SEQ ID NO: 7369997 - DNA, 22 bp, Homo sapiens
tgctggtgattaaatcctgaag

SEQ ID NO: 7369998 - DNA, 22 bp, Homo sapiens
tggcccagtcagcaggagaggg

SEQ ID NO: 7369999 - DNA, 22 bp, Homo sapiens
tggcccagtatgtataatctta

SEQ ID NO: 7370000 - DNA, 22 bp, Homo sapiens
tggcccaggtgcacccagaggc

SEQ ID NO: 7370001 - DNA, 22 bp, Homo sapiens
tggcccaggtgcaagagacaga

SEQ ID NO: 7370002 - DNA, 22 bp, Homo sapiens
tggcccagtagaaaagggatcg

SEQ ID NO: 7370003 - DNA, 22 bp, Homo sapiens
tggcccaggtgcacccagaggc

SEQ ID NO: 7370004 - DNA, 22 bp, Homo sapiens
tggccctgaaggccttgagcat

SEQ ID NO: 7370005 - DNA, 22 bp, Homo sapiens
tggccctgaatcaaggccagca

SEQ ID NO: 7370006 - DNA, 23 bp, Homo sapiens
tggccctgaatctgtcctggagg

SEQ ID NO: 7370007 - DNA, 22 bp, Homo sapiens
tggccctgaatcaaggccagca

SEQ ID NO: 7370008 - DNA, 23 bp, Homo sapiens
tggccctgaatctgtcctggagg

SEQ ID NO: 7370009 - DNA, 17 bp, Homo sapiens
tggccctagactccagc

SEQ ID NO: 7370010 - DNA, 22 bp, Homo sapiens
tggccctatttggaaatagagc

SEQ ID NO: 7370011 - DNA, 22 bp, Homo sapiens
tggccctgaaggccttgagcat

SEQ ID NO: 7370012 - DNA, 22 bp, Homo sapiens
tggccctgcacccagagcagtt

SEQ ID NO: 7370013 - DNA, 22 bp, Homo sapiens
tggccctgcacccagagcagtt

SEQ ID NO: 7370014 - DNA, 22 bp, Homo sapiens
tggccctgcagaactagcctgg

SEQ ID NO: 7370015 - DNA, 22 bp, Homo sapiens
tggccctgccactcactgctga

SEQ ID NO: 7370016 - DNA, 22 bp, Homo sapiens
tggccctgcagaactagcctgg

SEQ ID NO: 7370017 - DNA, 22 bp, Homo sapiens
tggccctgcagaactagcctgg

SEQ ID NO: 7370018 - DNA, 22 bp, Homo sapiens
tggccctgagggctcggagcca

SEQ ID NO: 7370019 - DNA, 22 bp, Homo sapiens
tggccctgaggacccagtgtgg

SEQ ID NO: 7370020 - DNA, 22 bp, Homo sapiens
tggccctgagggctcggagcca

SEQ ID NO: 7370021 - DNA, 22 bp, Homo sapiens
tggccctgaggggctgtgcccc

SEQ ID NO: 7370022 - DNA, 22 bp, Homo sapiens
tggccctgaggggctgtgcccc

SEQ ID NO: 7370023 - DNA, 22 bp, Homo sapiens
tggccctgaggggctgtgcccc

SEQ ID NO: 7370024 - DNA, 22 bp, Homo sapiens
tggccctgacacgtggtactgg

SEQ ID NO: 7370025 - DNA, 22 bp, Homo sapiens
tggccctgacacgtggtactgg

SEQ ID NO: 7370026 - DNA, 22 bp, Homo sapiens
tggccctgacaggtcctgggca

SEQ ID NO: 7370027 - DNA, 22 bp, Homo sapiens
tggccctgacaggtcctgggca

SEQ ID NO: 7370028 - DNA, 22 bp, Homo sapiens
tggccctgactgatgtggaggg

SEQ ID NO: 7370029 - DNA, 22 bp, Homo sapiens
tggccctgacttggaggcctga

SEQ ID NO: 7370030 - DNA, 22 bp, Homo sapiens
tggccctgaggacccagtgtgg

SEQ ID NO: 7370031 - DNA, 22 bp, Homo sapiens
tggccctgactgatgtggaggg

SEQ ID NO: 7370032 - DNA, 22 bp, Homo sapiens
tggccctgacttggaggcctga

SEQ ID NO: 7370033 - DNA, 22 bp, Homo sapiens
tggcccagctgcagatggtgga

SEQ ID NO: 7370034 - DNA, 22 bp, Homo sapiens
tggcccagctcagggtgggcgg

SEQ ID NO: 7370035 - DNA, 22 bp, Homo sapiens
tggcccagccctgctctagggc

SEQ ID NO: 7370036 - DNA, 22 bp, Homo sapiens
tggcccaagtctgctagaagag

SEQ ID NO: 7370037 - DNA, 15 bp, Homo sapiens
tggcccacccgttga

SEQ ID NO: 7370038 - DNA, 22 bp, Homo sapiens
tggcccagactctgctcttatc

SEQ ID NO: 7370039 - DNA, 22 bp, Homo sapiens
tggcccagccctgctctagggc

SEQ ID NO: 7370040 - DNA, 22 bp, Homo sapiens
tggcccagccctgctctagggc

SEQ ID NO: 7370041 - DNA, 22 bp, Homo sapiens
tggcccagactctgctcttatc

SEQ ID NO: 7370042 - DNA, 22 bp, Homo sapiens
tggccatgacatggaggctttg

SEQ ID NO: 7370043 - DNA, 22 bp, Homo sapiens
tggccatgaaggaggcagcaga

SEQ ID NO: 7370044 - DNA, 22 bp, Homo sapiens
tggccatgggatagtgcagggg

SEQ ID NO: 7370045 - DNA, 22 bp, Homo sapiens
tggcccaaagcagcccagcagg

SEQ ID NO: 7370046 - DNA, 22 bp, Homo sapiens
tggccagtttgctcaggcagtc

SEQ ID NO: 7370047 - DNA, 22 bp, Homo sapiens
tggccagtgtgtgctgccggct

SEQ ID NO: 7370048 - DNA, 22 bp, Homo sapiens
tggcccagggcacagcagggag

SEQ ID NO: 7370049 - DNA, 22 bp, Homo sapiens
tggcccagggcacagcagggag

SEQ ID NO: 7370050 - DNA, 22 bp, Homo sapiens
tggcccaggggctcttggtgtt

SEQ ID NO: 7370051 - DNA, 22 bp, Homo sapiens
tggcccagggtctacagcctca

SEQ ID NO: 7370052 - DNA, 22 bp, Homo sapiens
tggcccaggtctctctgagccc

SEQ ID NO: 7370053 - DNA, 22 bp, Homo sapiens
tggcccaggccaaagccctgga

SEQ ID NO: 7370054 - DNA, 22 bp, Homo sapiens
tggcccaggcgaggtgggcaga

SEQ ID NO: 7370055 - DNA, 22 bp, Homo sapiens
tggcccagggagttcatggtgt

SEQ ID NO: 7370056 - DNA, 22 bp, Homo sapiens
tggcccaggaggccagagggca

SEQ ID NO: 7370057 - DNA, 22 bp, Homo sapiens
tggcccaggaggccagagggca

SEQ ID NO: 7370058 - DNA, 22 bp, Homo sapiens
tggccctgccactcactgctga

SEQ ID NO: 7370059 - DNA, 22 bp, Homo sapiens
tggccctgccctcttcatcttt

SEQ ID NO: 7370060 - DNA, 22 bp, Homo sapiens
tggccctgccactcactgctga

SEQ ID NO: 7370061 - DNA, 22 bp, Homo sapiens
tggccctgccgcactatcctca

SEQ ID NO: 7370062 - DNA, 22 bp, Homo sapiens
tggccctgccctcttcatcttt

SEQ ID NO: 7370063 - DNA, 22 bp, Homo sapiens
tggccctgccgccacgacgtct

SEQ ID NO: 7370064 - DNA, 22 bp, Homo sapiens
tggccctgccgcactatcctca

SEQ ID NO: 7370065 - DNA, 22 bp, Homo sapiens
tggccctgggcagaggcaacat

SEQ ID NO: 7370066 - DNA, 22 bp, Homo sapiens
tggccctgggcatctttcgtga

SEQ ID NO: 7370067 - DNA, 22 bp, Homo sapiens
tggccctgggcagaggcaacat

SEQ ID NO: 7370068 - DNA, 21 bp, Homo sapiens
tggccctggccacggctgcca

SEQ ID NO: 7370069 - DNA, 22 bp, Homo sapiens
tggccctggctgagttagattt

SEQ ID NO: 7370070 - DNA, 22 bp, Homo sapiens
tggccctggctgagttagattt

SEQ ID NO: 7370071 - DNA, 22 bp, Homo sapiens
tggccctgtccctggagcctgg

SEQ ID NO: 7370072 - DNA, 22 bp, Homo sapiens
tggccctggtggcacagcctgc

SEQ ID NO: 7370073 - DNA, 22 bp, Homo sapiens
tggccctgggtggaatgtccca

SEQ ID NO: 7370074 - DNA, 22 bp, Homo sapiens
tggccctgggcatctttcgtga

SEQ ID NO: 7370075 - DNA, 22 bp, Homo sapiens
tggccctgggtggaatgtccca

SEQ ID NO: 7370076 - DNA, 22 bp, Homo sapiens
tggccctggtggcacagcctgc

SEQ ID NO: 7370077 - DNA, 22 bp, Homo sapiens
tggccctgtgactgagttctag

SEQ ID NO: 7370078 - DNA, 23 bp, Homo sapiens
tggccctgtgcatgctgcttccc

SEQ ID NO: 7370079 - DNA, 22 bp, Homo sapiens
tggccctgtctgcacacaggat

SEQ ID NO: 7370080 - DNA, 22 bp, Homo sapiens
tggccctgtgactgagttctag

SEQ ID NO: 7370081 - DNA, 22 bp, Homo sapiens
tggccctgtccctggagcctgg

SEQ ID NO: 7370082 - DNA, 22 bp, Homo sapiens
tggccctgtcctcatttcatct

SEQ ID NO: 7370083 - DNA, 22 bp, Homo sapiens
tggccctgtcctcatttcatct

SEQ ID NO: 7370084 - DNA, 22 bp, Homo sapiens
tggccctgtctgcacacaggat

SEQ ID NO: 7370085 - DNA, 22 bp, Homo sapiens
tggcctagagaagccaaaagat

SEQ ID NO: 7370086 - DNA, 22 bp, Homo sapiens
tggcctcaaccgtcctaagcac

SEQ ID NO: 7370087 - DNA, 20 bp, Homo sapiens
tggccctgttttctccaggc

SEQ ID NO: 7370088 - DNA, 22 bp, Homo sapiens
tggccctgttctgtacctcata

SEQ ID NO: 7370089 - DNA, 22 bp, Homo sapiens
tggccctgttctgtacctcata

SEQ ID NO: 7370090 - DNA, 22 bp, Homo sapiens
tggccctgttctgtacctcata

SEQ ID NO: 7370091 - DNA, 20 bp, Homo sapiens
tggccctgttttctccaggc

SEQ ID NO: 7370092 - DNA, 20 bp, Homo sapiens
tggccctgttttctccaggc

SEQ ID NO: 7370093 - DNA, 23 bp, Homo sapiens
tggccctgtgcatgctgcttccc

SEQ ID NO: 7370094 - DNA, 23 bp, Homo sapiens
tggccctgtgcatgctgcttccc

SEQ ID NO: 7370095 - DNA, 22 bp, Homo sapiens
tggccctgtggaggtcagtgag

SEQ ID NO: 7370096 - DNA, 22 bp, Homo sapiens
tggccctgtggcttcagaacag

SEQ ID NO: 7370097 - DNA, 22 bp, Homo sapiens
tggccctgtggcttcagaacag

SEQ ID NO: 7370098 - DNA, 22 bp, Homo sapiens
tggccctgtggaggtcagtgag

SEQ ID NO: 7370099 - DNA, 22 bp, Homo sapiens
tggccctgtgtgcaggctgcac

SEQ ID NO: 7370100 - DNA, 22 bp, Homo sapiens
tggccctgtgtgcaggctgcac

SEQ ID NO: 7370101 - DNA, 22 bp, Homo sapiens
tggccctgtgtcctgctgccag

SEQ ID NO: 7370102 - DNA, 22 bp, Homo sapiens
tggccctgtggcttcagaacag

SEQ ID NO: 7370103 - DNA, 22 bp, Homo sapiens
tggccctgtgtcctgctgccag

SEQ ID NO: 7370104 - DNA, 22 bp, Homo sapiens
tggccctgtgtcctgctgccag

SEQ ID NO: 7370105 - DNA, 22 bp, Homo sapiens
tggcctgactgtcaggctgtat

SEQ ID NO: 7370106 - DNA, 22 bp, Homo sapiens
tggcctggaagagaggtcgagg

SEQ ID NO: 7370107 - DNA, 22 bp, Homo sapiens
tggcctgctttcttaggtgttc

SEQ ID NO: 7370108 - DNA, 22 bp, Homo sapiens
tggccacactgcccccactggg

SEQ ID NO: 7370109 - DNA, 22 bp, Homo sapiens
tggccacagcctctgccagttc

SEQ ID NO: 7370110 - DNA, 22 bp, Homo sapiens
tggcatttcacctttcatttcc

SEQ ID NO: 7370111 - DNA, 23 bp, Homo sapiens
tggcatttctatactggcaagtg

SEQ ID NO: 7370112 - DNA, 22 bp, Homo sapiens
tggcatttcctcagtgctcaga

SEQ ID NO: 7370113 - DNA, 22 bp, Homo sapiens
tggccacatgcgtctgtgaggc

SEQ ID NO: 7370114 - DNA, 22 bp, Homo sapiens
tggccacatcctttccttgtca

SEQ ID NO: 7370115 - DNA, 22 bp, Homo sapiens
tggccacatatgtgggacagct

SEQ ID NO: 7370116 - DNA, 23 bp, Homo sapiens
tggccacagtccatgcatgccca

SEQ ID NO: 7370117 - DNA, 22 bp, Homo sapiens
tggccactggcttccactgagt

SEQ ID NO: 7370118 - DNA, 22 bp, Homo sapiens
tggccactcctccctgcaggct

SEQ ID NO: 7370119 - DNA, 22 bp, Homo sapiens
tggccactcagggatgcaggaa

SEQ ID NO: 7370120 - DNA, 22 bp, Homo sapiens
tggccagtaatagcttctggtg

SEQ ID NO: 7370121 - DNA, 22 bp, Homo sapiens
tggccaggcctcttggtgccca

SEQ ID NO: 7370122 - DNA, 22 bp, Homo sapiens
tggccagccctcttcccacact

SEQ ID NO: 7370123 - DNA, 22 bp, Homo sapiens
tggccagcacttagcccttacc

SEQ ID NO: 7370124 - DNA, 21 bp, Homo sapiens
tggccagctggagtctccaca

SEQ ID NO: 7370125 - DNA, 22 bp, Homo sapiens
tggcagtccagaccctggactc

SEQ ID NO: 7370126 - DNA, 22 bp, Homo sapiens
tggcatcatagccaaggtgctt

SEQ ID NO: 7370127 - DNA, 18 bp, Homo sapiens
tggcataaaatcagagtc

SEQ ID NO: 7370128 - DNA, 22 bp, Homo sapiens
tggcagtggcatcaccccaata

SEQ ID NO: 7370129 - DNA, 22 bp, Homo sapiens
tggcatgccttgtcagacagtg

SEQ ID NO: 7370130 - DNA, 22 bp, Homo sapiens
tggcagagtgcagaagaggcat

SEQ ID NO: 7370131 - DNA, 22 bp, Homo sapiens
tggcagagtggaccatactcaa

SEQ ID NO: 7370132 - DNA, 22 bp, Homo sapiens
tggcagagtctctcctttccag

SEQ ID NO: 7370133 - DNA, 22 bp, Homo sapiens
tggcagccttctctgagaaggt

SEQ ID NO: 7370134 - DNA, 22 bp, Homo sapiens
tggcagctacagacagaggtga

SEQ ID NO: 7370135 - DNA, 22 bp, Homo sapiens
tggcagctagatagtgtgttta

SEQ ID NO: 7370136 - DNA, 18 bp, Homo sapiens
tggcagctaggtaaagaa

SEQ ID NO: 7370137 - DNA, 22 bp, Homo sapiens
tggcagctagctgttttcatgc

SEQ ID NO: 7370138 - DNA, 22 bp, Homo sapiens
tggcagctatctttaatgagat

SEQ ID NO: 7370139 - DNA, 22 bp, Homo sapiens
tggcagctatggtctaagggcc

SEQ ID NO: 7370140 - DNA, 22 bp, Homo sapiens
tggcagctccgggtaggggctg

SEQ ID NO: 7370141 - DNA, 22 bp, Homo sapiens
tggcagctcctggggccagcac

SEQ ID NO: 7370142 - DNA, 22 bp, Homo sapiens
tggcagctcccagagcttccaa

SEQ ID NO: 7370143 - DNA, 22 bp, Homo sapiens
tggcagctattacaaggaagtc

SEQ ID NO: 7370144 - DNA, 22 bp, Homo sapiens
tggcagctcatttggaaatgga

SEQ ID NO: 7370145 - DNA, 22 bp, Homo sapiens
tggcagggcctgaatcttatac

SEQ ID NO: 7370146 - DNA, 22 bp, Homo sapiens
tggcaggatctttgagagtgaa

SEQ ID NO: 7370147 - DNA, 22 bp, Homo sapiens
tggcaggcaagttcagctccac

SEQ ID NO: 7370148 - DNA, 22 bp, Homo sapiens
tggcagctgcgttgtgtttctg

SEQ ID NO: 7370149 - DNA, 22 bp, Homo sapiens
tggcaggaaaaagggccagagg

SEQ ID NO: 7370150 - DNA, 22 bp, Homo sapiens
tggcagctgccatgtccacgtg

SEQ ID NO: 7370151 - DNA, 22 bp, Homo sapiens
tggcagctgcaggcctcctgag

SEQ ID NO: 7370152 - DNA, 22 bp, Homo sapiens
tggcagctgaatggctggatgg

SEQ ID NO: 7370153 - DNA, 17 bp, Homo sapiens
tggcagctgaaagctct

SEQ ID NO: 7370154 - DNA, 22 bp, Homo sapiens
tggcagctctgttcaacatgag

SEQ ID NO: 7370155 - DNA, 22 bp, Homo sapiens
tggcagctgagtgcaccccctc

SEQ ID NO: 7370156 - DNA, 22 bp, Homo sapiens
tggcagctgattagatggtgcc

SEQ ID NO: 7370157 - DNA, 22 bp, Homo sapiens
tggcagctgaggggaggctttg

SEQ ID NO: 7370158 - DNA, 22 bp, Homo sapiens
tggcaggaagacgtggggcacc

SEQ ID NO: 7370159 - DNA, 23 bp, Homo sapiens
tggcaggaaatgagaatgttcct

SEQ ID NO: 7370160 - DNA, 22 bp, Homo sapiens
tggcaggaggatgaggcggcta

SEQ ID NO: 7370161 - DNA, 22 bp, Homo sapiens
tggcaggagcctgcggggaggt

SEQ ID NO: 7370162 - DNA, 20 bp, Homo sapiens
tggcaggaggcagcagtgga

SEQ ID NO: 7370163 - DNA, 20 bp, Homo sapiens
tggcaggactggctccaccc

SEQ ID NO: 7370164 - DNA, 20 bp, Homo sapiens
tggcaggagccactggaagc

SEQ ID NO: 7370165 - DNA, 22 bp, Homo sapiens
tggcaggagagcgtcagatcag

SEQ ID NO: 7370166 - DNA, 22 bp, Homo sapiens
tggcaggaaggagactcagccc

SEQ ID NO: 7370167 - DNA, 20 bp, Homo sapiens
tggcaggaatagggccagag

SEQ ID NO: 7370168 - DNA, 22 bp, Homo sapiens
tggcaaagtttatcaggaatat

SEQ ID NO: 7370169 - DNA, 22 bp, Homo sapiens
tggcaaagtgactccttggggc

SEQ ID NO: 7370170 - DNA, 22 bp, Homo sapiens
tggcaacaagaaaggcagaggg

SEQ ID NO: 7370171 - DNA, 22 bp, Homo sapiens
tggcaacatgtcgaagtgctgt

SEQ ID NO: 7370172 - DNA, 22 bp, Homo sapiens
tggcaaaggaacctattttaaa

SEQ ID NO: 7370173 - DNA, 22 bp, Homo sapiens
tggcaaaggcgctcacatgcct

SEQ ID NO: 7370174 - DNA, 22 bp, Homo sapiens
tggcaaagtaattgggtttctc

SEQ ID NO: 7370175 - DNA, 22 bp, Homo sapiens
tggcaaagtatctgtcccagct

SEQ ID NO: 7370176 - DNA, 22 bp, Homo sapiens
tggcaaaggggaccatgttgaa

SEQ ID NO: 7370177 - DNA, 23 bp, Homo sapiens
tggcaaagcattcttataacagt

SEQ ID NO: 7370178 - DNA, 22 bp, Homo sapiens
tggcaaagattaccacatctac

SEQ ID NO: 7370179 - DNA, 22 bp, Homo sapiens
tggcaaaggaaatgatttaaga

SEQ ID NO: 7370180 - DNA, 22 bp, Homo sapiens
tggcaaagctagacattccctc

SEQ ID NO: 7370181 - DNA, 22 bp, Homo sapiens
tggcaaagaccgcaattacttt

SEQ ID NO: 7370182 - DNA, 22 bp, Homo sapiens
tggcaaaatgagcaattacttt

SEQ ID NO: 7370183 - DNA, 22 bp, Homo sapiens
tggcaaagatgaagcatttcgt

SEQ ID NO: 7370184 - DNA, 22 bp, Homo sapiens
tggcaaagatggttctcaccat

SEQ ID NO: 7370185 - DNA, 22 bp, Homo sapiens
tggcaaagattaccacatctac

SEQ ID NO: 7370186 - DNA, 22 bp, Homo sapiens
tggcaaagactgcaaggacttt

SEQ ID NO: 7370187 - DNA, 22 bp, Homo sapiens
tggcaaagacgctagctaagat

SEQ ID NO: 7370188 - DNA, 22 bp, Homo sapiens
tggatgggttgaaatgtgagcc

SEQ ID NO: 7370189 - DNA, 22 bp, Homo sapiens
tggattcaaatttcagctctgt

SEQ ID NO: 7370190 - DNA, 22 bp, Homo sapiens
tggcacagagggacccagcagc

SEQ ID NO: 7370191 - DNA, 22 bp, Homo sapiens
tggcacagcccattcagagaag

SEQ ID NO: 7370192 - DNA, 22 bp, Homo sapiens
tggcacagcttgtcataaactc

SEQ ID NO: 7370193 - DNA, 22 bp, Homo sapiens
tggcacagaaaaatgctccatt

SEQ ID NO: 7370194 - DNA, 22 bp, Homo sapiens
tggcaatttgtagagtaaatta

SEQ ID NO: 7370195 - DNA, 22 bp, Homo sapiens
tggcacaaaagtaattgcagtt

SEQ ID NO: 7370196 - DNA, 21 bp, Homo sapiens
tggcaatggccaacagtcatc

SEQ ID NO: 7370197 - DNA, 22 bp, Homo sapiens
tggcacagacagcacagcaatg

SEQ ID NO: 7370198 - DNA, 20 bp, Homo sapiens
tggcacagaacccttgccta

SEQ ID NO: 7370199 - DNA, 22 bp, Homo sapiens
tggcactgaaaaaggagaggtt

SEQ ID NO: 7370200 - DNA, 22 bp, Homo sapiens
tggcactgaaaaaggagaggtt

SEQ ID NO: 7370201 - DNA, 22 bp, Homo sapiens
tggcaccaccagacaccaggag

SEQ ID NO: 7370202 - DNA, 22 bp, Homo sapiens
tggcacatggttaatcataatt

SEQ ID NO: 7370203 - DNA, 22 bp, Homo sapiens
tggcactgggacagatgctctc

SEQ ID NO: 7370204 - DNA, 22 bp, Homo sapiens
tggcactgtagccactactgcc

SEQ ID NO: 7370205 - DNA, 22 bp, Homo sapiens
tggcactgggatgctactgtta

SEQ ID NO: 7370206 - DNA, 22 bp, Homo sapiens
tggcactgtcaccaatgctgtc

SEQ ID NO: 7370207 - DNA, 22 bp, Homo sapiens
tggcactggaatcgtagccttg

SEQ ID NO: 7370208 - DNA, 22 bp, Homo sapiens
tggcactgcctggcagggcccc

SEQ ID NO: 7370209 - DNA, 22 bp, Homo sapiens
tggcactgccaacctgctaggt

SEQ ID NO: 7370210 - DNA, 22 bp, Homo sapiens
tggcactgccaacctgctaggt

SEQ ID NO: 7370211 - DNA, 22 bp, Homo sapiens
tggcagagcccagactccagtc

SEQ ID NO: 7370212 - DNA, 22 bp, Homo sapiens
tgggagcagcattgccatgtgc

SEQ ID NO: 7370213 - DNA, 22 bp, Homo sapiens
tgggagcagcagggagatgcgg

SEQ ID NO: 7370214 - DNA, 22 bp, Homo sapiens
tgggagcagcattgccatgtgc

SEQ ID NO: 7370215 - DNA, 22 bp, Homo sapiens
tgggagcagccaacatggcctt

SEQ ID NO: 7370216 - DNA, 22 bp, Homo sapiens
tgggagcagctttgcgagggag

SEQ ID NO: 7370217 - DNA, 22 bp, Homo sapiens
tgggagcagctttgcgagggag

SEQ ID NO: 7370218 - DNA, 22 bp, Homo sapiens
tgggagcagctgggaacacagc

SEQ ID NO: 7370219 - DNA, 22 bp, Homo sapiens
tgggagcagcctcagcttcggg

SEQ ID NO: 7370220 - DNA, 22 bp, Homo sapiens
tgggagcaggaagcaggaagta

SEQ ID NO: 7370221 - DNA, 22 bp, Homo sapiens
tgggagcaccctgaggagcttc

SEQ ID NO: 7370222 - DNA, 22 bp, Homo sapiens
tgggagcaccctgaggagcttc

SEQ ID NO: 7370223 - DNA, 22 bp, Homo sapiens
tgggagcaagctggtgctggag

SEQ ID NO: 7370224 - DNA, 22 bp, Homo sapiens
tgggagcaagctggtgctggag

SEQ ID NO: 7370225 - DNA, 22 bp, Homo sapiens
tgggagcactctttgggaagca

SEQ ID NO: 7370226 - DNA, 22 bp, Homo sapiens
tgggagcaccttgagggcagaa

SEQ ID NO: 7370227 - DNA, 22 bp, Homo sapiens
tgggagcactctttgggaagca

SEQ ID NO: 7370228 - DNA, 22 bp, Homo sapiens
tgggaggacttgtgggcttcat

SEQ ID NO: 7370229 - DNA, 22 bp, Homo sapiens
tgggaggagccctctgggaagg

SEQ ID NO: 7370230 - DNA, 22 bp, Homo sapiens
tgggagaagcagtgggacagta

SEQ ID NO: 7370231 - DNA, 22 bp, Homo sapiens
tgggagagcttcatgccttcag

SEQ ID NO: 7370232 - DNA, 22 bp, Homo sapiens
tgggagacactggtgggagctt

SEQ ID NO: 7370233 - DNA, 21 bp, Homo sapiens
tgggagacacagccttgagct

SEQ ID NO: 7370234 - DNA, 21 bp, Homo sapiens
tgggagaccgccttcctggga

SEQ ID NO: 7370235 - DNA, 22 bp, Homo sapiens
tgggagcaagctacttagggaa

SEQ ID NO: 7370236 - DNA, 22 bp, Homo sapiens
tgggagcaaatgactgggagat

SEQ ID NO: 7370237 - DNA, 22 bp, Homo sapiens
tgggagcaaatgactgggagat

SEQ ID NO: 7370238 - DNA, 21 bp, Homo sapiens
tgggagagggctcagctaccc

SEQ ID NO: 7370239 - DNA, 22 bp, Homo sapiens
tgggagagtaaccaattccttc

SEQ ID NO: 7370240 - DNA, 22 bp, Homo sapiens
tgggaaggtgattttccaaaag

SEQ ID NO: 7370241 - DNA, 22 bp, Homo sapiens
tgggaaggtgtagaaagaacaa

SEQ ID NO: 7370242 - DNA, 22 bp, Homo sapiens
tgggaaggtacacgggaaagag

SEQ ID NO: 7370243 - DNA, 22 bp, Homo sapiens
tgggaagggtctgaatctgaga

SEQ ID NO: 7370244 - DNA, 22 bp, Homo sapiens
tgggaaggggagctggaaagga

SEQ ID NO: 7370245 - DNA, 22 bp, Homo sapiens
tgggaagggtcaacagctggaa

SEQ ID NO: 7370246 - DNA, 22 bp, Homo sapiens
tgggaaggcgtggaagtagaag

SEQ ID NO: 7370247 - DNA, 22 bp, Homo sapiens
tgggaagctactcatgcaggca

SEQ ID NO: 7370248 - DNA, 22 bp, Homo sapiens
tgggaagcattaatgatagggg

SEQ ID NO: 7370249 - DNA, 22 bp, Homo sapiens
tgggaagatgataattcacagt

SEQ ID NO: 7370250 - DNA, 21 bp, Homo sapiens
tgggacagtgatggctcctcc

SEQ ID NO: 7370251 - DNA, 22 bp, Homo sapiens
tgggacagtgaccccagaggtc

SEQ ID NO: 7370252 - DNA, 22 bp, Homo sapiens
tgggacagttgtcctccactct

SEQ ID NO: 7370253 - DNA, 22 bp, Homo sapiens
tgggacagtgtgccttgctcct

SEQ ID NO: 7370254 - DNA, 20 bp, Homo sapiens
tgggactgacccatctgagc

SEQ ID NO: 7370255 - DNA, 22 bp, Homo sapiens
tgggacaaggactagctccaat

SEQ ID NO: 7370256 - DNA, 22 bp, Homo sapiens
tgggacaggttggagagaagca

SEQ ID NO: 7370257 - DNA, 22 bp, Homo sapiens
tgggacagggaatctgatcccc

SEQ ID NO: 7370258 - DNA, 22 bp, Homo sapiens
tggcttcacacaggcacttccg

SEQ ID NO: 7370259 - DNA, 22 bp, Homo sapiens
tggctggcatagccattgctcc

SEQ ID NO: 7370260 - DNA, 22 bp, Homo sapiens
tggctggccctgggagtgcaga

SEQ ID NO: 7370261 - DNA, 23 bp, Homo sapiens
tggctggcagaaactgaagcatg

SEQ ID NO: 7370262 - DNA, 22 bp, Homo sapiens
tggcttctggctggtgagaaat

SEQ ID NO: 7370263 - DNA, 22 bp, Homo sapiens
tggcttcagagacagaatctat

SEQ ID NO: 7370264 - DNA, 22 bp, Homo sapiens
tggcttcacctcagcatgaagg

SEQ ID NO: 7370265 - DNA, 22 bp, Homo sapiens
tggcttcactgctcaagtgatt

SEQ ID NO: 7370266 - DNA, 18 bp, Homo sapiens
tggcttcagagtaaaatg

SEQ ID NO: 7370267 - DNA, 22 bp, Homo sapiens
tggcttctagtttgaggaaaaa

SEQ ID NO: 7370268 - DNA, 22 bp, Homo sapiens
tgggaaagactcaggacaggag

SEQ ID NO: 7370269 - DNA, 22 bp, Homo sapiens
tgggaaagctgcagaaattctc

SEQ ID NO: 7370270 - DNA, 22 bp, Homo sapiens
tgggaaagccagcagtgtcacc

SEQ ID NO: 7370271 - DNA, 20 bp, Homo sapiens
tgggaaagtctaagtgcctc

SEQ ID NO: 7370272 - DNA, 22 bp, Homo sapiens
tgggaaagactcaggacaggag

SEQ ID NO: 7370273 - DNA, 22 bp, Homo sapiens
tggctttataaatccactggtt

SEQ ID NO: 7370274 - DNA, 22 bp, Homo sapiens
tgggaaagtgttgaggtgtctt

SEQ ID NO: 7370275 - DNA, 22 bp, Homo sapiens
tgggaaagtgttgaggtgtctt

SEQ ID NO: 7370276 - DNA, 22 bp, Homo sapiens
tgggaaagtgtagcctgcaggc

SEQ ID NO: 7370277 - DNA, 18 bp, Homo sapiens
tgggaaagtttatagaat

SEQ ID NO: 7370278 - DNA, 22 bp, Homo sapiens
tgggaagaggatgaggcatatg

SEQ ID NO: 7370279 - DNA, 22 bp, Homo sapiens
tgggaagaagcagagaactgga

SEQ ID NO: 7370280 - DNA, 22 bp, Homo sapiens
tggctctgtggatgttctgacc

SEQ ID NO: 7370281 - DNA, 22 bp, Homo sapiens
tggctctgtgaacagacgactg

SEQ ID NO: 7370282 - DNA, 22 bp, Homo sapiens
tggctctggattaatctaggaa

SEQ ID NO: 7370283 - DNA, 22 bp, Homo sapiens
tggctctggggacagtaagtcc

SEQ ID NO: 7370284 - DNA, 19 bp, Homo sapiens
tggctctgtttctctggag

SEQ ID NO: 7370285 - DNA, 22 bp, Homo sapiens
tggctctgttcgccatcaggag

SEQ ID NO: 7370286 - DNA, 23 bp, Homo sapiens
tggctctgtgtcacatacaggat

SEQ ID NO: 7370287 - DNA, 22 bp, Homo sapiens
tggctctgttgtaaagaaattt

SEQ ID NO: 7370288 - DNA, 18 bp, Homo sapiens
tggctctgcagccagatg

SEQ ID NO: 7370289 - DNA, 22 bp, Homo sapiens
tggctctgccacctttccctaa

SEQ ID NO: 7370290 - DNA, 21 bp, Homo sapiens
tggctctgagcctcatggctg

SEQ ID NO: 7370291 - DNA, 22 bp, Homo sapiens
tggctctgagctgcaaagctgc

SEQ ID NO: 7370292 - DNA, 21 bp, Homo sapiens
tggctcgatttatagcatttc

SEQ ID NO: 7370293 - DNA, 22 bp, Homo sapiens
tggctgcagatcaagggcaggc

SEQ ID NO: 7370294 - DNA, 22 bp, Homo sapiens
tggctgagtttcatgcatcatg

SEQ ID NO: 7370295 - DNA, 20 bp, Homo sapiens
tggctgcacaccaggacagg

SEQ ID NO: 7370296 - DNA, 22 bp, Homo sapiens
tggctgagtgttccaaggagca

SEQ ID NO: 7370297 - DNA, 22 bp, Homo sapiens
tggctgagtgaacatgtccatt

SEQ ID NO: 7370298 - DNA, 22 bp, Homo sapiens
tggctgagttctccaggagtag

SEQ ID NO: 7370299 - DNA, 22 bp, Homo sapiens
tggctgagttctccaggagtag

SEQ ID NO: 7370300 - DNA, 22 bp, Homo sapiens
tggctgagttcctggcacacgg

SEQ ID NO: 7370301 - DNA, 22 bp, Homo sapiens
tggctgagttacgaacagagca

SEQ ID NO: 7370302 - DNA, 22 bp, Homo sapiens
tggctgcagtgcttgagatgtc

SEQ ID NO: 7370303 - DNA, 22 bp, Homo sapiens
tggctgctgcagacagacagga

SEQ ID NO: 7370304 - DNA, 22 bp, Homo sapiens
tggctgagaaaatggttttagg

SEQ ID NO: 7370305 - DNA, 22 bp, Homo sapiens
tggctgagccacttgttcagat

SEQ ID NO: 7370306 - DNA, 22 bp, Homo sapiens
tggctgaggagggtcttctggt

SEQ ID NO: 7370307 - DNA, 22 bp, Homo sapiens
tggctgaggagggtcttctggt

SEQ ID NO: 7370308 - DNA, 22 bp, Homo sapiens
tggctgaggagagggcggaagt

SEQ ID NO: 7370309 - DNA, 22 bp, Homo sapiens
tggctgaggagagggcggaagt

SEQ ID NO: 7370310 - DNA, 22 bp, Homo sapiens
tggctgaggctggagtgcagtg

SEQ ID NO: 7370311 - DNA, 22 bp, Homo sapiens
tggctgagtaagttgtgatatg

SEQ ID NO: 7370312 - DNA, 20 bp, Homo sapiens
tggccttttggcttggagct

SEQ ID NO: 7370313 - DNA, 22 bp, Homo sapiens
tggcgcagtttctctgctgcct

SEQ ID NO: 7370314 - DNA, 22 bp, Homo sapiens
tggcctgttgctcctaggggtc

SEQ ID NO: 7370315 - DNA, 22 bp, Homo sapiens
tggcctggtccttgtcaaggca

SEQ ID NO: 7370316 - DNA, 22 bp, Homo sapiens
tggcctggctcacagtgagatt

SEQ ID NO: 7370317 - DNA, 22 bp, Homo sapiens
tggcctggtgctcaggcagtag

SEQ ID NO: 7370318 - DNA, 22 bp, Homo sapiens
tggctcagaaggctgccttcac

SEQ ID NO: 7370319 - DNA, 22 bp, Homo sapiens
tggctcagatgctcttccagtg

SEQ ID NO: 7370320 - DNA, 22 bp, Homo sapiens
tggctcagatttttgtaggctt

SEQ ID NO: 7370321 - DNA, 22 bp, Homo sapiens
tggctcagaactacttctagtt

SEQ ID NO: 7370322 - DNA, 22 bp, Homo sapiens
tggctcagaagaaaaggtaaac

SEQ ID NO: 7370323 - DNA, 22 bp, Homo sapiens
tggctattgagtgatctctaga

SEQ ID NO: 7370324 - DNA, 22 bp, Homo sapiens
tggctaacaaggtgaaaccccg

SEQ ID NO: 7370325 - DNA, 23 bp, Homo sapiens
tggctaaaggctctagtcctgct

SEQ ID NO: 7370326 - DNA, 22 bp, Homo sapiens
tggctaacaaggtgaaaccccg

SEQ ID NO: 7370327 - DNA, 21 bp, Homo sapiens
tggcggggacttgtggctgcc

SEQ ID NO: 7370328 - DNA, 22 bp, Homo sapiens
tggctcagtggcagccgcagct

SEQ ID NO: 7370329 - DNA, 22 bp, Homo sapiens
tggctcagtggcagccgcagct

SEQ ID NO: 7370330 - DNA, 22 bp, Homo sapiens
tggctcagtgaagagataactt

SEQ ID NO: 7370331 - DNA, 22 bp, Homo sapiens
tggctcagtcatggatgagtaa

SEQ ID NO: 7370332 - DNA, 22 bp, Homo sapiens
tggctcagtagcagtgtggtca

SEQ ID NO: 7370333 - DNA, 23 bp, Homo sapiens
tggctcagggtctcttatgaagt

SEQ ID NO: 7370334 - DNA, 22 bp, Homo sapiens
tggctcagggtccccaaatggt

SEQ ID NO: 7370335 - DNA, 22 bp, Homo sapiens
tggctcaggatctaagcagaat

SEQ ID NO: 7370336 - DNA, 22 bp, Homo sapiens
tggctcaggcttgaaaatagat

SEQ ID NO: 7370337 - DNA, 22 bp, Homo sapiens
tggctcaggcttgaaaatagat

SEQ ID NO: 7370338 - DNA, 22 bp, Homo sapiens
tggctcagccagccctaggaac

SEQ ID NO: 7370339 - DNA, 22 bp, Homo sapiens
tggctcagcaggttagaaacta

SEQ ID NO: 7370340 - DNA, 22 bp, Homo sapiens
tggctcagcaggttagaaacta

SEQ ID NO: 7370341 - DNA, 22 bp, Homo sapiens
tggctcagcaagacattgacct

SEQ ID NO: 7370342 - DNA, 22 bp, Homo sapiens
tggctccaggggacacgcagta

SEQ ID NO: 7370343 - DNA, 22 bp, Homo sapiens
tggctccatcatccatgcaaga

SEQ ID NO: 7370344 - DNA, 20 bp, Homo sapiens
tggctccagcctcccctacc

SEQ ID NO: 7370345 - DNA, 23 bp, Homo sapiens
tggctccaggagaagccagaagc

SEQ ID NO: 7370346 - DNA, 22 bp, Homo sapiens
tggctccagatttcctgctgca

SEQ ID NO: 7370347 - DNA, 22 bp, Homo sapiens
tggctcagttaggtcagaaaca

SEQ ID NO: 7370348 - DNA, 22 bp, Homo sapiens
tggctcattctttagaatatac

SEQ ID NO: 7370349 - DNA, 22 bp, Homo sapiens
tggctcatggaattagctatta

SEQ ID NO: 7370350 - DNA, 22 bp, Homo sapiens
tggctcattctactctccctgg

SEQ ID NO: 7370351 - DNA, 22 bp, Homo sapiens
tggtattacttctagacacaag

SEQ ID NO: 7370352 - DNA, 22 bp, Homo sapiens
tggtattctttctgtagatcat

SEQ ID NO: 7370353 - DNA, 22 bp, Homo sapiens
tggtaaggtcttcactcagatt

SEQ ID NO: 7370354 - DNA, 16 bp, Homo sapiens
tggtaaggttaccaga

SEQ ID NO: 7370355 - DNA, 22 bp, Homo sapiens
tggtaaagtgctctaacttcat

SEQ ID NO: 7370356 - DNA, 22 bp, Homo sapiens
tggtaaagtggcttcacagtgt

SEQ ID NO: 7370357 - DNA, 22 bp, Homo sapiens
tggtaaagaaatgtcagggcag

SEQ ID NO: 7370358 - DNA, 22 bp, Homo sapiens
tggtaaagcacattgcatttaa

SEQ ID NO: 7370359 - DNA, 22 bp, Homo sapiens
tggtaagaataggggctttgga

SEQ ID NO: 7370360 - DNA, 22 bp, Homo sapiens
tggtaaggacttagttatcaat

SEQ ID NO: 7370361 - DNA, 22 bp, Homo sapiens
tggtaaggattgtagaaacgaa

SEQ ID NO: 7370362 - DNA, 22 bp, Homo sapiens
tggtaagataagagccaggcct

SEQ ID NO: 7370363 - DNA, 22 bp, Homo sapiens
tggtaagggtattatttcatcc

SEQ ID NO: 7370364 - DNA, 22 bp, Homo sapiens
tggtaaggggtggaaccagagc

SEQ ID NO: 7370365 - DNA, 22 bp, Homo sapiens
tggtaaggcccagctggagtcc

SEQ ID NO: 7370366 - DNA, 22 bp, Homo sapiens
tggtaagggctctctttctggc

SEQ ID NO: 7370367 - DNA, 22 bp, Homo sapiens
tgggttccctgacagcgatgct

SEQ ID NO: 7370368 - DNA, 22 bp, Homo sapiens
tgggtgggagcgccctgtctgg

SEQ ID NO: 7370369 - DNA, 21 bp, Homo sapiens
tgggtgcaagctgcggatgct

SEQ ID NO: 7370370 - DNA, 22 bp, Homo sapiens
tgggtgcatgtgagcacgtgca

SEQ ID NO: 7370371 - DNA, 22 bp, Homo sapiens
tgggtgagtgggaaaagcccag

SEQ ID NO: 7370372 - DNA, 22 bp, Homo sapiens
tgggtcctggaaggcgacaggt

SEQ ID NO: 7370373 - DNA, 22 bp, Homo sapiens
tgggtcctggctttgtcagggt

SEQ ID NO: 7370374 - DNA, 22 bp, Homo sapiens
tgggtcctctggagcagcagca

SEQ ID NO: 7370375 - DNA, 22 bp, Homo sapiens
tgggtccttcaaagctgggtct

SEQ ID NO: 7370376 - DNA, 22 bp, Homo sapiens
tgggtccttgctgattgctgag

SEQ ID NO: 7370377 - DNA, 22 bp, Homo sapiens
tgggtagggcctgcgcctgtgc

SEQ ID NO: 7370378 - DNA, 22 bp, Homo sapiens
tggggttgaagaaaggatctag

SEQ ID NO: 7370379 - DNA, 23 bp, Homo sapiens
tggggttgaattgtagctgtgcc

SEQ ID NO: 7370380 - DNA, 22 bp, Homo sapiens
tgggtagcagggctgagctgtg

SEQ ID NO: 7370381 - DNA, 22 bp, Homo sapiens
tggggggatacttgctactggc

SEQ ID NO: 7370382 - DNA, 22 bp, Homo sapiens
tgggggctgtgcacaggctcac

SEQ ID NO: 7370383 - DNA, 22 bp, Homo sapiens
tgggggtgactatctcgggaat

SEQ ID NO: 7370384 - DNA, 21 bp, Homo sapiens
tgggggtgaggcctaggaatc

SEQ ID NO: 7370385 - DNA, 22 bp, Homo sapiens
tgggggtgaaagtctggacagt

SEQ ID NO: 7370386 - DNA, 22 bp, Homo sapiens
tggggtgggcatgcgctgtcct

SEQ ID NO: 7370387 - DNA, 22 bp, Homo sapiens
tggggtgccgacagggagggca

SEQ ID NO: 7370388 - DNA, 22 bp, Homo sapiens
tggggtgctttcttgcctgtac

SEQ ID NO: 7370389 - DNA, 22 bp, Homo sapiens
tggggtggggttactcattctg

SEQ ID NO: 7370390 - DNA, 22 bp, Homo sapiens
tgggggcagccaggctgtcaag

SEQ ID NO: 7370391 - DNA, 22 bp, Homo sapiens
tgggggcagaggattcaggaat

SEQ ID NO: 7370392 - DNA, 22 bp, Homo sapiens
tgggggcagccaggctgtcaag

SEQ ID NO: 7370393 - DNA, 22 bp, Homo sapiens
tgggggcatggaccagcctggc

SEQ ID NO: 7370394 - DNA, 22 bp, Homo sapiens
tggggccagagctgcagggagc

SEQ ID NO: 7370395 - DNA, 22 bp, Homo sapiens
tggggcctgaggtggagctgca

SEQ ID NO: 7370396 - DNA, 22 bp, Homo sapiens
tggggccagagctgcagggagc

SEQ ID NO: 7370397 - DNA, 22 bp, Homo sapiens
tggggcctggtcagagctgcac

SEQ ID NO: 7370398 - DNA, 22 bp, Homo sapiens
tggggcgcgaggtcctggctcc

SEQ ID NO: 7370399 - DNA, 22 bp, Homo sapiens
tggggacaggagacttacagct

SEQ ID NO: 7370400 - DNA, 22 bp, Homo sapiens
tggggaagggcaccctggagac

SEQ ID NO: 7370401 - DNA, 22 bp, Homo sapiens
tggggacacagagccaaactat

SEQ ID NO: 7370402 - DNA, 22 bp, Homo sapiens
tggggaagacagcagacactgt

SEQ ID NO: 7370403 - DNA, 22 bp, Homo sapiens
tggggaaagatagttttctcta

SEQ ID NO: 7370404 - DNA, 22 bp, Homo sapiens
tggggaaaatgcagaagattac

SEQ ID NO: 7370405 - DNA, 23 bp, Homo sapiens
tgggcttctgagaaagcacctaa

SEQ ID NO: 7370406 - DNA, 22 bp, Homo sapiens
tggggacattcatgcaggttgt

SEQ ID NO: 7370407 - DNA, 22 bp, Homo sapiens
tggggacatagccagtctggct

SEQ ID NO: 7370408 - DNA, 22 bp, Homo sapiens
tggggagtgatgcctcggataa

SEQ ID NO: 7370409 - DNA, 22 bp, Homo sapiens
tggggagtgatgcctcggataa

SEQ ID NO: 7370410 - DNA, 20 bp, Homo sapiens
tgggcctctggtgcctctgg

SEQ ID NO: 7370411 - DNA, 22 bp, Homo sapiens
tgggcctgaaggagctgcgccc

SEQ ID NO: 7370412 - DNA, 19 bp, Homo sapiens
tgggcctctcatatctgcc

SEQ ID NO: 7370413 - DNA, 22 bp, Homo sapiens
tgggcctcctttccattcagag

SEQ ID NO: 7370414 - DNA, 21 bp, Homo sapiens
tgggcctgattcccagggtca

SEQ ID NO: 7370415 - DNA, 22 bp, Homo sapiens
tgggcctgactcacctgcctcc

SEQ ID NO: 7370416 - DNA, 22 bp, Homo sapiens
tgggcctgggctcctgtcctct

SEQ ID NO: 7370417 - DNA, 22 bp, Homo sapiens
tgggcctcctgccctggcctag

SEQ ID NO: 7370418 - DNA, 22 bp, Homo sapiens
tgggcctcatgcccagccaccc

SEQ ID NO: 7370419 - DNA, 22 bp, Homo sapiens
tgggcctcatcttcaatgagtc

SEQ ID NO: 7370420 - DNA, 22 bp, Homo sapiens
tgggcctcagtttgcttaatgt

SEQ ID NO: 7370421 - DNA, 21 bp, Homo sapiens
tgggcctcaggcagctgtgac

SEQ ID NO: 7370422 - DNA, 22 bp, Homo sapiens
tgggccagttggaatggatact

SEQ ID NO: 7370423 - DNA, 22 bp, Homo sapiens
tgggccagtttctcattgaaat

SEQ ID NO: 7370424 - DNA, 22 bp, Homo sapiens
tgggcctcaccttcttggcagc

SEQ ID NO: 7370425 - DNA, 22 bp, Homo sapiens
tgggccagttatttcacctctg

SEQ ID NO: 7370426 - DNA, 22 bp, Homo sapiens
tgggccaggtgcagtgctttag

SEQ ID NO: 7370427 - DNA, 21 bp, Homo sapiens
tgggccagtagaaaggaaggc

SEQ ID NO: 7370428 - DNA, 22 bp, Homo sapiens
tgggccagtcctgcctaaggtg

SEQ ID NO: 7370429 - DNA, 22 bp, Homo sapiens
tgggccagtccagccccaggga

SEQ ID NO: 7370430 - DNA, 22 bp, Homo sapiens
tgggccagtccagccccaggga

SEQ ID NO: 7370431 - DNA, 22 bp, Homo sapiens
tgggccagtagctactcgcaag

SEQ ID NO: 7370432 - DNA, 22 bp, Homo sapiens
tgggccaggtctgcggtcattt

SEQ ID NO: 7370433 - DNA, 22 bp, Homo sapiens
tgggccaggggcctcttctgat

SEQ ID NO: 7370434 - DNA, 22 bp, Homo sapiens
tgggccaggtctgtgtcagctg

SEQ ID NO: 7370435 - DNA, 23 bp, Homo sapiens
tgggccagggagtccggtttctt

SEQ ID NO: 7370436 - DNA, 22 bp, Homo sapiens
tgggccagggcacccagtccag

SEQ ID NO: 7370437 - DNA, 22 bp, Homo sapiens
tgggccaggcatgtgatcagca

SEQ ID NO: 7370438 - DNA, 22 bp, Homo sapiens
tgggctcagccttcatgtggcc

SEQ ID NO: 7370439 - DNA, 22 bp, Homo sapiens
tgggcctgggttcctcctgggc

SEQ ID NO: 7370440 - DNA, 22 bp, Homo sapiens
tgggcgacagagcaagactccg

SEQ ID NO: 7370441 - DNA, 22 bp, Homo sapiens
tgggcctgttgcctgagtccat

SEQ ID NO: 7370442 - DNA, 22 bp, Homo sapiens
tgggccagcactgggtgctcat

SEQ ID NO: 7370443 - DNA, 22 bp, Homo sapiens
tgggccagctccctgcccctgg

SEQ ID NO: 7370444 - DNA, 22 bp, Homo sapiens
tgggccagctccctgcccctgg

SEQ ID NO: 7370445 - DNA, 22 bp, Homo sapiens
tgggccagctgaagtgccgccc

SEQ ID NO: 7370446 - DNA, 22 bp, Homo sapiens
tgggccagctgaagtgccgccc

SEQ ID NO: 7370447 - DNA, 22 bp, Homo sapiens
tgggccaggatttcaagaccct

SEQ ID NO: 7370448 - DNA, 19 bp, Homo sapiens
tgggcaggttcagtaatgg

SEQ ID NO: 7370449 - DNA, 23 bp, Homo sapiens
tgggcagcttctgcatgcccacc

SEQ ID NO: 7370450 - DNA, 22 bp, Homo sapiens
tgggcagcttccacttagttag

SEQ ID NO: 7370451 - DNA, 22 bp, Homo sapiens
tgggcagggagctggaaccaca

SEQ ID NO: 7370452 - DNA, 22 bp, Homo sapiens
tgggcaggagagaagctaaaga

SEQ ID NO: 7370453 - DNA, 22 bp, Homo sapiens
tgggcagggagctggaaccaca

SEQ ID NO: 7370454 - DNA, 22 bp, Homo sapiens
tgggcaggggccctgcttccgt

SEQ ID NO: 7370455 - DNA, 22 bp, Homo sapiens
tgggcaggggccctgcttccgt

SEQ ID NO: 7370456 - DNA, 22 bp, Homo sapiens
tgggcagggatctcttttgcaa

SEQ ID NO: 7370457 - DNA, 22 bp, Homo sapiens
tgggcagcaaagactgtgtgct

SEQ ID NO: 7370458 - DNA, 22 bp, Homo sapiens
tgggcagagtagctcagaagaa

SEQ ID NO: 7370459 - DNA, 22 bp, Homo sapiens
tgggcacatagttttatggtca

SEQ ID NO: 7370460 - DNA, 22 bp, Homo sapiens
tgggattcaccatgggcttcag

SEQ ID NO: 7370461 - DNA, 22 bp, Homo sapiens
tgggaggcaggtaggtgatgat

SEQ ID NO: 7370462 - DNA, 22 bp, Homo sapiens
tgggaggccaaggcaggcggat

SEQ ID NO: 7370463 - DNA, 22 bp, Homo sapiens
tgggaggccgaggcaggtggat

SEQ ID NO: 7370464 - DNA, 22 bp, Homo sapiens
tgggaggccgaggcaggtggat

SEQ ID NO: 7370465 - DNA, 22 bp, Homo sapiens
tgggagtgatacagtatggaat

SEQ ID NO: 7370466 - DNA, 22 bp, Homo sapiens
tgggagtcatcgtgtttggatc

SEQ ID NO: 7370467 - DNA, 22 bp, Homo sapiens
tgggagtcactgttgttgaggg

SEQ ID NO: 7370468 - DNA, 22 bp, Homo sapiens
tgggaggcttccagaccttgct

SEQ ID NO: 7370469 - DNA, 23 bp, Homo sapiens
tgtaaaagcatttgtcagcctgg

SEQ ID NO: 7370470 - DNA, 22 bp, Homo sapiens
tgtaaaaagcccagccgctgag

SEQ ID NO: 7370471 - DNA, 22 bp, Homo sapiens
tggttttaaaaacatgctgcat

SEQ ID NO: 7370472 - DNA, 22 bp, Homo sapiens
tgtaaataattcctaggctttt

SEQ ID NO: 7370473 - DNA, 22 bp, Homo sapiens
tgtaaataatgcatgtaaatca

SEQ ID NO: 7370474 - DNA, 22 bp, Homo sapiens
tgtaaatagttagcttgcctct

SEQ ID NO: 7370475 - DNA, 22 bp, Homo sapiens
tgtaaagattagattacatgaa

SEQ ID NO: 7370476 - DNA, 22 bp, Homo sapiens
tgtaaagatccttagcaacatc

SEQ ID NO: 7370477 - DNA, 22 bp, Homo sapiens
tggtttcagtgccaatacagta

SEQ ID NO: 7370478 - DNA, 22 bp, Homo sapiens
tggttcctggttcacttggcag

SEQ ID NO: 7370479 - DNA, 18 bp, Homo sapiens
tggttccttgaaggggca

SEQ ID NO: 7370480 - DNA, 22 bp, Homo sapiens
tggttaagtccagaaaggaagc

SEQ ID NO: 7370481 - DNA, 22 bp, Homo sapiens
tggttgcctctcagagattccg

SEQ ID NO: 7370482 - DNA, 22 bp, Homo sapiens
tggttgtggtcctccacatcgc

SEQ ID NO: 7370483 - DNA, 19 bp, Homo sapiens
tggttgtgcacgggttggt

SEQ ID NO: 7370484 - DNA, 20 bp, Homo sapiens
tgtacacagtactttacaat

SEQ ID NO: 7370485 - DNA, 23 bp, Homo sapiens
tgtaaattttgtagtcacatttt

SEQ ID NO: 7370486 - DNA, 22 bp, Homo sapiens
tgtaaattgaaggaaatttgtg

SEQ ID NO: 7370487 - DNA, 22 bp, Homo sapiens
tgtaaattggaaatcaatcaag

SEQ ID NO: 7370488 - DNA, 23 bp, Homo sapiens
tgtaacaatttcatatacatgca

SEQ ID NO: 7370489 - DNA, 22 bp, Homo sapiens
tgtaagtacattgaaacatctt

SEQ ID NO: 7370490 - DNA, 22 bp, Homo sapiens
tgtaagtagaacaacataatct

SEQ ID NO: 7370491 - DNA, 22 bp, Homo sapiens
tgtaattttctcaagtttctac

SEQ ID NO: 7370492 - DNA, 22 bp, Homo sapiens
tgtacaaagagtatagctttga

SEQ ID NO: 7370493 - DNA, 22 bp, Homo sapiens
tgtaagacatatcttagtgatg

SEQ ID NO: 7370494 - DNA, 22 bp, Homo sapiens
tgtaagattctaagagttaatg

SEQ ID NO: 7370495 - DNA, 22 bp, Homo sapiens
tgtaagatatgagtacatgtaa

SEQ ID NO: 7370496 - DNA, 22 bp, Homo sapiens
tgtaagaaaacctgtacaaaga

SEQ ID NO: 7370497 - DNA, 22 bp, Homo sapiens
tgtaagaaaagtaaatagtgac

SEQ ID NO: 7370498 - DNA, 23 bp, Homo sapiens
tgtaacttgatggaatgagctat

SEQ ID NO: 7370499 - DNA, 23 bp, Homo sapiens
tgtaacttcttaaattcttcact

SEQ ID NO: 7370500 - DNA, 22 bp, Homo sapiens
tggtgggcacagtgcccaggct

SEQ ID NO: 7370501 - DNA, 22 bp, Homo sapiens
tggtggcatcactcagcctccc

SEQ ID NO: 7370502 - DNA, 22 bp, Homo sapiens
tggtggcagctgagtgtcaggt

SEQ ID NO: 7370503 - DNA, 19 bp, Homo sapiens
tggtggcaatgtcagctaa

SEQ ID NO: 7370504 - DNA, 22 bp, Homo sapiens
tggtggacaccgcagccatgaa

SEQ ID NO: 7370505 - DNA, 21 bp, Homo sapiens
tggtggagtgtgctgagcatg

SEQ ID NO: 7370506 - DNA, 19 bp, Homo sapiens
tggtggaggtgcacctgac

SEQ ID NO: 7370507 - DNA, 22 bp, Homo sapiens
tggtgccattagccctgctgtt

SEQ ID NO: 7370508 - DNA, 22 bp, Homo sapiens
tggtgccatcatagctcactgc

SEQ ID NO: 7370509 - DNA, 22 bp, Homo sapiens
tggtgccacttcttaggctggt

SEQ ID NO: 7370510 - DNA, 22 bp, Homo sapiens
tggtgccaccctccttcagctg

SEQ ID NO: 7370511 - DNA, 22 bp, Homo sapiens
tggtcagttgcatcagagaagt

SEQ ID NO: 7370512 - DNA, 22 bp, Homo sapiens
tggtcacctatagaggagatgt

SEQ ID NO: 7370513 - DNA, 22 bp, Homo sapiens
tggtcagaactcagcgtgcttg

SEQ ID NO: 7370514 - DNA, 22 bp, Homo sapiens
tggtcagaaggaagggctccta

SEQ ID NO: 7370515 - DNA, 22 bp, Homo sapiens
tggtcctggagagtgttccata

SEQ ID NO: 7370516 - DNA, 22 bp, Homo sapiens
tggtcctgggcacagtatatgc

SEQ ID NO: 7370517 - DNA, 19 bp, Homo sapiens
tggtctctgtctctttgca

SEQ ID NO: 7370518 - DNA, 22 bp, Homo sapiens
tggtgagataactttcggcaag

SEQ ID NO: 7370519 - DNA, 22 bp, Homo sapiens
tggtgagagctgaccgtgcgag

SEQ ID NO: 7370520 - DNA, 20 bp, Homo sapiens
tggtgagagcacctgatggg

SEQ ID NO: 7370521 - DNA, 22 bp, Homo sapiens
tggtgagaccttgttccttatg

SEQ ID NO: 7370522 - DNA, 22 bp, Homo sapiens
tggtgagatgtatggagggttg

SEQ ID NO: 7370523 - DNA, 22 bp, Homo sapiens
tggtgagctctttagactggga

SEQ ID NO: 7370524 - DNA, 23 bp, Homo sapiens
tggtctcacttggtaagatgaag

SEQ ID NO: 7370525 - DNA, 22 bp, Homo sapiens
tgtcatttgtttaggcaataat

SEQ ID NO: 7370526 - DNA, 22 bp, Homo sapiens
tgtcatttactccataccctca

SEQ ID NO: 7370527 - DNA, 22 bp, Homo sapiens
tgtcatttatgcttcttcagtg

SEQ ID NO: 7370528 - DNA, 22 bp, Homo sapiens
tgtcatctttttaaagaagaga

SEQ ID NO: 7370529 - DNA, 22 bp, Homo sapiens
tgtcatatgttgatgaaagaga

SEQ ID NO: 7370530 - DNA, 22 bp, Homo sapiens
tgtcacctttacccttttatag

SEQ ID NO: 7370531 - DNA, 22 bp, Homo sapiens
tgtcagaactctattgatgtcc

SEQ ID NO: 7370532 - DNA, 22 bp, Homo sapiens
tgtcaggtctaaaatgggtctc

SEQ ID NO: 7370533 - DNA, 18 bp, Homo sapiens
tgtcagtaaagtgacaga

SEQ ID NO: 7370534 - DNA, 20 bp, Homo sapiens
tgtcagtgcctgaggcacag

SEQ ID NO: 7370535 - DNA, 22 bp, Homo sapiens
tgtcagtgacagatttatgatc

SEQ ID NO: 7370536 - DNA, 22 bp, Homo sapiens
tgtcatagtgtggtagcagtgg

SEQ ID NO: 7370537 - DNA, 22 bp, Homo sapiens
tgtcatatagaatgttctatga

SEQ ID NO: 7370538 - DNA, 22 bp, Homo sapiens
tgtcataagtgtttgcacccag

SEQ ID NO: 7370539 - DNA, 22 bp, Homo sapiens
tgtcagttcagtgattacaaaa

SEQ ID NO: 7370540 - DNA, 22 bp, Homo sapiens
tgtcagttcaattatagtaatt

SEQ ID NO: 7370541 - DNA, 22 bp, Homo sapiens
tgtcagttctcacttacataaa

SEQ ID NO: 7370542 - DNA, 21 bp, Homo sapiens
tgtcagttcatgtataggcca

SEQ ID NO: 7370543 - DNA, 22 bp, Homo sapiens
tgtcagttgctattccaggcct

SEQ ID NO: 7370544 - DNA, 18 bp, Homo sapiens
tgtccctgcaaataacat

SEQ ID NO: 7370545 - DNA, 22 bp, Homo sapiens
tgtccctggactccaggagcca

SEQ ID NO: 7370546 - DNA, 22 bp, Homo sapiens
tgtcccagggaaggcccagcac

SEQ ID NO: 7370547 - DNA, 22 bp, Homo sapiens
tgtcctcagatatgtctactct

SEQ ID NO: 7370548 - DNA, 22 bp, Homo sapiens
tgtcctcaggacctggcacagt

SEQ ID NO: 7370549 - DNA, 22 bp, Homo sapiens
tgtcctcacaggaatgaacttt

SEQ ID NO: 7370550 - DNA, 22 bp, Homo sapiens
tgtcctttgggagggcacagct

SEQ ID NO: 7370551 - DNA, 22 bp, Homo sapiens
tgtccttttggctgtctatggt

SEQ ID NO: 7370552 - DNA, 22 bp, Homo sapiens
tgtatatacatacacacatgaa

SEQ ID NO: 7370553 - DNA, 22 bp, Homo sapiens
tgtatgaagccagaatctgttt

SEQ ID NO: 7370554 - DNA, 22 bp, Homo sapiens
tgtatacactatgctatatggt

SEQ ID NO: 7370555 - DNA, 22 bp, Homo sapiens
tgtatacatgtgttcatgcatg

SEQ ID NO: 7370556 - DNA, 22 bp, Homo sapiens
tgtatacatttggtgcatattt

SEQ ID NO: 7370557 - DNA, 19 bp, Homo sapiens
tgtagctagtgtctatcca

SEQ ID NO: 7370558 - DNA, 22 bp, Homo sapiens
tgtagccagattgataatttga

SEQ ID NO: 7370559 - DNA, 22 bp, Homo sapiens
tgtagatacacacatatagtgg

SEQ ID NO: 7370560 - DNA, 22 bp, Homo sapiens
tgtagactttctttgtgttagt

SEQ ID NO: 7370561 - DNA, 22 bp, Homo sapiens
tgtagatattaattattccttt

SEQ ID NO: 7370562 - DNA, 22 bp, Homo sapiens
tgtagcaagagcaatccattgt

SEQ ID NO: 7370563 - DNA, 22 bp, Homo sapiens
tgtagattttggagtctacaag

SEQ ID NO: 7370564 - DNA, 22 bp, Homo sapiens
tgtactgtatgccaggcactat

SEQ ID NO: 7370565 - DNA, 22 bp, Homo sapiens
tgtactgtattcatctttaact

SEQ ID NO: 7370566 - DNA, 22 bp, Homo sapiens
tgtagaaactacacatgcaaca

SEQ ID NO: 7370567 - DNA, 22 bp, Homo sapiens
tgtcacataatttatctgtagg

SEQ ID NO: 7370568 - DNA, 22 bp, Homo sapiens
tgtcacatccattttgcaagta

SEQ ID NO: 7370569 - DNA, 22 bp, Homo sapiens
tgtcacattgaatatgatttat

SEQ ID NO: 7370570 - DNA, 22 bp, Homo sapiens
tgtcaaaaccttggaggcaagg

SEQ ID NO: 7370571 - DNA, 22 bp, Homo sapiens
tgtcaaaaataagagagattgt

SEQ ID NO: 7370572 - DNA, 22 bp, Homo sapiens
tgtatttttagacctttagacc

SEQ ID NO: 7370573 - DNA, 22 bp, Homo sapiens
tgtcacagagcgtgcaacagaa

SEQ ID NO: 7370574 - DNA, 22 bp, Homo sapiens
tgtcacagagcgtgcaacagaa

SEQ ID NO: 7370575 - DNA, 22 bp, Homo sapiens
tgtcacactgaccacatctgta

SEQ ID NO: 7370576 - DNA, 22 bp, Homo sapiens
tgtcacaaaaatcagtaattgc

SEQ ID NO: 7370577 - DNA, 17 bp, Homo sapiens
tgtatttatcatgtcag

SEQ ID NO: 7370578 - DNA, 22 bp, Homo sapiens
tgtattttctgaagataatcaa

SEQ ID NO: 7370579 - DNA, 22 bp, Homo sapiens
tgtattttctgaagataatcaa

SEQ ID NO: 7370580 - DNA, 22 bp, Homo sapiens
tgtattttctgaggagcattag

SEQ ID NO: 7370581 - DNA, 22 bp, Homo sapiens
tgtattttctgaagataatcaa

SEQ ID NO: 7370582 - DNA, 22 bp, Homo sapiens
tgtattttcagagtggcatttc

SEQ ID NO: 7370583 - DNA, 22 bp, Homo sapiens
tgtattttgagtccaatctcct

SEQ ID NO: 7370584 - DNA, 22 bp, Homo sapiens
tgtattttgtgaggatcactct

SEQ ID NO: 7370585 - DNA, 22 bp, Homo sapiens
tgtattttgtgaggatcactct

SEQ ID NO: 7370586 - DNA, 22 bp, Homo sapiens
tgtattttgtgaggatcactct

SEQ ID NO: 7370587 - DNA, 22 bp, Homo sapiens
tgtattttgagtccaatctcct

SEQ ID NO: 7370588 - DNA, 22 bp, Homo sapiens
tgtattttctgaggagcattag

SEQ ID NO: 7370589 - DNA, 22 bp, Homo sapiens
tgtatttaattgtatcatcaca

SEQ ID NO: 7370590 - DNA, 22 bp, Homo sapiens
tgtatttaattgtatcatcaca

SEQ ID NO: 7370591 - DNA, 20 bp, Homo sapiens
tgtatttaatgaaggctttt

SEQ ID NO: 7370592 - DNA, 22 bp, Homo sapiens
tgtatttaagctttacctaaaa

SEQ ID NO: 7370593 - DNA, 22 bp, Homo sapiens
tgtatttaagctttacctaaaa

SEQ ID NO: 7370594 - DNA, 22 bp, Homo sapiens
tgtatgtatacactgatcatca

SEQ ID NO: 7370595 - DNA, 22 bp, Homo sapiens
tgtatgcataaaattatttaca

SEQ ID NO: 7370596 - DNA, 17 bp, Homo sapiens
tgtatgcatatgctttt

SEQ ID NO: 7370597 - DNA, 22 bp, Homo sapiens
tgtatgcaccattgtattacct

SEQ ID NO: 7370598 - DNA, 22 bp, Homo sapiens
ttcattcatgtattgtctatgg

SEQ ID NO: 7370599 - DNA, 22 bp, Homo sapiens
ttcattcattcatgaatgttaa

SEQ ID NO: 7370600 - DNA, 20 bp, Homo sapiens
ttcattcattccacaacttc

SEQ ID NO: 7370601 - DNA, 22 bp, Homo sapiens
ttcattcttgtctttgtatagt

SEQ ID NO: 7370602 - DNA, 22 bp, Homo sapiens
ttcattctttgaatctgaggta

SEQ ID NO: 7370603 - DNA, 19 bp, Homo sapiens
ttcattctttctacttacc

SEQ ID NO: 7370604 - DNA, 19 bp, Homo sapiens
ttcattctttctacttacc

SEQ ID NO: 7370605 - DNA, 22 bp, Homo sapiens
ttcattcttttacatgtgaata

SEQ ID NO: 7370606 - DNA, 22 bp, Homo sapiens
ttcaggacaaagggtaacaact

SEQ ID NO: 7370607 - DNA, 21 bp, Homo sapiens
ttcaggacaggaaaaacaggg

SEQ ID NO: 7370608 - DNA, 21 bp, Homo sapiens
ttcattcatggcataatatag

SEQ ID NO: 7370609 - DNA, 22 bp, Homo sapiens
ttcattcatctctaaaatgcct

SEQ ID NO: 7370610 - DNA, 22 bp, Homo sapiens
ttcattcatcacatgcagctgg

SEQ ID NO: 7370611 - DNA, 22 bp, Homo sapiens
ttcattcaggtgtatttatggg

SEQ ID NO: 7370612 - DNA, 22 bp, Homo sapiens
ttcattcaggtgtatttatggg

SEQ ID NO: 7370613 - DNA, 22 bp, Homo sapiens
ttcattcacccaggaaacatct

SEQ ID NO: 7370614 - DNA, 22 bp, Homo sapiens
ttcattcaaagaggcatccaag

SEQ ID NO: 7370615 - DNA, 22 bp, Homo sapiens
ttcattcacccaggaaacatct

SEQ ID NO: 7370616 - DNA, 22 bp, Homo sapiens
ttcattcaaagaggcatccaag

SEQ ID NO: 7370617 - DNA, 22 bp, Homo sapiens
ttccagctaactcacatccctt

SEQ ID NO: 7370618 - DNA, 22 bp, Homo sapiens
ttcactataaagtttcaacttt

SEQ ID NO: 7370619 - DNA, 22 bp, Homo sapiens
ttcactataaagtttcaacttt

SEQ ID NO: 7370620 - DNA, 22 bp, Homo sapiens
ttcagcaggtggtgagttctgc

SEQ ID NO: 7370621 - DNA, 21 bp, Homo sapiens
ttcagcagcatgttgtctgtt

SEQ ID NO: 7370622 - DNA, 17 bp, Homo sapiens
ttcagcagtgtttctcc

SEQ ID NO: 7370623 - DNA, 17 bp, Homo sapiens
ttcagcagtgtttctcc

SEQ ID NO: 7370624 - DNA, 22 bp, Homo sapiens
ttcagcagttcctattagatgt

SEQ ID NO: 7370625 - DNA, 22 bp, Homo sapiens
ttcacatttgcccttatgtgtg

SEQ ID NO: 7370626 - DNA, 20 bp, Homo sapiens
ttcacatttctgtagtgatt

SEQ ID NO: 7370627 - DNA, 22 bp, Homo sapiens
ttatttctactattttgcctga

SEQ ID NO: 7370628 - DNA, 22 bp, Homo sapiens
ttatttctactattttgcctga

SEQ ID NO: 7370629 - DNA, 22 bp, Homo sapiens
ttatttcttgtctatgtagcca

SEQ ID NO: 7370630 - DNA, 22 bp, Homo sapiens
ttatttggttgctgacttggaa

SEQ ID NO: 7370631 - DNA, 22 bp, Homo sapiens
ttatttggaaatatggcttctg

SEQ ID NO: 7370632 - DNA, 22 bp, Homo sapiens
ttaatggttagtaatggttatt

SEQ ID NO: 7370633 - DNA, 22 bp, Homo sapiens
ttaataaagtatgaattggaaa

SEQ ID NO: 7370634 - DNA, 22 bp, Homo sapiens
ttaataaagtatgaattggaaa

SEQ ID NO: 7370635 - DNA, 22 bp, Homo sapiens
ttaataaagtatgaattggaaa

SEQ ID NO: 7370636 - DNA, 23 bp, Homo sapiens
ttaaacttcagtgcagaacactc

SEQ ID NO: 7370637 - DNA, 22 bp, Homo sapiens
ttaaagagaaagtgtttgtctt

SEQ ID NO: 7370638 - DNA, 22 bp, Homo sapiens
ttaaagagtctactgcacatcc

SEQ ID NO: 7370639 - DNA, 22 bp, Homo sapiens
ttaaagagtaatcataggtcaa

SEQ ID NO: 7370640 - DNA, 22 bp, Homo sapiens
ttaaagaggtagttaggtttaa

SEQ ID NO: 7370641 - DNA, 22 bp, Homo sapiens
ttaaagagggaaagacttcaga

SEQ ID NO: 7370642 - DNA, 22 bp, Homo sapiens
ttaaagagtttattacttgtaa

SEQ ID NO: 7370643 - DNA, 22 bp, Homo sapiens
ttaaagatgcagctttagagaa

SEQ ID NO: 7370644 - DNA, 22 bp, Homo sapiens
ttacaacttgcagaggatgttg

SEQ ID NO: 7370645 - DNA, 21 bp, Homo sapiens
ttacaacatttgtgttctatg

SEQ ID NO: 7370646 - DNA, 21 bp, Homo sapiens
ttacaacatttgtgttctatg

SEQ ID NO: 7370647 - DNA, 22 bp, Homo sapiens
ttacaacatatttagcttgatt

SEQ ID NO: 7370648 - DNA, 22 bp, Homo sapiens
ttacaacagacacatattctaa

SEQ ID NO: 7370649 - DNA, 22 bp, Homo sapiens
ttacaacaaaggcacgtgcatg

SEQ ID NO: 7370650 - DNA, 22 bp, Homo sapiens
ttaattaaattcatgagcattg

SEQ ID NO: 7370651 - DNA, 22 bp, Homo sapiens
ttaattaaattcatgagcattg

SEQ ID NO: 7370652 - DNA, 22 bp, Homo sapiens
ttacaaagagaagttgtagaat

SEQ ID NO: 7370653 - DNA, 22 bp, Homo sapiens
ttacaaagtgttatgataaaca

SEQ ID NO: 7370654 - DNA, 21 bp, Homo sapiens
ttacaaagctacagatgttgc

SEQ ID NO: 7370655 - DNA, 21 bp, Homo sapiens
ttacaaagctacagatgttgc

SEQ ID NO: 7370656 - DNA, 22 bp, Homo sapiens
ttacacaaacacattccagata

SEQ ID NO: 7370657 - DNA, 22 bp, Homo sapiens
ttacacaaaaataagatatggc

SEQ ID NO: 7370658 - DNA, 22 bp, Homo sapiens
ttacagatacatttcttttgtt

SEQ ID NO: 7370659 - DNA, 22 bp, Homo sapiens
ttacagagtggtctggctatgt

SEQ ID NO: 7370660 - DNA, 22 bp, Homo sapiens
ttacaattgagtctattgtatg

SEQ ID NO: 7370661 - DNA, 22 bp, Homo sapiens
ttacaattgagtctattgtatg

SEQ ID NO: 7370662 - DNA, 22 bp, Homo sapiens
ttacaattgagtctattgtatg

SEQ ID NO: 7370663 - DNA, 23 bp, Homo sapiens
ttacatgtgtgcacacattctgg

SEQ ID NO: 7370664 - DNA, 22 bp, Homo sapiens
ttacatgtattttggaaaaagt

SEQ ID NO: 7370665 - DNA, 22 bp, Homo sapiens
ttacatgtaatctaaaataatt

SEQ ID NO: 7370666 - DNA, 21 bp, Homo sapiens
ttacatggtttatcatatgga

SEQ ID NO: 7370667 - DNA, 22 bp, Homo sapiens
ttacattgtccagaaattattg

SEQ ID NO: 7370668 - DNA, 22 bp, Homo sapiens
ttacattcttggaatcttgttt

SEQ ID NO: 7370669 - DNA, 22 bp, Homo sapiens
ttacattcttggaatcttgttt

SEQ ID NO: 7370670 - DNA, 22 bp, Homo sapiens
ttacattcttatctcagttatt

SEQ ID NO: 7370671 - DNA, 21 bp, Homo sapiens
ttacattcagaggagtggaag

SEQ ID NO: 7370672 - DNA, 22 bp, Homo sapiens
ttacattcccagtgtgcagcat

SEQ ID NO: 7370673 - DNA, 22 bp, Homo sapiens
ttacattcattgaagtgattca

SEQ ID NO: 7370674 - DNA, 22 bp, Homo sapiens
ttacattcagaaagatttgagt

SEQ ID NO: 7370675 - DNA, 21 bp, Homo sapiens
ttacattcagaggagtggaag

SEQ ID NO: 7370676 - DNA, 22 bp, Homo sapiens
ttacattcaatttctagaggta

SEQ ID NO: 7370677 - DNA, 22 bp, Homo sapiens
ttacattcaatttctagaggta

SEQ ID NO: 7370678 - DNA, 22 bp, Homo sapiens
ttacattcaaggaactcattct

SEQ ID NO: 7370679 - DNA, 22 bp, Homo sapiens
ttacatttcccccttggaggct

SEQ ID NO: 7370680 - DNA, 22 bp, Homo sapiens
ttacatttggctatgtcctcta

SEQ ID NO: 7370681 - DNA, 22 bp, Homo sapiens
ttacatttggctatgtcctcta

SEQ ID NO: 7370682 - DNA, 22 bp, Homo sapiens
ttacattttagttaacctgtga

SEQ ID NO: 7370683 - DNA, 22 bp, Homo sapiens
ttacattttgcacagatgtccc

SEQ ID NO: 7370684 - DNA, 22 bp, Homo sapiens
ttacattttgcacagatgtccc

SEQ ID NO: 7370685 - DNA, 22 bp, Homo sapiens
ttacatgactgcccttgtcagg

SEQ ID NO: 7370686 - DNA, 22 bp, Homo sapiens
ttacatgaggttaattaagcat

SEQ ID NO: 7370687 - DNA, 22 bp, Homo sapiens
ttacagatggggttgcaataaa

SEQ ID NO: 7370688 - DNA, 22 bp, Homo sapiens
ttacagatggatctagcaaaat

SEQ ID NO: 7370689 - DNA, 22 bp, Homo sapiens
ttagatatgtttttgctaatgc

SEQ ID NO: 7370690 - DNA, 22 bp, Homo sapiens
ttagaacatagcaacagaatta

SEQ ID NO: 7370691 - DNA, 22 bp, Homo sapiens
ttagaacatagcaacagaatta

SEQ ID NO: 7370692 - DNA, 22 bp, Homo sapiens
ttacattttgcacagatgtccc

SEQ ID NO: 7370693 - DNA, 22 bp, Homo sapiens
ttacattttggggtaaggataa

SEQ ID NO: 7370694 - DNA, 22 bp, Homo sapiens
ttacattttgcacagatgtccc

SEQ ID NO: 7370695 - DNA, 22 bp, Homo sapiens
ttagaaatacaagtgaggttga

SEQ ID NO: 7370696 - DNA, 22 bp, Homo sapiens
ttagaaatcacctctgaagatc

SEQ ID NO: 7370697 - DNA, 22 bp, Homo sapiens
ttagaaatgatttcacctcttt

SEQ ID NO: 7370698 - DNA, 22 bp, Homo sapiens
ttagaaatgcacccaagaccta

SEQ ID NO: 7370699 - DNA, 22 bp, Homo sapiens
ttagaaatgcacccaagaccta

SEQ ID NO: 7370700 - DNA, 22 bp, Homo sapiens
ttagaaatctgctgccatgcaa

SEQ ID NO: 7370701 - DNA, 22 bp, Homo sapiens
ttagaaatgtcacagatctgat

SEQ ID NO: 7370702 - DNA, 22 bp, Homo sapiens
ttagaaatgtcacagatctgat

SEQ ID NO: 7370703 - DNA, 22 bp, Homo sapiens
ttagcactggatttcatcagaa

SEQ ID NO: 7370704 - DNA, 22 bp, Homo sapiens
ttagcactttgattcatgcaga

SEQ ID NO: 7370705 - DNA, 22 bp, Homo sapiens
ttagcaaaaatatctcatatta

SEQ ID NO: 7370706 - DNA, 22 bp, Homo sapiens
ttagcaaaaatatctcatatta

SEQ ID NO: 7370707 - DNA, 17 bp, Homo sapiens
ttagcaaaatagcactt

SEQ ID NO: 7370708 - DNA, 17 bp, Homo sapiens
ttagcaaaatagcactt

SEQ ID NO: 7370709 - DNA, 22 bp, Homo sapiens
ttagatttacaagcactgttta

SEQ ID NO: 7370710 - DNA, 22 bp, Homo sapiens
ttagattattgagcatccactg

SEQ ID NO: 7370711 - DNA, 22 bp, Homo sapiens
ttaggtattttgttatgtcagc

SEQ ID NO: 7370712 - DNA, 22 bp, Homo sapiens
ttagtaaataaagtctactttc

SEQ ID NO: 7370713 - DNA, 19 bp, Homo sapiens
ttaggtattattgctttcc

SEQ ID NO: 7370714 - DNA, 22 bp, Homo sapiens
ttattcagggataacatccagg

SEQ ID NO: 7370715 - DNA, 22 bp, Homo sapiens
ttattcagttcccttcactctc

SEQ ID NO: 7370716 - DNA, 22 bp, Homo sapiens
ttattcagtttgtgtagaggtg

SEQ ID NO: 7370717 - DNA, 22 bp, Homo sapiens
ttattcagggataacatccagg

SEQ ID NO: 7370718 - DNA, 22 bp, Homo sapiens
ttattcatcagtgcattaattt

SEQ ID NO: 7370719 - DNA, 22 bp, Homo sapiens
ttattccatagaagtcaaggaa

SEQ ID NO: 7370720 - DNA, 22 bp, Homo sapiens
ttatgatttgccacagattggt

SEQ ID NO: 7370721 - DNA, 22 bp, Homo sapiens
ttatgatttgccacagattggt

SEQ ID NO: 7370722 - DNA, 22 bp, Homo sapiens
ttatgagactgttttacacact

SEQ ID NO: 7370723 - DNA, 18 bp, Homo sapiens
ttatgcaaaactgttttc

SEQ ID NO: 7370724 - DNA, 22 bp, Homo sapiens
ttattattccccaagtcattat

SEQ ID NO: 7370725 - DNA, 22 bp, Homo sapiens
ttatgaaaacaatcagtaggca

SEQ ID NO: 7370726 - DNA, 22 bp, Homo sapiens
ttatgaaaacaatcagtaggca

SEQ ID NO: 7370727 - DNA, 22 bp, Homo sapiens
ttatgaacaatttctaggaatg

SEQ ID NO: 7370728 - DNA, 22 bp, Homo sapiens
ttagtgattactacatagatga

SEQ ID NO: 7370729 - DNA, 22 bp, Homo sapiens
ttagtgatcaaaatcaaaattg

SEQ ID NO: 7370730 - DNA, 22 bp, Homo sapiens
ttagtgataggaagccagattg

SEQ ID NO: 7370731 - DNA, 22 bp, Homo sapiens
tgtggggacccatgccatgggc

SEQ ID NO: 7370732 - DNA, 22 bp, Homo sapiens
tgtggggactgagtggaggctt

SEQ ID NO: 7370733 - DNA, 22 bp, Homo sapiens
tgtggggacctggctgccaccc

SEQ ID NO: 7370734 - DNA, 22 bp, Homo sapiens
tgtgtactcaattgagccattt

SEQ ID NO: 7370735 - DNA, 20 bp, Homo sapiens
tgtgggcccttggctggcaa

SEQ ID NO: 7370736 - DNA, 22 bp, Homo sapiens
tgtgggccctaggcaccttgtc

SEQ ID NO: 7370737 - DNA, 22 bp, Homo sapiens
tgtggctgactcctggtcccca

SEQ ID NO: 7370738 - DNA, 22 bp, Homo sapiens
tgtggctccactccacattaat

SEQ ID NO: 7370739 - DNA, 22 bp, Homo sapiens
tgtggcgagaacattggaccat

SEQ ID NO: 7370740 - DNA, 22 bp, Homo sapiens
tgtggaagggacactggactgg

SEQ ID NO: 7370741 - DNA, 22 bp, Homo sapiens
tgtgggagaaggaagcaagctg

SEQ ID NO: 7370742 - DNA, 22 bp, Homo sapiens
tgtgggaggaacacagccagaa

SEQ ID NO: 7370743 - DNA, 22 bp, Homo sapiens
tgtgtggatgcagcgtgggtct

SEQ ID NO: 7370744 - DNA, 21 bp, Homo sapiens
tgtgtgggcatatctgctgca

SEQ ID NO: 7370745 - DNA, 22 bp, Homo sapiens
tgtgtgggagcacgggctgttg

SEQ ID NO: 7370746 - DNA, 22 bp, Homo sapiens
tgtgtagaggtaagtaacactt

SEQ ID NO: 7370747 - DNA, 17 bp, Homo sapiens
tgtgtagagcatcgcca

SEQ ID NO: 7370748 - DNA, 22 bp, Homo sapiens
tgtgtagaaagatctccaagat

SEQ ID NO: 7370749 - DNA, 22 bp, Homo sapiens
tgtgtattaccattttacagct

SEQ ID NO: 7370750 - DNA, 22 bp, Homo sapiens
tgtgtgcctgagccgtgcctgg

SEQ ID NO: 7370751 - DNA, 22 bp, Homo sapiens
tgtgtgtgtttctgctcataca

SEQ ID NO: 7370752 - DNA, 22 bp, Homo sapiens
tgtgtgtgggcggaacggcccc

SEQ ID NO: 7370753 - DNA, 22 bp, Homo sapiens
tgtgtgtggggaggcagcagat

SEQ ID NO: 7370754 - DNA, 22 bp, Homo sapiens
tgtgtgtgcaggagagcaggtg

SEQ ID NO: 7370755 - DNA, 21 bp, Homo sapiens
tgtgtgtgcaggcacacacac

SEQ ID NO: 7370756 - DNA, 22 bp, Homo sapiens
tgtgtgtgttcctcctcagcta

SEQ ID NO: 7370757 - DNA, 22 bp, Homo sapiens
tgtgtgtgtgcgcgcacgcata

SEQ ID NO: 7370758 - DNA, 22 bp, Homo sapiens
tgtttaagatccgtcagtcact

SEQ ID NO: 7370759 - DNA, 22 bp, Homo sapiens
tgtttaaccatctgcttttatg

SEQ ID NO: 7370760 - DNA, 22 bp, Homo sapiens
tgttggggtcaggagctagcct

SEQ ID NO: 7370761 - DNA, 19 bp, Homo sapiens
tgttgaagattatttgtgg

SEQ ID NO: 7370762 - DNA, 22 bp, Homo sapiens
tgtttattgagtgcctactata

SEQ ID NO: 7370763 - DNA, 22 bp, Homo sapiens
tgtttattcatggctaatgaaa

SEQ ID NO: 7370764 - DNA, 22 bp, Homo sapiens
tgtttattcatggctaatgaaa

SEQ ID NO: 7370765 - DNA, 22 bp, Homo sapiens
tgtttatagggtctgtcacttg

SEQ ID NO: 7370766 - DNA, 22 bp, Homo sapiens
tgttagaaattattagtaatat

SEQ ID NO: 7370767 - DNA, 22 bp, Homo sapiens
tgttacttcttggtaaaggaga

SEQ ID NO: 7370768 - DNA, 22 bp, Homo sapiens
tgttacttcttatttcttacat

SEQ ID NO: 7370769 - DNA, 18 bp, Homo sapiens
tgttaaatgaagatttgc

SEQ ID NO: 7370770 - DNA, 22 bp, Homo sapiens
tgttaaatgagattggaatttg

SEQ ID NO: 7370771 - DNA, 22 bp, Homo sapiens
tgttaaattgattcacctttct

SEQ ID NO: 7370772 - DNA, 22 bp, Homo sapiens
tgttagaatattgtaatattcg

SEQ ID NO: 7370773 - DNA, 22 bp, Homo sapiens
tgttctttgccagtgatttaat

SEQ ID NO: 7370774 - DNA, 22 bp, Homo sapiens
tgttctttgccagtgatttaat

SEQ ID NO: 7370775 - DNA, 22 bp, Homo sapiens
tgttctttcagttagacacagt

SEQ ID NO: 7370776 - DNA, 22 bp, Homo sapiens
ttaaaattatggcccatttgga

SEQ ID NO: 7370777 - DNA, 22 bp, Homo sapiens
ttaaaatttccccaccatgtat

SEQ ID NO: 7370778 - DNA, 22 bp, Homo sapiens
ttaaaatttccccaccatgtat

SEQ ID NO: 7370779 - DNA, 22 bp, Homo sapiens
ttaaaatttccccaccatgtat

SEQ ID NO: 7370780 - DNA, 22 bp, Homo sapiens
ttaaaatttccccaccatgtat

SEQ ID NO: 7370781 - DNA, 22 bp, Homo sapiens
ttaaaatttccccaccatgtat

SEQ ID NO: 7370782 - DNA, 22 bp, Homo sapiens
ttaaaacagcgtgaatctggca

SEQ ID NO: 7370783 - DNA, 22 bp, Homo sapiens
ttaaaaatatgtagggcccgat

SEQ ID NO: 7370784 - DNA, 22 bp, Homo sapiens
ttaaaaaccatcttcctttcct

SEQ ID NO: 7370785 - DNA, 22 bp, Homo sapiens
tgtttcaaaacagtgataattt

SEQ ID NO: 7370786 - DNA, 22 bp, Homo sapiens
tgtttcaactgttaagatatgc

SEQ ID NO: 7370787 - DNA, 22 bp, Homo sapiens
tgtttcaactgttaagatatgc

SEQ ID NO: 7370788 - DNA, 22 bp, Homo sapiens
tgtttgtgctgcctggtgggca

SEQ ID NO: 7370789 - DNA, 22 bp, Homo sapiens
tgttttaagagcgcactttata

SEQ ID NO: 7370790 - DNA, 22 bp, Homo sapiens
tgttttaagggtcaactgtcac

SEQ ID NO: 7370791 - DNA, 22 bp, Homo sapiens
tgttttaatctcccattgctct

SEQ ID NO: 7370792 - DNA, 22 bp, Homo sapiens
tgttttaatctcccattgctct

SEQ ID NO: 7370793 - DNA, 22 bp, Homo sapiens
tgtcttaagtagattacagcct

SEQ ID NO: 7370794 - DNA, 22 bp, Homo sapiens
tgtctgtggcaattgtgggtaa

SEQ ID NO: 7370795 - DNA, 22 bp, Homo sapiens
tgtcttcaaatattgaaatcct

SEQ ID NO: 7370796 - DNA, 22 bp, Homo sapiens
tgtcttcaggagtaaatatcat

SEQ ID NO: 7370797 - DNA, 22 bp, Homo sapiens
tgtcttttacctaatgagctgg

SEQ ID NO: 7370798 - DNA, 22 bp, Homo sapiens
tgtcttttagtttgtgagatct

SEQ ID NO: 7370799 - DNA, 22 bp, Homo sapiens
tgtcttttataactgacatata

SEQ ID NO: 7370800 - DNA, 22 bp, Homo sapiens
tgtcttttataactgacatata

SEQ ID NO: 7370801 - DNA, 22 bp, Homo sapiens
tgtcttttgccaaagatcagtt

SEQ ID NO: 7370802 - DNA, 22 bp, Homo sapiens
tgtcttttggagcatctttctt

SEQ ID NO: 7370803 - DNA, 22 bp, Homo sapiens
tgtgaaaagcgtgtgttctagg

SEQ ID NO: 7370804 - DNA, 22 bp, Homo sapiens
tgtctttaaaattaaacacatc

SEQ ID NO: 7370805 - DNA, 22 bp, Homo sapiens
tgtcttcttcataaggagagtg

SEQ ID NO: 7370806 - DNA, 17 bp, Homo sapiens
tgtcttctgaagagagc

SEQ ID NO: 7370807 - DNA, 17 bp, Homo sapiens
tgtcttctgaagagagc

SEQ ID NO: 7370808 - DNA, 17 bp, Homo sapiens
tgtcttctgaagagagc

SEQ ID NO: 7370809 - DNA, 22 bp, Homo sapiens
tgtcttctaccttgacagcatt

SEQ ID NO: 7370810 - DNA, 22 bp, Homo sapiens
tgtcttctaccttgacagcatt

SEQ ID NO: 7370811 - DNA, 22 bp, Homo sapiens
tgtcttcgctacaatgaaaagg

SEQ ID NO: 7370812 - DNA, 22 bp, Homo sapiens
tgtctgccctcaacccagaggc

SEQ ID NO: 7370813 - DNA, 22 bp, Homo sapiens
tgtctgccattagcccagtcca

SEQ ID NO: 7370814 - DNA, 22 bp, Homo sapiens
tgtctgccaaagcttcctcctg

SEQ ID NO: 7370815 - DNA, 22 bp, Homo sapiens
tgtctctgaggtgagggtcagc

SEQ ID NO: 7370816 - DNA, 18 bp, Homo sapiens
tgtctctgaattccagtg

SEQ ID NO: 7370817 - DNA, 22 bp, Homo sapiens
tgtctctttgggttcctcttgg

SEQ ID NO: 7370818 - DNA, 22 bp, Homo sapiens
tgtctacttgggctctacagca

SEQ ID NO: 7370819 - DNA, 22 bp, Homo sapiens
tgtctcctaatgtctgtttcct

SEQ ID NO: 7370820 - DNA, 22 bp, Homo sapiens
tgtctcctactgcctgtggatc

SEQ ID NO: 7370821 - DNA, 18 bp, Homo sapiens
tgtctctcctttctgtgt

SEQ ID NO: 7370822 - DNA, 20 bp, Homo sapiens
tgtctctcggttttgtgact

SEQ ID NO: 7370823 - DNA, 22 bp, Homo sapiens
tgtctctcatttagttttgcac

SEQ ID NO: 7370824 - DNA, 22 bp, Homo sapiens
tgtgactgaggctccaagctag

SEQ ID NO: 7370825 - DNA, 22 bp, Homo sapiens
tgtgactggagtccagcccact

SEQ ID NO: 7370826 - DNA, 22 bp, Homo sapiens
tgtgacctcatcttaactggaa

SEQ ID NO: 7370827 - DNA, 22 bp, Homo sapiens
tgtgcaaaataataaatcactg

SEQ ID NO: 7370828 - DNA, 22 bp, Homo sapiens
tgtgcaaaataataaatcactg

SEQ ID NO: 7370829 - DNA, 22 bp, Homo sapiens
tgtgcaaaataataaatcactg

SEQ ID NO: 7370830 - DNA, 22 bp, Homo sapiens
tgtgatactggtttatatcatt

SEQ ID NO: 7370831 - DNA, 22 bp, Homo sapiens
tgtgagattgttttactataat

SEQ ID NO: 7370832 - DNA, 22 bp, Homo sapiens
tgtgagcactatggctaggctc

SEQ ID NO: 7370833 - DNA, 22 bp, Homo sapiens
tgtgagttattttcaggagttt

SEQ ID NO: 7370834 - DNA, 22 bp, Homo sapiens
tgtgagttcttagaaagtcagt

SEQ ID NO: 7370835 - DNA, 22 bp, Homo sapiens
tgtgagtgacagttcccttggt

SEQ ID NO: 7370836 - DNA, 22 bp, Homo sapiens
tgtgaaatattggcaatttcat

SEQ ID NO: 7370837 - DNA, 22 bp, Homo sapiens
tgtgaaatatttatatactcaa

SEQ ID NO: 7370838 - DNA, 22 bp, Homo sapiens
tgtgaaatgagtatatttgaat

SEQ ID NO: 7370839 - DNA, 22 bp, Homo sapiens
tgtgaaatgaagataattcttg

SEQ ID NO: 7370840 - DNA, 22 bp, Homo sapiens
tgtgaaattgagaaactttcac

SEQ ID NO: 7370841 - DNA, 22 bp, Homo sapiens
tgtgaaatgtgtgtataattaa

SEQ ID NO: 7370842 - DNA, 22 bp, Homo sapiens
tgtgaagtccagagaagtcagg

SEQ ID NO: 7370843 - DNA, 22 bp, Homo sapiens
tgtgctcactctaaattaagat

SEQ ID NO: 7370844 - DNA, 22 bp, Homo sapiens
tgtgctatttttgcatatgtgt

SEQ ID NO: 7370845 - DNA, 22 bp, Homo sapiens
tgtgctgagcaaatccatctgt

SEQ ID NO: 7370846 - DNA, 22 bp, Homo sapiens
tgtggaaagtggtctaagcaca

SEQ ID NO: 7370847 - DNA, 22 bp, Homo sapiens
tgtgcctggcccagtggtgtca

SEQ ID NO: 7370848 - DNA, 22 bp, Homo sapiens
tgtgcagatagtgatttcagaa

SEQ ID NO: 7370849 - DNA, 22 bp, Homo sapiens
tgtgcacaggaagctattctct

SEQ ID NO: 7370850 - DNA, 22 bp, Homo sapiens
tgtgcacatatactcatattcc

SEQ ID NO: 7370851 - DNA, 18 bp, Homo sapiens
tgtgcaatattaaccacc

SEQ ID NO: 7370852 - DNA, 22 bp, Homo sapiens
tgtgcaaattaagtagattttc

SEQ ID NO: 7370853 - DNA, 22 bp, Homo sapiens
tgtgcaaagtgtacaaattaat

SEQ ID NO: 7370854 - DNA, 20 bp, Homo sapiens
tgtgccaaaactgtttgctt

SEQ ID NO: 7370855 - DNA, 22 bp, Homo sapiens
agcccagggctaataggaacca

SEQ ID NO: 7370856 - DNA, 22 bp, Homo sapiens
agcccagctttgaaccatatca

SEQ ID NO: 7370857 - DNA, 22 bp, Homo sapiens
acagacagtatggtggggctga

SEQ ID NO: 7370858 - DNA, 22 bp, Homo sapiens
acagacatcatcaacatcttcc

SEQ ID NO: 7370859 - DNA, 22 bp, Homo sapiens
agccaggaattggacaacacat

SEQ ID NO: 7370860 - DNA, 22 bp, Homo sapiens
agccaggacagggcagctcgct

SEQ ID NO: 7370861 - DNA, 22 bp, Homo sapiens
agccaggacagggcagctcgct

SEQ ID NO: 7370862 - DNA, 19 bp, Homo sapiens
agcatctccctgatcattc

SEQ ID NO: 7370863 - DNA, 22 bp, Homo sapiens
agcattcattgctagaatgtaa

SEQ ID NO: 7370864 - DNA, 22 bp, Homo sapiens
agcattcatgatgacaacagga

SEQ ID NO: 7370865 - DNA, 20 bp, Homo sapiens
agcattcattcagcaagcct

SEQ ID NO: 7370866 - DNA, 22 bp, Homo sapiens
agcattcaagtaattcacttgg

SEQ ID NO: 7370867 - DNA, 22 bp, Homo sapiens
agcattcaatgattggacttgc

SEQ ID NO: 7370868 - DNA, 22 bp, Homo sapiens
agcattccacactgaagtctgc

SEQ ID NO: 7370869 - DNA, 22 bp, Homo sapiens
agcctgtgtgaagccctcagag

SEQ ID NO: 7370870 - DNA, 22 bp, Homo sapiens
agcctgtgggagccgctcccgt

SEQ ID NO: 7370871 - DNA, 22 bp, Homo sapiens
agcctgtggatccctgcactgg

SEQ ID NO: 7370872 - DNA, 22 bp, Homo sapiens
agcctggctgtaacctcatggt

SEQ ID NO: 7370873 - DNA, 22 bp, Homo sapiens
agcctggctgtaacctcatggt

SEQ ID NO: 7370874 - DNA, 22 bp, Homo sapiens
agcctggctgggaagagcctct

SEQ ID NO: 7370875 - DNA, 22 bp, Homo sapiens
agcctggctaaattctcccatg

SEQ ID NO: 7370876 - DNA, 22 bp, Homo sapiens
agcctggcttaatcctcctttt

SEQ ID NO: 7370877 - DNA, 22 bp, Homo sapiens
agctcaggccggagctacaggc

SEQ ID NO: 7370878 - DNA, 22 bp, Homo sapiens
agctcagggctccaggaccgct

SEQ ID NO: 7370879 - DNA, 22 bp, Homo sapiens
agctcaggctctgcagggacta

SEQ ID NO: 7370880 - DNA, 22 bp, Homo sapiens
agctcagtggctcagtgggtat

SEQ ID NO: 7370881 - DNA, 22 bp, Homo sapiens
agccctgggttagggtgggagc

SEQ ID NO: 7370882 - DNA, 20 bp, Homo sapiens
agccctgtaaatcccctgga

SEQ ID NO: 7370883 - DNA, 22 bp, Homo sapiens
agccctgtgtgcttgtgttcct

SEQ ID NO: 7370884 - DNA, 22 bp, Homo sapiens
agccctgtgggccttgtggcac

SEQ ID NO: 7370885 - DNA, 22 bp, Homo sapiens
agccctgtctctcactccaggt

SEQ ID NO: 7370886 - DNA, 21 bp, Homo sapiens
agcctggcccagggggaggct

SEQ ID NO: 7370887 - DNA, 22 bp, Homo sapiens
agcctggccctgctgaactctg

SEQ ID NO: 7370888 - DNA, 22 bp, Homo sapiens
agcctggcctgggcaggcacat

SEQ ID NO: 7370889 - DNA, 22 bp, Homo sapiens
agcctggcggtcgtcggtcagg

SEQ ID NO: 7370890 - DNA, 22 bp, Homo sapiens
agcctggccaggcctgcccagg

SEQ ID NO: 7370891 - DNA, 22 bp, Homo sapiens
agccctgtgtgcttgtgttcct

SEQ ID NO: 7370892 - DNA, 22 bp, Homo sapiens
agccctgttaactgttttgaag

SEQ ID NO: 7370893 - DNA, 22 bp, Homo sapiens
agcctgctgggaagggaggctt

SEQ ID NO: 7370894 - DNA, 22 bp, Homo sapiens
agcccctgtttttccagtcaga

SEQ ID NO: 7370895 - DNA, 22 bp, Homo sapiens
agcccctgtcctctctgatgac

SEQ ID NO: 7370896 - DNA, 22 bp, Homo sapiens
agatttgtcttggtctcatctg

SEQ ID NO: 7370897 - DNA, 22 bp, Homo sapiens
agatttgtcctgctttctacct

SEQ ID NO: 7370898 - DNA, 21 bp, Homo sapiens
agatttgtcccttcccattta

SEQ ID NO: 7370899 - DNA, 22 bp, Homo sapiens
agatttgatatcatgcaacaaa

SEQ ID NO: 7370900 - DNA, 22 bp, Homo sapiens
agattcaggactggccacagcc

SEQ ID NO: 7370901 - DNA, 21 bp, Homo sapiens
agattcaggacagcagtcact

SEQ ID NO: 7370902 - DNA, 22 bp, Homo sapiens
agcagaaagcttattttgactg

SEQ ID NO: 7370903 - DNA, 22 bp, Homo sapiens
agcagaaatagaagtcaatgat

SEQ ID NO: 7370904 - DNA, 22 bp, Homo sapiens
acacacgtgctcaacacgctcc

SEQ ID NO: 7370905 - DNA, 22 bp, Homo sapiens
acacactgctcgctcagattaa

SEQ ID NO: 7370906 - DNA, 22 bp, Homo sapiens
acacacttcacccttgagctaa

SEQ ID NO: 7370907 - DNA, 22 bp, Homo sapiens
acacacttcacccttgagctaa

SEQ ID NO: 7370908 - DNA, 22 bp, Homo sapiens
acacacttcagatgtaatttgt

SEQ ID NO: 7370909 - DNA, 22 bp, Homo sapiens
agcagcagctcattcttcctgt

SEQ ID NO: 7370910 - DNA, 22 bp, Homo sapiens
agcagcagctcattcttcctgt

SEQ ID NO: 7370911 - DNA, 22 bp, Homo sapiens
agcagccaggaatctgcagagc

SEQ ID NO: 7370912 - DNA, 22 bp, Homo sapiens
agcagcagttgctgacgttcta

SEQ ID NO: 7370913 - DNA, 19 bp, Homo sapiens
agcagcagctaccacttgt

SEQ ID NO: 7370914 - DNA, 22 bp, Homo sapiens
agcagcagccgtagccttatta

SEQ ID NO: 7370915 - DNA, 22 bp, Homo sapiens
agcagcagccgtagccttatta

SEQ ID NO: 7370916 - DNA, 22 bp, Homo sapiens
agcagcagcattgagcgcttgt

SEQ ID NO: 7370917 - DNA, 22 bp, Homo sapiens
agcagcagcattgagcgcttgt

SEQ ID NO: 7370918 - DNA, 21 bp, Homo sapiens
agcagcagcagtggggcttct

SEQ ID NO: 7370919 - DNA, 23 bp, Homo sapiens
agcagcagcaattaagtggatat

SEQ ID NO: 7370920 - DNA, 19 bp, Homo sapiens
agcagcagcaccagggatt

SEQ ID NO: 7370921 - DNA, 19 bp, Homo sapiens
agcagcagcaccagggatt

SEQ ID NO: 7370922 - DNA, 22 bp, Homo sapiens
agcagcagattatggtctacat

SEQ ID NO: 7370923 - DNA, 21 bp, Homo sapiens
agcaggaggcagtcacagctc

SEQ ID NO: 7370924 - DNA, 22 bp, Homo sapiens
agcaggaggagagcctggcggt

SEQ ID NO: 7370925 - DNA, 22 bp, Homo sapiens
agcaggaggagagcctggcggt

SEQ ID NO: 7370926 - DNA, 22 bp, Homo sapiens
agcaggagctgtgggaagatgg

SEQ ID NO: 7370927 - DNA, 22 bp, Homo sapiens
agcagctgagatggtaagattc

SEQ ID NO: 7370928 - DNA, 22 bp, Homo sapiens
agcaggagtgtcccctggctgt

SEQ ID NO: 7370929 - DNA, 22 bp, Homo sapiens
agcaggagggttttgtagagtc

SEQ ID NO: 7370930 - DNA, 22 bp, Homo sapiens
agcaggagggttttgtagagtc

SEQ ID NO: 7370931 - DNA, 22 bp, Homo sapiens
agcaggagggttttgtagagtc

SEQ ID NO: 7370932 - DNA, 17 bp, Homo sapiens
agcagctgaagcagcca

SEQ ID NO: 7370933 - DNA, 17 bp, Homo sapiens
agcagctgaagcagcca

SEQ ID NO: 7370934 - DNA, 22 bp, Homo sapiens
agcagctgaaaggcaaacttct

SEQ ID NO: 7370935 - DNA, 22 bp, Homo sapiens
agcagctgaccagtgagtcctg

SEQ ID NO: 7370936 - DNA, 19 bp, Homo sapiens
agcagccatcgaccatgga

SEQ ID NO: 7370937 - DNA, 22 bp, Homo sapiens
agcagggcttctgtgcctgtgc

SEQ ID NO: 7370938 - DNA, 22 bp, Homo sapiens
agcagggcttgccgcttgtcct

SEQ ID NO: 7370939 - DNA, 22 bp, Homo sapiens
agcagggctttgcagacttggg

SEQ ID NO: 7370940 - DNA, 22 bp, Homo sapiens
agcagggctttgcagacttggg

SEQ ID NO: 7370941 - DNA, 22 bp, Homo sapiens
agcaggcatttgatatatattt

SEQ ID NO: 7370942 - DNA, 23 bp, Homo sapiens
agcaggcatctgtggcacaaggc

SEQ ID NO: 7370943 - DNA, 23 bp, Homo sapiens
agcaggcatctgtggcacaaggc

SEQ ID NO: 7370944 - DNA, 21 bp, Homo sapiens
agcaggcagtgggctggattt

SEQ ID NO: 7370945 - DNA, 22 bp, Homo sapiens
agcaggcagtgtagagccttca

SEQ ID NO: 7370946 - DNA, 22 bp, Homo sapiens
agcaggcatagagtagcactca

SEQ ID NO: 7370947 - DNA, 22 bp, Homo sapiens
agcagggctttggctggctttc

SEQ ID NO: 7370948 - DNA, 22 bp, Homo sapiens
agcagttatattgaaataaaaa

SEQ ID NO: 7370949 - DNA, 22 bp, Homo sapiens
agcagttatcgaagaatcaggt

SEQ ID NO: 7370950 - DNA, 22 bp, Homo sapiens
agcagttatgtgtctcttgact

SEQ ID NO: 7370951 - DNA, 19 bp, Homo sapiens
agcagttatatgcatggga

SEQ ID NO: 7370952 - DNA, 20 bp, Homo sapiens
agcaggtgacggggcctgct

SEQ ID NO: 7370953 - DNA, 22 bp, Homo sapiens
agacctctggatagatgtgagg

SEQ ID NO: 7370954 - DNA, 22 bp, Homo sapiens
agacctctgctcccttcatggt

SEQ ID NO: 7370955 - DNA, 22 bp, Homo sapiens
agacactggtgaagaaatcagg

SEQ ID NO: 7370956 - DNA, 22 bp, Homo sapiens
agactctggtcctcttgaattt

SEQ ID NO: 7370957 - DNA, 22 bp, Homo sapiens
agactctgtgctccttgctttc

SEQ ID NO: 7370958 - DNA, 21 bp, Homo sapiens
agactctggggatctctgtcc

SEQ ID NO: 7370959 - DNA, 17 bp, Homo sapiens
agacactgagccaagta

SEQ ID NO: 7370960 - DNA, 18 bp, Homo sapiens
agagaaagaccaaagcat

SEQ ID NO: 7370961 - DNA, 22 bp, Homo sapiens
agactgcagcaaccccttcagc

SEQ ID NO: 7370962 - DNA, 21 bp, Homo sapiens
agactgccattgttcttttgg

SEQ ID NO: 7370963 - DNA, 22 bp, Homo sapiens
agactgcatattgtcctttaga

SEQ ID NO: 7370964 - DNA, 21 bp, Homo sapiens
agactgccatctttgggccac

SEQ ID NO: 7370965 - DNA, 22 bp, Homo sapiens
aattatgtttgctttagatgga

SEQ ID NO: 7370966 - DNA, 22 bp, Homo sapiens
aattatgtgcttgcttgtttcc

SEQ ID NO: 7370967 - DNA, 22 bp, Homo sapiens
agagatcaaagcttgccaagta

SEQ ID NO: 7370968 - DNA, 20 bp, Homo sapiens
agagagcacaggcaggaaag

SEQ ID NO: 7370969 - DNA, 23 bp, Homo sapiens
agagagagtttgtgtcaggtacc

SEQ ID NO: 7370970 - DNA, 22 bp, Homo sapiens
agagacagggttttgccatgtt

SEQ ID NO: 7370971 - DNA, 22 bp, Homo sapiens
agagaaatagattggtccagaa

SEQ ID NO: 7370972 - DNA, 22 bp, Homo sapiens
agagaaatatttaggaaaggag

SEQ ID NO: 7370973 - DNA, 21 bp, Homo sapiens
agagaaagtcatggctgtggc

SEQ ID NO: 7370974 - DNA, 22 bp, Homo sapiens
agagagaggcagcagtgctcac

SEQ ID NO: 7370975 - DNA, 20 bp, Homo sapiens
agagagaggtaaattgagca

SEQ ID NO: 7370976 - DNA, 22 bp, Homo sapiens
agaatttcaaaaggaagccagc

SEQ ID NO: 7370977 - DNA, 23 bp, Homo sapiens
agaatttcaaagtccagcacatt

SEQ ID NO: 7370978 - DNA, 22 bp, Homo sapiens
agaatctgcatttttaataaca

SEQ ID NO: 7370979 - DNA, 23 bp, Homo sapiens
agacaaaagcctcagtcttaggc

SEQ ID NO: 7370980 - DNA, 22 bp, Homo sapiens
aatgtataaagtgttaataact

SEQ ID NO: 7370981 - DNA, 22 bp, Homo sapiens
aatgtataaagtgttaataact

SEQ ID NO: 7370982 - DNA, 22 bp, Homo sapiens
aatgaaaattggaccctagaac

SEQ ID NO: 7370983 - DNA, 22 bp, Homo sapiens
aatgctttgagggaagatgaaa

SEQ ID NO: 7370984 - DNA, 22 bp, Homo sapiens
aatgctttgagggaagatgaaa

SEQ ID NO: 7370985 - DNA, 22 bp, Homo sapiens
aatgctttgactatatctataa

SEQ ID NO: 7370986 - DNA, 22 bp, Homo sapiens
aatgctttgactatatctataa

SEQ ID NO: 7370987 - DNA, 22 bp, Homo sapiens
aatgctttgattgattaaaaca

SEQ ID NO: 7370988 - DNA, 22 bp, Homo sapiens
aatgctttgattgattaaaaca

SEQ ID NO: 7370989 - DNA, 22 bp, Homo sapiens
aatgctttttgcgaaatgtgca

SEQ ID NO: 7370990 - DNA, 19 bp, Homo sapiens
aatggacaggcaatagtct

SEQ ID NO: 7370991 - DNA, 22 bp, Homo sapiens
aatggaatgcctcacatgtatt

SEQ ID NO: 7370992 - DNA, 21 bp, Homo sapiens
aatggaagtttaaaggtatcc

SEQ ID NO: 7370993 - DNA, 22 bp, Homo sapiens
agaataaatgctacctatcaca

SEQ ID NO: 7370994 - DNA, 22 bp, Homo sapiens
agaataaatgctacctatcaca

SEQ ID NO: 7370995 - DNA, 22 bp, Homo sapiens
agaataaaatagtctgaagatg

SEQ ID NO: 7370996 - DNA, 22 bp, Homo sapiens
agaagttttcattacctataca

SEQ ID NO: 7370997 - DNA, 22 bp, Homo sapiens
agaagttttgggaaatactgat

SEQ ID NO: 7370998 - DNA, 22 bp, Homo sapiens
agaagttttgttgaatgtgtga

SEQ ID NO: 7370999 - DNA, 22 bp, Homo sapiens
agaataaatgttggacttagga

SEQ ID NO: 7371000 - DNA, 22 bp, Homo sapiens
agaataatcactgaagttcaaa

SEQ ID NO: 7371001 - DNA, 22 bp, Homo sapiens
agaatcattatatttattaagc

SEQ ID NO: 7371002 - DNA, 22 bp, Homo sapiens
aattcagttggcaaacatgctg

SEQ ID NO: 7371003 - DNA, 22 bp, Homo sapiens
aattcagttggcaaacatgctg

SEQ ID NO: 7371004 - DNA, 22 bp, Homo sapiens
aattcatactctatattgcttt

SEQ ID NO: 7371005 - DNA, 22 bp, Homo sapiens
agagcagctggctgcatctaga

SEQ ID NO: 7371006 - DNA, 22 bp, Homo sapiens
agaggcaactgatttctgccag

SEQ ID NO: 7371007 - DNA, 22 bp, Homo sapiens
agaggcaactgatttctgccag

SEQ ID NO: 7371008 - DNA, 22 bp, Homo sapiens
agaggcaacatggggaacagat

SEQ ID NO: 7371009 - DNA, 21 bp, Homo sapiens
agaggcaggcattaagtacac

SEQ ID NO: 7371010 - DNA, 19 bp, Homo sapiens
agaggcagtctccaacagg

SEQ ID NO: 7371011 - DNA, 22 bp, Homo sapiens
agaggcagtatacaatccgagc

SEQ ID NO: 7371012 - DNA, 23 bp, Homo sapiens
agaggccaacttcttgcccctcc

SEQ ID NO: 7371013 - DNA, 22 bp, Homo sapiens
agaggcatgatcttataattta

SEQ ID NO: 7371014 - DNA, 22 bp, Homo sapiens
agagggcattaactctgtcttg

SEQ ID NO: 7371015 - DNA, 22 bp, Homo sapiens
agagggcatgcttggtggcctg

SEQ ID NO: 7371016 - DNA, 22 bp, Homo sapiens
agagggcataaaatagagcacg

SEQ ID NO: 7371017 - DNA, 22 bp, Homo sapiens
aattttgtgtgggatcaaagga

SEQ ID NO: 7371018 - DNA, 21 bp, Homo sapiens
aattttgaaggaagattaagg

SEQ ID NO: 7371019 - DNA, 21 bp, Homo sapiens
aattttgaaggaagattaagg

SEQ ID NO: 7371020 - DNA, 22 bp, Homo sapiens
aatttcaaactaataggaacca

SEQ ID NO: 7371021 - DNA, 22 bp, Homo sapiens
agaggccacaccagcctcccgt

SEQ ID NO: 7371022 - DNA, 22 bp, Homo sapiens
aatttatttcctgccagtacac

SEQ ID NO: 7371023 - DNA, 22 bp, Homo sapiens
agatatacagagaattattcac

SEQ ID NO: 7371024 - DNA, 22 bp, Homo sapiens
agatctgagtggctgcatgtaa

SEQ ID NO: 7371025 - DNA, 21 bp, Homo sapiens
agattaaaatctgtgagaagg

SEQ ID NO: 7371026 - DNA, 19 bp, Homo sapiens
agattattgcacattcatg

SEQ ID NO: 7371027 - DNA, 22 bp, Homo sapiens
agattatgctggctgctacaag

SEQ ID NO: 7371028 - DNA, 22 bp, Homo sapiens
agattcagaaaattctctgttc

SEQ ID NO: 7371029 - DNA, 22 bp, Homo sapiens
agataatgttctgatccatttc

SEQ ID NO: 7371030 - DNA, 22 bp, Homo sapiens
acaaaaaccgtggattcagcat

SEQ ID NO: 7371031 - DNA, 22 bp, Homo sapiens
acaaaaaccgtggattcagcat

SEQ ID NO: 7371032 - DNA, 22 bp, Homo sapiens
aaggccagggatgccagctcgg

SEQ ID NO: 7371033 - DNA, 22 bp, Homo sapiens
aaggccaggcagggagctgtga

SEQ ID NO: 7371034 - DNA, 22 bp, Homo sapiens
aaggccaggccagatgacagtc

SEQ ID NO: 7371035 - DNA, 22 bp, Homo sapiens
aaggccagcttgtagggctggt

SEQ ID NO: 7371036 - DNA, 22 bp, Homo sapiens
aaggccagctggagggatgagg

SEQ ID NO: 7371037 - DNA, 22 bp, Homo sapiens
acattagtttctcagatcattt

SEQ ID NO: 7371038 - DNA, 22 bp, Homo sapiens
acattagaacattaatattggg

SEQ ID NO: 7371039 - DNA, 22 bp, Homo sapiens
acattagaacattaatattggg

SEQ ID NO: 7371040 - DNA, 22 bp, Homo sapiens
acattacctggcatttgatctt

SEQ ID NO: 7371041 - DNA, 22 bp, Homo sapiens
acattctctccatgtcttcttt

SEQ ID NO: 7371042 - DNA, 22 bp, Homo sapiens
acataatgagctctttataaat

SEQ ID NO: 7371043 - DNA, 22 bp, Homo sapiens
acataatggacaataatgcatc

SEQ ID NO: 7371044 - DNA, 22 bp, Homo sapiens
acataagttatggataaaatgt

SEQ ID NO: 7371045 - DNA, 22 bp, Homo sapiens
acataatagcatttctaatttg

SEQ ID NO: 7371046 - DNA, 22 bp, Homo sapiens
acatacttatgctaaaaatata

SEQ ID NO: 7371047 - DNA, 22 bp, Homo sapiens
acatacttaacattaaagtcat

SEQ ID NO: 7371048 - DNA, 23 bp, Homo sapiens
acatgggaaatgcaaagagaagt

SEQ ID NO: 7371049 - DNA, 19 bp, Homo sapiens
acatggctctccagtctgg

SEQ ID NO: 7371050 - DNA, 22 bp, Homo sapiens
accacaggggaggaatgatgcc

SEQ ID NO: 7371051 - DNA, 22 bp, Homo sapiens
accacagggtaaagttagatat

SEQ ID NO: 7371052 - DNA, 22 bp, Homo sapiens
acattcttaacagttaaaaact

SEQ ID NO: 7371053 - DNA, 22 bp, Homo sapiens
accacaggaggatggctgctgg

SEQ ID NO: 7371054 - DNA, 22 bp, Homo sapiens
acattcttaacagttaaaaact

SEQ ID NO: 7371055 - DNA, 22 bp, Homo sapiens
acattcttataagagtgaggca

SEQ ID NO: 7371056 - DNA, 22 bp, Homo sapiens
aagggcagcttaaattggtagc

SEQ ID NO: 7371057 - DNA, 22 bp, Homo sapiens
aagggcagctattatcgtcatc

SEQ ID NO: 7371058 - DNA, 22 bp, Homo sapiens
accaggcaaaaccacaggagca

SEQ ID NO: 7371059 - DNA, 22 bp, Homo sapiens
accaggcaactgtgaatgggct

SEQ ID NO: 7371060 - DNA, 22 bp, Homo sapiens
accaggcactcttgtggcagtg

SEQ ID NO: 7371061 - DNA, 22 bp, Homo sapiens
accaggcagagctgggccttaa

SEQ ID NO: 7371062 - DNA, 22 bp, Homo sapiens
accagctggtcacctgggcact

SEQ ID NO: 7371063 - DNA, 22 bp, Homo sapiens
accagctggcccatgagcacgt

SEQ ID NO: 7371064 - DNA, 22 bp, Homo sapiens
aagtaaaagctttaccatgcgc

SEQ ID NO: 7371065 - DNA, 22 bp, Homo sapiens
aagtaaaagctttaccatgcgc

SEQ ID NO: 7371066 - DNA, 22 bp, Homo sapiens
aagtaaaattcaatcttcactg

SEQ ID NO: 7371067 - DNA, 22 bp, Homo sapiens
aaggtttttttccagtatctct

SEQ ID NO: 7371068 - DNA, 22 bp, Homo sapiens
aagtaaaacacacagtccaccg

SEQ ID NO: 7371069 - DNA, 22 bp, Homo sapiens
accaggcatgatgtggagcaca

SEQ ID NO: 7371070 - DNA, 22 bp, Homo sapiens
aaggtttccagtgatattgtgg

SEQ ID NO: 7371071 - DNA, 22 bp, Homo sapiens
aaggttcctctctccacccagc

SEQ ID NO: 7371072 - DNA, 22 bp, Homo sapiens
aaggttccctctctggaagcct

SEQ ID NO: 7371073 - DNA, 22 bp, Homo sapiens
acaggtaggttaaaatgtgtca

SEQ ID NO: 7371074 - DNA, 22 bp, Homo sapiens
acaggtagcatttttcctcttt

SEQ ID NO: 7371075 - DNA, 22 bp, Homo sapiens
acaggtagatacatacttctaa

SEQ ID NO: 7371076 - DNA, 22 bp, Homo sapiens
acaggtactttgtaatgaagga

SEQ ID NO: 7371077 - DNA, 22 bp, Homo sapiens
acaggctctggggcaggatggc

SEQ ID NO: 7371078 - DNA, 22 bp, Homo sapiens
acaggcttcattacttcagcgt

SEQ ID NO: 7371079 - DNA, 22 bp, Homo sapiens
acagtgtactaggtacatgttc

SEQ ID NO: 7371080 - DNA, 22 bp, Homo sapiens
acagtgtactaggtacatgttc

SEQ ID NO: 7371081 - DNA, 22 bp, Homo sapiens
acagtgtagcatggtagcaatg

SEQ ID NO: 7371082 - DNA, 22 bp, Homo sapiens
acagtgtataaaatcttaaaga

SEQ ID NO: 7371083 - DNA, 22 bp, Homo sapiens
acagtgtataaaatcttaaaga

SEQ ID NO: 7371084 - DNA, 22 bp, Homo sapiens
acagtgtatgatatttcacagt

SEQ ID NO: 7371085 - DNA, 22 bp, Homo sapiens
acagtttagaatgccacatagt

SEQ ID NO: 7371086 - DNA, 22 bp, Homo sapiens
acagtttactggccttgccgtt

SEQ ID NO: 7371087 - DNA, 22 bp, Homo sapiens
acaggtgtatgaatatgttcca

SEQ ID NO: 7371088 - DNA, 22 bp, Homo sapiens
acagtgcaggtctcaacaatta

SEQ ID NO: 7371089 - DNA, 22 bp, Homo sapiens
acaggcacctgccaccacatct

SEQ ID NO: 7371090 - DNA, 22 bp, Homo sapiens
acaggcactttgacatgccatc

SEQ ID NO: 7371091 - DNA, 22 bp, Homo sapiens
acaggcagagaactcagccaga

SEQ ID NO: 7371092 - DNA, 22 bp, Homo sapiens
acaggcactttgacatgccatc

SEQ ID NO: 7371093 - DNA, 19 bp, Homo sapiens
acaggcagaattgggtgtg

SEQ ID NO: 7371094 - DNA, 22 bp, Homo sapiens
acaggaggagctgtttcaggga

SEQ ID NO: 7371095 - DNA, 22 bp, Homo sapiens
acaggaggagcagctgtgtgcc

SEQ ID NO: 7371096 - DNA, 22 bp, Homo sapiens
acaggcagagagtggcggactc

SEQ ID NO: 7371097 - DNA, 22 bp, Homo sapiens
acaggcagagtcaggttgggtt

SEQ ID NO: 7371098 - DNA, 22 bp, Homo sapiens
acaggcagagtcaggttgggtt

SEQ ID NO: 7371099 - DNA, 22 bp, Homo sapiens
aagccctgagcactgcagagaa

SEQ ID NO: 7371100 - DNA, 22 bp, Homo sapiens
aagccctgcagtctctgccaca

SEQ ID NO: 7371101 - DNA, 22 bp, Homo sapiens
aagccctgcagtctctgccaca

SEQ ID NO: 7371102 - DNA, 22 bp, Homo sapiens
aagccctgccacccattcactg

SEQ ID NO: 7371103 - DNA, 22 bp, Homo sapiens
aagccctggcgggtggagggcc

SEQ ID NO: 7371104 - DNA, 22 bp, Homo sapiens
aagccctggctcagctcaccag

SEQ ID NO: 7371105 - DNA, 22 bp, Homo sapiens
acaggccagcctggggtaaggt

SEQ ID NO: 7371106 - DNA, 22 bp, Homo sapiens
acagctttatctcagggatcag

SEQ ID NO: 7371107 - DNA, 22 bp, Homo sapiens
acagctttttactaatagattg

SEQ ID NO: 7371108 - DNA, 22 bp, Homo sapiens
aagtgcaagcaggacttagttt

SEQ ID NO: 7371109 - DNA, 22 bp, Homo sapiens
aagtgcaatgaatagctgcaat

SEQ ID NO: 7371110 - DNA, 22 bp, Homo sapiens
aagtgactatttgagtacatca

SEQ ID NO: 7371111 - DNA, 22 bp, Homo sapiens
aagtgaagaaatacatgagaat

SEQ ID NO: 7371112 - DNA, 22 bp, Homo sapiens
acctttatcgccatcattgtgc

SEQ ID NO: 7371113 - DNA, 22 bp, Homo sapiens
acctttatagcaacctggtgaa

SEQ ID NO: 7371114 - DNA, 22 bp, Homo sapiens
acctttatagctgattatgaca

SEQ ID NO: 7371115 - DNA, 22 bp, Homo sapiens
acctttatatgaaagatgacat

SEQ ID NO: 7371116 - DNA, 22 bp, Homo sapiens
acctttatatatcaacttctcc

SEQ ID NO: 7371117 - DNA, 22 bp, Homo sapiens
accttgttgtaggtacaaaaga

SEQ ID NO: 7371118 - DNA, 22 bp, Homo sapiens
accttgtcttttatagaacaag

SEQ ID NO: 7371119 - DNA, 22 bp, Homo sapiens
aagtgacacatttgtgatgaat

SEQ ID NO: 7371120 - DNA, 18 bp, Homo sapiens
aagtgaattgtccttttc

SEQ ID NO: 7371121 - DNA, 22 bp, Homo sapiens
aagtgaatttcattccaattct

SEQ ID NO: 7371122 - DNA, 22 bp, Homo sapiens
acctgggtctggtgttgggacg

SEQ ID NO: 7371123 - DNA, 22 bp, Homo sapiens
acctgggttgctggcgtgaggg

SEQ ID NO: 7371124 - DNA, 19 bp, Homo sapiens
accttctgggaaacattcc

SEQ ID NO: 7371125 - DNA, 22 bp, Homo sapiens
accttctggtctgcctgacagc

SEQ ID NO: 7371126 - DNA, 22 bp, Homo sapiens
acctgggatggggccaggttta

SEQ ID NO: 7371127 - DNA, 22 bp, Homo sapiens
aagtaaatatctgtagtcttta

SEQ ID NO: 7371128 - DNA, 21 bp, Homo sapiens
aagtaaatcagagaaataacc

SEQ ID NO: 7371129 - DNA, 22 bp, Homo sapiens
actcatcagtggttttaatcaa

SEQ ID NO: 7371130 - DNA, 22 bp, Homo sapiens
aagtgcaggtctcagctactct

SEQ ID NO: 7371131 - DNA, 22 bp, Homo sapiens
aagtggagtccctacaaccagc

SEQ ID NO: 7371132 - DNA, 22 bp, Homo sapiens
aagttttaacaagtacttacta

SEQ ID NO: 7371133 - DNA, 22 bp, Homo sapiens
aagtttgtggtcatttattata

SEQ ID NO: 7371134 - DNA, 22 bp, Homo sapiens
aagtttgttcagggcttacatt

SEQ ID NO: 7371135 - DNA, 21 bp, Homo sapiens
aagtttctccctaattgttgc

SEQ ID NO: 7371136 - DNA, 22 bp, Homo sapiens
aagtggcagttcaggaagcaga

SEQ ID NO: 7371137 - DNA, 22 bp, Homo sapiens
aagtggcagaatagtggcagga

SEQ ID NO: 7371138 - DNA, 22 bp, Homo sapiens
aataaagaatggatgagatcgt

SEQ ID NO: 7371139 - DNA, 22 bp, Homo sapiens
aataaagaatggatgagatcgt

SEQ ID NO: 7371140 - DNA, 22 bp, Homo sapiens
aataaagacaaacaggggagcc

SEQ ID NO: 7371141 - DNA, 22 bp, Homo sapiens
aataaagcatgaggcatttatc

SEQ ID NO: 7371142 - DNA, 22 bp, Homo sapiens
aataaagcagggtccttgcact

SEQ ID NO: 7371143 - DNA, 18 bp, Homo sapiens
aataaagcaggatttctc

SEQ ID NO: 7371144 - DNA, 22 bp, Homo sapiens
aataaagactcagaggcccagg

SEQ ID NO: 7371145 - DNA, 20 bp, Homo sapiens
aataaagcaacgagcgagct

SEQ ID NO: 7371146 - DNA, 22 bp, Homo sapiens
aataaagcacttgggttggtaa

SEQ ID NO: 7371147 - DNA, 22 bp, Homo sapiens
aataaagtagcgtttaaggtgc

SEQ ID NO: 7371148 - DNA, 22 bp, Homo sapiens
aataaagcctgtctctttagag

SEQ ID NO: 7371149 - DNA, 22 bp, Homo sapiens
aataaagccttattgattttac

SEQ ID NO: 7371150 - DNA, 22 bp, Homo sapiens
aataacagaaacttgagcatca

SEQ ID NO: 7371151 - DNA, 22 bp, Homo sapiens
aataacagaaacttgagcatca

SEQ ID NO: 7371152 - DNA, 22 bp, Homo sapiens
aataacagagtcttcaagatag

SEQ ID NO: 7371153 - DNA, 22 bp, Homo sapiens
aataaatgaacaaagcaggttg

SEQ ID NO: 7371154 - DNA, 22 bp, Homo sapiens
aataaatgaacaaagcaggttg

SEQ ID NO: 7371155 - DNA, 22 bp, Homo sapiens
aataaatgttaagattgtctca

SEQ ID NO: 7371156 - DNA, 21 bp, Homo sapiens
aagttttatgttgccatttgt

SEQ ID NO: 7371157 - DNA, 22 bp, Homo sapiens
actgagactttgttgagttctt

SEQ ID NO: 7371158 - DNA, 22 bp, Homo sapiens
actgagactgcccctgtaacaa

SEQ ID NO: 7371159 - DNA, 22 bp, Homo sapiens
actgagactgaatctgaatgat

SEQ ID NO: 7371160 - DNA, 22 bp, Homo sapiens
actgagacaactgtgtttctaa

SEQ ID NO: 7371161 - DNA, 20 bp, Homo sapiens
actgagaccaataagtagaa

SEQ ID NO: 7371162 - DNA, 22 bp, Homo sapiens
aataaaatggtcagttttctca

SEQ ID NO: 7371163 - DNA, 22 bp, Homo sapiens
actgagaagctcgcagtgatgc

SEQ ID NO: 7371164 - DNA, 22 bp, Homo sapiens
aataacctttatttcaaagtgt

SEQ ID NO: 7371165 - DNA, 22 bp, Homo sapiens
aataactggcacatatcacata

SEQ ID NO: 7371166 - DNA, 22 bp, Homo sapiens
aatactgctgcctgcaaattat

SEQ ID NO: 7371167 - DNA, 22 bp, Homo sapiens
aatatcaggatgcaaagctgtg

SEQ ID NO: 7371168 - DNA, 22 bp, Homo sapiens
aatatcttctaaggatagaact

SEQ ID NO: 7371169 - DNA, 22 bp, Homo sapiens
aatatgaattattgttacaagt

SEQ ID NO: 7371170 - DNA, 22 bp, Homo sapiens
aatatcttctaaggatagaact

SEQ ID NO: 7371171 - DNA, 22 bp, Homo sapiens
acttagcaggtggtgactcgaa

SEQ ID NO: 7371172 - DNA, 22 bp, Homo sapiens
acttataggccaagtagactgt

SEQ ID NO: 7371173 - DNA, 22 bp, Homo sapiens
acttagcacgaacatttacttt

SEQ ID NO: 7371174 - DNA, 22 bp, Homo sapiens
acttagaattagtgtagaatga

SEQ ID NO: 7371175 - DNA, 22 bp, Homo sapiens
aatagaaaggaggggctcttgt

SEQ ID NO: 7371176 - DNA, 22 bp, Homo sapiens
aatagaacaataattgtaaact

SEQ ID NO: 7371177 - DNA, 22 bp, Homo sapiens
acttccagctttataattcagt

SEQ ID NO: 7371178 - DNA, 22 bp, Homo sapiens
acttatgaggagaaaatatata

SEQ ID NO: 7371179 - DNA, 22 bp, Homo sapiens
acttatcttagttcatttgtat

SEQ ID NO: 7371180 - DNA, 22 bp, Homo sapiens
acttatgtagtacctcttatgt

SEQ ID NO: 7371181 - DNA, 22 bp, Homo sapiens
agaaaatattcattgagaggct

SEQ ID NO: 7371182 - DNA, 22 bp, Homo sapiens
agaaaattactccagagacaag

SEQ ID NO: 7371183 - DNA, 21 bp, Homo sapiens
agaaaatggcgttttagattt

SEQ ID NO: 7371184 - DNA, 21 bp, Homo sapiens
agaaaatggcgttttagattt

SEQ ID NO: 7371185 - DNA, 22 bp, Homo sapiens
agaaaatgtgaacttgtgaatt

SEQ ID NO: 7371186 - DNA, 22 bp, Homo sapiens
aatatgtctctggctagacatt

SEQ ID NO: 7371187 - DNA, 22 bp, Homo sapiens
aatatgcagcttatcttctagg

SEQ ID NO: 7371188 - DNA, 22 bp, Homo sapiens
aatattatcaaaagctttttca

SEQ ID NO: 7371189 - DNA, 22 bp, Homo sapiens
aatattatcaaaagctttttca

SEQ ID NO: 7371190 - DNA, 22 bp, Homo sapiens
aatatgttcaaaatagatcact

SEQ ID NO: 7371191 - DNA, 22 bp, Homo sapiens
aatcttcattttgacaagattc

SEQ ID NO: 7371192 - DNA, 22 bp, Homo sapiens
aatcttcactcattcagagttg

SEQ ID NO: 7371193 - DNA, 22 bp, Homo sapiens
aatcttaagctgaattctctcc

SEQ ID NO: 7371194 - DNA, 22 bp, Homo sapiens
aatctgtttaacagatttctgt

SEQ ID NO: 7371195 - DNA, 22 bp, Homo sapiens
agaaactacttggaggaaagat

SEQ ID NO: 7371196 - DNA, 22 bp, Homo sapiens
aatctattccctttctgtaaaa

SEQ ID NO: 7371197 - DNA, 22 bp, Homo sapiens
aaacagttttctcatttagtgt

SEQ ID NO: 7371198 - DNA, 22 bp, Homo sapiens
aaacatcaccattttacctaat

SEQ ID NO: 7371199 - DNA, 22 bp, Homo sapiens
aaacatcaccattttacctaat

SEQ ID NO: 7371200 - DNA, 22 bp, Homo sapiens
aaacatcaccattttacctaat

SEQ ID NO: 7371201 - DNA, 22 bp, Homo sapiens
aaacatagataatagatagatg

SEQ ID NO: 7371202 - DNA, 22 bp, Homo sapiens
aaacatcataggcatgcatgat

SEQ ID NO: 7371203 - DNA, 22 bp, Homo sapiens
aaacatcataggcatgcatgat

SEQ ID NO: 7371204 - DNA, 22 bp, Homo sapiens
aaacatctactgtaggctggag

SEQ ID NO: 7371205 - DNA, 22 bp, Homo sapiens
aaacactggcaatttcatgcac

SEQ ID NO: 7371206 - DNA, 22 bp, Homo sapiens
aaacactgcgtggtggcaactc

SEQ ID NO: 7371207 - DNA, 22 bp, Homo sapiens
aaacactgcgtggtggcaactc

SEQ ID NO: 7371208 - DNA, 22 bp, Homo sapiens
aaacactgcagggtttacttga

SEQ ID NO: 7371209 - DNA, 22 bp, Homo sapiens
aaacactggtatgatgtatagt

SEQ ID NO: 7371210 - DNA, 20 bp, Homo sapiens
aaacactggctggggcacag

SEQ ID NO: 7371211 - DNA, 20 bp, Homo sapiens
aaacactggctggggcacag

SEQ ID NO: 7371212 - DNA, 22 bp, Homo sapiens
aaacactgtacaatctgcaggg

SEQ ID NO: 7371213 - DNA, 22 bp, Homo sapiens
aaacactgtacaatctgcaggg

SEQ ID NO: 7371214 - DNA, 22 bp, Homo sapiens
aaacactgtctctggtattgaa

SEQ ID NO: 7371215 - DNA, 22 bp, Homo sapiens
aaagtcatttgtatataccctt

SEQ ID NO: 7371216 - DNA, 22 bp, Homo sapiens
aaagtcattttccagaccagta

SEQ ID NO: 7371217 - DNA, 22 bp, Homo sapiens
aaagtcattttccagaccagta

SEQ ID NO: 7371218 - DNA, 22 bp, Homo sapiens
aaagtgcattgtttgtgttcct

SEQ ID NO: 7371219 - DNA, 22 bp, Homo sapiens
aaagcaatgcttgtggaatgta

SEQ ID NO: 7371220 - DNA, 22 bp, Homo sapiens
aaaggaggaatggagagatgct

SEQ ID NO: 7371221 - DNA, 22 bp, Homo sapiens
aaaggccaagcatgaggtggac

SEQ ID NO: 7371222 - DNA, 22 bp, Homo sapiens
aaaggccacacagagcagggag

SEQ ID NO: 7371223 - DNA, 22 bp, Homo sapiens
aaaggcccacagtcagtctacc

SEQ ID NO: 7371224 - DNA, 22 bp, Homo sapiens
aaaggcccacagtcagtctacc

SEQ ID NO: 7371225 - DNA, 22 bp, Homo sapiens
aaaggccactgcaagggaaggt

SEQ ID NO: 7371226 - DNA, 22 bp, Homo sapiens
aaagcaatagtaatggtaatag

SEQ ID NO: 7371227 - DNA, 22 bp, Homo sapiens
aaagcaatcagattcagatgtc

SEQ ID NO: 7371228 - DNA, 22 bp, Homo sapiens
aaagcaatgcccgttcattatc

SEQ ID NO: 7371229 - DNA, 22 bp, Homo sapiens
aaagatgtcagtttgaaataac

SEQ ID NO: 7371230 - DNA, 22 bp, Homo sapiens
aaagatgtcagtttgaaataac

SEQ ID NO: 7371231 - DNA, 22 bp, Homo sapiens
aaagatgtcagtttgaaataac

SEQ ID NO: 7371232 - DNA, 22 bp, Homo sapiens
aaatgcctgtgtaaattctagc

SEQ ID NO: 7371233 - DNA, 22 bp, Homo sapiens
aaatgccttcaaacacttaagg

SEQ ID NO: 7371234 - DNA, 22 bp, Homo sapiens
aaatgcctcccattctactgac

SEQ ID NO: 7371235 - DNA, 22 bp, Homo sapiens
aaatgcctctgggttattctag

SEQ ID NO: 7371236 - DNA, 22 bp, Homo sapiens
aaatatgtgatcagtgaataaa

SEQ ID NO: 7371237 - DNA, 22 bp, Homo sapiens
aaatattattgcttaaggggag

SEQ ID NO: 7371238 - DNA, 22 bp, Homo sapiens
aaatccagctacggggcaacat

SEQ ID NO: 7371239 - DNA, 22 bp, Homo sapiens
aaatcattatttacagttctga

SEQ ID NO: 7371240 - DNA, 22 bp, Homo sapiens
aaatcatggtggaagaaacaga

SEQ ID NO: 7371241 - DNA, 22 bp, Homo sapiens
aaactaatgaagtgaagacgct

SEQ ID NO: 7371242 - DNA, 23 bp, Homo sapiens
aaactacaacgccaggcactgag

SEQ ID NO: 7371243 - DNA, 22 bp, Homo sapiens
aaactacatctcatggatgagg

SEQ ID NO: 7371244 - DNA, 22 bp, Homo sapiens
aaactacatctcatggatgagg

SEQ ID NO: 7371245 - DNA, 23 bp, Homo sapiens
aaactacaacgccaggcactgag

SEQ ID NO: 7371246 - DNA, 22 bp, Homo sapiens
aaatatgtaagattagcactag

SEQ ID NO: 7371247 - DNA, 22 bp, Homo sapiens
aaatatgtatggagttcatgaa

SEQ ID NO: 7371248 - DNA, 22 bp, Homo sapiens
aaatatgtaagattagcactag

SEQ ID NO: 7371249 - DNA, 22 bp, Homo sapiens
aaatactgtgaataaaggtttt

SEQ ID NO: 7371250 - DNA, 22 bp, Homo sapiens
aaatagaaaccaacaaggtcag

SEQ ID NO: 7371251 - DNA, 22 bp, Homo sapiens
aaatagaaaccaacaaggtcag

SEQ ID NO: 7371252 - DNA, 22 bp, Homo sapiens
aaatacagattccagggtctta

SEQ ID NO: 7371253 - DNA, 22 bp, Homo sapiens
aaatagaattggaagcagagtt

SEQ ID NO: 7371254 - DNA, 22 bp, Homo sapiens
aaatagaattaactagctactg

SEQ ID NO: 7371255 - DNA, 22 bp, Homo sapiens
aaatagaattaactagctactg

SEQ ID NO: 7371256 - DNA, 22 bp, Homo sapiens
aaacaaagcatcttgctatgca

SEQ ID NO: 7371257 - DNA, 22 bp, Homo sapiens
aaacaaacataggtttgaaagt

SEQ ID NO: 7371258 - DNA, 22 bp, Homo sapiens
aaacaaatagtgcatgggaatt

SEQ ID NO: 7371259 - DNA, 22 bp, Homo sapiens
aaacaaatttcaagctgtgaca

SEQ ID NO: 7371260 - DNA, 22 bp, Homo sapiens
aaacaaatttcaagctgtgaca

SEQ ID NO: 7371261 - DNA, 22 bp, Homo sapiens
aaacaagagcttacatggctgc

SEQ ID NO: 7371262 - DNA, 22 bp, Homo sapiens
aaacacaatgtttctttgttct

SEQ ID NO: 7371263 - DNA, 22 bp, Homo sapiens
aaacaactcggcaactgctttt

SEQ ID NO: 7371264 - DNA, 22 bp, Homo sapiens
aaacacacctttggaactgtga

SEQ ID NO: 7371265 - DNA, 22 bp, Homo sapiens
aaacacacagaaatgaatgagg

SEQ ID NO: 7371266 - DNA, 22 bp, Homo sapiens
aaacacacagaaatgaatgagg

SEQ ID NO: 7371267 - DNA, 22 bp, Homo sapiens
aaaatagctatggaatgtcact

SEQ ID NO: 7371268 - DNA, 22 bp, Homo sapiens
aaaatagcctcacataattgct

SEQ ID NO: 7371269 - DNA, 22 bp, Homo sapiens
aaaatagcctcacataattgct

SEQ ID NO: 7371270 - DNA, 22 bp, Homo sapiens
aaaagtgtccagattatgaaga

SEQ ID NO: 7371271 - DNA, 22 bp, Homo sapiens
aaaagtgatgggatggcacttc

SEQ ID NO: 7371272 - DNA, 22 bp, Homo sapiens
aaaagtctgctttctattatca

SEQ ID NO: 7371273 - DNA, 22 bp, Homo sapiens
aaaagtattttggatctcagat

SEQ ID NO: 7371274 - DNA, 22 bp, Homo sapiens
aaaagtattttgagcactttat

SEQ ID NO: 7371275 - DNA, 22 bp, Homo sapiens
aaaagggaaagcagaatgactt

SEQ ID NO: 7371276 - DNA, 22 bp, Homo sapiens
aaaagggactactctcagctcc

SEQ ID NO: 7371277 - DNA, 22 bp, Homo sapiens
aaaagtattttggatctcagat

SEQ ID NO: 7371278 - DNA, 22 bp, Homo sapiens
aaaagtattttggatctcagat

SEQ ID NO: 7371279 - DNA, 22 bp, Homo sapiens
aaaaatgtcattatggaactga

SEQ ID NO: 7371280 - DNA, 22 bp, Homo sapiens
aaaaatgtcattatggaactga

SEQ ID NO: 7371281 - DNA, 22 bp, Homo sapiens
aaaaggctcttcaaaatggaag

SEQ ID NO: 7371282 - DNA, 22 bp, Homo sapiens
aaaaggcttggaacctttccct

SEQ ID NO: 7371283 - DNA, 20 bp, Homo sapiens
aaaaagacaaaacgagttgg

SEQ ID NO: 7371284 - DNA, 20 bp, Homo sapiens
aaaaagacaaaacgagttgg

SEQ ID NO: 7371285 - DNA, 22 bp, Homo sapiens
aaacttgttctcttgtgcctat

SEQ ID NO: 7371286 - DNA, 22 bp, Homo sapiens
aaacttgttctcatgttgcaga

SEQ ID NO: 7371287 - DNA, 22 bp, Homo sapiens
aaacttgtgagctaaataaatg

SEQ ID NO: 7371288 - DNA, 22 bp, Homo sapiens
aaactttaggaaggaatttaca

SEQ ID NO: 7371289 - DNA, 23 bp, Homo sapiens
aaacttgctatggctgaaatcat

SEQ ID NO: 7371290 - DNA, 22 bp, Homo sapiens
aaacttggggctttcttacatt

SEQ ID NO: 7371291 - DNA, 22 bp, Homo sapiens
aaacttgagccaagggcttggg

SEQ ID NO: 7371292 - DNA, 22 bp, Homo sapiens
aaacttgaggcaatgaaggtgt

SEQ ID NO: 7371293 - DNA, 22 bp, Homo sapiens
aaagaagcataggctagacttc

SEQ ID NO: 7371294 - DNA, 22 bp, Homo sapiens
aaagaagatggagacctgacta

SEQ ID NO: 7371295 - DNA, 22 bp, Homo sapiens
aaagaagatggagacctgacta

SEQ ID NO: 7371296 - DNA, 22 bp, Homo sapiens
aaagaagagctggaaggagtct

SEQ ID NO: 7371297 - DNA, 22 bp, Homo sapiens
aaagaagctgtggctctgggag

SEQ ID NO: 7371298 - DNA, 22 bp, Homo sapiens
aaagaaggacctggaggaggat

SEQ ID NO: 7371299 - DNA, 22 bp, Homo sapiens
aaagatctgacttagacacaga

SEQ ID NO: 7371300 - DNA, 22 bp, Homo sapiens
aaagatctgtgttaactcaagg

SEQ ID NO: 7371301 - DNA, 22 bp, Homo sapiens
aaaccaaccctggctggcctag

SEQ ID NO: 7371302 - DNA, 22 bp, Homo sapiens
aaaccacacttagcagtttcgt

SEQ ID NO: 7371303 - DNA, 22 bp, Homo sapiens
aaacatgagttaaaagtaactg

SEQ ID NO: 7371304 - DNA, 22 bp, Homo sapiens
aaacatcttgctctgattggta

SEQ ID NO: 7371305 - DNA, 22 bp, Homo sapiens
aaacatcttctcttgattcttt

SEQ ID NO: 7371306 - DNA, 22 bp, Homo sapiens
aaacagtctgatgccatctgcc

SEQ ID NO: 7371307 - DNA, 22 bp, Homo sapiens
aaacagtcctctttatttagtc

SEQ ID NO: 7371308 - DNA, 22 bp, Homo sapiens
aaacacaggtactgcagaagtg

SEQ ID NO: 7371309 - DNA, 22 bp, Homo sapiens
aagacagaccacgtgacagggc

SEQ ID NO: 7371310 - DNA, 22 bp, Homo sapiens
aagacagaagtgatttgatgtg

SEQ ID NO: 7371311 - DNA, 22 bp, Homo sapiens
aagagagagttcctaggcaaaa

SEQ ID NO: 7371312 - DNA, 22 bp, Homo sapiens
aagacagagactctgcaacagg

SEQ ID NO: 7371313 - DNA, 22 bp, Homo sapiens
aagaatgttcttgtagtcatga

SEQ ID NO: 7371314 - DNA, 22 bp, Homo sapiens
aagacactaagctttcaggata

SEQ ID NO: 7371315 - DNA, 22 bp, Homo sapiens
aagaattatctgaaagctgtgt

SEQ ID NO: 7371316 - DNA, 22 bp, Homo sapiens
aagagcattttagtctcccttt

SEQ ID NO: 7371317 - DNA, 22 bp, Homo sapiens
aagagcatctatttcacagtgg

SEQ ID NO: 7371318 - DNA, 22 bp, Homo sapiens
aagagccagtgggaaagtcttg

SEQ ID NO: 7371319 - DNA, 22 bp, Homo sapiens
aagagccatttcatatcatctc

SEQ ID NO: 7371320 - DNA, 22 bp, Homo sapiens
aagagcccttgttcataattat

SEQ ID NO: 7371321 - DNA, 22 bp, Homo sapiens
aagaggacttgtgaagatgtac

SEQ ID NO: 7371322 - DNA, 22 bp, Homo sapiens
aagaggaagtctccatggagag

SEQ ID NO: 7371323 - DNA, 22 bp, Homo sapiens
aagaggacagtattcaatatga

SEQ ID NO: 7371324 - DNA, 22 bp, Homo sapiens
aagaggaatgggtgtgtttatg

SEQ ID NO: 7371325 - DNA, 22 bp, Homo sapiens
aagaggaagtctccatggagag

SEQ ID NO: 7371326 - DNA, 22 bp, Homo sapiens
aagaatgcatcaaaagtcagag

SEQ ID NO: 7371327 - DNA, 22 bp, Homo sapiens
aagaatgagctcaaagatctta

SEQ ID NO: 7371328 - DNA, 22 bp, Homo sapiens
aagaatgagctcaaagatctta

SEQ ID NO: 7371329 - DNA, 22 bp, Homo sapiens
aagaatgattacaaagcaacga

SEQ ID NO: 7371330 - DNA, 22 bp, Homo sapiens
aagaatgagctcaaagatctta

SEQ ID NO: 7371331 - DNA, 22 bp, Homo sapiens
aagaatgagctcaaagatctta

SEQ ID NO: 7371332 - DNA, 22 bp, Homo sapiens
aagaaaggtgtgtttgcagatg

SEQ ID NO: 7371333 - DNA, 22 bp, Homo sapiens
aagaaagtgggtaatatgattt

SEQ ID NO: 7371334 - DNA, 22 bp, Homo sapiens
aactttttctgggatggagggt

SEQ ID NO: 7371335 - DNA, 22 bp, Homo sapiens
aagaaagggctattgttctcca

SEQ ID NO: 7371336 - DNA, 22 bp, Homo sapiens
aagaaaggatatatgggaggta

SEQ ID NO: 7371337 - DNA, 22 bp, Homo sapiens
aactttgctggaaaattggagc

SEQ ID NO: 7371338 - DNA, 22 bp, Homo sapiens
aactttgcttgggtcaaactca

SEQ ID NO: 7371339 - DNA, 22 bp, Homo sapiens
aactttgcttttgtgggtaaag

SEQ ID NO: 7371340 - DNA, 22 bp, Homo sapiens
aactttgcataactaactacag

SEQ ID NO: 7371341 - DNA, 20 bp, Homo sapiens
aactttgcattttattctcc

SEQ ID NO: 7371342 - DNA, 18 bp, Homo sapiens
aagaggaggagcaggttg

SEQ ID NO: 7371343 - DNA, 22 bp, Homo sapiens
aagattctcagagtgaaagaat

SEQ ID NO: 7371344 - DNA, 22 bp, Homo sapiens
aagcaaattggatgtctgtgag

SEQ ID NO: 7371345 - DNA, 22 bp, Homo sapiens
aagcaaattctggaggtgaggt

SEQ ID NO: 7371346 - DNA, 22 bp, Homo sapiens
aagcaaatgaaccagaggtaat

SEQ ID NO: 7371347 - DNA, 22 bp, Homo sapiens
aagcaaatgtgggtgcagaatt

SEQ ID NO: 7371348 - DNA, 22 bp, Homo sapiens
aagcaacattctctgtggcatt

SEQ ID NO: 7371349 - DNA, 19 bp, Homo sapiens
aaatatcagagagatgata

SEQ ID NO: 7371350 - DNA, 22 bp, Homo sapiens
aaatatcattctggtgcacaga

SEQ ID NO: 7371351 - DNA, 22 bp, Homo sapiens
aaatatcatttataacttttaa

SEQ ID NO: 7371352 - DNA, 22 bp, Homo sapiens
aaatatcatttataacttttaa

SEQ ID NO: 7371353 - DNA, 22 bp, Homo sapiens
aagcagcaacaaactggataaa

SEQ ID NO: 7371354 - DNA, 22 bp, Homo sapiens
aagcagagttagcttgtcacct

SEQ ID NO: 7371355 - DNA, 22 bp, Homo sapiens
aagcagaaaaactgagctccaa

SEQ ID NO: 7371356 - DNA, 22 bp, Homo sapiens
aagcagagttagcttgtcacct

SEQ ID NO: 7371357 - DNA, 22 bp, Homo sapiens
aagcagcagcaggattaaagag

SEQ ID NO: 7371358 - DNA, 22 bp, Homo sapiens
aagccaatggattggttgcttt

SEQ ID NO: 7371359 - DNA, 22 bp, Homo sapiens
aaatggtccatcctaaagaagt

SEQ ID NO: 7371360 - DNA, 22 bp, Homo sapiens
aaatggctgacttttcatggga

SEQ ID NO: 7371361 - DNA, 22 bp, Homo sapiens
aaatggctgactaaattaaatt

SEQ ID NO: 7371362 - DNA, 22 bp, Homo sapiens
aacaactgaaaagctttttctg

SEQ ID NO: 7371363 - DNA, 22 bp, Homo sapiens
aacaaccaaaaagatgaatgta

SEQ ID NO: 7371364 - DNA, 22 bp, Homo sapiens
aacaacagctgctaaagagttg

SEQ ID NO: 7371365 - DNA, 22 bp, Homo sapiens
aacaaatgtgttttgtaattaa

SEQ ID NO: 7371366 - DNA, 22 bp, Homo sapiens
aacaaatgtgttttgtaattaa

SEQ ID NO: 7371367 - DNA, 22 bp, Homo sapiens
aacaaatttagctctgagtgct

SEQ ID NO: 7371368 - DNA, 22 bp, Homo sapiens
aacagctttgtatacagtaact

SEQ ID NO: 7371369 - DNA, 22 bp, Homo sapiens
aacagcttttttggtcagcatt

SEQ ID NO: 7371370 - DNA, 22 bp, Homo sapiens
aacagctttgagcagttctgta

SEQ ID NO: 7371371 - DNA, 22 bp, Homo sapiens
aacacatgccttaagaataagt

SEQ ID NO: 7371372 - DNA, 22 bp, Homo sapiens
aacacatgggtgtttattgtac

SEQ ID NO: 7371373 - DNA, 23 bp, Homo sapiens
aacacattgctaattacattcaa

SEQ ID NO: 7371374 - DNA, 22 bp, Homo sapiens
aacacatatttatatatgcaca

SEQ ID NO: 7371375 - DNA, 22 bp, Homo sapiens
aacacaaagaagctgcaggatc

SEQ ID NO: 7371376 - DNA, 22 bp, Homo sapiens
aacacaaagaagctgcaggatc

SEQ ID NO: 7371377 - DNA, 22 bp, Homo sapiens
aacaattgacacttcattgtga

SEQ ID NO: 7371378 - DNA, 22 bp, Homo sapiens
aacaattatcatatacattgca

SEQ ID NO: 7371379 - DNA, 22 bp, Homo sapiens
aacaattatcatatacattgca

SEQ ID NO: 7371380 - DNA, 22 bp, Homo sapiens
aacaattatcatatacattgca

SEQ ID NO: 7371381 - DNA, 22 bp, Homo sapiens
aacaatgttcttttagcttgaa

SEQ ID NO: 7371382 - DNA, 22 bp, Homo sapiens
aacaattactaccaaggcctgt

SEQ ID NO: 7371383 - DNA, 22 bp, Homo sapiens
aacaagaacacctacagttcta

SEQ ID NO: 7371384 - DNA, 22 bp, Homo sapiens
aacattctcattgggatatgtg

SEQ ID NO: 7371385 - DNA, 22 bp, Homo sapiens
aacattctatgtgcattcagaa

SEQ ID NO: 7371386 - DNA, 22 bp, Homo sapiens
aacattctatgtgcattcagaa

SEQ ID NO: 7371387 - DNA, 22 bp, Homo sapiens
aacattcagctgatgggtcata

SEQ ID NO: 7371388 - DNA, 22 bp, Homo sapiens
aacattcagctgggtggagcag

SEQ ID NO: 7371389 - DNA, 22 bp, Homo sapiens
aacattcagctgggtggagcag

SEQ ID NO: 7371390 - DNA, 22 bp, Homo sapiens
aacattctactgtactgcattg

SEQ ID NO: 7371391 - DNA, 16 bp, Homo sapiens
aacattcatatgagtg

SEQ ID NO: 7371392 - DNA, 22 bp, Homo sapiens
aacattctactgtactgcattg

SEQ ID NO: 7371393 - DNA, 22 bp, Homo sapiens
aacatttctgagaatatcagtt

SEQ ID NO: 7371394 - DNA, 22 bp, Homo sapiens
aacatttcataacttgactttt

SEQ ID NO: 7371395 - DNA, 22 bp, Homo sapiens
aacatttcattggaagctatgt

SEQ ID NO: 7371396 - DNA, 22 bp, Homo sapiens
aacattagatttgtttttctag

SEQ ID NO: 7371397 - DNA, 22 bp, Homo sapiens
aacattcaaaacccagttcagt

SEQ ID NO: 7371398 - DNA, 22 bp, Homo sapiens
aacattcaagttctggtttatg

SEQ ID NO: 7371399 - DNA, 22 bp, Homo sapiens
aacattcaattgaggaagttaa

SEQ ID NO: 7371400 - DNA, 22 bp, Homo sapiens
aacattcacctctacctccttc

SEQ ID NO: 7371401 - DNA, 20 bp, Homo sapiens
aacagtaccccccttgttct

SEQ ID NO: 7371402 - DNA, 22 bp, Homo sapiens
aacagtctaaattatacccttt

SEQ ID NO: 7371403 - DNA, 19 bp, Homo sapiens
aacagtctgggaagcacag

SEQ ID NO: 7371404 - DNA, 22 bp, Homo sapiens
aactaagttgcccagtccctgg

SEQ ID NO: 7371405 - DNA, 22 bp, Homo sapiens
aacatttgcagaggaaagctat

SEQ ID NO: 7371406 - DNA, 22 bp, Homo sapiens
aacatttcttctgaaactgagt

SEQ ID NO: 7371407 - DNA, 22 bp, Homo sapiens
aactatgttaataagtttcatt

SEQ ID NO: 7371408 - DNA, 22 bp, Homo sapiens
aactatgttaataagtttcatt

SEQ ID NO: 7371409 - DNA, 22 bp, Homo sapiens
aactgaggccaagtgaggaaag

SEQ ID NO: 7371410 - DNA, 23 bp, Homo sapiens
aactgagataatgtatgtaaagc

SEQ ID NO: 7371411 - DNA, 22 bp, Homo sapiens
aactgatttcaagttcagtttc

SEQ ID NO: 7371412 - DNA, 22 bp, Homo sapiens
aactgattgttggatgatagtg

SEQ ID NO: 7371413 - DNA, 22 bp, Homo sapiens
aactgattgttggatgatagtg

SEQ ID NO: 7371414 - DNA, 22 bp, Homo sapiens
aacttgcagggatgttctgaat

SEQ ID NO: 7371415 - DNA, 22 bp, Homo sapiens
aactcagatatgatagcaggag

SEQ ID NO: 7371416 - DNA, 22 bp, Homo sapiens
aagaggaactgggggctgagtc

SEQ ID NO: 7371417 - DNA, 22 bp, Homo sapiens
aagacatttatttgaatcaatt

SEQ ID NO: 7371418 - DNA, 22 bp, Homo sapiens
aagaccagggtgggtacgttcc

SEQ ID NO: 7371419 - DNA, 22 bp, Homo sapiens
aagacatttatgaaaagtgctg

SEQ ID NO: 7371420 - DNA, 19 bp, Homo sapiens
aagaggcaaccctcgagcc

SEQ ID NO: 7371421 - DNA, 22 bp, Homo sapiens
aagaggagtagatgtggttggt

SEQ ID NO: 7371422 - DNA, 22 bp, Homo sapiens
aagaggagggcagattcaaggc

SEQ ID NO: 7371423 - DNA, 22 bp, Homo sapiens
aagaggcagaaatatcgctgaa

SEQ ID NO: 7371424 - DNA, 22 bp, Homo sapiens
aagaggcagaaatatcgctgaa

SEQ ID NO: 7371425 - DNA, 19 bp, Homo sapiens
aagaggcaaccctcgagcc

SEQ ID NO: 7371426 - DNA, 22 bp, Homo sapiens
aagaggcagaaatatcgctgaa

SEQ ID NO: 7371427 - DNA, 22 bp, Homo sapiens
aagaggcagcccgctgaggctg

SEQ ID NO: 7371428 - DNA, 22 bp, Homo sapiens
aagaggcagcccgctgaggctg

SEQ ID NO: 7371429 - DNA, 22 bp, Homo sapiens
aagaggcagcccgctgaggctg

SEQ ID NO: 7371430 - DNA, 22 bp, Homo sapiens
aagaggcagtggtgatgaatgg

SEQ ID NO: 7371431 - DNA, 22 bp, Homo sapiens
aagaggcagtggtgatgaatgg

SEQ ID NO: 7371432 - DNA, 22 bp, Homo sapiens
aagaggcataaaatttatatgg

SEQ ID NO: 7371433 - DNA, 22 bp, Homo sapiens
aagaggcataaaatttatatgg

SEQ ID NO: 7371434 - DNA, 22 bp, Homo sapiens
aagaggcataaaatttatatgg

SEQ ID NO: 7371435 - DNA, 21 bp, Homo sapiens
aagaggcatcactatttgtgt

SEQ ID NO: 7371436 - DNA, 22 bp, Homo sapiens
acacacagagtttatacaggca

SEQ ID NO: 7371437 - DNA, 22 bp, Homo sapiens
acacacagcgcctaccatgtgc

SEQ ID NO: 7371438 - DNA, 22 bp, Homo sapiens
acacacagaaggaagccccact

SEQ ID NO: 7371439 - DNA, 21 bp, Homo sapiens
aagaggcatcactatttgtgt

SEQ ID NO: 7371440 - DNA, 22 bp, Homo sapiens
aagaggcatctcagcttcctct

SEQ ID NO: 7371441 - DNA, 22 bp, Homo sapiens
acacacatgcatgcttgccatt

SEQ ID NO: 7371442 - DNA, 19 bp, Homo sapiens
aagagggaaagtgctatgc

SEQ ID NO: 7371443 - DNA, 20 bp, Homo sapiens
aagagtctttactgagctaa

SEQ ID NO: 7371444 - DNA, 22 bp, Homo sapiens
aagagtttaattttgtctagac

SEQ ID NO: 7371445 - DNA, 22 bp, Homo sapiens
aagagttagctcaataacttga

SEQ ID NO: 7371446 - DNA, 22 bp, Homo sapiens
aagagttatacctatttctaac

SEQ ID NO: 7371447 - DNA, 22 bp, Homo sapiens
aagagttaagcaacagatacca

SEQ ID NO: 7371448 - DNA, 22 bp, Homo sapiens
aagagtaaagcaaagcacttgt

SEQ ID NO: 7371449 - DNA, 22 bp, Homo sapiens
aagagtaaatgtctaattagga

SEQ ID NO: 7371450 - DNA, 22 bp, Homo sapiens
acactacaatctcagaactata

SEQ ID NO: 7371451 - DNA, 22 bp, Homo sapiens
acactagagagcaggcattccc

SEQ ID NO: 7371452 - DNA, 22 bp, Homo sapiens
acactaaatgagtctacagtac

SEQ ID NO: 7371453 - DNA, 22 bp, Homo sapiens
acactaaggttggagtcacagt

SEQ ID NO: 7371454 - DNA, 22 bp, Homo sapiens
acacatttctctttttgtaagt

SEQ ID NO: 7371455 - DNA, 22 bp, Homo sapiens
acacatttctctttttgtaagt

SEQ ID NO: 7371456 - DNA, 22 bp, Homo sapiens
aagagtttatgatataacatgt

SEQ ID NO: 7371457 - DNA, 22 bp, Homo sapiens
acacccttgtccatagcagatg

SEQ ID NO: 7371458 - DNA, 22 bp, Homo sapiens
acaccttctgagaactgagcag

SEQ ID NO: 7371459 - DNA, 22 bp, Homo sapiens
acacctttcaggtccagacagt

SEQ ID NO: 7371460 - DNA, 22 bp, Homo sapiens
acagaagcaaagactcaggcaa

SEQ ID NO: 7371461 - DNA, 22 bp, Homo sapiens
acagaagataatgctgccttgg

SEQ ID NO: 7371462 - DNA, 22 bp, Homo sapiens
aagatttttttccacagactca

SEQ ID NO: 7371463 - DNA, 22 bp, Homo sapiens
aagcaaaacgtgctctaggagg

SEQ ID NO: 7371464 - DNA, 19 bp, Homo sapiens
aagatttggtcattgataa

SEQ ID NO: 7371465 - DNA, 22 bp, Homo sapiens
aagattttcagctaatggtgca

SEQ ID NO: 7371466 - DNA, 22 bp, Homo sapiens
aagattttctcaactgtatttg

SEQ ID NO: 7371467 - DNA, 22 bp, Homo sapiens
aagattttcagtgcctaaaaca

SEQ ID NO: 7371468 - DNA, 22 bp, Homo sapiens
aagatacatcaaagcaaattgg

SEQ ID NO: 7371469 - DNA, 22 bp, Homo sapiens
aagatactcagtggatatgcat

SEQ ID NO: 7371470 - DNA, 22 bp, Homo sapiens
aagatactttgcatgcatgaag

SEQ ID NO: 7371471 - DNA, 20 bp, Homo sapiens
aagatagaatcctaactttg

SEQ ID NO: 7371472 - DNA, 22 bp, Homo sapiens
aagatatagataaaactatgca

SEQ ID NO: 7371473 - DNA, 19 bp, Homo sapiens
acagaaatgtaagtgagac

SEQ ID NO: 7371474 - DNA, 22 bp, Homo sapiens
acagaagaccaagaaagcttcc

SEQ ID NO: 7371475 - DNA, 22 bp, Homo sapiens
acagaagaaagggaggttttgc

SEQ ID NO: 7371476 - DNA, 18 bp, Homo sapiens
acagaggcagacatgtat

SEQ ID NO: 7371477 - DNA, 22 bp, Homo sapiens
acagaggaaggctgagctgccc

SEQ ID NO: 7371478 - DNA, 22 bp, Homo sapiens
aagcaaagacagtttgagtgga

SEQ ID NO: 7371479 - DNA, 22 bp, Homo sapiens
aagcaaacaggagaagagctgt

SEQ ID NO: 7371480 - DNA, 22 bp, Homo sapiens
acagagtcataagcggagctcg

SEQ ID NO: 7371481 - DNA, 22 bp, Homo sapiens
acagagtcatggtagtcaaagg

SEQ ID NO: 7371482 - DNA, 22 bp, Homo sapiens
aagcacatttggaaaacatgga

SEQ ID NO: 7371483 - DNA, 22 bp, Homo sapiens
aactctttttttaagtgtagcc

SEQ ID NO: 7371484 - DNA, 22 bp, Homo sapiens
aactctttgaacagtgaggcta

SEQ ID NO: 7371485 - DNA, 22 bp, Homo sapiens
aatgtattctgggaaaatgtta

SEQ ID NO: 7371486 - DNA, 22 bp, Homo sapiens
aactcctgttctatgacaagag

SEQ ID NO: 7371487 - DNA, 22 bp, Homo sapiens
aactctctctggctcccagcaa

SEQ ID NO: 7371488 - DNA, 22 bp, Homo sapiens
aatgtcttggatacagaggttg

SEQ ID NO: 7371489 - DNA, 22 bp, Homo sapiens
aatgtctttaaagtgcaataga

SEQ ID NO: 7371490 - DNA, 22 bp, Homo sapiens
aatgtctttaaagtgcaataga

SEQ ID NO: 7371491 - DNA, 22 bp, Homo sapiens
aatgtctttacttttgtgggca

SEQ ID NO: 7371492 - DNA, 22 bp, Homo sapiens
aatgtctttctgttctatgaga

SEQ ID NO: 7371493 - DNA, 22 bp, Homo sapiens
aatgtctttacttttgtgggca

SEQ ID NO: 7371494 - DNA, 22 bp, Homo sapiens
aatgtctttatttcaggtttac

SEQ ID NO: 7371495 - DNA, 22 bp, Homo sapiens
aatgtctttctcataacagata

SEQ ID NO: 7371496 - DNA, 20 bp, Homo sapiens
aatgtcttgagacatttcag

SEQ ID NO: 7371497 - DNA, 22 bp, Homo sapiens
aatgtcttgagaagagaaatct

SEQ ID NO: 7371498 - DNA, 22 bp, Homo sapiens
aatgtcttcttcagctgaataa

SEQ ID NO: 7371499 - DNA, 22 bp, Homo sapiens
aatgtcaacacaagagaaatgc

SEQ ID NO: 7371500 - DNA, 22 bp, Homo sapiens
aatgtcaacacaagagaaatgc

SEQ ID NO: 7371501 - DNA, 22 bp, Homo sapiens
aatgtcaaaggctatacattca

SEQ ID NO: 7371502 - DNA, 22 bp, Homo sapiens
aatgtattttgggagtttcttt

SEQ ID NO: 7371503 - DNA, 22 bp, Homo sapiens
aatgtatttgatgtattagcct

SEQ ID NO: 7371504 - DNA, 20 bp, Homo sapiens
aatgtattgttttgtttcag

SEQ ID NO: 7371505 - DNA, 20 bp, Homo sapiens
aatgtattgttttgtttcag

SEQ ID NO: 7371506 - DNA, 22 bp, Homo sapiens
aattactgtaattttctacagc

SEQ ID NO: 7371507 - DNA, 22 bp, Homo sapiens
aattacttaagagaaactttga

SEQ ID NO: 7371508 - DNA, 22 bp, Homo sapiens
aattacttaagagaaactttga

SEQ ID NO: 7371509 - DNA, 22 bp, Homo sapiens
aactttctgaaaagcttgatca

SEQ ID NO: 7371510 - DNA, 22 bp, Homo sapiens
aactttctctacggcatttgtt

SEQ ID NO: 7371511 - DNA, 22 bp, Homo sapiens
aatgttattacacttgtgaaat

SEQ ID NO: 7371512 - DNA, 21 bp, Homo sapiens
aactttagaaagactgggaag

SEQ ID NO: 7371513 - DNA, 20 bp, Homo sapiens
aactttagacataatctctt

SEQ ID NO: 7371514 - DNA, 22 bp, Homo sapiens
aatgtcttttgcagttcaagat

SEQ ID NO: 7371515 - DNA, 22 bp, Homo sapiens
aatgtgttttcactgaagattc

SEQ ID NO: 7371516 - DNA, 22 bp, Homo sapiens
aatgttaaaaccttcagtgctt

SEQ ID NO: 7371517 - DNA, 22 bp, Homo sapiens
aatgtgttttatgagagaatat

SEQ ID NO: 7371518 - DNA, 22 bp, Homo sapiens
aatgtgttttcactgaagattc

SEQ ID NO: 7371519 - DNA, 22 bp, Homo sapiens
aatgtcttttcccttactttcc

SEQ ID NO: 7371520 - DNA, 22 bp, Homo sapiens
aatgtcttttaacctctggact

SEQ ID NO: 7371521 - DNA, 22 bp, Homo sapiens
aatgtcttttgatacaagttac

SEQ ID NO: 7371522 - DNA, 22 bp, Homo sapiens
aatgtcttttgatacaagttac

SEQ ID NO: 7371523 - DNA, 22 bp, Homo sapiens
aatgtcttttaaatgttgaggt

SEQ ID NO: 7371524 - DNA, 22 bp, Homo sapiens
aatgtcttttaaatgttgaggt

SEQ ID NO: 7371525 - DNA, 22 bp, Homo sapiens
aatgtcttttaacctctggact

SEQ ID NO: 7371526 - DNA, 21 bp, Homo sapiens
aatgtctttgtccatgctctg

SEQ ID NO: 7371527 - DNA, 22 bp, Homo sapiens
aatgtctttgccagggtcgggc

SEQ ID NO: 7371528 - DNA, 22 bp, Homo sapiens
aatgtctttcttggttctggtt

SEQ ID NO: 7371529 - DNA, 22 bp, Homo sapiens
aatgtctttcttggttctggtt

SEQ ID NO: 7371530 - DNA, 22 bp, Homo sapiens
aatgtctttgcaggagggattg

SEQ ID NO: 7371531 - DNA, 23 bp, Homo sapiens
acaactttacagatacattttgt

SEQ ID NO: 7371532 - DNA, 22 bp, Homo sapiens
acaactgttggaggaacacagg

SEQ ID NO: 7371533 - DNA, 22 bp, Homo sapiens
acaagaaaggtaggattcaggt

SEQ ID NO: 7371534 - DNA, 22 bp, Homo sapiens
acaagaaaggtaggattcaggt

SEQ ID NO: 7371535 - DNA, 22 bp, Homo sapiens
aagacattcacaaatgttcact

SEQ ID NO: 7371536 - DNA, 22 bp, Homo sapiens
acaagaataaggataagagatt

SEQ ID NO: 7371537 - DNA, 22 bp, Homo sapiens
aagacattgctgcttttaattg

SEQ ID NO: 7371538 - DNA, 22 bp, Homo sapiens
aagacattgtcattttataatt

SEQ ID NO: 7371539 - DNA, 22 bp, Homo sapiens
acaacaaaatcactagtcttcc

SEQ ID NO: 7371540 - DNA, 22 bp, Homo sapiens
aagacaatttgatactagttgc

SEQ ID NO: 7371541 - DNA, 22 bp, Homo sapiens
aagacaatttgatactagttgc

SEQ ID NO: 7371542 - DNA, 22 bp, Homo sapiens
aagacaattttgagtatgcaca

SEQ ID NO: 7371543 - DNA, 22 bp, Homo sapiens
aagacaatgcattactaagaag

SEQ ID NO: 7371544 - DNA, 22 bp, Homo sapiens
aagacaatcctggacagtcagc

SEQ ID NO: 7371545 - DNA, 22 bp, Homo sapiens
aagaatctgttgattccccact

SEQ ID NO: 7371546 - DNA, 22 bp, Homo sapiens
aagaattattgcaatactagat

SEQ ID NO: 7371547 - DNA, 22 bp, Homo sapiens
aagacaagccttgtttttctgc

SEQ ID NO: 7371548 - DNA, 17 bp, Homo sapiens
aagacaagacaaatgca

SEQ ID NO: 7371549 - DNA, 22 bp, Homo sapiens
aagacaacagagatgacagact

SEQ ID NO: 7371550 - DNA, 22 bp, Homo sapiens
aagacaaaggggtccttggatg

SEQ ID NO: 7371551 - DNA, 23 bp, Homo sapiens
aattcaaattcagtgtgactagg

SEQ ID NO: 7371552 - DNA, 22 bp, Homo sapiens
aacattctgtcaattgatgacc

SEQ ID NO: 7371553 - DNA, 22 bp, Homo sapiens
aacattctggttctaaaaacct

SEQ ID NO: 7371554 - DNA, 22 bp, Homo sapiens
aacattcttaagatttgtgtct

SEQ ID NO: 7371555 - DNA, 22 bp, Homo sapiens
aacattctttagctcttcctgc

SEQ ID NO: 7371556 - DNA, 22 bp, Homo sapiens
aacattcttcaaatatcactct

SEQ ID NO: 7371557 - DNA, 22 bp, Homo sapiens
aacattcttcaaatatcactct

SEQ ID NO: 7371558 - DNA, 22 bp, Homo sapiens
aacagtttgctttaagaggcac

SEQ ID NO: 7371559 - DNA, 22 bp, Homo sapiens
aacagtttgtggatagcttgta

SEQ ID NO: 7371560 - DNA, 22 bp, Homo sapiens
aacattgaatttaaaatacagt

SEQ ID NO: 7371561 - DNA, 20 bp, Homo sapiens
aacattgtttgtaaaagcag

SEQ ID NO: 7371562 - DNA, 22 bp, Homo sapiens
aacattgccatggttaatttta

SEQ ID NO: 7371563 - DNA, 22 bp, Homo sapiens
aacatttcagcacctgattcct

SEQ ID NO: 7371564 - DNA, 22 bp, Homo sapiens
aatcacatttacattgctaatt

SEQ ID NO: 7371565 - DNA, 20 bp, Homo sapiens
aactcctagcctcaagtgat

SEQ ID NO: 7371566 - DNA, 21 bp, Homo sapiens
aactcccagtgccttcccagc

SEQ ID NO: 7371567 - DNA, 22 bp, Homo sapiens
aactcatttgcatttttcctgt

SEQ ID NO: 7371568 - DNA, 22 bp, Homo sapiens
aaccattagtcaatcagcaaga

SEQ ID NO: 7371569 - DNA, 22 bp, Homo sapiens
aataaactgctcaattgcatca

SEQ ID NO: 7371570 - DNA, 22 bp, Homo sapiens
aataaacaaatccttccttccc

SEQ ID NO: 7371571 - DNA, 22 bp, Homo sapiens
aataaacaaatccttccttccc

SEQ ID NO: 7371572 - DNA, 22 bp, Homo sapiens
aagtttctgtatgctcttctgt

SEQ ID NO: 7371573 - DNA, 20 bp, Homo sapiens
aagtttctggtttatatctt

SEQ ID NO: 7371574 - DNA, 22 bp, Homo sapiens
aagtttctgttcatatctctga

SEQ ID NO: 7371575 - DNA, 22 bp, Homo sapiens
aagtttctgttcgctttaataa

SEQ ID NO: 7371576 - DNA, 22 bp, Homo sapiens
aagtttctggaccttacctgct

SEQ ID NO: 7371577 - DNA, 22 bp, Homo sapiens
aagtttctgatattgttaaagc

SEQ ID NO: 7371578 - DNA, 22 bp, Homo sapiens
aagtttgacagaagtttctaat

SEQ ID NO: 7371579 - DNA, 22 bp, Homo sapiens
aataaaatggtcagttttctca

SEQ ID NO: 7371580 - DNA, 22 bp, Homo sapiens
aagtatttcgttctgaaaaagt

SEQ ID NO: 7371581 - DNA, 21 bp, Homo sapiens
aagtcaatacagataagtctt

SEQ ID NO: 7371582 - DNA, 22 bp, Homo sapiens
aacactgagggaaaagagatag

SEQ ID NO: 7371583 - DNA, 20 bp, Homo sapiens
aacactgagggctactcttc

SEQ ID NO: 7371584 - DNA, 22 bp, Homo sapiens
aacactggaagggacatcaagt

SEQ ID NO: 7371585 - DNA, 22 bp, Homo sapiens
aacactggacaggaggctaggt

SEQ ID NO: 7371586 - DNA, 22 bp, Homo sapiens
aacactgctccaaaaaaggctt

SEQ ID NO: 7371587 - DNA, 22 bp, Homo sapiens
aacactgggataggtgatagac

SEQ ID NO: 7371588 - DNA, 22 bp, Homo sapiens
aagttctgccaggctgtggcag

SEQ ID NO: 7371589 - DNA, 23 bp, Homo sapiens
aagttctgattgtttttccatag

SEQ ID NO: 7371590 - DNA, 22 bp, Homo sapiens
aagttctggggtaatgagaatt

SEQ ID NO: 7371591 - DNA, 22 bp, Homo sapiens
aaggggcctcacagatgggctt

SEQ ID NO: 7371592 - DNA, 21 bp, Homo sapiens
aaggggcaaacccaggacacc

SEQ ID NO: 7371593 - DNA, 22 bp, Homo sapiens
aaggggagttagtgataaaacc

SEQ ID NO: 7371594 - DNA, 22 bp, Homo sapiens
aagggagatagttcgccatggg

SEQ ID NO: 7371595 - DNA, 22 bp, Homo sapiens
aagggagcaaatggacagacgg

SEQ ID NO: 7371596 - DNA, 22 bp, Homo sapiens
aagggagccaagaaagcagggc

SEQ ID NO: 7371597 - DNA, 22 bp, Homo sapiens
aagggaggccagaggttttgca

SEQ ID NO: 7371598 - DNA, 22 bp, Homo sapiens
aagggaggaggatttattgtac

SEQ ID NO: 7371599 - DNA, 22 bp, Homo sapiens
aagggagcttaggagatcaggc

SEQ ID NO: 7371600 - DNA, 22 bp, Homo sapiens
aagggagcggggagaccctatg

SEQ ID NO: 7371601 - DNA, 22 bp, Homo sapiens
aacaatgagtcctctgaggtta

SEQ ID NO: 7371602 - DNA, 23 bp, Homo sapiens
aacaatagagataaagtgagatc

SEQ ID NO: 7371603 - DNA, 22 bp, Homo sapiens
aacaatgaccacacaatgtact

SEQ ID NO: 7371604 - DNA, 22 bp, Homo sapiens
aacaatcaagtttctaaatgac

SEQ ID NO: 7371605 - DNA, 22 bp, Homo sapiens
aacaatcaagtttctaaatgac

SEQ ID NO: 7371606 - DNA, 22 bp, Homo sapiens
aacaataattgcggttctctat

SEQ ID NO: 7371607 - DNA, 22 bp, Homo sapiens
aagggagacagttgtgtgagga

SEQ ID NO: 7371608 - DNA, 22 bp, Homo sapiens
aacaataactagacatgccatg

SEQ ID NO: 7371609 - DNA, 22 bp, Homo sapiens
aacaagttctaagtgtctactt

SEQ ID NO: 7371610 - DNA, 22 bp, Homo sapiens
aacaagttactcttaaagtata

SEQ ID NO: 7371611 - DNA, 19 bp, Homo sapiens
aacaagtaggaatggaaga

SEQ ID NO: 7371612 - DNA, 22 bp, Homo sapiens
aacaagcagatgcaatgcactt

SEQ ID NO: 7371613 - DNA, 22 bp, Homo sapiens
aacaaatgtgttttgtaattaa

SEQ ID NO: 7371614 - DNA, 22 bp, Homo sapiens
aacaagatagagctcttgcctt

SEQ ID NO: 7371615 - DNA, 22 bp, Homo sapiens
aaggccacagagcctcagagag

SEQ ID NO: 7371616 - DNA, 22 bp, Homo sapiens
aaggccacacttgctggccagc

SEQ ID NO: 7371617 - DNA, 22 bp, Homo sapiens
aaggccaaggctgcagtgagcc

SEQ ID NO: 7371618 - DNA, 22 bp, Homo sapiens
aaggccaaggctgcagtgagcc

SEQ ID NO: 7371619 - DNA, 22 bp, Homo sapiens
aaggccaaagttttcaggctaa

SEQ ID NO: 7371620 - DNA, 22 bp, Homo sapiens
aaggccacgtctccttccagag

SEQ ID NO: 7371621 - DNA, 22 bp, Homo sapiens
aaggccaccaccagcgaggggg

SEQ ID NO: 7371622 - DNA, 22 bp, Homo sapiens
aaggcattggactagtatcaga

SEQ ID NO: 7371623 - DNA, 22 bp, Homo sapiens
aaatttctaagtcaagaagaac

SEQ ID NO: 7371624 - DNA, 22 bp, Homo sapiens
aaatttcagttggaatgagctc

SEQ ID NO: 7371625 - DNA, 22 bp, Homo sapiens
aaatttcaagcaaagtagctat

SEQ ID NO: 7371626 - DNA, 22 bp, Homo sapiens
aagccatggtagaaaactcagt

SEQ ID NO: 7371627 - DNA, 22 bp, Homo sapiens
aagccatggcatgccaggatca

SEQ ID NO: 7371628 - DNA, 22 bp, Homo sapiens
aagccatggctgcatcagcctg

SEQ ID NO: 7371629 - DNA, 22 bp, Homo sapiens
aagccatgcaagccacaaggtg

SEQ ID NO: 7371630 - DNA, 21 bp, Homo sapiens
aaggaaaagcttggtctctga

SEQ ID NO: 7371631 - DNA, 22 bp, Homo sapiens
aagctttgttcttcacagagtg

SEQ ID NO: 7371632 - DNA, 22 bp, Homo sapiens
aagctttgtccaaggccatgca

SEQ ID NO: 7371633 - DNA, 22 bp, Homo sapiens
aagctttgggcagaagaggatt

SEQ ID NO: 7371634 - DNA, 22 bp, Homo sapiens
aagctttggagaggcgggcagg

SEQ ID NO: 7371635 - DNA, 22 bp, Homo sapiens
aagctttgcaccggtggctgga

SEQ ID NO: 7371636 - DNA, 22 bp, Homo sapiens
aagctttggaagggcagggttg

SEQ ID NO: 7371637 - DNA, 22 bp, Homo sapiens
aagctttgcaatgcttcattat

SEQ ID NO: 7371638 - DNA, 22 bp, Homo sapiens
aagctttgataattggattact

SEQ ID NO: 7371639 - DNA, 22 bp, Homo sapiens
aagctttgactactgcctcttg

SEQ ID NO: 7371640 - DNA, 22 bp, Homo sapiens
aagctttatgatctctcagcta

SEQ ID NO: 7371641 - DNA, 22 bp, Homo sapiens
aagctgtagaggcagtacattt

SEQ ID NO: 7371642 - DNA, 22 bp, Homo sapiens
aagctgtagaggcagtacattt

SEQ ID NO: 7371643 - DNA, 22 bp, Homo sapiens
aagctgtatgacctaaatcttg

SEQ ID NO: 7371644 - DNA, 22 bp, Homo sapiens
aagctgtatgacctaaatcttg

SEQ ID NO: 7371645 - DNA, 22 bp, Homo sapiens
aagctttagagatgagttcctt

SEQ ID NO: 7371646 - DNA, 22 bp, Homo sapiens
aagctttaagtgtcagtcagcc

SEQ ID NO: 7371647 - DNA, 22 bp, Homo sapiens
aaggacctgattttgagcatct

SEQ ID NO: 7371648 - DNA, 22 bp, Homo sapiens
aaggactgaataattctctttc

SEQ ID NO: 7371649 - DNA, 22 bp, Homo sapiens
aaggagaaggcatcattcaagt

SEQ ID NO: 7371650 - DNA, 22 bp, Homo sapiens
aaatttaaggaggtgctcactt

SEQ ID NO: 7371651 - DNA, 22 bp, Homo sapiens
aaattagtacattgcaaagtcc

SEQ ID NO: 7371652 - DNA, 22 bp, Homo sapiens
aaattagtacattgcaaagtcc

SEQ ID NO: 7371653 - DNA, 22 bp, Homo sapiens
aaatgttttgctcccatgtggt

SEQ ID NO: 7371654 - DNA, 22 bp, Homo sapiens
aaattagtcatgttgtattact

SEQ ID NO: 7371655 - DNA, 22 bp, Homo sapiens
aaattagtcatgttgtattact

SEQ ID NO: 7371656 - DNA, 22 bp, Homo sapiens
aaattagtcggtttaggaattt

SEQ ID NO: 7371657 - DNA, 22 bp, Homo sapiens
aaattagtcggtttaggaattt

SEQ ID NO: 7371658 - DNA, 22 bp, Homo sapiens
aaattataggtgccaccttgga

SEQ ID NO: 7371659 - DNA, 22 bp, Homo sapiens
aaattagtgttttcttactggt

SEQ ID NO: 7371660 - DNA, 22 bp, Homo sapiens
aaattagtgcaccaggttgaag

SEQ ID NO: 7371661 - DNA, 22 bp, Homo sapiens
aaattatcatgattattgtgta

SEQ ID NO: 7371662 - DNA, 22 bp, Homo sapiens
aaattattaaacagtgggatgc

SEQ ID NO: 7371663 - DNA, 22 bp, Homo sapiens
aaattattagttaagttgggca

SEQ ID NO: 7371664 - DNA, 22 bp, Homo sapiens
aaattattacaagctagttggc

SEQ ID NO: 7371665 - DNA, 22 bp, Homo sapiens
aaattattatgcccctctataa

SEQ ID NO: 7371666 - DNA, 22 bp, Homo sapiens
aaattattataggcagagctga

SEQ ID NO: 7371667 - DNA, 23 bp, Homo sapiens
caccactttctccttctccttgg

SEQ ID NO: 7371668 - DNA, 23 bp, Homo sapiens
caccactttctccttctccttgg

SEQ ID NO: 7371669 - DNA, 23 bp, Homo sapiens
caccactttctccttctccttgg

SEQ ID NO: 7371670 - DNA, 22 bp, Homo sapiens
caccagcagaagactgagggtg

SEQ ID NO: 7371671 - DNA, 20 bp, Homo sapiens
caccagcagcagctgccacc

SEQ ID NO: 7371672 - DNA, 20 bp, Homo sapiens
caccagcagcagctgccacc

SEQ ID NO: 7371673 - DNA, 22 bp, Homo sapiens
agcagggcaggtaaggatcaga

SEQ ID NO: 7371674 - DNA, 22 bp, Homo sapiens
agcagggcaaagtcaggctaac

SEQ ID NO: 7371675 - DNA, 22 bp, Homo sapiens
agcaggaaggtctgtgtgagtc

SEQ ID NO: 7371676 - DNA, 21 bp, Homo sapiens
agcagctgggcaacatggagg

SEQ ID NO: 7371677 - DNA, 22 bp, Homo sapiens
cacagcaatagctaactgatac

SEQ ID NO: 7371678 - DNA, 22 bp, Homo sapiens
cacagcaagagctaaatgacca

SEQ ID NO: 7371679 - DNA, 22 bp, Homo sapiens
agcaggaagtagtctgtaagca

SEQ ID NO: 7371680 - DNA, 22 bp, Homo sapiens
cacagcagacagggaggcggct

SEQ ID NO: 7371681 - DNA, 22 bp, Homo sapiens
agcaggctgggcaatatgggca

SEQ ID NO: 7371682 - DNA, 22 bp, Homo sapiens
cacagcagaacttaatttcaaa

SEQ ID NO: 7371683 - DNA, 22 bp, Homo sapiens
cacagcagaaagtgtaggagga

SEQ ID NO: 7371684 - DNA, 17 bp, Homo sapiens
agcagggagtcaaggga

SEQ ID NO: 7371685 - DNA, 22 bp, Homo sapiens
agcagggaggcccagggcactg

SEQ ID NO: 7371686 - DNA, 22 bp, Homo sapiens
agcatggggcaatgcatgtgct

SEQ ID NO: 7371687 - DNA, 22 bp, Homo sapiens
cactgtggggtttggctggaac

SEQ ID NO: 7371688 - DNA, 22 bp, Homo sapiens
cactgtgggtcccagactggag

SEQ ID NO: 7371689 - DNA, 22 bp, Homo sapiens
agcagtagtgatggcccctgag

SEQ ID NO: 7371690 - DNA, 18 bp, Homo sapiens
agcagtagcgccaggtgc

SEQ ID NO: 7371691 - DNA, 22 bp, Homo sapiens
agcaggttgttttgtggccagg

SEQ ID NO: 7371692 - DNA, 22 bp, Homo sapiens
agcaggttaaaccaaaatataa

SEQ ID NO: 7371693 - DNA, 18 bp, Homo sapiens
agcatgagagaggctgtg

SEQ ID NO: 7371694 - DNA, 19 bp, Homo sapiens
agcagtggagccatgcctg

SEQ ID NO: 7371695 - DNA, 22 bp, Homo sapiens
agcagtggcatacattttgagt

SEQ ID NO: 7371696 - DNA, 22 bp, Homo sapiens
agcagtggagcgagatgtttaa

SEQ ID NO: 7371697 - DNA, 21 bp, Homo sapiens
agcagctgggcaacatggagg

SEQ ID NO: 7371698 - DNA, 22 bp, Homo sapiens
agcagctggcagcttcttctct

SEQ ID NO: 7371699 - DNA, 17 bp, Homo sapiens
agcagctggcacaggag

SEQ ID NO: 7371700 - DNA, 17 bp, Homo sapiens
agcagctggcacaggag

SEQ ID NO: 7371701 - DNA, 22 bp, Homo sapiens
agcagctggaactaatagtggt

SEQ ID NO: 7371702 - DNA, 19 bp, Homo sapiens
agcagctggaggtggagtg

SEQ ID NO: 7371703 - DNA, 22 bp, Homo sapiens
agcagctgcttttcttcattgg

SEQ ID NO: 7371704 - DNA, 22 bp, Homo sapiens
agcagctggaacatatgaagaa

SEQ ID NO: 7371705 - DNA, 22 bp, Homo sapiens
cacagagattagaattagacta

SEQ ID NO: 7371706 - DNA, 22 bp, Homo sapiens
agcagctagaatagtgcctggt

SEQ ID NO: 7371707 - DNA, 22 bp, Homo sapiens
agcagcctttgatcatctggga

SEQ ID NO: 7371708 - DNA, 21 bp, Homo sapiens
agcagccttgtgtgccaggca

SEQ ID NO: 7371709 - DNA, 22 bp, Homo sapiens
agcagctcccctcatgctccac

SEQ ID NO: 7371710 - DNA, 22 bp, Homo sapiens
cacagaacatccttagctcatg

SEQ ID NO: 7371711 - DNA, 22 bp, Homo sapiens
cacagagatcggaacagaagta

SEQ ID NO: 7371712 - DNA, 22 bp, Homo sapiens
agcagcagatcaaacaggcttg

SEQ ID NO: 7371713 - DNA, 22 bp, Homo sapiens
agcagcagatcaaacaggcttg

SEQ ID NO: 7371714 - DNA, 22 bp, Homo sapiens
agcagcagagctctggtctgca

SEQ ID NO: 7371715 - DNA, 19 bp, Homo sapiens
agcagcagaagtgtgcctt

SEQ ID NO: 7371716 - DNA, 22 bp, Homo sapiens
agcagcagaggtcagaaaggta

SEQ ID NO: 7371717 - DNA, 22 bp, Homo sapiens
agcagcagaggtcagaaaggta

SEQ ID NO: 7371718 - DNA, 19 bp, Homo sapiens
agcagcagaagtgtgcctt

SEQ ID NO: 7371719 - DNA, 22 bp, Homo sapiens
caatactgagtttacattcatc

SEQ ID NO: 7371720 - DNA, 22 bp, Homo sapiens
agcagcctattcttctcttgga

SEQ ID NO: 7371721 - DNA, 22 bp, Homo sapiens
agcagcctgcagatattggtct

SEQ ID NO: 7371722 - DNA, 22 bp, Homo sapiens
agcagccttaggtattgtgatt

SEQ ID NO: 7371723 - DNA, 22 bp, Homo sapiens
agcagccttaggtattgtgatt

SEQ ID NO: 7371724 - DNA, 22 bp, Homo sapiens
agcagccttgcaggggtcgcac

SEQ ID NO: 7371725 - DNA, 22 bp, Homo sapiens
agcagccttaggtattgtgatt

SEQ ID NO: 7371726 - DNA, 22 bp, Homo sapiens
agcagccttgcaggggtcgcac

SEQ ID NO: 7371727 - DNA, 22 bp, Homo sapiens
agcagccagagaatgatgcagt

SEQ ID NO: 7371728 - DNA, 21 bp, Homo sapiens
agcagcagatctggtgagggc

SEQ ID NO: 7371729 - DNA, 22 bp, Homo sapiens
caatacaattaccagttaatca

SEQ ID NO: 7371730 - DNA, 22 bp, Homo sapiens
caatacaattaccagttaatca

SEQ ID NO: 7371731 - DNA, 22 bp, Homo sapiens
caataatttacattggatacca

SEQ ID NO: 7371732 - DNA, 21 bp, Homo sapiens
agcagaggctgcctggtgact

SEQ ID NO: 7371733 - DNA, 21 bp, Homo sapiens
agcagaggggacatgtttgat

SEQ ID NO: 7371734 - DNA, 16 bp, Homo sapiens
agcagaggtgagtgaa

SEQ ID NO: 7371735 - DNA, 22 bp, Homo sapiens
agcagaggtgtttattatggga

SEQ ID NO: 7371736 - DNA, 22 bp, Homo sapiens
agcagaggtgtttattatggga

SEQ ID NO: 7371737 - DNA, 22 bp, Homo sapiens
agcagagtctgtgtgcacttta

SEQ ID NO: 7371738 - DNA, 22 bp, Homo sapiens
agcagaggtttgttggaaacct

SEQ ID NO: 7371739 - DNA, 20 bp, Homo sapiens
agcagagtgcccatcccgga

SEQ ID NO: 7371740 - DNA, 22 bp, Homo sapiens
agcagaggaggatttagttagg

SEQ ID NO: 7371741 - DNA, 21 bp, Homo sapiens
agcagaggcagaatgtatgca

SEQ ID NO: 7371742 - DNA, 21 bp, Homo sapiens
agcagaggcagaatgtatgca

SEQ ID NO: 7371743 - DNA, 22 bp, Homo sapiens
agcagaggacagttcttaggaa

SEQ ID NO: 7371744 - DNA, 22 bp, Homo sapiens
agcagagacctggttttgttga

SEQ ID NO: 7371745 - DNA, 22 bp, Homo sapiens
agcactgtgagcaccagcacgc

SEQ ID NO: 7371746 - DNA, 22 bp, Homo sapiens
agcagagctgcagtggcctgct

SEQ ID NO: 7371747 - DNA, 22 bp, Homo sapiens
agcacgagatcgatgtgccttt

SEQ ID NO: 7371748 - DNA, 20 bp, Homo sapiens
agcactgtctgaccagtggc

SEQ ID NO: 7371749 - DNA, 22 bp, Homo sapiens
agcactggagtttagtgggatt

SEQ ID NO: 7371750 - DNA, 22 bp, Homo sapiens
caaaggcctgagaactgagggg

SEQ ID NO: 7371751 - DNA, 22 bp, Homo sapiens
caaaggcagttactgaatgaag

SEQ ID NO: 7371752 - DNA, 22 bp, Homo sapiens
caaaggcagttactgaatgaag

SEQ ID NO: 7371753 - DNA, 22 bp, Homo sapiens
caaaggcatgtgagtatatgtg

SEQ ID NO: 7371754 - DNA, 22 bp, Homo sapiens
caaaggcatcggcaattaggga

SEQ ID NO: 7371755 - DNA, 22 bp, Homo sapiens
caaaggcatcggcaattaggga

SEQ ID NO: 7371756 - DNA, 22 bp, Homo sapiens
caaaggcatgtgagtatatgtg

SEQ ID NO: 7371757 - DNA, 22 bp, Homo sapiens
caaaggcatgtgagtatatgtg

SEQ ID NO: 7371758 - DNA, 22 bp, Homo sapiens
caaagggaaacgcagtgtcaag

SEQ ID NO: 7371759 - DNA, 22 bp, Homo sapiens
agcctgggcaacaacacagcga

SEQ ID NO: 7371760 - DNA, 22 bp, Homo sapiens
agcctggccactcagggcctga

SEQ ID NO: 7371761 - DNA, 22 bp, Homo sapiens
agcctggcttagctctctcact

SEQ ID NO: 7371762 - DNA, 19 bp, Homo sapiens
agcctggctttgctctgct

SEQ ID NO: 7371763 - DNA, 19 bp, Homo sapiens
agcctggctttgctctgct

SEQ ID NO: 7371764 - DNA, 22 bp, Homo sapiens
cagcaaatactactagttttta

SEQ ID NO: 7371765 - DNA, 22 bp, Homo sapiens
agctacaaatgtatgtgctgat

SEQ ID NO: 7371766 - DNA, 22 bp, Homo sapiens
agctaattagaaatagattatt

SEQ ID NO: 7371767 - DNA, 22 bp, Homo sapiens
agctacacttaaccacatagca

SEQ ID NO: 7371768 - DNA, 22 bp, Homo sapiens
agctacacccctttacagtcct

SEQ ID NO: 7371769 - DNA, 21 bp, Homo sapiens
agcggcagaccctgcatttga

SEQ ID NO: 7371770 - DNA, 22 bp, Homo sapiens
agctccagcggatggtcttata

SEQ ID NO: 7371771 - DNA, 23 bp, Homo sapiens
agctccagctgacgtgggcagcc

SEQ ID NO: 7371772 - DNA, 23 bp, Homo sapiens
agctccagaacatagcacaggaa

SEQ ID NO: 7371773 - DNA, 23 bp, Homo sapiens
agctccagaacatagcacaggaa

SEQ ID NO: 7371774 - DNA, 22 bp, Homo sapiens
agctagaggtgaaacatgccaa

SEQ ID NO: 7371775 - DNA, 22 bp, Homo sapiens
agctaggaaattgaggctgaga

SEQ ID NO: 7371776 - DNA, 22 bp, Homo sapiens
agctctgtgttcacagcactaa

SEQ ID NO: 7371777 - DNA, 19 bp, Homo sapiens
agctctgtcaggctacata

SEQ ID NO: 7371778 - DNA, 20 bp, Homo sapiens
agctcttaagaagaagatga

SEQ ID NO: 7371779 - DNA, 22 bp, Homo sapiens
agctcttacatttaggtctatg

SEQ ID NO: 7371780 - DNA, 22 bp, Homo sapiens
agctctttatgggtaaatgcca

SEQ ID NO: 7371781 - DNA, 22 bp, Homo sapiens
agctctttctacaagcaggcag

SEQ ID NO: 7371782 - DNA, 22 bp, Homo sapiens
agctctttgagcaaggcagctc

SEQ ID NO: 7371783 - DNA, 22 bp, Homo sapiens
agctctttgagaaggcagtgtg

SEQ ID NO: 7371784 - DNA, 22 bp, Homo sapiens
agctctttggcactgagcagca

SEQ ID NO: 7371785 - DNA, 22 bp, Homo sapiens
agctctttgctggcagtaggct

SEQ ID NO: 7371786 - DNA, 22 bp, Homo sapiens
agccctgggcacctgtgagggg

SEQ ID NO: 7371787 - DNA, 22 bp, Homo sapiens
agccctgggcacctgtgagggg

SEQ ID NO: 7371788 - DNA, 22 bp, Homo sapiens
agccctggctcccagcagcgct

SEQ ID NO: 7371789 - DNA, 22 bp, Homo sapiens
cagatggccagaggcagctgca

SEQ ID NO: 7371790 - DNA, 22 bp, Homo sapiens
cagatggcagggcagctctgca

SEQ ID NO: 7371791 - DNA, 22 bp, Homo sapiens
cagatggcatttcctttctggc

SEQ ID NO: 7371792 - DNA, 19 bp, Homo sapiens
cagatggccacctacttgc

SEQ ID NO: 7371793 - DNA, 22 bp, Homo sapiens
agccctggcagagccaggtagt

SEQ ID NO: 7371794 - DNA, 22 bp, Homo sapiens
agccccagttccctggaagtct

SEQ ID NO: 7371795 - DNA, 22 bp, Homo sapiens
agccccagcccctctctcacaa

SEQ ID NO: 7371796 - DNA, 20 bp, Homo sapiens
agccccacccttgtcctggc

SEQ ID NO: 7371797 - DNA, 22 bp, Homo sapiens
agccccacgttgtctagcacct

SEQ ID NO: 7371798 - DNA, 22 bp, Homo sapiens
agccccaggatgggccgcagga

SEQ ID NO: 7371799 - DNA, 22 bp, Homo sapiens
agccccaggatgggccgcagga

SEQ ID NO: 7371800 - DNA, 22 bp, Homo sapiens
agccccagtaagggagggcctg

SEQ ID NO: 7371801 - DNA, 22 bp, Homo sapiens
agccccacactctctctgagaa

SEQ ID NO: 7371802 - DNA, 22 bp, Homo sapiens
agccccacactctctctgagaa

SEQ ID NO: 7371803 - DNA, 22 bp, Homo sapiens
agcccatgcaacaggcctagcg

SEQ ID NO: 7371804 - DNA, 22 bp, Homo sapiens
agcccaggttgaggctgcagtg

SEQ ID NO: 7371805 - DNA, 22 bp, Homo sapiens
agcccaggttgaggctgcagtg

SEQ ID NO: 7371806 - DNA, 19 bp, Homo sapiens
agccagttggtaagaggct

SEQ ID NO: 7371807 - DNA, 22 bp, Homo sapiens
agccagttggctatgaggagga

SEQ ID NO: 7371808 - DNA, 22 bp, Homo sapiens
agccagtttaagcaggaggggt

SEQ ID NO: 7371809 - DNA, 22 bp, Homo sapiens
agccagttcaagttatggcgtt

SEQ ID NO: 7371810 - DNA, 22 bp, Homo sapiens
agccagtgcagctggaaattca

SEQ ID NO: 7371811 - DNA, 22 bp, Homo sapiens
agccagtgccagtcatgcctgc

SEQ ID NO: 7371812 - DNA, 22 bp, Homo sapiens
cagagacccttctcagtggcca

SEQ ID NO: 7371813 - DNA, 20 bp, Homo sapiens
cagagacccaggcttcagct

SEQ ID NO: 7371814 - DNA, 22 bp, Homo sapiens
cagagacatgtggcctgcacgt

SEQ ID NO: 7371815 - DNA, 22 bp, Homo sapiens
cagagacattaagtgccatgat

SEQ ID NO: 7371816 - DNA, 22 bp, Homo sapiens
cagagaaagggtgaattccttc

SEQ ID NO: 7371817 - DNA, 22 bp, Homo sapiens
cagagacatccattttatatgc

SEQ ID NO: 7371818 - DNA, 22 bp, Homo sapiens
cagagacatccatgttagttgg

SEQ ID NO: 7371819 - DNA, 18 bp, Homo sapiens
cagagctcctggatgcag

SEQ ID NO: 7371820 - DNA, 22 bp, Homo sapiens
agccagctaccggggctcctgg

SEQ ID NO: 7371821 - DNA, 22 bp, Homo sapiens
cactttctcatgaatttggccc

SEQ ID NO: 7371822 - DNA, 22 bp, Homo sapiens
cactttataaaattggtgtgag

SEQ ID NO: 7371823 - DNA, 22 bp, Homo sapiens
agccagcacggcgccatggagt

SEQ ID NO: 7371824 - DNA, 22 bp, Homo sapiens
agagccctgaagcagagctaaa

SEQ ID NO: 7371825 - DNA, 22 bp, Homo sapiens
agagccctttctccaggcacct

SEQ ID NO: 7371826 - DNA, 22 bp, Homo sapiens
agagccctgccaatggatgagg

SEQ ID NO: 7371827 - DNA, 22 bp, Homo sapiens
agagcccttgccctcagtcacc

SEQ ID NO: 7371828 - DNA, 22 bp, Homo sapiens
agagccctgtggttctggtaag

SEQ ID NO: 7371829 - DNA, 22 bp, Homo sapiens
agagcctgagcctgatcttgaa

SEQ ID NO: 7371830 - DNA, 22 bp, Homo sapiens
agagctgaaaaagctgacccgg

SEQ ID NO: 7371831 - DNA, 20 bp, Homo sapiens
agagcagcagttggtgaggt

SEQ ID NO: 7371832 - DNA, 22 bp, Homo sapiens
agagcagatggccagggggcct

SEQ ID NO: 7371833 - DNA, 22 bp, Homo sapiens
agagcagatttcaaatattggc

SEQ ID NO: 7371834 - DNA, 22 bp, Homo sapiens
agagcagatggagctggaagag

SEQ ID NO: 7371835 - DNA, 22 bp, Homo sapiens
agagcagatggagctggaagag

SEQ ID NO: 7371836 - DNA, 22 bp, Homo sapiens
agagcagatggccagggggcct

SEQ ID NO: 7371837 - DNA, 22 bp, Homo sapiens
agagcccctggtggagtgagaa

SEQ ID NO: 7371838 - DNA, 22 bp, Homo sapiens
agagcaccccgggaagagcaag

SEQ ID NO: 7371839 - DNA, 22 bp, Homo sapiens
agagcagacatccttgtcttgt

SEQ ID NO: 7371840 - DNA, 22 bp, Homo sapiens
agagcagaggcatggccgtggg

SEQ ID NO: 7371841 - DNA, 22 bp, Homo sapiens
agagcagagtggctgtagcttg

SEQ ID NO: 7371842 - DNA, 22 bp, Homo sapiens
agagcagagggctctgggacaa

SEQ ID NO: 7371843 - DNA, 22 bp, Homo sapiens
agagcagagtggctgtagcttg

SEQ ID NO: 7371844 - DNA, 22 bp, Homo sapiens
agagcagagtggctgtagcttg

SEQ ID NO: 7371845 - DNA, 22 bp, Homo sapiens
agagcagagggctctgggacaa

SEQ ID NO: 7371846 - DNA, 22 bp, Homo sapiens
agagattgctagctggctttaa

SEQ ID NO: 7371847 - DNA, 22 bp, Homo sapiens
agagagttgaggaagcaacact

SEQ ID NO: 7371848 - DNA, 22 bp, Homo sapiens
agacttctaaatagcagcttct

SEQ ID NO: 7371849 - DNA, 23 bp, Homo sapiens
agacttctccaacaagcttggct

SEQ ID NO: 7371850 - DNA, 22 bp, Homo sapiens
agagaagggtagcccattctcc

SEQ ID NO: 7371851 - DNA, 19 bp, Homo sapiens
agacttttgtaagttgaga

SEQ ID NO: 7371852 - DNA, 22 bp, Homo sapiens
agagaagtgtcatttcagtttt

SEQ ID NO: 7371853 - DNA, 22 bp, Homo sapiens
agagaatacaaagaagatatgt

SEQ ID NO: 7371854 - DNA, 22 bp, Homo sapiens
agagaaggtcactaaggaccca

SEQ ID NO: 7371855 - DNA, 22 bp, Homo sapiens
agagaaggtcactaaggaccca

SEQ ID NO: 7371856 - DNA, 22 bp, Homo sapiens
agagaaggtcactaaggaccca

SEQ ID NO: 7371857 - DNA, 22 bp, Homo sapiens
agagagggaatatttggggtat

SEQ ID NO: 7371858 - DNA, 19 bp, Homo sapiens
agagaggctgtgtgaggga

SEQ ID NO: 7371859 - DNA, 22 bp, Homo sapiens
agagaggctgggcgtagggctt

SEQ ID NO: 7371860 - DNA, 22 bp, Homo sapiens
agagaggctgctggactatatg

SEQ ID NO: 7371861 - DNA, 22 bp, Homo sapiens
agagaattacagaagaatgtca

SEQ ID NO: 7371862 - DNA, 22 bp, Homo sapiens
agagacaatgccaatgcacacg

SEQ ID NO: 7371863 - DNA, 22 bp, Homo sapiens
agagacaatgccaatgcacacg

SEQ ID NO: 7371864 - DNA, 22 bp, Homo sapiens
agagacaaacactgcaacttct

SEQ ID NO: 7371865 - DNA, 22 bp, Homo sapiens
agagacaagaaatacctgggac

SEQ ID NO: 7371866 - DNA, 22 bp, Homo sapiens
atgcctttaagagatactgagg

SEQ ID NO: 7371867 - DNA, 22 bp, Homo sapiens
atgcctggtatgaagcaaggaa

SEQ ID NO: 7371868 - DNA, 22 bp, Homo sapiens
atgcctgtaaaacagcacccag

SEQ ID NO: 7371869 - DNA, 22 bp, Homo sapiens
atgcctgtaatcccagcacttt

SEQ ID NO: 7371870 - DNA, 22 bp, Homo sapiens
agacgcagatttatttcagttt

SEQ ID NO: 7371871 - DNA, 22 bp, Homo sapiens
agactctgattccctcatgtca

SEQ ID NO: 7371872 - DNA, 22 bp, Homo sapiens
agactgtaattgacatgtcagc

SEQ ID NO: 7371873 - DNA, 22 bp, Homo sapiens
atgcctttttatcatggatgat

SEQ ID NO: 7371874 - DNA, 22 bp, Homo sapiens
atgccttttcgggtacttctct

SEQ ID NO: 7371875 - DNA, 22 bp, Homo sapiens
atgccttttccatctcaggcag

SEQ ID NO: 7371876 - DNA, 22 bp, Homo sapiens
atgcctttgttgaccactataa

SEQ ID NO: 7371877 - DNA, 22 bp, Homo sapiens
atgcctttggcattatttcttg

SEQ ID NO: 7371878 - DNA, 22 bp, Homo sapiens
atgcctttggagaatccaacat

SEQ ID NO: 7371879 - DNA, 22 bp, Homo sapiens
atgcctttctctgtagaaagaa

SEQ ID NO: 7371880 - DNA, 22 bp, Homo sapiens
atgcctttatcaggaggtaaat

SEQ ID NO: 7371881 - DNA, 22 bp, Homo sapiens
atgcctttcccaacagggtggg

SEQ ID NO: 7371882 - DNA, 22 bp, Homo sapiens
atgcctttctggtgttcttcct

SEQ ID NO: 7371883 - DNA, 22 bp, Homo sapiens
atgcctttcttagccctgaagg

SEQ ID NO: 7371884 - DNA, 22 bp, Homo sapiens
atgcctttgccacagattagga

SEQ ID NO: 7371885 - DNA, 20 bp, Homo sapiens
atgcctttgatagtcaggct

SEQ ID NO: 7371886 - DNA, 22 bp, Homo sapiens
atgcctttctttggtgcaggtt

SEQ ID NO: 7371887 - DNA, 22 bp, Homo sapiens
agacctggaagttcaagagaaa

SEQ ID NO: 7371888 - DNA, 22 bp, Homo sapiens
agacccaggcttcatgtgaatc

SEQ ID NO: 7371889 - DNA, 22 bp, Homo sapiens
agaccccatacctcagcaggta

SEQ ID NO: 7371890 - DNA, 22 bp, Homo sapiens
agacctggagtgaagagttccc

SEQ ID NO: 7371891 - DNA, 22 bp, Homo sapiens
atgcatttttgagtatgaatga

SEQ ID NO: 7371892 - DNA, 22 bp, Homo sapiens
atgatactctaggtgatttaca

SEQ ID NO: 7371893 - DNA, 22 bp, Homo sapiens
atgatatacttcctagaacagt

SEQ ID NO: 7371894 - DNA, 22 bp, Homo sapiens
atgatatagagagtagattaaa

SEQ ID NO: 7371895 - DNA, 22 bp, Homo sapiens
atgatacatcttgtttatttca

SEQ ID NO: 7371896 - DNA, 22 bp, Homo sapiens
agacactgttctcacatgcttg

SEQ ID NO: 7371897 - DNA, 22 bp, Homo sapiens
agacaaatttgttttcctgtct

SEQ ID NO: 7371898 - DNA, 22 bp, Homo sapiens
agacaactgcagagcaaagaat

SEQ ID NO: 7371899 - DNA, 22 bp, Homo sapiens
agacaaggcccccttgggctct

SEQ ID NO: 7371900 - DNA, 22 bp, Homo sapiens
atgaggcacgtgttactggcct

SEQ ID NO: 7371901 - DNA, 22 bp, Homo sapiens
atgaggccagggtgccatgaaa

SEQ ID NO: 7371902 - DNA, 22 bp, Homo sapiens
agaatcaaagagaaatactttg

SEQ ID NO: 7371903 - DNA, 22 bp, Homo sapiens
atgagggaggcaaggagatgct

SEQ ID NO: 7371904 - DNA, 22 bp, Homo sapiens
atgagggaggggtggtgccgca

SEQ ID NO: 7371905 - DNA, 22 bp, Homo sapiens
atgaggcttaaactgctgcaac

SEQ ID NO: 7371906 - DNA, 22 bp, Homo sapiens
atgaggctatgaatggggagat

SEQ ID NO: 7371907 - DNA, 22 bp, Homo sapiens
atgaggccatggctgtcactaa

SEQ ID NO: 7371908 - DNA, 22 bp, Homo sapiens
atctgcttcgcgccaatttcat

SEQ ID NO: 7371909 - DNA, 22 bp, Homo sapiens
atctgcttgaaacttcttatac

SEQ ID NO: 7371910 - DNA, 18 bp, Homo sapiens
atgaacactgagctgaat

SEQ ID NO: 7371911 - DNA, 22 bp, Homo sapiens
atgaagcattacaggatgacag

SEQ ID NO: 7371912 - DNA, 19 bp, Homo sapiens
atgaagcattgtttttgta

SEQ ID NO: 7371913 - DNA, 22 bp, Homo sapiens
atctgcctcttcttcattgcga

SEQ ID NO: 7371914 - DNA, 22 bp, Homo sapiens
atctgcctgcagtggaggtggg

SEQ ID NO: 7371915 - DNA, 22 bp, Homo sapiens
agaatatagttaccaaattctg

SEQ ID NO: 7371916 - DNA, 22 bp, Homo sapiens
agaatatcgtagcatattatct

SEQ ID NO: 7371917 - DNA, 22 bp, Homo sapiens
agaatattcatctgtattctta

SEQ ID NO: 7371918 - DNA, 22 bp, Homo sapiens
agagtgcagaggtcaaagaaca

SEQ ID NO: 7371919 - DNA, 22 bp, Homo sapiens
agagtgcatgacatgatcttgg

SEQ ID NO: 7371920 - DNA, 22 bp, Homo sapiens
agagtgcatgttttatctttgt

SEQ ID NO: 7371921 - DNA, 22 bp, Homo sapiens
agagtgcaaccgaaacaagcag

SEQ ID NO: 7371922 - DNA, 23 bp, Homo sapiens
agagtgcagagatatgcttgtgt

SEQ ID NO: 7371923 - DNA, 22 bp, Homo sapiens
agagtgcagaggtcaaagaaca

SEQ ID NO: 7371924 - DNA, 22 bp, Homo sapiens
agagtcaacatcgagccactgg

SEQ ID NO: 7371925 - DNA, 22 bp, Homo sapiens
agagtcaagtagggcatgggct

SEQ ID NO: 7371926 - DNA, 22 bp, Homo sapiens
agagtactgctgctgggtactg

SEQ ID NO: 7371927 - DNA, 22 bp, Homo sapiens
agagtcagtaacatatatggta

SEQ ID NO: 7371928 - DNA, 22 bp, Homo sapiens
agagtcagtcactggcactttg

SEQ ID NO: 7371929 - DNA, 16 bp, Homo sapiens
agaggctgtaatggaa

SEQ ID NO: 7371930 - DNA, 22 bp, Homo sapiens
agaggctgtcccttgctattcc

SEQ ID NO: 7371931 - DNA, 19 bp, Homo sapiens
agaggctgtcacctgtagc

SEQ ID NO: 7371932 - DNA, 22 bp, Homo sapiens
agagggcagtctcagattggga

SEQ ID NO: 7371933 - DNA, 22 bp, Homo sapiens
agagggcagtctcagattggga

SEQ ID NO: 7371934 - DNA, 22 bp, Homo sapiens
agagggcagggcggtaagtcct

SEQ ID NO: 7371935 - DNA, 22 bp, Homo sapiens
agaggggaggcgaaccagagtc

SEQ ID NO: 7371936 - DNA, 22 bp, Homo sapiens
agaggggagagctaagcaattc

SEQ ID NO: 7371937 - DNA, 23 bp, Homo sapiens
agaggcacagcacttggctggcc

SEQ ID NO: 7371938 - DNA, 22 bp, Homo sapiens
agaggcaatgaaagcagtctct

SEQ ID NO: 7371939 - DNA, 22 bp, Homo sapiens
agaggcaatgaaagcagtctct

SEQ ID NO: 7371940 - DNA, 22 bp, Homo sapiens
agaggcacaaactggaaaggac

SEQ ID NO: 7371941 - DNA, 22 bp, Homo sapiens
agaggcacaacagtcccattgt

SEQ ID NO: 7371942 - DNA, 22 bp, Homo sapiens
agaggcaagattatcagggcat

SEQ ID NO: 7371943 - DNA, 22 bp, Homo sapiens
agaggcaaggcaggattcttct

SEQ ID NO: 7371944 - DNA, 22 bp, Homo sapiens
agaggcaagggacctttctggg

SEQ ID NO: 7371945 - DNA, 22 bp, Homo sapiens
agaggcaagggacctttctggg

SEQ ID NO: 7371946 - DNA, 22 bp, Homo sapiens
agaggcaagttcagagctagga

SEQ ID NO: 7371947 - DNA, 19 bp, Homo sapiens
agaggcaagggctcatgac

SEQ ID NO: 7371948 - DNA, 19 bp, Homo sapiens
agaggcaagggtggaagta

SEQ ID NO: 7371949 - DNA, 22 bp, Homo sapiens
attacactagctattcttatgg

SEQ ID NO: 7371950 - DNA, 22 bp, Homo sapiens
attacacatagacattcgttca

SEQ ID NO: 7371951 - DNA, 22 bp, Homo sapiens
attacacaggctggctctttga

SEQ ID NO: 7371952 - DNA, 22 bp, Homo sapiens
agaggcaccatctggaacagcc

SEQ ID NO: 7371953 - DNA, 22 bp, Homo sapiens
agaggcactaagggaagagcag

SEQ ID NO: 7371954 - DNA, 22 bp, Homo sapiens
agaggcacggaggctgcatgga

SEQ ID NO: 7371955 - DNA, 23 bp, Homo sapiens
agaggctgcagggtattgagaat

SEQ ID NO: 7371956 - DNA, 18 bp, Homo sapiens
agaggctggacaggggat

SEQ ID NO: 7371957 - DNA, 22 bp, Homo sapiens
agaggccagcagtgcctatctg

SEQ ID NO: 7371958 - DNA, 22 bp, Homo sapiens
agaggccagcccaggccaccga

SEQ ID NO: 7371959 - DNA, 23 bp, Homo sapiens
agaggcaggagtggcttgcccgg

SEQ ID NO: 7371960 - DNA, 22 bp, Homo sapiens
agaggccaccttctcttgagaa

SEQ ID NO: 7371961 - DNA, 22 bp, Homo sapiens
agaggccaccttctcttgagaa

SEQ ID NO: 7371962 - DNA, 22 bp, Homo sapiens
agaggccactttgcctgtgatg

SEQ ID NO: 7371963 - DNA, 22 bp, Homo sapiens
agcaagagcatgtcggcctggt

SEQ ID NO: 7371964 - DNA, 22 bp, Homo sapiens
agcaagagatttccctacctcc

SEQ ID NO: 7371965 - DNA, 22 bp, Homo sapiens
agcaacagggtggtcttcagaa

SEQ ID NO: 7371966 - DNA, 22 bp, Homo sapiens
agcaacaggcataatgtgttga

SEQ ID NO: 7371967 - DNA, 22 bp, Homo sapiens
caaaggcaggtcatggccactt

SEQ ID NO: 7371968 - DNA, 22 bp, Homo sapiens
caaaggcaggccccctgtgcag

SEQ ID NO: 7371969 - DNA, 22 bp, Homo sapiens
caaaggcaggtgctgaatattc

SEQ ID NO: 7371970 - DNA, 22 bp, Homo sapiens
caaaggcaggtgctgaatattc

SEQ ID NO: 7371971 - DNA, 22 bp, Homo sapiens
caaagcaagggctgaagactcc

SEQ ID NO: 7371972 - DNA, 22 bp, Homo sapiens
caaagcaccacaaaccaggtga

SEQ ID NO: 7371973 - DNA, 22 bp, Homo sapiens
caaagcaaggctcagtttgaac

SEQ ID NO: 7371974 - DNA, 22 bp, Homo sapiens
caaagcaaggctcagtttgaac

SEQ ID NO: 7371975 - DNA, 22 bp, Homo sapiens
caaagcaagggctgaagactcc

SEQ ID NO: 7371976 - DNA, 20 bp, Homo sapiens
agcaagagtgtacctggcca

SEQ ID NO: 7371977 - DNA, 22 bp, Homo sapiens
caaacattttgagtggtttctg

SEQ ID NO: 7371978 - DNA, 20 bp, Homo sapiens
agcaagagtaaggacagcga

SEQ ID NO: 7371979 - DNA, 22 bp, Homo sapiens
caaagatatgacatggaaaatg

SEQ ID NO: 7371980 - DNA, 22 bp, Homo sapiens
attttatccccactggattaca

SEQ ID NO: 7371981 - DNA, 22 bp, Homo sapiens
attttatgacacgattcttcca

SEQ ID NO: 7371982 - DNA, 22 bp, Homo sapiens
attttatgacacgattcttcca

SEQ ID NO: 7371983 - DNA, 22 bp, Homo sapiens
attttcaccctgaatatattga

SEQ ID NO: 7371984 - DNA, 22 bp, Homo sapiens
agcaaagctatctctatggaga

SEQ ID NO: 7371985 - DNA, 22 bp, Homo sapiens
agcaaatgggtttatatttgac

SEQ ID NO: 7371986 - DNA, 22 bp, Homo sapiens
agcaaatgggtttatatttgac

SEQ ID NO: 7371987 - DNA, 19 bp, Homo sapiens
agcaacaccgtttatttcc

SEQ ID NO: 7371988 - DNA, 22 bp, Homo sapiens
agcaacagccctgtttcattag

SEQ ID NO: 7371989 - DNA, 22 bp, Homo sapiens
agcaacagcaacgacatttctc

SEQ ID NO: 7371990 - DNA, 22 bp, Homo sapiens
agatattaggaggattcataat

SEQ ID NO: 7371991 - DNA, 22 bp, Homo sapiens
agatcaagcactgtgcaaaaat

SEQ ID NO: 7371992 - DNA, 22 bp, Homo sapiens
agatataataatttacaagtgt

SEQ ID NO: 7371993 - DNA, 22 bp, Homo sapiens
attggtcccctcctatgtgcca

SEQ ID NO: 7371994 - DNA, 22 bp, Homo sapiens
attggtcaggactggcatgtgg

SEQ ID NO: 7371995 - DNA, 22 bp, Homo sapiens
attggtagttttgtatttctct

SEQ ID NO: 7371996 - DNA, 22 bp, Homo sapiens
attgggcggtgtccagaggctc

SEQ ID NO: 7371997 - DNA, 22 bp, Homo sapiens
attggcatagtaggacagatca

SEQ ID NO: 7371998 - DNA, 22 bp, Homo sapiens
agatggagaccttggatgaact

SEQ ID NO: 7371999 - DNA, 22 bp, Homo sapiens
agatgctttcctgatatttatg

SEQ ID NO: 7372000 - DNA, 22 bp, Homo sapiens
agatgattatgatagcactgtt

SEQ ID NO: 7372001 - DNA, 21 bp, Homo sapiens
agatcattcttctgagcactt

SEQ ID NO: 7372002 - DNA, 22 bp, Homo sapiens
agatggagttgtagcagtgact

SEQ ID NO: 7372003 - DNA, 19 bp, Homo sapiens
agatggcaaaatgcaaaga

SEQ ID NO: 7372004 - DNA, 17 bp, Homo sapiens
agatggcaggaggcaga

SEQ ID NO: 7372005 - DNA, 22 bp, Homo sapiens
agatggaggaaggctgaactca

SEQ ID NO: 7372006 - DNA, 22 bp, Homo sapiens
agatggagtctcactcttgttg

SEQ ID NO: 7372007 - DNA, 22 bp, Homo sapiens
agatggagtggagatgagtaaa

SEQ ID NO: 7372008 - DNA, 22 bp, Homo sapiens
agatggagttagtaccagagtc

SEQ ID NO: 7372009 - DNA, 22 bp, Homo sapiens
agatggcaggccctgtgggggt

SEQ ID NO: 7372010 - DNA, 22 bp, Homo sapiens
aggctccagcagccagaggaag

SEQ ID NO: 7372011 - DNA, 22 bp, Homo sapiens
acattgaagctgtgaaatcaaa

SEQ ID NO: 7372012 - DNA, 18 bp, Homo sapiens
aggcttcccaggcaggcc

SEQ ID NO: 7372013 - DNA, 22 bp, Homo sapiens
acattcttggactccactctag

SEQ ID NO: 7372014 - DNA, 22 bp, Homo sapiens
acattctatgaagataatttta

SEQ ID NO: 7372015 - DNA, 22 bp, Homo sapiens
acattctagatatgttatattt

SEQ ID NO: 7372016 - DNA, 22 bp, Homo sapiens
acattctagaagtctttgcaat

SEQ ID NO: 7372017 - DNA, 22 bp, Homo sapiens
acattctaaagcatgctcagga

SEQ ID NO: 7372018 - DNA, 22 bp, Homo sapiens
acattctaacattgtacagata

SEQ ID NO: 7372019 - DNA, 22 bp, Homo sapiens
acattctacagttaaccattag

SEQ ID NO: 7372020 - DNA, 22 bp, Homo sapiens
acattcattccaggtcagtcag

SEQ ID NO: 7372021 - DNA, 22 bp, Homo sapiens
acattcattgagcaacaacaat

SEQ ID NO: 7372022 - DNA, 22 bp, Homo sapiens
acattcaaggccttctgacaca

SEQ ID NO: 7372023 - DNA, 22 bp, Homo sapiens
acattcacgctctcaaagctga

SEQ ID NO: 7372024 - DNA, 20 bp, Homo sapiens
aggccctgccagggacggag

SEQ ID NO: 7372025 - DNA, 22 bp, Homo sapiens
aggccctgcattgtactgaggg

SEQ ID NO: 7372026 - DNA, 22 bp, Homo sapiens
aggccctgcaggagtggggaca

SEQ ID NO: 7372027 - DNA, 22 bp, Homo sapiens
aggccctgcaggaagcaggatg

SEQ ID NO: 7372028 - DNA, 22 bp, Homo sapiens
aggccctgcaggaagcaggatg

SEQ ID NO: 7372029 - DNA, 22 bp, Homo sapiens
aggccacaggagtactgtcggt

SEQ ID NO: 7372030 - DNA, 22 bp, Homo sapiens
aggccacagcctgggaggtgac

SEQ ID NO: 7372031 - DNA, 22 bp, Homo sapiens
aggccacagcctgggaggtgac

SEQ ID NO: 7372032 - DNA, 22 bp, Homo sapiens
aggccacaggattgcacagcat

SEQ ID NO: 7372033 - DNA, 22 bp, Homo sapiens
aggccacaggcaccctgtgttc

SEQ ID NO: 7372034 - DNA, 22 bp, Homo sapiens
aggccacagtactttgcagacc

SEQ ID NO: 7372035 - DNA, 22 bp, Homo sapiens
aggccacagagagtgcatgtgc

SEQ ID NO: 7372036 - DNA, 22 bp, Homo sapiens
aggccacagagagtgcatgtgc

SEQ ID NO: 7372037 - DNA, 20 bp, Homo sapiens
aggcatgggatgcccagatt

SEQ ID NO: 7372038 - DNA, 22 bp, Homo sapiens
acatacatgggattaaaaaatt

SEQ ID NO: 7372039 - DNA, 22 bp, Homo sapiens
acatacatgggattaaaaaatt

SEQ ID NO: 7372040 - DNA, 22 bp, Homo sapiens
aggcccagggctgctctctgaa

SEQ ID NO: 7372041 - DNA, 23 bp, Homo sapiens
aggcccaggtatgtttgttttgg

SEQ ID NO: 7372042 - DNA, 22 bp, Homo sapiens
aggcccagggctgctctctgaa

SEQ ID NO: 7372043 - DNA, 21 bp, Homo sapiens
aggcccagctttcctcttgct

SEQ ID NO: 7372044 - DNA, 21 bp, Homo sapiens
aggcccaggaatatgcatttt

SEQ ID NO: 7372045 - DNA, 22 bp, Homo sapiens
aggcccagtagtcgacggcgct

SEQ ID NO: 7372046 - DNA, 22 bp, Homo sapiens
aggccctgagaaaatccctgca

SEQ ID NO: 7372047 - DNA, 22 bp, Homo sapiens
aggccctgatccgaatccagat

SEQ ID NO: 7372048 - DNA, 22 bp, Homo sapiens
aggccctgagcatccgagggca

SEQ ID NO: 7372049 - DNA, 22 bp, Homo sapiens
aggccctgagcatccgagggca

SEQ ID NO: 7372050 - DNA, 20 bp, Homo sapiens
acatgaaaggaaacaggaaa

SEQ ID NO: 7372051 - DNA, 22 bp, Homo sapiens
aggccaggtggtcatgcttgct

SEQ ID NO: 7372052 - DNA, 22 bp, Homo sapiens
aggcccagcttgaagtgggaag

SEQ ID NO: 7372053 - DNA, 21 bp, Homo sapiens
aggcccagctttcctcttgct

SEQ ID NO: 7372054 - DNA, 22 bp, Homo sapiens
aggcccagctgggccaggaaca

SEQ ID NO: 7372055 - DNA, 22 bp, Homo sapiens
aggccagccctcacctgtgttc

SEQ ID NO: 7372056 - DNA, 18 bp, Homo sapiens
aggccagccctgctactg

SEQ ID NO: 7372057 - DNA, 22 bp, Homo sapiens
acatcttttactctggttcggg

SEQ ID NO: 7372058 - DNA, 22 bp, Homo sapiens
acatctttgtttcttagtgtat

SEQ ID NO: 7372059 - DNA, 22 bp, Homo sapiens
acatcttttttctctaattgtg

SEQ ID NO: 7372060 - DNA, 22 bp, Homo sapiens
accacaggaattgctctgtggt

SEQ ID NO: 7372061 - DNA, 22 bp, Homo sapiens
accacactggctagtgaagaag

SEQ ID NO: 7372062 - DNA, 22 bp, Homo sapiens
accaaaggctcctgaagaactg

SEQ ID NO: 7372063 - DNA, 23 bp, Homo sapiens
aggcttcctatcttagagctggg

SEQ ID NO: 7372064 - DNA, 19 bp, Homo sapiens
accaaaggagtggggtata

SEQ ID NO: 7372065 - DNA, 22 bp, Homo sapiens
accaaaggctatgggacctgcc

SEQ ID NO: 7372066 - DNA, 22 bp, Homo sapiens
accaggaagaacaggcaaggca

SEQ ID NO: 7372067 - DNA, 22 bp, Homo sapiens
accaggactaataaaaatgttc

SEQ ID NO: 7372068 - DNA, 22 bp, Homo sapiens
accaggaggcctggagcacaaa

SEQ ID NO: 7372069 - DNA, 22 bp, Homo sapiens
accaggagccatagagtcaggc

SEQ ID NO: 7372070 - DNA, 22 bp, Homo sapiens
accaggagccacaggaggagcc

SEQ ID NO: 7372071 - DNA, 20 bp, Homo sapiens
accaggagatggaggcaggg

SEQ ID NO: 7372072 - DNA, 20 bp, Homo sapiens
accaggtggctgatgacacc

SEQ ID NO: 7372073 - DNA, 22 bp, Homo sapiens
agggcctcctaatttcctcata

SEQ ID NO: 7372074 - DNA, 23 bp, Homo sapiens
agggcccaagcctggacagcagg

SEQ ID NO: 7372075 - DNA, 22 bp, Homo sapiens
accatacacaatttgcaacggt

SEQ ID NO: 7372076 - DNA, 22 bp, Homo sapiens
accagggttgagtcagctgcgt

SEQ ID NO: 7372077 - DNA, 22 bp, Homo sapiens
accaggagggaccctggtggcc

SEQ ID NO: 7372078 - DNA, 22 bp, Homo sapiens
accctggctctctggccaccgc

SEQ ID NO: 7372079 - DNA, 22 bp, Homo sapiens
accctggagcttttctggccct

SEQ ID NO: 7372080 - DNA, 22 bp, Homo sapiens
accctggaggtctacagtgcag

SEQ ID NO: 7372081 - DNA, 22 bp, Homo sapiens
accctggagcttttctggccct

SEQ ID NO: 7372082 - DNA, 22 bp, Homo sapiens
accctggaggtctacagtgcag

SEQ ID NO: 7372083 - DNA, 22 bp, Homo sapiens
accctggaggtggaggtgcagt

SEQ ID NO: 7372084 - DNA, 22 bp, Homo sapiens
accctggaggtggaggtgcagt

SEQ ID NO: 7372085 - DNA, 22 bp, Homo sapiens
accctggattgggaaccagaag

SEQ ID NO: 7372086 - DNA, 22 bp, Homo sapiens
accctcttgagggaagcacttt

SEQ ID NO: 7372087 - DNA, 22 bp, Homo sapiens
accctggactggggctgaggct

SEQ ID NO: 7372088 - DNA, 22 bp, Homo sapiens
accctggagcaataatccctgg

SEQ ID NO: 7372089 - DNA, 22 bp, Homo sapiens
accctggacatcttgtcatagc

SEQ ID NO: 7372090 - DNA, 22 bp, Homo sapiens
accctggacatcttgtcatagc

SEQ ID NO: 7372091 - DNA, 22 bp, Homo sapiens
accccacagcatacaaaggcac

SEQ ID NO: 7372092 - DNA, 20 bp, Homo sapiens
accccacagagtccattgca

SEQ ID NO: 7372093 - DNA, 19 bp, Homo sapiens
agggcctgagcagatgttg

SEQ ID NO: 7372094 - DNA, 23 bp, Homo sapiens
agggcctctgtcccccagcactc

SEQ ID NO: 7372095 - DNA, 21 bp, Homo sapiens
agggcctctcatttgtgccag

SEQ ID NO: 7372096 - DNA, 22 bp, Homo sapiens
agggcctctctgggcctttcct

SEQ ID NO: 7372097 - DNA, 22 bp, Homo sapiens
agggcctctgagccagttctgg

SEQ ID NO: 7372098 - DNA, 22 bp, Homo sapiens
acccacagccgctgtgcgtccc

SEQ ID NO: 7372099 - DNA, 22 bp, Homo sapiens
acccagggaccccgctgacgcc

SEQ ID NO: 7372100 - DNA, 22 bp, Homo sapiens
acccagggtagagtgcagtggc

SEQ ID NO: 7372101 - DNA, 22 bp, Homo sapiens
acccagggtcaccccgtagggt

SEQ ID NO: 7372102 - DNA, 22 bp, Homo sapiens
acccagggttcctgggtcccag

SEQ ID NO: 7372103 - DNA, 22 bp, Homo sapiens
acccagggtcaccccgtagggt

SEQ ID NO: 7372104 - DNA, 19 bp, Homo sapiens
acccagggttgatgtccag

SEQ ID NO: 7372105 - DNA, 22 bp, Homo sapiens
acccagggtttgagctctgcag

SEQ ID NO: 7372106 - DNA, 22 bp, Homo sapiens
acccaggtggctctgacggggg

SEQ ID NO: 7372107 - DNA, 22 bp, Homo sapiens
aggagctgatgattctttgatc

SEQ ID NO: 7372108 - DNA, 22 bp, Homo sapiens
aggagctggaatggtccttttg

SEQ ID NO: 7372109 - DNA, 22 bp, Homo sapiens
acagggtgactttgtgacagat

SEQ ID NO: 7372110 - DNA, 22 bp, Homo sapiens
acagggtgaatgtgacattatc

SEQ ID NO: 7372111 - DNA, 22 bp, Homo sapiens
aggagcagaccgtagtcctgca

SEQ ID NO: 7372112 - DNA, 20 bp, Homo sapiens
aggagccattgactgcagca

SEQ ID NO: 7372113 - DNA, 22 bp, Homo sapiens
aggagccattttccaagggcga

SEQ ID NO: 7372114 - DNA, 23 bp, Homo sapiens
aggaagctaccaattttgtaggc

SEQ ID NO: 7372115 - DNA, 22 bp, Homo sapiens
aggaagctagaaggtcttcttt

SEQ ID NO: 7372116 - DNA, 22 bp, Homo sapiens
aggaagctaaccagggagtgag

SEQ ID NO: 7372117 - DNA, 22 bp, Homo sapiens
aggagacatactataggaatat

SEQ ID NO: 7372118 - DNA, 22 bp, Homo sapiens
aggagacataactatgatgaga

SEQ ID NO: 7372119 - DNA, 22 bp, Homo sapiens
aggaggccgctgatgggctccc

SEQ ID NO: 7372120 - DNA, 17 bp, Homo sapiens
aggagggaaatagcttg

SEQ ID NO: 7372121 - DNA, 22 bp, Homo sapiens
aggagggaataagaaagagtca

SEQ ID NO: 7372122 - DNA, 22 bp, Homo sapiens
aggagggacaccaatatatgtt

SEQ ID NO: 7372123 - DNA, 22 bp, Homo sapiens
aggagggaataagaaagagtca

SEQ ID NO: 7372124 - DNA, 22 bp, Homo sapiens
aggagggagcactatatgggga

SEQ ID NO: 7372125 - DNA, 22 bp, Homo sapiens
aggagggacctaggaatattgc

SEQ ID NO: 7372126 - DNA, 20 bp, Homo sapiens
aggagggacctggattggcg

SEQ ID NO: 7372127 - DNA, 20 bp, Homo sapiens
aggagggacctggattggcg

SEQ ID NO: 7372128 - DNA, 22 bp, Homo sapiens
aggagggagatgcccatcctgg

SEQ ID NO: 7372129 - DNA, 22 bp, Homo sapiens
aggcaaagaagttggtcaggag

SEQ ID NO: 7372130 - DNA, 22 bp, Homo sapiens
aggcaaaagaatgtcataaatg

SEQ ID NO: 7372131 - DNA, 21 bp, Homo sapiens
aggattttgttgaagtttctg

SEQ ID NO: 7372132 - DNA, 22 bp, Homo sapiens
aggcaaagaggatattttgggg

SEQ ID NO: 7372133 - DNA, 22 bp, Homo sapiens
aggcaaagcgataccagagcta

SEQ ID NO: 7372134 - DNA, 22 bp, Homo sapiens
aggcaaagagccagcaaatctg

SEQ ID NO: 7372135 - DNA, 22 bp, Homo sapiens
aggcacagatttggggaaagca

SEQ ID NO: 7372136 - DNA, 19 bp, Homo sapiens
aggcacaattctgagaagc

SEQ ID NO: 7372137 - DNA, 22 bp, Homo sapiens
aggcacagaatggcattcagtg

SEQ ID NO: 7372138 - DNA, 22 bp, Homo sapiens
aggcacaaagacagaaaagcac

SEQ ID NO: 7372139 - DNA, 22 bp, Homo sapiens
aggcaacatgggccaggcagaa

SEQ ID NO: 7372140 - DNA, 22 bp, Homo sapiens
aggcaacaggaaaccacatgat

SEQ ID NO: 7372141 - DNA, 22 bp, Homo sapiens
aggcaacataacacgaaagtct

SEQ ID NO: 7372142 - DNA, 22 bp, Homo sapiens
acatacatcaagtatcacaaga

SEQ ID NO: 7372143 - DNA, 22 bp, Homo sapiens
acataaatttcactgttccgtg

SEQ ID NO: 7372144 - DNA, 22 bp, Homo sapiens
agctggctatgccctgtgaacc

SEQ ID NO: 7372145 - DNA, 21 bp, Homo sapiens
agctggctatagttagtgatg

SEQ ID NO: 7372146 - DNA, 22 bp, Homo sapiens
agctggctcagccgggtggtct

SEQ ID NO: 7372147 - DNA, 21 bp, Homo sapiens
agctggctctctctggagaga

SEQ ID NO: 7372148 - DNA, 22 bp, Homo sapiens
agctggctatacttgaaaagtc

SEQ ID NO: 7372149 - DNA, 22 bp, Homo sapiens
acagcctgcagccccaggtcgc

SEQ ID NO: 7372150 - DNA, 22 bp, Homo sapiens
acagcctgatttatggagcagt

SEQ ID NO: 7372151 - DNA, 22 bp, Homo sapiens
agctgctggggagggcagacac

SEQ ID NO: 7372152 - DNA, 22 bp, Homo sapiens
agctgctgtgtgctcaggcagg

SEQ ID NO: 7372153 - DNA, 22 bp, Homo sapiens
agctgcttcaaaatgggctcct

SEQ ID NO: 7372154 - DNA, 22 bp, Homo sapiens
agctgcttcctctttgatgtca

SEQ ID NO: 7372155 - DNA, 22 bp, Homo sapiens
agctgcttataagatttgggag

SEQ ID NO: 7372156 - DNA, 22 bp, Homo sapiens
agctgcttattcattgatcgat

SEQ ID NO: 7372157 - DNA, 22 bp, Homo sapiens
acagcccagaaagcctaagggg

SEQ ID NO: 7372158 - DNA, 22 bp, Homo sapiens
agctccaggtgcaagtcatggt

SEQ ID NO: 7372159 - DNA, 20 bp, Homo sapiens
agctccagtgctgacgcttc

SEQ ID NO: 7372160 - DNA, 22 bp, Homo sapiens
acagcccaagtcacctgcagga

SEQ ID NO: 7372161 - DNA, 22 bp, Homo sapiens
agctgcagccctcctgcatggc

SEQ ID NO: 7372162 - DNA, 22 bp, Homo sapiens
agctgcaggaagtagaagcgga

SEQ ID NO: 7372163 - DNA, 22 bp, Homo sapiens
agctgctcattactttctgttg

SEQ ID NO: 7372164 - DNA, 22 bp, Homo sapiens
agctgtgtaagtcatgtaggtg

SEQ ID NO: 7372165 - DNA, 22 bp, Homo sapiens
agcttcagcttgcagctgtgat

SEQ ID NO: 7372166 - DNA, 22 bp, Homo sapiens
agcttagtggttgtatgagtta

SEQ ID NO: 7372167 - DNA, 22 bp, Homo sapiens
agcttataatgtaactaaggac

SEQ ID NO: 7372168 - DNA, 22 bp, Homo sapiens
agcttatagatctctctgatat

SEQ ID NO: 7372169 - DNA, 19 bp, Homo sapiens
agcttttactaacagcaga

SEQ ID NO: 7372170 - DNA, 22 bp, Homo sapiens
aggaaaaaagtctgtgattata

SEQ ID NO: 7372171 - DNA, 22 bp, Homo sapiens
aggaaaaacctgttaatggtag

SEQ ID NO: 7372172 - DNA, 22 bp, Homo sapiens
agctttatggtgcctcacttga

SEQ ID NO: 7372173 - DNA, 22 bp, Homo sapiens
aggaagagcattcacatggtag

SEQ ID NO: 7372174 - DNA, 22 bp, Homo sapiens
aggaagagcattcacatggtag

SEQ ID NO: 7372175 - DNA, 22 bp, Homo sapiens
aggaaagaaaggaggtgcattt

SEQ ID NO: 7372176 - DNA, 22 bp, Homo sapiens
actctctgagctaccaggtgag

SEQ ID NO: 7372177 - DNA, 22 bp, Homo sapiens
actccctgtacttgcctctctt

SEQ ID NO: 7372178 - DNA, 22 bp, Homo sapiens
aggtgggcggattcatgaggtc

SEQ ID NO: 7372179 - DNA, 22 bp, Homo sapiens
agtataaagtggttttcagcac

SEQ ID NO: 7372180 - DNA, 22 bp, Homo sapiens
agtactttttgttcaattgtgc

SEQ ID NO: 7372181 - DNA, 22 bp, Homo sapiens
agtactttgcactttgctcaga

SEQ ID NO: 7372182 - DNA, 20 bp, Homo sapiens
agtaccttttgtatgttacc

SEQ ID NO: 7372183 - DNA, 22 bp, Homo sapiens
aggtcaaaagcaaggccaggtt

SEQ ID NO: 7372184 - DNA, 22 bp, Homo sapiens
aggtcaaaatcaggcagggaag

SEQ ID NO: 7372185 - DNA, 20 bp, Homo sapiens
aggtagctttgcatttttgt

SEQ ID NO: 7372186 - DNA, 22 bp, Homo sapiens
aggtagcttggtgctttcattc

SEQ ID NO: 7372187 - DNA, 19 bp, Homo sapiens
aggtagctcagactcaaag

SEQ ID NO: 7372188 - DNA, 22 bp, Homo sapiens
aggtagctggtgctgggctcct

SEQ ID NO: 7372189 - DNA, 22 bp, Homo sapiens
accctgtcttccctgggcatca

SEQ ID NO: 7372190 - DNA, 22 bp, Homo sapiens
aggtatttcatggagcaagcag

SEQ ID NO: 7372191 - DNA, 22 bp, Homo sapiens
aggtatttgttacagcagcacc

SEQ ID NO: 7372192 - DNA, 22 bp, Homo sapiens
acctttatgtttgattacaatt

SEQ ID NO: 7372193 - DNA, 22 bp, Homo sapiens
acctttctgcaagttctgggac

SEQ ID NO: 7372194 - DNA, 22 bp, Homo sapiens
acctttcacggtatcagacatc

SEQ ID NO: 7372195 - DNA, 22 bp, Homo sapiens
aggtgaatgctcacattctaat

SEQ ID NO: 7372196 - DNA, 22 bp, Homo sapiens
aggtgacaggacaggagctggt

SEQ ID NO: 7372197 - DNA, 22 bp, Homo sapiens
aggtgacaggatgcagataaac

SEQ ID NO: 7372198 - DNA, 22 bp, Homo sapiens
aggtgacattcagagaacattt

SEQ ID NO: 7372199 - DNA, 19 bp, Homo sapiens
aggtgacatgtgacagcct

SEQ ID NO: 7372200 - DNA, 22 bp, Homo sapiens
aggtgacatcccggcagcagag

SEQ ID NO: 7372201 - DNA, 22 bp, Homo sapiens
aggtgacatcccggcagcagag

SEQ ID NO: 7372202 - DNA, 22 bp, Homo sapiens
acgatgatgaaagagaacattc

SEQ ID NO: 7372203 - DNA, 22 bp, Homo sapiens
acgaataaatctatttcacaca

SEQ ID NO: 7372204 - DNA, 21 bp, Homo sapiens
aggtgggcaggtggagtggcc

SEQ ID NO: 7372205 - DNA, 22 bp, Homo sapiens
aggtgagaaaacgagggttgca

SEQ ID NO: 7372206 - DNA, 22 bp, Homo sapiens
actactagtggctacaataatg

SEQ ID NO: 7372207 - DNA, 22 bp, Homo sapiens
actgcacttcagcctgggtgac

SEQ ID NO: 7372208 - DNA, 22 bp, Homo sapiens
actgcacttcaccctgggtgac

SEQ ID NO: 7372209 - DNA, 22 bp, Homo sapiens
actgcacttcaccctgggtgac

SEQ ID NO: 7372210 - DNA, 22 bp, Homo sapiens
actgcagcaggtaagagcattt

SEQ ID NO: 7372211 - DNA, 22 bp, Homo sapiens
actgcattctttatcccacaac

SEQ ID NO: 7372212 - DNA, 22 bp, Homo sapiens
agtgaagctggagaaaggcagt

SEQ ID NO: 7372213 - DNA, 22 bp, Homo sapiens
agtgaagcggcagatattagaa

SEQ ID NO: 7372214 - DNA, 22 bp, Homo sapiens
actgcactcctgcctgggtaac

SEQ ID NO: 7372215 - DNA, 22 bp, Homo sapiens
actgcactcctgcctgggtaac

SEQ ID NO: 7372216 - DNA, 22 bp, Homo sapiens
actgcactcctgcctgggtaac

SEQ ID NO: 7372217 - DNA, 22 bp, Homo sapiens
actgcacttacatagaggaggc

SEQ ID NO: 7372218 - DNA, 22 bp, Homo sapiens
actgcactccagcctgggtgat

SEQ ID NO: 7372219 - DNA, 22 bp, Homo sapiens
actgcactccagcctgggtgat

SEQ ID NO: 7372220 - DNA, 22 bp, Homo sapiens
actgagcctgtgccctcatcag

SEQ ID NO: 7372221 - DNA, 22 bp, Homo sapiens
actgagagtcaagatagcatgg

SEQ ID NO: 7372222 - DNA, 22 bp, Homo sapiens
actctgcctttcagcagatgaa

SEQ ID NO: 7372223 - DNA, 22 bp, Homo sapiens
actctgcctgcggtgggcggga

SEQ ID NO: 7372224 - DNA, 22 bp, Homo sapiens
actctgcctggaggtaacagga

SEQ ID NO: 7372225 - DNA, 22 bp, Homo sapiens
actctgccttagtcctggggct

SEQ ID NO: 7372226 - DNA, 22 bp, Homo sapiens
actctgccttggtgtcacaaga

SEQ ID NO: 7372227 - DNA, 22 bp, Homo sapiens
actctgccccgagttctgggaa

SEQ ID NO: 7372228 - DNA, 22 bp, Homo sapiens
actctgccatcccaggtgctgt

SEQ ID NO: 7372229 - DNA, 22 bp, Homo sapiens
actctgcctgaacctcctgcaa

SEQ ID NO: 7372230 - DNA, 22 bp, Homo sapiens
actctgccctaggcctctgggg

SEQ ID NO: 7372231 - DNA, 22 bp, Homo sapiens
actctgccacataaaggtagat

SEQ ID NO: 7372232 - DNA, 22 bp, Homo sapiens
actctgagttcctacttgctcc

SEQ ID NO: 7372233 - DNA, 21 bp, Homo sapiens
actctgccagtctcctgcact

SEQ ID NO: 7372234 - DNA, 22 bp, Homo sapiens
actctgaactccaggaggctca

SEQ ID NO: 7372235 - DNA, 22 bp, Homo sapiens
actctgaatgtgcatgtaaatc

SEQ ID NO: 7372236 - DNA, 22 bp, Homo sapiens
actctgaaatagaggctggtgg

SEQ ID NO: 7372237 - DNA, 22 bp, Homo sapiens
actctgagccaccagatcccca

SEQ ID NO: 7372238 - DNA, 22 bp, Homo sapiens
actctgagtcatgcactccttg

SEQ ID NO: 7372239 - DNA, 22 bp, Homo sapiens
actctgagaatccctggacttt

SEQ ID NO: 7372240 - DNA, 22 bp, Homo sapiens
actctgagaactgagattccct

SEQ ID NO: 7372241 - DNA, 22 bp, Homo sapiens
actggctgtgtaacctcaggca

SEQ ID NO: 7372242 - DNA, 22 bp, Homo sapiens
actggctgtggccacggctgct

SEQ ID NO: 7372243 - DNA, 21 bp, Homo sapiens
actggctgtcttcctactggt

SEQ ID NO: 7372244 - DNA, 22 bp, Homo sapiens
actggctgtgcccatagagctc

SEQ ID NO: 7372245 - DNA, 22 bp, Homo sapiens
actggctgtgcagagggcagta

SEQ ID NO: 7372246 - DNA, 22 bp, Homo sapiens
actggctggccgcgctcttcgc

SEQ ID NO: 7372247 - DNA, 22 bp, Homo sapiens
actggctggccacaccctggta

SEQ ID NO: 7372248 - DNA, 21 bp, Homo sapiens
actggctggctgagtttcctg

SEQ ID NO: 7372249 - DNA, 21 bp, Homo sapiens
actggctggtggctaagaatc

SEQ ID NO: 7372250 - DNA, 22 bp, Homo sapiens
actgggaggcaaagagcaagga

SEQ ID NO: 7372251 - DNA, 22 bp, Homo sapiens
agtgtccttagttagctttggg

SEQ ID NO: 7372252 - DNA, 21 bp, Homo sapiens
agtgtccttgatcttgccttg

SEQ ID NO: 7372253 - DNA, 22 bp, Homo sapiens
agtgtccttgattcctgttgtt

SEQ ID NO: 7372254 - DNA, 23 bp, Homo sapiens
actgcctgctactatgcccacgg

SEQ ID NO: 7372255 - DNA, 19 bp, Homo sapiens
actgcctgcaggtgttggg

SEQ ID NO: 7372256 - DNA, 22 bp, Homo sapiens
actgcctggcctggcctcactg

SEQ ID NO: 7372257 - DNA, 22 bp, Homo sapiens
actgcctgtagccctgagatgt

SEQ ID NO: 7372258 - DNA, 22 bp, Homo sapiens
actggctgatcacctgcctcag

SEQ ID NO: 7372259 - DNA, 22 bp, Homo sapiens
actggctgcctccaaagtgtgc

SEQ ID NO: 7372260 - DNA, 21 bp, Homo sapiens
actggctgccatgatccaggg

SEQ ID NO: 7372261 - DNA, 22 bp, Homo sapiens
actggctggagttgccaaggct

SEQ ID NO: 7372262 - DNA, 22 bp, Homo sapiens
actggctggactctgacctctt

SEQ ID NO: 7372263 - DNA, 22 bp, Homo sapiens
actggctgcggggtggaagaag

SEQ ID NO: 7372264 - DNA, 20 bp, Homo sapiens
actggctgcctggaatgcgc

SEQ ID NO: 7372265 - DNA, 22 bp, Homo sapiens
actggctgcgatcttggcgctt

SEQ ID NO: 7372266 - DNA, 22 bp, Homo sapiens
actggctgcgttcctgtgagac

SEQ ID NO: 7372267 - DNA, 22 bp, Homo sapiens
actgcccttgtcctggcacacc

SEQ ID NO: 7372268 - DNA, 22 bp, Homo sapiens
actgcccttgtcctggcacacc

SEQ ID NO: 7372269 - DNA, 22 bp, Homo sapiens
actgccctggcaccacacatgc

SEQ ID NO: 7372270 - DNA, 22 bp, Homo sapiens
actgccctgtaactgccaggta

SEQ ID NO: 7372271 - DNA, 22 bp, Homo sapiens
actgcctgagctattggaaaag

SEQ ID NO: 7372272 - DNA, 22 bp, Homo sapiens
actgccctggagacagcagagt

SEQ ID NO: 7372273 - DNA, 22 bp, Homo sapiens
actgccctccagcctgggtgac

SEQ ID NO: 7372274 - DNA, 22 bp, Homo sapiens
actgccagtattcacgttcctg

SEQ ID NO: 7372275 - DNA, 22 bp, Homo sapiens
actgccaggtaagtgctcctgc

SEQ ID NO: 7372276 - DNA, 23 bp, Homo sapiens
actgccagattgaaggtttctta

SEQ ID NO: 7372277 - DNA, 22 bp, Homo sapiens
actgccagaggaggtatctgaa

SEQ ID NO: 7372278 - DNA, 22 bp, Homo sapiens
agaaagattttcaacaggaggt

SEQ ID NO: 7372279 - DNA, 22 bp, Homo sapiens
agaaatcatgtcttatttctat

SEQ ID NO: 7372280 - DNA, 22 bp, Homo sapiens
atcagtgtttgcatgggagctt

SEQ ID NO: 7372281 - DNA, 22 bp, Homo sapiens
agaaatcaggaacagtaaggag

SEQ ID NO: 7372282 - DNA, 22 bp, Homo sapiens
atcagtgcttcatagccctggt

SEQ ID NO: 7372283 - DNA, 22 bp, Homo sapiens
atcagtgttgttgattggatag

SEQ ID NO: 7372284 - DNA, 17 bp, Homo sapiens
atcagtagcatatcaga

SEQ ID NO: 7372285 - DNA, 21 bp, Homo sapiens
atcagtaaggttggaggaaga

SEQ ID NO: 7372286 - DNA, 22 bp, Homo sapiens
agaaaaagtcaaggaattggac

SEQ ID NO: 7372287 - DNA, 22 bp, Homo sapiens
agaaaaagaaagtggatttgtc

SEQ ID NO: 7372288 - DNA, 22 bp, Homo sapiens
atattttggggtgatgtgcatc

SEQ ID NO: 7372289 - DNA, 22 bp, Homo sapiens
actttttacagggtgtatacca

SEQ ID NO: 7372290 - DNA, 22 bp, Homo sapiens
actttttacagggtgtatacca

SEQ ID NO: 7372291 - DNA, 22 bp, Homo sapiens
acttttcccttggtagagttgc

SEQ ID NO: 7372292 - DNA, 21 bp, Homo sapiens
agaaaaacacgatataagccc

SEQ ID NO: 7372293 - DNA, 21 bp, Homo sapiens
agaaaaaccagcatgttttca

SEQ ID NO: 7372294 - DNA, 22 bp, Homo sapiens
agaaggcagatgggacggagca

SEQ ID NO: 7372295 - DNA, 22 bp, Homo sapiens
agaaggcactcacactggcacg

SEQ ID NO: 7372296 - DNA, 22 bp, Homo sapiens
atctgccaagagaacgtgggtc

SEQ ID NO: 7372297 - DNA, 22 bp, Homo sapiens
atctgccaatgccatgagaaga

SEQ ID NO: 7372298 - DNA, 21 bp, Homo sapiens
agaaggcaccagcaaggactg

SEQ ID NO: 7372299 - DNA, 22 bp, Homo sapiens
agaaggcaccgtggccaatatt

SEQ ID NO: 7372300 - DNA, 22 bp, Homo sapiens
agaaggagtgtacaggtcatgc

SEQ ID NO: 7372301 - DNA, 22 bp, Homo sapiens
atctctgtaaaccataaattga

SEQ ID NO: 7372302 - DNA, 22 bp, Homo sapiens
atctcttctagctctgaaatta

SEQ ID NO: 7372303 - DNA, 22 bp, Homo sapiens
agaagccacaggaaagcagctt

SEQ ID NO: 7372304 - DNA, 22 bp, Homo sapiens
agaagccaagaacagacagtgc

SEQ ID NO: 7372305 - DNA, 22 bp, Homo sapiens
atctctttgatggctcctgtga

SEQ ID NO: 7372306 - DNA, 22 bp, Homo sapiens
atctctttgatggctcctgtga

SEQ ID NO: 7372307 - DNA, 22 bp, Homo sapiens
agaaatctattatttcagagtt

SEQ ID NO: 7372308 - DNA, 22 bp, Homo sapiens
agaaatctgactgctgtgcaca

SEQ ID NO: 7372309 - DNA, 22 bp, Homo sapiens
agaaatctgactgctgtgcaca

SEQ ID NO: 7372310 - DNA, 22 bp, Homo sapiens
agaaatcttatcaagaaatgcc

SEQ ID NO: 7372311 - DNA, 22 bp, Homo sapiens
agaaatcttatcaagaaatgcc

SEQ ID NO: 7372312 - DNA, 22 bp, Homo sapiens
atcccacctcaatctgaagctc

SEQ ID NO: 7372313 - DNA, 22 bp, Homo sapiens
atcccagagaataatgatcagg

SEQ ID NO: 7372314 - DNA, 22 bp, Homo sapiens
atctcaggggttccttctagag

SEQ ID NO: 7372315 - DNA, 22 bp, Homo sapiens
atctcagggctggagccctgga

SEQ ID NO: 7372316 - DNA, 22 bp, Homo sapiens
atctcaggaggttcctctgtcc

SEQ ID NO: 7372317 - DNA, 22 bp, Homo sapiens
atctcaggccctagtgacctca

SEQ ID NO: 7372318 - DNA, 22 bp, Homo sapiens
agaacatagatacctaagacag

SEQ ID NO: 7372319 - DNA, 22 bp, Homo sapiens
ataaagtctaccgtattaaaga

SEQ ID NO: 7372320 - DNA, 22 bp, Homo sapiens
actgtttcagtttctgaagttt

SEQ ID NO: 7372321 - DNA, 22 bp, Homo sapiens
ataaagtttaaaagtcaatagt

SEQ ID NO: 7372322 - DNA, 22 bp, Homo sapiens
ataaagtttaaaagtcaatagt

SEQ ID NO: 7372323 - DNA, 19 bp, Homo sapiens
ataaataaaaagtgggaga

SEQ ID NO: 7372324 - DNA, 19 bp, Homo sapiens
ataaataaaaagtgggaga

SEQ ID NO: 7372325 - DNA, 21 bp, Homo sapiens
ataaagttttacaggaatgca

SEQ ID NO: 7372326 - DNA, 22 bp, Homo sapiens
acttccttttgggaaactgttt

SEQ ID NO: 7372327 - DNA, 22 bp, Homo sapiens
acttccttttcaaccatacagc

SEQ ID NO: 7372328 - DNA, 22 bp, Homo sapiens
acttccttgtactgactccatt

SEQ ID NO: 7372329 - DNA, 22 bp, Homo sapiens
acttccttgtcaggtgcatcat

SEQ ID NO: 7372330 - DNA, 22 bp, Homo sapiens
acttccttccaaacattcattt

SEQ ID NO: 7372331 - DNA, 22 bp, Homo sapiens
acttccttccaaacattcattt

SEQ ID NO: 7372332 - DNA, 22 bp, Homo sapiens
ataaaaactgacccatcctttg

SEQ ID NO: 7372333 - DNA, 23 bp, Homo sapiens
agtttttaatggtcatagctgag

SEQ ID NO: 7372334 - DNA, 22 bp, Homo sapiens
agttttatgtagacaattcatt

SEQ ID NO: 7372335 - DNA, 21 bp, Homo sapiens
agtttttactcttaactgtgg

SEQ ID NO: 7372336 - DNA, 21 bp, Homo sapiens
agtttttactcttaactgtgg

SEQ ID NO: 7372337 - DNA, 22 bp, Homo sapiens
agtttctaccggtacattcagg

SEQ ID NO: 7372338 - DNA, 22 bp, Homo sapiens
agttttatggctcaacctaata

SEQ ID NO: 7372339 - DNA, 23 bp, Homo sapiens
acttttcaattagctatgcttaa

SEQ ID NO: 7372340 - DNA, 22 bp, Homo sapiens
atagatatttgagttgtttcca

SEQ ID NO: 7372341 - DNA, 22 bp, Homo sapiens
atagatatttgagttgtttcca

SEQ ID NO: 7372342 - DNA, 22 bp, Homo sapiens
atagagttgagttcaaatatgt

SEQ ID NO: 7372343 - DNA, 22 bp, Homo sapiens
atacatcatttatggaataagg

SEQ ID NO: 7372344 - DNA, 22 bp, Homo sapiens
actttgccacattctttaggcc

SEQ ID NO: 7372345 - DNA, 22 bp, Homo sapiens
actttgccatgttgtatgacta

SEQ ID NO: 7372346 - DNA, 22 bp, Homo sapiens
actttgccattgcaaatacaca

SEQ ID NO: 7372347 - DNA, 22 bp, Homo sapiens
actttgcccagaactgtcccag

SEQ ID NO: 7372348 - DNA, 22 bp, Homo sapiens
actttgccccaaagaagttggt

SEQ ID NO: 7372349 - DNA, 22 bp, Homo sapiens
actttgcctccttgatagtttc

SEQ ID NO: 7372350 - DNA, 22 bp, Homo sapiens
actttgccttcttactgtgttg

SEQ ID NO: 7372351 - DNA, 22 bp, Homo sapiens
actttgccttcttactgtgttg

SEQ ID NO: 7372352 - DNA, 22 bp, Homo sapiens
actttgccccaggtctcatgac

SEQ ID NO: 7372353 - DNA, 22 bp, Homo sapiens
actttgccctacagcagctctg

SEQ ID NO: 7372354 - DNA, 22 bp, Homo sapiens
actttgcctacaagcccatggt

SEQ ID NO: 7372355 - DNA, 22 bp, Homo sapiens
ataatttttgtttgatgtccaa

SEQ ID NO: 7372356 - DNA, 22 bp, Homo sapiens
ataatttttgtttgatgtccaa

SEQ ID NO: 7372357 - DNA, 22 bp, Homo sapiens
atacaaaaattagccgggagta

SEQ ID NO: 7372358 - DNA, 22 bp, Homo sapiens
atacaaaatatatactggagac

SEQ ID NO: 7372359 - DNA, 22 bp, Homo sapiens
atacaaaatatatactggagac

SEQ ID NO: 7372360 - DNA, 22 bp, Homo sapiens
atacaaagacaaatctcaatct

SEQ ID NO: 7372361 - DNA, 22 bp, Homo sapiens
atacaaaatatatactggagac

SEQ ID NO: 7372362 - DNA, 22 bp, Homo sapiens
actttaaaactgatcatcagag

SEQ ID NO: 7372363 - DNA, 22 bp, Homo sapiens
atacatcaaggatgatggtgta

SEQ ID NO: 7372364 - DNA, 22 bp, Homo sapiens
atacatcaaggatgatggtgta

SEQ ID NO: 7372365 - DNA, 22 bp, Homo sapiens
atacatcacctatatattcaca

SEQ ID NO: 7372366 - DNA, 22 bp, Homo sapiens
aggctggcgacatctggcgggc

SEQ ID NO: 7372367 - DNA, 22 bp, Homo sapiens
ccatttaacacagagttttcca

SEQ ID NO: 7372368 - DNA, 22 bp, Homo sapiens
ccatttcacccactgctttagg

SEQ ID NO: 7372369 - DNA, 22 bp, Homo sapiens
aggctggagtgctggagtgctg

SEQ ID NO: 7372370 - DNA, 22 bp, Homo sapiens
aggctggcccacctcttgtctt

SEQ ID NO: 7372371 - DNA, 22 bp, Homo sapiens
aggctggagtgtagcagtgcag

SEQ ID NO: 7372372 - DNA, 22 bp, Homo sapiens
aggctggagtgcagtggtgtga

SEQ ID NO: 7372373 - DNA, 22 bp, Homo sapiens
aggctgcttcttgtccttggca

SEQ ID NO: 7372374 - DNA, 22 bp, Homo sapiens
aggctgctttttatttacaggt

SEQ ID NO: 7372375 - DNA, 22 bp, Homo sapiens
aggctgagctgacctggtttgg

SEQ ID NO: 7372376 - DNA, 22 bp, Homo sapiens
aggctgagctgacctggtttgg

SEQ ID NO: 7372377 - DNA, 22 bp, Homo sapiens
aggctgaggcaggtggatcacc

SEQ ID NO: 7372378 - DNA, 22 bp, Homo sapiens
ccagggctcaggctcccagtgg

SEQ ID NO: 7372379 - DNA, 22 bp, Homo sapiens
ccagggcctgagggcgacgccc

SEQ ID NO: 7372380 - DNA, 22 bp, Homo sapiens
ccagggcctgagggcgacgccc

SEQ ID NO: 7372381 - DNA, 22 bp, Homo sapiens
ccagggcctgagggcgacgccc

SEQ ID NO: 7372382 - DNA, 22 bp, Homo sapiens
ccagggcctgccacttagcaag

SEQ ID NO: 7372383 - DNA, 22 bp, Homo sapiens
ccaggctggagtgcaatggcat

SEQ ID NO: 7372384 - DNA, 22 bp, Homo sapiens
aggcgtggttgaggcgagcata

SEQ ID NO: 7372385 - DNA, 22 bp, Homo sapiens
aggcgtggttgaggcgagcata

SEQ ID NO: 7372386 - DNA, 22 bp, Homo sapiens
aggctaagttgattaaattgtt

SEQ ID NO: 7372387 - DNA, 22 bp, Homo sapiens
aggctaagtgattagtgacata

SEQ ID NO: 7372388 - DNA, 22 bp, Homo sapiens
aggctacagatacagaggctac

SEQ ID NO: 7372389 - DNA, 22 bp, Homo sapiens
aggctacagcctcaagagtgca

SEQ ID NO: 7372390 - DNA, 22 bp, Homo sapiens
ccagaaaatatggctaaggtga

SEQ ID NO: 7372391 - DNA, 22 bp, Homo sapiens
ccagaagacaagaatgttctta

SEQ ID NO: 7372392 - DNA, 22 bp, Homo sapiens
ccagaacacagtggaagaatat

SEQ ID NO: 7372393 - DNA, 22 bp, Homo sapiens
ccagaacacagtggaagaatat

SEQ ID NO: 7372394 - DNA, 22 bp, Homo sapiens
aggccacagttgaggccagcaa

SEQ ID NO: 7372395 - DNA, 22 bp, Homo sapiens
aggccagtgcagctggaacaga

SEQ ID NO: 7372396 - DNA, 22 bp, Homo sapiens
aggcccagactcagcggggcgg

SEQ ID NO: 7372397 - DNA, 22 bp, Homo sapiens
ccagagctaaacacacaggctg

SEQ ID NO: 7372398 - DNA, 17 bp, Homo sapiens
ccagagctactgagact

SEQ ID NO: 7372399 - DNA, 20 bp, Homo sapiens
ccagagctgatggctgcccg

SEQ ID NO: 7372400 - DNA, 22 bp, Homo sapiens
ccagagctgagggagcctgagc

SEQ ID NO: 7372401 - DNA, 22 bp, Homo sapiens
ccagagctgaggagatgggctt

SEQ ID NO: 7372402 - DNA, 22 bp, Homo sapiens
ccagagctgaggagatgggctt

SEQ ID NO: 7372403 - DNA, 22 bp, Homo sapiens
aggccacattgtgattcccgca

SEQ ID NO: 7372404 - DNA, 22 bp, Homo sapiens
aggccacatagcttgcatgtag

SEQ ID NO: 7372405 - DNA, 22 bp, Homo sapiens
aggccacatagcttgcatgtag

SEQ ID NO: 7372406 - DNA, 22 bp, Homo sapiens
ccagctcttttggctgagtgag

SEQ ID NO: 7372407 - DNA, 22 bp, Homo sapiens
aggcgctgtgcttggggctgga

SEQ ID NO: 7372408 - DNA, 22 bp, Homo sapiens
aggcggctccgggagtgtgggc

SEQ ID NO: 7372409 - DNA, 22 bp, Homo sapiens
aggcggcttctgaggaggctgc

SEQ ID NO: 7372410 - DNA, 22 bp, Homo sapiens
aggcggcttctgaggaggctgc

SEQ ID NO: 7372411 - DNA, 22 bp, Homo sapiens
aggcgtgggaggatctgaggcc

SEQ ID NO: 7372412 - DNA, 22 bp, Homo sapiens
aggcctgtctggggctcagcca

SEQ ID NO: 7372413 - DNA, 22 bp, Homo sapiens
ccaggacaagccagagggacag

SEQ ID NO: 7372414 - DNA, 22 bp, Homo sapiens
ccaggaaggtatgggaagaaaa

SEQ ID NO: 7372415 - DNA, 22 bp, Homo sapiens
ccaggaaggcaggcctccccgc

SEQ ID NO: 7372416 - DNA, 22 bp, Homo sapiens
ccccactctcggccagataggc

SEQ ID NO: 7372417 - DNA, 22 bp, Homo sapiens
cccatgcaccctctaagaagga

SEQ ID NO: 7372418 - DNA, 22 bp, Homo sapiens
cccatgctgagtggcctgagat

SEQ ID NO: 7372419 - DNA, 22 bp, Homo sapiens
cccatgggttttcctccctgcc

SEQ ID NO: 7372420 - DNA, 22 bp, Homo sapiens
ccccttccacagtgcttcctaa

SEQ ID NO: 7372421 - DNA, 22 bp, Homo sapiens
ccctagggtttggccagagccc

SEQ ID NO: 7372422 - DNA, 22 bp, Homo sapiens
ccctgcacagcctggctctctt

SEQ ID NO: 7372423 - DNA, 22 bp, Homo sapiens
ccctcccaggagtggccagaga

SEQ ID NO: 7372424 - DNA, 22 bp, Homo sapiens
ccctgctgtgcctgactgccat

SEQ ID NO: 7372425 - DNA, 22 bp, Homo sapiens
ccctgctgtccctcagtcctgc

SEQ ID NO: 7372426 - DNA, 22 bp, Homo sapiens
ccctgctgtcaggtgctgggag

SEQ ID NO: 7372427 - DNA, 22 bp, Homo sapiens
ccctgctgtgtcccacctggaa

SEQ ID NO: 7372428 - DNA, 22 bp, Homo sapiens
ccctgctgtgcctgactgccat

SEQ ID NO: 7372429 - DNA, 22 bp, Homo sapiens
ccctgctgtgtagcggaggaac

SEQ ID NO: 7372430 - DNA, 22 bp, Homo sapiens
ccctgctgcaggcttcaggagg

SEQ ID NO: 7372431 - DNA, 22 bp, Homo sapiens
ccctgctgcatggcctccacga

SEQ ID NO: 7372432 - DNA, 22 bp, Homo sapiens
ccctgctgccttcacccaggac

SEQ ID NO: 7372433 - DNA, 22 bp, Homo sapiens
ccctgctgccttcacccaggac

SEQ ID NO: 7372434 - DNA, 22 bp, Homo sapiens
ccctgctgtcaggtgctgggag

SEQ ID NO: 7372435 - DNA, 22 bp, Homo sapiens
ccctgccagggtcctgacagac

SEQ ID NO: 7372436 - DNA, 22 bp, Homo sapiens
cccaggagatggaggttgcagt

SEQ ID NO: 7372437 - DNA, 22 bp, Homo sapiens
cccaggagatgcactccattgg

SEQ ID NO: 7372438 - DNA, 23 bp, Homo sapiens
cccaggagcctgagtcctctctg

SEQ ID NO: 7372439 - DNA, 22 bp, Homo sapiens
cccaggaggtagaggttgcagt

SEQ ID NO: 7372440 - DNA, 22 bp, Homo sapiens
cccaggagggtggcctctgccc

SEQ ID NO: 7372441 - DNA, 22 bp, Homo sapiens
cccagtcatcctgcaggtgaaa

SEQ ID NO: 7372442 - DNA, 22 bp, Homo sapiens
cccaggctgtctgtcctttgct

SEQ ID NO: 7372443 - DNA, 22 bp, Homo sapiens
cccaggaggtcgaagctgcagt

SEQ ID NO: 7372444 - DNA, 22 bp, Homo sapiens
agggcctccagggcagcagtgg

SEQ ID NO: 7372445 - DNA, 22 bp, Homo sapiens
ccctggaactcctaggcaagca

SEQ ID NO: 7372446 - DNA, 22 bp, Homo sapiens
agggcctgctctatcactctca

SEQ ID NO: 7372447 - DNA, 22 bp, Homo sapiens
agggctggagccacagctggga

SEQ ID NO: 7372448 - DNA, 22 bp, Homo sapiens
cctcaggccagggggcggccag

SEQ ID NO: 7372449 - DNA, 22 bp, Homo sapiens
cctcaggcctctgcctcattgg

SEQ ID NO: 7372450 - DNA, 20 bp, Homo sapiens
cctcaggccagttttaaagt

SEQ ID NO: 7372451 - DNA, 22 bp, Homo sapiens
cctcaggccctgtccctgcgcc

SEQ ID NO: 7372452 - DNA, 22 bp, Homo sapiens
cctcaggccctgtccctgcgcc

SEQ ID NO: 7372453 - DNA, 22 bp, Homo sapiens
cctcaggcaggaaactgtcccg

SEQ ID NO: 7372454 - DNA, 22 bp, Homo sapiens
agggccttgctgtctgaagctg

SEQ ID NO: 7372455 - DNA, 22 bp, Homo sapiens
agggtagggcccggagacagac

SEQ ID NO: 7372456 - DNA, 22 bp, Homo sapiens
agggtaggaactgagtggaagg

SEQ ID NO: 7372457 - DNA, 22 bp, Homo sapiens
cctgaagaacctcacgggcact

SEQ ID NO: 7372458 - DNA, 22 bp, Homo sapiens
cctgaagaagttgttatggtct

SEQ ID NO: 7372459 - DNA, 22 bp, Homo sapiens
cctgaagaaaattccacgagaa

SEQ ID NO: 7372460 - DNA, 20 bp, Homo sapiens
cctgaagagtttctctttct

SEQ ID NO: 7372461 - DNA, 22 bp, Homo sapiens
cctgaagagtgaatgtggcagt

SEQ ID NO: 7372462 - DNA, 22 bp, Homo sapiens
cctgaagatgagggacagctaa

SEQ ID NO: 7372463 - DNA, 22 bp, Homo sapiens
cctgaagatgctgtggcctggt

SEQ ID NO: 7372464 - DNA, 22 bp, Homo sapiens
cctgaagagcactctagagttg

SEQ ID NO: 7372465 - DNA, 22 bp, Homo sapiens
cctgaagaattcaaatccagat

SEQ ID NO: 7372466 - DNA, 22 bp, Homo sapiens
cctgaagacaacttttatcacc

SEQ ID NO: 7372467 - DNA, 22 bp, Homo sapiens
cctgagaggccctctcactgtc

SEQ ID NO: 7372468 - DNA, 22 bp, Homo sapiens
cctgaagatccattatagacac

SEQ ID NO: 7372469 - DNA, 22 bp, Homo sapiens
aggggcaaatgtgagcctggaa

SEQ ID NO: 7372470 - DNA, 23 bp, Homo sapiens
aggggcagcaagttttggtgtta

SEQ ID NO: 7372471 - DNA, 23 bp, Homo sapiens
aggggcagcaagttttggtgtta

SEQ ID NO: 7372472 - DNA, 22 bp, Homo sapiens
aggggagcaacatagtcactct

SEQ ID NO: 7372473 - DNA, 22 bp, Homo sapiens
cagggtttcaccatgttagcag

SEQ ID NO: 7372474 - DNA, 22 bp, Homo sapiens
aggaagaggtagctgtcaaggg

SEQ ID NO: 7372475 - DNA, 22 bp, Homo sapiens
aggaagaggtagctgtcaaggg

SEQ ID NO: 7372476 - DNA, 20 bp, Homo sapiens
aggaaggagaatctgagcaa

SEQ ID NO: 7372477 - DNA, 22 bp, Homo sapiens
aggaagagtgttacctatgggt

SEQ ID NO: 7372478 - DNA, 22 bp, Homo sapiens
aggaagaggtgtgcaatggtgt

SEQ ID NO: 7372479 - DNA, 22 bp, Homo sapiens
cagggtggtaccagcatctagt

SEQ ID NO: 7372480 - DNA, 22 bp, Homo sapiens
cagggtggtgaatagctatagt

SEQ ID NO: 7372481 - DNA, 22 bp, Homo sapiens
cagggtggtaccagcatctagt

SEQ ID NO: 7372482 - DNA, 22 bp, Homo sapiens
cagggtggggctggctatcaaa

SEQ ID NO: 7372483 - DNA, 22 bp, Homo sapiens
aggaaacatccttatctattct

SEQ ID NO: 7372484 - DNA, 22 bp, Homo sapiens
aggaaacagtgaacttggcagg

SEQ ID NO: 7372485 - DNA, 22 bp, Homo sapiens
aggaaacagtgaacttggcagg

SEQ ID NO: 7372486 - DNA, 22 bp, Homo sapiens
aggaaacagagtgaagcttggg

SEQ ID NO: 7372487 - DNA, 22 bp, Homo sapiens
aggaaacaggcagcctttgaac

SEQ ID NO: 7372488 - DNA, 22 bp, Homo sapiens
aggaaacattgatattgggaaa

SEQ ID NO: 7372489 - DNA, 17 bp, Homo sapiens
aggaaacattttctttc

SEQ ID NO: 7372490 - DNA, 22 bp, Homo sapiens
aggaaacatgaatctgccttga

SEQ ID NO: 7372491 - DNA, 22 bp, Homo sapiens
aggaaacatgaatctgccttga

SEQ ID NO: 7372492 - DNA, 22 bp, Homo sapiens
caggtcctggcagctgactcag

SEQ ID NO: 7372493 - DNA, 22 bp, Homo sapiens
aggaagggttctttgtgaaaga

SEQ ID NO: 7372494 - DNA, 22 bp, Homo sapiens
aggaaggtaatgaactgaggag

SEQ ID NO: 7372495 - DNA, 22 bp, Homo sapiens
cagggacccgcacaggtagcat

SEQ ID NO: 7372496 - DNA, 22 bp, Homo sapiens
cagggacattggtggccaggtt

SEQ ID NO: 7372497 - DNA, 22 bp, Homo sapiens
aggaaaaataaggcagcagggc

SEQ ID NO: 7372498 - DNA, 22 bp, Homo sapiens
aggaaaaataaggcagcagggc

SEQ ID NO: 7372499 - DNA, 20 bp, Homo sapiens
aggaaaaatggaaactggag

SEQ ID NO: 7372500 - DNA, 22 bp, Homo sapiens
aggaaaacagaccaaggagctc

SEQ ID NO: 7372501 - DNA, 22 bp, Homo sapiens
aggaaacaacttggcatgagcc

SEQ ID NO: 7372502 - DNA, 22 bp, Homo sapiens
aggaaaagtgtgaagtatggag

SEQ ID NO: 7372503 - DNA, 22 bp, Homo sapiens
agctttattaactctccaggtg

SEQ ID NO: 7372504 - DNA, 22 bp, Homo sapiens
agctttattcatgatttcaggg

SEQ ID NO: 7372505 - DNA, 22 bp, Homo sapiens
agctttatatgttgtttctcca

SEQ ID NO: 7372506 - DNA, 22 bp, Homo sapiens
agctttcagtctctgaaggaac

SEQ ID NO: 7372507 - DNA, 22 bp, Homo sapiens
agctttatttgtcattcacggc

SEQ ID NO: 7372508 - DNA, 22 bp, Homo sapiens
agctggagatcatgctgatact

SEQ ID NO: 7372509 - DNA, 22 bp, Homo sapiens
agctggaggataactcacttct

SEQ ID NO: 7372510 - DNA, 22 bp, Homo sapiens
agctggaggagtttctcctagc

SEQ ID NO: 7372511 - DNA, 22 bp, Homo sapiens
agctgggttcagaggcacatgg

SEQ ID NO: 7372512 - DNA, 22 bp, Homo sapiens
agctggtgaacctgaggcacag

SEQ ID NO: 7372513 - DNA, 22 bp, Homo sapiens
caggcagagtgagaagcccttg

SEQ ID NO: 7372514 - DNA, 20 bp, Homo sapiens
caggcagaggatgctgacca

SEQ ID NO: 7372515 - DNA, 22 bp, Homo sapiens
caggcagagtgaggtggtctaa

SEQ ID NO: 7372516 - DNA, 22 bp, Homo sapiens
agctgggtggagggcccacggt

SEQ ID NO: 7372517 - DNA, 22 bp, Homo sapiens
agctgggtggtgctgagccttg

SEQ ID NO: 7372518 - DNA, 21 bp, Homo sapiens
agctgggtgggctgagtgaca

SEQ ID NO: 7372519 - DNA, 22 bp, Homo sapiens
agctgctttgctgggcaggccc

SEQ ID NO: 7372520 - DNA, 22 bp, Homo sapiens
agctgctttgctgggcaggccc

SEQ ID NO: 7372521 - DNA, 22 bp, Homo sapiens
agctgcttttagggccgggctc

SEQ ID NO: 7372522 - DNA, 22 bp, Homo sapiens
agctgcctggagccagagttga

SEQ ID NO: 7372523 - DNA, 22 bp, Homo sapiens
agctgcctgcttatgagctcca

SEQ ID NO: 7372524 - DNA, 22 bp, Homo sapiens
agctgcctgccatgccgctggt

SEQ ID NO: 7372525 - DNA, 21 bp, Homo sapiens
agctgcctgctctggacctgg

SEQ ID NO: 7372526 - DNA, 22 bp, Homo sapiens
agctgcctgctgcactcggtgc

SEQ ID NO: 7372527 - DNA, 22 bp, Homo sapiens
agctgcctgcatttatatcctg

SEQ ID NO: 7372528 - DNA, 22 bp, Homo sapiens
agctgcctctgaactttaattc

SEQ ID NO: 7372529 - DNA, 22 bp, Homo sapiens
agctgcctctgctggtttagaa

SEQ ID NO: 7372530 - DNA, 22 bp, Homo sapiens
agctgcctcctggtgccccatc

SEQ ID NO: 7372531 - DNA, 17 bp, Homo sapiens
agctgcctctcccacca

SEQ ID NO: 7372532 - DNA, 22 bp, Homo sapiens
agctgcctctcttgaggttacg

SEQ ID NO: 7372533 - DNA, 22 bp, Homo sapiens
agctgcctcctggtgccccatc

SEQ ID NO: 7372534 - DNA, 22 bp, Homo sapiens
agctgcctccctgtgcttgtcc

SEQ ID NO: 7372535 - DNA, 22 bp, Homo sapiens
agctgcctccatggtcaaagat

SEQ ID NO: 7372536 - DNA, 22 bp, Homo sapiens
agctgccctgtggggagggttg

SEQ ID NO: 7372537 - DNA, 21 bp, Homo sapiens
agctgcctccacttctgaggc

SEQ ID NO: 7372538 - DNA, 22 bp, Homo sapiens
agctgcctcagtcactcatggc

SEQ ID NO: 7372539 - DNA, 22 bp, Homo sapiens
agctgcctcagcaacacagacc

SEQ ID NO: 7372540 - DNA, 22 bp, Homo sapiens
agctgcctagtagattgattgg

SEQ ID NO: 7372541 - DNA, 22 bp, Homo sapiens
agctgccctcgctggggccaga

SEQ ID NO: 7372542 - DNA, 20 bp, Homo sapiens
agctgcccctgggcactgcc

SEQ ID NO: 7372543 - DNA, 18 bp, Homo sapiens
agctgccctgggctggag

SEQ ID NO: 7372544 - DNA, 22 bp, Homo sapiens
agctgccccgaggcggcgggaa

SEQ ID NO: 7372545 - DNA, 22 bp, Homo sapiens
agctgccactgagggtgcacag

SEQ ID NO: 7372546 - DNA, 17 bp, Homo sapiens
caggaaaatatgagtga

SEQ ID NO: 7372547 - DNA, 21 bp, Homo sapiens
agctgaaaagttgtttacaag

SEQ ID NO: 7372548 - DNA, 20 bp, Homo sapiens
agctctttttagctaaggta

SEQ ID NO: 7372549 - DNA, 22 bp, Homo sapiens
agctcttttatcatgaggagag

SEQ ID NO: 7372550 - DNA, 22 bp, Homo sapiens
catcacttttaaaggtgatcga

SEQ ID NO: 7372551 - DNA, 22 bp, Homo sapiens
cagttcaaagttaagcagcagt

SEQ ID NO: 7372552 - DNA, 22 bp, Homo sapiens
cagttcaagagaaatactactg

SEQ ID NO: 7372553 - DNA, 22 bp, Homo sapiens
cagttcctggttccattcttct

SEQ ID NO: 7372554 - DNA, 21 bp, Homo sapiens
cagttctcttagatttccagt

SEQ ID NO: 7372555 - DNA, 22 bp, Homo sapiens
aggagtgggggcgagaagttaa

SEQ ID NO: 7372556 - DNA, 22 bp, Homo sapiens
aggagtggtgcaggacctgcca

SEQ ID NO: 7372557 - DNA, 22 bp, Homo sapiens
aggagtggtgcaggacctgcca

SEQ ID NO: 7372558 - DNA, 22 bp, Homo sapiens
catcatttcacttagatgaagt

SEQ ID NO: 7372559 - DNA, 22 bp, Homo sapiens
cagtgaggctctgctgagcggt

SEQ ID NO: 7372560 - DNA, 20 bp, Homo sapiens
aggagatgatccagagtcag

SEQ ID NO: 7372561 - DNA, 22 bp, Homo sapiens
aggaattaacaatatatttagg

SEQ ID NO: 7372562 - DNA, 22 bp, Homo sapiens
cagtgaggagtccagggcagag

SEQ ID NO: 7372563 - DNA, 22 bp, Homo sapiens
cagtctgatgttcgcaggtgaa

SEQ ID NO: 7372564 - DNA, 23 bp, Homo sapiens
cagtctgcagcccacttgggcag

SEQ ID NO: 7372565 - DNA, 22 bp, Homo sapiens
aggagctggcctagaaaggaga

SEQ ID NO: 7372566 - DNA, 22 bp, Homo sapiens
cagtggaatacgagcagatgtc

SEQ ID NO: 7372567 - DNA, 22 bp, Homo sapiens
cagtggaaatcagagtgagagt

SEQ ID NO: 7372568 - DNA, 22 bp, Homo sapiens
aggagccaagatgctgtctggc

SEQ ID NO: 7372569 - DNA, 22 bp, Homo sapiens
cagtgcttttaaaacaacatca

SEQ ID NO: 7372570 - DNA, 22 bp, Homo sapiens
cagtgcttttaaaacaacatca

SEQ ID NO: 7372571 - DNA, 22 bp, Homo sapiens
cagtgcttttcaaagttctatg

SEQ ID NO: 7372572 - DNA, 22 bp, Homo sapiens
aggagcagcttctgaaccatgt

SEQ ID NO: 7372573 - DNA, 22 bp, Homo sapiens
aggagccaaattactagctctg

SEQ ID NO: 7372574 - DNA, 22 bp, Homo sapiens
aggagcagcccactcctgtcct

SEQ ID NO: 7372575 - DNA, 22 bp, Homo sapiens
aggagcagattggtaagatcat

SEQ ID NO: 7372576 - DNA, 20 bp, Homo sapiens
aggcagctggccaggcaggt

SEQ ID NO: 7372577 - DNA, 20 bp, Homo sapiens
aggcagctgggaaatgaggg

SEQ ID NO: 7372578 - DNA, 23 bp, Homo sapiens
aggcagctgggtagcatctttct

SEQ ID NO: 7372579 - DNA, 22 bp, Homo sapiens
aggcagctgtgaggactggatt

SEQ ID NO: 7372580 - DNA, 22 bp, Homo sapiens
aggcagctggcagcacccaggg

SEQ ID NO: 7372581 - DNA, 21 bp, Homo sapiens
aggcagcgattttcatattgc

SEQ ID NO: 7372582 - DNA, 22 bp, Homo sapiens
aggcagctttaactggtagtag

SEQ ID NO: 7372583 - DNA, 22 bp, Homo sapiens
aggcagcttctgattagcagcg

SEQ ID NO: 7372584 - DNA, 22 bp, Homo sapiens
aggcagcttaagccctggccca

SEQ ID NO: 7372585 - DNA, 22 bp, Homo sapiens
aggcagctttcagtgtctctca

SEQ ID NO: 7372586 - DNA, 22 bp, Homo sapiens
aggcagctttctggtgcaccat

SEQ ID NO: 7372587 - DNA, 22 bp, Homo sapiens
aggcagctttgtagtaaagcta

SEQ ID NO: 7372588 - DNA, 22 bp, Homo sapiens
aggcagctttctgtaggggtgt

SEQ ID NO: 7372589 - DNA, 22 bp, Homo sapiens
aggcagaggagaatgatcttcc

SEQ ID NO: 7372590 - DNA, 19 bp, Homo sapiens
aggcagaggcttggctagc

SEQ ID NO: 7372591 - DNA, 22 bp, Homo sapiens
aggcagaggaagggtggatttg

SEQ ID NO: 7372592 - DNA, 20 bp, Homo sapiens
aggcagagcgcacttttaga

SEQ ID NO: 7372593 - DNA, 22 bp, Homo sapiens
aggcaggcctacacaatgggag

SEQ ID NO: 7372594 - DNA, 18 bp, Homo sapiens
aggcaggcggatcacaag

SEQ ID NO: 7372595 - DNA, 22 bp, Homo sapiens
aggcaggcctacacaatgggag

SEQ ID NO: 7372596 - DNA, 22 bp, Homo sapiens
aggcaggccctctggaaaggta

SEQ ID NO: 7372597 - DNA, 22 bp, Homo sapiens
aggcaggctctgggtatgtgca

SEQ ID NO: 7372598 - DNA, 22 bp, Homo sapiens
aggcaggctagtcgcttgagcc

SEQ ID NO: 7372599 - DNA, 22 bp, Homo sapiens
aggcaggctcaatgcccagtct

SEQ ID NO: 7372600 - DNA, 22 bp, Homo sapiens
ccaaagaaacccaagctcaggg

SEQ ID NO: 7372601 - DNA, 22 bp, Homo sapiens
ccaaacaaatccccattcttag

SEQ ID NO: 7372602 - DNA, 22 bp, Homo sapiens
ccaaaattattacatttgtagg

SEQ ID NO: 7372603 - DNA, 22 bp, Homo sapiens
ccaaaatattagtgcttaagta

SEQ ID NO: 7372604 - DNA, 22 bp, Homo sapiens
ccaaaattaagcctcttatgtt

SEQ ID NO: 7372605 - DNA, 22 bp, Homo sapiens
ccaaaataacagcccaattcac

SEQ ID NO: 7372606 - DNA, 21 bp, Homo sapiens
ccaaagaactgccatttgtca

SEQ ID NO: 7372607 - DNA, 21 bp, Homo sapiens
ccaaagaactgccatttgtca

SEQ ID NO: 7372608 - DNA, 22 bp, Homo sapiens
aggcaggcccctgagaatagac

SEQ ID NO: 7372609 - DNA, 22 bp, Homo sapiens
aggcactgactcaagggagcca

SEQ ID NO: 7372610 - DNA, 22 bp, Homo sapiens
aggcactgactcaagggagcca

SEQ ID NO: 7372611 - DNA, 22 bp, Homo sapiens
aggcactgacctgcttccttga

SEQ ID NO: 7372612 - DNA, 22 bp, Homo sapiens
aggcactgacctgcttccttga

SEQ ID NO: 7372613 - DNA, 22 bp, Homo sapiens
aggcactgactcaagggagcca

SEQ ID NO: 7372614 - DNA, 22 bp, Homo sapiens
aggcactgagaggctgtgttgc

SEQ ID NO: 7372615 - DNA, 22 bp, Homo sapiens
aggcactgagaggctgtgttgc

SEQ ID NO: 7372616 - DNA, 22 bp, Homo sapiens
aggcactgactcaagggagcca

SEQ ID NO: 7372617 - DNA, 22 bp, Homo sapiens
aggcactgacagattctgtgtc

SEQ ID NO: 7372618 - DNA, 22 bp, Homo sapiens
aggcactgacagattctgtgtc

SEQ ID NO: 7372619 - DNA, 22 bp, Homo sapiens
aggcactgacaattctggactg

SEQ ID NO: 7372620 - DNA, 23 bp, Homo sapiens
aggcactgaatgtgtcagtgagt

SEQ ID NO: 7372621 - DNA, 23 bp, Homo sapiens
aggcactgaatgtgtcagtgagt

SEQ ID NO: 7372622 - DNA, 23 bp, Homo sapiens
aggcactgaatgtgtcagtgagt

SEQ ID NO: 7372623 - DNA, 22 bp, Homo sapiens
aggcactgattctgttttccat

SEQ ID NO: 7372624 - DNA, 22 bp, Homo sapiens
aggcactgattctcagagttac

SEQ ID NO: 7372625 - DNA, 22 bp, Homo sapiens
aggcagagagcagtggccgtct

SEQ ID NO: 7372626 - DNA, 22 bp, Homo sapiens
aggcactgaagaactctttttg

SEQ ID NO: 7372627 - DNA, 22 bp, Homo sapiens
aggcactgaagaactctttttg

SEQ ID NO: 7372628 - DNA, 22 bp, Homo sapiens
aggcactgaaaggtggccagag

SEQ ID NO: 7372629 - DNA, 22 bp, Homo sapiens
aggcactgaaaggtggccagag

SEQ ID NO: 7372630 - DNA, 22 bp, Homo sapiens
aggcactgaatatccagtaaaa

SEQ ID NO: 7372631 - DNA, 22 bp, Homo sapiens
aggcactgaatatccagtaaaa

SEQ ID NO: 7372632 - DNA, 22 bp, Homo sapiens
aggcactgaagtggtaaatgta

SEQ ID NO: 7372633 - DNA, 22 bp, Homo sapiens
aggcactgaaggaagcttgcgc

SEQ ID NO: 7372634 - DNA, 19 bp, Homo sapiens
aggcacaggttgtctggac

SEQ ID NO: 7372635 - DNA, 22 bp, Homo sapiens
aggcacagtgcctggaatcaaa

SEQ ID NO: 7372636 - DNA, 23 bp, Homo sapiens
aggatcctggtacaggagcagag

SEQ ID NO: 7372637 - DNA, 22 bp, Homo sapiens
aggataattggcatttgtaggc

SEQ ID NO: 7372638 - DNA, 22 bp, Homo sapiens
catgtgtgaagactgcgggcca

SEQ ID NO: 7372639 - DNA, 22 bp, Homo sapiens
aggcacaggtggacttcacagt

SEQ ID NO: 7372640 - DNA, 22 bp, Homo sapiens
aggcacagggatgcggagccag

SEQ ID NO: 7372641 - DNA, 22 bp, Homo sapiens
aggcacagggatgcggagccag

SEQ ID NO: 7372642 - DNA, 22 bp, Homo sapiens
catgtgtgggacccttaggttg

SEQ ID NO: 7372643 - DNA, 22 bp, Homo sapiens
catgtgtgagtgagcagtcttc

SEQ ID NO: 7372644 - DNA, 22 bp, Homo sapiens
catgtgtgagtgagcagtcttc

SEQ ID NO: 7372645 - DNA, 22 bp, Homo sapiens
ctatatttcttggctttaaaca

SEQ ID NO: 7372646 - DNA, 22 bp, Homo sapiens
ctatatttcttggctttaaaca

SEQ ID NO: 7372647 - DNA, 22 bp, Homo sapiens
ctatcaaacagccattaatata

SEQ ID NO: 7372648 - DNA, 22 bp, Homo sapiens
ctatattctggaatgtccattt

SEQ ID NO: 7372649 - DNA, 22 bp, Homo sapiens
ctatatgccagtggcaccctct

SEQ ID NO: 7372650 - DNA, 22 bp, Homo sapiens
ctatatgcctgtgcagtctttg

SEQ ID NO: 7372651 - DNA, 22 bp, Homo sapiens
ctatattctggaatgtccattt

SEQ ID NO: 7372652 - DNA, 22 bp, Homo sapiens
ctatattctggaatgtccattt

SEQ ID NO: 7372653 - DNA, 22 bp, Homo sapiens
ctatatatatcatcttccagtt

SEQ ID NO: 7372654 - DNA, 22 bp, Homo sapiens
agtcagcagtgaaagcacagcc

SEQ ID NO: 7372655 - DNA, 22 bp, Homo sapiens
agtcagctggatactcttgtag

SEQ ID NO: 7372656 - DNA, 22 bp, Homo sapiens
agtcagctacaagttcattcac

SEQ ID NO: 7372657 - DNA, 19 bp, Homo sapiens
agtcagctagttcctatac

SEQ ID NO: 7372658 - DNA, 22 bp, Homo sapiens
ctatgaccccagcatgaataag

SEQ ID NO: 7372659 - DNA, 22 bp, Homo sapiens
ctatgaccccagcatgaataag

SEQ ID NO: 7372660 - DNA, 22 bp, Homo sapiens
ctatctgtaaatttgaggttct

SEQ ID NO: 7372661 - DNA, 22 bp, Homo sapiens
ctatctttcgattctagcttaa

SEQ ID NO: 7372662 - DNA, 22 bp, Homo sapiens
ctatcttttgttcattttgagt

SEQ ID NO: 7372663 - DNA, 22 bp, Homo sapiens
ctattgggatcctgacaaatct

SEQ ID NO: 7372664 - DNA, 22 bp, Homo sapiens
ctatttatctatttctgaatga

SEQ ID NO: 7372665 - DNA, 22 bp, Homo sapiens
ctattgggtcagccttctggct

SEQ ID NO: 7372666 - DNA, 22 bp, Homo sapiens
ctattgggtcagaaatgagaaa

SEQ ID NO: 7372667 - DNA, 22 bp, Homo sapiens
ctattgggccaaagaagatgcc

SEQ ID NO: 7372668 - DNA, 17 bp, Homo sapiens
ctattgggccatttctt

SEQ ID NO: 7372669 - DNA, 22 bp, Homo sapiens
ctattgggtatttattgagcac

SEQ ID NO: 7372670 - DNA, 22 bp, Homo sapiens
ctagctagtccagaaacctctc

SEQ ID NO: 7372671 - DNA, 22 bp, Homo sapiens
agtcacacactgtcagttctgc

SEQ ID NO: 7372672 - DNA, 22 bp, Homo sapiens
agtcacactggttgtttacagt

SEQ ID NO: 7372673 - DNA, 22 bp, Homo sapiens
agtcaaggctattatgtgggaa

SEQ ID NO: 7372674 - DNA, 22 bp, Homo sapiens
agtaggcattgtgaaactgcat

SEQ ID NO: 7372675 - DNA, 22 bp, Homo sapiens
agtaggcatagaaagaagcacc

SEQ ID NO: 7372676 - DNA, 22 bp, Homo sapiens
agtaggcatagaaagaagcacc

SEQ ID NO: 7372677 - DNA, 22 bp, Homo sapiens
agtaggcagggaataatacaaa

SEQ ID NO: 7372678 - DNA, 22 bp, Homo sapiens
agtaggcagaagtggcattcgg

SEQ ID NO: 7372679 - DNA, 18 bp, Homo sapiens
agtaggcactgtggggtt

SEQ ID NO: 7372680 - DNA, 22 bp, Homo sapiens
agtagcagaaggtcttgaaggg

SEQ ID NO: 7372681 - DNA, 20 bp, Homo sapiens
agtagcagtaatatggaaga

SEQ ID NO: 7372682 - DNA, 22 bp, Homo sapiens
agtagcagtttggctgaattta

SEQ ID NO: 7372683 - DNA, 22 bp, Homo sapiens
agtagcagtgacagctgaggta

SEQ ID NO: 7372684 - DNA, 22 bp, Homo sapiens
agtaacactattttcatatgta

SEQ ID NO: 7372685 - DNA, 22 bp, Homo sapiens
agtaacaaatattcattggatt

SEQ ID NO: 7372686 - DNA, 22 bp, Homo sapiens
agtaacaaatagctgcctttaa

SEQ ID NO: 7372687 - DNA, 22 bp, Homo sapiens
agtaacaaagtgggagaatgat

SEQ ID NO: 7372688 - DNA, 22 bp, Homo sapiens
agtagatagagtaagataccga

SEQ ID NO: 7372689 - DNA, 22 bp, Homo sapiens
agtagaccaaacatttaaaacc

SEQ ID NO: 7372690 - DNA, 22 bp, Homo sapiens
agtagaggccaggcctccctgg

SEQ ID NO: 7372691 - DNA, 22 bp, Homo sapiens
agtagacatgagcaatgataat

SEQ ID NO: 7372692 - DNA, 22 bp, Homo sapiens
ccttctccctctgagaggaacc

SEQ ID NO: 7372693 - DNA, 22 bp, Homo sapiens
ccttctccctctgagaggaacc

SEQ ID NO: 7372694 - DNA, 22 bp, Homo sapiens
ccttctcccctctgcagggtgt

SEQ ID NO: 7372695 - DNA, 21 bp, Homo sapiens
ccttctccattacagtaagct

SEQ ID NO: 7372696 - DNA, 22 bp, Homo sapiens
agtaaacattttcatattttct

SEQ ID NO: 7372697 - DNA, 22 bp, Homo sapiens
agtaaacatgtaattgttcatt

SEQ ID NO: 7372698 - DNA, 18 bp, Homo sapiens
agtaaatggtttattttc

SEQ ID NO: 7372699 - DNA, 22 bp, Homo sapiens
agtaaattatttagcttccaga

SEQ ID NO: 7372700 - DNA, 22 bp, Homo sapiens
agtaaatttcagctccattgta

SEQ ID NO: 7372701 - DNA, 22 bp, Homo sapiens
agtaaatttctgcatgtgtact

SEQ ID NO: 7372702 - DNA, 22 bp, Homo sapiens
agtaaattgtaccccagtggcc

SEQ ID NO: 7372703 - DNA, 22 bp, Homo sapiens
agtaacaaagaaagcctttgga

SEQ ID NO: 7372704 - DNA, 22 bp, Homo sapiens
aggtcagcaggccaggggcgaa

SEQ ID NO: 7372705 - DNA, 22 bp, Homo sapiens
aggtcagcatgctcctctctgt

SEQ ID NO: 7372706 - DNA, 22 bp, Homo sapiens
aggtcaccatggcatgctccac

SEQ ID NO: 7372707 - DNA, 22 bp, Homo sapiens
aggtcagttttaggaaagagca

SEQ ID NO: 7372708 - DNA, 20 bp, Homo sapiens
aggtcagtagaatgattttg

SEQ ID NO: 7372709 - DNA, 22 bp, Homo sapiens
aggtaactgtggctaggtaact

SEQ ID NO: 7372710 - DNA, 22 bp, Homo sapiens
aggtaactggctaactgaacga

SEQ ID NO: 7372711 - DNA, 22 bp, Homo sapiens
aggtaatttctccaaacatgct

SEQ ID NO: 7372712 - DNA, 22 bp, Homo sapiens
aggtaattttgtgttaatgatt

SEQ ID NO: 7372713 - DNA, 22 bp, Homo sapiens
aggtacagatgaaagtctagtt

SEQ ID NO: 7372714 - DNA, 22 bp, Homo sapiens
aggtattgaccacctccttgat

SEQ ID NO: 7372715 - DNA, 17 bp, Homo sapiens
aggtatttaaggagctg

SEQ ID NO: 7372716 - DNA, 22 bp, Homo sapiens
aggtacagcaatataagaggtc

SEQ ID NO: 7372717 - DNA, 22 bp, Homo sapiens
aggtatttatgagagcacatat

SEQ ID NO: 7372718 - DNA, 22 bp, Homo sapiens
aggtaaaatgagtctccattat

SEQ ID NO: 7372719 - DNA, 19 bp, Homo sapiens
agggttacccgctgccacc

SEQ ID NO: 7372720 - DNA, 22 bp, Homo sapiens
cctgaggttatccatctacctg

SEQ ID NO: 7372721 - DNA, 22 bp, Homo sapiens
ccttccagatgtaagagctgat

SEQ ID NO: 7372722 - DNA, 22 bp, Homo sapiens
cctgtgggccctggacagagac

SEQ ID NO: 7372723 - DNA, 22 bp, Homo sapiens
cctgtgggagggagcggctgga

SEQ ID NO: 7372724 - DNA, 22 bp, Homo sapiens
cctgtgggaggttctgtgagtc

SEQ ID NO: 7372725 - DNA, 22 bp, Homo sapiens
aggtgcagcatgagtccaacgg

SEQ ID NO: 7372726 - DNA, 22 bp, Homo sapiens
cctgtgccagccccttctgctg

SEQ ID NO: 7372727 - DNA, 22 bp, Homo sapiens
cctgtgccagctgggccctgcc

SEQ ID NO: 7372728 - DNA, 22 bp, Homo sapiens
cctgtgccagctgggccctgcc

SEQ ID NO: 7372729 - DNA, 22 bp, Homo sapiens
cctggggctccagagcagcgga

SEQ ID NO: 7372730 - DNA, 22 bp, Homo sapiens
cctggggctctgcacagagcag

SEQ ID NO: 7372731 - DNA, 22 bp, Homo sapiens
agttaaatgtcagtagcttaac

SEQ ID NO: 7372732 - DNA, 22 bp, Homo sapiens
agtgtgcatttgcagaagaccc

SEQ ID NO: 7372733 - DNA, 22 bp, Homo sapiens
agtgtgcatttgcagaagaccc

SEQ ID NO: 7372734 - DNA, 22 bp, Homo sapiens
agtgtgggccacgcagctgagc

SEQ ID NO: 7372735 - DNA, 22 bp, Homo sapiens
agtgtgggccacgcagctgagc

SEQ ID NO: 7372736 - DNA, 22 bp, Homo sapiens
agtgtttatggaaccctggtgg

SEQ ID NO: 7372737 - DNA, 22 bp, Homo sapiens
agttccaatcctggcatttatt

SEQ ID NO: 7372738 - DNA, 22 bp, Homo sapiens
agttccaaagcctgtattctta

SEQ ID NO: 7372739 - DNA, 19 bp, Homo sapiens
agttatttctaaatttacc

SEQ ID NO: 7372740 - DNA, 22 bp, Homo sapiens
agttcccaaattacaggccaca

SEQ ID NO: 7372741 - DNA, 22 bp, Homo sapiens
agttccagctgtgaccagaaaa

SEQ ID NO: 7372742 - DNA, 22 bp, Homo sapiens
ctgagctgacatcttcctcttt

SEQ ID NO: 7372743 - DNA, 22 bp, Homo sapiens
ctgagcagccccaccagccatt

SEQ ID NO: 7372744 - DNA, 22 bp, Homo sapiens
ctgagctctaatgtcagccttg

SEQ ID NO: 7372745 - DNA, 22 bp, Homo sapiens
ctgagctcacgccattctcctt

SEQ ID NO: 7372746 - DNA, 22 bp, Homo sapiens
ctgagccagggccacacatgga

SEQ ID NO: 7372747 - DNA, 22 bp, Homo sapiens
ctgagccagcgggctcactttt

SEQ ID NO: 7372748 - DNA, 22 bp, Homo sapiens
ctgagccagctggcatgtgcta

SEQ ID NO: 7372749 - DNA, 22 bp, Homo sapiens
ctgagccagctggcatgtgcta

SEQ ID NO: 7372750 - DNA, 22 bp, Homo sapiens
agtgtcctacagctcctgcctg

SEQ ID NO: 7372751 - DNA, 22 bp, Homo sapiens
agtgtctgggctcccttggagc

SEQ ID NO: 7372752 - DNA, 22 bp, Homo sapiens
agtgtctggtctctgaactaaa

SEQ ID NO: 7372753 - DNA, 22 bp, Homo sapiens
agtgtatttgagcatctcctta

SEQ ID NO: 7372754 - DNA, 22 bp, Homo sapiens
agtgggtcagagagctccagat

SEQ ID NO: 7372755 - DNA, 22 bp, Homo sapiens
agtggggagtttccagatgtgt

SEQ ID NO: 7372756 - DNA, 22 bp, Homo sapiens
agtggggagtttccagatgtgt

SEQ ID NO: 7372757 - DNA, 22 bp, Homo sapiens
agtgagtcaaacatatcctgac

SEQ ID NO: 7372758 - DNA, 22 bp, Homo sapiens
agtgagtggagagctctaggtt

SEQ ID NO: 7372759 - DNA, 22 bp, Homo sapiens
agtgaggggattcaggcaaggt

SEQ ID NO: 7372760 - DNA, 19 bp, Homo sapiens
agtgaaatggagtattcaa

SEQ ID NO: 7372761 - DNA, 22 bp, Homo sapiens
agtgaaaacactagttcttgcc

SEQ ID NO: 7372762 - DNA, 22 bp, Homo sapiens
agtgaaataaagctgcctatgg

SEQ ID NO: 7372763 - DNA, 22 bp, Homo sapiens
agtgaaatatgcccattgctgt

SEQ ID NO: 7372764 - DNA, 22 bp, Homo sapiens
agtgaaatcaggttttgactgc

SEQ ID NO: 7372765 - DNA, 22 bp, Homo sapiens
agtctttatttagagttaggac

SEQ ID NO: 7372766 - DNA, 22 bp, Homo sapiens
agtctttccttttggaagaaaa

SEQ ID NO: 7372767 - DNA, 22 bp, Homo sapiens
agtctttatacagaaatatatg

SEQ ID NO: 7372768 - DNA, 23 bp, Homo sapiens
ctcaccaagcgccgccgctgtgt

SEQ ID NO: 7372769 - DNA, 22 bp, Homo sapiens
ctcacattccacttgtgccaac

SEQ ID NO: 7372770 - DNA, 22 bp, Homo sapiens
agtctcaagtgttagtattatt

SEQ ID NO: 7372771 - DNA, 22 bp, Homo sapiens
agtggaaggtcaggggacagtg

SEQ ID NO: 7372772 - DNA, 22 bp, Homo sapiens
agtgcttttgtcattgaatctt

SEQ ID NO: 7372773 - DNA, 22 bp, Homo sapiens
agtgcttttatatcattaatcc

SEQ ID NO: 7372774 - DNA, 22 bp, Homo sapiens
agtgctttgtagtttcattgtg

SEQ ID NO: 7372775 - DNA, 22 bp, Homo sapiens
agtggaggttacagctgtacat

SEQ ID NO: 7372776 - DNA, 22 bp, Homo sapiens
agtggcatctctctaatgacga

SEQ ID NO: 7372777 - DNA, 22 bp, Homo sapiens
agtggagtgagtggcagaagga

SEQ ID NO: 7372778 - DNA, 22 bp, Homo sapiens
agtggcagaactacctttttat

SEQ ID NO: 7372779 - DNA, 20 bp, Homo sapiens
agtgccctccgacattgttt

SEQ ID NO: 7372780 - DNA, 22 bp, Homo sapiens
agtgccattcaagttttaaggg

SEQ ID NO: 7372781 - DNA, 18 bp, Homo sapiens
agtgccagctctgctttc

SEQ ID NO: 7372782 - DNA, 22 bp, Homo sapiens
agtgccttctctgggctaggtc

SEQ ID NO: 7372783 - DNA, 22 bp, Homo sapiens
agtgccttacaagagtgagggg

SEQ ID NO: 7372784 - DNA, 22 bp, Homo sapiens
agtgccttaaacagcatcggag

SEQ ID NO: 7372785 - DNA, 22 bp, Homo sapiens
agtgccttgtgtgtgggcagcc

SEQ ID NO: 7372786 - DNA, 22 bp, Homo sapiens
agtgccttgggtattttgagta

SEQ ID NO: 7372787 - DNA, 22 bp, Homo sapiens
agtgccttggctgtgatgggga

SEQ ID NO: 7372788 - DNA, 19 bp, Homo sapiens
ctggcctgtgtcctgtgct

SEQ ID NO: 7372789 - DNA, 22 bp, Homo sapiens
ctggccttttgtttctggagaa

SEQ ID NO: 7372790 - DNA, 21 bp, Homo sapiens
ctggccttcaactgattggat

SEQ ID NO: 7372791 - DNA, 22 bp, Homo sapiens
ctggccttgaggaggccaccaa

SEQ ID NO: 7372792 - DNA, 22 bp, Homo sapiens
ctggctcaataaatattagctg

SEQ ID NO: 7372793 - DNA, 22 bp, Homo sapiens
ctggctcaatttgtactgctgt

SEQ ID NO: 7372794 - DNA, 22 bp, Homo sapiens
atagtggttggatatgtcagag

SEQ ID NO: 7372795 - DNA, 22 bp, Homo sapiens
ctggctcacaggtgagatgcat

SEQ ID NO: 7372796 - DNA, 23 bp, Homo sapiens
atataaacaccagatagattgta

SEQ ID NO: 7372797 - DNA, 22 bp, Homo sapiens
atagttttctatgcactgttat

SEQ ID NO: 7372798 - DNA, 22 bp, Homo sapiens
atagttttctatgcactgttat

SEQ ID NO: 7372799 - DNA, 22 bp, Homo sapiens
atagttttatagatattgtgta

SEQ ID NO: 7372800 - DNA, 23 bp, Homo sapiens
atataaacaccagatagattgta

SEQ ID NO: 7372801 - DNA, 22 bp, Homo sapiens
atataaagagcttagtatagtg

SEQ ID NO: 7372802 - DNA, 22 bp, Homo sapiens
atataaagagcttagtatagtg

SEQ ID NO: 7372803 - DNA, 22 bp, Homo sapiens
atataaagtgtttagaaagctg

SEQ ID NO: 7372804 - DNA, 22 bp, Homo sapiens
atatactgtaggccactataag

SEQ ID NO: 7372805 - DNA, 22 bp, Homo sapiens
atatactgtagtggtttagagc

SEQ ID NO: 7372806 - DNA, 20 bp, Homo sapiens
atataccatcccacaacagg

SEQ ID NO: 7372807 - DNA, 22 bp, Homo sapiens
ctgggagctggatgccctgccc

SEQ ID NO: 7372808 - DNA, 22 bp, Homo sapiens
ctgggagctgtcaggagcgtgt

SEQ ID NO: 7372809 - DNA, 22 bp, Homo sapiens
ctgggagctggaatgggagaag

SEQ ID NO: 7372810 - DNA, 22 bp, Homo sapiens
ctgggagctggaatgggagaag

SEQ ID NO: 7372811 - DNA, 22 bp, Homo sapiens
atatacactcaccatggtattt

SEQ ID NO: 7372812 - DNA, 22 bp, Homo sapiens
atatacactccactgatacagg

SEQ ID NO: 7372813 - DNA, 22 bp, Homo sapiens
atatacacatgtgtatacattt

SEQ ID NO: 7372814 - DNA, 22 bp, Homo sapiens
atataatacaacctgctaagtg

SEQ ID NO: 7372815 - DNA, 22 bp, Homo sapiens
atataatagtttcataaaggct

SEQ ID NO: 7372816 - DNA, 19 bp, Homo sapiens
ctggctgcaatgccagggt

SEQ ID NO: 7372817 - DNA, 22 bp, Homo sapiens
ctggcaggtttggtgtctggtg

SEQ ID NO: 7372818 - DNA, 22 bp, Homo sapiens
ctggcaggttatagagctgccc

SEQ ID NO: 7372819 - DNA, 22 bp, Homo sapiens
ctggcccttctcttgcttcctg

SEQ ID NO: 7372820 - DNA, 22 bp, Homo sapiens
ctggcctaggaatggttttccg

SEQ ID NO: 7372821 - DNA, 22 bp, Homo sapiens
ctggcctcacctcagacttact

SEQ ID NO: 7372822 - DNA, 22 bp, Homo sapiens
ctggcctcagagggtcatggtg

SEQ ID NO: 7372823 - DNA, 22 bp, Homo sapiens
ctggcacagcttgggccccatc

SEQ ID NO: 7372824 - DNA, 22 bp, Homo sapiens
ctggcacagccactgcaggcag

SEQ ID NO: 7372825 - DNA, 22 bp, Homo sapiens
ctggcacagttaacatatgcta

SEQ ID NO: 7372826 - DNA, 22 bp, Homo sapiens
atacatgtaactgcattgtaat

SEQ ID NO: 7372827 - DNA, 22 bp, Homo sapiens
atacatgtcatcatatgtttgt

SEQ ID NO: 7372828 - DNA, 22 bp, Homo sapiens
atacatgtcatcatatgtttgt

SEQ ID NO: 7372829 - DNA, 22 bp, Homo sapiens
atacatgtgtccctgatttatt

SEQ ID NO: 7372830 - DNA, 22 bp, Homo sapiens
atacatgtgtccctgatttatt

SEQ ID NO: 7372831 - DNA, 22 bp, Homo sapiens
atacatgtgggtctaaacatat

SEQ ID NO: 7372832 - DNA, 22 bp, Homo sapiens
atacacatgtgtatgtgcatgc

SEQ ID NO: 7372833 - DNA, 22 bp, Homo sapiens
atacacatgttattgtggaagc

SEQ ID NO: 7372834 - DNA, 20 bp, Homo sapiens
atacacatgcagacagatgc

SEQ ID NO: 7372835 - DNA, 22 bp, Homo sapiens
ctggcacacagcaggctctcag

SEQ ID NO: 7372836 - DNA, 22 bp, Homo sapiens
ctggcacacagcaggctctcag

SEQ ID NO: 7372837 - DNA, 22 bp, Homo sapiens
ctggcacacagaggccctcggg

SEQ ID NO: 7372838 - DNA, 22 bp, Homo sapiens
atacaagttctcatgtgtatct

SEQ ID NO: 7372839 - DNA, 22 bp, Homo sapiens
atacacatatgtgtgtatatgt

SEQ ID NO: 7372840 - DNA, 22 bp, Homo sapiens
atacacatatgtgtgtatatgt

SEQ ID NO: 7372841 - DNA, 20 bp, Homo sapiens
atacacatattcttgcaact

SEQ ID NO: 7372842 - DNA, 22 bp, Homo sapiens
atacacatgcacacatgtgtgt

SEQ ID NO: 7372843 - DNA, 22 bp, Homo sapiens
atacacatgcacacatgtgtgt

SEQ ID NO: 7372844 - DNA, 22 bp, Homo sapiens
atacacatctatttaagagaca

SEQ ID NO: 7372845 - DNA, 22 bp, Homo sapiens
atacacatctatttaagagaca

SEQ ID NO: 7372846 - DNA, 22 bp, Homo sapiens
atacacaggtgctaggtcaata

SEQ ID NO: 7372847 - DNA, 22 bp, Homo sapiens
atacaagttgcccaaatgatta

SEQ ID NO: 7372848 - DNA, 21 bp, Homo sapiens
atacacatacacataaatgtg

SEQ ID NO: 7372849 - DNA, 21 bp, Homo sapiens
atacacatacacataaatgtg

SEQ ID NO: 7372850 - DNA, 22 bp, Homo sapiens
atacacatatcaggtgtataca

SEQ ID NO: 7372851 - DNA, 22 bp, Homo sapiens
ctgctgcccagtgtgcattggg

SEQ ID NO: 7372852 - DNA, 20 bp, Homo sapiens
ctgctcagaccaactcttct

SEQ ID NO: 7372853 - DNA, 20 bp, Homo sapiens
ctgctcagaccaactcttct

SEQ ID NO: 7372854 - DNA, 19 bp, Homo sapiens
ctgctcagagcagctccag

SEQ ID NO: 7372855 - DNA, 19 bp, Homo sapiens
ctgctcaggtcagtctgtc

SEQ ID NO: 7372856 - DNA, 22 bp, Homo sapiens
ataaagctcttagtagcagcct

SEQ ID NO: 7372857 - DNA, 22 bp, Homo sapiens
ataaagctttgaaatggagata

SEQ ID NO: 7372858 - DNA, 22 bp, Homo sapiens
ataaagcttctgagtctagatc

SEQ ID NO: 7372859 - DNA, 22 bp, Homo sapiens
ataaagctttgaaatggagata

SEQ ID NO: 7372860 - DNA, 22 bp, Homo sapiens
ctgcctggggcatcagtcaagg

SEQ ID NO: 7372861 - DNA, 22 bp, Homo sapiens
ctgctaaacctctctgagagct

SEQ ID NO: 7372862 - DNA, 22 bp, Homo sapiens
ctgcgtttgggtagaggcgagt

SEQ ID NO: 7372863 - DNA, 22 bp, Homo sapiens
ctgcgttttgacatttcggggc

SEQ ID NO: 7372864 - DNA, 22 bp, Homo sapiens
ctgcgtttagagtaggaggcat

SEQ ID NO: 7372865 - DNA, 22 bp, Homo sapiens
ctgcctgtgaacatactggggg

SEQ ID NO: 7372866 - DNA, 22 bp, Homo sapiens
ctgcctggtgcggtgcccaccc

SEQ ID NO: 7372867 - DNA, 22 bp, Homo sapiens
ctgcctggtgcggtgcccaccc

SEQ ID NO: 7372868 - DNA, 22 bp, Homo sapiens
agttctcaaggttaggaaaagt

SEQ ID NO: 7372869 - DNA, 22 bp, Homo sapiens
agttctgacctaacctttctca

SEQ ID NO: 7372870 - DNA, 22 bp, Homo sapiens
agttctctttagctcatatggt

SEQ ID NO: 7372871 - DNA, 22 bp, Homo sapiens
agttctcttccacagcctcctc

SEQ ID NO: 7372872 - DNA, 22 bp, Homo sapiens
agttctcttctcatcacccagg

SEQ ID NO: 7372873 - DNA, 22 bp, Homo sapiens
agttctctggctcctttccaga

SEQ ID NO: 7372874 - DNA, 22 bp, Homo sapiens
agttctgtgacaatatcattac

SEQ ID NO: 7372875 - DNA, 22 bp, Homo sapiens
ataaaagaagttttggtacttg

SEQ ID NO: 7372876 - DNA, 22 bp, Homo sapiens
ataaaacttattagaattgtgt

SEQ ID NO: 7372877 - DNA, 22 bp, Homo sapiens
ataaaacttattagaattgtgt

SEQ ID NO: 7372878 - DNA, 22 bp, Homo sapiens
ataaaaaggacagatgtggtct

SEQ ID NO: 7372879 - DNA, 22 bp, Homo sapiens
ataaaaaggacagatgtggtct

SEQ ID NO: 7372880 - DNA, 22 bp, Homo sapiens
ataaaaccaaagcagcagtgtt

SEQ ID NO: 7372881 - DNA, 22 bp, Homo sapiens
ataaaaatgagggcggtagcta

SEQ ID NO: 7372882 - DNA, 17 bp, Homo sapiens
agttttgatataatggc

SEQ ID NO: 7372883 - DNA, 22 bp, Homo sapiens
ataaaaactgacccatcctttg

SEQ ID NO: 7372884 - DNA, 22 bp, Homo sapiens
agttctgtggctgtgccctgta

SEQ ID NO: 7372885 - DNA, 22 bp, Homo sapiens
ctgcaggcttccagggctgtgg

SEQ ID NO: 7372886 - DNA, 22 bp, Homo sapiens
ataaaatctttatgtgctctgc

SEQ ID NO: 7372887 - DNA, 22 bp, Homo sapiens
ataaaatcagagttggattgga

SEQ ID NO: 7372888 - DNA, 22 bp, Homo sapiens
ataaaatcaactggctccagtt

SEQ ID NO: 7372889 - DNA, 22 bp, Homo sapiens
ataaactctgcctcagaagagc

SEQ ID NO: 7372890 - DNA, 22 bp, Homo sapiens
ataaactcatgccaagaaatga

SEQ ID NO: 7372891 - DNA, 22 bp, Homo sapiens
ataaagctaagacttacatgaa

SEQ ID NO: 7372892 - DNA, 22 bp, Homo sapiens
ataaagctatttttaattctgt

SEQ ID NO: 7372893 - DNA, 22 bp, Homo sapiens
ataaagctattcctctcttttt

SEQ ID NO: 7372894 - DNA, 22 bp, Homo sapiens
ataaagaggatgtatttacagc

SEQ ID NO: 7372895 - DNA, 22 bp, Homo sapiens
ataaagatttctttttctctac

SEQ ID NO: 7372896 - DNA, 21 bp, Homo sapiens
ataaagacaaacactatttgg

SEQ ID NO: 7372897 - DNA, 22 bp, Homo sapiens
ataaactggtaggaaaacagta

SEQ ID NO: 7372898 - DNA, 22 bp, Homo sapiens
atctctaatcaccagctctagc

SEQ ID NO: 7372899 - DNA, 22 bp, Homo sapiens
atctctaaagtctgttcagctc

SEQ ID NO: 7372900 - DNA, 22 bp, Homo sapiens
cttcctttcagaggaaggcctg

SEQ ID NO: 7372901 - DNA, 22 bp, Homo sapiens
cttcctttcagaggaaggcctg

SEQ ID NO: 7372902 - DNA, 22 bp, Homo sapiens
cttccttggcttctggggtgtg

SEQ ID NO: 7372903 - DNA, 22 bp, Homo sapiens
cttccttgtggtccttctcatt

SEQ ID NO: 7372904 - DNA, 22 bp, Homo sapiens
cttctgagatgttgttttacag

SEQ ID NO: 7372905 - DNA, 22 bp, Homo sapiens
cttctgacccctggtctacagc

SEQ ID NO: 7372906 - DNA, 19 bp, Homo sapiens
cttctgcagggtgacagtg

SEQ ID NO: 7372907 - DNA, 23 bp, Homo sapiens
atctgttcatctgacacagattc

SEQ ID NO: 7372908 - DNA, 22 bp, Homo sapiens
atctgttcttcaaaatattaca

SEQ ID NO: 7372909 - DNA, 22 bp, Homo sapiens
atcttatttaacacagcaaaac

SEQ ID NO: 7372910 - DNA, 22 bp, Homo sapiens
atctgtcttgccttgcatattt

SEQ ID NO: 7372911 - DNA, 22 bp, Homo sapiens
atctgtcttgccttgcatattt

SEQ ID NO: 7372912 - DNA, 22 bp, Homo sapiens
atctgtcttccaccacacatcc

SEQ ID NO: 7372913 - DNA, 22 bp, Homo sapiens
atctgtcttttattcatgagct

SEQ ID NO: 7372914 - DNA, 22 bp, Homo sapiens
atctgtctatgtggctatgtat

SEQ ID NO: 7372915 - DNA, 22 bp, Homo sapiens
cttcttaatcataacggtatct

SEQ ID NO: 7372916 - DNA, 22 bp, Homo sapiens
cttcttaatcataacggtatct

SEQ ID NO: 7372917 - DNA, 22 bp, Homo sapiens
cttcttaatcccttatatattt

SEQ ID NO: 7372918 - DNA, 22 bp, Homo sapiens
cttcttaactgtatatactatg

SEQ ID NO: 7372919 - DNA, 22 bp, Homo sapiens
cttcttaactgtatatactatg

SEQ ID NO: 7372920 - DNA, 22 bp, Homo sapiens
cttcttaactgtatatactatg

SEQ ID NO: 7372921 - DNA, 22 bp, Homo sapiens
cttcttaaagattacacaatga

SEQ ID NO: 7372922 - DNA, 22 bp, Homo sapiens
cttaagaatattgaagttgtgg

SEQ ID NO: 7372923 - DNA, 22 bp, Homo sapiens
cttaagaaattgcattctaatc

SEQ ID NO: 7372924 - DNA, 22 bp, Homo sapiens
cttaagaagcaagtctcagcaa

SEQ ID NO: 7372925 - DNA, 22 bp, Homo sapiens
atcatacatgtaactaagtaaa

SEQ ID NO: 7372926 - DNA, 22 bp, Homo sapiens
cttaatctcacctgcaaagtcc

SEQ ID NO: 7372927 - DNA, 22 bp, Homo sapiens
cttagatgaagtcacagaaccc

SEQ ID NO: 7372928 - DNA, 23 bp, Homo sapiens
atccatgtgagaatagactagca

SEQ ID NO: 7372929 - DNA, 22 bp, Homo sapiens
cttattagaaagaaaagacatg

SEQ ID NO: 7372930 - DNA, 22 bp, Homo sapiens
cttattcaatgctggaaatgtt

SEQ ID NO: 7372931 - DNA, 22 bp, Homo sapiens
cttatgtacacacatatattgt

SEQ ID NO: 7372932 - DNA, 22 bp, Homo sapiens
cttatgaagaccctacctccag

SEQ ID NO: 7372933 - DNA, 22 bp, Homo sapiens
cttcaacagttttagaacactg

SEQ ID NO: 7372934 - DNA, 22 bp, Homo sapiens
cttattcagaaggagaaatgga

SEQ ID NO: 7372935 - DNA, 22 bp, Homo sapiens
cttcacaaatggcctagagttc

SEQ ID NO: 7372936 - DNA, 22 bp, Homo sapiens
cttcaataggaactgcatggca

SEQ ID NO: 7372937 - DNA, 22 bp, Homo sapiens
cttcaagatatttctagaatca

SEQ ID NO: 7372938 - DNA, 19 bp, Homo sapiens
cttccttgctccccatgtg

SEQ ID NO: 7372939 - DNA, 22 bp, Homo sapiens
cttccttgctgtctgctccagg

SEQ ID NO: 7372940 - DNA, 22 bp, Homo sapiens
cttccttgcggcccctgcctag

SEQ ID NO: 7372941 - DNA, 22 bp, Homo sapiens
atcataaagtgctatctgattg

SEQ ID NO: 7372942 - DNA, 22 bp, Homo sapiens
atcataaaccactttgtaatct

SEQ ID NO: 7372943 - DNA, 22 bp, Homo sapiens
atcagtttgataataaggcttg

SEQ ID NO: 7372944 - DNA, 22 bp, Homo sapiens
atcagtttctgtgaagaacaca

SEQ ID NO: 7372945 - DNA, 22 bp, Homo sapiens
atcagtttatacttataaatct

SEQ ID NO: 7372946 - DNA, 22 bp, Homo sapiens
atcagttttgggggacatactg

SEQ ID NO: 7372947 - DNA, 22 bp, Homo sapiens
atcataaaattgcaccatttct

SEQ ID NO: 7372948 - DNA, 22 bp, Homo sapiens
atcataaaattgcaccatttct

SEQ ID NO: 7372949 - DNA, 22 bp, Homo sapiens
atcaggtgatgctctggttccc

SEQ ID NO: 7372950 - DNA, 22 bp, Homo sapiens
atcaggtgaagtcactgagtgg

SEQ ID NO: 7372951 - DNA, 20 bp, Homo sapiens
ctgtccttttgttggaagac

SEQ ID NO: 7372952 - DNA, 22 bp, Homo sapiens
atcagcagtgtctacctcggtg

SEQ ID NO: 7372953 - DNA, 22 bp, Homo sapiens
atcagcacaacgtacagagaaa

SEQ ID NO: 7372954 - DNA, 22 bp, Homo sapiens
atcagcagatgctcaatgaaca

SEQ ID NO: 7372955 - DNA, 22 bp, Homo sapiens
atcagcagatgctcaatgaaca

SEQ ID NO: 7372956 - DNA, 22 bp, Homo sapiens
atcagcaggcatattaactgaa

SEQ ID NO: 7372957 - DNA, 22 bp, Homo sapiens
atcagcagctaaggaactaaca

SEQ ID NO: 7372958 - DNA, 22 bp, Homo sapiens
atcagcaggaagggcaccttta

SEQ ID NO: 7372959 - DNA, 22 bp, Homo sapiens
ctgtaagatgggataagacttt

SEQ ID NO: 7372960 - DNA, 22 bp, Homo sapiens
ctgtaatcccagctactcggga

SEQ ID NO: 7372961 - DNA, 22 bp, Homo sapiens
atcacaatccctctctctgata

SEQ ID NO: 7372962 - DNA, 22 bp, Homo sapiens
atcacacagagcattaggggcc

SEQ ID NO: 7372963 - DNA, 22 bp, Homo sapiens
atcaagaattgggagctattga

SEQ ID NO: 7372964 - DNA, 22 bp, Homo sapiens
atcacaaaggtctcagagcaca

SEQ ID NO: 7372965 - DNA, 22 bp, Homo sapiens
ctgggagcttgttaggaatgca

SEQ ID NO: 7372966 - DNA, 22 bp, Homo sapiens
ctgggaggacaacttggagctc

SEQ ID NO: 7372967 - DNA, 22 bp, Homo sapiens
ctgggaggacaacttggagctc

SEQ ID NO: 7372968 - DNA, 22 bp, Homo sapiens
ctgggaggattcattgaggtga

SEQ ID NO: 7372969 - DNA, 22 bp, Homo sapiens
ctgggggcaatggtcagagtgt

SEQ ID NO: 7372970 - DNA, 22 bp, Homo sapiens
ctgggggcaagcagacagctgt

SEQ ID NO: 7372971 - DNA, 22 bp, Homo sapiens
atcaagaacttattttggaaat

SEQ ID NO: 7372972 - DNA, 22 bp, Homo sapiens
ctggtcagggtagtgttgcaga

SEQ ID NO: 7372973 - DNA, 22 bp, Homo sapiens
ctgggtctccggcagcctcggg

SEQ ID NO: 7372974 - DNA, 22 bp, Homo sapiens
atattattctagtaacagtgat

SEQ ID NO: 7372975 - DNA, 22 bp, Homo sapiens
atattattctagtaacagtgat

SEQ ID NO: 7372976 - DNA, 22 bp, Homo sapiens
atattcaaattacatttactaa

SEQ ID NO: 7372977 - DNA, 22 bp, Homo sapiens
attgttctggatatttacattg

SEQ ID NO: 7372978 - DNA, 22 bp, Homo sapiens
attgttctgtagtgacatgtag

SEQ ID NO: 7372979 - DNA, 22 bp, Homo sapiens
attgttctaagggtttaattaa

SEQ ID NO: 7372980 - DNA, 22 bp, Homo sapiens
attgttctggatatttacattg

SEQ ID NO: 7372981 - DNA, 22 bp, Homo sapiens
attgttcaatgtaataattttg

SEQ ID NO: 7372982 - DNA, 22 bp, Homo sapiens
attgttcaatgtaataattttg

SEQ ID NO: 7372983 - DNA, 22 bp, Homo sapiens
attgttcactgtgaatcttgat

SEQ ID NO: 7372984 - DNA, 22 bp, Homo sapiens
attgttcactgtgaatcttgat

SEQ ID NO: 7372985 - DNA, 22 bp, Homo sapiens
gcagtgccacaagatgggagga

SEQ ID NO: 7372986 - DNA, 22 bp, Homo sapiens
gcagtgcatgtcggaactcatt

SEQ ID NO: 7372987 - DNA, 22 bp, Homo sapiens
gcagtgccgaaggtagtggttg

SEQ ID NO: 7372988 - DNA, 22 bp, Homo sapiens
gccactgtagagtatggacaag

SEQ ID NO: 7372989 - DNA, 22 bp, Homo sapiens
attgttttaattccattgtgaa

SEQ ID NO: 7372990 - DNA, 20 bp, Homo sapiens
attgtttcatttaatgtaca

SEQ ID NO: 7372991 - DNA, 22 bp, Homo sapiens
attgtttccccggaattattca

SEQ ID NO: 7372992 - DNA, 22 bp, Homo sapiens
atttaaatgcttaagagggttt

SEQ ID NO: 7372993 - DNA, 22 bp, Homo sapiens
atttaaatgcttaagagggttt

SEQ ID NO: 7372994 - DNA, 22 bp, Homo sapiens
gcattcattcattcattaggta

SEQ ID NO: 7372995 - DNA, 22 bp, Homo sapiens
gcattcatctagtatcactctg

SEQ ID NO: 7372996 - DNA, 22 bp, Homo sapiens
gcattcatatggaaggaaacta

SEQ ID NO: 7372997 - DNA, 22 bp, Homo sapiens
gcattcactgggtgttcatggg

SEQ ID NO: 7372998 - DNA, 22 bp, Homo sapiens
gcagggaggtttgctgacctgg

SEQ ID NO: 7372999 - DNA, 22 bp, Homo sapiens
attggtgtgccacaactagttt

SEQ ID NO: 7373000 - DNA, 22 bp, Homo sapiens
attgtaaaagtattctaagatt

SEQ ID NO: 7373001 - DNA, 22 bp, Homo sapiens
gcaggctgtggtatgttgggca

SEQ ID NO: 7373002 - DNA, 22 bp, Homo sapiens
gcagggaggaagagatgcttcc

SEQ ID NO: 7373003 - DNA, 22 bp, Homo sapiens
gcagggaggtttgctgacctgg

SEQ ID NO: 7373004 - DNA, 22 bp, Homo sapiens
gcaggatgccagggcagcagcg

SEQ ID NO: 7373005 - DNA, 22 bp, Homo sapiens
gcaggatgagtgagtacattta

SEQ ID NO: 7373006 - DNA, 22 bp, Homo sapiens
gcaggatgcaacagcttgtagt

SEQ ID NO: 7373007 - DNA, 22 bp, Homo sapiens
gcaggatgaaggcagaggctga

SEQ ID NO: 7373008 - DNA, 14 bp, Homo sapiens
gcaggcggatcact

SEQ ID NO: 7373009 - DNA, 22 bp, Homo sapiens
gcaggagcagtcaggggcagct

SEQ ID NO: 7373010 - DNA, 22 bp, Homo sapiens
gcactgggggcagcagtgaggg

SEQ ID NO: 7373011 - DNA, 23 bp, Homo sapiens
gcactgggctctcagcaaggtgt

SEQ ID NO: 7373012 - DNA, 22 bp, Homo sapiens
gcacagggccctgtgcgtaggt

SEQ ID NO: 7373013 - DNA, 22 bp, Homo sapiens
gcacagggaggctggcctggcc

SEQ ID NO: 7373014 - DNA, 22 bp, Homo sapiens
gcacagggaggctggcctggcc

SEQ ID NO: 7373015 - DNA, 22 bp, Homo sapiens
gcacagggcaacaggtctgtta

SEQ ID NO: 7373016 - DNA, 22 bp, Homo sapiens
gcactgggggcagcagtgaggg

SEQ ID NO: 7373017 - DNA, 22 bp, Homo sapiens
gcactggggtcatagcctccag

SEQ ID NO: 7373018 - DNA, 22 bp, Homo sapiens
gcactgggtgtgaggcagcgtc

SEQ ID NO: 7373019 - DNA, 22 bp, Homo sapiens
gcactgggtgtgaggcagcgtc

SEQ ID NO: 7373020 - DNA, 22 bp, Homo sapiens
gcactgggtgggagatctgaat

SEQ ID NO: 7373021 - DNA, 22 bp, Homo sapiens
gcactgtagtgggggagaaatg

SEQ ID NO: 7373022 - DNA, 22 bp, Homo sapiens
gcacagggagacagccgtggcc

SEQ ID NO: 7373023 - DNA, 22 bp, Homo sapiens
gcacagggagacagccgtggcc

SEQ ID NO: 7373024 - DNA, 22 bp, Homo sapiens
gcacaggctgttggccttcaga

SEQ ID NO: 7373025 - DNA, 22 bp, Homo sapiens
gcaaaaattccagggacgactc

SEQ ID NO: 7373026 - DNA, 22 bp, Homo sapiens
gcaaaagtacagccggatttct

SEQ ID NO: 7373027 - DNA, 20 bp, Homo sapiens
gcaaaataggctctgttggt

SEQ ID NO: 7373028 - DNA, 22 bp, Homo sapiens
gcaaaatgatcttcttcaggct

SEQ ID NO: 7373029 - DNA, 22 bp, Homo sapiens
gcaaaatttacactccttcttc

SEQ ID NO: 7373030 - DNA, 22 bp, Homo sapiens
atgtttctacagcgtccactga

SEQ ID NO: 7373031 - DNA, 22 bp, Homo sapiens
gatttctgggctttatttcaga

SEQ ID NO: 7373032 - DNA, 22 bp, Homo sapiens
gcaaaaaatgcttgttgcttag

SEQ ID NO: 7373033 - DNA, 22 bp, Homo sapiens
gcaaaaaatgcttgttgcttag

SEQ ID NO: 7373034 - DNA, 22 bp, Homo sapiens
gcaacacaatatcccagtacat

SEQ ID NO: 7373035 - DNA, 22 bp, Homo sapiens
gcaaacaagctgcctgaagatt

SEQ ID NO: 7373036 - DNA, 22 bp, Homo sapiens
gcaaacaaggacatacatcctg

SEQ ID NO: 7373037 - DNA, 21 bp, Homo sapiens
gcaaccagaccacagggcagt

SEQ ID NO: 7373038 - DNA, 22 bp, Homo sapiens
gcaacagcattctcattgacat

SEQ ID NO: 7373039 - DNA, 22 bp, Homo sapiens
gcaacagcccaggttctgtgtg

SEQ ID NO: 7373040 - DNA, 22 bp, Homo sapiens
gcagaaggtctggcacttcagg

SEQ ID NO: 7373041 - DNA, 21 bp, Homo sapiens
gcagaagtggctacatctcca

SEQ ID NO: 7373042 - DNA, 22 bp, Homo sapiens
gcagaagtggattctacaattt

SEQ ID NO: 7373043 - DNA, 22 bp, Homo sapiens
gcagaagtggattctacaattt

SEQ ID NO: 7373044 - DNA, 22 bp, Homo sapiens
gcagaggcctaggtggaaggcc

SEQ ID NO: 7373045 - DNA, 22 bp, Homo sapiens
gcagaagtggtgctgtgccact

SEQ ID NO: 7373046 - DNA, 22 bp, Homo sapiens
gcagaggctccattttacagat

SEQ ID NO: 7373047 - DNA, 22 bp, Homo sapiens
gcagaggcctgaaggtggcggg

SEQ ID NO: 7373048 - DNA, 22 bp, Homo sapiens
gcagaggctccattttacagat

SEQ ID NO: 7373049 - DNA, 22 bp, Homo sapiens
gcagaggctccattttacagat

SEQ ID NO: 7373050 - DNA, 22 bp, Homo sapiens
gcagaggctctttaatgcttag

SEQ ID NO: 7373051 - DNA, 22 bp, Homo sapiens
gcagaggctgggtgtcccagtc

SEQ ID NO: 7373052 - DNA, 22 bp, Homo sapiens
gcagaggctgggtgtcccagtc

SEQ ID NO: 7373053 - DNA, 22 bp, Homo sapiens
gcagaggctgtagggaaggttg

SEQ ID NO: 7373054 - DNA, 22 bp, Homo sapiens
gcagatgaagtttacaggaaac

SEQ ID NO: 7373055 - DNA, 22 bp, Homo sapiens
gcagagtttgaagtcaagatgt

SEQ ID NO: 7373056 - DNA, 20 bp, Homo sapiens
gcagatgagactcacagagg

SEQ ID NO: 7373057 - DNA, 22 bp, Homo sapiens
gcagagtttctggcacattgga

SEQ ID NO: 7373058 - DNA, 22 bp, Homo sapiens
gcagagttggagccagcccagg

SEQ ID NO: 7373059 - DNA, 22 bp, Homo sapiens
gcagagttctcttccagctaac

SEQ ID NO: 7373060 - DNA, 22 bp, Homo sapiens
gcagagttgatgcaagtactga

SEQ ID NO: 7373061 - DNA, 22 bp, Homo sapiens
gcagcctgttgtaccagcctgt

SEQ ID NO: 7373062 - DNA, 17 bp, Homo sapiens
gcagcctcttggtagtg

SEQ ID NO: 7373063 - DNA, 22 bp, Homo sapiens
gcagcctgaggccctttctggc

SEQ ID NO: 7373064 - DNA, 18 bp, Homo sapiens
gcaggagatgggtggggt

SEQ ID NO: 7373065 - DNA, 22 bp, Homo sapiens
gcaggagagtctgtgccaggtt

SEQ ID NO: 7373066 - DNA, 22 bp, Homo sapiens
gcagccttcagtttggcaggag

SEQ ID NO: 7373067 - DNA, 22 bp, Homo sapiens
gcagccttccgtggacctggac

SEQ ID NO: 7373068 - DNA, 21 bp, Homo sapiens
gcagccaggactttgggctgg

SEQ ID NO: 7373069 - DNA, 22 bp, Homo sapiens
gcagatgcctgaaggagctggg

SEQ ID NO: 7373070 - DNA, 22 bp, Homo sapiens
gcagatgctgagatttatttct

SEQ ID NO: 7373071 - DNA, 22 bp, Homo sapiens
gcagatgctgctcctctctaga

SEQ ID NO: 7373072 - DNA, 22 bp, Homo sapiens
gcagatgcaagggtactggggc

SEQ ID NO: 7373073 - DNA, 22 bp, Homo sapiens
gcagatgatgtagacagacagt

SEQ ID NO: 7373074 - DNA, 22 bp, Homo sapiens
gcagatgcagaactcagtgggt

SEQ ID NO: 7373075 - DNA, 22 bp, Homo sapiens
gcagatgcagagatggctgggg

SEQ ID NO: 7373076 - DNA, 22 bp, Homo sapiens
atttcttccttctcctagaaga

SEQ ID NO: 7373077 - DNA, 22 bp, Homo sapiens
atttcttccttctcctagaaga

SEQ ID NO: 7373078 - DNA, 22 bp, Homo sapiens
atttgcaaaggttaacagcagt

SEQ ID NO: 7373079 - DNA, 22 bp, Homo sapiens
atttgcaattactcatgtcatt

SEQ ID NO: 7373080 - DNA, 22 bp, Homo sapiens
attttaataagattcccaagta

SEQ ID NO: 7373081 - DNA, 22 bp, Homo sapiens
atttgccatgaagagtgtttga

SEQ ID NO: 7373082 - DNA, 22 bp, Homo sapiens
atttgccatgaagagtgtttga

SEQ ID NO: 7373083 - DNA, 21 bp, Homo sapiens
atttgcattaaaatattacgc

SEQ ID NO: 7373084 - DNA, 22 bp, Homo sapiens
atttgcattgtagaccctctaa

SEQ ID NO: 7373085 - DNA, 22 bp, Homo sapiens
atttgcatttacatagcataga

SEQ ID NO: 7373086 - DNA, 22 bp, Homo sapiens
atttgcatttacatagcataga

SEQ ID NO: 7373087 - DNA, 22 bp, Homo sapiens
gcctgcctagaattgcagcttt

SEQ ID NO: 7373088 - DNA, 22 bp, Homo sapiens
attttctagatagatgatgcat

SEQ ID NO: 7373089 - DNA, 22 bp, Homo sapiens
attttacataaggaaggtttaa

SEQ ID NO: 7373090 - DNA, 22 bp, Homo sapiens
attttactactccaattaatga

SEQ ID NO: 7373091 - DNA, 22 bp, Homo sapiens
attttactaagtggatatctgt

SEQ ID NO: 7373092 - DNA, 22 bp, Homo sapiens
attttactaagtggatatctgt

SEQ ID NO: 7373093 - DNA, 22 bp, Homo sapiens
attttctagatagatgatgcat

SEQ ID NO: 7373094 - DNA, 22 bp, Homo sapiens
attttctagatagatgatgcat

SEQ ID NO: 7373095 - DNA, 22 bp, Homo sapiens
attttgaaaagcatttgagtaa

SEQ ID NO: 7373096 - DNA, 22 bp, Homo sapiens
attttgaaatacttgaaggaaa

SEQ ID NO: 7373097 - DNA, 22 bp, Homo sapiens
attttgaaaccaagttatttcc

SEQ ID NO: 7373098 - DNA, 22 bp, Homo sapiens
attttgaaaccaagttatttcc

SEQ ID NO: 7373099 - DNA, 18 bp, Homo sapiens
attttgaacaatgctgta

SEQ ID NO: 7373100 - DNA, 22 bp, Homo sapiens
gcccagccagagctgtgtgatg

SEQ ID NO: 7373101 - DNA, 22 bp, Homo sapiens
gcccagcccagaaaggttcgga

SEQ ID NO: 7373102 - DNA, 22 bp, Homo sapiens
gcccagccacagtcactttcat

SEQ ID NO: 7373103 - DNA, 22 bp, Homo sapiens
gccagaggtatcaaagatagta

SEQ ID NO: 7373104 - DNA, 18 bp, Homo sapiens
gccagaggtactactgat

SEQ ID NO: 7373105 - DNA, 22 bp, Homo sapiens
gccagaggggctcgaaggcgcg

SEQ ID NO: 7373106 - DNA, 18 bp, Homo sapiens
gccagagggcccaaggtc

SEQ ID NO: 7373107 - DNA, 22 bp, Homo sapiens
atttacagtttagcatttcaag

SEQ ID NO: 7373108 - DNA, 22 bp, Homo sapiens
atttacataatagactttaggt

SEQ ID NO: 7373109 - DNA, 22 bp, Homo sapiens
gccagagggattcctggtgtgt

SEQ ID NO: 7373110 - DNA, 18 bp, Homo sapiens
gccagagggaagcaggtg

SEQ ID NO: 7373111 - DNA, 22 bp, Homo sapiens
atttaccagtgctgacatttga

SEQ ID NO: 7373112 - DNA, 22 bp, Homo sapiens
atttaccagctgtgcactgata

SEQ ID NO: 7373113 - DNA, 22 bp, Homo sapiens
gcccagcccctgggtggacgtg

SEQ ID NO: 7373114 - DNA, 22 bp, Homo sapiens
gcccaggagttcaagtctagtg

SEQ ID NO: 7373115 - DNA, 23 bp, Homo sapiens
gccctgcccttagcacactcaca

SEQ ID NO: 7373116 - DNA, 22 bp, Homo sapiens
atttcttccttctcctagaaga

SEQ ID NO: 7373117 - DNA, 23 bp, Homo sapiens
gccctgcccttagcacactcaca

SEQ ID NO: 7373118 - DNA, 22 bp, Homo sapiens
gccctgccctgagccgtagacc

SEQ ID NO: 7373119 - DNA, 22 bp, Homo sapiens
gccctgcaccccaatggcatga

SEQ ID NO: 7373120 - DNA, 22 bp, Homo sapiens
gccctcccctctgggtggtgag

SEQ ID NO: 7373121 - DNA, 23 bp, Homo sapiens
gccctccctcccaggtgggtgtt

SEQ ID NO: 7373122 - DNA, 19 bp, Homo sapiens
gccctcctcactgagctct

SEQ ID NO: 7373123 - DNA, 17 bp, Homo sapiens
gctccaggcgtgagtga

SEQ ID NO: 7373124 - DNA, 22 bp, Homo sapiens
gctcgcctggctggatctgggt

SEQ ID NO: 7373125 - DNA, 22 bp, Homo sapiens
gcgtgtcaatctatctgttcca

SEQ ID NO: 7373126 - DNA, 22 bp, Homo sapiens
gctaatcaatgttaaggctgtg

SEQ ID NO: 7373127 - DNA, 23 bp, Homo sapiens
gctcaggcatcattcttcctggc

SEQ ID NO: 7373128 - DNA, 22 bp, Homo sapiens
gctcaaagaggcctccaaatcc

SEQ ID NO: 7373129 - DNA, 22 bp, Homo sapiens
gctcaaagcactttgcaaatat

SEQ ID NO: 7373130 - DNA, 22 bp, Homo sapiens
gctcaaagaatattcagaatga

SEQ ID NO: 7373131 - DNA, 22 bp, Homo sapiens
caaatcatggaataactagaga

SEQ ID NO: 7373132 - DNA, 22 bp, Homo sapiens
gctgagaacagagctctgagct

SEQ ID NO: 7373133 - DNA, 22 bp, Homo sapiens
caaatgaatatttccatgggtt

SEQ ID NO: 7373134 - DNA, 22 bp, Homo sapiens
atgtttcaccagttttataaga

SEQ ID NO: 7373135 - DNA, 22 bp, Homo sapiens
atgtttcaccagcaaattacct

SEQ ID NO: 7373136 - DNA, 22 bp, Homo sapiens
atgtttatgttgggctatattt

SEQ ID NO: 7373137 - DNA, 22 bp, Homo sapiens
atgtttattttgcagagtaggg

SEQ ID NO: 7373138 - DNA, 22 bp, Homo sapiens
atgtttaatcggctgcctttcc

SEQ ID NO: 7373139 - DNA, 22 bp, Homo sapiens
atgtttcagggtgatagaaggt

SEQ ID NO: 7373140 - DNA, 22 bp, Homo sapiens
atgtttcagatacagatcaaat

SEQ ID NO: 7373141 - DNA, 22 bp, Homo sapiens
atgtttcagttctaaagttaga

SEQ ID NO: 7373142 - DNA, 22 bp, Homo sapiens
atgtttcatgactgagcaaaat

SEQ ID NO: 7373143 - DNA, 22 bp, Homo sapiens
gagtccaggctggtcaaatagc

SEQ ID NO: 7373144 - DNA, 22 bp, Homo sapiens
gatctcaaagcagtgtgggttg

SEQ ID NO: 7373145 - DNA, 22 bp, Homo sapiens
atgtttcccagagcaaatctgg

SEQ ID NO: 7373146 - DNA, 22 bp, Homo sapiens
atgtttccatagaagtcacagt

SEQ ID NO: 7373147 - DNA, 22 bp, Homo sapiens
gagttatttgtagggattatat

SEQ ID NO: 7373148 - DNA, 22 bp, Homo sapiens
gagttattaatggctgagtttg

SEQ ID NO: 7373149 - DNA, 22 bp, Homo sapiens
gagttaattcgaatattctagc

SEQ ID NO: 7373150 - DNA, 23 bp, Homo sapiens
gaggccacattcccctgcttgag

SEQ ID NO: 7373151 - DNA, 22 bp, Homo sapiens
gaggccacagtgtctgggggcc

SEQ ID NO: 7373152 - DNA, 22 bp, Homo sapiens
gaggccacattacttggtgggt

SEQ ID NO: 7373153 - DNA, 22 bp, Homo sapiens
gaggccaatcaatagggcaata

SEQ ID NO: 7373154 - DNA, 22 bp, Homo sapiens
gaggccaagttggagaccaggt

SEQ ID NO: 7373155 - DNA, 17 bp, Homo sapiens
gaggccaaggcaggcgg

SEQ ID NO: 7373156 - DNA, 22 bp, Homo sapiens
gaggccaaggtgggcagatcac

SEQ ID NO: 7373157 - DNA, 22 bp, Homo sapiens
atgtcacatggttctggggcct

SEQ ID NO: 7373158 - DNA, 22 bp, Homo sapiens
gaggcattaaagggaatcttct

SEQ ID NO: 7373159 - DNA, 22 bp, Homo sapiens
atgtcacatggtcacctctagc

SEQ ID NO: 7373160 - DNA, 22 bp, Homo sapiens
atgtcacatggtcacctctagc

SEQ ID NO: 7373161 - DNA, 22 bp, Homo sapiens
atgtcacatgagagcgcagcac

SEQ ID NO: 7373162 - DNA, 22 bp, Homo sapiens
atgtcacatctgggatggccct

SEQ ID NO: 7373163 - DNA, 22 bp, Homo sapiens
gagggcacaaaggcaacattca

SEQ ID NO: 7373164 - DNA, 22 bp, Homo sapiens
gagggatgtgcctgaaggcagg

SEQ ID NO: 7373165 - DNA, 22 bp, Homo sapiens
gagggaagaaagaattgatgcg

SEQ ID NO: 7373166 - DNA, 22 bp, Homo sapiens
gagggcagaaaattatgcggtg

SEQ ID NO: 7373167 - DNA, 22 bp, Homo sapiens
gagggcacgaaacaaccacttc

SEQ ID NO: 7373168 - DNA, 22 bp, Homo sapiens
gagtccaggatttgagctctgt

SEQ ID NO: 7373169 - DNA, 22 bp, Homo sapiens
gagtccaggctgttgctcatct

SEQ ID NO: 7373170 - DNA, 22 bp, Homo sapiens
gaggtagcgagtggacagtgca

SEQ ID NO: 7373171 - DNA, 22 bp, Homo sapiens
gaggtagccacagatagagact

SEQ ID NO: 7373172 - DNA, 22 bp, Homo sapiens
gaggtagcatgctggaagggac

SEQ ID NO: 7373173 - DNA, 22 bp, Homo sapiens
gaggtagcgagtggacagtgca

SEQ ID NO: 7373174 - DNA, 17 bp, Homo sapiens
gaggtaggaagtgagtc

SEQ ID NO: 7373175 - DNA, 22 bp, Homo sapiens
gaggtactttctggttcaggtg

SEQ ID NO: 7373176 - DNA, 22 bp, Homo sapiens
gagcagggagacaactctggtg

SEQ ID NO: 7373177 - DNA, 22 bp, Homo sapiens
gagcagctctgtgcctggagac

SEQ ID NO: 7373178 - DNA, 22 bp, Homo sapiens
gagcagtgaagacagaagtaca

SEQ ID NO: 7373179 - DNA, 22 bp, Homo sapiens
gagcagtagagtacatggctcc

SEQ ID NO: 7373180 - DNA, 22 bp, Homo sapiens
gagcctgtgagccccaactcca

SEQ ID NO: 7373181 - DNA, 22 bp, Homo sapiens
gagcctgtgtttcctgtagcca

SEQ ID NO: 7373182 - DNA, 22 bp, Homo sapiens
gagcctgggtccttccctggga

SEQ ID NO: 7373183 - DNA, 22 bp, Homo sapiens
gagcctggcctcctgcctcagc

SEQ ID NO: 7373184 - DNA, 21 bp, Homo sapiens
atggaaaaacaggtagagcat

SEQ ID NO: 7373185 - DNA, 22 bp, Homo sapiens
atgctttttaaacttaattgga

SEQ ID NO: 7373186 - DNA, 22 bp, Homo sapiens
gagcagctcaggcacttagcca

SEQ ID NO: 7373187 - DNA, 22 bp, Homo sapiens
gagcagctcagaggactagtgt

SEQ ID NO: 7373188 - DNA, 22 bp, Homo sapiens
gagcagctccagccgcatgact

SEQ ID NO: 7373189 - DNA, 22 bp, Homo sapiens
gagcagctaaaattctcatgca

SEQ ID NO: 7373190 - DNA, 22 bp, Homo sapiens
gagcagctagataaagcccttc

SEQ ID NO: 7373191 - DNA, 22 bp, Homo sapiens
gagctttgagattcttatggta

SEQ ID NO: 7373192 - DNA, 22 bp, Homo sapiens
gagctttgatcgctaagcctca

SEQ ID NO: 7373193 - DNA, 22 bp, Homo sapiens
gagctttaagggataaaatgat

SEQ ID NO: 7373194 - DNA, 22 bp, Homo sapiens
gaggaaggagggaaagcgcgcg

SEQ ID NO: 7373195 - DNA, 22 bp, Homo sapiens
gagctttgcattattcagaagc

SEQ ID NO: 7373196 - DNA, 22 bp, Homo sapiens
gagctttgcctaaaactagaat

SEQ ID NO: 7373197 - DNA, 22 bp, Homo sapiens
gagctttggggaagaatacaga

SEQ ID NO: 7373198 - DNA, 22 bp, Homo sapiens
gagctttgctggaagcctgggg

SEQ ID NO: 7373199 - DNA, 22 bp, Homo sapiens
gagctttgttccgtggtggcac

SEQ ID NO: 7373200 - DNA, 22 bp, Homo sapiens
gagctttgtgctggtaggtggt

SEQ ID NO: 7373201 - DNA, 22 bp, Homo sapiens
gagctttgtctcctggagaccc

SEQ ID NO: 7373202 - DNA, 22 bp, Homo sapiens
gagctttgtcccttgggggctc

SEQ ID NO: 7373203 - DNA, 22 bp, Homo sapiens
gagctttgtagcaggaaggaag

SEQ ID NO: 7373204 - DNA, 22 bp, Homo sapiens
gagctttggtgccaagtatttg

SEQ ID NO: 7373205 - DNA, 22 bp, Homo sapiens
gagctttgtaaaaaacttgcac

SEQ ID NO: 7373206 - DNA, 22 bp, Homo sapiens
gaggaagcagggcttggctgag

SEQ ID NO: 7373207 - DNA, 22 bp, Homo sapiens
gaggaagctgcgtggcatttca

SEQ ID NO: 7373208 - DNA, 22 bp, Homo sapiens
atgtacaaaatgttttgaaatg

SEQ ID NO: 7373209 - DNA, 22 bp, Homo sapiens
atgtcacagtctgactcagtga

SEQ ID NO: 7373210 - DNA, 22 bp, Homo sapiens
atgtcacagtctgactcagtga

SEQ ID NO: 7373211 - DNA, 22 bp, Homo sapiens
atgtcacagcaggagtattctt

SEQ ID NO: 7373212 - DNA, 22 bp, Homo sapiens
atgtcacagcaggagtattctt

SEQ ID NO: 7373213 - DNA, 22 bp, Homo sapiens
atgtcacagctcccattcctcc

SEQ ID NO: 7373214 - DNA, 22 bp, Homo sapiens
atgtcacagcaggagtattctt

SEQ ID NO: 7373215 - DNA, 22 bp, Homo sapiens
atgtcacaaaagtcccattatg

SEQ ID NO: 7373216 - DNA, 22 bp, Homo sapiens
atgtaaggagccacagtggggg

SEQ ID NO: 7373217 - DNA, 22 bp, Homo sapiens
atgtaatttatgttatccataa

SEQ ID NO: 7373218 - DNA, 21 bp, Homo sapiens
gaatgtctgccttcacaatga

SEQ ID NO: 7373219 - DNA, 19 bp, Homo sapiens
gaatgtctcctacttctga

SEQ ID NO: 7373220 - DNA, 22 bp, Homo sapiens
gaatgtctgtttcaacaagcac

SEQ ID NO: 7373221 - DNA, 22 bp, Homo sapiens
gaatgtcttattgctcgttgta

SEQ ID NO: 7373222 - DNA, 22 bp, Homo sapiens
gaatgtcttcaaaactagactg

SEQ ID NO: 7373223 - DNA, 22 bp, Homo sapiens
gaatgtctttttggtacttata

SEQ ID NO: 7373224 - DNA, 22 bp, Homo sapiens
gaatgtcttctgttcccagctg

SEQ ID NO: 7373225 - DNA, 22 bp, Homo sapiens
gaatgtctatgtaaccgagggg

SEQ ID NO: 7373226 - DNA, 22 bp, Homo sapiens
gaatgtctccaacttggggaaa

SEQ ID NO: 7373227 - DNA, 22 bp, Homo sapiens
gaatgtctaaacatagctttta

SEQ ID NO: 7373228 - DNA, 22 bp, Homo sapiens
gaatgttatgtatccagtcaca

SEQ ID NO: 7373229 - DNA, 22 bp, Homo sapiens
gaatgttaatgcacttctagct

SEQ ID NO: 7373230 - DNA, 22 bp, Homo sapiens
atgcatataaggcacatgtatt

SEQ ID NO: 7373231 - DNA, 22 bp, Homo sapiens
atgcatataaggcacatgtatt

SEQ ID NO: 7373232 - DNA, 22 bp, Homo sapiens
atgcatatatacatacacagtc

SEQ ID NO: 7373233 - DNA, 22 bp, Homo sapiens
atgcatatagaacatttgacat

SEQ ID NO: 7373234 - DNA, 22 bp, Homo sapiens
atgcatatagaacatttgacat

SEQ ID NO: 7373235 - DNA, 22 bp, Homo sapiens
atgcatatagaacatttgacat

SEQ ID NO: 7373236 - DNA, 22 bp, Homo sapiens
gaagcacatggctatagctatt

SEQ ID NO: 7373237 - DNA, 22 bp, Homo sapiens
atgcacaaggtagattattatt

SEQ ID NO: 7373238 - DNA, 22 bp, Homo sapiens
gaagcagaaggtttggacgtgc

SEQ ID NO: 7373239 - DNA, 22 bp, Homo sapiens
gaagcagacttttgcttatttg

SEQ ID NO: 7373240 - DNA, 22 bp, Homo sapiens
gaagcagagcctaaggcagaca

SEQ ID NO: 7373241 - DNA, 22 bp, Homo sapiens
atgccccaggaggtgccatcca

SEQ ID NO: 7373242 - DNA, 22 bp, Homo sapiens
atgccctgctgccatctggccg

SEQ ID NO: 7373243 - DNA, 22 bp, Homo sapiens
atgccctgaggaatgtcacgct

SEQ ID NO: 7373244 - DNA, 22 bp, Homo sapiens
atgcctccttctgaaacagggc

SEQ ID NO: 7373245 - DNA, 22 bp, Homo sapiens
atgcctctgctcttggtcctca

SEQ ID NO: 7373246 - DNA, 20 bp, Homo sapiens
atgcctctaattttgcaaac

SEQ ID NO: 7373247 - DNA, 22 bp, Homo sapiens
atgcctcctgtgccactgtgat

SEQ ID NO: 7373248 - DNA, 22 bp, Homo sapiens
atgcctcctcaaatctgccaca

SEQ ID NO: 7373249 - DNA, 22 bp, Homo sapiens
gacaggaacataaatgtaggag

SEQ ID NO: 7373250 - DNA, 22 bp, Homo sapiens
gacaggaaatatgggggttgtt

SEQ ID NO: 7373251 - DNA, 22 bp, Homo sapiens
gacaggaaaggggtctgttttc

SEQ ID NO: 7373252 - DNA, 22 bp, Homo sapiens
gacagggaggaaagagactgct

SEQ ID NO: 7373253 - DNA, 22 bp, Homo sapiens
atgcctccaagattcttacgtt

SEQ ID NO: 7373254 - DNA, 22 bp, Homo sapiens
atgcctcccctgtgtcttttat

SEQ ID NO: 7373255 - DNA, 22 bp, Homo sapiens
atgcctccctgtccttcagttc

SEQ ID NO: 7373256 - DNA, 22 bp, Homo sapiens
atgcctccgcatgtgcctttga

SEQ ID NO: 7373257 - DNA, 20 bp, Homo sapiens
atgccctgtcctcttctgtt

SEQ ID NO: 7373258 - DNA, 22 bp, Homo sapiens
gaccctgactctaatgcttggc

SEQ ID NO: 7373259 - DNA, 22 bp, Homo sapiens
gaccctgaggatgcaccagcag

SEQ ID NO: 7373260 - DNA, 22 bp, Homo sapiens
gaccccaggcagatcagggggt

SEQ ID NO: 7373261 - DNA, 22 bp, Homo sapiens
gaccccagaggaaggggcgccg

SEQ ID NO: 7373262 - DNA, 19 bp, Homo sapiens
atgctttatgttatttctt

SEQ ID NO: 7373263 - DNA, 22 bp, Homo sapiens
gaccctccactcactgctgtgt

SEQ ID NO: 7373264 - DNA, 22 bp, Homo sapiens
atgctttcttctttcctgtaag

SEQ ID NO: 7373265 - DNA, 22 bp, Homo sapiens
atgcttttaactcctttatccc

SEQ ID NO: 7373266 - DNA, 22 bp, Homo sapiens
atgcttttccaggagaaatata

SEQ ID NO: 7373267 - DNA, 22 bp, Homo sapiens
atgcttttcctaaaatgatgcc

SEQ ID NO: 7373268 - DNA, 22 bp, Homo sapiens
atgcttttcctaaaatgatgcc

SEQ ID NO: 7373269 - DNA, 22 bp, Homo sapiens
gactttgccacttgctccagct

SEQ ID NO: 7373270 - DNA, 21 bp, Homo sapiens
gactttcttaccagatttttg

SEQ ID NO: 7373271 - DNA, 22 bp, Homo sapiens
gactttctgtccagtgatttct

SEQ ID NO: 7373272 - DNA, 22 bp, Homo sapiens
gactttctgctatactttctgt

SEQ ID NO: 7373273 - DNA, 22 bp, Homo sapiens
gacagtgttacaatttaatgga

SEQ ID NO: 7373274 - DNA, 22 bp, Homo sapiens
gacagtggttccaaggcagctt

SEQ ID NO: 7373275 - DNA, 22 bp, Homo sapiens
gacagtggattcatctagtcaa

SEQ ID NO: 7373276 - DNA, 20 bp, Homo sapiens
atgcttaagtgttcattatt

SEQ ID NO: 7373277 - DNA, 22 bp, Homo sapiens
atgcttaacttcctagtctata

SEQ ID NO: 7373278 - DNA, 22 bp, Homo sapiens
atgcttaagctcagttatatat

SEQ ID NO: 7373279 - DNA, 22 bp, Homo sapiens
atgctttatacaaaacacttaa

SEQ ID NO: 7373280 - DNA, 22 bp, Homo sapiens
atgctttatacaaaacacttaa

SEQ ID NO: 7373281 - DNA, 22 bp, Homo sapiens
atgctttacagttttccaaaca

SEQ ID NO: 7373282 - DNA, 22 bp, Homo sapiens
atcttcagcgaggtttcctttc

SEQ ID NO: 7373283 - DNA, 22 bp, Homo sapiens
atcttcaactttggggctgcct

SEQ ID NO: 7373284 - DNA, 22 bp, Homo sapiens
atcttcaactcagagagtgctg

SEQ ID NO: 7373285 - DNA, 19 bp, Homo sapiens
atcttcaaagccagcagca

SEQ ID NO: 7373286 - DNA, 22 bp, Homo sapiens
atcttcccaggctggggagagg

SEQ ID NO: 7373287 - DNA, 22 bp, Homo sapiens
atcttcccaggctggggagagg

SEQ ID NO: 7373288 - DNA, 22 bp, Homo sapiens
atcttcccaggctggggagagg

SEQ ID NO: 7373289 - DNA, 22 bp, Homo sapiens
atgaatcaaactgtacactgag

SEQ ID NO: 7373290 - DNA, 20 bp, Homo sapiens
atgaatattttggtctttcc

SEQ ID NO: 7373291 - DNA, 22 bp, Homo sapiens
atgaatatgagactgagagcct

SEQ ID NO: 7373292 - DNA, 22 bp, Homo sapiens
atgaatacgcggtcatacacat

SEQ ID NO: 7373293 - DNA, 22 bp, Homo sapiens
cttgaggtatgaaacctgcatt

SEQ ID NO: 7373294 - DNA, 22 bp, Homo sapiens
cttgagagggagtagtttagga

SEQ ID NO: 7373295 - DNA, 22 bp, Homo sapiens
atgaagcagttaaggtgcatga

SEQ ID NO: 7373296 - DNA, 22 bp, Homo sapiens
gaaaatagttcatcacaatgat

SEQ ID NO: 7373297 - DNA, 22 bp, Homo sapiens
gaaaatgagcctcagctacatt

SEQ ID NO: 7373298 - DNA, 22 bp, Homo sapiens
gaaaataggctgcatctccttc

SEQ ID NO: 7373299 - DNA, 22 bp, Homo sapiens
gaaaataggcagatgcattgta

SEQ ID NO: 7373300 - DNA, 22 bp, Homo sapiens
gaaaatagcagatagaccaatg

SEQ ID NO: 7373301 - DNA, 20 bp, Homo sapiens
gaaaataggccagccaggta

SEQ ID NO: 7373302 - DNA, 22 bp, Homo sapiens
gaaaactaacggaaaagttagg

SEQ ID NO: 7373303 - DNA, 22 bp, Homo sapiens
gaaaactaacggaaaagttagg

SEQ ID NO: 7373304 - DNA, 22 bp, Homo sapiens
gaaaagaactgcatgggattaa

SEQ ID NO: 7373305 - DNA, 22 bp, Homo sapiens
gaaaagagaacatctgaggatc

SEQ ID NO: 7373306 - DNA, 22 bp, Homo sapiens
gaactttattccagaagaaagc

SEQ ID NO: 7373307 - DNA, 22 bp, Homo sapiens
gaactttaaaacaaagtacagt

SEQ ID NO: 7373308 - DNA, 22 bp, Homo sapiens
gaacatttgatgatgacattgg

SEQ ID NO: 7373309 - DNA, 22 bp, Homo sapiens
gaactttataactgtaaatgtc

SEQ ID NO: 7373310 - DNA, 22 bp, Homo sapiens
gaacatctgttaaataaaggta

SEQ ID NO: 7373311 - DNA, 22 bp, Homo sapiens
gaacattcacagactcaccatt

SEQ ID NO: 7373312 - DNA, 23 bp, Homo sapiens
gaacattcattggttgctttaga

SEQ ID NO: 7373313 - DNA, 22 bp, Homo sapiens
gaagaaagatcaaatagtttcc

SEQ ID NO: 7373314 - DNA, 22 bp, Homo sapiens
gaagaaagatcaaatagtttcc

SEQ ID NO: 7373315 - DNA, 22 bp, Homo sapiens
gaagaaagattggcatgcttca

SEQ ID NO: 7373316 - DNA, 22 bp, Homo sapiens
atgcaatttactgtacataaat

SEQ ID NO: 7373317 - DNA, 21 bp, Homo sapiens
atgcacaaaaagactctttct

SEQ ID NO: 7373318 - DNA, 22 bp, Homo sapiens
atgcacaagaggctagaaaaga

SEQ ID NO: 7373319 - DNA, 22 bp, Homo sapiens
atgcaatgttacagaatgtact

SEQ ID NO: 7373320 - DNA, 22 bp, Homo sapiens
atgaggcagtctggcctgaggg

SEQ ID NO: 7373321 - DNA, 22 bp, Homo sapiens
atgaggcatctgcagtcactag

SEQ ID NO: 7373322 - DNA, 22 bp, Homo sapiens
atgaggcattcacagaaggcac

SEQ ID NO: 7373323 - DNA, 23 bp, Homo sapiens
atgaggcattaaacaggcttttt

SEQ ID NO: 7373324 - DNA, 22 bp, Homo sapiens
gaacatcagtcataatttaacg

SEQ ID NO: 7373325 - DNA, 22 bp, Homo sapiens
gaacatcatgaagaaaacatat

SEQ ID NO: 7373326 - DNA, 22 bp, Homo sapiens
ggctgccttgaccctggctccg

SEQ ID NO: 7373327 - DNA, 22 bp, Homo sapiens
ggctgccttgaccctggctccg

SEQ ID NO: 7373328 - DNA, 22 bp, Homo sapiens
ggctgcctcaattaatcttaca

SEQ ID NO: 7373329 - DNA, 22 bp, Homo sapiens
ggctgcctcagatttgctgact

SEQ ID NO: 7373330 - DNA, 22 bp, Homo sapiens
ggctgcctcagatttgctgact

SEQ ID NO: 7373331 - DNA, 22 bp, Homo sapiens
ggctgccttgaccctggctccg

SEQ ID NO: 7373332 - DNA, 22 bp, Homo sapiens
ggctgcctcaaagctcaagctc

SEQ ID NO: 7373333 - DNA, 19 bp, Homo sapiens
ggctgcctttccttaccag

SEQ ID NO: 7373334 - DNA, 19 bp, Homo sapiens
ggctgcctttccttaccag

SEQ ID NO: 7373335 - DNA, 22 bp, Homo sapiens
ggctgccttgggggttgtcatt

SEQ ID NO: 7373336 - DNA, 22 bp, Homo sapiens
ggctgcctttagaacggatgct

SEQ ID NO: 7373337 - DNA, 22 bp, Homo sapiens
ggctgcctttagaacggatgct

SEQ ID NO: 7373338 - DNA, 22 bp, Homo sapiens
ggctgcagaggcgatctgaggt

SEQ ID NO: 7373339 - DNA, 22 bp, Homo sapiens
cactgcctccccaggctccaca

SEQ ID NO: 7373340 - DNA, 22 bp, Homo sapiens
cactgcctccccaggctccaca

SEQ ID NO: 7373341 - DNA, 22 bp, Homo sapiens
cactgcctctgcctcctgggtt

SEQ ID NO: 7373342 - DNA, 20 bp, Homo sapiens
ggcgcctggcctcatggctg

SEQ ID NO: 7373343 - DNA, 19 bp, Homo sapiens
ggctcctggggctcagccc

SEQ ID NO: 7373344 - DNA, 18 bp, Homo sapiens
ggctcctgtgatcacatt

SEQ ID NO: 7373345 - DNA, 22 bp, Homo sapiens
cagaacagacttaacagggctg

SEQ ID NO: 7373346 - DNA, 22 bp, Homo sapiens
ggcttgcttcttgtccaggaat

SEQ ID NO: 7373347 - DNA, 22 bp, Homo sapiens
ggcttcttcctggctcctatta

SEQ ID NO: 7373348 - DNA, 19 bp, Homo sapiens
ggcttcagggagttagcat

SEQ ID NO: 7373349 - DNA, 22 bp, Homo sapiens
cagaagaggactgggtagctca

SEQ ID NO: 7373350 - DNA, 22 bp, Homo sapiens
cagaacagagtcaaaagtatgt

SEQ ID NO: 7373351 - DNA, 22 bp, Homo sapiens
cagaaatgcctgcttctctctc

SEQ ID NO: 7373352 - DNA, 22 bp, Homo sapiens
cagaaatgcctgcttctctctc

SEQ ID NO: 7373353 - DNA, 19 bp, Homo sapiens
cagaaatagcgaagtgtaa

SEQ ID NO: 7373354 - DNA, 22 bp, Homo sapiens
cagaaatggagcccaggaatct

SEQ ID NO: 7373355 - DNA, 22 bp, Homo sapiens
cagaaatggagcccaggaatct

SEQ ID NO: 7373356 - DNA, 22 bp, Homo sapiens
cagaaatgtactgacatgcagt

SEQ ID NO: 7373357 - DNA, 22 bp, Homo sapiens
cagaaatgtactgacatgcagt

SEQ ID NO: 7373358 - DNA, 22 bp, Homo sapiens
ggcaggtgtgagatcgaggcca

SEQ ID NO: 7373359 - DNA, 22 bp, Homo sapiens
ggcaggtgtggagtgttatttt

SEQ ID NO: 7373360 - DNA, 22 bp, Homo sapiens
cacatgcccagaacttctcatt

SEQ ID NO: 7373361 - DNA, 22 bp, Homo sapiens
ggcaggttggatgctgtagtga

SEQ ID NO: 7373362 - DNA, 22 bp, Homo sapiens
cacatttctctacctcacacaa

SEQ ID NO: 7373363 - DNA, 22 bp, Homo sapiens
cacatttctgtacttaggtaga

SEQ ID NO: 7373364 - DNA, 22 bp, Homo sapiens
cacatgcagttttccagcagtc

SEQ ID NO: 7373365 - DNA, 22 bp, Homo sapiens
cacatgcagttttccagcagtc

SEQ ID NO: 7373366 - DNA, 22 bp, Homo sapiens
ggcaggagaaaggtctcttctt

SEQ ID NO: 7373367 - DNA, 21 bp, Homo sapiens
ggagtttttctggaagggact

SEQ ID NO: 7373368 - DNA, 23 bp, Homo sapiens
ggataaatctcagcttcttccat

SEQ ID NO: 7373369 - DNA, 22 bp, Homo sapiens
ggcagctgcaaatctgctctgt

SEQ ID NO: 7373370 - DNA, 22 bp, Homo sapiens
ggcaggaaaacaatgagccagg

SEQ ID NO: 7373371 - DNA, 19 bp, Homo sapiens
ggataaggttggagtgatc

SEQ ID NO: 7373372 - DNA, 22 bp, Homo sapiens
ggatcagaacgtgatggctgtg

SEQ ID NO: 7373373 - DNA, 20 bp, Homo sapiens
ggatcagatggagcctctgc

SEQ ID NO: 7373374 - DNA, 22 bp, Homo sapiens
ggccagctcagggtccttgggc

SEQ ID NO: 7373375 - DNA, 22 bp, Homo sapiens
cacccagccttcacacaggagt

SEQ ID NO: 7373376 - DNA, 22 bp, Homo sapiens
cacccaggcaaggattctgcaa

SEQ ID NO: 7373377 - DNA, 22 bp, Homo sapiens
cacccaggcaggtggctgagaa

SEQ ID NO: 7373378 - DNA, 22 bp, Homo sapiens
cacccaggacaggccagatgtg

SEQ ID NO: 7373379 - DNA, 22 bp, Homo sapiens
cacccaggacaaaatatggaat

SEQ ID NO: 7373380 - DNA, 22 bp, Homo sapiens
cacccaggacaggccagatgtg

SEQ ID NO: 7373381 - DNA, 22 bp, Homo sapiens
cacccaggcaggtggctgagaa

SEQ ID NO: 7373382 - DNA, 22 bp, Homo sapiens
cacccaggctagagtgcagtgg

SEQ ID NO: 7373383 - DNA, 22 bp, Homo sapiens
ggccagcctggggctcccagac

SEQ ID NO: 7373384 - DNA, 22 bp, Homo sapiens
ggccagcctggggctcccagac

SEQ ID NO: 7373385 - DNA, 22 bp, Homo sapiens
caccaagaatcttcacttttta

SEQ ID NO: 7373386 - DNA, 19 bp, Homo sapiens
cacattttgagtctgagat

SEQ ID NO: 7373387 - DNA, 22 bp, Homo sapiens
cacatttttactgccaacttaa

SEQ ID NO: 7373388 - DNA, 19 bp, Homo sapiens
cacattttgagtctgagat

SEQ ID NO: 7373389 - DNA, 22 bp, Homo sapiens
ggccccaggcctttggtctggc

SEQ ID NO: 7373390 - DNA, 22 bp, Homo sapiens
ggccccagggattaggccaacc

SEQ ID NO: 7373391 - DNA, 22 bp, Homo sapiens
ggcgccagcactgcagcgcctc

SEQ ID NO: 7373392 - DNA, 22 bp, Homo sapiens
ggcgccagcactgcagcgcctc

SEQ ID NO: 7373393 - DNA, 22 bp, Homo sapiens
ggcgccagcggtaagtaagaca

SEQ ID NO: 7373394 - DNA, 22 bp, Homo sapiens
ggcgccagcggtaagtaagaca

SEQ ID NO: 7373395 - DNA, 22 bp, Homo sapiens
ggcccagcacagtgcttggggg

SEQ ID NO: 7373396 - DNA, 22 bp, Homo sapiens
ggcccagagctccctggcacct

SEQ ID NO: 7373397 - DNA, 22 bp, Homo sapiens
ggcccagcccgagtcagccttc

SEQ ID NO: 7373398 - DNA, 22 bp, Homo sapiens
ggcccagcatcttgtgaagttt

SEQ ID NO: 7373399 - DNA, 22 bp, Homo sapiens
ggccccagcctcagtcccctga

SEQ ID NO: 7373400 - DNA, 22 bp, Homo sapiens
ggacaaaggtagacagtctctg

SEQ ID NO: 7373401 - DNA, 22 bp, Homo sapiens
ggacaagcctgtgagtgggttt

SEQ ID NO: 7373402 - DNA, 19 bp, Homo sapiens
ggaagagaggaaaggtgga

SEQ ID NO: 7373403 - DNA, 22 bp, Homo sapiens
ggaagagattctttacattcat

SEQ ID NO: 7373404 - DNA, 22 bp, Homo sapiens
ggaagagaggttcagccctaag

SEQ ID NO: 7373405 - DNA, 22 bp, Homo sapiens
ggaagagagatcccatagatgt

SEQ ID NO: 7373406 - DNA, 22 bp, Homo sapiens
cacagagaactgtgggagtgtg

SEQ ID NO: 7373407 - DNA, 22 bp, Homo sapiens
cacagagaatgatgagtcactg

SEQ ID NO: 7373408 - DNA, 22 bp, Homo sapiens
ggacagcattcctagttccaaa

SEQ ID NO: 7373409 - DNA, 22 bp, Homo sapiens
ggacagctcctgcacttgagta

SEQ ID NO: 7373410 - DNA, 21 bp, Homo sapiens
ggacagctgcgcgcagggctc

SEQ ID NO: 7373411 - DNA, 22 bp, Homo sapiens
ggagagctgaagcatggacagg

SEQ ID NO: 7373412 - DNA, 22 bp, Homo sapiens
cacaggagattgatctattggt

SEQ ID NO: 7373413 - DNA, 22 bp, Homo sapiens
ggaggggcatagttcaccatca

SEQ ID NO: 7373414 - DNA, 22 bp, Homo sapiens
cacagccttgagcgaggacaag

SEQ ID NO: 7373415 - DNA, 22 bp, Homo sapiens
cacagccttgagcgaggacaag

SEQ ID NO: 7373416 - DNA, 22 bp, Homo sapiens
cacagcctccttcagagagcat

SEQ ID NO: 7373417 - DNA, 22 bp, Homo sapiens
cacagcctcctctggctcacgg

SEQ ID NO: 7373418 - DNA, 22 bp, Homo sapiens
ggaggagacagtaaaaagcacg

SEQ ID NO: 7373419 - DNA, 22 bp, Homo sapiens
ggagcaggagtctcttgaattt

SEQ ID NO: 7373420 - DNA, 22 bp, Homo sapiens
ggagcaggagtctcttgaattt

SEQ ID NO: 7373421 - DNA, 22 bp, Homo sapiens
ggagcagcttgcatgctcaggg

SEQ ID NO: 7373422 - DNA, 22 bp, Homo sapiens
ggagcagcctgtgtagacgggg

SEQ ID NO: 7373423 - DNA, 22 bp, Homo sapiens
ggaggagcacttctgagctcag

SEQ ID NO: 7373424 - DNA, 22 bp, Homo sapiens
ggaggagagaggttgcaaacac

SEQ ID NO: 7373425 - DNA, 21 bp, Homo sapiens
cacagcagggttcctgggctc

SEQ ID NO: 7373426 - DNA, 22 bp, Homo sapiens
cacagcataatgaaatatactt

SEQ ID NO: 7373427 - DNA, 22 bp, Homo sapiens
cacagcagtctttcactaaata

SEQ ID NO: 7373428 - DNA, 22 bp, Homo sapiens
cacagcaggcactatacagggc

SEQ ID NO: 7373429 - DNA, 22 bp, Homo sapiens
cacagcagggcatggctgttgt

SEQ ID NO: 7373430 - DNA, 22 bp, Homo sapiens
cacagccctgcgccccagtttg

SEQ ID NO: 7373431 - DNA, 22 bp, Homo sapiens
ggagcagccacgtctcagggca

SEQ ID NO: 7373432 - DNA, 22 bp, Homo sapiens
ggagcagccgcgtctcagggca

SEQ ID NO: 7373433 - DNA, 22 bp, Homo sapiens
gctggccatggggagtgaggag

SEQ ID NO: 7373434 - DNA, 22 bp, Homo sapiens
gctggccatagaagccaaagag

SEQ ID NO: 7373435 - DNA, 22 bp, Homo sapiens
gctggccagtgtggtgaccacc

SEQ ID NO: 7373436 - DNA, 22 bp, Homo sapiens
gctggccatggcctgcgccatc

SEQ ID NO: 7373437 - DNA, 22 bp, Homo sapiens
gctggccatatattttgctgtt

SEQ ID NO: 7373438 - DNA, 22 bp, Homo sapiens
gctgggccccttgaaaggcgtc

SEQ ID NO: 7373439 - DNA, 22 bp, Homo sapiens
gctgggaggaatttggggaata

SEQ ID NO: 7373440 - DNA, 22 bp, Homo sapiens
gctgggaggaatttggggaata

SEQ ID NO: 7373441 - DNA, 22 bp, Homo sapiens
gctggaggctggagtgcagtgg

SEQ ID NO: 7373442 - DNA, 22 bp, Homo sapiens
ggaacacagtgccttacaaact

SEQ ID NO: 7373443 - DNA, 22 bp, Homo sapiens
ggaacacagaagggctgaaaaa

SEQ ID NO: 7373444 - DNA, 22 bp, Homo sapiens
ggaacacaaatgggagagctgg

SEQ ID NO: 7373445 - DNA, 22 bp, Homo sapiens
ggaacacaaatgggagagctgg

SEQ ID NO: 7373446 - DNA, 22 bp, Homo sapiens
caatgtatcaaccagaaagttc

SEQ ID NO: 7373447 - DNA, 22 bp, Homo sapiens
caatgcttttgttctttactca

SEQ ID NO: 7373448 - DNA, 22 bp, Homo sapiens
caatgcttcaggctccttatag

SEQ ID NO: 7373449 - DNA, 22 bp, Homo sapiens
caatgcttttagcttcagcttg

SEQ ID NO: 7373450 - DNA, 22 bp, Homo sapiens
caatgctttatttcctcccctt

SEQ ID NO: 7373451 - DNA, 22 bp, Homo sapiens
caatgcttttagcttcagcttg

SEQ ID NO: 7373452 - DNA, 22 bp, Homo sapiens
caagtgtgtaattactgggagc

SEQ ID NO: 7373453 - DNA, 22 bp, Homo sapiens
caatcgtagttgaaatgaatct

SEQ ID NO: 7373454 - DNA, 22 bp, Homo sapiens
caatctctggtgcttctgagag

SEQ ID NO: 7373455 - DNA, 22 bp, Homo sapiens
gctggtttcacccaaccgatgt

SEQ ID NO: 7373456 - DNA, 22 bp, Homo sapiens
gctggttagaaaacagagctca

SEQ ID NO: 7373457 - DNA, 22 bp, Homo sapiens
cagctcctagatcggcgaagtg

SEQ ID NO: 7373458 - DNA, 22 bp, Homo sapiens
cagctcctatgagtatgattcc

SEQ ID NO: 7373459 - DNA, 22 bp, Homo sapiens
cagctcccctctgtggggcagt

SEQ ID NO: 7373460 - DNA, 22 bp, Homo sapiens
cagctcccgccatcgggaggca

SEQ ID NO: 7373461 - DNA, 22 bp, Homo sapiens
cagctccctatggtgaggcgac

SEQ ID NO: 7373462 - DNA, 22 bp, Homo sapiens
cagctcctctggccagccctgc

SEQ ID NO: 7373463 - DNA, 22 bp, Homo sapiens
cagctctgaggaacactccttt

SEQ ID NO: 7373464 - DNA, 19 bp, Homo sapiens
gtgctgagatgtggtacta

SEQ ID NO: 7373465 - DNA, 22 bp, Homo sapiens
gtgctgagcacagctgcccagg

SEQ ID NO: 7373466 - DNA, 22 bp, Homo sapiens
gtgctgagcacaaggcccagag

SEQ ID NO: 7373467 - DNA, 22 bp, Homo sapiens
gtgctgagaattgatgtccttg

SEQ ID NO: 7373468 - DNA, 22 bp, Homo sapiens
gtgctgagatcttccctcactg

SEQ ID NO: 7373469 - DNA, 22 bp, Homo sapiens
cagccctgtgctaagcaccctc

SEQ ID NO: 7373470 - DNA, 22 bp, Homo sapiens
gtgcattcaggggttgacagga

SEQ ID NO: 7373471 - DNA, 22 bp, Homo sapiens
cagccctgtgcggagggccctg

SEQ ID NO: 7373472 - DNA, 22 bp, Homo sapiens
gtgcaggaggatgacaactgca

SEQ ID NO: 7373473 - DNA, 22 bp, Homo sapiens
gtgcaggagctcccgcagtggt

SEQ ID NO: 7373474 - DNA, 22 bp, Homo sapiens
gtgcaggagcttctggcctgac

SEQ ID NO: 7373475 - DNA, 22 bp, Homo sapiens
gtcctctgtgtaggctgcagac

SEQ ID NO: 7373476 - DNA, 22 bp, Homo sapiens
gtcctgcaaagttcagcttgct

SEQ ID NO: 7373477 - DNA, 22 bp, Homo sapiens
cagcatgcattttctctctttg

SEQ ID NO: 7373478 - DNA, 22 bp, Homo sapiens
cagcagtcacacaaactctgga

SEQ ID NO: 7373479 - DNA, 22 bp, Homo sapiens
cagcagtaactcccgtgcagca

SEQ ID NO: 7373480 - DNA, 22 bp, Homo sapiens
cagcagtctgtttcaacaggtc

SEQ ID NO: 7373481 - DNA, 22 bp, Homo sapiens
cagcagtctgtttcaacaggtc

SEQ ID NO: 7373482 - DNA, 22 bp, Homo sapiens
cagcagtcaggcaaatgggagg

SEQ ID NO: 7373483 - DNA, 22 bp, Homo sapiens
cagcagtcaggcctgtgggaga

SEQ ID NO: 7373484 - DNA, 22 bp, Homo sapiens
cagcagtccctgcagtggggaa

SEQ ID NO: 7373485 - DNA, 22 bp, Homo sapiens
cagcagtcttcccttccttttt

SEQ ID NO: 7373486 - DNA, 20 bp, Homo sapiens
cagcagtggatgagagtttt

SEQ ID NO: 7373487 - DNA, 22 bp, Homo sapiens
cagcagtggaactacccaggga

SEQ ID NO: 7373488 - DNA, 22 bp, Homo sapiens
cagcagtgcttcagtgtgagat

SEQ ID NO: 7373489 - DNA, 22 bp, Homo sapiens
cagcagagcatttggtaggagg

SEQ ID NO: 7373490 - DNA, 22 bp, Homo sapiens
cagcagagcatttggtaggagg

SEQ ID NO: 7373491 - DNA, 22 bp, Homo sapiens
cagcagagctgggaataaaatt

SEQ ID NO: 7373492 - DNA, 22 bp, Homo sapiens
cagcagagctgggctttgaatt

SEQ ID NO: 7373493 - DNA, 22 bp, Homo sapiens
cagcagagacggtaagcagaac

SEQ ID NO: 7373494 - DNA, 22 bp, Homo sapiens
cagcagagacggtaagcagaac

SEQ ID NO: 7373495 - DNA, 23 bp, Homo sapiens
cagcagagagcagacctttgtgt

SEQ ID NO: 7373496 - DNA, 22 bp, Homo sapiens
cagcagagatgagattcctata

SEQ ID NO: 7373497 - DNA, 22 bp, Homo sapiens
gtctcagtaagaaaggctcctg

SEQ ID NO: 7373498 - DNA, 22 bp, Homo sapiens
gtctcagttttccaaactgtca

SEQ ID NO: 7373499 - DNA, 18 bp, Homo sapiens
gtctttggagtggaggta

SEQ ID NO: 7373500 - DNA, 22 bp, Homo sapiens
gtctttggatgtaagataaagt

SEQ ID NO: 7373501 - DNA, 22 bp, Homo sapiens
gtctttggaggcactgttgagt

SEQ ID NO: 7373502 - DNA, 22 bp, Homo sapiens
gtctttggagaggtgccatttc

SEQ ID NO: 7373503 - DNA, 22 bp, Homo sapiens
gtctttggaaagacaaagttca

SEQ ID NO: 7373504 - DNA, 22 bp, Homo sapiens
gtgaggtagcagagacagtgaa

SEQ ID NO: 7373505 - DNA, 23 bp, Homo sapiens
gtgaggtatattgaaatcatgct

SEQ ID NO: 7373506 - DNA, 22 bp, Homo sapiens
gtgcaaaagtaattgcagtact

SEQ ID NO: 7373507 - DNA, 22 bp, Homo sapiens
gtgaatattctttgtgcagtat

SEQ ID NO: 7373508 - DNA, 22 bp, Homo sapiens
gtgaatgccgcagtctgttgct

SEQ ID NO: 7373509 - DNA, 22 bp, Homo sapiens
gtgaggtaaactgtagttcaga

SEQ ID NO: 7373510 - DNA, 22 bp, Homo sapiens
gtgaataaaacacctgccaaga

SEQ ID NO: 7373511 - DNA, 23 bp, Homo sapiens
gtgcaaagatataccacatggct

SEQ ID NO: 7373512 - DNA, 22 bp, Homo sapiens
gtgcaaagtgcatggggaaggg

SEQ ID NO: 7373513 - DNA, 22 bp, Homo sapiens
gtgcaggagccaggggtaggaa

SEQ ID NO: 7373514 - DNA, 22 bp, Homo sapiens
gtgcaggagcaggagccatgtc

SEQ ID NO: 7373515 - DNA, 22 bp, Homo sapiens
gtgcaggacagcacatctcctg

SEQ ID NO: 7373516 - DNA, 22 bp, Homo sapiens
gtgcagctgcttgcctggttag

SEQ ID NO: 7373517 - DNA, 22 bp, Homo sapiens
gtgcagctggtggagtctgggg

SEQ ID NO: 7373518 - DNA, 22 bp, Homo sapiens
gtgcagctgagggcctcttcta

SEQ ID NO: 7373519 - DNA, 22 bp, Homo sapiens
cagaagcacatgtttacatgta

SEQ ID NO: 7373520 - DNA, 23 bp, Homo sapiens
cagaagcacctgttgactgctgc

SEQ ID NO: 7373521 - DNA, 23 bp, Homo sapiens
cagaagcacctgttgactgctgc

SEQ ID NO: 7373522 - DNA, 22 bp, Homo sapiens
cagaagcagaacactagattta

SEQ ID NO: 7373523 - DNA, 22 bp, Homo sapiens
cagaagcaagggccaaagtctt

SEQ ID NO: 7373524 - DNA, 22 bp, Homo sapiens
cagaagagtagctgaacaagtt

SEQ ID NO: 7373525 - DNA, 18 bp, Homo sapiens
cagaagcaggcagtgcag

SEQ ID NO: 7373526 - DNA, 22 bp, Homo sapiens
cagagagaatcttggcagctga

SEQ ID NO: 7373527 - DNA, 19 bp, Homo sapiens
cagagagaccaaggcgcca

SEQ ID NO: 7373528 - DNA, 21 bp, Homo sapiens
cagagagctagaacttcatga

SEQ ID NO: 7373529 - DNA, 22 bp, Homo sapiens
cagagagcttgcccttgtatat

SEQ ID NO: 7373530 - DNA, 22 bp, Homo sapiens
cagagagcttagtgtgctgcat

SEQ ID NO: 7373531 - DNA, 22 bp, Homo sapiens
cagagagagtctgtccctgaag

SEQ ID NO: 7373532 - DNA, 22 bp, Homo sapiens
cagagagagtggggtgtggatt

SEQ ID NO: 7373533 - DNA, 22 bp, Homo sapiens
cagagagagtggggtgtggatt

SEQ ID NO: 7373534 - DNA, 22 bp, Homo sapiens
gggccctgcgactcgcggcgga

SEQ ID NO: 7373535 - DNA, 22 bp, Homo sapiens
gggccaggagtggagatatggg

SEQ ID NO: 7373536 - DNA, 22 bp, Homo sapiens
gggccctgcgtccggaagtctg

SEQ ID NO: 7373537 - DNA, 22 bp, Homo sapiens
gggccctgcgtccggaagtctg

SEQ ID NO: 7373538 - DNA, 22 bp, Homo sapiens
gggccctggacgtggcggcaga

SEQ ID NO: 7373539 - DNA, 22 bp, Homo sapiens
gggccctggacgtggcggcaga

SEQ ID NO: 7373540 - DNA, 22 bp, Homo sapiens
gggccctggatttaagcatgga

SEQ ID NO: 7373541 - DNA, 22 bp, Homo sapiens
gggccctggccgaatccctctg

SEQ ID NO: 7373542 - DNA, 18 bp, Homo sapiens
gggccctggcgtccgccc

SEQ ID NO: 7373543 - DNA, 22 bp, Homo sapiens
gggccctggccgaatccctctg

SEQ ID NO: 7373544 - DNA, 22 bp, Homo sapiens
gggccctggatttaagcatgga

SEQ ID NO: 7373545 - DNA, 18 bp, Homo sapiens
gggccctggcgtccgccc

SEQ ID NO: 7373546 - DNA, 22 bp, Homo sapiens
gggccctggctttcctgttctt

SEQ ID NO: 7373547 - DNA, 22 bp, Homo sapiens
gggccctggctttcctgttctt

SEQ ID NO: 7373548 - DNA, 20 bp, Homo sapiens
gggccctgggattcagagca

SEQ ID NO: 7373549 - DNA, 22 bp, Homo sapiens
gggccctgggattcagagcaag

SEQ ID NO: 7373550 - DNA, 21 bp, Homo sapiens
cagagcagcgttctgctgtgg

SEQ ID NO: 7373551 - DNA, 21 bp, Homo sapiens
cagagcagcgttctgctgtgg

SEQ ID NO: 7373552 - DNA, 22 bp, Homo sapiens
cagagcagcagagcttccatgg

SEQ ID NO: 7373553 - DNA, 22 bp, Homo sapiens
gggctcaggcctggcctctcac

SEQ ID NO: 7373554 - DNA, 22 bp, Homo sapiens
cagaggaaatgggaaggagata

SEQ ID NO: 7373555 - DNA, 22 bp, Homo sapiens
cagaggaaagtatttctggaag

SEQ ID NO: 7373556 - DNA, 22 bp, Homo sapiens
cagaggaaatgggaaggagata

SEQ ID NO: 7373557 - DNA, 22 bp, Homo sapiens
cagaggaaatgggaaggagata

SEQ ID NO: 7373558 - DNA, 22 bp, Homo sapiens
cagaggaagagatacaagccct

SEQ ID NO: 7373559 - DNA, 22 bp, Homo sapiens
cagaggaagagatacaagccct

SEQ ID NO: 7373560 - DNA, 22 bp, Homo sapiens
cagaggaacgtttggattgatt

SEQ ID NO: 7373561 - DNA, 19 bp, Homo sapiens
cagaggcactttctcttag

SEQ ID NO: 7373562 - DNA, 22 bp, Homo sapiens
cagaggcagaatggagatttgg

SEQ ID NO: 7373563 - DNA, 22 bp, Homo sapiens
cagaggcagaatggagatttgg

SEQ ID NO: 7373564 - DNA, 22 bp, Homo sapiens
cagaggcagaccctccagggcg

SEQ ID NO: 7373565 - DNA, 22 bp, Homo sapiens
cagaggcagaccctccagggcg

SEQ ID NO: 7373566 - DNA, 22 bp, Homo sapiens
cagaggcagaggtcatctctgg

SEQ ID NO: 7373567 - DNA, 22 bp, Homo sapiens
cagaggcagccgggggagaacg

SEQ ID NO: 7373568 - DNA, 22 bp, Homo sapiens
cagaggcagccgggggagaacg

SEQ ID NO: 7373569 - DNA, 22 bp, Homo sapiens
cagaggcagaggtcatctctgg

SEQ ID NO: 7373570 - DNA, 22 bp, Homo sapiens
cagaggcaggaagatgggcagt

SEQ ID NO: 7373571 - DNA, 22 bp, Homo sapiens
cagaggcaggaagatgggcagt

SEQ ID NO: 7373572 - DNA, 22 bp, Homo sapiens
gggggcaggtctggaactttga

SEQ ID NO: 7373573 - DNA, 19 bp, Homo sapiens
cagaggcactttctcttag

SEQ ID NO: 7373574 - DNA, 22 bp, Homo sapiens
cagaggaagggtgctgcgaaag

SEQ ID NO: 7373575 - DNA, 22 bp, Homo sapiens
cagaggaagttccttgatgaga

SEQ ID NO: 7373576 - DNA, 22 bp, Homo sapiens
cagaggaagctgggtgtggagt

SEQ ID NO: 7373577 - DNA, 22 bp, Homo sapiens
cagaggaagcagacacatcttg

SEQ ID NO: 7373578 - DNA, 22 bp, Homo sapiens
cagaggaaggctctgggaatgt

SEQ ID NO: 7373579 - DNA, 22 bp, Homo sapiens
cagaggacatgaaaactcgctc

SEQ ID NO: 7373580 - DNA, 22 bp, Homo sapiens
cagaggaccagaaaggggccca

SEQ ID NO: 7373581 - DNA, 22 bp, Homo sapiens
cagaggaccattgtatgtattg

SEQ ID NO: 7373582 - DNA, 22 bp, Homo sapiens
cagaggacctgtgtggccagag

SEQ ID NO: 7373583 - DNA, 22 bp, Homo sapiens
gggggagctgttattggcaggg

SEQ ID NO: 7373584 - DNA, 22 bp, Homo sapiens
cagagtttaaacaaatgaaata

SEQ ID NO: 7373585 - DNA, 22 bp, Homo sapiens
cagagtttgcaagggcagaagc

SEQ ID NO: 7373586 - DNA, 22 bp, Homo sapiens
cagaggcaggataagaactgcg

SEQ ID NO: 7373587 - DNA, 22 bp, Homo sapiens
cagaggcaggataagaactgcg

SEQ ID NO: 7373588 - DNA, 22 bp, Homo sapiens
cagaggctgaccctgctgttgt

SEQ ID NO: 7373589 - DNA, 21 bp, Homo sapiens
cagaggctgagagggcaatct

SEQ ID NO: 7373590 - DNA, 22 bp, Homo sapiens
ggtgagaggcagaggacagctt

SEQ ID NO: 7373591 - DNA, 22 bp, Homo sapiens
ggtgagaggcagaggacagctt

SEQ ID NO: 7373592 - DNA, 22 bp, Homo sapiens
cagatacattaaaatgatgatt

SEQ ID NO: 7373593 - DNA, 22 bp, Homo sapiens
cagataaatagacttggtcaga

SEQ ID NO: 7373594 - DNA, 22 bp, Homo sapiens
ggtgcagaggagccagctgggg

SEQ ID NO: 7373595 - DNA, 22 bp, Homo sapiens
ggtgcagaagaaagcagtcatt

SEQ ID NO: 7373596 - DNA, 22 bp, Homo sapiens
ggtgcagaaggaagggagctgg

SEQ ID NO: 7373597 - DNA, 22 bp, Homo sapiens
ggtgcaaaagtagttctgcttt

SEQ ID NO: 7373598 - DNA, 22 bp, Homo sapiens
ggtgcagatctttctcttcagg

SEQ ID NO: 7373599 - DNA, 22 bp, Homo sapiens
cagatgctatgtattatgtatg

SEQ ID NO: 7373600 - DNA, 22 bp, Homo sapiens
cagcagaagcaacattcaggct

SEQ ID NO: 7373601 - DNA, 22 bp, Homo sapiens
cagcagaacagttaaagaaacc

SEQ ID NO: 7373602 - DNA, 22 bp, Homo sapiens
cagcagaacagttaaagaaacc

SEQ ID NO: 7373603 - DNA, 22 bp, Homo sapiens
cagcagaacaggcagggaagct

SEQ ID NO: 7373604 - DNA, 22 bp, Homo sapiens
cagatggaaggcatagaggttt

SEQ ID NO: 7373605 - DNA, 22 bp, Homo sapiens
cagatgcttggaggacacttgg

SEQ ID NO: 7373606 - DNA, 22 bp, Homo sapiens
cagcagagaaattaaacttctg

SEQ ID NO: 7373607 - DNA, 22 bp, Homo sapiens
cagcagaagtccgactccagtc

SEQ ID NO: 7373608 - DNA, 18 bp, Homo sapiens
cagcagagacattcaaaa

SEQ ID NO: 7373609 - DNA, 22 bp, Homo sapiens
cagcagagaaattacatatttg

SEQ ID NO: 7373610 - DNA, 22 bp, Homo sapiens
cagcagagaccaagtgatttga

SEQ ID NO: 7373611 - DNA, 22 bp, Homo sapiens
cagcagagaccaagtgatttga

SEQ ID NO: 7373612 - DNA, 22 bp, Homo sapiens
ggtgtctgatggtggcttctca

SEQ ID NO: 7373613 - DNA, 22 bp, Homo sapiens
ggtgtctgcttccctccagctg

SEQ ID NO: 7373614 - DNA, 22 bp, Homo sapiens
ggtgtctgtgatggcatataac

SEQ ID NO: 7373615 - DNA, 22 bp, Homo sapiens
ggtgtctgttgcctcctggtta

SEQ ID NO: 7373616 - DNA, 22 bp, Homo sapiens
gtaagaaaaccttctttctaat

SEQ ID NO: 7373617 - DNA, 20 bp, Homo sapiens
cagcagagacccatggggag

SEQ ID NO: 7373618 - DNA, 20 bp, Homo sapiens
cagcagagacccatggggag

SEQ ID NO: 7373619 - DNA, 23 bp, Homo sapiens
catgtacagagtttgataaagtg

SEQ ID NO: 7373620 - DNA, 22 bp, Homo sapiens
catgtacactcatgtaactata

SEQ ID NO: 7373621 - DNA, 23 bp, Homo sapiens
catgtacagagtttgataaagtg

SEQ ID NO: 7373622 - DNA, 23 bp, Homo sapiens
catgtacacacagctgtacagtg

SEQ ID NO: 7373623 - DNA, 22 bp, Homo sapiens
catgtgtaccagctgttctttg

SEQ ID NO: 7373624 - DNA, 22 bp, Homo sapiens
catgtgggaagaggccagctgg

SEQ ID NO: 7373625 - DNA, 22 bp, Homo sapiens
catgttttgtgtacagaatatt

SEQ ID NO: 7373626 - DNA, 22 bp, Homo sapiens
tccaggtattactaagtgttaa

SEQ ID NO: 7373627 - DNA, 21 bp, Homo sapiens
cattacaagatttccaatttg

SEQ ID NO: 7373628 - DNA, 22 bp, Homo sapiens
cattaattgtatttttcaaagt

SEQ ID NO: 7373629 - DNA, 22 bp, Homo sapiens
cattacaaacatgttaagattt

SEQ ID NO: 7373630 - DNA, 22 bp, Homo sapiens
catgtaaaacactcagaacagt

SEQ ID NO: 7373631 - DNA, 22 bp, Homo sapiens
catgtaaagcacttcataacag

SEQ ID NO: 7373632 - DNA, 19 bp, Homo sapiens
catggtgaaaccccgtctc

SEQ ID NO: 7373633 - DNA, 22 bp, Homo sapiens
catgcttacttgtctcagcaga

SEQ ID NO: 7373634 - DNA, 22 bp, Homo sapiens
catgcttacctgccaaagcact

SEQ ID NO: 7373635 - DNA, 22 bp, Homo sapiens
catgctgttgaatatgacattg

SEQ ID NO: 7373636 - DNA, 22 bp, Homo sapiens
catgcttcacacactgaatgac

SEQ ID NO: 7373637 - DNA, 22 bp, Homo sapiens
catgctttaccaaagcagtgat

SEQ ID NO: 7373638 - DNA, 22 bp, Homo sapiens
tccagcacagaatttcctagct

SEQ ID NO: 7373639 - DNA, 20 bp, Homo sapiens
tccagcaccctcacagagaa

SEQ ID NO: 7373640 - DNA, 22 bp, Homo sapiens
tccagcagaaaagaggtaggga

SEQ ID NO: 7373641 - DNA, 22 bp, Homo sapiens
tccagcagaaccagagacctgg

SEQ ID NO: 7373642 - DNA, 22 bp, Homo sapiens
catgctctctggcaacttgtgt

SEQ ID NO: 7373643 - DNA, 22 bp, Homo sapiens
catgctgcaggagctcttctca

SEQ ID NO: 7373644 - DNA, 20 bp, Homo sapiens
catgctgcctccattgatgc

SEQ ID NO: 7373645 - DNA, 22 bp, Homo sapiens
catgctgtactctgtgtcagaa

SEQ ID NO: 7373646 - DNA, 22 bp, Homo sapiens
catgctgtggtaaatcactgaa

SEQ ID NO: 7373647 - DNA, 22 bp, Homo sapiens
tcatcagggatattggcctgaa

SEQ ID NO: 7373648 - DNA, 22 bp, Homo sapiens
catgcattttctattcactcag

SEQ ID NO: 7373649 - DNA, 22 bp, Homo sapiens
catgctctctggcaacttgtgt

SEQ ID NO: 7373650 - DNA, 22 bp, Homo sapiens
catgctatttatacataagtct

SEQ ID NO: 7373651 - DNA, 22 bp, Homo sapiens
tccaagaagcttacaatctaat

SEQ ID NO: 7373652 - DNA, 22 bp, Homo sapiens
tccaagatctacagcagtttag

SEQ ID NO: 7373653 - DNA, 22 bp, Homo sapiens
tccaagatctacagcagtttag

SEQ ID NO: 7373654 - DNA, 22 bp, Homo sapiens
tcagtgtgggtaagcatgctgt

SEQ ID NO: 7373655 - DNA, 22 bp, Homo sapiens
tcagtgtgaattcaggagccta

SEQ ID NO: 7373656 - DNA, 22 bp, Homo sapiens
tcagtgtgagtaccatgctcag

SEQ ID NO: 7373657 - DNA, 22 bp, Homo sapiens
catcataataacccagacacag

SEQ ID NO: 7373658 - DNA, 22 bp, Homo sapiens
catcataaaattgagataactg

SEQ ID NO: 7373659 - DNA, 22 bp, Homo sapiens
tcagtgtcttctctttcctacc

SEQ ID NO: 7373660 - DNA, 22 bp, Homo sapiens
catcagtggatatagattagcg

SEQ ID NO: 7373661 - DNA, 22 bp, Homo sapiens
catcagtgcccttggggatgcc

SEQ ID NO: 7373662 - DNA, 22 bp, Homo sapiens
catcagtgagccccttgatgag

SEQ ID NO: 7373663 - DNA, 22 bp, Homo sapiens
catcagtgaaagtgaatgttct

SEQ ID NO: 7373664 - DNA, 22 bp, Homo sapiens
tcatacaattcaatctctgatt

SEQ ID NO: 7373665 - DNA, 22 bp, Homo sapiens
tcatacaactaagagtttcaga

SEQ ID NO: 7373666 - DNA, 22 bp, Homo sapiens
tcataatacaaagagttctgca

SEQ ID NO: 7373667 - DNA, 22 bp, Homo sapiens
tcataatgaccccagagtccgc

SEQ ID NO: 7373668 - DNA, 22 bp, Homo sapiens
tcataatgtagttcatggctgg

SEQ ID NO: 7373669 - DNA, 22 bp, Homo sapiens
tcatcactgtatcattgataga

SEQ ID NO: 7373670 - DNA, 22 bp, Homo sapiens
catcgtatggccgaatgtacat

SEQ ID NO: 7373671 - DNA, 22 bp, Homo sapiens
tcagtttcctcatctacaaaag

SEQ ID NO: 7373672 - DNA, 22 bp, Homo sapiens
tcagtttcacttgaagaaaaga

SEQ ID NO: 7373673 - DNA, 22 bp, Homo sapiens
catcaatgtgcagagatgaacg

SEQ ID NO: 7373674 - DNA, 22 bp, Homo sapiens
tcaggcagagctgtggagctct

SEQ ID NO: 7373675 - DNA, 22 bp, Homo sapiens
tcaggcagagctgtggagctct

SEQ ID NO: 7373676 - DNA, 22 bp, Homo sapiens
tcaggcagaccaccgtgggcag

SEQ ID NO: 7373677 - DNA, 22 bp, Homo sapiens
tcaggcagaattatcaaaagat

SEQ ID NO: 7373678 - DNA, 22 bp, Homo sapiens
tcaggcagaccaccgtgggcag

SEQ ID NO: 7373679 - DNA, 22 bp, Homo sapiens
tcaggcagagctgtggagctct

SEQ ID NO: 7373680 - DNA, 22 bp, Homo sapiens
tcaggcagagggagaagccaag

SEQ ID NO: 7373681 - DNA, 21 bp, Homo sapiens
catattaaatcggtgccttta

SEQ ID NO: 7373682 - DNA, 22 bp, Homo sapiens
catcaaataggaatatttggca

SEQ ID NO: 7373683 - DNA, 22 bp, Homo sapiens
catcaaatgccatatatggttg

SEQ ID NO: 7373684 - DNA, 22 bp, Homo sapiens
catcaaatctgacttttcttcc

SEQ ID NO: 7373685 - DNA, 22 bp, Homo sapiens
tcaggaggcgtgctggggtaca

SEQ ID NO: 7373686 - DNA, 22 bp, Homo sapiens
tcaggaggctcaagacctggca

SEQ ID NO: 7373687 - DNA, 22 bp, Homo sapiens
tcaggaggcgtctcgctggggc

SEQ ID NO: 7373688 - DNA, 22 bp, Homo sapiens
tcaggagggagtgtggatagag

SEQ ID NO: 7373689 - DNA, 21 bp, Homo sapiens
tcaggaggctcagactcctgc

SEQ ID NO: 7373690 - DNA, 22 bp, Homo sapiens
tcaggcagaattatcaaaagat

SEQ ID NO: 7373691 - DNA, 22 bp, Homo sapiens
tcaggaggccggcaggatttga

SEQ ID NO: 7373692 - DNA, 22 bp, Homo sapiens
tcaggaggccgtgtgctcagtg

SEQ ID NO: 7373693 - DNA, 22 bp, Homo sapiens
tcaggaggccaccaggacctgt

SEQ ID NO: 7373694 - DNA, 22 bp, Homo sapiens
tcaggaggcggaggttgcagtg

SEQ ID NO: 7373695 - DNA, 22 bp, Homo sapiens
tcaggaggcggtgctgcctttg

SEQ ID NO: 7373696 - DNA, 22 bp, Homo sapiens
tcaggaggcctgagtagctcta

SEQ ID NO: 7373697 - DNA, 22 bp, Homo sapiens
cagtgtaagaattcaaagccta

SEQ ID NO: 7373698 - DNA, 22 bp, Homo sapiens
cagtgtaagctctagactagaa

SEQ ID NO: 7373699 - DNA, 22 bp, Homo sapiens
cagtgtaagctctagactagaa

SEQ ID NO: 7373700 - DNA, 22 bp, Homo sapiens
ccagatgtccctctcaggtttg

SEQ ID NO: 7373701 - DNA, 22 bp, Homo sapiens
ccagatgtccctctcaggtttg

SEQ ID NO: 7373702 - DNA, 22 bp, Homo sapiens
ccagatgtccctctcaggtttg

SEQ ID NO: 7373703 - DNA, 22 bp, Homo sapiens
ccagatttgagcgtcttaaacc

SEQ ID NO: 7373704 - DNA, 22 bp, Homo sapiens
ccagagcccgggacctggactt

SEQ ID NO: 7373705 - DNA, 22 bp, Homo sapiens
ccagaggctgggttcacctcag

SEQ ID NO: 7373706 - DNA, 22 bp, Homo sapiens
ccagaggctgggttcacctcag

SEQ ID NO: 7373707 - DNA, 22 bp, Homo sapiens
ccagaggctgggttcacctcag

SEQ ID NO: 7373708 - DNA, 22 bp, Homo sapiens
ccagaggctggggaaggataca

SEQ ID NO: 7373709 - DNA, 22 bp, Homo sapiens
ccagaggctggggaaggataca

SEQ ID NO: 7373710 - DNA, 22 bp, Homo sapiens
ccagaggctggcagccagctga

SEQ ID NO: 7373711 - DNA, 22 bp, Homo sapiens
tctagaaagtttgtactgattt

SEQ ID NO: 7373712 - DNA, 22 bp, Homo sapiens
tctagaaagtttgtactgattt

SEQ ID NO: 7373713 - DNA, 22 bp, Homo sapiens
ccaccctgccttgggccagtga

SEQ ID NO: 7373714 - DNA, 20 bp, Homo sapiens
ccaccctgctaagaatacac

SEQ ID NO: 7373715 - DNA, 20 bp, Homo sapiens
ccaccctccaggaacacata

SEQ ID NO: 7373716 - DNA, 22 bp, Homo sapiens
tctcagttctgccgcaagtatt

SEQ ID NO: 7373717 - DNA, 22 bp, Homo sapiens
tctcagttcttctcattccaga

SEQ ID NO: 7373718 - DNA, 22 bp, Homo sapiens
tctcagtgttgttctgcagatg

SEQ ID NO: 7373719 - DNA, 22 bp, Homo sapiens
tctcagtgtttaaaaagatttc

SEQ ID NO: 7373720 - DNA, 22 bp, Homo sapiens
tctcagtgttatctatctgcct

SEQ ID NO: 7373721 - DNA, 22 bp, Homo sapiens
tctcagtgtggtgcttaggata

SEQ ID NO: 7373722 - DNA, 22 bp, Homo sapiens
tctcagtgtgttttctctcaga

SEQ ID NO: 7373723 - DNA, 22 bp, Homo sapiens
tctcagtggcttcctcactttt

SEQ ID NO: 7373724 - DNA, 22 bp, Homo sapiens
tctcaggcatctgtgtggcaca

SEQ ID NO: 7373725 - DNA, 22 bp, Homo sapiens
tctcaggcactgggtgccaact

SEQ ID NO: 7373726 - DNA, 22 bp, Homo sapiens
tctcaggcatggtttgttcatc

SEQ ID NO: 7373727 - DNA, 22 bp, Homo sapiens
tctcagtggatctcagaatttt

SEQ ID NO: 7373728 - DNA, 22 bp, Homo sapiens
tctcagagacctgaactccctg

SEQ ID NO: 7373729 - DNA, 22 bp, Homo sapiens
tctatacatgtgcacacacatc

SEQ ID NO: 7373730 - DNA, 22 bp, Homo sapiens
tctatagacttggacatatagt

SEQ ID NO: 7373731 - DNA, 22 bp, Homo sapiens
catttctagggatcataaagta

SEQ ID NO: 7373732 - DNA, 22 bp, Homo sapiens
catttcactattcactaaaagg

SEQ ID NO: 7373733 - DNA, 22 bp, Homo sapiens
catttcactattcactaaaagg

SEQ ID NO: 7373734 - DNA, 22 bp, Homo sapiens
catttcagtgtcttgtgatgaa

SEQ ID NO: 7373735 - DNA, 22 bp, Homo sapiens
catttcatagttgtcacaataa

SEQ ID NO: 7373736 - DNA, 21 bp, Homo sapiens
catttcatgattatagaaatg

SEQ ID NO: 7373737 - DNA, 22 bp, Homo sapiens
catttcattcctttgaaagtgg

SEQ ID NO: 7373738 - DNA, 20 bp, Homo sapiens
catttcattgtgtcttcact

SEQ ID NO: 7373739 - DNA, 20 bp, Homo sapiens
tccagttttggagacattct

SEQ ID NO: 7373740 - DNA, 22 bp, Homo sapiens
tccagtttgggtgtgagctgcg

SEQ ID NO: 7373741 - DNA, 18 bp, Homo sapiens
tccaggtcccaggggaag

SEQ ID NO: 7373742 - DNA, 22 bp, Homo sapiens
tccatatacaacttaatcttta

SEQ ID NO: 7373743 - DNA, 22 bp, Homo sapiens
tccatataatgggattccttat

SEQ ID NO: 7373744 - DNA, 22 bp, Homo sapiens
tccatacatatccaaagagaag

SEQ ID NO: 7373745 - DNA, 22 bp, Homo sapiens
tccatacatacagatatgcatt

SEQ ID NO: 7373746 - DNA, 22 bp, Homo sapiens
catttattggcatgtagtaggt

SEQ ID NO: 7373747 - DNA, 22 bp, Homo sapiens
catttattgagtggccacagtg

SEQ ID NO: 7373748 - DNA, 22 bp, Homo sapiens
cattttatgtttatggagtgct

SEQ ID NO: 7373749 - DNA, 22 bp, Homo sapiens
cattttatcctctgggaagcta

SEQ ID NO: 7373750 - DNA, 19 bp, Homo sapiens
cattttaagcatccccagt

SEQ ID NO: 7373751 - DNA, 22 bp, Homo sapiens
cattttaagatgacctggtttc

SEQ ID NO: 7373752 - DNA, 22 bp, Homo sapiens
cattttaaatgatttaagccaa

SEQ ID NO: 7373753 - DNA, 22 bp, Homo sapiens
cattttccacaggcctatttcc

SEQ ID NO: 7373754 - DNA, 19 bp, Homo sapiens
cattttcccatcatccttt

SEQ ID NO: 7373755 - DNA, 22 bp, Homo sapiens
cattttgtgctagacactatgg

SEQ ID NO: 7373756 - DNA, 20 bp, Homo sapiens
tcctggccttctcgggcagt

SEQ ID NO: 7373757 - DNA, 22 bp, Homo sapiens
ccacagggcctttcctgctggc

SEQ ID NO: 7373758 - DNA, 21 bp, Homo sapiens
ccacaggggctcccctgtcag

SEQ ID NO: 7373759 - DNA, 22 bp, Homo sapiens
ccacagggaacatgacagcctt

SEQ ID NO: 7373760 - DNA, 22 bp, Homo sapiens
ccacagggcctttcctgctggc

SEQ ID NO: 7373761 - DNA, 22 bp, Homo sapiens
ccacaggcggagtggcgggcag

SEQ ID NO: 7373762 - DNA, 23 bp, Homo sapiens
tcctgctgaaagctccagctggc

SEQ ID NO: 7373763 - DNA, 22 bp, Homo sapiens
ccaaccacgaaaccaaggtggc

SEQ ID NO: 7373764 - DNA, 23 bp, Homo sapiens
tcctgagggtttcccagccttgg

SEQ ID NO: 7373765 - DNA, 22 bp, Homo sapiens
tacagccttcatctttgccttg

SEQ ID NO: 7373766 - DNA, 22 bp, Homo sapiens
tacagccatggttaatttacct

SEQ ID NO: 7373767 - DNA, 22 bp, Homo sapiens
tacagcccaagaagtttatacg

SEQ ID NO: 7373768 - DNA, 22 bp, Homo sapiens
tacagcctccacaggccaagtg

SEQ ID NO: 7373769 - DNA, 20 bp, Homo sapiens
tacagcctattcaccacata

SEQ ID NO: 7373770 - DNA, 22 bp, Homo sapiens
tacagccatcatgtatgtatat

SEQ ID NO: 7373771 - DNA, 22 bp, Homo sapiens
tacagcatgtccttagcaaggc

SEQ ID NO: 7373772 - DNA, 17 bp, Homo sapiens
caggccttgagccttta

SEQ ID NO: 7373773 - DNA, 22 bp, Homo sapiens
caggccttgaaggcctgcggga

SEQ ID NO: 7373774 - DNA, 22 bp, Homo sapiens
caggccttctccctccctcaac

SEQ ID NO: 7373775 - DNA, 22 bp, Homo sapiens
caggccttatctccaccctgca

SEQ ID NO: 7373776 - DNA, 22 bp, Homo sapiens
caggccttagtaggtgctccct

SEQ ID NO: 7373777 - DNA, 22 bp, Homo sapiens
tacagttagcctgtctactccc

SEQ ID NO: 7373778 - DNA, 22 bp, Homo sapiens
tacagttagtgcctggctactt

SEQ ID NO: 7373779 - DNA, 22 bp, Homo sapiens
caggccttgggacccagactgg

SEQ ID NO: 7373780 - DNA, 22 bp, Homo sapiens
caggccttgcgtcccatggcct

SEQ ID NO: 7373781 - DNA, 22 bp, Homo sapiens
caggccttgagttttgggcttt

SEQ ID NO: 7373782 - DNA, 22 bp, Homo sapiens
caggccttaaggactcggagaa

SEQ ID NO: 7373783 - DNA, 23 bp, Homo sapiens
tacagctgcagaatcaggctaag

SEQ ID NO: 7373784 - DNA, 22 bp, Homo sapiens
tacagctgagtttaggtacagg

SEQ ID NO: 7373785 - DNA, 22 bp, Homo sapiens
caggctcctcactcatgctccc

SEQ ID NO: 7373786 - DNA, 22 bp, Homo sapiens
caggctccagcttcctgctcag

SEQ ID NO: 7373787 - DNA, 22 bp, Homo sapiens
tacagttatatgtgataagtaa

SEQ ID NO: 7373788 - DNA, 22 bp, Homo sapiens
gtggagccaggggctgtaggta

SEQ ID NO: 7373789 - DNA, 22 bp, Homo sapiens
tacaatagggcttttgtttatg

SEQ ID NO: 7373790 - DNA, 22 bp, Homo sapiens
tacacagggagagattggaaac

SEQ ID NO: 7373791 - DNA, 22 bp, Homo sapiens
caggccaaaattcaggcattct

SEQ ID NO: 7373792 - DNA, 22 bp, Homo sapiens
caggccaactgcatggtgacca

SEQ ID NO: 7373793 - DNA, 22 bp, Homo sapiens
caggccaaagatcccattgaca

SEQ ID NO: 7373794 - DNA, 22 bp, Homo sapiens
caggccaataaatgtgatggcc

SEQ ID NO: 7373795 - DNA, 22 bp, Homo sapiens
caggccaataaatgtgatggcc

SEQ ID NO: 7373796 - DNA, 22 bp, Homo sapiens
caggccaagtcccaagtgcggg

SEQ ID NO: 7373797 - DNA, 22 bp, Homo sapiens
caggccaagtcccaagtgcggg

SEQ ID NO: 7373798 - DNA, 22 bp, Homo sapiens
caggccaagcctccccagctcc

SEQ ID NO: 7373799 - DNA, 22 bp, Homo sapiens
gtggagcaatcagagggtcagt

SEQ ID NO: 7373800 - DNA, 22 bp, Homo sapiens
gtggagcaggactagctgagaa

SEQ ID NO: 7373801 - DNA, 22 bp, Homo sapiens
gtggagcacggaggaggcccct

SEQ ID NO: 7373802 - DNA, 22 bp, Homo sapiens
gtggagcataacacactagcct

SEQ ID NO: 7373803 - DNA, 22 bp, Homo sapiens
cagctctgccatcatctgcctt

SEQ ID NO: 7373804 - DNA, 22 bp, Homo sapiens
cagctctgccacttcctagcta

SEQ ID NO: 7373805 - DNA, 22 bp, Homo sapiens
caggccctcgcccgcagcgacc

SEQ ID NO: 7373806 - DNA, 22 bp, Homo sapiens
caggccctcctgtgatctgcct

SEQ ID NO: 7373807 - DNA, 22 bp, Homo sapiens
caggccctcgtggtgagctggg

SEQ ID NO: 7373808 - DNA, 22 bp, Homo sapiens
caggccctctgcaccctcgtct

SEQ ID NO: 7373809 - DNA, 22 bp, Homo sapiens
caggccctgcacagtggtcctg

SEQ ID NO: 7373810 - DNA, 22 bp, Homo sapiens
caggccctgccttgagggacct

SEQ ID NO: 7373811 - DNA, 22 bp, Homo sapiens
caggccctgcactaggccctgg

SEQ ID NO: 7373812 - DNA, 22 bp, Homo sapiens
caggccctcaggcaagggctct

SEQ ID NO: 7373813 - DNA, 22 bp, Homo sapiens
caggcccaggggtctggcccac

SEQ ID NO: 7373814 - DNA, 22 bp, Homo sapiens
caggccacgccccggcgtgtga

SEQ ID NO: 7373815 - DNA, 22 bp, Homo sapiens
caggccacacggcggctccctg

SEQ ID NO: 7373816 - DNA, 22 bp, Homo sapiens
caggccacaagttgggttcaag

SEQ ID NO: 7373817 - DNA, 22 bp, Homo sapiens
caggccaatatcacatgctatg

SEQ ID NO: 7373818 - DNA, 22 bp, Homo sapiens
caggccacagctaaagaggatt

SEQ ID NO: 7373819 - DNA, 22 bp, Homo sapiens
caggccaccagatacatgcccc

SEQ ID NO: 7373820 - DNA, 22 bp, Homo sapiens
tacacttgttcaaacagcaaaa

SEQ ID NO: 7373821 - DNA, 22 bp, Homo sapiens
tacagacattcaattttgaccc

SEQ ID NO: 7373822 - DNA, 22 bp, Homo sapiens
caggccctgccttggcatgtgt

SEQ ID NO: 7373823 - DNA, 22 bp, Homo sapiens
cagggcagtttgtgcctatgag

SEQ ID NO: 7373824 - DNA, 22 bp, Homo sapiens
cagggcagttttacttctctct

SEQ ID NO: 7373825 - DNA, 22 bp, Homo sapiens
cagggcagttttacttctctct

SEQ ID NO: 7373826 - DNA, 22 bp, Homo sapiens
tagcagttagagttgactgcaa

SEQ ID NO: 7373827 - DNA, 22 bp, Homo sapiens
tagcataacaggtaagagtgag

SEQ ID NO: 7373828 - DNA, 22 bp, Homo sapiens
cagggatggcctggcgggccac

SEQ ID NO: 7373829 - DNA, 22 bp, Homo sapiens
cagggatgagcagatggagcaa

SEQ ID NO: 7373830 - DNA, 22 bp, Homo sapiens
tagcagagtttggtacctgggg

SEQ ID NO: 7373831 - DNA, 21 bp, Homo sapiens
tagcaattatagatgtctaaa

SEQ ID NO: 7373832 - DNA, 21 bp, Homo sapiens
tagcaattatagatgtctaaa

SEQ ID NO: 7373833 - DNA, 22 bp, Homo sapiens
cagggatgagaaagctctctaa

SEQ ID NO: 7373834 - DNA, 22 bp, Homo sapiens
cagggagggacaattgtcacct

SEQ ID NO: 7373835 - DNA, 22 bp, Homo sapiens
cagggagggaggaaaatttgct

SEQ ID NO: 7373836 - DNA, 22 bp, Homo sapiens
cagggagctttgtcttctcatt

SEQ ID NO: 7373837 - DNA, 22 bp, Homo sapiens
cagggagcctgaatgttccagg

SEQ ID NO: 7373838 - DNA, 22 bp, Homo sapiens
cagggagctttcccaggaccct

SEQ ID NO: 7373839 - DNA, 22 bp, Homo sapiens
cagggaggatgggctgttttgc

SEQ ID NO: 7373840 - DNA, 23 bp, Homo sapiens
cagggaggagatactgtgtatct

SEQ ID NO: 7373841 - DNA, 22 bp, Homo sapiens
cagggaggctgtcttatgcctg

SEQ ID NO: 7373842 - DNA, 22 bp, Homo sapiens
caggctgcagaggcctttcatg

SEQ ID NO: 7373843 - DNA, 22 bp, Homo sapiens
tacctcattacatctgcaatga

SEQ ID NO: 7373844 - DNA, 22 bp, Homo sapiens
tacctcatgctgtacagcacgt

SEQ ID NO: 7373845 - DNA, 22 bp, Homo sapiens
tacctataggtacaattacaag

SEQ ID NO: 7373846 - DNA, 22 bp, Homo sapiens
tagaaacaagggagaggattct

SEQ ID NO: 7373847 - DNA, 22 bp, Homo sapiens
tagaaagacagaggttttgtct

SEQ ID NO: 7373848 - DNA, 22 bp, Homo sapiens
tagaaagagcatagtattataa

SEQ ID NO: 7373849 - DNA, 22 bp, Homo sapiens
tagaaagagcatagtattataa

SEQ ID NO: 7373850 - DNA, 22 bp, Homo sapiens
tagaaattcaatgctctgagta

SEQ ID NO: 7373851 - DNA, 22 bp, Homo sapiens
tagaaatgttagatgtattgag

SEQ ID NO: 7373852 - DNA, 22 bp, Homo sapiens
tagaaagcatgcaagtttgatg

SEQ ID NO: 7373853 - DNA, 22 bp, Homo sapiens
tagaaatgtgataatagcttaa

SEQ ID NO: 7373854 - DNA, 22 bp, Homo sapiens
cagggagaagtctggtcagtcc

SEQ ID NO: 7373855 - DNA, 22 bp, Homo sapiens
cagggagaggcatcatagggaa

SEQ ID NO: 7373856 - DNA, 22 bp, Homo sapiens
cagggagaggcatcatagggaa

SEQ ID NO: 7373857 - DNA, 22 bp, Homo sapiens
cagggagatcttggctcctggt

SEQ ID NO: 7373858 - DNA, 22 bp, Homo sapiens
cagggagaggcctctgttgccc

SEQ ID NO: 7373859 - DNA, 22 bp, Homo sapiens
cagggagaggcctctgttgccc

SEQ ID NO: 7373860 - DNA, 22 bp, Homo sapiens
tagacagtgagctatgagtggt

SEQ ID NO: 7373861 - DNA, 22 bp, Homo sapiens
cagggagatcttggctcctggt

SEQ ID NO: 7373862 - DNA, 22 bp, Homo sapiens
tatgcaaagtcctaagaaagaa

SEQ ID NO: 7373863 - DNA, 22 bp, Homo sapiens
tatgcaaagccacccagggacg

SEQ ID NO: 7373864 - DNA, 22 bp, Homo sapiens
tatgcaaacagttcaggtgaca

SEQ ID NO: 7373865 - DNA, 22 bp, Homo sapiens
tatgcaaacagttcaggtgaca

SEQ ID NO: 7373866 - DNA, 22 bp, Homo sapiens
tatgatatgcactttatcagaa

SEQ ID NO: 7373867 - DNA, 22 bp, Homo sapiens
tatgatattctaaattgacacc

SEQ ID NO: 7373868 - DNA, 22 bp, Homo sapiens
tatgaagaaatctttgaaaatc

SEQ ID NO: 7373869 - DNA, 22 bp, Homo sapiens
tatgaagaagttctgtgaaatg

SEQ ID NO: 7373870 - DNA, 22 bp, Homo sapiens
tatattgggacttcaggacttt

SEQ ID NO: 7373871 - DNA, 22 bp, Homo sapiens
tatattgtagctgatgacaaat

SEQ ID NO: 7373872 - DNA, 22 bp, Homo sapiens
tatattgtagctgatgacaaat

SEQ ID NO: 7373873 - DNA, 22 bp, Homo sapiens
tatattgaccagtacaattggt

SEQ ID NO: 7373874 - DNA, 22 bp, Homo sapiens
tatattccagttcatctcttga

SEQ ID NO: 7373875 - DNA, 22 bp, Homo sapiens
tatgaacatgttcattgactta

SEQ ID NO: 7373876 - DNA, 22 bp, Homo sapiens
tatgtacatggagagcaattga

SEQ ID NO: 7373877 - DNA, 22 bp, Homo sapiens
tatgtacatgatttcatttgct

SEQ ID NO: 7373878 - DNA, 22 bp, Homo sapiens
tatgtacatcttgagcaatgaa

SEQ ID NO: 7373879 - DNA, 22 bp, Homo sapiens
cagtaccagtcaccacattgat

SEQ ID NO: 7373880 - DNA, 22 bp, Homo sapiens
cagtactaagactccacctagc

SEQ ID NO: 7373881 - DNA, 22 bp, Homo sapiens
caggtggggcgccctcaggcag

SEQ ID NO: 7373882 - DNA, 22 bp, Homo sapiens
tatatagaaaagcagatgttgg

SEQ ID NO: 7373883 - DNA, 22 bp, Homo sapiens
tatattcattttaaagccatct

SEQ ID NO: 7373884 - DNA, 22 bp, Homo sapiens
tatattcaatgattagtatcag

SEQ ID NO: 7373885 - DNA, 22 bp, Homo sapiens
tagttttagcagcaatgggatg

SEQ ID NO: 7373886 - DNA, 22 bp, Homo sapiens
tagtacagttccatcaaagcag

SEQ ID NO: 7373887 - DNA, 22 bp, Homo sapiens
tagtacagtggcattcaaactt

SEQ ID NO: 7373888 - DNA, 22 bp, Homo sapiens
tagtaacccacacaacagtaga

SEQ ID NO: 7373889 - DNA, 22 bp, Homo sapiens
tagtaaatctcagaaaaagatc

SEQ ID NO: 7373890 - DNA, 22 bp, Homo sapiens
tagtaaattaaaatattgactt

SEQ ID NO: 7373891 - DNA, 22 bp, Homo sapiens
tagtaacaacaactagcatttt

SEQ ID NO: 7373892 - DNA, 22 bp, Homo sapiens
tagtaacaacaactagcatttt

SEQ ID NO: 7373893 - DNA, 22 bp, Homo sapiens
cagtgcagtttcccagatgctg

SEQ ID NO: 7373894 - DNA, 22 bp, Homo sapiens
tcacatggcgagctttaaaata

SEQ ID NO: 7373895 - DNA, 22 bp, Homo sapiens
cagtggcaagtccggtattgaa

SEQ ID NO: 7373896 - DNA, 22 bp, Homo sapiens
cagtggcaagaacagtaataat

SEQ ID NO: 7373897 - DNA, 22 bp, Homo sapiens
cagtggcaagtccggtattgaa

SEQ ID NO: 7373898 - DNA, 22 bp, Homo sapiens
cagtggcaaggacagtaataat

SEQ ID NO: 7373899 - DNA, 22 bp, Homo sapiens
cagtggcaagtccggtattgaa

SEQ ID NO: 7373900 - DNA, 22 bp, Homo sapiens
cagtggaggccttgggaccttt

SEQ ID NO: 7373901 - DNA, 22 bp, Homo sapiens
tcactgcagacaacctcagtca

SEQ ID NO: 7373902 - DNA, 22 bp, Homo sapiens
cagtggcacatggaccttgtca

SEQ ID NO: 7373903 - DNA, 22 bp, Homo sapiens
cagtggcacatggaccttgtca

SEQ ID NO: 7373904 - DNA, 22 bp, Homo sapiens
cagtggcacatggaccttgtca

SEQ ID NO: 7373905 - DNA, 22 bp, Homo sapiens
tcactgcagcctctgcctcccg

SEQ ID NO: 7373906 - DNA, 22 bp, Homo sapiens
cagtggcagagccgttgccatc

SEQ ID NO: 7373907 - DNA, 22 bp, Homo sapiens
cagtggcagagccgttgccatc

SEQ ID NO: 7373908 - DNA, 17 bp, Homo sapiens
cagtggcagatcttctc

SEQ ID NO: 7373909 - DNA, 22 bp, Homo sapiens
cagtggcacttgtcatttctga

SEQ ID NO: 7373910 - DNA, 17 bp, Homo sapiens
cagtggcagatcttctc

SEQ ID NO: 7373911 - DNA, 22 bp, Homo sapiens
tcacattcttccctgacttctt

SEQ ID NO: 7373912 - DNA, 22 bp, Homo sapiens
tcactgcaacctccacctcctg

SEQ ID NO: 7373913 - DNA, 22 bp, Homo sapiens
tcactgcaacctctgcctcccg

SEQ ID NO: 7373914 - DNA, 22 bp, Homo sapiens
tcactgcaagctccacctcccg

SEQ ID NO: 7373915 - DNA, 22 bp, Homo sapiens
tcacatgtcagtcttaaacaga

SEQ ID NO: 7373916 - DNA, 22 bp, Homo sapiens
tcacatgtcagtcttaaacaga

SEQ ID NO: 7373917 - DNA, 22 bp, Homo sapiens
tcacatgtcagtcttaaacaga

SEQ ID NO: 7373918 - DNA, 22 bp, Homo sapiens
tcacatgtcaaaaactacataa

SEQ ID NO: 7373919 - DNA, 22 bp, Homo sapiens
tcacatgtcaagaagataattt

SEQ ID NO: 7373920 - DNA, 22 bp, Homo sapiens
tcacattctcagcatctataca

SEQ ID NO: 7373921 - DNA, 22 bp, Homo sapiens
tcaaattagtggaataataatg

SEQ ID NO: 7373922 - DNA, 17 bp, Homo sapiens
tcaaatgtacagaacta

SEQ ID NO: 7373923 - DNA, 22 bp, Homo sapiens
tcaaatgttccctgtactggcc

SEQ ID NO: 7373924 - DNA, 22 bp, Homo sapiens
tcaaatgtgtaaggtcaggaca

SEQ ID NO: 7373925 - DNA, 22 bp, Homo sapiens
tcaaattgtcatcttgataatg

SEQ ID NO: 7373926 - DNA, 22 bp, Homo sapiens
tcaaattttaacatgcattaga

SEQ ID NO: 7373927 - DNA, 22 bp, Homo sapiens
tcaaattttaacatgcattaga

SEQ ID NO: 7373928 - DNA, 22 bp, Homo sapiens
tcaaattatttaggatagtgct

SEQ ID NO: 7373929 - DNA, 22 bp, Homo sapiens
cagtcttctaacctagcagcct

SEQ ID NO: 7373930 - DNA, 22 bp, Homo sapiens
cagtctttgttcccattactga

SEQ ID NO: 7373931 - DNA, 22 bp, Homo sapiens
cagtcttttgtatattagcaga

SEQ ID NO: 7373932 - DNA, 22 bp, Homo sapiens
cagtgaaatcacaactttagtt

SEQ ID NO: 7373933 - DNA, 17 bp, Homo sapiens
cagtgaagagacattaa

SEQ ID NO: 7373934 - DNA, 22 bp, Homo sapiens
cagtccctgggggagtcaccag

SEQ ID NO: 7373935 - DNA, 22 bp, Homo sapiens
cagtccctagtggagctcacag

SEQ ID NO: 7373936 - DNA, 22 bp, Homo sapiens
cagtcccagctgctcagaaggc

SEQ ID NO: 7373937 - DNA, 22 bp, Homo sapiens
cagtcccagacccagaaggtgg

SEQ ID NO: 7373938 - DNA, 22 bp, Homo sapiens
cagtcccagggttggttcagct

SEQ ID NO: 7373939 - DNA, 22 bp, Homo sapiens
cagtcttagccttccctcaccc

SEQ ID NO: 7373940 - DNA, 22 bp, Homo sapiens
cagtctggaggtcagctggctt

SEQ ID NO: 7373941 - DNA, 22 bp, Homo sapiens
cagtctggaggtcagctggctt

SEQ ID NO: 7373942 - DNA, 22 bp, Homo sapiens
cagtagaattattataaaacat

SEQ ID NO: 7373943 - DNA, 22 bp, Homo sapiens
cagtagcaggcactcagcacgt

SEQ ID NO: 7373944 - DNA, 22 bp, Homo sapiens
cagtagcactctgtcagtgaag

SEQ ID NO: 7373945 - DNA, 22 bp, Homo sapiens
tcaaagcatcagtcaatttagg

SEQ ID NO: 7373946 - DNA, 22 bp, Homo sapiens
tcaaagcctgtggatagtttgg

SEQ ID NO: 7373947 - DNA, 22 bp, Homo sapiens
tcaaagcaatttcaccagtgcc

SEQ ID NO: 7373948 - DNA, 20 bp, Homo sapiens
tcaaagcactgcctgtcatc

SEQ ID NO: 7373949 - DNA, 22 bp, Homo sapiens
tctgggccctaaaccagctcta

SEQ ID NO: 7373950 - DNA, 22 bp, Homo sapiens
ccaggagcaggagctgcagctg

SEQ ID NO: 7373951 - DNA, 22 bp, Homo sapiens
ccaggagcaggagctgcagctg

SEQ ID NO: 7373952 - DNA, 22 bp, Homo sapiens
ccaggagcaggagctggacaga

SEQ ID NO: 7373953 - DNA, 22 bp, Homo sapiens
ccaggagcagggctggctgcac

SEQ ID NO: 7373954 - DNA, 22 bp, Homo sapiens
ccaggagcagggctggctgcac

SEQ ID NO: 7373955 - DNA, 22 bp, Homo sapiens
tctgttcttcctacattcacat

SEQ ID NO: 7373956 - DNA, 22 bp, Homo sapiens
tctgttctattggtctatgtgt

SEQ ID NO: 7373957 - DNA, 22 bp, Homo sapiens
tctgttcttaaagcattcttgc

SEQ ID NO: 7373958 - DNA, 22 bp, Homo sapiens
tctgttcttctccactgtatgt

SEQ ID NO: 7373959 - DNA, 22 bp, Homo sapiens
tctgttcttctccactgtatgt

SEQ ID NO: 7373960 - DNA, 22 bp, Homo sapiens
tctgttcttgcttttctccaac

SEQ ID NO: 7373961 - DNA, 22 bp, Homo sapiens
tctgttcttgcttttctccaac

SEQ ID NO: 7373962 - DNA, 22 bp, Homo sapiens
tctgttctaagcattctatgtg

SEQ ID NO: 7373963 - DNA, 22 bp, Homo sapiens
tctgttctaagcattctatgtg

SEQ ID NO: 7373964 - DNA, 22 bp, Homo sapiens
ccaggagcctgggccaggctgg

SEQ ID NO: 7373965 - DNA, 22 bp, Homo sapiens
ccaggcagcctgctccattctg

SEQ ID NO: 7373966 - DNA, 22 bp, Homo sapiens
ccaggcagccaagtgtgtgtgt

SEQ ID NO: 7373967 - DNA, 22 bp, Homo sapiens
ccaggcaggcgatggtgcagtg

SEQ ID NO: 7373968 - DNA, 22 bp, Homo sapiens
ccaggcaggcagcgttctcagg

SEQ ID NO: 7373969 - DNA, 22 bp, Homo sapiens
ccaggcctcctgtgagtggacc

SEQ ID NO: 7373970 - DNA, 22 bp, Homo sapiens
ccaggcaggcgatggtgcagtg

SEQ ID NO: 7373971 - DNA, 22 bp, Homo sapiens
ccaggcaggcgatggtgcagtg

SEQ ID NO: 7373972 - DNA, 22 bp, Homo sapiens
ccaggcccccgagcagaagaca

SEQ ID NO: 7373973 - DNA, 22 bp, Homo sapiens
tcttagaagtttatggcacgga

SEQ ID NO: 7373974 - DNA, 22 bp, Homo sapiens
tcttagaagttcatgttccagc

SEQ ID NO: 7373975 - DNA, 22 bp, Homo sapiens
tcttagaaactgtatcgattag

SEQ ID NO: 7373976 - DNA, 22 bp, Homo sapiens
tcttagaaaaatggtatgtttt

SEQ ID NO: 7373977 - DNA, 22 bp, Homo sapiens
tcttagaaattccccagtggct

SEQ ID NO: 7373978 - DNA, 22 bp, Homo sapiens
tcttagaaatgaagttctttct

SEQ ID NO: 7373979 - DNA, 22 bp, Homo sapiens
tcttctctgtggcctggtggtg

SEQ ID NO: 7373980 - DNA, 17 bp, Homo sapiens
tcttctcttccagtctt

SEQ ID NO: 7373981 - DNA, 17 bp, Homo sapiens
tcttctcttccagtctt

SEQ ID NO: 7373982 - DNA, 19 bp, Homo sapiens
tcttctgacttgagaaaga

SEQ ID NO: 7373983 - DNA, 19 bp, Homo sapiens
tcttctgacttcaagaaac

SEQ ID NO: 7373984 - DNA, 22 bp, Homo sapiens
tcttctgagacttctctttggt

SEQ ID NO: 7373985 - DNA, 22 bp, Homo sapiens
ccaggaggcttcgtccgtggag

SEQ ID NO: 7373986 - DNA, 16 bp, Homo sapiens
ccaggaggctgacacc

SEQ ID NO: 7373987 - DNA, 22 bp, Homo sapiens
ccaggcagaatgaaacccctgt

SEQ ID NO: 7373988 - DNA, 22 bp, Homo sapiens
ccaggcacttgtttgccaggca

SEQ ID NO: 7373989 - DNA, 22 bp, Homo sapiens
ccaggcacttgtttgccaggca

SEQ ID NO: 7373990 - DNA, 22 bp, Homo sapiens
ccaggcagaatgaaacccctgt

SEQ ID NO: 7373991 - DNA, 21 bp, Homo sapiens
ccaggcagagctgtgagttct

SEQ ID NO: 7373992 - DNA, 22 bp, Homo sapiens
ccaggaggcggaggttgcagtg

SEQ ID NO: 7373993 - DNA, 22 bp, Homo sapiens
ccaggaggctctgactggaccc

SEQ ID NO: 7373994 - DNA, 22 bp, Homo sapiens
ccaggaggctcttgtccctggt

SEQ ID NO: 7373995 - DNA, 22 bp, Homo sapiens
ccaggaggctctgcccatccca

SEQ ID NO: 7373996 - DNA, 22 bp, Homo sapiens
ccaggcagagtgctccagaaag

SEQ ID NO: 7373997 - DNA, 22 bp, Homo sapiens
ccaggcagagtgctccagaaag

SEQ ID NO: 7373998 - DNA, 22 bp, Homo sapiens
ccaggcagagggaatagcaagt

SEQ ID NO: 7373999 - DNA, 22 bp, Homo sapiens
ccaggcagagggatccccatcc

SEQ ID NO: 7374000 - DNA, 22 bp, Homo sapiens
ccaggcagagggatccccatcc

SEQ ID NO: 7374001 - DNA, 20 bp, Homo sapiens
tcttacaatcgttacatcca

SEQ ID NO: 7374002 - DNA, 22 bp, Homo sapiens
tcttacaccattcaaatatttt

SEQ ID NO: 7374003 - DNA, 22 bp, Homo sapiens
tcttacccggcaacgtgtgtcg

SEQ ID NO: 7374004 - DNA, 22 bp, Homo sapiens
tcttaatgctagccaatagaga

SEQ ID NO: 7374005 - DNA, 22 bp, Homo sapiens
tcttaattctgtgtcttcacta

SEQ ID NO: 7374006 - DNA, 23 bp, Homo sapiens
tgaaacagatgccaatgatcaag

SEQ ID NO: 7374007 - DNA, 21 bp, Homo sapiens
tgaaacactctttccatgaga

SEQ ID NO: 7374008 - DNA, 22 bp, Homo sapiens
tgaaacagaagatgttcatgtg

SEQ ID NO: 7374009 - DNA, 22 bp, Homo sapiens
tgaaacagagtggatacagtga

SEQ ID NO: 7374010 - DNA, 22 bp, Homo sapiens
tgaaacaaatttggaaaatcta

SEQ ID NO: 7374011 - DNA, 22 bp, Homo sapiens
tcttttgtgccaagtaatgaat

SEQ ID NO: 7374012 - DNA, 22 bp, Homo sapiens
tcttttgtgattctttagttac

SEQ ID NO: 7374013 - DNA, 21 bp, Homo sapiens
tgaaacaatcagacagagtct

SEQ ID NO: 7374014 - DNA, 21 bp, Homo sapiens
tgaaatgagaatgctgagcac

SEQ ID NO: 7374015 - DNA, 22 bp, Homo sapiens
tcttgcagaagaagctgccaag

SEQ ID NO: 7374016 - DNA, 22 bp, Homo sapiens
tcttgcagacagcttccagcct

SEQ ID NO: 7374017 - DNA, 22 bp, Homo sapiens
tcttgcagactcacaaggtact

SEQ ID NO: 7374018 - DNA, 20 bp, Homo sapiens
tcttgcagctcctgtaccat

SEQ ID NO: 7374019 - DNA, 19 bp, Homo sapiens
tcttgcagccccagcaggc

SEQ ID NO: 7374020 - DNA, 22 bp, Homo sapiens
tcttgcagcttcatctgcaatt

SEQ ID NO: 7374021 - DNA, 22 bp, Homo sapiens
tcttgcaggcatgaaaggactc

SEQ ID NO: 7374022 - DNA, 22 bp, Homo sapiens
ccaggcctgcatctgctgcgca

SEQ ID NO: 7374023 - DNA, 22 bp, Homo sapiens
tcttgatttgaattgcagttgt

SEQ ID NO: 7374024 - DNA, 22 bp, Homo sapiens
tcttgcaggcggctcagcaacc

SEQ ID NO: 7374025 - DNA, 22 bp, Homo sapiens
tcttgcaggcaaactacctcta

SEQ ID NO: 7374026 - DNA, 22 bp, Homo sapiens
tcttgcagttgcgcagtgcatg

SEQ ID NO: 7374027 - DNA, 22 bp, Homo sapiens
tcttttgtcggtgtatcatgga

SEQ ID NO: 7374028 - DNA, 22 bp, Homo sapiens
ccagggctgagactgtattggg

SEQ ID NO: 7374029 - DNA, 22 bp, Homo sapiens
ccagggctgagctgtgaccatg

SEQ ID NO: 7374030 - DNA, 22 bp, Homo sapiens
ccagggcatgggaagaactgaa

SEQ ID NO: 7374031 - DNA, 22 bp, Homo sapiens
ccagggcagtgggagaaggtgc

SEQ ID NO: 7374032 - DNA, 22 bp, Homo sapiens
ccagggcacgttgggacagtac

SEQ ID NO: 7374033 - DNA, 22 bp, Homo sapiens
ccagggcacgttgggacagtac

SEQ ID NO: 7374034 - DNA, 22 bp, Homo sapiens
ccagggcaggggctggagttca

SEQ ID NO: 7374035 - DNA, 22 bp, Homo sapiens
ccagggcaattatttggagggt

SEQ ID NO: 7374036 - DNA, 22 bp, Homo sapiens
ccagggcaaatgagatcatagc

SEQ ID NO: 7374037 - DNA, 22 bp, Homo sapiens
ccagggagggtcctgtggcttc

SEQ ID NO: 7374038 - DNA, 22 bp, Homo sapiens
ccagggagggtcctgtggcttc

SEQ ID NO: 7374039 - DNA, 22 bp, Homo sapiens
ccagggagtttccaatctgaga

SEQ ID NO: 7374040 - DNA, 23 bp, Homo sapiens
ccagggagtgctactatcaagcc

SEQ ID NO: 7374041 - DNA, 22 bp, Homo sapiens
tgaaatgatatctgataacaaa

SEQ ID NO: 7374042 - DNA, 22 bp, Homo sapiens
ccagggaagattagaagccact

SEQ ID NO: 7374043 - DNA, 22 bp, Homo sapiens
tgcagggatcctagctgaagag

SEQ ID NO: 7374044 - DNA, 22 bp, Homo sapiens
tgcaggccagggtagggactag

SEQ ID NO: 7374045 - DNA, 21 bp, Homo sapiens
tgcaggcaggcagagatgctg

SEQ ID NO: 7374046 - DNA, 21 bp, Homo sapiens
tgcaggcaggcagagatgctg

SEQ ID NO: 7374047 - DNA, 22 bp, Homo sapiens
tgcaggcaggggatgagcagcc

SEQ ID NO: 7374048 - DNA, 22 bp, Homo sapiens
tgcaggcataaccgatgttgat

SEQ ID NO: 7374049 - DNA, 22 bp, Homo sapiens
tgcaggcattggtgagagaagc

SEQ ID NO: 7374050 - DNA, 22 bp, Homo sapiens
tgcagccaccacctctgctgaa

SEQ ID NO: 7374051 - DNA, 22 bp, Homo sapiens
tgcagctgattaaagggcagac

SEQ ID NO: 7374052 - DNA, 22 bp, Homo sapiens
tgcagctgcaagtccaggtcag

SEQ ID NO: 7374053 - DNA, 20 bp, Homo sapiens
tgcagctgcaggagggtggg

SEQ ID NO: 7374054 - DNA, 22 bp, Homo sapiens
tgcagctgctcattctctcagt

SEQ ID NO: 7374055 - DNA, 22 bp, Homo sapiens
tgcagctgcaggagggtgggag

SEQ ID NO: 7374056 - DNA, 22 bp, Homo sapiens
tgcagctgcctagggctggctt

SEQ ID NO: 7374057 - DNA, 22 bp, Homo sapiens
tgcagctgcctagggctggctt

SEQ ID NO: 7374058 - DNA, 22 bp, Homo sapiens
tgcagctgcctccttcccttgt

SEQ ID NO: 7374059 - DNA, 23 bp, Homo sapiens
tgcagctgcctctggcgggccgg

SEQ ID NO: 7374060 - DNA, 22 bp, Homo sapiens
cccagagctgggtgggcagcgg

SEQ ID NO: 7374061 - DNA, 22 bp, Homo sapiens
cccagagctgattgttggagcc

SEQ ID NO: 7374062 - DNA, 22 bp, Homo sapiens
cccagagctcagtgtgcaaggt

SEQ ID NO: 7374063 - DNA, 22 bp, Homo sapiens
cccagagcctcattctgttggg

SEQ ID NO: 7374064 - DNA, 22 bp, Homo sapiens
tgcactggggtcccagcgcacg

SEQ ID NO: 7374065 - DNA, 22 bp, Homo sapiens
tgcactgggaaagaaggaggga

SEQ ID NO: 7374066 - DNA, 22 bp, Homo sapiens
tgcactttaaaaaatggtgatg

SEQ ID NO: 7374067 - DNA, 22 bp, Homo sapiens
tgcactggtggtgagtgaggga

SEQ ID NO: 7374068 - DNA, 22 bp, Homo sapiens
tgcaataagtattgcttacatg

SEQ ID NO: 7374069 - DNA, 22 bp, Homo sapiens
tgcaaatattgggacagtctag

SEQ ID NO: 7374070 - DNA, 22 bp, Homo sapiens
tgcactccaggctgggtgacag

SEQ ID NO: 7374071 - DNA, 18 bp, Homo sapiens
tgcactagatgctggcag

SEQ ID NO: 7374072 - DNA, 22 bp, Homo sapiens
tgagccatgggactccaaggga

SEQ ID NO: 7374073 - DNA, 22 bp, Homo sapiens
tgagccatgggactccaaggga

SEQ ID NO: 7374074 - DNA, 22 bp, Homo sapiens
tgagcccaggagtatgaggctg

SEQ ID NO: 7374075 - DNA, 21 bp, Homo sapiens
ccagtgctacagctgcctgac

SEQ ID NO: 7374076 - DNA, 22 bp, Homo sapiens
ccagtgctaaggtagcctctgc

SEQ ID NO: 7374077 - DNA, 22 bp, Homo sapiens
tgaggcagtgctgggaagcctg

SEQ ID NO: 7374078 - DNA, 22 bp, Homo sapiens
ccagtccacgtcaagaagaggt

SEQ ID NO: 7374079 - DNA, 22 bp, Homo sapiens
ccagtccacgtcaagaagaggt

SEQ ID NO: 7374080 - DNA, 22 bp, Homo sapiens
ccagggctgctcattggctggt

SEQ ID NO: 7374081 - DNA, 22 bp, Homo sapiens
tgagcagagacttcaagggcag

SEQ ID NO: 7374082 - DNA, 22 bp, Homo sapiens
tgagcaggggagagcgaatgtg

SEQ ID NO: 7374083 - DNA, 22 bp, Homo sapiens
tgagtccatagtggatccttca

SEQ ID NO: 7374084 - DNA, 22 bp, Homo sapiens
tgataaacttagaaagaatgtt

SEQ ID NO: 7374085 - DNA, 22 bp, Homo sapiens
tgagtccaggtgcttacctgga

SEQ ID NO: 7374086 - DNA, 22 bp, Homo sapiens
tgagtccactttaaaatgtcag

SEQ ID NO: 7374087 - DNA, 22 bp, Homo sapiens
ccatccctgagtcacaggaggg

SEQ ID NO: 7374088 - DNA, 22 bp, Homo sapiens
ccatccctgggccatgtcccct

SEQ ID NO: 7374089 - DNA, 22 bp, Homo sapiens
ccatccagaccagtccatgggt

SEQ ID NO: 7374090 - DNA, 22 bp, Homo sapiens
tgaggcagtgtgagataataaa

SEQ ID NO: 7374091 - DNA, 22 bp, Homo sapiens
tgaggctgacaaaagatgaggt

SEQ ID NO: 7374092 - DNA, 22 bp, Homo sapiens
tgaggctgaaactggcgataga

SEQ ID NO: 7374093 - DNA, 18 bp, Homo sapiens
tgaggctgaatatggggc

SEQ ID NO: 7374094 - DNA, 23 bp, Homo sapiens
ccatcaggcctccgtgtccagcc

SEQ ID NO: 7374095 - DNA, 22 bp, Homo sapiens
ccatcagttttatctgacaaaa

SEQ ID NO: 7374096 - DNA, 22 bp, Homo sapiens
ccatatatgattgcctctttca

SEQ ID NO: 7374097 - DNA, 19 bp, Homo sapiens
ccatataaccagcaagtgt

SEQ ID NO: 7374098 - DNA, 18 bp, Homo sapiens
ccatcaccctaactagtg

SEQ ID NO: 7374099 - DNA, 20 bp, Homo sapiens
tggctttagtgagggaacat

SEQ ID NO: 7374100 - DNA, 20 bp, Homo sapiens
tggctttactagtggcactc

SEQ ID NO: 7374101 - DNA, 20 bp, Homo sapiens
tggctttactagtggcactc

SEQ ID NO: 7374102 - DNA, 22 bp, Homo sapiens
cctctcccacgtggcagaggct

SEQ ID NO: 7374103 - DNA, 22 bp, Homo sapiens
cctctcccagggagagcctgag

SEQ ID NO: 7374104 - DNA, 19 bp, Homo sapiens
cctctcccatgcttacctc

SEQ ID NO: 7374105 - DNA, 19 bp, Homo sapiens
cctctcccatgcttacctc

SEQ ID NO: 7374106 - DNA, 22 bp, Homo sapiens
tgggacaggaggcctctggaga

SEQ ID NO: 7374107 - DNA, 22 bp, Homo sapiens
tgggacagattataagtctgca

SEQ ID NO: 7374108 - DNA, 22 bp, Homo sapiens
tgggacagagtgagctttggcc

SEQ ID NO: 7374109 - DNA, 22 bp, Homo sapiens
tgggcagacattgagtttgttc

SEQ ID NO: 7374110 - DNA, 22 bp, Homo sapiens
tgggagagcagagaaccctctt

SEQ ID NO: 7374111 - DNA, 22 bp, Homo sapiens
cctcctgggctcctgtctgcac

SEQ ID NO: 7374112 - DNA, 22 bp, Homo sapiens
cctcccacttcttgctgaggtc

SEQ ID NO: 7374113 - DNA, 22 bp, Homo sapiens
cctcccacatcctagctctgct

SEQ ID NO: 7374114 - DNA, 22 bp, Homo sapiens
cctccagggcagacggggagca

SEQ ID NO: 7374115 - DNA, 22 bp, Homo sapiens
tggcattttgttcagtatatgg

SEQ ID NO: 7374116 - DNA, 23 bp, Homo sapiens
tggcattttagttagcttcagtg

SEQ ID NO: 7374117 - DNA, 22 bp, Homo sapiens
tggcagtgtgggaggaaggtac

SEQ ID NO: 7374118 - DNA, 21 bp, Homo sapiens
tgggcctcaagtgggtggcag

SEQ ID NO: 7374119 - DNA, 22 bp, Homo sapiens
tgggcaggcaagtgaatacctt

SEQ ID NO: 7374120 - DNA, 22 bp, Homo sapiens
tgggcctggccctgtggaggag

SEQ ID NO: 7374121 - DNA, 22 bp, Homo sapiens
tgggctcatgtttctttgagga

SEQ ID NO: 7374122 - DNA, 22 bp, Homo sapiens
cctgagtgccatgagagcaccc

SEQ ID NO: 7374123 - DNA, 21 bp, Homo sapiens
cctgagtgagacctggcccgt

SEQ ID NO: 7374124 - DNA, 22 bp, Homo sapiens
cctgagtgaattccctcactgt

SEQ ID NO: 7374125 - DNA, 22 bp, Homo sapiens
cctgagtgacctgaggtctagt

SEQ ID NO: 7374126 - DNA, 22 bp, Homo sapiens
cctgagtgcttccagagtcatg

SEQ ID NO: 7374127 - DNA, 22 bp, Homo sapiens
cctgagtggagggattctgcag

SEQ ID NO: 7374128 - DNA, 22 bp, Homo sapiens
cctgagtggccaggcagctgtg

SEQ ID NO: 7374129 - DNA, 22 bp, Homo sapiens
cctgagtggcagggtttgggct

SEQ ID NO: 7374130 - DNA, 17 bp, Homo sapiens
cctgagtgggagaggaa

SEQ ID NO: 7374131 - DNA, 22 bp, Homo sapiens
cctgagtggggagctaagtgag

SEQ ID NO: 7374132 - DNA, 22 bp, Homo sapiens
cctgagtggtgctaagcagata

SEQ ID NO: 7374133 - DNA, 22 bp, Homo sapiens
cctgagtgtaataatgaaggca

SEQ ID NO: 7374134 - DNA, 22 bp, Homo sapiens
cctgagttgtcagttgctgtag

SEQ ID NO: 7374135 - DNA, 22 bp, Homo sapiens
cctgagttcttatttccagtca

SEQ ID NO: 7374136 - DNA, 19 bp, Homo sapiens
cctgagtgtttcagagaca

SEQ ID NO: 7374137 - DNA, 22 bp, Homo sapiens
cctgataacacagatacaagat

SEQ ID NO: 7374138 - DNA, 22 bp, Homo sapiens
cctgatcaaagaggtcagcatt

SEQ ID NO: 7374139 - DNA, 22 bp, Homo sapiens
tggggagaggtatcattgagat

SEQ ID NO: 7374140 - DNA, 22 bp, Homo sapiens
cctgcaggctgcaggccagttc

SEQ ID NO: 7374141 - DNA, 22 bp, Homo sapiens
cctgcagggaatcgaggcagaa

SEQ ID NO: 7374142 - DNA, 22 bp, Homo sapiens
cctgcctgaaggtcagccaccc

SEQ ID NO: 7374143 - DNA, 19 bp, Homo sapiens
cctgcctgaccccggctac

SEQ ID NO: 7374144 - DNA, 22 bp, Homo sapiens
cctgcctgcaaaatgggacaag

SEQ ID NO: 7374145 - DNA, 22 bp, Homo sapiens
cctgcctgcaccttctctgggg

SEQ ID NO: 7374146 - DNA, 22 bp, Homo sapiens
tggtgggagtccgctgtgctgc

SEQ ID NO: 7374147 - DNA, 22 bp, Homo sapiens
tggttacagaacatgaatgttg

SEQ ID NO: 7374148 - DNA, 22 bp, Homo sapiens
tggttagacacatgcatgtcat

SEQ ID NO: 7374149 - DNA, 22 bp, Homo sapiens
cctgcctactgagttttatatt

SEQ ID NO: 7374150 - DNA, 22 bp, Homo sapiens
cctgcctatgagacgttttgcc

SEQ ID NO: 7374151 - DNA, 22 bp, Homo sapiens
tggtagcaacatctcagtggct

SEQ ID NO: 7374152 - DNA, 22 bp, Homo sapiens
cctgccctgtcactggctaggg

SEQ ID NO: 7374153 - DNA, 22 bp, Homo sapiens
tggtaaggttccagatctagaa

SEQ ID NO: 7374154 - DNA, 22 bp, Homo sapiens
tggtaaggttctacagtgttga

SEQ ID NO: 7374155 - DNA, 22 bp, Homo sapiens
tgggtgggagcaccctgtctgg

SEQ ID NO: 7374156 - DNA, 22 bp, Homo sapiens
tgggtcagtttgggggccagcc

SEQ ID NO: 7374157 - DNA, 22 bp, Homo sapiens
tgggtggcacttctggggtcca

SEQ ID NO: 7374158 - DNA, 22 bp, Homo sapiens
tgggtggcggcctggttctgag

SEQ ID NO: 7374159 - DNA, 18 bp, Homo sapiens
tgggtggctagggagttt

SEQ ID NO: 7374160 - DNA, 22 bp, Homo sapiens
cctgcatgtggtcagcactcct

SEQ ID NO: 7374161 - DNA, 22 bp, Homo sapiens
cctgcattaaatcctgttctgc

SEQ ID NO: 7374162 - DNA, 22 bp, Homo sapiens
cctgcattgctcttctgttcct

SEQ ID NO: 7374163 - DNA, 22 bp, Homo sapiens
cctgccagaaaagagggagttc

SEQ ID NO: 7374164 - DNA, 22 bp, Homo sapiens
cctgcaggttgcagaggcggaa

SEQ ID NO: 7374165 - DNA, 22 bp, Homo sapiens
cctgcaggtccccggatgcgca

SEQ ID NO: 7374166 - DNA, 22 bp, Homo sapiens
cctgcagggtgctgccacagat

SEQ ID NO: 7374167 - DNA, 22 bp, Homo sapiens
cctgcagggtgctgccacagat

SEQ ID NO: 7374168 - DNA, 22 bp, Homo sapiens
tgctgccttagcagccaggcaa

SEQ ID NO: 7374169 - DNA, 22 bp, Homo sapiens
tgctgccttagaaatggctata

SEQ ID NO: 7374170 - DNA, 22 bp, Homo sapiens
tgctgccttctaggcgtgccct

SEQ ID NO: 7374171 - DNA, 22 bp, Homo sapiens
tgctgcctttactgggatttaa

SEQ ID NO: 7374172 - DNA, 22 bp, Homo sapiens
tgctgccttgacctcctgggct

SEQ ID NO: 7374173 - DNA, 22 bp, Homo sapiens
tgctgccttgtgctgcctttca

SEQ ID NO: 7374174 - DNA, 22 bp, Homo sapiens
tgctgcctttgcttagcgaata

SEQ ID NO: 7374175 - DNA, 22 bp, Homo sapiens
tgctgcctttcaatgttgtcat

SEQ ID NO: 7374176 - DNA, 22 bp, Homo sapiens
tgctgcctttctgaatggtgga

SEQ ID NO: 7374177 - DNA, 22 bp, Homo sapiens
tgctgcaggcagcccctctact

SEQ ID NO: 7374178 - DNA, 22 bp, Homo sapiens
tgctgcctgatgctttctggac

SEQ ID NO: 7374179 - DNA, 22 bp, Homo sapiens
tgctgcctggagccttttgttt

SEQ ID NO: 7374180 - DNA, 22 bp, Homo sapiens
tgctgcctgctacgagggaaga

SEQ ID NO: 7374181 - DNA, 22 bp, Homo sapiens
tgctgcctggtttcttcttgct

SEQ ID NO: 7374182 - DNA, 22 bp, Homo sapiens
tgctgcctgtgccaggagggtc

SEQ ID NO: 7374183 - DNA, 20 bp, Homo sapiens
tgctgcctgtttttgtgaat

SEQ ID NO: 7374184 - DNA, 22 bp, Homo sapiens
tgctgcctgttgtggggccacg

SEQ ID NO: 7374185 - DNA, 21 bp, Homo sapiens
tgctgcctgtgggtgtttacc

SEQ ID NO: 7374186 - DNA, 22 bp, Homo sapiens
cccagtggagataggagtgtgg

SEQ ID NO: 7374187 - DNA, 22 bp, Homo sapiens
cccagtggaaggagtagaagac

SEQ ID NO: 7374188 - DNA, 19 bp, Homo sapiens
cccagtctaggtcctagga

SEQ ID NO: 7374189 - DNA, 19 bp, Homo sapiens
cccagtccttgtcctgggc

SEQ ID NO: 7374190 - DNA, 22 bp, Homo sapiens
tgctcaggtcgttctgcccctt

SEQ ID NO: 7374191 - DNA, 22 bp, Homo sapiens
tgcaggtgctccgggggtgccc

SEQ ID NO: 7374192 - DNA, 19 bp, Homo sapiens
tgctaatcaagaaaacctt

SEQ ID NO: 7374193 - DNA, 22 bp, Homo sapiens
tgccttctcttccctgggagct

SEQ ID NO: 7374194 - DNA, 22 bp, Homo sapiens
tgctaggggtcagcaccatatc

SEQ ID NO: 7374195 - DNA, 22 bp, Homo sapiens
tgctaggtgctcctccctaatt

SEQ ID NO: 7374196 - DNA, 22 bp, Homo sapiens
tgctaggggcactaaaagctga

SEQ ID NO: 7374197 - DNA, 22 bp, Homo sapiens
tgctcaggagcttagagcacag

SEQ ID NO: 7374198 - DNA, 22 bp, Homo sapiens
tgctcaggccctgggccatcct

SEQ ID NO: 7374199 - DNA, 22 bp, Homo sapiens
tgctcagggagcttcctggtgg

SEQ ID NO: 7374200 - DNA, 22 bp, Homo sapiens
cccagttgttgccggctctgga

SEQ ID NO: 7374201 - DNA, 22 bp, Homo sapiens
tgctgcctttgtggggtcactg

SEQ ID NO: 7374202 - DNA, 22 bp, Homo sapiens
tgctgcctttgggacctggcct

SEQ ID NO: 7374203 - DNA, 22 bp, Homo sapiens
tgcttccctgctctgcacacct

SEQ ID NO: 7374204 - DNA, 19 bp, Homo sapiens
tgcttcctcaccatctccc

SEQ ID NO: 7374205 - DNA, 22 bp, Homo sapiens
tgcttcctgaggccgtcttctc

SEQ ID NO: 7374206 - DNA, 22 bp, Homo sapiens
tgcttccttcccgttcttctcc

SEQ ID NO: 7374207 - DNA, 22 bp, Homo sapiens
tgcttccttgagctctccaatc

SEQ ID NO: 7374208 - DNA, 22 bp, Homo sapiens
ccctccctatgtagatgatgtt

SEQ ID NO: 7374209 - DNA, 22 bp, Homo sapiens
tgcttggctaaaaatggcaaga

SEQ ID NO: 7374210 - DNA, 22 bp, Homo sapiens
tgcttgctggaggcagacagaa

SEQ ID NO: 7374211 - DNA, 22 bp, Homo sapiens
tgcttgctgggccaatggcaat

SEQ ID NO: 7374212 - DNA, 22 bp, Homo sapiens
tgcttgctgggtcttgcatctg

SEQ ID NO: 7374213 - DNA, 22 bp, Homo sapiens
tgcttgctgtaaagcttggtca

SEQ ID NO: 7374214 - DNA, 22 bp, Homo sapiens
tgcttgcttcagccctcatctt

SEQ ID NO: 7374215 - DNA, 22 bp, Homo sapiens
tgcttgcttctcacatgcacct

SEQ ID NO: 7374216 - DNA, 22 bp, Homo sapiens
tgcttgcttgaggcgagacatt

SEQ ID NO: 7374217 - DNA, 22 bp, Homo sapiens
ccctccctgaagaagttactct

SEQ ID NO: 7374218 - DNA, 22 bp, Homo sapiens
ccctccctttgcagcagtgcat

SEQ ID NO: 7374219 - DNA, 22 bp, Homo sapiens
ccctcctcaactctggcttcca

SEQ ID NO: 7374220 - DNA, 23 bp, Homo sapiens
tggaaacattctgaatgtccatc

SEQ ID NO: 7374221 - DNA, 22 bp, Homo sapiens
ccctcctcaactctggcttcca

SEQ ID NO: 7374222 - DNA, 22 bp, Homo sapiens
tggagacatgggcgaatctaag

SEQ ID NO: 7374223 - DNA, 22 bp, Homo sapiens
tggagaattctatgttgagggg

SEQ ID NO: 7374224 - DNA, 22 bp, Homo sapiens
tggagaattctatgttgagggg

SEQ ID NO: 7374225 - DNA, 22 bp, Homo sapiens
tggagacagagatagccaattg

SEQ ID NO: 7374226 - DNA, 18 bp, Homo sapiens
tggagacatagacaatgt

SEQ ID NO: 7374227 - DNA, 18 bp, Homo sapiens
tggagacatagacaatgt

SEQ ID NO: 7374228 - DNA, 22 bp, Homo sapiens
tggaggagaactccctggctac

SEQ ID NO: 7374229 - DNA, 22 bp, Homo sapiens
tggaggagaactccctggctac

SEQ ID NO: 7374230 - DNA, 22 bp, Homo sapiens
tggaggcagtttaagtctgaga

SEQ ID NO: 7374231 - DNA, 22 bp, Homo sapiens
tggaggcattgtgactgctgaa

SEQ ID NO: 7374232 - DNA, 22 bp, Homo sapiens
ccctggaggaagaaacaatggc

SEQ ID NO: 7374233 - DNA, 22 bp, Homo sapiens
tggaggacaggactggacagcc

SEQ ID NO: 7374234 - DNA, 22 bp, Homo sapiens
ccctggagtgccggaatcaaga

SEQ ID NO: 7374235 - DNA, 22 bp, Homo sapiens
ccctggagtccggagctcacct

SEQ ID NO: 7374236 - DNA, 22 bp, Homo sapiens
ccctggagtccggagctcacct

SEQ ID NO: 7374237 - DNA, 22 bp, Homo sapiens
ccctggaggtggaggttgcagg

SEQ ID NO: 7374238 - DNA, 22 bp, Homo sapiens
ccctggaggtcagaggcctggg

SEQ ID NO: 7374239 - DNA, 22 bp, Homo sapiens
ccctggagggcagacagatgcc

SEQ ID NO: 7374240 - DNA, 22 bp, Homo sapiens
ccctggctgctaccaggtagct

SEQ ID NO: 7374241 - DNA, 22 bp, Homo sapiens
tggcagaagtacacaagcatgc

SEQ ID NO: 7374242 - DNA, 22 bp, Homo sapiens
ccctggagtgtgacgaggcatt

SEQ ID NO: 7374243 - DNA, 22 bp, Homo sapiens
ccctgggacccgctgcagaggc

SEQ ID NO: 7374244 - DNA, 22 bp, Homo sapiens
ccctttagcccctgcagagact

SEQ ID NO: 7374245 - DNA, 22 bp, Homo sapiens
ccctttaaggtctgattttcag

SEQ ID NO: 7374246 - DNA, 22 bp, Homo sapiens
cccttgggccccagctcagggc

SEQ ID NO: 7374247 - DNA, 22 bp, Homo sapiens
cccttggggtggaggttgcagt

SEQ ID NO: 7374248 - DNA, 22 bp, Homo sapiens
gagaaagatggaatcttacagg

SEQ ID NO: 7374249 - DNA, 22 bp, Homo sapiens
gagaaacactgttagtttatta

SEQ ID NO: 7374250 - DNA, 22 bp, Homo sapiens
gactgcctcagtttccctgcag

SEQ ID NO: 7374251 - DNA, 20 bp, Homo sapiens
gagacagcaaaagcctctcc

SEQ ID NO: 7374252 - DNA, 19 bp, Homo sapiens
gagacatgtagatagaaga

SEQ ID NO: 7374253 - DNA, 22 bp, Homo sapiens
gagaaaggcattcctatgcaaa

SEQ ID NO: 7374254 - DNA, 22 bp, Homo sapiens
gagaaaggcattcctatgcaaa

SEQ ID NO: 7374255 - DNA, 22 bp, Homo sapiens
gagagggcaaggtagatgctac

SEQ ID NO: 7374256 - DNA, 21 bp, Homo sapiens
gagagggcattataggaagtg

SEQ ID NO: 7374257 - DNA, 22 bp, Homo sapiens
gagagggctgcctggtgtgagg

SEQ ID NO: 7374258 - DNA, 22 bp, Homo sapiens
gagagaaatgtgcagtttgggc

SEQ ID NO: 7374259 - DNA, 22 bp, Homo sapiens
gagagaaattagttggtttgct

SEQ ID NO: 7374260 - DNA, 18 bp, Homo sapiens
gagagggatccctcagga

SEQ ID NO: 7374261 - DNA, 22 bp, Homo sapiens
gagagaaaacaagttctccatt

SEQ ID NO: 7374262 - DNA, 21 bp, Homo sapiens
gagactctcatgttatttgga

SEQ ID NO: 7374263 - DNA, 22 bp, Homo sapiens
gagactcttgctttaatagccc

SEQ ID NO: 7374264 - DNA, 20 bp, Homo sapiens
gagactggatctggagagac

SEQ ID NO: 7374265 - DNA, 22 bp, Homo sapiens
gagactgcattgtccaagggtt

SEQ ID NO: 7374266 - DNA, 22 bp, Homo sapiens
gagactgcatagatggccacaa

SEQ ID NO: 7374267 - DNA, 22 bp, Homo sapiens
gagactgctggtaaagatggga

SEQ ID NO: 7374268 - DNA, 22 bp, Homo sapiens
gactctcaagcacaagtccacc

SEQ ID NO: 7374269 - DNA, 21 bp, Homo sapiens
gactctctagtgctgtccagt

SEQ ID NO: 7374270 - DNA, 22 bp, Homo sapiens
gaccaggagatttgagctaggc

SEQ ID NO: 7374271 - DNA, 22 bp, Homo sapiens
gacatttagaagttagattcaa

SEQ ID NO: 7374272 - DNA, 22 bp, Homo sapiens
gaccagaaatcaacacagaatg

SEQ ID NO: 7374273 - DNA, 22 bp, Homo sapiens
gaccagagaaaggcactggaag

SEQ ID NO: 7374274 - DNA, 22 bp, Homo sapiens
gacatttaaattgcaggcagcc

SEQ ID NO: 7374275 - DNA, 22 bp, Homo sapiens
gacatttactgaatactgatta

SEQ ID NO: 7374276 - DNA, 22 bp, Homo sapiens
gacattcaagtttgcagttagg

SEQ ID NO: 7374277 - DNA, 22 bp, Homo sapiens
gacattcacagtttccgatggt

SEQ ID NO: 7374278 - DNA, 22 bp, Homo sapiens
gacattcagactcacatggagg

SEQ ID NO: 7374279 - DNA, 22 bp, Homo sapiens
gacattcacaggtaaacattcc

SEQ ID NO: 7374280 - DNA, 22 bp, Homo sapiens
gacattcattgatgtcttcctc

SEQ ID NO: 7374281 - DNA, 22 bp, Homo sapiens
gacattctaaaaaatatggaag

SEQ ID NO: 7374282 - DNA, 22 bp, Homo sapiens
gacattcagccaattactttct

SEQ ID NO: 7374283 - DNA, 22 bp, Homo sapiens
gacattcaggtgttcaatgcca

SEQ ID NO: 7374284 - DNA, 20 bp, Homo sapiens
gacattcatagttattacca

SEQ ID NO: 7374285 - DNA, 22 bp, Homo sapiens
gacattcattaagcctttctgt

SEQ ID NO: 7374286 - DNA, 22 bp, Homo sapiens
gacattcattaagcctttctgt

SEQ ID NO: 7374287 - DNA, 22 bp, Homo sapiens
gacagcagcataatacatgaac

SEQ ID NO: 7374288 - DNA, 22 bp, Homo sapiens
gacagaggagaagatgctgtgg

SEQ ID NO: 7374289 - DNA, 22 bp, Homo sapiens
gacagcaagagacagagcatcc

SEQ ID NO: 7374290 - DNA, 22 bp, Homo sapiens
gaagggggaaaatgacaacaga

SEQ ID NO: 7374291 - DNA, 22 bp, Homo sapiens
gaagggtgcatggagggaagtc

SEQ ID NO: 7374292 - DNA, 22 bp, Homo sapiens
gaaggtgcagtggctggaggct

SEQ ID NO: 7374293 - DNA, 22 bp, Homo sapiens
gaatcatttatttttgacagca

SEQ ID NO: 7374294 - DNA, 22 bp, Homo sapiens
gaaggttatgggggttggatta

SEQ ID NO: 7374295 - DNA, 22 bp, Homo sapiens
gacagacactgtgtcctcactt

SEQ ID NO: 7374296 - DNA, 22 bp, Homo sapiens
gaatgagggagatgttggtgca

SEQ ID NO: 7374297 - DNA, 22 bp, Homo sapiens
gaatgaggtcatcttgtaatct

SEQ ID NO: 7374298 - DNA, 22 bp, Homo sapiens
gaatgacattgaaaagacattg

SEQ ID NO: 7374299 - DNA, 22 bp, Homo sapiens
gaatgaataggtgtccagatgg

SEQ ID NO: 7374300 - DNA, 18 bp, Homo sapiens
gaaaggagagacagtagg

SEQ ID NO: 7374301 - DNA, 17 bp, Homo sapiens
gaaaggaggcaacactg

SEQ ID NO: 7374302 - DNA, 22 bp, Homo sapiens
gaaaggagagggttaaggagct

SEQ ID NO: 7374303 - DNA, 17 bp, Homo sapiens
gaaaggaggcaacactg

SEQ ID NO: 7374304 - DNA, 22 bp, Homo sapiens
gaaaggagggaaacagagcggt

SEQ ID NO: 7374305 - DNA, 22 bp, Homo sapiens
gaaaggagggctcacaaaagtg

SEQ ID NO: 7374306 - DNA, 22 bp, Homo sapiens
gaaaggaacttgtgagtgggag

SEQ ID NO: 7374307 - DNA, 22 bp, Homo sapiens
gaaaggaaattgagggacgcat

SEQ ID NO: 7374308 - DNA, 22 bp, Homo sapiens
gaaaggaagaaaggtcatttta

SEQ ID NO: 7374309 - DNA, 22 bp, Homo sapiens
gaaagcttccattttgtacatt

SEQ ID NO: 7374310 - DNA, 22 bp, Homo sapiens
gaaagcttccattttgtacatt

SEQ ID NO: 7374311 - DNA, 22 bp, Homo sapiens
gaaaggaaatattctaagcact

SEQ ID NO: 7374312 - DNA, 22 bp, Homo sapiens
gaagcagctaggatcttcattt

SEQ ID NO: 7374313 - DNA, 22 bp, Homo sapiens
gaagcagctcagattgactgaa

SEQ ID NO: 7374314 - DNA, 22 bp, Homo sapiens
gaagcagcgaagtggaagggac

SEQ ID NO: 7374315 - DNA, 22 bp, Homo sapiens
gaagcagccacggggagacaga

SEQ ID NO: 7374316 - DNA, 22 bp, Homo sapiens
gaagcagcagctggggacagtt

SEQ ID NO: 7374317 - DNA, 22 bp, Homo sapiens
gaaaggcaggcagggtgtccat

SEQ ID NO: 7374318 - DNA, 22 bp, Homo sapiens
gaagcaaaatgtctgcacatat

SEQ ID NO: 7374319 - DNA, 22 bp, Homo sapiens
gaagcaaagagctagtgccgct

SEQ ID NO: 7374320 - DNA, 22 bp, Homo sapiens
gaagcaagtgcaaggaagaggc

SEQ ID NO: 7374321 - DNA, 22 bp, Homo sapiens
gaagcagctttctggtgaggag

SEQ ID NO: 7374322 - DNA, 22 bp, Homo sapiens
gaagcagctggtgagatggagc

SEQ ID NO: 7374323 - DNA, 22 bp, Homo sapiens
gaaggcccagcttgaatgctgc

SEQ ID NO: 7374324 - DNA, 22 bp, Homo sapiens
gaaggcccagtcaaggggctag

SEQ ID NO: 7374325 - DNA, 22 bp, Homo sapiens
gaagggaaggaaagaaccagca

SEQ ID NO: 7374326 - DNA, 22 bp, Homo sapiens
gaaggcagtaaatggctgtttt

SEQ ID NO: 7374327 - DNA, 22 bp, Homo sapiens
gaaggcacagatggcagtccac

SEQ ID NO: 7374328 - DNA, 22 bp, Homo sapiens
gaaggcaaggagggaagccacc

SEQ ID NO: 7374329 - DNA, 22 bp, Homo sapiens
gaaggcaccctccatcactcac

SEQ ID NO: 7374330 - DNA, 22 bp, Homo sapiens
gaaggcaccctccatcactcac

SEQ ID NO: 7374331 - DNA, 22 bp, Homo sapiens
gaaggcacccggcgtgcggcgg

SEQ ID NO: 7374332 - DNA, 22 bp, Homo sapiens
gaaggcactgaactccttctgg

SEQ ID NO: 7374333 - DNA, 22 bp, Homo sapiens
gaaggcaggcttctgattaggt

SEQ ID NO: 7374334 - DNA, 22 bp, Homo sapiens
gaggaaaatgggacaggctgta

SEQ ID NO: 7374335 - DNA, 22 bp, Homo sapiens
gaggaaatcattccagaaaagg

SEQ ID NO: 7374336 - DNA, 23 bp, Homo sapiens
gaggaaagaatatagatgcaatc

SEQ ID NO: 7374337 - DNA, 22 bp, Homo sapiens
gagctgcctgtgtgccatgatg

SEQ ID NO: 7374338 - DNA, 22 bp, Homo sapiens
gagctgcctgttgcatagcaac

SEQ ID NO: 7374339 - DNA, 19 bp, Homo sapiens
gagctgccttttgaagacc

SEQ ID NO: 7374340 - DNA, 22 bp, Homo sapiens
gaggaaaatgggacaggctgta

SEQ ID NO: 7374341 - DNA, 22 bp, Homo sapiens
gaggaaaatggagtgtaattaa

SEQ ID NO: 7374342 - DNA, 22 bp, Homo sapiens
gaggagagagggactgtctgca

SEQ ID NO: 7374343 - DNA, 22 bp, Homo sapiens
gaggaagaagcaaaccagctaa

SEQ ID NO: 7374344 - DNA, 22 bp, Homo sapiens
gagctgcctacattgccaagag

SEQ ID NO: 7374345 - DNA, 22 bp, Homo sapiens
gagctgcctgaacaagcagcag

SEQ ID NO: 7374346 - DNA, 22 bp, Homo sapiens
gagctgccggcccacagtacta

SEQ ID NO: 7374347 - DNA, 22 bp, Homo sapiens
gagctgagtctgcagtcgccat

SEQ ID NO: 7374348 - DNA, 22 bp, Homo sapiens
gagctgagtagaggctgctccc

SEQ ID NO: 7374349 - DNA, 22 bp, Homo sapiens
gagctgaggctcaggctggcgt

SEQ ID NO: 7374350 - DNA, 22 bp, Homo sapiens
gagctgaggccagagtcttctg

SEQ ID NO: 7374351 - DNA, 22 bp, Homo sapiens
gagctgagcttaactccttgaa

SEQ ID NO: 7374352 - DNA, 22 bp, Homo sapiens
gagccctgtgattctgttgtgt

SEQ ID NO: 7374353 - DNA, 22 bp, Homo sapiens
gagccctgtaggaatctctcaa

SEQ ID NO: 7374354 - DNA, 22 bp, Homo sapiens
gagccctgtaggaatctctcaa

SEQ ID NO: 7374355 - DNA, 22 bp, Homo sapiens
gagctgagatcgtgccattgca

SEQ ID NO: 7374356 - DNA, 22 bp, Homo sapiens
gagccctgttcaggcctcctca

SEQ ID NO: 7374357 - DNA, 22 bp, Homo sapiens
gagccctgtagcaagtcatgtc

SEQ ID NO: 7374358 - DNA, 18 bp, Homo sapiens
gagccctgggagatctct

SEQ ID NO: 7374359 - DNA, 22 bp, Homo sapiens
gagccctgtagcaagtcatgtc

SEQ ID NO: 7374360 - DNA, 22 bp, Homo sapiens
gagccctgcgtgtctgggggca

SEQ ID NO: 7374361 - DNA, 22 bp, Homo sapiens
gagccctgctgggccttgtctc

SEQ ID NO: 7374362 - DNA, 22 bp, Homo sapiens
gagccctgatttgcagcatttg

SEQ ID NO: 7374363 - DNA, 22 bp, Homo sapiens
gagccctgcccacttgtctgag

SEQ ID NO: 7374364 - DNA, 18 bp, Homo sapiens
gagccctgagtctgcaca

SEQ ID NO: 7374365 - DNA, 18 bp, Homo sapiens
gagccctgagtctgcaca

SEQ ID NO: 7374366 - DNA, 22 bp, Homo sapiens
gagccctgacactgagggagtt

SEQ ID NO: 7374367 - DNA, 22 bp, Homo sapiens
gagccctgagagttgtgaggcc

SEQ ID NO: 7374368 - DNA, 22 bp, Homo sapiens
gagccctgaacaacagcaggaa

SEQ ID NO: 7374369 - DNA, 22 bp, Homo sapiens
gagcccaggttctgcttccagc

SEQ ID NO: 7374370 - DNA, 22 bp, Homo sapiens
gagccatgagatagttggttcg

SEQ ID NO: 7374371 - DNA, 22 bp, Homo sapiens
gagcccagcccagagccatatg

SEQ ID NO: 7374372 - DNA, 22 bp, Homo sapiens
gagccaggtttgaatctcagtc

SEQ ID NO: 7374373 - DNA, 22 bp, Homo sapiens
gagcccagctgcggccctcagc

SEQ ID NO: 7374374 - DNA, 22 bp, Homo sapiens
gagcccagctctacctcagact

SEQ ID NO: 7374375 - DNA, 22 bp, Homo sapiens
gagcccagctgtccttggcaaa

SEQ ID NO: 7374376 - DNA, 22 bp, Homo sapiens
gagcatgcgcgtgggagacacc

SEQ ID NO: 7374377 - DNA, 19 bp, Homo sapiens
gagcatgactggccttgca

SEQ ID NO: 7374378 - DNA, 22 bp, Homo sapiens
gagcatgagggaaggcagcaga

SEQ ID NO: 7374379 - DNA, 18 bp, Homo sapiens
gagcatgggcagtgggga

SEQ ID NO: 7374380 - DNA, 22 bp, Homo sapiens
gagcatggctgcctccctgtgc

SEQ ID NO: 7374381 - DNA, 22 bp, Homo sapiens
gagcagtggtggtgtgttagag

SEQ ID NO: 7374382 - DNA, 22 bp, Homo sapiens
gagcagttttatttcatgagac

SEQ ID NO: 7374383 - DNA, 22 bp, Homo sapiens
gagcagttttatttcatgagac

SEQ ID NO: 7374384 - DNA, 22 bp, Homo sapiens
gagcagtgtttgtggacctgga

SEQ ID NO: 7374385 - DNA, 22 bp, Homo sapiens
gagcagtgagtgaatgttgcct

SEQ ID NO: 7374386 - DNA, 22 bp, Homo sapiens
gaggagaggggctcccaagagc

SEQ ID NO: 7374387 - DNA, 22 bp, Homo sapiens
gaggagaggctggacgcggtga

SEQ ID NO: 7374388 - DNA, 22 bp, Homo sapiens
gaggagaggccatcgttgttat

SEQ ID NO: 7374389 - DNA, 22 bp, Homo sapiens
gaggagagatggtagattgggt

SEQ ID NO: 7374390 - DNA, 22 bp, Homo sapiens
gaggagagatggtagattgggt

SEQ ID NO: 7374391 - DNA, 22 bp, Homo sapiens
gaggagagcctgcactttgacc

SEQ ID NO: 7374392 - DNA, 22 bp, Homo sapiens
gaggagcaagaaatagtgccca

SEQ ID NO: 7374393 - DNA, 22 bp, Homo sapiens
gaggagcacatgaggctgaggg

SEQ ID NO: 7374394 - DNA, 22 bp, Homo sapiens
gaggagcacatgaggctgaggg

SEQ ID NO: 7374395 - DNA, 22 bp, Homo sapiens
gaggagcacatgaggctgaggg

SEQ ID NO: 7374396 - DNA, 22 bp, Homo sapiens
gaggagcatgggaaggctctgg

SEQ ID NO: 7374397 - DNA, 22 bp, Homo sapiens
gaggagccaaggtatgtgtgtt

SEQ ID NO: 7374398 - DNA, 22 bp, Homo sapiens
gaggagcatgggaaggctctgg

SEQ ID NO: 7374399 - DNA, 22 bp, Homo sapiens
gaggcaggcagattgcttgagg

SEQ ID NO: 7374400 - DNA, 22 bp, Homo sapiens
gaggcaggcagattgcttgagg

SEQ ID NO: 7374401 - DNA, 22 bp, Homo sapiens
gaggcaggcactgttatcagca

SEQ ID NO: 7374402 - DNA, 22 bp, Homo sapiens
gaggcaggaggattgcttgagc

SEQ ID NO: 7374403 - DNA, 22 bp, Homo sapiens
gaggcaggaggattgcttgagc

SEQ ID NO: 7374404 - DNA, 22 bp, Homo sapiens
gaggcagcttggggctgtgggt

SEQ ID NO: 7374405 - DNA, 22 bp, Homo sapiens
gaggagcccccactgggctcac

SEQ ID NO: 7374406 - DNA, 22 bp, Homo sapiens
gaggcagctgggtccggtcggg

SEQ ID NO: 7374407 - DNA, 22 bp, Homo sapiens
gaggcagcttagggtactgact

SEQ ID NO: 7374408 - DNA, 22 bp, Homo sapiens
gaggcagtgtttactgccctgt

SEQ ID NO: 7374409 - DNA, 22 bp, Homo sapiens
gaggcataaatcacagtgttca

SEQ ID NO: 7374410 - DNA, 22 bp, Homo sapiens
gaggcagtgtcggtggcaggat

SEQ ID NO: 7374411 - DNA, 22 bp, Homo sapiens
gaggcaggccctgaatgagtca

SEQ ID NO: 7374412 - DNA, 22 bp, Homo sapiens
gaggctcagagaggtccacata

SEQ ID NO: 7374413 - DNA, 22 bp, Homo sapiens
gaggctgacggcaccatcttct

SEQ ID NO: 7374414 - DNA, 20 bp, Homo sapiens
gaggctgaagtgtttttgct

SEQ ID NO: 7374415 - DNA, 22 bp, Homo sapiens
gagggagtgccagagggccagc

SEQ ID NO: 7374416 - DNA, 22 bp, Homo sapiens
gagggctgatgttgccacctca

SEQ ID NO: 7374417 - DNA, 22 bp, Homo sapiens
gagggagtaacgtactacagtg

SEQ ID NO: 7374418 - DNA, 22 bp, Homo sapiens
gagggaggtgatactgaacgta

SEQ ID NO: 7374419 - DNA, 22 bp, Homo sapiens
gagggaggtgatactgaacgta

SEQ ID NO: 7374420 - DNA, 22 bp, Homo sapiens
gaggctgcagctatcagacatt

SEQ ID NO: 7374421 - DNA, 22 bp, Homo sapiens
gaggctgagggttagagagtca

SEQ ID NO: 7374422 - DNA, 22 bp, Homo sapiens
gaggctgagtagctttgtgctc

SEQ ID NO: 7374423 - DNA, 22 bp, Homo sapiens
gagggaggggagctccaccctc

SEQ ID NO: 7374424 - DNA, 22 bp, Homo sapiens
gagggagggccaggtcccaacc

SEQ ID NO: 7374425 - DNA, 22 bp, Homo sapiens
gagggagggactagcattctct

SEQ ID NO: 7374426 - DNA, 22 bp, Homo sapiens
gagggagggactagcattctct

SEQ ID NO: 7374427 - DNA, 22 bp, Homo sapiens
gagggagggaaagtttaacact

SEQ ID NO: 7374428 - DNA, 22 bp, Homo sapiens
gagggaggcatcatgaatccag

SEQ ID NO: 7374429 - DNA, 22 bp, Homo sapiens
gagggagcttgatggatgtttg

SEQ ID NO: 7374430 - DNA, 22 bp, Homo sapiens
gagggagcttgatggatgtttg

SEQ ID NO: 7374431 - DNA, 22 bp, Homo sapiens
gagggagctggagcagacgccg

SEQ ID NO: 7374432 - DNA, 22 bp, Homo sapiens
gagggagagtgatggaccattg

SEQ ID NO: 7374433 - DNA, 22 bp, Homo sapiens
gagggagagtgatggaccattg

SEQ ID NO: 7374434 - DNA, 22 bp, Homo sapiens
gagggagccgccacagactggg

SEQ ID NO: 7374435 - DNA, 22 bp, Homo sapiens
gagggagctatgaatagaagaa

SEQ ID NO: 7374436 - DNA, 22 bp, Homo sapiens
ctgggaagaagtgggctacatt

SEQ ID NO: 7374437 - DNA, 22 bp, Homo sapiens
ctgcttcctgctgggatactga

SEQ ID NO: 7374438 - DNA, 22 bp, Homo sapiens
ctgggaagaagtgggctacatt

SEQ ID NO: 7374439 - DNA, 22 bp, Homo sapiens
ctgggacacccaaggaaagagc

SEQ ID NO: 7374440 - DNA, 22 bp, Homo sapiens
ctgggacacccagagctgcaga

SEQ ID NO: 7374441 - DNA, 22 bp, Homo sapiens
ctgggacacgttctattccaaa

SEQ ID NO: 7374442 - DNA, 22 bp, Homo sapiens
ctgggacacgttgtgctttaac

SEQ ID NO: 7374443 - DNA, 22 bp, Homo sapiens
ctgggacagagcagcagtgggg

SEQ ID NO: 7374444 - DNA, 22 bp, Homo sapiens
ctgcttccaagaaagagatagg

SEQ ID NO: 7374445 - DNA, 22 bp, Homo sapiens
ctgcttcctccctgtaaaggca

SEQ ID NO: 7374446 - DNA, 21 bp, Homo sapiens
ctgcttcctctcttcatggca

SEQ ID NO: 7374447 - DNA, 22 bp, Homo sapiens
ctgcttccatgcaatggcagtc

SEQ ID NO: 7374448 - DNA, 22 bp, Homo sapiens
ctgcttccatggtctggagact

SEQ ID NO: 7374449 - DNA, 22 bp, Homo sapiens
ctgcttccacacaagcaaagct

SEQ ID NO: 7374450 - DNA, 20 bp, Homo sapiens
ctgcttccaggctcaccccc

SEQ ID NO: 7374451 - DNA, 22 bp, Homo sapiens
ctgcttccataaataatgtgct

SEQ ID NO: 7374452 - DNA, 20 bp, Homo sapiens
ctgctgtgtgtgcctcagcc

SEQ ID NO: 7374453 - DNA, 22 bp, Homo sapiens
ctgcttatggagatgagtaaga

SEQ ID NO: 7374454 - DNA, 22 bp, Homo sapiens
ctgggagattgctagagatgca

SEQ ID NO: 7374455 - DNA, 22 bp, Homo sapiens
ctgggagatctcctgagggcag

SEQ ID NO: 7374456 - DNA, 23 bp, Homo sapiens
ctgggacatggtaggggcacaac

SEQ ID NO: 7374457 - DNA, 22 bp, Homo sapiens
ctgggacatggtgctgtcttta

SEQ ID NO: 7374458 - DNA, 22 bp, Homo sapiens
ctgggacattataagaaacatt

SEQ ID NO: 7374459 - DNA, 22 bp, Homo sapiens
ctgggacatgatagaaacagat

SEQ ID NO: 7374460 - DNA, 22 bp, Homo sapiens
ctgggacatattgctagtgttg

SEQ ID NO: 7374461 - DNA, 22 bp, Homo sapiens
ctgggacagttcaggtagggca

SEQ ID NO: 7374462 - DNA, 22 bp, Homo sapiens
ctgggacatagatcagcctttt

SEQ ID NO: 7374463 - DNA, 22 bp, Homo sapiens
ctgggacagctgagacaggaga

SEQ ID NO: 7374464 - DNA, 22 bp, Homo sapiens
ctgggctagaaggaccaggatg

SEQ ID NO: 7374465 - DNA, 22 bp, Homo sapiens
ctgggctcaaatcctatctcca

SEQ ID NO: 7374466 - DNA, 22 bp, Homo sapiens
ctgggcctccagctctgccagc

SEQ ID NO: 7374467 - DNA, 22 bp, Homo sapiens
ctgggcagaattttaggatggc

SEQ ID NO: 7374468 - DNA, 22 bp, Homo sapiens
ctgggcactgcagcaggcatca

SEQ ID NO: 7374469 - DNA, 22 bp, Homo sapiens
ctgggagcggctgtcactggtt

SEQ ID NO: 7374470 - DNA, 17 bp, Homo sapiens
ctgggatgtggactctt

SEQ ID NO: 7374471 - DNA, 22 bp, Homo sapiens
ctgggagcaagtcaggaaaggt

SEQ ID NO: 7374472 - DNA, 22 bp, Homo sapiens
ctgggagcccgcgtcctggtgg

SEQ ID NO: 7374473 - DNA, 22 bp, Homo sapiens
ctgggagcgcagcaggcacaac

SEQ ID NO: 7374474 - DNA, 22 bp, Homo sapiens
ctgggagcgcagcaggcacaac

SEQ ID NO: 7374475 - DNA, 22 bp, Homo sapiens
ctgggagcctggcagttgctga

SEQ ID NO: 7374476 - DNA, 22 bp, Homo sapiens
ctgtcacactaaaacaagaagt

SEQ ID NO: 7374477 - DNA, 17 bp, Homo sapiens
ctgtcacaatacctcgc

SEQ ID NO: 7374478 - DNA, 22 bp, Homo sapiens
ctgtcacaggttcaaactcccc

SEQ ID NO: 7374479 - DNA, 22 bp, Homo sapiens
ctgtcacagcccgcgtctcctc

SEQ ID NO: 7374480 - DNA, 18 bp, Homo sapiens
ctgtcaccgccaccacac

SEQ ID NO: 7374481 - DNA, 22 bp, Homo sapiens
ctgtattttttaagaatatctc

SEQ ID NO: 7374482 - DNA, 22 bp, Homo sapiens
ctgtattttttaagaatatctc

SEQ ID NO: 7374483 - DNA, 22 bp, Homo sapiens
ctgtatttgaaagaaaagattt

SEQ ID NO: 7374484 - DNA, 22 bp, Homo sapiens
ctgtatatggcttactttatat

SEQ ID NO: 7374485 - DNA, 22 bp, Homo sapiens
ctgtatttgaaagaaaagattt

SEQ ID NO: 7374486 - DNA, 22 bp, Homo sapiens
ctgtcctgtggtgacaggtaca

SEQ ID NO: 7374487 - DNA, 22 bp, Homo sapiens
ctgtctgccctggccagagccc

SEQ ID NO: 7374488 - DNA, 22 bp, Homo sapiens
ctgtctgcaggatagtaccctc

SEQ ID NO: 7374489 - DNA, 18 bp, Homo sapiens
ctgtcagcagcttcacga

SEQ ID NO: 7374490 - DNA, 22 bp, Homo sapiens
ctgtcagcttctcctggccaga

SEQ ID NO: 7374491 - DNA, 22 bp, Homo sapiens
ctgtcactgatgggctcaccag

SEQ ID NO: 7374492 - DNA, 22 bp, Homo sapiens
ctgtcacctgccagcataccca

SEQ ID NO: 7374493 - DNA, 22 bp, Homo sapiens
ctgtcacctgttcactgcagca

SEQ ID NO: 7374494 - DNA, 22 bp, Homo sapiens
ctgtcactctggcaacccagta

SEQ ID NO: 7374495 - DNA, 22 bp, Homo sapiens
ctgtgctgctagacctggattc

SEQ ID NO: 7374496 - DNA, 22 bp, Homo sapiens
ctgtctgtgcctcttctcccag

SEQ ID NO: 7374497 - DNA, 22 bp, Homo sapiens
ctgtctgtgacctctgcatgtc

SEQ ID NO: 7374498 - DNA, 22 bp, Homo sapiens
ctgtctgtcaagttcatctcca

SEQ ID NO: 7374499 - DNA, 22 bp, Homo sapiens
ctgtctgtcccgtcaccgcccc

SEQ ID NO: 7374500 - DNA, 22 bp, Homo sapiens
ctgtagaggaacaagagctctt

SEQ ID NO: 7374501 - DNA, 22 bp, Homo sapiens
ctgtacatcccgagagccagta

SEQ ID NO: 7374502 - DNA, 22 bp, Homo sapiens
ctgtacataaaggaataggtgt

SEQ ID NO: 7374503 - DNA, 19 bp, Homo sapiens
ctgtacaggttgcttctgg

SEQ ID NO: 7374504 - DNA, 22 bp, Homo sapiens
ctggtgccctgtgtggcaggag

SEQ ID NO: 7374505 - DNA, 22 bp, Homo sapiens
ctggggagacgatcgatgttct

SEQ ID NO: 7374506 - DNA, 22 bp, Homo sapiens
ctggtcagctgaagccccacac

SEQ ID NO: 7374507 - DNA, 22 bp, Homo sapiens
cttccaatagcaacaaagatta

SEQ ID NO: 7374508 - DNA, 22 bp, Homo sapiens
cttccaatagcaacaaagatta

SEQ ID NO: 7374509 - DNA, 22 bp, Homo sapiens
cttcctttggttggagcgccgt

SEQ ID NO: 7374510 - DNA, 20 bp, Homo sapiens
cttccttttccttcgtcaaa

SEQ ID NO: 7374511 - DNA, 22 bp, Homo sapiens
cttcctttgctgttcggaggtt

SEQ ID NO: 7374512 - DNA, 22 bp, Homo sapiens
cttcctttggttggagcgccgt

SEQ ID NO: 7374513 - DNA, 22 bp, Homo sapiens
cttcctttgctgttcggaggtt

SEQ ID NO: 7374514 - DNA, 22 bp, Homo sapiens
cttcctttgctgttcggaggtt

SEQ ID NO: 7374515 - DNA, 22 bp, Homo sapiens
cttcctttccccaatcatatcg

SEQ ID NO: 7374516 - DNA, 22 bp, Homo sapiens
cttcctgggtctggagactgga

SEQ ID NO: 7374517 - DNA, 23 bp, Homo sapiens
cttctcagtagtacacacactat

SEQ ID NO: 7374518 - DNA, 22 bp, Homo sapiens
cttctcagaggccagaagctat

SEQ ID NO: 7374519 - DNA, 22 bp, Homo sapiens
cttctcaaacctgaaaggacaa

SEQ ID NO: 7374520 - DNA, 22 bp, Homo sapiens
cttctcaactgcacttgccagg

SEQ ID NO: 7374521 - DNA, 17 bp, Homo sapiens
cttctagaaggcaaact

SEQ ID NO: 7374522 - DNA, 19 bp, Homo sapiens
cttctaagtcatttggaat

SEQ ID NO: 7374523 - DNA, 22 bp, Homo sapiens
cttctagagctggagcaaatgt

SEQ ID NO: 7374524 - DNA, 22 bp, Homo sapiens
cttctagagtaaggaacaaatg

SEQ ID NO: 7374525 - DNA, 22 bp, Homo sapiens
cttcatttccatccaactggga

SEQ ID NO: 7374526 - DNA, 22 bp, Homo sapiens
cttcatttcaggctgaagaata

SEQ ID NO: 7374527 - DNA, 22 bp, Homo sapiens
cttccaaagcactttatggacc

SEQ ID NO: 7374528 - DNA, 22 bp, Homo sapiens
cttccaaatgtaaataagtttc

SEQ ID NO: 7374529 - DNA, 22 bp, Homo sapiens
cttccaaaatttatatgttgaa

SEQ ID NO: 7374530 - DNA, 22 bp, Homo sapiens
cttcagttagccaattcaggtc

SEQ ID NO: 7374531 - DNA, 22 bp, Homo sapiens
cttcattggcttccatagatgc

SEQ ID NO: 7374532 - DNA, 22 bp, Homo sapiens
cttatatttgtcaactttacaa

SEQ ID NO: 7374533 - DNA, 22 bp, Homo sapiens
cttagctagaggcaattatgtt

SEQ ID NO: 7374534 - DNA, 22 bp, Homo sapiens
cttagctttaaaagtgagatct

SEQ ID NO: 7374535 - DNA, 22 bp, Homo sapiens
cttagcttctctgcatctgtgt

SEQ ID NO: 7374536 - DNA, 22 bp, Homo sapiens
cttaggaaatatatactaaact

SEQ ID NO: 7374537 - DNA, 22 bp, Homo sapiens
cttaggaagttgttacacactt

SEQ ID NO: 7374538 - DNA, 22 bp, Homo sapiens
cttagtgacatgtattcttcat

SEQ ID NO: 7374539 - DNA, 22 bp, Homo sapiens
cttagtgaggaatgaatttgtt

SEQ ID NO: 7374540 - DNA, 22 bp, Homo sapiens
cttagtgagaaggagcccatgc

SEQ ID NO: 7374541 - DNA, 22 bp, Homo sapiens
cttagaaataatggtttcagtt

SEQ ID NO: 7374542 - DNA, 22 bp, Homo sapiens
cttagaaagagttttctcccct

SEQ ID NO: 7374543 - DNA, 22 bp, Homo sapiens
cttagaaatcgaactcaggtta

SEQ ID NO: 7374544 - DNA, 20 bp, Homo sapiens
cttagcaccagcaggacagg

SEQ ID NO: 7374545 - DNA, 22 bp, Homo sapiens
cttagaaatgcagattctcagg

SEQ ID NO: 7374546 - DNA, 22 bp, Homo sapiens
cttacactttccgaaagcttgt

SEQ ID NO: 7374547 - DNA, 22 bp, Homo sapiens
cttacatactgagaaaatatcc

SEQ ID NO: 7374548 - DNA, 22 bp, Homo sapiens
cttacatatgcaagacaaaggg

SEQ ID NO: 7374549 - DNA, 22 bp, Homo sapiens
cttaaatccatcatttctaatc

SEQ ID NO: 7374550 - DNA, 22 bp, Homo sapiens
cttaaattcttaatgccctcat

SEQ ID NO: 7374551 - DNA, 22 bp, Homo sapiens
cttaaattttcatctacaagaa

SEQ ID NO: 7374552 - DNA, 22 bp, Homo sapiens
cttaaattggatgagttaagtt

SEQ ID NO: 7374553 - DNA, 22 bp, Homo sapiens
cttaaattggatgagttaagtt

SEQ ID NO: 7374554 - DNA, 22 bp, Homo sapiens
cttaaattttcatctacaagaa

SEQ ID NO: 7374555 - DNA, 22 bp, Homo sapiens
cttaatttaaaatagttcaggc

SEQ ID NO: 7374556 - DNA, 22 bp, Homo sapiens
cttaatttcaaactgctagtga

SEQ ID NO: 7374557 - DNA, 22 bp, Homo sapiens
cttaatttaagcctagaatgca

SEQ ID NO: 7374558 - DNA, 22 bp, Homo sapiens
cttaatttttgtagtagatgga

SEQ ID NO: 7374559 - DNA, 22 bp, Homo sapiens
cttacaaaggagaggagatagg

SEQ ID NO: 7374560 - DNA, 22 bp, Homo sapiens
cttacaaaggagaggagatagg

SEQ ID NO: 7374561 - DNA, 22 bp, Homo sapiens
cttacaaaggagaggagatagg

SEQ ID NO: 7374562 - DNA, 22 bp, Homo sapiens
cttacaaatacacttaggagag

SEQ ID NO: 7374563 - DNA, 22 bp, Homo sapiens
cttacaaatacacttaggagag

SEQ ID NO: 7374564 - DNA, 22 bp, Homo sapiens
ctgttttctagggctgaggtga

SEQ ID NO: 7374565 - DNA, 22 bp, Homo sapiens
ctgttttccctggagttcagca

SEQ ID NO: 7374566 - DNA, 22 bp, Homo sapiens
cttaaaatctggcagttagcta

SEQ ID NO: 7374567 - DNA, 22 bp, Homo sapiens
cttaaaatctggcagttagcta

SEQ ID NO: 7374568 - DNA, 21 bp, Homo sapiens
ctgtttcttgtgaagtgacac

SEQ ID NO: 7374569 - DNA, 22 bp, Homo sapiens
ctgtttatccctttggtcagca

SEQ ID NO: 7374570 - DNA, 22 bp, Homo sapiens
ctgtttatacgacaggtggagg

SEQ ID NO: 7374571 - DNA, 22 bp, Homo sapiens
ctgtttataaatagaggggagt

SEQ ID NO: 7374572 - DNA, 22 bp, Homo sapiens
gaaaattattgaaaatggctct

SEQ ID NO: 7374573 - DNA, 22 bp, Homo sapiens
gaaaatgttagcttcatagtca

SEQ ID NO: 7374574 - DNA, 22 bp, Homo sapiens
gaaaatgtttcctgttatttgc

SEQ ID NO: 7374575 - DNA, 22 bp, Homo sapiens
gaaaatacttcagtgttctggc

SEQ ID NO: 7374576 - DNA, 22 bp, Homo sapiens
gaaaattattgaaaatggctct

SEQ ID NO: 7374577 - DNA, 22 bp, Homo sapiens
gaaaattattgaaaatggctct

SEQ ID NO: 7374578 - DNA, 22 bp, Homo sapiens
gaaagccatagcccagctttac

SEQ ID NO: 7374579 - DNA, 22 bp, Homo sapiens
gaaagccagagagaaagggctc

SEQ ID NO: 7374580 - DNA, 22 bp, Homo sapiens
gaaagagaggggctgagatgca

SEQ ID NO: 7374581 - DNA, 22 bp, Homo sapiens
gaaacacatgcagctccataga

SEQ ID NO: 7374582 - DNA, 22 bp, Homo sapiens
cttttccaaagtccatctggtc

SEQ ID NO: 7374583 - DNA, 22 bp, Homo sapiens
ctttgcagttagcctaggattg

SEQ ID NO: 7374584 - DNA, 22 bp, Homo sapiens
ctttgcagtatagcctagtaga

SEQ ID NO: 7374585 - DNA, 22 bp, Homo sapiens
ctttgcagtgaatccataaata

SEQ ID NO: 7374586 - DNA, 22 bp, Homo sapiens
cttttctgtatcaaaaggatta

SEQ ID NO: 7374587 - DNA, 22 bp, Homo sapiens
cttctggagctcaccaacttcc

SEQ ID NO: 7374588 - DNA, 22 bp, Homo sapiens
cttctggaggacactggcccca

SEQ ID NO: 7374589 - DNA, 22 bp, Homo sapiens
cttctggcaaaacaggcagaaa

SEQ ID NO: 7374590 - DNA, 23 bp, Homo sapiens
cttctggctctatatcagaattc

SEQ ID NO: 7374591 - DNA, 22 bp, Homo sapiens
ctttacaaagcaattttgtctc

SEQ ID NO: 7374592 - DNA, 22 bp, Homo sapiens
ctttacaaactataaagtgcgg

SEQ ID NO: 7374593 - DNA, 22 bp, Homo sapiens
ctttacaaagcaattttgtctc

SEQ ID NO: 7374594 - DNA, 22 bp, Homo sapiens
ctttaagactaaattagagttt

SEQ ID NO: 7374595 - DNA, 22 bp, Homo sapiens
ctttaaataatacaaggtccag

SEQ ID NO: 7374596 - DNA, 22 bp, Homo sapiens
ctttaaataatacaaggtccag

SEQ ID NO: 7374597 - DNA, 22 bp, Homo sapiens
ctttaattctcaggtgcacata

SEQ ID NO: 7374598 - DNA, 22 bp, Homo sapiens
ctttctttgtccaccaacaatg

SEQ ID NO: 7374599 - DNA, 22 bp, Homo sapiens
ctttgaaaaatggtttcctaga

SEQ ID NO: 7374600 - DNA, 22 bp, Homo sapiens
tttcttaaatatttgcaggaca

SEQ ID NO: 7374601 - DNA, 19 bp, Homo sapiens
tttctgtttgcttctggtt

SEQ ID NO: 7374602 - DNA, 21 bp, Homo sapiens
tttcttaggctctaaaatgac

SEQ ID NO: 7374603 - DNA, 22 bp, Homo sapiens
tttcttagggactgtaaaatag

SEQ ID NO: 7374604 - DNA, 22 bp, Homo sapiens
tttcttcttgatttaaacaggg

SEQ ID NO: 7374605 - DNA, 22 bp, Homo sapiens
tttcttcttgatttaaacaggg

SEQ ID NO: 7374606 - DNA, 22 bp, Homo sapiens
tttcttctgtttgtagttacac

SEQ ID NO: 7374607 - DNA, 22 bp, Homo sapiens
tttcttcttgagtaaccagatt

SEQ ID NO: 7374608 - DNA, 22 bp, Homo sapiens
tttcttcttgagtaaccagatt

SEQ ID NO: 7374609 - DNA, 22 bp, Homo sapiens
ctctgctgtgccgccagggcct

SEQ ID NO: 7374610 - DNA, 22 bp, Homo sapiens
ctctgcttgtatcacatttgct

SEQ ID NO: 7374611 - DNA, 22 bp, Homo sapiens
ctctgctgtctccagggcagtc

SEQ ID NO: 7374612 - DNA, 21 bp, Homo sapiens
ctctgctgtctaccagctgtt

SEQ ID NO: 7374613 - DNA, 19 bp, Homo sapiens
ctctggagtcattgctccc

SEQ ID NO: 7374614 - DNA, 22 bp, Homo sapiens
ctctggagcatttcacctacat

SEQ ID NO: 7374615 - DNA, 22 bp, Homo sapiens
ctctgcttgtgtcaggcatgct

SEQ ID NO: 7374616 - DNA, 22 bp, Homo sapiens
tttgaagtcagacactgctttg

SEQ ID NO: 7374617 - DNA, 22 bp, Homo sapiens
tttctgatattcatttagaaga

SEQ ID NO: 7374618 - DNA, 22 bp, Homo sapiens
ctctgaggtctaggaccatggc

SEQ ID NO: 7374619 - DNA, 22 bp, Homo sapiens
ctctgaggtccttcccagctct

SEQ ID NO: 7374620 - DNA, 22 bp, Homo sapiens
tttctgttgtacttaaactagg

SEQ ID NO: 7374621 - DNA, 22 bp, Homo sapiens
tttctgttgttggtgtctggct

SEQ ID NO: 7374622 - DNA, 22 bp, Homo sapiens
tttctgtttagcataaagtggc

SEQ ID NO: 7374623 - DNA, 22 bp, Homo sapiens
tttctgtttagcataaagtggc

SEQ ID NO: 7374624 - DNA, 22 bp, Homo sapiens
ctctgagctcgtgcagtacttc

SEQ ID NO: 7374625 - DNA, 22 bp, Homo sapiens
ctctgagctgaaacatgagcat

SEQ ID NO: 7374626 - DNA, 22 bp, Homo sapiens
ctctctggcccatcctgttgcc

SEQ ID NO: 7374627 - DNA, 22 bp, Homo sapiens
ctctctggcacttcattgctgt

SEQ ID NO: 7374628 - DNA, 22 bp, Homo sapiens
ctctctggatatttgtatgctg

SEQ ID NO: 7374629 - DNA, 22 bp, Homo sapiens
ctctgaggtcctacagtgaccc

SEQ ID NO: 7374630 - DNA, 22 bp, Homo sapiens
ctctgaggtcagggcccggcaa

SEQ ID NO: 7374631 - DNA, 22 bp, Homo sapiens
ctctctggaattaaagcccaat

SEQ ID NO: 7374632 - DNA, 22 bp, Homo sapiens
tttctctgccagttattttcct

SEQ ID NO: 7374633 - DNA, 22 bp, Homo sapiens
ctctagcttttgataccagtgt

SEQ ID NO: 7374634 - DNA, 22 bp, Homo sapiens
ctctatttatggcatctttatg

SEQ ID NO: 7374635 - DNA, 22 bp, Homo sapiens
ctcctggaggatagtgactggg

SEQ ID NO: 7374636 - DNA, 22 bp, Homo sapiens
tttatatatggctggtctggat

SEQ ID NO: 7374637 - DNA, 22 bp, Homo sapiens
tttatatggttgactatgagtt

SEQ ID NO: 7374638 - DNA, 22 bp, Homo sapiens
ctcctgcttcacgggcaccgcc

SEQ ID NO: 7374639 - DNA, 22 bp, Homo sapiens
ctcctgctgaatggccaggagc

SEQ ID NO: 7374640 - DNA, 22 bp, Homo sapiens
ctcctcagttgtcccatggaga

SEQ ID NO: 7374641 - DNA, 22 bp, Homo sapiens
ctcctcagttgtcccatggaga

SEQ ID NO: 7374642 - DNA, 22 bp, Homo sapiens
tttacacaaaagatagcacacc

SEQ ID NO: 7374643 - DNA, 22 bp, Homo sapiens
tttcaaagttgggaattgtaat

SEQ ID NO: 7374644 - DNA, 22 bp, Homo sapiens
tttcaaagtggagaattagaca

SEQ ID NO: 7374645 - DNA, 22 bp, Homo sapiens
tttcaaagtggagaattagaca

SEQ ID NO: 7374646 - DNA, 22 bp, Homo sapiens
tttcaaataccataaacctaat

SEQ ID NO: 7374647 - DNA, 22 bp, Homo sapiens
tttcaaataccataaacctaat

SEQ ID NO: 7374648 - DNA, 22 bp, Homo sapiens
tttcaaatagaatctttccaaa

SEQ ID NO: 7374649 - DNA, 22 bp, Homo sapiens
tttcaaatgcatgtctttcctc

SEQ ID NO: 7374650 - DNA, 22 bp, Homo sapiens
ctcgggtaccatgctaggcact

SEQ ID NO: 7374651 - DNA, 21 bp, Homo sapiens
ctctacattcccagcaactct

SEQ ID NO: 7374652 - DNA, 22 bp, Homo sapiens
ctctaagtgttcctttatctat

SEQ ID NO: 7374653 - DNA, 22 bp, Homo sapiens
ctctaagtgtcaaacagatatg

SEQ ID NO: 7374654 - DNA, 22 bp, Homo sapiens
tttatattacctggaatagctt

SEQ ID NO: 7374655 - DNA, 22 bp, Homo sapiens
tttcaaagtcaagaaggatact

SEQ ID NO: 7374656 - DNA, 22 bp, Homo sapiens
ctccccacatttctccctgtct

SEQ ID NO: 7374657 - DNA, 22 bp, Homo sapiens
ctccccaccttcgcggtccctg

SEQ ID NO: 7374658 - DNA, 22 bp, Homo sapiens
ttgtttcaaggaagaattagga

SEQ ID NO: 7374659 - DNA, 22 bp, Homo sapiens
ttgtttcagctgtatgctatgt

SEQ ID NO: 7374660 - DNA, 22 bp, Homo sapiens
ttgtttattagcaattatcctg

SEQ ID NO: 7374661 - DNA, 22 bp, Homo sapiens
ctcccttttggatatggggaga

SEQ ID NO: 7374662 - DNA, 22 bp, Homo sapiens
ctcccttccaatgactatgctt

SEQ ID NO: 7374663 - DNA, 22 bp, Homo sapiens
ctccctgtgtcttcacttggcc

SEQ ID NO: 7374664 - DNA, 22 bp, Homo sapiens
ctccctggtgtcccctccagga

SEQ ID NO: 7374665 - DNA, 22 bp, Homo sapiens
ctccctggtctttcccatcatt

SEQ ID NO: 7374666 - DNA, 22 bp, Homo sapiens
ctccctggtctttcccatcatt

SEQ ID NO: 7374667 - DNA, 22 bp, Homo sapiens
ctccctggcagccgcactcctg

SEQ ID NO: 7374668 - DNA, 22 bp, Homo sapiens
ctccctgggcagatgtggctct

SEQ ID NO: 7374669 - DNA, 22 bp, Homo sapiens
ctccctggaggcccagacctgg

SEQ ID NO: 7374670 - DNA, 22 bp, Homo sapiens
ctccctggaggtgagctggcac

SEQ ID NO: 7374671 - DNA, 22 bp, Homo sapiens
ctgcctctgttgggcatggtct

SEQ ID NO: 7374672 - DNA, 22 bp, Homo sapiens
ctgcctcttgacagatcgtggc

SEQ ID NO: 7374673 - DNA, 19 bp, Homo sapiens
ctgctccaggagctgggga

SEQ ID NO: 7374674 - DNA, 19 bp, Homo sapiens
ctgctccctccttctggca

SEQ ID NO: 7374675 - DNA, 19 bp, Homo sapiens
ctgctccctccttctggca

SEQ ID NO: 7374676 - DNA, 22 bp, Homo sapiens
ctgctgcctgacaatttaggtt

SEQ ID NO: 7374677 - DNA, 22 bp, Homo sapiens
ctgctgcctcgacattgggaca

SEQ ID NO: 7374678 - DNA, 22 bp, Homo sapiens
ctgctgccttccaaaggccagg

SEQ ID NO: 7374679 - DNA, 22 bp, Homo sapiens
ctgctggcctagcccatcctct

SEQ ID NO: 7374680 - DNA, 22 bp, Homo sapiens
ctgctcctgtgggccagtggcc

SEQ ID NO: 7374681 - DNA, 22 bp, Homo sapiens
ctgctctaatatcagatagact

SEQ ID NO: 7374682 - DNA, 22 bp, Homo sapiens
ctgctctccccaggccagtctg

SEQ ID NO: 7374683 - DNA, 22 bp, Homo sapiens
ctgctgcctagtccaagacgtg

SEQ ID NO: 7374684 - DNA, 22 bp, Homo sapiens
ctgccctgagtcatgccagatg

SEQ ID NO: 7374685 - DNA, 22 bp, Homo sapiens
ctgcctctggcctcaggcccag

SEQ ID NO: 7374686 - DNA, 22 bp, Homo sapiens
ctgcctctggttttggtccctg

SEQ ID NO: 7374687 - DNA, 22 bp, Homo sapiens
ctgagggctggagctgaggcct

SEQ ID NO: 7374688 - DNA, 22 bp, Homo sapiens
ctgcagtgttctggaatgcatt

SEQ ID NO: 7374689 - DNA, 22 bp, Homo sapiens
ttttcagttccatctctgctct

SEQ ID NO: 7374690 - DNA, 22 bp, Homo sapiens
ttttccttaacagagggagaaa

SEQ ID NO: 7374691 - DNA, 22 bp, Homo sapiens
ttttcctggggcttctggactc

SEQ ID NO: 7374692 - DNA, 22 bp, Homo sapiens
tttttctagctcaaagattcta

SEQ ID NO: 7374693 - DNA, 22 bp, Homo sapiens
ctgaaggattagagagcactta

SEQ ID NO: 7374694 - DNA, 22 bp, Homo sapiens
ctgaagatttggctgtaaagca

SEQ ID NO: 7374695 - DNA, 22 bp, Homo sapiens
ctgaagattcgcctttgtttat

SEQ ID NO: 7374696 - DNA, 22 bp, Homo sapiens
ctgaagatgttctttttggttc

SEQ ID NO: 7374697 - DNA, 22 bp, Homo sapiens
ctgaagattataaacagacata

SEQ ID NO: 7374698 - DNA, 22 bp, Homo sapiens
ctgaaaaatatgttttggagaa

SEQ ID NO: 7374699 - DNA, 22 bp, Homo sapiens
tttttcttgtgctggatctaat

SEQ ID NO: 7374700 - DNA, 22 bp, Homo sapiens
tttttctgtctcttacattgca

SEQ ID NO: 7374701 - DNA, 22 bp, Homo sapiens
ctgagaggtaagcagcgcagtg

SEQ ID NO: 7374702 - DNA, 22 bp, Homo sapiens
ctgagaggtgacagcgtgctgg

SEQ ID NO: 7374703 - DNA, 22 bp, Homo sapiens
ctgagaggggaccagggtgttt

SEQ ID NO: 7374704 - DNA, 22 bp, Homo sapiens
ctgagaggggaccagggtgttt

SEQ ID NO: 7374705 - DNA, 22 bp, Homo sapiens
ctgagaggtaagcagcgcagtg

SEQ ID NO: 7374706 - DNA, 22 bp, Homo sapiens
ctgagaggtgctggtggctgca

SEQ ID NO: 7374707 - DNA, 22 bp, Homo sapiens
ctgagaggtgacagcgtgctgg

SEQ ID NO: 7374708 - DNA, 22 bp, Homo sapiens
ctgaataattttctgttgtatg

SEQ ID NO: 7374709 - DNA, 22 bp, Homo sapiens
ctgaataattttatagttgctg

SEQ ID NO: 7374710 - DNA, 22 bp, Homo sapiens
ctgaataatgttctcttgtatg

SEQ ID NO: 7374711 - DNA, 22 bp, Homo sapiens
ctgaataatacagactagcttc

SEQ ID NO: 7374712 - DNA, 22 bp, Homo sapiens
ctgaataatattccattatgag

SEQ ID NO: 7374713 - DNA, 22 bp, Homo sapiens
ctgagataaatgcctccagtca

SEQ ID NO: 7374714 - DNA, 22 bp, Homo sapiens
ctgagatctttatacgaggcac

SEQ ID NO: 7374715 - DNA, 22 bp, Homo sapiens
ctgagcgacaagtagcttttga

SEQ ID NO: 7374716 - DNA, 22 bp, Homo sapiens
ctgagcgaggagttggagcttt

SEQ ID NO: 7374717 - DNA, 22 bp, Homo sapiens
ctgagggagctgctggccttgg

SEQ ID NO: 7374718 - DNA, 22 bp, Homo sapiens
ttctacatgagaaaatgtattt

SEQ ID NO: 7374719 - DNA, 22 bp, Homo sapiens
ttctacctcctagaaaatctgg

SEQ ID NO: 7374720 - DNA, 22 bp, Homo sapiens
ctacattaaattggcttactta

SEQ ID NO: 7374721 - DNA, 20 bp, Homo sapiens
ctacatgttctgcttctctc

SEQ ID NO: 7374722 - DNA, 22 bp, Homo sapiens
ctacatagatggatgattgtaa

SEQ ID NO: 7374723 - DNA, 22 bp, Homo sapiens
ctaaattatcatgagaattatg

SEQ ID NO: 7374724 - DNA, 22 bp, Homo sapiens
ctaaatgttcacatgcaatttt

SEQ ID NO: 7374725 - DNA, 22 bp, Homo sapiens
ctaaccatcttacaaatgtctg

SEQ ID NO: 7374726 - DNA, 22 bp, Homo sapiens
ctaaattatttgcacattagag

SEQ ID NO: 7374727 - DNA, 21 bp, Homo sapiens
ttctcagtgtccatgttagtt

SEQ ID NO: 7374728 - DNA, 19 bp, Homo sapiens
ttctcagttcaggagaaga

SEQ ID NO: 7374729 - DNA, 22 bp, Homo sapiens
ttctcagtattacatgctaatg

SEQ ID NO: 7374730 - DNA, 23 bp, Homo sapiens
ttctcagtcctgcccagggaggc

SEQ ID NO: 7374731 - DNA, 22 bp, Homo sapiens
ttctcaggtgaggctgaggctg

SEQ ID NO: 7374732 - DNA, 22 bp, Homo sapiens
ttctatttttgtggaactgtag

SEQ ID NO: 7374733 - DNA, 19 bp, Homo sapiens
ttctcattcctttccactt

SEQ ID NO: 7374734 - DNA, 20 bp, Homo sapiens
ttctccaaaggagacactag

SEQ ID NO: 7374735 - DNA, 22 bp, Homo sapiens
ttctcctgcgcaggcccaggga

SEQ ID NO: 7374736 - DNA, 22 bp, Homo sapiens
ttctcatgtaaatgccatcatc

SEQ ID NO: 7374737 - DNA, 22 bp, Homo sapiens
ttctcatgatgcaattcatccc

SEQ ID NO: 7374738 - DNA, 22 bp, Homo sapiens
ttctcatgaaactcgcttcctc

SEQ ID NO: 7374739 - DNA, 22 bp, Homo sapiens
ttctccttgaaaagctgcatct

SEQ ID NO: 7374740 - DNA, 21 bp, Homo sapiens
ttctcctgttttgcaccacag

SEQ ID NO: 7374741 - DNA, 22 bp, Homo sapiens
cgtctgcctaaggactgccttc

SEQ ID NO: 7374742 - DNA, 22 bp, Homo sapiens
cgtcatcacggcaagcatctcc

SEQ ID NO: 7374743 - DNA, 21 bp, Homo sapiens
ttcagtttcttcctcatctat

SEQ ID NO: 7374744 - DNA, 22 bp, Homo sapiens
ttcagtttgctacaagcaacat

SEQ ID NO: 7374745 - DNA, 18 bp, Homo sapiens
ttcagtttctagttcctt

SEQ ID NO: 7374746 - DNA, 21 bp, Homo sapiens
ttcagtttcttcctcatctat

SEQ ID NO: 7374747 - DNA, 22 bp, Homo sapiens
ttcagtttccacttacatttaa

SEQ ID NO: 7374748 - DNA, 22 bp, Homo sapiens
ttcagtttccctaaagccaatt

SEQ ID NO: 7374749 - DNA, 19 bp, Homo sapiens
ttcagtttcctcatctgga

SEQ ID NO: 7374750 - DNA, 22 bp, Homo sapiens
ttcagtttcgttatctatgaga

SEQ ID NO: 7374751 - DNA, 22 bp, Homo sapiens
ttcagtttcgttatctatgaga

SEQ ID NO: 7374752 - DNA, 19 bp, Homo sapiens
ttcagtttcctcatctgga

SEQ ID NO: 7374753 - DNA, 22 bp, Homo sapiens
ttcagtttcagtcttgcaaaaa

SEQ ID NO: 7374754 - DNA, 22 bp, Homo sapiens
cgcagcagccccgtggtaggtg

SEQ ID NO: 7374755 - DNA, 22 bp, Homo sapiens
cgcagctgcaaaggaaacattt

SEQ ID NO: 7374756 - DNA, 22 bp, Homo sapiens
cgcagctgcacggggctgagcc

SEQ ID NO: 7374757 - DNA, 21 bp, Homo sapiens
cgcagctgagaaatatacaga

SEQ ID NO: 7374758 - DNA, 22 bp, Homo sapiens
cgcagctgaccttttacaaaac

SEQ ID NO: 7374759 - DNA, 22 bp, Homo sapiens
cgggagcacgggaggcggagct

SEQ ID NO: 7374760 - DNA, 21 bp, Homo sapiens
cgggaaggaggttctgaccct

SEQ ID NO: 7374761 - DNA, 22 bp, Homo sapiens
ttgatattttgcacgcttggta

SEQ ID NO: 7374762 - DNA, 22 bp, Homo sapiens
ttgatttttccagcttctagag

SEQ ID NO: 7374763 - DNA, 22 bp, Homo sapiens
ttgatttttttctactatgcgc

SEQ ID NO: 7374764 - DNA, 22 bp, Homo sapiens
ttgcaaaaaccacaattacttt

SEQ ID NO: 7374765 - DNA, 22 bp, Homo sapiens
ttgcaaaaactgcaattacttt

SEQ ID NO: 7374766 - DNA, 22 bp, Homo sapiens
ttgcaaaaaccacaattacttt

SEQ ID NO: 7374767 - DNA, 22 bp, Homo sapiens
ttgcaaaagcaattgcagtttt

SEQ ID NO: 7374768 - DNA, 22 bp, Homo sapiens
ttgcaaaagccgaggcactcca

SEQ ID NO: 7374769 - DNA, 22 bp, Homo sapiens
ttgcaaaagccgaggcactcca

SEQ ID NO: 7374770 - DNA, 22 bp, Homo sapiens
ttgcaaaaactgcaattacttt

SEQ ID NO: 7374771 - DNA, 22 bp, Homo sapiens
ttgcaaaaccatcctaagtaaa

SEQ ID NO: 7374772 - DNA, 22 bp, Homo sapiens
ttgcaaaatcatttctcaggat

SEQ ID NO: 7374773 - DNA, 23 bp, Homo sapiens
ttgcaaaatgagtcttgagtgaa

SEQ ID NO: 7374774 - DNA, 23 bp, Homo sapiens
ttgcaaaatgcaattgagttaga

SEQ ID NO: 7374775 - DNA, 22 bp, Homo sapiens
ctcagcagtgacaagagagtat

SEQ ID NO: 7374776 - DNA, 22 bp, Homo sapiens
ctcaggccattcctaccaaggg

SEQ ID NO: 7374777 - DNA, 22 bp, Homo sapiens
ctcaggccaggtttctcccaca

SEQ ID NO: 7374778 - DNA, 22 bp, Homo sapiens
ctcaggccaggtttctcccaca

SEQ ID NO: 7374779 - DNA, 22 bp, Homo sapiens
ctcaggccaataagctccagcc

SEQ ID NO: 7374780 - DNA, 22 bp, Homo sapiens
ctcaggccattcttccagctgc

SEQ ID NO: 7374781 - DNA, 22 bp, Homo sapiens
ctcaggccattcttccagctgc

SEQ ID NO: 7374782 - DNA, 22 bp, Homo sapiens
ctcaggcctgagtggcagtccc

SEQ ID NO: 7374783 - DNA, 22 bp, Homo sapiens
ctcaggcctgagtggcagtccc

SEQ ID NO: 7374784 - DNA, 22 bp, Homo sapiens
ctcaggcccacagcagacccac

SEQ ID NO: 7374785 - DNA, 22 bp, Homo sapiens
ctcaggcccacagcagacccac

SEQ ID NO: 7374786 - DNA, 22 bp, Homo sapiens
ttgcacatgttggttcttgaaa

SEQ ID NO: 7374787 - DNA, 23 bp, Homo sapiens
ttgcactgatcaatttgataagc

SEQ ID NO: 7374788 - DNA, 22 bp, Homo sapiens
ttgcactgtaagcatctgtgtc

SEQ ID NO: 7374789 - DNA, 22 bp, Homo sapiens
ttgcctagagttgcacatctgg

SEQ ID NO: 7374790 - DNA, 22 bp, Homo sapiens
ctcaggccttgaagtcttttct

SEQ ID NO: 7374791 - DNA, 22 bp, Homo sapiens
ctcaggccttgaagtcttttct

SEQ ID NO: 7374792 - DNA, 18 bp, Homo sapiens
ctcaggcctttccctgtg

SEQ ID NO: 7374793 - DNA, 18 bp, Homo sapiens
ctcaggcctttccctgtg

SEQ ID NO: 7374794 - DNA, 22 bp, Homo sapiens
ttctgaaattcgactatccaat

SEQ ID NO: 7374795 - DNA, 22 bp, Homo sapiens
ttctgaaatttcaactttacta

SEQ ID NO: 7374796 - DNA, 22 bp, Homo sapiens
ttctgtctctgtgtttacatta

SEQ ID NO: 7374797 - DNA, 22 bp, Homo sapiens
ttcttaagtttagcaacttgtg

SEQ ID NO: 7374798 - DNA, 20 bp, Homo sapiens
ttcttaaagacctcactttg

SEQ ID NO: 7374799 - DNA, 20 bp, Homo sapiens
ttcttaaagacctcactttg

SEQ ID NO: 7374800 - DNA, 22 bp, Homo sapiens
ttcttaaagaggcaaaacacag

SEQ ID NO: 7374801 - DNA, 22 bp, Homo sapiens
ttcttaaagaggcaaaacacag

SEQ ID NO: 7374802 - DNA, 22 bp, Homo sapiens
ttcttaaagaggcaaaacacag

SEQ ID NO: 7374803 - DNA, 22 bp, Homo sapiens
ttgaataattaattacactcag

SEQ ID NO: 7374804 - DNA, 22 bp, Homo sapiens
ttgaataatatgcttcgttctc

SEQ ID NO: 7374805 - DNA, 22 bp, Homo sapiens
ttgaaatatcaagttattagtg

SEQ ID NO: 7374806 - DNA, 21 bp, Homo sapiens
ttcttcatgatgattaatggc

SEQ ID NO: 7374807 - DNA, 22 bp, Homo sapiens
ttcttcccttcattccaccacc

SEQ ID NO: 7374808 - DNA, 22 bp, Homo sapiens
ttcttcccagccagcacagccc

SEQ ID NO: 7374809 - DNA, 22 bp, Homo sapiens
ttcttcagtgacaaaggcaaaa

SEQ ID NO: 7374810 - DNA, 22 bp, Homo sapiens
ttatggtaattaaaacatgtat

SEQ ID NO: 7374811 - DNA, 23 bp, Homo sapiens
ttatggggaaggtgactgggaca

SEQ ID NO: 7374812 - DNA, 22 bp, Homo sapiens
cctttcttgcttagtggctcat

SEQ ID NO: 7374813 - DNA, 22 bp, Homo sapiens
cctttgccatgacatggcacaa

SEQ ID NO: 7374814 - DNA, 22 bp, Homo sapiens
ttatgtcaaaatggttgagatt

SEQ ID NO: 7374815 - DNA, 22 bp, Homo sapiens
ttatgtcatgtggtggtgaaga

SEQ ID NO: 7374816 - DNA, 22 bp, Homo sapiens
cgagcagagcagagacgtctgg

SEQ ID NO: 7374817 - DNA, 22 bp, Homo sapiens
cgagcagaatggagggtgccga

SEQ ID NO: 7374818 - DNA, 20 bp, Homo sapiens
cgattcagtggagtttgaaa

SEQ ID NO: 7374819 - DNA, 22 bp, Homo sapiens
cgagtgtccctaccatttccta

SEQ ID NO: 7374820 - DNA, 22 bp, Homo sapiens
cgcaccactgaattccagcctg

SEQ ID NO: 7374821 - DNA, 22 bp, Homo sapiens
cgcaaagagctctaaatcagac

SEQ ID NO: 7374822 - DNA, 22 bp, Homo sapiens
ttatttttaaaagttcacacag

SEQ ID NO: 7374823 - DNA, 22 bp, Homo sapiens
ttattcacctctattagactca

SEQ ID NO: 7374824 - DNA, 22 bp, Homo sapiens
cgcagagggagccgcgggctgc

SEQ ID NO: 7374825 - DNA, 22 bp, Homo sapiens
cgcagagggcaggcagtgctgg

SEQ ID NO: 7374826 - DNA, 19 bp, Homo sapiens
cgcagagggcttctgagag

SEQ ID NO: 7374827 - DNA, 22 bp, Homo sapiens
cgcactggagctggaacgagtc

SEQ ID NO: 7374828 - DNA, 22 bp, Homo sapiens
ttcaaaaaggtatgttcaagtc

SEQ ID NO: 7374829 - DNA, 17 bp, Homo sapiens
ttattttttgggctgag

SEQ ID NO: 7374830 - DNA, 22 bp, Homo sapiens
ttatttttaaaagttcacacag

SEQ ID NO: 7374831 - DNA, 22 bp, Homo sapiens
ccttctgctccctggccagggc

SEQ ID NO: 7374832 - DNA, 22 bp, Homo sapiens
ttacctaaaatagctcaattta

SEQ ID NO: 7374833 - DNA, 22 bp, Homo sapiens
ttacctaaaatagctcaattta

SEQ ID NO: 7374834 - DNA, 21 bp, Homo sapiens
ccttctccacagggtctccgg

SEQ ID NO: 7374835 - DNA, 22 bp, Homo sapiens
ccttgtatcatatgctgggctt

SEQ ID NO: 7374836 - DNA, 22 bp, Homo sapiens
cctttaaagactgcataacttc

SEQ ID NO: 7374837 - DNA, 22 bp, Homo sapiens
ccttgtttctctcccagataag

SEQ ID NO: 7374838 - DNA, 22 bp, Homo sapiens
cctttaaatggatgttcaactg

SEQ ID NO: 7374839 - DNA, 22 bp, Homo sapiens
ttatcctgcatcctggaactca

SEQ ID NO: 7374840 - DNA, 22 bp, Homo sapiens
ttaatgatacctatgttaattt

SEQ ID NO: 7374841 - DNA, 22 bp, Homo sapiens
ttaatcacagctctgccatgag

SEQ ID NO: 7374842 - DNA, 22 bp, Homo sapiens
ttacaatagttccttcttttgt

SEQ ID NO: 7374843 - DNA, 22 bp, Homo sapiens
ttacaagttttcatgaaattga

SEQ ID NO: 7374844 - DNA, 22 bp, Homo sapiens
ttaaaatccagtgttggtggat

SEQ ID NO: 7374845 - DNA, 22 bp, Homo sapiens
ttaaaatagccagtgcccctct

SEQ ID NO: 7374846 - DNA, 22 bp, Homo sapiens
ttaaaatagccagtgcccctct

SEQ ID NO: 7374847 - DNA, 22 bp, Homo sapiens
ttaaaatgcagattatgactca

SEQ ID NO: 7374848 - DNA, 21 bp, Homo sapiens
ttaaaatgaggaagtggtggc

SEQ ID NO: 7374849 - DNA, 22 bp, Homo sapiens
ttaaaaggcatcataggtgaat

SEQ ID NO: 7374850 - DNA, 22 bp, Homo sapiens
tgttttctattacctgagattg

SEQ ID NO: 7374851 - DNA, 22 bp, Homo sapiens
tgttttctagaaacaatgccta

SEQ ID NO: 7374852 - DNA, 22 bp, Homo sapiens
tgttttctattacctgagattg

SEQ ID NO: 7374853 - DNA, 22 bp, Homo sapiens
ttaaaagtctgatgatttacat

SEQ ID NO: 7374854 - DNA, 22 bp, Homo sapiens
ttaaaagggatgttatctgtaa

SEQ ID NO: 7374855 - DNA, 22 bp, Homo sapiens
ttaaaagggtaagcagcaactt

SEQ ID NO: 7374856 - DNA, 22 bp, Homo sapiens
cctgtagaatctgtagacccat

SEQ ID NO: 7374857 - DNA, 22 bp, Homo sapiens
cctgtaggcgagggatggacag

SEQ ID NO: 7374858 - DNA, 22 bp, Homo sapiens
cctgtattaggtagacaactat

SEQ ID NO: 7374859 - DNA, 22 bp, Homo sapiens
cctgtattatttgtatgtgctg

SEQ ID NO: 7374860 - DNA, 22 bp, Homo sapiens
cctgtattatttgtatgtgctg

SEQ ID NO: 7374861 - DNA, 22 bp, Homo sapiens
cctgtattcaattttgtgtgat

SEQ ID NO: 7374862 - DNA, 22 bp, Homo sapiens
cctgtattggaagcagtaggga

SEQ ID NO: 7374863 - DNA, 22 bp, Homo sapiens
cctgtattgtgcccagaatctc

SEQ ID NO: 7374864 - DNA, 22 bp, Homo sapiens
cctgtatttaaaaatattctaa

SEQ ID NO: 7374865 - DNA, 22 bp, Homo sapiens
cctgtatttgcaacttttctta

SEQ ID NO: 7374866 - DNA, 22 bp, Homo sapiens
cctgtatttgcatctggcctct

SEQ ID NO: 7374867 - DNA, 22 bp, Homo sapiens
cctgtatttgcatctggcctct

SEQ ID NO: 7374868 - DNA, 22 bp, Homo sapiens
ttaatactataatttgaagtac

SEQ ID NO: 7374869 - DNA, 22 bp, Homo sapiens
ttaaggaaacatttttccatag

SEQ ID NO: 7374870 - DNA, 22 bp, Homo sapiens
cctgtcacgatgactgcactct

SEQ ID NO: 7374871 - DNA, 22 bp, Homo sapiens
cctgtcacctaggtactgagca

SEQ ID NO: 7374872 - DNA, 18 bp, Homo sapiens
cctgtcacgtccaggcct

SEQ ID NO: 7374873 - DNA, 22 bp, Homo sapiens
cctgtatttgcttccttctgca

SEQ ID NO: 7374874 - DNA, 23 bp, Homo sapiens
cctgtcaacaaggccccactgta

SEQ ID NO: 7374875 - DNA, 22 bp, Homo sapiens
cctgtcacatatttgctgttca

SEQ ID NO: 7374876 - DNA, 22 bp, Homo sapiens
cctggggagccgcctgagcccc

SEQ ID NO: 7374877 - DNA, 22 bp, Homo sapiens
tgtttctgggtgtgtctcacct

SEQ ID NO: 7374878 - DNA, 22 bp, Homo sapiens
tgtttcttctcacacaaactca

SEQ ID NO: 7374879 - DNA, 17 bp, Homo sapiens
tgttttcattcattgct

SEQ ID NO: 7374880 - DNA, 22 bp, Homo sapiens
tgttttcctcctggtttctgcc

SEQ ID NO: 7374881 - DNA, 22 bp, Homo sapiens
tgttgattagtgtttagactta

SEQ ID NO: 7374882 - DNA, 22 bp, Homo sapiens
tgttgctaaggggaatgagagc

SEQ ID NO: 7374883 - DNA, 22 bp, Homo sapiens
cctgccttcccagcttggcttt

SEQ ID NO: 7374884 - DNA, 22 bp, Homo sapiens
tggttagactcaccttatagtt

SEQ ID NO: 7374885 - DNA, 22 bp, Homo sapiens
tggttagaggcttcttgcttgg

SEQ ID NO: 7374886 - DNA, 22 bp, Homo sapiens
tggttagatgaggctggtttca

SEQ ID NO: 7374887 - DNA, 22 bp, Homo sapiens
cctgctcatgggtccctggcag

SEQ ID NO: 7374888 - DNA, 22 bp, Homo sapiens
cctgctcagctgtcctcacgct

SEQ ID NO: 7374889 - DNA, 22 bp, Homo sapiens
cctgcctttctcagtaatcttt

SEQ ID NO: 7374890 - DNA, 22 bp, Homo sapiens
cctgccttctaaagcgcccgcc

SEQ ID NO: 7374891 - DNA, 22 bp, Homo sapiens
cctgccttgacgtaacgcatga

SEQ ID NO: 7374892 - DNA, 22 bp, Homo sapiens
gcatcctggctctaggtgtcat

SEQ ID NO: 7374893 - DNA, 22 bp, Homo sapiens
gcatcctctgagagctctagat

SEQ ID NO: 7374894 - DNA, 22 bp, Homo sapiens
gcatcccctgcattctgttttc

SEQ ID NO: 7374895 - DNA, 19 bp, Homo sapiens
gcataaatacactattgtc

SEQ ID NO: 7374896 - DNA, 22 bp, Homo sapiens
gcataaacttaagattttgttt

SEQ ID NO: 7374897 - DNA, 22 bp, Homo sapiens
gcataaatgttctttcagattt

SEQ ID NO: 7374898 - DNA, 22 bp, Homo sapiens
gcatttgtacaaaatgcagtag

SEQ ID NO: 7374899 - DNA, 22 bp, Homo sapiens
gcatgattaatatgcttactgt

SEQ ID NO: 7374900 - DNA, 22 bp, Homo sapiens
gcatgaggtttgggctctgtga

SEQ ID NO: 7374901 - DNA, 20 bp, Homo sapiens
gcatgaggaatcattgcagc

SEQ ID NO: 7374902 - DNA, 19 bp, Homo sapiens
gcatctgcatgatggggtt

SEQ ID NO: 7374903 - DNA, 19 bp, Homo sapiens
gcagtctgttgaagggcag

SEQ ID NO: 7374904 - DNA, 20 bp, Homo sapiens
gcagtccagatgcttttaac

SEQ ID NO: 7374905 - DNA, 22 bp, Homo sapiens
gcagtcctctcattggcctcct

SEQ ID NO: 7374906 - DNA, 22 bp, Homo sapiens
gcagtcctcatcctttagcagt

SEQ ID NO: 7374907 - DNA, 22 bp, Homo sapiens
gccaagcctgtagacacaagct

SEQ ID NO: 7374908 - DNA, 22 bp, Homo sapiens
gccaaggaaggcttcctggaag

SEQ ID NO: 7374909 - DNA, 22 bp, Homo sapiens
gccaaggcctctgcaggatgag

SEQ ID NO: 7374910 - DNA, 22 bp, Homo sapiens
gccaaggcctctgcaggatgag

SEQ ID NO: 7374911 - DNA, 22 bp, Homo sapiens
gcattttaataagattcatagg

SEQ ID NO: 7374912 - DNA, 22 bp, Homo sapiens
gcattttaataagattcatagg

SEQ ID NO: 7374913 - DNA, 22 bp, Homo sapiens
gccagagagagtccctgggcct

SEQ ID NO: 7374914 - DNA, 22 bp, Homo sapiens
gccagagcagaatagagtggcc

SEQ ID NO: 7374915 - DNA, 23 bp, Homo sapiens
gccagaggaacgcagagctttct

SEQ ID NO: 7374916 - DNA, 23 bp, Homo sapiens
gccagaggaacgcagagctttct

SEQ ID NO: 7374917 - DNA, 22 bp, Homo sapiens
gccagaggaacgctgcgcgccc

SEQ ID NO: 7374918 - DNA, 22 bp, Homo sapiens
gccagaggcccaaggacagctg

SEQ ID NO: 7374919 - DNA, 22 bp, Homo sapiens
gccagcaggttgtcaaggagct

SEQ ID NO: 7374920 - DNA, 22 bp, Homo sapiens
gccagcaggtggagagatcaag

SEQ ID NO: 7374921 - DNA, 22 bp, Homo sapiens
gccaggttgctgacgacgatct

SEQ ID NO: 7374922 - DNA, 22 bp, Homo sapiens
gccagtaagtggtagagttgag

SEQ ID NO: 7374923 - DNA, 22 bp, Homo sapiens
gccagtaaaacaaaggccatgt

SEQ ID NO: 7374924 - DNA, 22 bp, Homo sapiens
gccagtggagcacatggtgaag

SEQ ID NO: 7374925 - DNA, 22 bp, Homo sapiens
gccagtgggacccgctgtgggc

SEQ ID NO: 7374926 - DNA, 22 bp, Homo sapiens
gccagtggcttgccaggcagga

SEQ ID NO: 7374927 - DNA, 22 bp, Homo sapiens
gccagtggccctctggagaagg

SEQ ID NO: 7374928 - DNA, 23 bp, Homo sapiens
gcccagagaggctcaccaggaat

SEQ ID NO: 7374929 - DNA, 23 bp, Homo sapiens
gccaggcacatggtggacacgca

SEQ ID NO: 7374930 - DNA, 22 bp, Homo sapiens
gccaggtccagggtggagcgct

SEQ ID NO: 7374931 - DNA, 22 bp, Homo sapiens
gccaggcacagttctaggtgct

SEQ ID NO: 7374932 - DNA, 22 bp, Homo sapiens
gccaggtctgggtagcagagga

SEQ ID NO: 7374933 - DNA, 22 bp, Homo sapiens
gccaggagagctccttcaggtt

SEQ ID NO: 7374934 - DNA, 22 bp, Homo sapiens
gccaggagagctccttcaggtt

SEQ ID NO: 7374935 - DNA, 22 bp, Homo sapiens
gccaggagccagcttcttagca

SEQ ID NO: 7374936 - DNA, 22 bp, Homo sapiens
gccaggaggctgctgtgtaggc

SEQ ID NO: 7374937 - DNA, 22 bp, Homo sapiens
gccaggaggctgctgtgtaggc

SEQ ID NO: 7374938 - DNA, 22 bp, Homo sapiens
gccaggactgagaatgggagca

SEQ ID NO: 7374939 - DNA, 22 bp, Homo sapiens
gccaggactcttcctagaaggt

SEQ ID NO: 7374940 - DNA, 22 bp, Homo sapiens
gccctgacactttgcagctgag

SEQ ID NO: 7374941 - DNA, 22 bp, Homo sapiens
gccctgaccttcactgactctc

SEQ ID NO: 7374942 - DNA, 22 bp, Homo sapiens
gccctgagaatgtgtgtgtcta

SEQ ID NO: 7374943 - DNA, 23 bp, Homo sapiens
gccctgactgcggcctcccactc

SEQ ID NO: 7374944 - DNA, 22 bp, Homo sapiens
gccctgagactgagcatgggtt

SEQ ID NO: 7374945 - DNA, 22 bp, Homo sapiens
gcctcagctcccagcccaggct

SEQ ID NO: 7374946 - DNA, 22 bp, Homo sapiens
gcctcagccggcggacgccagg

SEQ ID NO: 7374947 - DNA, 20 bp, Homo sapiens
gcctcagccaacccatgggg

SEQ ID NO: 7374948 - DNA, 20 bp, Homo sapiens
gcctcagccaacccatgggg

SEQ ID NO: 7374949 - DNA, 22 bp, Homo sapiens
gcctcagctgttgcaggggccc

SEQ ID NO: 7374950 - DNA, 22 bp, Homo sapiens
gcctcagctcccagcccaggct

SEQ ID NO: 7374951 - DNA, 22 bp, Homo sapiens
gcctcaggccgccctgctgctc

SEQ ID NO: 7374952 - DNA, 22 bp, Homo sapiens
gccctgaggggtggtgtctgta

SEQ ID NO: 7374953 - DNA, 22 bp, Homo sapiens
gcccagggcgatggtcggggcc

SEQ ID NO: 7374954 - DNA, 22 bp, Homo sapiens
gcccagggcgatggtcggggcc

SEQ ID NO: 7374955 - DNA, 22 bp, Homo sapiens
gcccagggctgcaagtggacgc

SEQ ID NO: 7374956 - DNA, 22 bp, Homo sapiens
gcccagggcagggcaagagtga

SEQ ID NO: 7374957 - DNA, 23 bp, Homo sapiens
gcccagggactgggaatcagtgg

SEQ ID NO: 7374958 - DNA, 22 bp, Homo sapiens
gcccaggctggagttcagtggt

SEQ ID NO: 7374959 - DNA, 22 bp, Homo sapiens
gcccaggctggagtgcagtggt

SEQ ID NO: 7374960 - DNA, 22 bp, Homo sapiens
gcccaggggcagcgcatagtgg

SEQ ID NO: 7374961 - DNA, 22 bp, Homo sapiens
gcccagggcttcaaagagagaa

SEQ ID NO: 7374962 - DNA, 22 bp, Homo sapiens
gcccaggggagtagtcaattta

SEQ ID NO: 7374963 - DNA, 19 bp, Homo sapiens
gcccaggggcccgatgctg

SEQ ID NO: 7374964 - DNA, 22 bp, Homo sapiens
gcccatggaaaacctgtcctct

SEQ ID NO: 7374965 - DNA, 23 bp, Homo sapiens
gcccatgctgttgggcccgagca

SEQ ID NO: 7374966 - DNA, 22 bp, Homo sapiens
gcaggctgaaactcggggtcta

SEQ ID NO: 7374967 - DNA, 22 bp, Homo sapiens
gcagggccttagcagcggctgc

SEQ ID NO: 7374968 - DNA, 22 bp, Homo sapiens
gcagggccttagcagcggctgc

SEQ ID NO: 7374969 - DNA, 22 bp, Homo sapiens
gcagggccttggtcatcttttt

SEQ ID NO: 7374970 - DNA, 22 bp, Homo sapiens
gcaggaggttgagccaggactg

SEQ ID NO: 7374971 - DNA, 22 bp, Homo sapiens
gcaggaggttgagccaggactg

SEQ ID NO: 7374972 - DNA, 22 bp, Homo sapiens
gcaggaggttgagccaggactg

SEQ ID NO: 7374973 - DNA, 22 bp, Homo sapiens
gcaggagtgacatggatgtgga

SEQ ID NO: 7374974 - DNA, 22 bp, Homo sapiens
gcaggagtatgcagctatggtt

SEQ ID NO: 7374975 - DNA, 22 bp, Homo sapiens
gcaggagtgtggtgggacatcc

SEQ ID NO: 7374976 - DNA, 22 bp, Homo sapiens
gcaggagtgacatggatgtgga

SEQ ID NO: 7374977 - DNA, 22 bp, Homo sapiens
gcaggagtggagaccatgggga

SEQ ID NO: 7374978 - DNA, 22 bp, Homo sapiens
gcaggagttaggcgtcgtggat

SEQ ID NO: 7374979 - DNA, 22 bp, Homo sapiens
gcaggaggccaggtatgcttta

SEQ ID NO: 7374980 - DNA, 22 bp, Homo sapiens
gcaggaggccaggtatgcttta

SEQ ID NO: 7374981 - DNA, 22 bp, Homo sapiens
gcaggaggatcacttgagccca

SEQ ID NO: 7374982 - DNA, 22 bp, Homo sapiens
gcaggaggatcacttgagccca

SEQ ID NO: 7374983 - DNA, 22 bp, Homo sapiens
gcaggaggagcattaactgagc

SEQ ID NO: 7374984 - DNA, 22 bp, Homo sapiens
gcaggaggagcattaactgagc

SEQ ID NO: 7374985 - DNA, 22 bp, Homo sapiens
gcagctggcccctttccttgtt

SEQ ID NO: 7374986 - DNA, 22 bp, Homo sapiens
gcagctggagcatcttctcatc

SEQ ID NO: 7374987 - DNA, 22 bp, Homo sapiens
gcagcatgttgaaagggccaca

SEQ ID NO: 7374988 - DNA, 22 bp, Homo sapiens
gcagcagtgtgggctgaaccta

SEQ ID NO: 7374989 - DNA, 22 bp, Homo sapiens
gcagcagtggttttatcatttt

SEQ ID NO: 7374990 - DNA, 22 bp, Homo sapiens
gcagcagtggtctgtagaagga

SEQ ID NO: 7374991 - DNA, 22 bp, Homo sapiens
gcagcagtactcaatatcctgg

SEQ ID NO: 7374992 - DNA, 22 bp, Homo sapiens
gcagcagtaggaaataacacag

SEQ ID NO: 7374993 - DNA, 22 bp, Homo sapiens
gcagcaggtgtgcttttaatga

SEQ ID NO: 7374994 - DNA, 22 bp, Homo sapiens
gcagcagtgcgggcagctacag

SEQ ID NO: 7374995 - DNA, 20 bp, Homo sapiens
gcagcagtgcaagtcctctt

SEQ ID NO: 7374996 - DNA, 22 bp, Homo sapiens
gcagctgcaagcacttctggca

SEQ ID NO: 7374997 - DNA, 22 bp, Homo sapiens
gcagctgcacttctacctaatt

SEQ ID NO: 7374998 - DNA, 22 bp, Homo sapiens
gcagctgcaataggcatcaagc

SEQ ID NO: 7374999 - DNA, 22 bp, Homo sapiens
gcagctgcaagcacttctggca

SEQ ID NO: 7375000 - DNA, 22 bp, Homo sapiens
gcagctgcagagaccgggtggg

SEQ ID NO: 7375001 - DNA, 22 bp, Homo sapiens
gcagctgcagaccctcagtgct

SEQ ID NO: 7375002 - DNA, 18 bp, Homo sapiens
gcagctgcagttgtagct

SEQ ID NO: 7375003 - DNA, 22 bp, Homo sapiens
gcagctgcaggtggtcccatgc

SEQ ID NO: 7375004 - DNA, 22 bp, Homo sapiens
gcagctgccagtccccttccag

SEQ ID NO: 7375005 - DNA, 22 bp, Homo sapiens
gcagctgcaggcaggcttgctg

SEQ ID NO: 7375006 - DNA, 22 bp, Homo sapiens
gcagctgcaggcaggcttgctg

SEQ ID NO: 7375007 - DNA, 20 bp, Homo sapiens
gcagctgcccccagtccctg

SEQ ID NO: 7375008 - DNA, 22 bp, Homo sapiens
gcagctgccccgactgtgagtc

SEQ ID NO: 7375009 - DNA, 22 bp, Homo sapiens
gcagctgccgtgagctcacgcc

SEQ ID NO: 7375010 - DNA, 22 bp, Homo sapiens
gcagctgcctaaagtgctaaga

SEQ ID NO: 7375011 - DNA, 22 bp, Homo sapiens
gcagcaggaataggataagcaa

SEQ ID NO: 7375012 - DNA, 22 bp, Homo sapiens
gcagcaggagagtttgtcctgc

SEQ ID NO: 7375013 - DNA, 22 bp, Homo sapiens
gcagcaggatggccaattgcca

SEQ ID NO: 7375014 - DNA, 22 bp, Homo sapiens
gcagcaggtctgtcaatgtcat

SEQ ID NO: 7375015 - DNA, 22 bp, Homo sapiens
gcagcagctcagttctgggagg

SEQ ID NO: 7375016 - DNA, 22 bp, Homo sapiens
gcagcagctcagttctgggagg

SEQ ID NO: 7375017 - DNA, 22 bp, Homo sapiens
gcagcagctcagccgggcactg

SEQ ID NO: 7375018 - DNA, 22 bp, Homo sapiens
gcagcagctcagccgggcactg

SEQ ID NO: 7375019 - DNA, 22 bp, Homo sapiens
gcagcagctctgaatgggcccc

SEQ ID NO: 7375020 - DNA, 22 bp, Homo sapiens
gcagcagctgacagtgggtgcc

SEQ ID NO: 7375021 - DNA, 22 bp, Homo sapiens
gcagcagctccctatccaggct

SEQ ID NO: 7375022 - DNA, 22 bp, Homo sapiens
gcagcagctctcaaagtggtct

SEQ ID NO: 7375023 - DNA, 22 bp, Homo sapiens
gcagaggaggacccaggaatta

SEQ ID NO: 7375024 - DNA, 22 bp, Homo sapiens
gcagcagccgacatggattgca

SEQ ID NO: 7375025 - DNA, 23 bp, Homo sapiens
gcactgccatgtgctctgcaggc

SEQ ID NO: 7375026 - DNA, 22 bp, Homo sapiens
gcactgcctgtgttcagggtaa

SEQ ID NO: 7375027 - DNA, 22 bp, Homo sapiens
gcactgctccaggtgtggcttg

SEQ ID NO: 7375028 - DNA, 16 bp, Homo sapiens
gcactgccttgggccc

SEQ ID NO: 7375029 - DNA, 22 bp, Homo sapiens
gcactgatgcaaaaatcactca

SEQ ID NO: 7375030 - DNA, 22 bp, Homo sapiens
gcactgattacccattgctgct

SEQ ID NO: 7375031 - DNA, 22 bp, Homo sapiens
gcactgcaggtgggtggagagg

SEQ ID NO: 7375032 - DNA, 22 bp, Homo sapiens
gcactgggaagaatgagcctgt

SEQ ID NO: 7375033 - DNA, 22 bp, Homo sapiens
gcactgggaatgagggcagctt

SEQ ID NO: 7375034 - DNA, 22 bp, Homo sapiens
gcactggattttgatctgcaag

SEQ ID NO: 7375035 - DNA, 22 bp, Homo sapiens
gcactggaaatacctagatgaa

SEQ ID NO: 7375036 - DNA, 22 bp, Homo sapiens
gcactgctttctgagtcattgt

SEQ ID NO: 7375037 - DNA, 22 bp, Homo sapiens
gcactctcctggctgccacagt

SEQ ID NO: 7375038 - DNA, 22 bp, Homo sapiens
gcacaggcatcaggctttttct

SEQ ID NO: 7375039 - DNA, 22 bp, Homo sapiens
gcacaggccatgggaggacagc

SEQ ID NO: 7375040 - DNA, 22 bp, Homo sapiens
gcactgggctccaggaaggagg

SEQ ID NO: 7375041 - DNA, 22 bp, Homo sapiens
gcactgggctccaggaaggagg

SEQ ID NO: 7375042 - DNA, 22 bp, Homo sapiens
gcactgggagtctgtgggggtt

SEQ ID NO: 7375043 - DNA, 16 bp, Homo sapiens
gcactgggatgtcttc

SEQ ID NO: 7375044 - DNA, 23 bp, Homo sapiens
gcactgggctctcagcaaggtgt

SEQ ID NO: 7375045 - DNA, 22 bp, Homo sapiens
gcactgggctccaggaaggagg

SEQ ID NO: 7375046 - DNA, 22 bp, Homo sapiens
gcactgggaatgtgagcagctg

SEQ ID NO: 7375047 - DNA, 22 bp, Homo sapiens
gcactgggagctgcctgccggt

SEQ ID NO: 7375048 - DNA, 22 bp, Homo sapiens
gcactgggaatgagggcagctt

SEQ ID NO: 7375049 - DNA, 22 bp, Homo sapiens
gcactgggaatgtgagcagctg

SEQ ID NO: 7375050 - DNA, 22 bp, Homo sapiens
gcactgggaatgctgatgggct

SEQ ID NO: 7375051 - DNA, 22 bp, Homo sapiens
gcacttccatctgtcaccaggt

SEQ ID NO: 7375052 - DNA, 22 bp, Homo sapiens
gcagaggacacaggagggcaag

SEQ ID NO: 7375053 - DNA, 22 bp, Homo sapiens
gcacagctggactctgcctggc

SEQ ID NO: 7375054 - DNA, 22 bp, Homo sapiens
gcacagcatgaagagaggaagc

SEQ ID NO: 7375055 - DNA, 22 bp, Homo sapiens
gcaagctgtgatttatgtgaat

SEQ ID NO: 7375056 - DNA, 22 bp, Homo sapiens
gcaagcagttacccaggattcg

SEQ ID NO: 7375057 - DNA, 22 bp, Homo sapiens
gcaagcagactgggcccctgtg

SEQ ID NO: 7375058 - DNA, 22 bp, Homo sapiens
gcaagcagacattcaggtaggt

SEQ ID NO: 7375059 - DNA, 22 bp, Homo sapiens
gcaagctgctcttatgtggagg

SEQ ID NO: 7375060 - DNA, 22 bp, Homo sapiens
gagggggagatgtgcacacact

SEQ ID NO: 7375061 - DNA, 22 bp, Homo sapiens
gcaagcaaattatttataggca

SEQ ID NO: 7375062 - DNA, 22 bp, Homo sapiens
gcaagcaaaatgggagattccc

SEQ ID NO: 7375063 - DNA, 22 bp, Homo sapiens
gcaagcaagcaggtagagctga

SEQ ID NO: 7375064 - DNA, 22 bp, Homo sapiens
gagggtccctgctcagggccag

SEQ ID NO: 7375065 - DNA, 21 bp, Homo sapiens
gcaaatgagttaactaactca

SEQ ID NO: 7375066 - DNA, 22 bp, Homo sapiens
gcaagaaaagagccttcagtgg

SEQ ID NO: 7375067 - DNA, 22 bp, Homo sapiens
gctctgctaatattgtagtacc

SEQ ID NO: 7375068 - DNA, 22 bp, Homo sapiens
gctctgcctttgtcttacacgg

SEQ ID NO: 7375069 - DNA, 22 bp, Homo sapiens
gctctgccttctcactgggttc

SEQ ID NO: 7375070 - DNA, 22 bp, Homo sapiens
gctctgcctggtcgcgtgctgg

SEQ ID NO: 7375071 - DNA, 17 bp, Homo sapiens
gctctgcctctcccacc

SEQ ID NO: 7375072 - DNA, 22 bp, Homo sapiens
gctctgcctctttgctgcgtca

SEQ ID NO: 7375073 - DNA, 22 bp, Homo sapiens
gctctgccccaggaactcagcc

SEQ ID NO: 7375074 - DNA, 22 bp, Homo sapiens
gctctgccctgggccgttgtaa

SEQ ID NO: 7375075 - DNA, 22 bp, Homo sapiens
gctctgcctcccctagtgttac

SEQ ID NO: 7375076 - DNA, 17 bp, Homo sapiens
gctctgccccagcctct

SEQ ID NO: 7375077 - DNA, 22 bp, Homo sapiens
gctctgcccagtgccctgagac

SEQ ID NO: 7375078 - DNA, 18 bp, Homo sapiens
gctctgcccaggctgccc

SEQ ID NO: 7375079 - DNA, 22 bp, Homo sapiens
gctgaagagcaaggctgggtct

SEQ ID NO: 7375080 - DNA, 23 bp, Homo sapiens
gctgaagagcaaaccaggcaaaa

SEQ ID NO: 7375081 - DNA, 22 bp, Homo sapiens
gctgaagagagatgcgtccagc

SEQ ID NO: 7375082 - DNA, 23 bp, Homo sapiens
gctgaagagcaaaccaggcaaaa

SEQ ID NO: 7375083 - DNA, 22 bp, Homo sapiens
gctgaagagaggccttgagcac

SEQ ID NO: 7375084 - DNA, 22 bp, Homo sapiens
gctgaagacctccctctccatg

SEQ ID NO: 7375085 - DNA, 22 bp, Homo sapiens
gctgaagagacttctgttcgaa

SEQ ID NO: 7375086 - DNA, 21 bp, Homo sapiens
gctcaggctcttgacagagca

SEQ ID NO: 7375087 - DNA, 22 bp, Homo sapiens
gctcaggctctcccaggggaat

SEQ ID NO: 7375088 - DNA, 22 bp, Homo sapiens
gctcaggcctggctatccattg

SEQ ID NO: 7375089 - DNA, 21 bp, Homo sapiens
gctcaggctcaggttcaggtt

SEQ ID NO: 7375090 - DNA, 22 bp, Homo sapiens
gctcaggcctcggacacacaat

SEQ ID NO: 7375091 - DNA, 22 bp, Homo sapiens
gctcaggcctggcccatgggac

SEQ ID NO: 7375092 - DNA, 22 bp, Homo sapiens
gctcaggcctccagaggggcaa

SEQ ID NO: 7375093 - DNA, 22 bp, Homo sapiens
gctcaggcctccagaggggcaa

SEQ ID NO: 7375094 - DNA, 19 bp, Homo sapiens
gctcaggctgtgtgtgggg

SEQ ID NO: 7375095 - DNA, 22 bp, Homo sapiens
gctcaggctggattgcagtggc

SEQ ID NO: 7375096 - DNA, 22 bp, Homo sapiens
gctcaggcttcttctataaaga

SEQ ID NO: 7375097 - DNA, 22 bp, Homo sapiens
gctgaataagagtctactttgc

SEQ ID NO: 7375098 - DNA, 20 bp, Homo sapiens
gctgaagattcccatgcaag

SEQ ID NO: 7375099 - DNA, 22 bp, Homo sapiens
gctgaagatttttgctagcccc

SEQ ID NO: 7375100 - DNA, 22 bp, Homo sapiens
gctgaagatgcatcccttctct

SEQ ID NO: 7375101 - DNA, 22 bp, Homo sapiens
gctgaagataggcatttcagca

SEQ ID NO: 7375102 - DNA, 22 bp, Homo sapiens
gctgaagataagtgaagaggct

SEQ ID NO: 7375103 - DNA, 22 bp, Homo sapiens
gctgaagataagtgaagaggct

SEQ ID NO: 7375104 - DNA, 22 bp, Homo sapiens
gctgcacttgagcctgggagaa

SEQ ID NO: 7375105 - DNA, 22 bp, Homo sapiens
gctgcacatggcagaggccttt

SEQ ID NO: 7375106 - DNA, 22 bp, Homo sapiens
gctgcactttgactgctggggt

SEQ ID NO: 7375107 - DNA, 22 bp, Homo sapiens
gctgatccttttatgtctagct

SEQ ID NO: 7375108 - DNA, 22 bp, Homo sapiens
gctgaataggactgtcatctct

SEQ ID NO: 7375109 - DNA, 22 bp, Homo sapiens
gctgccagctgcggcccacgcg

SEQ ID NO: 7375110 - DNA, 22 bp, Homo sapiens
gctgccagctcactctcctgag

SEQ ID NO: 7375111 - DNA, 22 bp, Homo sapiens
gctgccagcgtcagacctgggg

SEQ ID NO: 7375112 - DNA, 22 bp, Homo sapiens
gctgccagcccagcaaggtgtg

SEQ ID NO: 7375113 - DNA, 22 bp, Homo sapiens
gctgccagccagggtgggatcc

SEQ ID NO: 7375114 - DNA, 22 bp, Homo sapiens
gctgccaggacggagaggagcg

SEQ ID NO: 7375115 - DNA, 21 bp, Homo sapiens
gctgccaggattttgcaggaa

SEQ ID NO: 7375116 - DNA, 22 bp, Homo sapiens
gctgccagggaggtggtggagg

SEQ ID NO: 7375117 - DNA, 22 bp, Homo sapiens
gctgccagtagttggagctcca

SEQ ID NO: 7375118 - DNA, 22 bp, Homo sapiens
gctgccaggggcagctgtctca

SEQ ID NO: 7375119 - DNA, 20 bp, Homo sapiens
gctgccagggcggagacatc

SEQ ID NO: 7375120 - DNA, 22 bp, Homo sapiens
gctgccagtgtggcatgatgca

SEQ ID NO: 7375121 - DNA, 20 bp, Homo sapiens
gctgccagtgcctgatgctt

SEQ ID NO: 7375122 - DNA, 22 bp, Homo sapiens
gctgccagttccttcttactcc

SEQ ID NO: 7375123 - DNA, 22 bp, Homo sapiens
gctgccatcccctgctgggctg

SEQ ID NO: 7375124 - DNA, 22 bp, Homo sapiens
gctgccatctcctgaggacagg

SEQ ID NO: 7375125 - DNA, 22 bp, Homo sapiens
gctgcagctttaggatccagtg

SEQ ID NO: 7375126 - DNA, 22 bp, Homo sapiens
gctgcaggttgggcaacagagt

SEQ ID NO: 7375127 - DNA, 22 bp, Homo sapiens
gctgcaggttgggcaacagagt

SEQ ID NO: 7375128 - DNA, 22 bp, Homo sapiens
gctgcagggggtgggcgtctcc

SEQ ID NO: 7375129 - DNA, 22 bp, Homo sapiens
gctgccagcacacaggtgttag

SEQ ID NO: 7375130 - DNA, 22 bp, Homo sapiens
gctgccagcacagttcagctgt

SEQ ID NO: 7375131 - DNA, 22 bp, Homo sapiens
gctgccagccaacttgctgtgc

SEQ ID NO: 7375132 - DNA, 22 bp, Homo sapiens
gctatcttcatggaaatacagg

SEQ ID NO: 7375133 - DNA, 22 bp, Homo sapiens
gctatctttctgcaccataatt

SEQ ID NO: 7375134 - DNA, 22 bp, Homo sapiens
gctatcatccttgtcagtgact

SEQ ID NO: 7375135 - DNA, 22 bp, Homo sapiens
gctcaatgctcaatgctgcaaa

SEQ ID NO: 7375136 - DNA, 22 bp, Homo sapiens
gctcaagccttctgcccacctc

SEQ ID NO: 7375137 - DNA, 22 bp, Homo sapiens
gctcagctgggaccaatgtgtt

SEQ ID NO: 7375138 - DNA, 22 bp, Homo sapiens
gctcagctggagagggacgggt

SEQ ID NO: 7375139 - DNA, 22 bp, Homo sapiens
gctcacatcatagtaagctcat

SEQ ID NO: 7375140 - DNA, 22 bp, Homo sapiens
gctcagctgcacctggagagcc

SEQ ID NO: 7375141 - DNA, 22 bp, Homo sapiens
gctcacaggcagtgttgggaga

SEQ ID NO: 7375142 - DNA, 22 bp, Homo sapiens
gcggaaggctgcctggcttgag

SEQ ID NO: 7375143 - DNA, 22 bp, Homo sapiens
gccttctgatcgctggactgac

SEQ ID NO: 7375144 - DNA, 22 bp, Homo sapiens
gccttctgatatctcttggcat

SEQ ID NO: 7375145 - DNA, 22 bp, Homo sapiens
gccttctgtgctcctggccttt

SEQ ID NO: 7375146 - DNA, 22 bp, Homo sapiens
gccttctgattgctggactgac

SEQ ID NO: 7375147 - DNA, 22 bp, Homo sapiens
gcctcagggataggatgagcat

SEQ ID NO: 7375148 - DNA, 22 bp, Homo sapiens
gcctggctaagcagaaggaccc

SEQ ID NO: 7375149 - DNA, 22 bp, Homo sapiens
gcctcaggcctatagctgctgt

SEQ ID NO: 7375150 - DNA, 22 bp, Homo sapiens
gcctggctggtcactgcctggc

SEQ ID NO: 7375151 - DNA, 22 bp, Homo sapiens
gcctggctgggcaccaggggag

SEQ ID NO: 7375152 - DNA, 22 bp, Homo sapiens
gccttcatagagtgtaggcctt

SEQ ID NO: 7375153 - DNA, 22 bp, Homo sapiens
gccttattacctgcactttgaa

SEQ ID NO: 7375154 - DNA, 22 bp, Homo sapiens
gccttagcctgcacttcctgtt

SEQ ID NO: 7375155 - DNA, 22 bp, Homo sapiens
gcctggggcatgcagctgatac

SEQ ID NO: 7375156 - DNA, 22 bp, Homo sapiens
gctggctcttcagtggagatag

SEQ ID NO: 7375157 - DNA, 22 bp, Homo sapiens
gctggctgcacaggggctcact

SEQ ID NO: 7375158 - DNA, 22 bp, Homo sapiens
gctgggagaggccctgaagtga

SEQ ID NO: 7375159 - DNA, 22 bp, Homo sapiens
gctgggagcaaagccatgcata

SEQ ID NO: 7375160 - DNA, 22 bp, Homo sapiens
gctgccatggctgggggccgtg

SEQ ID NO: 7375161 - DNA, 22 bp, Homo sapiens
gctgccatgttgtgaggacact

SEQ ID NO: 7375162 - DNA, 22 bp, Homo sapiens
gctgtgagggcttctgaggcat

SEQ ID NO: 7375163 - DNA, 22 bp, Homo sapiens
gctgtctttcccctgctccaga

SEQ ID NO: 7375164 - DNA, 22 bp, Homo sapiens
gctgtcttgggtagaaagaggt

SEQ ID NO: 7375165 - DNA, 22 bp, Homo sapiens
gctgtcttgtatgttgtaggac

SEQ ID NO: 7375166 - DNA, 22 bp, Homo sapiens
gctgtcttgatgattggatgct

SEQ ID NO: 7375167 - DNA, 22 bp, Homo sapiens
gctgtcttccttgctccaaggg

SEQ ID NO: 7375168 - DNA, 22 bp, Homo sapiens
gctgtcttgctcactcttgcag

SEQ ID NO: 7375169 - DNA, 22 bp, Homo sapiens
gcttcattttgccctctggtgg

SEQ ID NO: 7375170 - DNA, 21 bp, Homo sapiens
gcttccaagatggcaccttga

SEQ ID NO: 7375171 - DNA, 22 bp, Homo sapiens
gcttccagtaagttgctgccat

SEQ ID NO: 7375172 - DNA, 16 bp, Homo sapiens
gctgggagggagaggt

SEQ ID NO: 7375173 - DNA, 19 bp, Homo sapiens
gctgggtggggtccacagc

SEQ ID NO: 7375174 - DNA, 22 bp, Homo sapiens
gctgggtggatcggaggctctg

SEQ ID NO: 7375175 - DNA, 21 bp, Homo sapiens
ggaacattgttaatagtctct

SEQ ID NO: 7375176 - DNA, 21 bp, Homo sapiens
ggaagcagtggcggcaactcc

SEQ ID NO: 7375177 - DNA, 23 bp, Homo sapiens
ggacacatttatttcagaattca

SEQ ID NO: 7375178 - DNA, 22 bp, Homo sapiens
ggaagctgttcctgtgtggcca

SEQ ID NO: 7375179 - DNA, 17 bp, Homo sapiens
gcttcctcatgcagttc

SEQ ID NO: 7375180 - DNA, 20 bp, Homo sapiens
ggaaatcaccaggctccacc

SEQ ID NO: 7375181 - DNA, 22 bp, Homo sapiens
ggaaaggggcctggatcttttg

SEQ ID NO: 7375182 - DNA, 22 bp, Homo sapiens
ggaaagggcatggccttttcac

SEQ ID NO: 7375183 - DNA, 22 bp, Homo sapiens
ggaaagggagttttgcttatga

SEQ ID NO: 7375184 - DNA, 22 bp, Homo sapiens
ggaaagggagttttgcttatga

SEQ ID NO: 7375185 - DNA, 22 bp, Homo sapiens
ggaaaggagatattggagagtg

SEQ ID NO: 7375186 - DNA, 22 bp, Homo sapiens
ggaaaggagatgaataggatta

SEQ ID NO: 7375187 - DNA, 22 bp, Homo sapiens
ggacagagcagacgagcagcgg

SEQ ID NO: 7375188 - DNA, 22 bp, Homo sapiens
ggacagagagtgaatatgacat

SEQ ID NO: 7375189 - DNA, 22 bp, Homo sapiens
ggacagacaaaaatagtaagca

SEQ ID NO: 7375190 - DNA, 22 bp, Homo sapiens
ggacagagccctggtggcctaa

SEQ ID NO: 7375191 - DNA, 22 bp, Homo sapiens
ggacagagccctggtggcctaa

SEQ ID NO: 7375192 - DNA, 22 bp, Homo sapiens
ggacacgtggctgaaggcggcc

SEQ ID NO: 7375193 - DNA, 22 bp, Homo sapiens
ggacccagctctgagaccctgc

SEQ ID NO: 7375194 - DNA, 22 bp, Homo sapiens
ggacccaggtagggaggaagat

SEQ ID NO: 7375195 - DNA, 18 bp, Homo sapiens
ggacccagggcctcaccc

SEQ ID NO: 7375196 - DNA, 22 bp, Homo sapiens
ggaccggtggcttcctcgggtc

SEQ ID NO: 7375197 - DNA, 23 bp, Homo sapiens
ggaccctgtggagggtgagagtc

SEQ ID NO: 7375198 - DNA, 22 bp, Homo sapiens
ggaccctgtaaagtcgtgtcca

SEQ ID NO: 7375199 - DNA, 23 bp, Homo sapiens
ggaccctgtggagggtgagagtc

SEQ ID NO: 7375200 - DNA, 22 bp, Homo sapiens
ggaccctggagacccactggga

SEQ ID NO: 7375201 - DNA, 22 bp, Homo sapiens
ggaccctgcgtgtatccacact

SEQ ID NO: 7375202 - DNA, 22 bp, Homo sapiens
ggaccctgcagccacccgacat

SEQ ID NO: 7375203 - DNA, 22 bp, Homo sapiens
ggaccctgggcagctggctgct

SEQ ID NO: 7375204 - DNA, 22 bp, Homo sapiens
ggacgcagccgagggagcaggg

SEQ ID NO: 7375205 - DNA, 22 bp, Homo sapiens
ggacgcagcgagggaagcagcc

SEQ ID NO: 7375206 - DNA, 22 bp, Homo sapiens
ggactcctctagaagttgaggc

SEQ ID NO: 7375207 - DNA, 22 bp, Homo sapiens
ggagagagatgccgccttgctc

SEQ ID NO: 7375208 - DNA, 22 bp, Homo sapiens
ggactgaggacatgtgaggcat

SEQ ID NO: 7375209 - DNA, 22 bp, Homo sapiens
ggagaggagctattgggggctc

SEQ ID NO: 7375210 - DNA, 22 bp, Homo sapiens
ggagagctggtatatgaagaca

SEQ ID NO: 7375211 - DNA, 22 bp, Homo sapiens
ggagaggatgttttagtaactt

SEQ ID NO: 7375212 - DNA, 22 bp, Homo sapiens
ggagaggcgatgagtcacagcc

SEQ ID NO: 7375213 - DNA, 22 bp, Homo sapiens
ggctgctggggacgtgggagag

SEQ ID NO: 7375214 - DNA, 19 bp, Homo sapiens
ggctggagaaaggaatcag

SEQ ID NO: 7375215 - DNA, 22 bp, Homo sapiens
ggctccctgggtgctcctgctc

SEQ ID NO: 7375216 - DNA, 22 bp, Homo sapiens
ggctcctgaggaccaggcacag

SEQ ID NO: 7375217 - DNA, 22 bp, Homo sapiens
ggctaaagatgtgttctttgga

SEQ ID NO: 7375218 - DNA, 22 bp, Homo sapiens
ggctcccaggagggcctggagg

SEQ ID NO: 7375219 - DNA, 22 bp, Homo sapiens
ggctccagtttgtgccttcagc

SEQ ID NO: 7375220 - DNA, 22 bp, Homo sapiens
ggctccctgcctgtcctcagtc

SEQ ID NO: 7375221 - DNA, 17 bp, Homo sapiens
ggctccctgactatgga

SEQ ID NO: 7375222 - DNA, 22 bp, Homo sapiens
ggctccctgcaacctccgcctc

SEQ ID NO: 7375223 - DNA, 22 bp, Homo sapiens
gggaaggctgcctgagggatgg

SEQ ID NO: 7375224 - DNA, 22 bp, Homo sapiens
ggctttattttgcatgaatgct

SEQ ID NO: 7375225 - DNA, 22 bp, Homo sapiens
ggctttatttgcagccattgtt

SEQ ID NO: 7375226 - DNA, 22 bp, Homo sapiens
ggctttattttgcatgaatgct

SEQ ID NO: 7375227 - DNA, 22 bp, Homo sapiens
ggctttgacatgctgaattaaa

SEQ ID NO: 7375228 - DNA, 22 bp, Homo sapiens
ggctttatagggtagaggatca

SEQ ID NO: 7375229 - DNA, 22 bp, Homo sapiens
ggctttatagggtagaggatca

SEQ ID NO: 7375230 - DNA, 22 bp, Homo sapiens
ggctgtgcctctggcagcacat

SEQ ID NO: 7375231 - DNA, 22 bp, Homo sapiens
ggctttatgcagggatagaaat

SEQ ID NO: 7375232 - DNA, 22 bp, Homo sapiens
ggctttatcaaatgagaccctg

SEQ ID NO: 7375233 - DNA, 22 bp, Homo sapiens
ggctttatcaaatgagaccctg

SEQ ID NO: 7375234 - DNA, 22 bp, Homo sapiens
ggctttatgcacagcagatggt

SEQ ID NO: 7375235 - DNA, 22 bp, Homo sapiens
ggctttatgcacagcagatggt

SEQ ID NO: 7375236 - DNA, 22 bp, Homo sapiens
ggctttatattgtttgagcaga

SEQ ID NO: 7375237 - DNA, 22 bp, Homo sapiens
ggctttatattgtttgagcaga

SEQ ID NO: 7375238 - DNA, 22 bp, Homo sapiens
ggctttattatgtggccatgtg

SEQ ID NO: 7375239 - DNA, 22 bp, Homo sapiens
ggctttattatgtggccatgtg

SEQ ID NO: 7375240 - DNA, 22 bp, Homo sapiens
ggctttattaagcagggtaagt

SEQ ID NO: 7375241 - DNA, 22 bp, Homo sapiens
ggctttattatgtggccatgtg

SEQ ID NO: 7375242 - DNA, 22 bp, Homo sapiens
ggctttatttcactgtaccata

SEQ ID NO: 7375243 - DNA, 22 bp, Homo sapiens
ggctttatttcactgtaccata

SEQ ID NO: 7375244 - DNA, 22 bp, Homo sapiens
ggctttatttgcagccattgtt

SEQ ID NO: 7375245 - DNA, 22 bp, Homo sapiens
ggctttatgcagggatagaaat

SEQ ID NO: 7375246 - DNA, 21 bp, Homo sapiens
ggctttatgctcacccagcct

SEQ ID NO: 7375247 - DNA, 21 bp, Homo sapiens
ggctttatgctcacccagcct

SEQ ID NO: 7375248 - DNA, 22 bp, Homo sapiens
ggctttatgtttttcatgtggt

SEQ ID NO: 7375249 - DNA, 22 bp, Homo sapiens
ggctttatgtttttcatgtggt

SEQ ID NO: 7375250 - DNA, 22 bp, Homo sapiens
ggctttattaactcatccgtaa

SEQ ID NO: 7375251 - DNA, 22 bp, Homo sapiens
ggctttattaactcatccgtaa

SEQ ID NO: 7375252 - DNA, 22 bp, Homo sapiens
ggctttattaagcagggtaagt

SEQ ID NO: 7375253 - DNA, 22 bp, Homo sapiens
gggagctgagctggaagagaat

SEQ ID NO: 7375254 - DNA, 22 bp, Homo sapiens
gggagctgagctggaagagaat

SEQ ID NO: 7375255 - DNA, 22 bp, Homo sapiens
gggagctgagctctgagccacg

SEQ ID NO: 7375256 - DNA, 22 bp, Homo sapiens
gggagctgacctgcaggttccc

SEQ ID NO: 7375257 - DNA, 21 bp, Homo sapiens
gggagctgacagcagcacggc

SEQ ID NO: 7375258 - DNA, 22 bp, Homo sapiens
gggagctgagggacctctgtgg

SEQ ID NO: 7375259 - DNA, 22 bp, Homo sapiens
gggagctggagctggaagactc

SEQ ID NO: 7375260 - DNA, 19 bp, Homo sapiens
gggagctgaggtctttggt

SEQ ID NO: 7375261 - DNA, 22 bp, Homo sapiens
gggaagtgatggagccaggatt

SEQ ID NO: 7375262 - DNA, 21 bp, Homo sapiens
gggcactgaaagggaatagca

SEQ ID NO: 7375263 - DNA, 22 bp, Homo sapiens
gggcacatgcttagggaggaaa

SEQ ID NO: 7375264 - DNA, 22 bp, Homo sapiens
gggcactggaggccaaggagct

SEQ ID NO: 7375265 - DNA, 18 bp, Homo sapiens
gggcactggggactggag

SEQ ID NO: 7375266 - DNA, 22 bp, Homo sapiens
gggcaggttattggagtaggga

SEQ ID NO: 7375267 - DNA, 22 bp, Homo sapiens
gggcaggttggcatcccgggca

SEQ ID NO: 7375268 - DNA, 23 bp, Homo sapiens
gggcaggtttttataggcttcag

SEQ ID NO: 7375269 - DNA, 22 bp, Homo sapiens
gggagctggagctggaagactc

SEQ ID NO: 7375270 - DNA, 22 bp, Homo sapiens
gggagggagaggacagttctat

SEQ ID NO: 7375271 - DNA, 22 bp, Homo sapiens
gggagctggcctactattagat

SEQ ID NO: 7375272 - DNA, 22 bp, Homo sapiens
gggagctggatgattgaggcaa

SEQ ID NO: 7375273 - DNA, 16 bp, Homo sapiens
gggagggagttggtgg

SEQ ID NO: 7375274 - DNA, 22 bp, Homo sapiens
gggagggatctgctaggcaatg

SEQ ID NO: 7375275 - DNA, 22 bp, Homo sapiens
gggagggatctgctaggcaatg

SEQ ID NO: 7375276 - DNA, 22 bp, Homo sapiens
gggagggaggtgatgcttggct

SEQ ID NO: 7375277 - DNA, 22 bp, Homo sapiens
gggagggaggtgctggttcacg

SEQ ID NO: 7375278 - DNA, 22 bp, Homo sapiens
gggaggttgaggctgcagtgag

SEQ ID NO: 7375279 - DNA, 22 bp, Homo sapiens
gggaggtgattaggaccatgta

SEQ ID NO: 7375280 - DNA, 22 bp, Homo sapiens
gggagggattagttctgcctgg

SEQ ID NO: 7375281 - DNA, 21 bp, Homo sapiens
gggagggatggaaatgatgtt

SEQ ID NO: 7375282 - DNA, 22 bp, Homo sapiens
gggaggtgatggcaagcagcgg

SEQ ID NO: 7375283 - DNA, 22 bp, Homo sapiens
ggcagcttaaaccacagacatt

SEQ ID NO: 7375284 - DNA, 23 bp, Homo sapiens
ggcagcttacttggtctctttca

SEQ ID NO: 7375285 - DNA, 22 bp, Homo sapiens
ggcagcttcctaggagagggca

SEQ ID NO: 7375286 - DNA, 23 bp, Homo sapiens
ggcagcttatactttcatagaca

SEQ ID NO: 7375287 - DNA, 22 bp, Homo sapiens
ggcagcttcttaatatggagac

SEQ ID NO: 7375288 - DNA, 18 bp, Homo sapiens
ggcagcttgactagcaac

SEQ ID NO: 7375289 - DNA, 22 bp, Homo sapiens
ggcagcttggttgcagaccatc

SEQ ID NO: 7375290 - DNA, 22 bp, Homo sapiens
ggcagcttgtccttcaggagag

SEQ ID NO: 7375291 - DNA, 22 bp, Homo sapiens
ggcagctttggattcgcggctg

SEQ ID NO: 7375292 - DNA, 22 bp, Homo sapiens
ggcagctgttggctctctagga

SEQ ID NO: 7375293 - DNA, 22 bp, Homo sapiens
ggcagctgtttgtcctcctgtt

SEQ ID NO: 7375294 - DNA, 17 bp, Homo sapiens
ggcagctgtgtgcatgc

SEQ ID NO: 7375295 - DNA, 22 bp, Homo sapiens
ggcagctgtggacgtcgtcatt

SEQ ID NO: 7375296 - DNA, 21 bp, Homo sapiens
ggcagctgtggttaattgaac

SEQ ID NO: 7375297 - DNA, 22 bp, Homo sapiens
ggcagcagtaggagctaatctt

SEQ ID NO: 7375298 - DNA, 22 bp, Homo sapiens
ggcagcagggtagccatttctc

SEQ ID NO: 7375299 - DNA, 22 bp, Homo sapiens
ggcagcagggctgtctccctac

SEQ ID NO: 7375300 - DNA, 22 bp, Homo sapiens
ggcagcagcaaggttggagctg

SEQ ID NO: 7375301 - DNA, 22 bp, Homo sapiens
ggcagcaggagccatctggtag

SEQ ID NO: 7375302 - DNA, 21 bp, Homo sapiens
ggcagaagtagcatggacggg

SEQ ID NO: 7375303 - DNA, 22 bp, Homo sapiens
ggcagaagataggacagggaat

SEQ ID NO: 7375304 - DNA, 22 bp, Homo sapiens
ggcagaagataggacagggaat

SEQ ID NO: 7375305 - DNA, 22 bp, Homo sapiens
ggcagaagacaggcaaatcatg

SEQ ID NO: 7375306 - DNA, 22 bp, Homo sapiens
ggcagaagaaaggctaagtctc

SEQ ID NO: 7375307 - DNA, 22 bp, Homo sapiens
ggcagaagaaaggctaagtctc

SEQ ID NO: 7375308 - DNA, 19 bp, Homo sapiens
ggcagaaggtgtaggggga

SEQ ID NO: 7375309 - DNA, 22 bp, Homo sapiens
ggcagaaggcaattagagactg

SEQ ID NO: 7375310 - DNA, 22 bp, Homo sapiens
ggcagaaggcctcccagctcct

SEQ ID NO: 7375311 - DNA, 22 bp, Homo sapiens
ggcactgggcaccggctgaggg

SEQ ID NO: 7375312 - DNA, 18 bp, Homo sapiens
ggcactggtgatgcagag

SEQ ID NO: 7375313 - DNA, 22 bp, Homo sapiens
ggcactgtgtacacacagagac

SEQ ID NO: 7375314 - DNA, 19 bp, Homo sapiens
ggcactggggccaggacca

SEQ ID NO: 7375315 - DNA, 22 bp, Homo sapiens
ggcactgggttgtaggaattaa

SEQ ID NO: 7375316 - DNA, 22 bp, Homo sapiens
ggagatggcaagaagttattag

SEQ ID NO: 7375317 - DNA, 22 bp, Homo sapiens
ggagatggccaaaaacacaaat

SEQ ID NO: 7375318 - DNA, 22 bp, Homo sapiens
ggagatggagtggattcagcag

SEQ ID NO: 7375319 - DNA, 22 bp, Homo sapiens
ggagatggctctgcaaggtcta

SEQ ID NO: 7375320 - DNA, 21 bp, Homo sapiens
ggagatgggtatcgcctgggc

SEQ ID NO: 7375321 - DNA, 22 bp, Homo sapiens
ggagatgggggattttacagcg

SEQ ID NO: 7375322 - DNA, 22 bp, Homo sapiens
ggagatggctggcaggtagatg

SEQ ID NO: 7375323 - DNA, 22 bp, Homo sapiens
ggagcacagccttgccagtacc

SEQ ID NO: 7375324 - DNA, 22 bp, Homo sapiens
ggagcacagccttgccagtacc

SEQ ID NO: 7375325 - DNA, 22 bp, Homo sapiens
ggagcacaccgggagcttgcct

SEQ ID NO: 7375326 - DNA, 22 bp, Homo sapiens
ggagcagagctgggcttggctg

SEQ ID NO: 7375327 - DNA, 17 bp, Homo sapiens
ggagcagatccaccatt

SEQ ID NO: 7375328 - DNA, 22 bp, Homo sapiens
ggagcagatgtcttcatggcct

SEQ ID NO: 7375329 - DNA, 22 bp, Homo sapiens
ggagcagagctcttcatctgca

SEQ ID NO: 7375330 - DNA, 22 bp, Homo sapiens
ggagcagagcatttcacagcct

SEQ ID NO: 7375331 - DNA, 22 bp, Homo sapiens
ggagcagacataaccttacaga

SEQ ID NO: 7375332 - DNA, 22 bp, Homo sapiens
ggattctactgatcagcaccac

SEQ ID NO: 7375333 - DNA, 22 bp, Homo sapiens
ggattcagggtaaagtttcagt

SEQ ID NO: 7375334 - DNA, 22 bp, Homo sapiens
ggattcagcgaggcagcctgga

SEQ ID NO: 7375335 - DNA, 22 bp, Homo sapiens
ggatggcagtctgcatgagaaa

SEQ ID NO: 7375336 - DNA, 22 bp, Homo sapiens
ggatggcatgttgggctctgtt

SEQ ID NO: 7375337 - DNA, 22 bp, Homo sapiens
ggatggaggttctcagatgctc

SEQ ID NO: 7375338 - DNA, 23 bp, Homo sapiens
ggatggacgtgatgccttagcca

SEQ ID NO: 7375339 - DNA, 22 bp, Homo sapiens
ggatgcaggaggtcggggagca

SEQ ID NO: 7375340 - DNA, 22 bp, Homo sapiens
ggatgcaggggcagcagagcct

SEQ ID NO: 7375341 - DNA, 22 bp, Homo sapiens
ggatgcagtgaggagcccgcgc

SEQ ID NO: 7375342 - DNA, 22 bp, Homo sapiens
ggatgaggtagatgaacaaggg

SEQ ID NO: 7375343 - DNA, 22 bp, Homo sapiens
ggatgcaggaacacagcgacct

SEQ ID NO: 7375344 - DNA, 23 bp, Homo sapiens
ggatggacgtgatgccttagcca

SEQ ID NO: 7375345 - DNA, 21 bp, Homo sapiens
ggcatgctgctgctacttggc

SEQ ID NO: 7375346 - DNA, 22 bp, Homo sapiens
ggcatgcttgctgtttgggaat

SEQ ID NO: 7375347 - DNA, 22 bp, Homo sapiens
ggcatgctctttatattgcaat

SEQ ID NO: 7375348 - DNA, 22 bp, Homo sapiens
ggcatgctcaggcttcttgctg

SEQ ID NO: 7375349 - DNA, 22 bp, Homo sapiens
ggcatgctctttgtccacagta

SEQ ID NO: 7375350 - DNA, 22 bp, Homo sapiens
ggcatgctacttcttcaatttt

SEQ ID NO: 7375351 - DNA, 22 bp, Homo sapiens
ggcatgctaggcattttatggg

SEQ ID NO: 7375352 - DNA, 22 bp, Homo sapiens
ggccagctttctgtcttctagg

SEQ ID NO: 7375353 - DNA, 22 bp, Homo sapiens
ggcatctcgcattcttgtttct

SEQ ID NO: 7375354 - DNA, 21 bp, Homo sapiens
ggcatgagggcagtgagcaga

SEQ ID NO: 7375355 - DNA, 20 bp, Homo sapiens
ggcatgagatgtgagggagg

SEQ ID NO: 7375356 - DNA, 22 bp, Homo sapiens
ggcatctgtggagccttttcca

SEQ ID NO: 7375357 - DNA, 22 bp, Homo sapiens
ggcatctgagctgtgtatggtt

SEQ ID NO: 7375358 - DNA, 22 bp, Homo sapiens
ggcagggtttctccattctgcc

SEQ ID NO: 7375359 - DNA, 22 bp, Homo sapiens
ggcaggtagcctagaggaggtt

SEQ ID NO: 7375360 - DNA, 22 bp, Homo sapiens
ggcaggtagcctagaggaggtt

SEQ ID NO: 7375361 - DNA, 22 bp, Homo sapiens
ggcaggtgagagctctttgaaa

SEQ ID NO: 7375362 - DNA, 18 bp, Homo sapiens
ggcaggagcaagaatagg

SEQ ID NO: 7375363 - DNA, 22 bp, Homo sapiens
ggcaggagctcaggttggttcc

SEQ ID NO: 7375364 - DNA, 22 bp, Homo sapiens
ggcaggagataaaatattagtt

SEQ ID NO: 7375365 - DNA, 22 bp, Homo sapiens
ggcaggagaatggcgtgaactc

SEQ ID NO: 7375366 - DNA, 22 bp, Homo sapiens
ggcaggagctctccagtttgcc

SEQ ID NO: 7375367 - DNA, 22 bp, Homo sapiens
ggcaggagctctccagtttgcc

SEQ ID NO: 7375368 - DNA, 22 bp, Homo sapiens
ggcaggaggaagagttagcacc

SEQ ID NO: 7375369 - DNA, 22 bp, Homo sapiens
ggccctgctcaggctgcgatga

SEQ ID NO: 7375370 - DNA, 22 bp, Homo sapiens
ggccaggcgatgacccctccac

SEQ ID NO: 7375371 - DNA, 22 bp, Homo sapiens
ggccctgggccctctagcttgt

SEQ ID NO: 7375372 - DNA, 22 bp, Homo sapiens
ggccctgggatgctcagcagtg

SEQ ID NO: 7375373 - DNA, 22 bp, Homo sapiens
ggcctgcctcacagtcagcacc

SEQ ID NO: 7375374 - DNA, 19 bp, Homo sapiens
ggcctgcccaatgtctgct

SEQ ID NO: 7375375 - DNA, 22 bp, Homo sapiens
ggcctgctctgcagcctctaca

SEQ ID NO: 7375376 - DNA, 22 bp, Homo sapiens
ggcctgctgcagtgtgacagtt

SEQ ID NO: 7375377 - DNA, 22 bp, Homo sapiens
ggcctgctgggccccacagtcc

SEQ ID NO: 7375378 - DNA, 22 bp, Homo sapiens
ggcctgctggggcctcagacac

SEQ ID NO: 7375379 - DNA, 19 bp, Homo sapiens
ggcctggctatccctgctg

SEQ ID NO: 7375380 - DNA, 22 bp, Homo sapiens
ggcctggcctccagatgtgggc

SEQ ID NO: 7375381 - DNA, 22 bp, Homo sapiens
ggtgccttttccgtgtggccca

SEQ ID NO: 7375382 - DNA, 22 bp, Homo sapiens
ggtgctcaagagggcatcctct

SEQ ID NO: 7375383 - DNA, 22 bp, Homo sapiens
ggtgccaggctcccagctcagg

SEQ ID NO: 7375384 - DNA, 22 bp, Homo sapiens
ggtgccagagtggcccaggggc

SEQ ID NO: 7375385 - DNA, 22 bp, Homo sapiens
ggtgccagcctagtgcagtggt

SEQ ID NO: 7375386 - DNA, 22 bp, Homo sapiens
ggtgccagagtggcccaggggc

SEQ ID NO: 7375387 - DNA, 22 bp, Homo sapiens
ggtgggaggcaggctgctccca

SEQ ID NO: 7375388 - DNA, 22 bp, Homo sapiens
ggtgggagccaacacccttctg

SEQ ID NO: 7375389 - DNA, 22 bp, Homo sapiens
ggtgggagccaacacccttctg

SEQ ID NO: 7375390 - DNA, 22 bp, Homo sapiens
ggtcttctggaaagcagactgt

SEQ ID NO: 7375391 - DNA, 22 bp, Homo sapiens
ggtgaagcgtatttgtggagct

SEQ ID NO: 7375392 - DNA, 22 bp, Homo sapiens
ggtctttctactgcacttggct

SEQ ID NO: 7375393 - DNA, 22 bp, Homo sapiens
ggtctttcattacatgggttaa

SEQ ID NO: 7375394 - DNA, 22 bp, Homo sapiens
ggtgaaggaggaagctgatgga

SEQ ID NO: 7375395 - DNA, 22 bp, Homo sapiens
ggtgaaggcacaagagggcaag

SEQ ID NO: 7375396 - DNA, 22 bp, Homo sapiens
ggtgcagggagaggcaggcccc

SEQ ID NO: 7375397 - DNA, 22 bp, Homo sapiens
ggtaataagatctgttacatgg

SEQ ID NO: 7375398 - DNA, 22 bp, Homo sapiens
ggtaccaccaattcagctgcca

SEQ ID NO: 7375399 - DNA, 22 bp, Homo sapiens
ggtaaggagagagaaattatgc

SEQ ID NO: 7375400 - DNA, 22 bp, Homo sapiens
ggtaaggagctccggcttctgc

SEQ ID NO: 7375401 - DNA, 22 bp, Homo sapiens
gggtcaggcctcaaggtgggct

SEQ ID NO: 7375402 - DNA, 22 bp, Homo sapiens
gggtccagagcctcagcccaga

SEQ ID NO: 7375403 - DNA, 20 bp, Homo sapiens
ggtcagcctggggctccagg

SEQ ID NO: 7375404 - DNA, 22 bp, Homo sapiens
ggtcagccttggatttggtagc

SEQ ID NO: 7375405 - DNA, 22 bp, Homo sapiens
ggtaggaagatagagcaaagtt

SEQ ID NO: 7375406 - DNA, 20 bp, Homo sapiens
ggtagctgctgcagttggta

SEQ ID NO: 7375407 - DNA, 20 bp, Homo sapiens
ggtagctgctgcagttggta

SEQ ID NO: 7375408 - DNA, 22 bp, Homo sapiens
ggtagctgcagcaggctggcaa

SEQ ID NO: 7375409 - DNA, 22 bp, Homo sapiens
ggtagactgagctccttgagga

SEQ ID NO: 7375410 - DNA, 20 bp, Homo sapiens
ggtagcagctgctgtcatcc

SEQ ID NO: 7375411 - DNA, 22 bp, Homo sapiens
ggtcagggggatctgtgaggta

SEQ ID NO: 7375412 - DNA, 18 bp, Homo sapiens
ggtcaggggcggagagaa

SEQ ID NO: 7375413 - DNA, 22 bp, Homo sapiens
gggctccagcccgggaccaggt

SEQ ID NO: 7375414 - DNA, 19 bp, Homo sapiens
gggctccttgggcctctct

SEQ ID NO: 7375415 - DNA, 22 bp, Homo sapiens
gggcctgccattgctgccccag

SEQ ID NO: 7375416 - DNA, 22 bp, Homo sapiens
gggcctgctccccatcgctgct

SEQ ID NO: 7375417 - DNA, 22 bp, Homo sapiens
gggcctccgtgtgctggtgctc

SEQ ID NO: 7375418 - DNA, 22 bp, Homo sapiens
gggcctcagctctgctctgcaa

SEQ ID NO: 7375419 - DNA, 18 bp, Homo sapiens
gggcatcattcacaaagt

SEQ ID NO: 7375420 - DNA, 22 bp, Homo sapiens
ggggcacttccaggctgaggct

SEQ ID NO: 7375421 - DNA, 22 bp, Homo sapiens
ggggcacacttttggtagatat

SEQ ID NO: 7375422 - DNA, 22 bp, Homo sapiens
ggggcagaaagcccacagagtg

SEQ ID NO: 7375423 - DNA, 22 bp, Homo sapiens
ggggcaggagcccttcttcagc

SEQ ID NO: 7375424 - DNA, 22 bp, Homo sapiens
gggggagctacaggtcccttgg

SEQ ID NO: 7375425 - DNA, 22 bp, Homo sapiens
gggggagctagtccagctgagg

SEQ ID NO: 7375426 - DNA, 22 bp, Homo sapiens
gggggccttgttagtggatgga

SEQ ID NO: 7375427 - DNA, 23 bp, Homo sapiens
gggggccgtcctggggattatag

SEQ ID NO: 7375428 - DNA, 22 bp, Homo sapiens
gtgcctccctgttgactagggt

SEQ ID NO: 7375429 - DNA, 22 bp, Homo sapiens
gtgcctcccggggctcttcctt

SEQ ID NO: 7375430 - DNA, 22 bp, Homo sapiens
gtgcctccttaaattctgcacc

SEQ ID NO: 7375431 - DNA, 22 bp, Homo sapiens
gtgcctgaaagccatgctcact

SEQ ID NO: 7375432 - DNA, 22 bp, Homo sapiens
gtgcctcccgggaccatgcact

SEQ ID NO: 7375433 - DNA, 22 bp, Homo sapiens
gtgcctccatcagtgcctccaa

SEQ ID NO: 7375434 - DNA, 22 bp, Homo sapiens
gtgcctccaggctcgactagtc

SEQ ID NO: 7375435 - DNA, 22 bp, Homo sapiens
gtgctgtctcaagaaggattct

SEQ ID NO: 7375436 - DNA, 22 bp, Homo sapiens
gtgctgtcactggtaaatgcgg

SEQ ID NO: 7375437 - DNA, 22 bp, Homo sapiens
gtgctgtcattagcatctagag

SEQ ID NO: 7375438 - DNA, 22 bp, Homo sapiens
gtgctgtatcagaatctgctct

SEQ ID NO: 7375439 - DNA, 22 bp, Homo sapiens
gtgcttgcagtgagatgagatg

SEQ ID NO: 7375440 - DNA, 22 bp, Homo sapiens
gtgcacactcttggggcacttt

SEQ ID NO: 7375441 - DNA, 22 bp, Homo sapiens
gtgcacacaagcaatgcactta

SEQ ID NO: 7375442 - DNA, 22 bp, Homo sapiens
gtgcacacatacatgaacgctg

SEQ ID NO: 7375443 - DNA, 22 bp, Homo sapiens
gtgcccaggggccagctgccgg

SEQ ID NO: 7375444 - DNA, 22 bp, Homo sapiens
gtgcccaggtgtccctgagaag

SEQ ID NO: 7375445 - DNA, 22 bp, Homo sapiens
gtcttcttttcagtctgcttgt

SEQ ID NO: 7375446 - DNA, 22 bp, Homo sapiens
gtcttctgtctgtctggcatgt

SEQ ID NO: 7375447 - DNA, 22 bp, Homo sapiens
gtcttctgtctgtctggcatgt

SEQ ID NO: 7375448 - DNA, 22 bp, Homo sapiens
gtcttctggggccaggcccgct

SEQ ID NO: 7375449 - DNA, 22 bp, Homo sapiens
gtcttctgcccaggcagacgga

SEQ ID NO: 7375450 - DNA, 22 bp, Homo sapiens
gtcttctgcctccattagagtt

SEQ ID NO: 7375451 - DNA, 22 bp, Homo sapiens
gtcttctggaagagagccagct

SEQ ID NO: 7375452 - DNA, 22 bp, Homo sapiens
gtgataagacagtaggcacaag

SEQ ID NO: 7375453 - DNA, 22 bp, Homo sapiens
gtgagtgtcagtcaaaggtttt

SEQ ID NO: 7375454 - DNA, 22 bp, Homo sapiens
gtctctctcccaagattggcta

SEQ ID NO: 7375455 - DNA, 22 bp, Homo sapiens
gtctctatcatagctgaaccct

SEQ ID NO: 7375456 - DNA, 20 bp, Homo sapiens
gtcttctattcccagaaagt

SEQ ID NO: 7375457 - DNA, 22 bp, Homo sapiens
gtcttctgatctggttagccat

SEQ ID NO: 7375458 - DNA, 22 bp, Homo sapiens
gtcttctgcaactgcacctgcc

SEQ ID NO: 7375459 - DNA, 22 bp, Homo sapiens
gtcttctgcccaggcagacgga

SEQ ID NO: 7375460 - DNA, 22 bp, Homo sapiens
gtcttattttctgtctactaaa

SEQ ID NO: 7375461 - DNA, 22 bp, Homo sapiens
gtcttatttaaggacaagaaga

SEQ ID NO: 7375462 - DNA, 22 bp, Homo sapiens
gtcttatttaacctaaatttct

SEQ ID NO: 7375463 - DNA, 22 bp, Homo sapiens
gtcttagatttcaccgataatg

SEQ ID NO: 7375464 - DNA, 22 bp, Homo sapiens
gtcagttttgctacagttgctg

SEQ ID NO: 7375465 - DNA, 22 bp, Homo sapiens
gtcataaaaggaccacctattg

SEQ ID NO: 7375466 - DNA, 18 bp, Homo sapiens
gtcagttttgaagccaga

SEQ ID NO: 7375467 - DNA, 22 bp, Homo sapiens
gtcagtttgactcagtgttata

SEQ ID NO: 7375468 - DNA, 20 bp, Homo sapiens
gtcagtgtcttcagtagtga

SEQ ID NO: 7375469 - DNA, 22 bp, Homo sapiens
gtcataaagacagaaacattcc

SEQ ID NO: 7375470 - DNA, 22 bp, Homo sapiens
gtcattcttaacaactcagtag

SEQ ID NO: 7375471 - DNA, 22 bp, Homo sapiens
gtcattctctggtgtggttgtt

SEQ ID NO: 7375472 - DNA, 17 bp, Homo sapiens
gtcattctcagaaaatg

SEQ ID NO: 7375473 - DNA, 22 bp, Homo sapiens
gtcacattcatgcagaatcaaa

SEQ ID NO: 7375474 - DNA, 22 bp, Homo sapiens
gtcattttatgggaacagattt

SEQ ID NO: 7375475 - DNA, 22 bp, Homo sapiens
gtccctggagctgagcagtgct

SEQ ID NO: 7375476 - DNA, 21 bp, Homo sapiens
gtcctcagctgatgggagctg

SEQ ID NO: 7375477 - DNA, 22 bp, Homo sapiens
gtcctcagcaccagaactaggg

SEQ ID NO: 7375478 - DNA, 22 bp, Homo sapiens
gtcctcaggaaggctttctgac

SEQ ID NO: 7375479 - DNA, 22 bp, Homo sapiens
gtcctctccaggaggctctgat

SEQ ID NO: 7375480 - DNA, 22 bp, Homo sapiens
gtcctctgcccaggtcaaggtt

SEQ ID NO: 7375481 - DNA, 22 bp, Homo sapiens
gtctcccatcgtttgtgaggaa

SEQ ID NO: 7375482 - DNA, 22 bp, Homo sapiens
gtaaattatttcaagatcatct

SEQ ID NO: 7375483 - DNA, 22 bp, Homo sapiens
gtaaattatttcaagatcatct

SEQ ID NO: 7375484 - DNA, 22 bp, Homo sapiens
gtaatacttgaagaattcagag

SEQ ID NO: 7375485 - DNA, 22 bp, Homo sapiens
gtaagttagttcctgtgttagt

SEQ ID NO: 7375486 - DNA, 22 bp, Homo sapiens
gtcaaggcatctctagagcaat

SEQ ID NO: 7375487 - DNA, 22 bp, Homo sapiens
gtaggaaagtaaatgaaataca

SEQ ID NO: 7375488 - DNA, 22 bp, Homo sapiens
gtagctgatcctgaggacaggg

SEQ ID NO: 7375489 - DNA, 22 bp, Homo sapiens
gtagctgcatattttcttagaa

SEQ ID NO: 7375490 - DNA, 22 bp, Homo sapiens
gtagcttacatcagagttggtt

SEQ ID NO: 7375491 - DNA, 22 bp, Homo sapiens
gtagctgatattagcaatgagt

SEQ ID NO: 7375492 - DNA, 22 bp, Homo sapiens
gtagaggctcagagagccgcag

SEQ ID NO: 7375493 - DNA, 22 bp, Homo sapiens
gtagatgagctcacatgacctt

SEQ ID NO: 7375494 - DNA, 22 bp, Homo sapiens
gtagatctcaacactggaagta

SEQ ID NO: 7375495 - DNA, 18 bp, Homo sapiens
gtagcaaaggagttactt

SEQ ID NO: 7375496 - DNA, 22 bp, Homo sapiens
gtagcaaagggacggctctaga

SEQ ID NO: 7375497 - DNA, 22 bp, Homo sapiens
tatgctttaacattaaacaaca

SEQ ID NO: 7375498 - DNA, 22 bp, Homo sapiens
tatgctaactgggggaaaagag

SEQ ID NO: 7375499 - DNA, 22 bp, Homo sapiens
tatgccagcacttagatgagat

SEQ ID NO: 7375500 - DNA, 21 bp, Homo sapiens
tatgttagtgatgtttgtagg

SEQ ID NO: 7375501 - DNA, 22 bp, Homo sapiens
tatgttaagtgggataatcaaa

SEQ ID NO: 7375502 - DNA, 22 bp, Homo sapiens
tatgtttaaatgtatgtgtatg

SEQ ID NO: 7375503 - DNA, 22 bp, Homo sapiens
tatgttgcaccaacctaataat

SEQ ID NO: 7375504 - DNA, 22 bp, Homo sapiens
tatgttctctgctctaggatgt

SEQ ID NO: 7375505 - DNA, 22 bp, Homo sapiens
tatgttctgactctacatggga

SEQ ID NO: 7375506 - DNA, 22 bp, Homo sapiens
tattcacagttgatttacagtt

SEQ ID NO: 7375507 - DNA, 22 bp, Homo sapiens
tattcacagttgatttacagtt

SEQ ID NO: 7375508 - DNA, 22 bp, Homo sapiens
tattcacattaataagtcttca

SEQ ID NO: 7375509 - DNA, 22 bp, Homo sapiens
tattcacatgtacatatgctca

SEQ ID NO: 7375510 - DNA, 22 bp, Homo sapiens
tattcacaaaatgaggtcctca

SEQ ID NO: 7375511 - DNA, 22 bp, Homo sapiens
tattcaaagtaccttcattgcc

SEQ ID NO: 7375512 - DNA, 22 bp, Homo sapiens
tattcaaagtgcgaggtcaggg

SEQ ID NO: 7375513 - DNA, 20 bp, Homo sapiens
tattcaactttaaaaactta

SEQ ID NO: 7375514 - DNA, 22 bp, Homo sapiens
tattcatagtaaacaaaagtgg

SEQ ID NO: 7375515 - DNA, 22 bp, Homo sapiens
tattcagaggtgaagtagggag

SEQ ID NO: 7375516 - DNA, 22 bp, Homo sapiens
tattcacattctcaggcctggt

SEQ ID NO: 7375517 - DNA, 22 bp, Homo sapiens
tattcatattgtaaaagaagtg

SEQ ID NO: 7375518 - DNA, 22 bp, Homo sapiens
tattgacatttttatagcttga

SEQ ID NO: 7375519 - DNA, 22 bp, Homo sapiens
tattgaccagactgacacacat

SEQ ID NO: 7375520 - DNA, 22 bp, Homo sapiens
tattgaggaaacagagcaggca

SEQ ID NO: 7375521 - DNA, 22 bp, Homo sapiens
tattgaggtgcttagctggggg

SEQ ID NO: 7375522 - DNA, 22 bp, Homo sapiens
tatttcaagaacttctatccat

SEQ ID NO: 7375523 - DNA, 22 bp, Homo sapiens
tattgtatcttaccacatgtat

SEQ ID NO: 7375524 - DNA, 22 bp, Homo sapiens
tatttcaacgtatgaaaagctg

SEQ ID NO: 7375525 - DNA, 22 bp, Homo sapiens
tatttcactcagtataccatag

SEQ ID NO: 7375526 - DNA, 22 bp, Homo sapiens
tatttcactattctctgtaact

SEQ ID NO: 7375527 - DNA, 22 bp, Homo sapiens
tatttcaggctatatttcttgt

SEQ ID NO: 7375528 - DNA, 22 bp, Homo sapiens
tatttcagggagaataaatttg

SEQ ID NO: 7375529 - DNA, 22 bp, Homo sapiens
tatttcagggagaataaatttg

SEQ ID NO: 7375530 - DNA, 22 bp, Homo sapiens
tatttcagcacatgggataggt

SEQ ID NO: 7375531 - DNA, 22 bp, Homo sapiens
tatttcagcaagaagaatgtgg

SEQ ID NO: 7375532 - DNA, 22 bp, Homo sapiens
tattgggtaaagatccagtttt

SEQ ID NO: 7375533 - DNA, 22 bp, Homo sapiens
tattggtgatgacttgaggcca

SEQ ID NO: 7375534 - DNA, 22 bp, Homo sapiens
tattggtatctgagacagagtt

SEQ ID NO: 7375535 - DNA, 22 bp, Homo sapiens
tatttgtgtgggtatctatata

SEQ ID NO: 7375536 - DNA, 22 bp, Homo sapiens
tatttgtatttcatgcagtaaa

SEQ ID NO: 7375537 - DNA, 22 bp, Homo sapiens
tatttgtcacctatggctgtcc

SEQ ID NO: 7375538 - DNA, 22 bp, Homo sapiens
tatttgtcactgcacttgaaat

SEQ ID NO: 7375539 - DNA, 22 bp, Homo sapiens
tatttgtctaagaggctgacag

SEQ ID NO: 7375540 - DNA, 22 bp, Homo sapiens
tatttgttgcgggaattgctat

SEQ ID NO: 7375541 - DNA, 22 bp, Homo sapiens
tattttcaccttctctggatat

SEQ ID NO: 7375542 - DNA, 22 bp, Homo sapiens
tatttgtatgtgtgtacatata

SEQ ID NO: 7375543 - DNA, 22 bp, Homo sapiens
tatttgtagaatggattaaggg

SEQ ID NO: 7375544 - DNA, 22 bp, Homo sapiens
tatttggttcttcttctgtgta

SEQ ID NO: 7375545 - DNA, 22 bp, Homo sapiens
tatttggatacaatcatttgct

SEQ ID NO: 7375546 - DNA, 22 bp, Homo sapiens
tatttggagtgatggaaatgtt

SEQ ID NO: 7375547 - DNA, 22 bp, Homo sapiens
tatattatcataaaaccattca

SEQ ID NO: 7375548 - DNA, 22 bp, Homo sapiens
tatattatcataaaaccattca

SEQ ID NO: 7375549 - DNA, 22 bp, Homo sapiens
tatattataagccctttcagaa

SEQ ID NO: 7375550 - DNA, 22 bp, Homo sapiens
tatattaaaccctctctgtagg

SEQ ID NO: 7375551 - DNA, 22 bp, Homo sapiens
tatattaaatgaccagttttaa

SEQ ID NO: 7375552 - DNA, 22 bp, Homo sapiens
tatagatagactgacgatacag

SEQ ID NO: 7375553 - DNA, 22 bp, Homo sapiens
tatatgcagtgtgtcattcaag

SEQ ID NO: 7375554 - DNA, 22 bp, Homo sapiens
tatatgctaatggtgccattcc

SEQ ID NO: 7375555 - DNA, 22 bp, Homo sapiens
tatactctgagaaacgtgtcac

SEQ ID NO: 7375556 - DNA, 22 bp, Homo sapiens
tatactgtcgcattacactcac

SEQ ID NO: 7375557 - DNA, 20 bp, Homo sapiens
tatactaacatatatctgtt

SEQ ID NO: 7375558 - DNA, 20 bp, Homo sapiens
tatactaacatatatctgtt

SEQ ID NO: 7375559 - DNA, 22 bp, Homo sapiens
tataccttccacaaaacagctt

SEQ ID NO: 7375560 - DNA, 22 bp, Homo sapiens
tataccttgagcagggcggccc

SEQ ID NO: 7375561 - DNA, 22 bp, Homo sapiens
tatacctttaccttgaccaaat

SEQ ID NO: 7375562 - DNA, 22 bp, Homo sapiens
tatactatgcttctgatccaat

SEQ ID NO: 7375563 - DNA, 22 bp, Homo sapiens
tatacatgttttacataagtga

SEQ ID NO: 7375564 - DNA, 22 bp, Homo sapiens
tagtgtttagtacatatgcata

SEQ ID NO: 7375565 - DNA, 22 bp, Homo sapiens
tagttaaagccctaaattgata

SEQ ID NO: 7375566 - DNA, 22 bp, Homo sapiens
tagttaatgctaattaacaaat

SEQ ID NO: 7375567 - DNA, 22 bp, Homo sapiens
tagttaattctttaagaacaag

SEQ ID NO: 7375568 - DNA, 18 bp, Homo sapiens
tatatttcacacatattc

SEQ ID NO: 7375569 - DNA, 22 bp, Homo sapiens
tatatttaattagttgctggat

SEQ ID NO: 7375570 - DNA, 20 bp, Homo sapiens
tatattttctctttggcctt

SEQ ID NO: 7375571 - DNA, 22 bp, Homo sapiens
tatcaaattgaggcagctgggg

SEQ ID NO: 7375572 - DNA, 22 bp, Homo sapiens
tatcaaaaggagttgaaagggg

SEQ ID NO: 7375573 - DNA, 22 bp, Homo sapiens
tatcaatacatgttatcagtgt

SEQ ID NO: 7375574 - DNA, 22 bp, Homo sapiens
tatcaatacatgttatcagtgt

SEQ ID NO: 7375575 - DNA, 22 bp, Homo sapiens
tatcaacattaatattttctgg

SEQ ID NO: 7375576 - DNA, 22 bp, Homo sapiens
tatctagatggattttagtgaa

SEQ ID NO: 7375577 - DNA, 22 bp, Homo sapiens
tatctataagtactaacatggt

SEQ ID NO: 7375578 - DNA, 21 bp, Homo sapiens
tatcttgggctctgtgcttga

SEQ ID NO: 7375579 - DNA, 22 bp, Homo sapiens
tatctttagaggaagagaatct

SEQ ID NO: 7375580 - DNA, 22 bp, Homo sapiens
tatctttattatgtctatctgc

SEQ ID NO: 7375581 - DNA, 22 bp, Homo sapiens
tatgcatagtgatttagaacag

SEQ ID NO: 7375582 - DNA, 22 bp, Homo sapiens
tatgatatgcactttatcagaa

SEQ ID NO: 7375583 - DNA, 22 bp, Homo sapiens
tatgcactggtactattcgtgt

SEQ ID NO: 7375584 - DNA, 22 bp, Homo sapiens
taggaaatactgtaagtttggg

SEQ ID NO: 7375585 - DNA, 22 bp, Homo sapiens
taggaaatatttgaacatagga

SEQ ID NO: 7375586 - DNA, 22 bp, Homo sapiens
taggaaatatttgaacatagga

SEQ ID NO: 7375587 - DNA, 19 bp, Homo sapiens
tagcccagagcctggctac

SEQ ID NO: 7375588 - DNA, 22 bp, Homo sapiens
tagcccagatgattgaaccatg

SEQ ID NO: 7375589 - DNA, 22 bp, Homo sapiens
taggaaggaagagcctcagatt

SEQ ID NO: 7375590 - DNA, 22 bp, Homo sapiens
taggaaatggctcagttactgc

SEQ ID NO: 7375591 - DNA, 22 bp, Homo sapiens
taggaagggctcagggctcggt

SEQ ID NO: 7375592 - DNA, 22 bp, Homo sapiens
taggctcacatagcactaagtg

SEQ ID NO: 7375593 - DNA, 19 bp, Homo sapiens
taggccctagctctgcagt

SEQ ID NO: 7375594 - DNA, 22 bp, Homo sapiens
tagtccaggtttccatctccac

SEQ ID NO: 7375595 - DNA, 22 bp, Homo sapiens
tagtccagtaaaacagctaacg

SEQ ID NO: 7375596 - DNA, 22 bp, Homo sapiens
tagtcacagtacaggataaaga

SEQ ID NO: 7375597 - DNA, 22 bp, Homo sapiens
tagtcatctgggtaatgttcaa

SEQ ID NO: 7375598 - DNA, 20 bp, Homo sapiens
tagtccaatacttagtccat

SEQ ID NO: 7375599 - DNA, 22 bp, Homo sapiens
tagtccagccttgggtgtagcc

SEQ ID NO: 7375600 - DNA, 22 bp, Homo sapiens
tagtatagattgaagcagatca

SEQ ID NO: 7375601 - DNA, 22 bp, Homo sapiens
tagtatatctttagtacatagt

SEQ ID NO: 7375602 - DNA, 22 bp, Homo sapiens
tagtatattttgttgcaattca

SEQ ID NO: 7375603 - DNA, 22 bp, Homo sapiens
tagtacagtttactttcagcgc

SEQ ID NO: 7375604 - DNA, 22 bp, Homo sapiens
tagtactacgttttctactatc

SEQ ID NO: 7375605 - DNA, 22 bp, Homo sapiens
taggttccatttaaacaaagaa

SEQ ID NO: 7375606 - DNA, 22 bp, Homo sapiens
taggttccatgagggaggcaaa

SEQ ID NO: 7375607 - DNA, 22 bp, Homo sapiens
tagcaagaggtgaaggtttcat

SEQ ID NO: 7375608 - DNA, 22 bp, Homo sapiens
tagcaaaaactgcagttacttt

SEQ ID NO: 7375609 - DNA, 22 bp, Homo sapiens
tagcaaaaactgcagttacttt

SEQ ID NO: 7375610 - DNA, 22 bp, Homo sapiens
tagcaaaagccacgattacttt

SEQ ID NO: 7375611 - DNA, 22 bp, Homo sapiens
tagcaagacaacttttctcagt

SEQ ID NO: 7375612 - DNA, 22 bp, Homo sapiens
tagatgttccacatatatatgt

SEQ ID NO: 7375613 - DNA, 20 bp, Homo sapiens
tagatgtttcctgtcataaa

SEQ ID NO: 7375614 - DNA, 22 bp, Homo sapiens
tagattttacttctgtcattac

SEQ ID NO: 7375615 - DNA, 22 bp, Homo sapiens
tagattaagatgccagttttga

SEQ ID NO: 7375616 - DNA, 22 bp, Homo sapiens
tagattttaggagattttactg

SEQ ID NO: 7375617 - DNA, 22 bp, Homo sapiens
tagattttgcatttctaacaag

SEQ ID NO: 7375618 - DNA, 22 bp, Homo sapiens
tagattttgcatttctaacaag

SEQ ID NO: 7375619 - DNA, 21 bp, Homo sapiens
tagcagaaacagttcaggcca

SEQ ID NO: 7375620 - DNA, 22 bp, Homo sapiens
tagcagtatattttaaggaagc

SEQ ID NO: 7375621 - DNA, 22 bp, Homo sapiens
tagcagtatggagcgaggccca

SEQ ID NO: 7375622 - DNA, 22 bp, Homo sapiens
tagcagaacaatagtcaatgat

SEQ ID NO: 7375623 - DNA, 22 bp, Homo sapiens
tagcagaaccagcagtcaattt

SEQ ID NO: 7375624 - DNA, 22 bp, Homo sapiens
tagcacctgtgcacaccaggca

SEQ ID NO: 7375625 - DNA, 22 bp, Homo sapiens
tagccaccagaaaggttttcag

SEQ ID NO: 7375626 - DNA, 22 bp, Homo sapiens
tagccatgtgtggaacacagcc

SEQ ID NO: 7375627 - DNA, 22 bp, Homo sapiens
tagccatgagcagatcactata

SEQ ID NO: 7375628 - DNA, 22 bp, Homo sapiens
tagccagggagacactgtggag

SEQ ID NO: 7375629 - DNA, 23 bp, Homo sapiens
tagccaggcccagcatggacacc

SEQ ID NO: 7375630 - DNA, 22 bp, Homo sapiens
tagccaggcaattatgggtgat

SEQ ID NO: 7375631 - DNA, 22 bp, Homo sapiens
tagccaggcaattatgggtgat

SEQ ID NO: 7375632 - DNA, 22 bp, Homo sapiens
tagaagttaaaggaatacagaa

SEQ ID NO: 7375633 - DNA, 22 bp, Homo sapiens
tagaagttgctcaataaatgtt

SEQ ID NO: 7375634 - DNA, 22 bp, Homo sapiens
tagaagttatgataataatagt

SEQ ID NO: 7375635 - DNA, 22 bp, Homo sapiens
tagaatcatacctctaggaaca

SEQ ID NO: 7375636 - DNA, 22 bp, Homo sapiens
tagaataagttgatgatatatg

SEQ ID NO: 7375637 - DNA, 22 bp, Homo sapiens
tactttctgtccttctgttaaa

SEQ ID NO: 7375638 - DNA, 22 bp, Homo sapiens
tactttctaagacatacaactt

SEQ ID NO: 7375639 - DNA, 22 bp, Homo sapiens
tactttcttgttcctttcataa

SEQ ID NO: 7375640 - DNA, 22 bp, Homo sapiens
tactttctttctgatccttatg

SEQ ID NO: 7375641 - DNA, 22 bp, Homo sapiens
tagagcaatgctctactccttg

SEQ ID NO: 7375642 - DNA, 22 bp, Homo sapiens
tagagatgtgatatagcagagt

SEQ ID NO: 7375643 - DNA, 22 bp, Homo sapiens
tagagatgccctagctgaagta

SEQ ID NO: 7375644 - DNA, 22 bp, Homo sapiens
tagaggagagttgctggatgga

SEQ ID NO: 7375645 - DNA, 22 bp, Homo sapiens
tagaggagggctgttcttcagt

SEQ ID NO: 7375646 - DNA, 22 bp, Homo sapiens
tagaggcaaccagtgttgagaa

SEQ ID NO: 7375647 - DNA, 22 bp, Homo sapiens
tagaggcaaccagtgttgagaa

SEQ ID NO: 7375648 - DNA, 22 bp, Homo sapiens
tagaggcacagtctatgtagag

SEQ ID NO: 7375649 - DNA, 22 bp, Homo sapiens
tagaggcacagtctatgtagag

SEQ ID NO: 7375650 - DNA, 22 bp, Homo sapiens
tagaggcaccctggaggagact

SEQ ID NO: 7375651 - DNA, 22 bp, Homo sapiens
tagaggcagaagaaattgacaa

SEQ ID NO: 7375652 - DNA, 22 bp, Homo sapiens
tagaggcaccctggaggagact

SEQ ID NO: 7375653 - DNA, 22 bp, Homo sapiens
tacactattttactgatacaaa

SEQ ID NO: 7375654 - DNA, 22 bp, Homo sapiens
tacaggaactgggcaggacatt

SEQ ID NO: 7375655 - DNA, 22 bp, Homo sapiens
tacaggaagcactcaagaaatg

SEQ ID NO: 7375656 - DNA, 22 bp, Homo sapiens
tacaggaagtaagtaatgaaat

SEQ ID NO: 7375657 - DNA, 22 bp, Homo sapiens
tacagtttttcactgaagatgt

SEQ ID NO: 7375658 - DNA, 22 bp, Homo sapiens
tacataattaatctttaagttc

SEQ ID NO: 7375659 - DNA, 22 bp, Homo sapiens
tacagttaagctactggagaat

SEQ ID NO: 7375660 - DNA, 22 bp, Homo sapiens
tacagttaccctggaaagaaat

SEQ ID NO: 7375661 - DNA, 22 bp, Homo sapiens
tacagttacgctgagaaacgaa

SEQ ID NO: 7375662 - DNA, 22 bp, Homo sapiens
tacatacagtggatgctttagg

SEQ ID NO: 7375663 - DNA, 22 bp, Homo sapiens
tacatacatattcatacaggtg

SEQ ID NO: 7375664 - DNA, 22 bp, Homo sapiens
tacattcacagttgttcatctc

SEQ ID NO: 7375665 - DNA, 22 bp, Homo sapiens
tacattcacttgttgaaggtgg

SEQ ID NO: 7375666 - DNA, 22 bp, Homo sapiens
tacattcagagaaagtttccat

SEQ ID NO: 7375667 - DNA, 22 bp, Homo sapiens
tacattcagcaaaagaatggtt

SEQ ID NO: 7375668 - DNA, 22 bp, Homo sapiens
tacattcagaattgggaggcaa

SEQ ID NO: 7375669 - DNA, 22 bp, Homo sapiens
tacattcagaagaatggacacg

SEQ ID NO: 7375670 - DNA, 22 bp, Homo sapiens
tacattcatggtgacttgtatg

SEQ ID NO: 7375671 - DNA, 22 bp, Homo sapiens
tacattcatatgtgtgcataca

SEQ ID NO: 7375672 - DNA, 22 bp, Homo sapiens
tacattcatggtgacttgtatg

SEQ ID NO: 7375673 - DNA, 15 bp, Homo sapiens
tacattcatttccac

SEQ ID NO: 7375674 - DNA, 23 bp, Homo sapiens
tacattcatttgcacagccagta

SEQ ID NO: 7375675 - DNA, 22 bp, Homo sapiens
tacattacaggaaagataaaga

SEQ ID NO: 7375676 - DNA, 22 bp, Homo sapiens
tacattcaacatgtcactatgt

SEQ ID NO: 7375677 - DNA, 22 bp, Homo sapiens
tacattcaacatgtcactatgt

SEQ ID NO: 7375678 - DNA, 20 bp, Homo sapiens
tacattcaaaacaaactctg

SEQ ID NO: 7375679 - DNA, 22 bp, Homo sapiens
tacattcaaacgatttattgat

SEQ ID NO: 7375680 - DNA, 22 bp, Homo sapiens
tactggagagccttgtccacat

SEQ ID NO: 7375681 - DNA, 22 bp, Homo sapiens
tactgagctggtccactgaggt

SEQ ID NO: 7375682 - DNA, 22 bp, Homo sapiens
tactgagtaccaagcattgtgt

SEQ ID NO: 7375683 - DNA, 22 bp, Homo sapiens
tactgagtggcaaaggcaagaa

SEQ ID NO: 7375684 - DNA, 22 bp, Homo sapiens
tactgcactccagcctgggtga

SEQ ID NO: 7375685 - DNA, 19 bp, Homo sapiens
tacttattagaaatatggg

SEQ ID NO: 7375686 - DNA, 19 bp, Homo sapiens
tacttattagaaatatggg

SEQ ID NO: 7375687 - DNA, 22 bp, Homo sapiens
tacttattgttgaactgaatca

SEQ ID NO: 7375688 - DNA, 22 bp, Homo sapiens
tacttcaaccttctctattaga

SEQ ID NO: 7375689 - DNA, 22 bp, Homo sapiens
tacctgttgtcacgataacact

SEQ ID NO: 7375690 - DNA, 22 bp, Homo sapiens
tacctgagaagaaacccgtgtt

SEQ ID NO: 7375691 - DNA, 22 bp, Homo sapiens
tacccagagggagagcaactat

SEQ ID NO: 7375692 - DNA, 22 bp, Homo sapiens
tacccagatatactttatgtta

SEQ ID NO: 7375693 - DNA, 22 bp, Homo sapiens
tactgaatggggcagtaagaaa

SEQ ID NO: 7375694 - DNA, 22 bp, Homo sapiens
tactgaagcaccattaaagaca

SEQ ID NO: 7375695 - DNA, 22 bp, Homo sapiens
tacgcctgtaatcccagcactt

SEQ ID NO: 7375696 - DNA, 22 bp, Homo sapiens
tacaatgtaattctgattatgt

SEQ ID NO: 7375697 - DNA, 22 bp, Homo sapiens
taatttttccacgtacactggg

SEQ ID NO: 7375698 - DNA, 18 bp, Homo sapiens
taatttgcacagttgcaa

SEQ ID NO: 7375699 - DNA, 22 bp, Homo sapiens
taatttgaatctcgctatttta

SEQ ID NO: 7375700 - DNA, 20 bp, Homo sapiens
taatttgatatctataagtt

SEQ ID NO: 7375701 - DNA, 22 bp, Homo sapiens
taattttaactgtgctgtttgg

SEQ ID NO: 7375702 - DNA, 22 bp, Homo sapiens
taattttaatagtatgtggcat

SEQ ID NO: 7375703 - DNA, 22 bp, Homo sapiens
taattttacttcctgagcacct

SEQ ID NO: 7375704 - DNA, 22 bp, Homo sapiens
taattttacttcctgagcacct

SEQ ID NO: 7375705 - DNA, 22 bp, Homo sapiens
taattttacttcctgagcacct

SEQ ID NO: 7375706 - DNA, 23 bp, Homo sapiens
taattttagccttacaggaccct

SEQ ID NO: 7375707 - DNA, 22 bp, Homo sapiens
taattttatgacagtgtatttt

SEQ ID NO: 7375708 - DNA, 22 bp, Homo sapiens
taattttatgacagtgtatttt

SEQ ID NO: 7375709 - DNA, 22 bp, Homo sapiens
taattttatgacagtgtatttt

SEQ ID NO: 7375710 - DNA, 22 bp, Homo sapiens
tacaccaggtgttatggtcaat

SEQ ID NO: 7375711 - DNA, 22 bp, Homo sapiens
tacaccattcccaggtggattt

SEQ ID NO: 7375712 - DNA, 22 bp, Homo sapiens
tacaccattcccaggtggattt

SEQ ID NO: 7375713 - DNA, 22 bp, Homo sapiens
tacacattacataatactatct

SEQ ID NO: 7375714 - DNA, 22 bp, Homo sapiens
tacacattacataatactatct

SEQ ID NO: 7375715 - DNA, 22 bp, Homo sapiens
tacacaaaggcactctgttgtt

SEQ ID NO: 7375716 - DNA, 21 bp, Homo sapiens
tacacaaagcgtggtccagag

SEQ ID NO: 7375717 - DNA, 22 bp, Homo sapiens
tacaattactcagctctgctgt

SEQ ID NO: 7375718 - DNA, 22 bp, Homo sapiens
tacaatgttcatagctttggca

SEQ ID NO: 7375719 - DNA, 22 bp, Homo sapiens
tacacatatgtgtgtatatgtg

SEQ ID NO: 7375720 - DNA, 22 bp, Homo sapiens
tacacatatgtgtgtatatgtg

SEQ ID NO: 7375721 - DNA, 22 bp, Homo sapiens
tacacatatgtccattaatcag

SEQ ID NO: 7375722 - DNA, 22 bp, Homo sapiens
taagcagcgtaaaagccaggga

SEQ ID NO: 7375723 - DNA, 22 bp, Homo sapiens
taagcaagtggtagaaggacaa

SEQ ID NO: 7375724 - DNA, 22 bp, Homo sapiens
taagcaatgagataatcatggg

SEQ ID NO: 7375725 - DNA, 22 bp, Homo sapiens
taagttacctgttttgtcatca

SEQ ID NO: 7375726 - DNA, 22 bp, Homo sapiens
taataaatgaaagtgctggcat

SEQ ID NO: 7375727 - DNA, 22 bp, Homo sapiens
taataaatgaaagtgctggcat

SEQ ID NO: 7375728 - DNA, 22 bp, Homo sapiens
taataacaattgtaggacatga

SEQ ID NO: 7375729 - DNA, 22 bp, Homo sapiens
taataaatgaaagtgctggcat

SEQ ID NO: 7375730 - DNA, 22 bp, Homo sapiens
taataaagatgtgggctttgaa

SEQ ID NO: 7375731 - DNA, 22 bp, Homo sapiens
taagtttccagattgtaagtcc

SEQ ID NO: 7375732 - DNA, 22 bp, Homo sapiens
taagtttctacttgtcgggtct

SEQ ID NO: 7375733 - DNA, 22 bp, Homo sapiens
taagtttctccaaagcacagaa

SEQ ID NO: 7375734 - DNA, 22 bp, Homo sapiens
taagtttccagattgtaagtcc

SEQ ID NO: 7375735 - DNA, 22 bp, Homo sapiens
taagtttaaatgtacatgaagc

SEQ ID NO: 7375736 - DNA, 22 bp, Homo sapiens
taatgccttatgtcaaatgtaa

SEQ ID NO: 7375737 - DNA, 22 bp, Homo sapiens
taatgcttttccttcaaataag

SEQ ID NO: 7375738 - DNA, 22 bp, Homo sapiens
taatgctttgttttgatctaac

SEQ ID NO: 7375739 - DNA, 22 bp, Homo sapiens
taatgctttgttttgatctaac

SEQ ID NO: 7375740 - DNA, 22 bp, Homo sapiens
taatgcttttccttcaaataag

SEQ ID NO: 7375741 - DNA, 22 bp, Homo sapiens
taatgcttcctatatagcactc

SEQ ID NO: 7375742 - DNA, 22 bp, Homo sapiens
taatgcttgcaaattatgggac

SEQ ID NO: 7375743 - DNA, 22 bp, Homo sapiens
taatgcttatgttatgcaattt

SEQ ID NO: 7375744 - DNA, 22 bp, Homo sapiens
taatgcttatgttatgcaattt

SEQ ID NO: 7375745 - DNA, 22 bp, Homo sapiens
taatgcttcaatttccttgatt

SEQ ID NO: 7375746 - DNA, 22 bp, Homo sapiens
taatgaggtgatgactaaggtc

SEQ ID NO: 7375747 - DNA, 22 bp, Homo sapiens
taatgaggggaaccatctgtag

SEQ ID NO: 7375748 - DNA, 22 bp, Homo sapiens
taatgaggcatttgagtcacct

SEQ ID NO: 7375749 - DNA, 22 bp, Homo sapiens
taatgaggaaggagactttcac

SEQ ID NO: 7375750 - DNA, 22 bp, Homo sapiens
taatgaggcaagagtcatggct

SEQ ID NO: 7375751 - DNA, 22 bp, Homo sapiens
taatgaggaaatagagggaatg

SEQ ID NO: 7375752 - DNA, 22 bp, Homo sapiens
taatgagatcatatcttctgag

SEQ ID NO: 7375753 - DNA, 22 bp, Homo sapiens
taatgagaagactttgaggctc

SEQ ID NO: 7375754 - DNA, 22 bp, Homo sapiens
gtttacaaatattttaaatggt

SEQ ID NO: 7375755 - DNA, 22 bp, Homo sapiens
gtttacaaatattttaaatggt

SEQ ID NO: 7375756 - DNA, 22 bp, Homo sapiens
gttcctggtggtcatggcagct

SEQ ID NO: 7375757 - DNA, 23 bp, Homo sapiens
gttccttcatgtggtcattggtt

SEQ ID NO: 7375758 - DNA, 22 bp, Homo sapiens
gttccttggaagaacttgaggt

SEQ ID NO: 7375759 - DNA, 22 bp, Homo sapiens
gttccttgggaacaacgctgaa

SEQ ID NO: 7375760 - DNA, 22 bp, Homo sapiens
gttccttgtatttcagacatga

SEQ ID NO: 7375761 - DNA, 22 bp, Homo sapiens
gttccttgtaatttgttaagga

SEQ ID NO: 7375762 - DNA, 22 bp, Homo sapiens
gttcctttgtttagcagagaca

SEQ ID NO: 7375763 - DNA, 22 bp, Homo sapiens
gttcctttcctatttggataag

SEQ ID NO: 7375764 - DNA, 23 bp, Homo sapiens
gtttctatgtcttgtgccttcat

SEQ ID NO: 7375765 - DNA, 22 bp, Homo sapiens
gtttctaattggaactttgagg

SEQ ID NO: 7375766 - DNA, 22 bp, Homo sapiens
gtttctaagggagagctgccag

SEQ ID NO: 7375767 - DNA, 22 bp, Homo sapiens
gtttcctttttctgccctcaat

SEQ ID NO: 7375768 - DNA, 22 bp, Homo sapiens
gtttctaaatgttctgagtttt

SEQ ID NO: 7375769 - DNA, 22 bp, Homo sapiens
gtttctaaatgttctgagtttt

SEQ ID NO: 7375770 - DNA, 22 bp, Homo sapiens
gtttctaagcacatgtgagtgt

SEQ ID NO: 7375771 - DNA, 22 bp, Homo sapiens
gtttctaagcacatgtgagtgt

SEQ ID NO: 7375772 - DNA, 22 bp, Homo sapiens
gtttcctttgccagtaaatggg

SEQ ID NO: 7375773 - DNA, 22 bp, Homo sapiens
gtttccttttggaattagagct

SEQ ID NO: 7375774 - DNA, 22 bp, Homo sapiens
gtttcttaagttacaaaatctt

SEQ ID NO: 7375775 - DNA, 22 bp, Homo sapiens
gttagacatgagtgtgcttaca

SEQ ID NO: 7375776 - DNA, 22 bp, Homo sapiens
gttagaaatgcagaaacttgac

SEQ ID NO: 7375777 - DNA, 22 bp, Homo sapiens
gttagaaagtgtctgcttgggt

SEQ ID NO: 7375778 - DNA, 22 bp, Homo sapiens
gttagaaacgcaggctctccgg

SEQ ID NO: 7375779 - DNA, 22 bp, Homo sapiens
gttagaaacacattcttattga

SEQ ID NO: 7375780 - DNA, 22 bp, Homo sapiens
gttacaaaggtcataaaagtgt

SEQ ID NO: 7375781 - DNA, 20 bp, Homo sapiens
gttaggacttaaataaagga

SEQ ID NO: 7375782 - DNA, 20 bp, Homo sapiens
gttaggaggttggacatgga

SEQ ID NO: 7375783 - DNA, 20 bp, Homo sapiens
gttaggaggttggacatgga

SEQ ID NO: 7375784 - DNA, 22 bp, Homo sapiens
gttagagggaaaaatcatttgc

SEQ ID NO: 7375785 - DNA, 22 bp, Homo sapiens
gttagagggctgccttttgttt

SEQ ID NO: 7375786 - DNA, 22 bp, Homo sapiens
gttataaaggtgataatggtca

SEQ ID NO: 7375787 - DNA, 22 bp, Homo sapiens
gttataaaatgcacagttgttt

SEQ ID NO: 7375788 - DNA, 22 bp, Homo sapiens
gttccaaagttagagtgtattg

SEQ ID NO: 7375789 - DNA, 22 bp, Homo sapiens
gttccaaatttggatctttagg

SEQ ID NO: 7375790 - DNA, 22 bp, Homo sapiens
gttccaaagtctctgagctgag

SEQ ID NO: 7375791 - DNA, 22 bp, Homo sapiens
taactgtattttaggtctcatt

SEQ ID NO: 7375792 - DNA, 22 bp, Homo sapiens
taactgtagtaattctagtttt

SEQ ID NO: 7375793 - DNA, 22 bp, Homo sapiens
taagaaactgtcacagtactat

SEQ ID NO: 7375794 - DNA, 22 bp, Homo sapiens
taagaaactaatgcaataagag

SEQ ID NO: 7375795 - DNA, 22 bp, Homo sapiens
taagatgaggtaggtaagactt

SEQ ID NO: 7375796 - DNA, 22 bp, Homo sapiens
taagataatccattataatgtt

SEQ ID NO: 7375797 - DNA, 22 bp, Homo sapiens
taagataatccattataatgtt

SEQ ID NO: 7375798 - DNA, 22 bp, Homo sapiens
taagataataagtatgtctatg

SEQ ID NO: 7375799 - DNA, 22 bp, Homo sapiens
taagataaggaacattctgtga

SEQ ID NO: 7375800 - DNA, 22 bp, Homo sapiens
taacacactgaaggtgagatgg

SEQ ID NO: 7375801 - DNA, 22 bp, Homo sapiens
taacaatttgcttcatttgttt

SEQ ID NO: 7375802 - DNA, 22 bp, Homo sapiens
taacaatttgcttcatttgttt

SEQ ID NO: 7375803 - DNA, 21 bp, Homo sapiens
taacaatctctacttctcatt

SEQ ID NO: 7375804 - DNA, 22 bp, Homo sapiens
taacaatagtgtttgctagtca

SEQ ID NO: 7375805 - DNA, 22 bp, Homo sapiens
taacaatttgcttcatttgttt

SEQ ID NO: 7375806 - DNA, 22 bp, Homo sapiens
taacaatagtgtttgctagtca

SEQ ID NO: 7375807 - DNA, 22 bp, Homo sapiens
taacaaactggaaattgacatt

SEQ ID NO: 7375808 - DNA, 22 bp, Homo sapiens
taaatacttagttttgtgtcta

SEQ ID NO: 7375809 - DNA, 22 bp, Homo sapiens
taaatacttagttttgtgtcta

SEQ ID NO: 7375810 - DNA, 22 bp, Homo sapiens
taaatacagtcatttgagccat

SEQ ID NO: 7375811 - DNA, 22 bp, Homo sapiens
taaatacagtcatttgagccat

SEQ ID NO: 7375812 - DNA, 22 bp, Homo sapiens
taacacatggttctgtcaggaa

SEQ ID NO: 7375813 - DNA, 22 bp, Homo sapiens
taacacatggttagtacacaat

SEQ ID NO: 7375814 - DNA, 22 bp, Homo sapiens
taaataagttcttcattgtttg

SEQ ID NO: 7375815 - DNA, 17 bp, Homo sapiens
taaatacacaagggtat

SEQ ID NO: 7375816 - DNA, 17 bp, Homo sapiens
taaatacacaagggtat

SEQ ID NO: 7375817 - DNA, 17 bp, Homo sapiens
taaatacacaagggtat

SEQ ID NO: 7375818 - DNA, 22 bp, Homo sapiens
taaataagttcttcattgtttg

SEQ ID NO: 7375819 - DNA, 22 bp, Homo sapiens
taaataagtcactgaccattta

SEQ ID NO: 7375820 - DNA, 22 bp, Homo sapiens
taaagttcagtgcatgaatgtg

SEQ ID NO: 7375821 - DNA, 22 bp, Homo sapiens
taaagtgtgtatatacatatgg

SEQ ID NO: 7375822 - DNA, 22 bp, Homo sapiens
taaagtgtttgtatgcagataa

SEQ ID NO: 7375823 - DNA, 22 bp, Homo sapiens
taaagtgttgtacaaatgtatg

SEQ ID NO: 7375824 - DNA, 21 bp, Homo sapiens
taaagaagatgaatgtgatca

SEQ ID NO: 7375825 - DNA, 22 bp, Homo sapiens
taaacatctgaatcctgcttcc

SEQ ID NO: 7375826 - DNA, 22 bp, Homo sapiens
taaacatcaggaatgaaaacct

SEQ ID NO: 7375827 - DNA, 22 bp, Homo sapiens
taaacatcagtacaaagactaa

SEQ ID NO: 7375828 - DNA, 22 bp, Homo sapiens
taaacatctgtagccttcagtc

SEQ ID NO: 7375829 - DNA, 16 bp, Homo sapiens
taaacagcagacagtt

SEQ ID NO: 7375830 - DNA, 23 bp, Homo sapiens
gttttcaacacaataaatgtaac

SEQ ID NO: 7375831 - DNA, 22 bp, Homo sapiens
gttttataattgcttcataaga

SEQ ID NO: 7375832 - DNA, 22 bp, Homo sapiens
gttttataggctgttgctatat

SEQ ID NO: 7375833 - DNA, 22 bp, Homo sapiens
gttttataggtgaaatattact

SEQ ID NO: 7375834 - DNA, 22 bp, Homo sapiens
gttttataggtgaaatattact

SEQ ID NO: 7375835 - DNA, 22 bp, Homo sapiens
gttttatatgtctctgctgaca

SEQ ID NO: 7375836 - DNA, 22 bp, Homo sapiens
gttttatagttcgggacctgtt

SEQ ID NO: 7375837 - DNA, 22 bp, Homo sapiens
gttttattggaacacagccatg

SEQ ID NO: 7375838 - DNA, 22 bp, Homo sapiens
gttttatttccatgagagaccg

SEQ ID NO: 7375839 - DNA, 22 bp, Homo sapiens
tcatgttttagtaaagtgaagg

SEQ ID NO: 7375840 - DNA, 22 bp, Homo sapiens
tcatgtttttgccatatgactc

SEQ ID NO: 7375841 - DNA, 18 bp, Homo sapiens
tcatggctttagtccctc

SEQ ID NO: 7375842 - DNA, 22 bp, Homo sapiens
tccacacacatttctatgtgca

SEQ ID NO: 7375843 - DNA, 22 bp, Homo sapiens
tccacaggctgaggcccttctg

SEQ ID NO: 7375844 - DNA, 22 bp, Homo sapiens
tccacaggcaagtctcttggca

SEQ ID NO: 7375845 - DNA, 22 bp, Homo sapiens
tccacagggatgcctgcggctt

SEQ ID NO: 7375846 - DNA, 22 bp, Homo sapiens
tccacagggatgttgagttctt

SEQ ID NO: 7375847 - DNA, 22 bp, Homo sapiens
tccacaggaaagcacctcccat

SEQ ID NO: 7375848 - DNA, 21 bp, Homo sapiens
tccaccctctctgctcccagt

SEQ ID NO: 7375849 - DNA, 22 bp, Homo sapiens
tccacgctgtgtgaccttgggc

SEQ ID NO: 7375850 - DNA, 22 bp, Homo sapiens
tccactgctcattccacaggca

SEQ ID NO: 7375851 - DNA, 22 bp, Homo sapiens
tccactgcagcttctgatggaa

SEQ ID NO: 7375852 - DNA, 22 bp, Homo sapiens
tccactgtggtcccttgctgcc

SEQ ID NO: 7375853 - DNA, 22 bp, Homo sapiens
tccaccatgtaacaagctctgt

SEQ ID NO: 7375854 - DNA, 22 bp, Homo sapiens
tccacagggattcacccaaaag

SEQ ID NO: 7375855 - DNA, 22 bp, Homo sapiens
tccacagggattcacccaaaag

SEQ ID NO: 7375856 - DNA, 22 bp, Homo sapiens
tccacagggcctttctggtgtg

SEQ ID NO: 7375857 - DNA, 22 bp, Homo sapiens
tccagaaactgctgagataaga

SEQ ID NO: 7375858 - DNA, 22 bp, Homo sapiens
tccagaaaattttacagtgcct

SEQ ID NO: 7375859 - DNA, 21 bp, Homo sapiens
tccagcctttccctcacttcc

SEQ ID NO: 7375860 - DNA, 19 bp, Homo sapiens
tccagcctgctgtttctct

SEQ ID NO: 7375861 - DNA, 23 bp, Homo sapiens
tccaggagcatgctggctggcga

SEQ ID NO: 7375862 - DNA, 22 bp, Homo sapiens
tcccagctgtgtggaggagatg

SEQ ID NO: 7375863 - DNA, 22 bp, Homo sapiens
tcccagcctttcttttctgctg

SEQ ID NO: 7375864 - DNA, 22 bp, Homo sapiens
tccagttagtgggcaaaattta

SEQ ID NO: 7375865 - DNA, 22 bp, Homo sapiens
tcccacagtggtacagccctga

SEQ ID NO: 7375866 - DNA, 22 bp, Homo sapiens
tcccactggacgtctgtgctgg

SEQ ID NO: 7375867 - DNA, 22 bp, Homo sapiens
tcccactgtctgtcttgctgca

SEQ ID NO: 7375868 - DNA, 22 bp, Homo sapiens
tcccactgctttgctctgctca

SEQ ID NO: 7375869 - DNA, 22 bp, Homo sapiens
tcccactgtcttctcgtgctcg

SEQ ID NO: 7375870 - DNA, 22 bp, Homo sapiens
tcccagaaacgcatatgttcat

SEQ ID NO: 7375871 - DNA, 22 bp, Homo sapiens
tcccagaagtgaaatttctaga

SEQ ID NO: 7375872 - DNA, 22 bp, Homo sapiens
tcccagaatctccagtgctaca

SEQ ID NO: 7375873 - DNA, 22 bp, Homo sapiens
tcccagagtcagaggtggggcc

SEQ ID NO: 7375874 - DNA, 22 bp, Homo sapiens
tcccagagttcaatgggaaggt

SEQ ID NO: 7375875 - DNA, 22 bp, Homo sapiens
tcccagagtgagccaggggcag

SEQ ID NO: 7375876 - DNA, 21 bp, Homo sapiens
tcccagagtgcttgggactgc

SEQ ID NO: 7375877 - DNA, 22 bp, Homo sapiens
tccagggagcaagtcaggccgg

SEQ ID NO: 7375878 - DNA, 22 bp, Homo sapiens
tccagggagtcaaatgaactac

SEQ ID NO: 7375879 - DNA, 22 bp, Homo sapiens
tccagggatctttagagtcttt

SEQ ID NO: 7375880 - DNA, 22 bp, Homo sapiens
tccagggatgccagccatgttg

SEQ ID NO: 7375881 - DNA, 22 bp, Homo sapiens
tccagggatgtcctgtagcact

SEQ ID NO: 7375882 - DNA, 22 bp, Homo sapiens
tccagtgcattcagacacttgg

SEQ ID NO: 7375883 - DNA, 22 bp, Homo sapiens
tccagtcttcttgcagctacat

SEQ ID NO: 7375884 - DNA, 22 bp, Homo sapiens
tccagtctggagccttctggtt

SEQ ID NO: 7375885 - DNA, 22 bp, Homo sapiens
tccagtgctgtttccaatgtaa

SEQ ID NO: 7375886 - DNA, 22 bp, Homo sapiens
tccagtggtagtaaagaggtct

SEQ ID NO: 7375887 - DNA, 20 bp, Homo sapiens
tccaggcccactcagctgaa

SEQ ID NO: 7375888 - DNA, 22 bp, Homo sapiens
tccaggccattgactgcatcct

SEQ ID NO: 7375889 - DNA, 22 bp, Homo sapiens
tccaggccattgactgcatcct

SEQ ID NO: 7375890 - DNA, 22 bp, Homo sapiens
tccagggacctccctgagagct

SEQ ID NO: 7375891 - DNA, 22 bp, Homo sapiens
tccagggagagccgctgctcca

SEQ ID NO: 7375892 - DNA, 22 bp, Homo sapiens
tccagggacagtatagaggatc

SEQ ID NO: 7375893 - DNA, 22 bp, Homo sapiens
tccagggagatggcagaggctg

SEQ ID NO: 7375894 - DNA, 22 bp, Homo sapiens
tccagggagatactggctgcca

SEQ ID NO: 7375895 - DNA, 23 bp, Homo sapiens
tccctgtgtacagcctgcatgag

SEQ ID NO: 7375896 - DNA, 23 bp, Homo sapiens
tccctgtgtacagcctgcatgag

SEQ ID NO: 7375897 - DNA, 18 bp, Homo sapiens
tcccttctcccttgcctc

SEQ ID NO: 7375898 - DNA, 18 bp, Homo sapiens
tcccttctcccttgcctc

SEQ ID NO: 7375899 - DNA, 22 bp, Homo sapiens
tccctgggcggacattctccca

SEQ ID NO: 7375900 - DNA, 22 bp, Homo sapiens
tccctgggcttctccagacttg

SEQ ID NO: 7375901 - DNA, 22 bp, Homo sapiens
tccctgtccaaagtcttcctat

SEQ ID NO: 7375902 - DNA, 20 bp, Homo sapiens
tccctggggccctacttcct

SEQ ID NO: 7375903 - DNA, 22 bp, Homo sapiens
tccctgtaaggttctgagattt

SEQ ID NO: 7375904 - DNA, 22 bp, Homo sapiens
tcccaggcaaaggcagctcatt

SEQ ID NO: 7375905 - DNA, 22 bp, Homo sapiens
tccctgatgccttgatccgtgg

SEQ ID NO: 7375906 - DNA, 22 bp, Homo sapiens
tccctgatgtgggctgcgtgac

SEQ ID NO: 7375907 - DNA, 22 bp, Homo sapiens
tccctgcacccttgctgggccc

SEQ ID NO: 7375908 - DNA, 22 bp, Homo sapiens
tccctgcagtagtggctaagat

SEQ ID NO: 7375909 - DNA, 22 bp, Homo sapiens
tccctgcagtaggcagccctcc

SEQ ID NO: 7375910 - DNA, 22 bp, Homo sapiens
tccctgcaggtgtgcaagctga

SEQ ID NO: 7375911 - DNA, 22 bp, Homo sapiens
tcctccctaaatcctagactgt

SEQ ID NO: 7375912 - DNA, 23 bp, Homo sapiens
tcctccctgacttctacagcaca

SEQ ID NO: 7375913 - DNA, 22 bp, Homo sapiens
tcctccctgtaccattcctctg

SEQ ID NO: 7375914 - DNA, 22 bp, Homo sapiens
tcctccctgggagcttctgagt

SEQ ID NO: 7375915 - DNA, 23 bp, Homo sapiens
tcctcccaaatttcagcctcatt

SEQ ID NO: 7375916 - DNA, 22 bp, Homo sapiens
tcctccgggcacgtcagtccct

SEQ ID NO: 7375917 - DNA, 22 bp, Homo sapiens
tcctcctcacgctgttgcttgt

SEQ ID NO: 7375918 - DNA, 21 bp, Homo sapiens
tcctcctccactaggctagcc

SEQ ID NO: 7375919 - DNA, 22 bp, Homo sapiens
tcctcccttgactcctgctttt

SEQ ID NO: 7375920 - DNA, 19 bp, Homo sapiens
tcctccctttggtgtcctg

SEQ ID NO: 7375921 - DNA, 22 bp, Homo sapiens
tcctcctctatcagacagtgcc

SEQ ID NO: 7375922 - DNA, 22 bp, Homo sapiens
tcctcctcctcacagtcacctg

SEQ ID NO: 7375923 - DNA, 22 bp, Homo sapiens
tcctcagtcgtttgagccaaaa

SEQ ID NO: 7375924 - DNA, 22 bp, Homo sapiens
tcctcagtgctagccaactgcc

SEQ ID NO: 7375925 - DNA, 22 bp, Homo sapiens
tccgaggccaaagctgtgaata

SEQ ID NO: 7375926 - DNA, 22 bp, Homo sapiens
tccgggaggcagaggttgcagt

SEQ ID NO: 7375927 - DNA, 22 bp, Homo sapiens
tcacagcagtaaagaaaacact

SEQ ID NO: 7375928 - DNA, 19 bp, Homo sapiens
tcacagcatctgtctgaac

SEQ ID NO: 7375929 - DNA, 19 bp, Homo sapiens
tcacagcatctgtctgaac

SEQ ID NO: 7375930 - DNA, 22 bp, Homo sapiens
tcacagcagggtaacaggaaga

SEQ ID NO: 7375931 - DNA, 22 bp, Homo sapiens
tcacagcagggtaacaggaaga

SEQ ID NO: 7375932 - DNA, 22 bp, Homo sapiens
tcacagcatttttagaaagatt

SEQ ID NO: 7375933 - DNA, 22 bp, Homo sapiens
tcacagcattgtcacaaggctg

SEQ ID NO: 7375934 - DNA, 22 bp, Homo sapiens
tcacagcattgagtgtactaga

SEQ ID NO: 7375935 - DNA, 22 bp, Homo sapiens
tcacagcattgagtgtactaga

SEQ ID NO: 7375936 - DNA, 22 bp, Homo sapiens
tcacagcattcgcaatggacag

SEQ ID NO: 7375937 - DNA, 22 bp, Homo sapiens
tcacagcacatggaccgagtcc

SEQ ID NO: 7375938 - DNA, 22 bp, Homo sapiens
tcacagcaccaggatctctcca

SEQ ID NO: 7375939 - DNA, 22 bp, Homo sapiens
tcacagcaccaggatctctcca

SEQ ID NO: 7375940 - DNA, 22 bp, Homo sapiens
tcacagcaaccctgaggcgagt

SEQ ID NO: 7375941 - DNA, 22 bp, Homo sapiens
tcacagcaacactggggcagac

SEQ ID NO: 7375942 - DNA, 22 bp, Homo sapiens
tcacagcagaatttaggaggca

SEQ ID NO: 7375943 - DNA, 22 bp, Homo sapiens
tcacagcaggcagatattgttg

SEQ ID NO: 7375944 - DNA, 22 bp, Homo sapiens
tcacagcaggcagatattgttg

SEQ ID NO: 7375945 - DNA, 22 bp, Homo sapiens
tcacagcaccctgaggtgctgg

SEQ ID NO: 7375946 - DNA, 22 bp, Homo sapiens
tcacagctattctcatgtattt

SEQ ID NO: 7375947 - DNA, 22 bp, Homo sapiens
tcacatctgaaaaaatattgag

SEQ ID NO: 7375948 - DNA, 23 bp, Homo sapiens
tcacatctgccgtagtgtattct

SEQ ID NO: 7375949 - DNA, 20 bp, Homo sapiens
tcacatcctctcccaacatg

SEQ ID NO: 7375950 - DNA, 22 bp, Homo sapiens
tcacatctatacccaataattt

SEQ ID NO: 7375951 - DNA, 22 bp, Homo sapiens
tcacatctaattccatttctgc

SEQ ID NO: 7375952 - DNA, 22 bp, Homo sapiens
tcacacagtgagcggggctcag

SEQ ID NO: 7375953 - DNA, 22 bp, Homo sapiens
tcacacagtgagaaagtgcgga

SEQ ID NO: 7375954 - DNA, 22 bp, Homo sapiens
tcacacagggttctggtctcat

SEQ ID NO: 7375955 - DNA, 22 bp, Homo sapiens
tcacagaatgtctagcataatt

SEQ ID NO: 7375956 - DNA, 22 bp, Homo sapiens
tcacagcaaaagtgtgcagagc

SEQ ID NO: 7375957 - DNA, 22 bp, Homo sapiens
tcacagcaaatgctgcttctca

SEQ ID NO: 7375958 - DNA, 22 bp, Homo sapiens
tcacagcaaatgctgcttctca

SEQ ID NO: 7375959 - DNA, 22 bp, Homo sapiens
tcacagacactgggttattgca

SEQ ID NO: 7375960 - DNA, 22 bp, Homo sapiens
tcaatacatacaatgtatagtg

SEQ ID NO: 7375961 - DNA, 22 bp, Homo sapiens
tcaaacatatctgattttccat

SEQ ID NO: 7375962 - DNA, 22 bp, Homo sapiens
tcaaacataggcacacattcag

SEQ ID NO: 7375963 - DNA, 22 bp, Homo sapiens
tcaaacataggcacacattcag

SEQ ID NO: 7375964 - DNA, 22 bp, Homo sapiens
tcaaacataaaactaaatcgag

SEQ ID NO: 7375965 - DNA, 23 bp, Homo sapiens
tcaaacatattgtgagacacagg

SEQ ID NO: 7375966 - DNA, 23 bp, Homo sapiens
tcaaacatattgtgagacacagg

SEQ ID NO: 7375967 - DNA, 23 bp, Homo sapiens
tcaaacatattgtgagacacagg

SEQ ID NO: 7375968 - DNA, 22 bp, Homo sapiens
tcaaaagtttcacatagagata

SEQ ID NO: 7375969 - DNA, 22 bp, Homo sapiens
tcaaaagtttcacatagagata

SEQ ID NO: 7375970 - DNA, 20 bp, Homo sapiens
tcaaaataggtgtgggcgga

SEQ ID NO: 7375971 - DNA, 22 bp, Homo sapiens
tcaaaagtctgcattcttcaca

SEQ ID NO: 7375972 - DNA, 22 bp, Homo sapiens
tcaaaagacacaggaggctagt

SEQ ID NO: 7375973 - DNA, 22 bp, Homo sapiens
tcaaaaatggtctttgagctgc

SEQ ID NO: 7375974 - DNA, 22 bp, Homo sapiens
tcaaaatttcagcactagccct

SEQ ID NO: 7375975 - DNA, 22 bp, Homo sapiens
tcaaaattttatttctcaagga

SEQ ID NO: 7375976 - DNA, 18 bp, Homo sapiens
tcaaaatatttctgtgga

SEQ ID NO: 7375977 - DNA, 22 bp, Homo sapiens
tcaaaattagtgaccaaaggca

SEQ ID NO: 7375978 - DNA, 22 bp, Homo sapiens
tcaaaattaaaccaacgtccag

SEQ ID NO: 7375979 - DNA, 22 bp, Homo sapiens
tcacacagcagccccgggtgtt

SEQ ID NO: 7375980 - DNA, 23 bp, Homo sapiens
tcacacagctggtcaggtacaga

SEQ ID NO: 7375981 - DNA, 22 bp, Homo sapiens
tcacaattgtttttaggatcaa

SEQ ID NO: 7375982 - DNA, 22 bp, Homo sapiens
tcacacacatggatagtatttt

SEQ ID NO: 7375983 - DNA, 22 bp, Homo sapiens
tcacacacatttgctgtctgat

SEQ ID NO: 7375984 - DNA, 21 bp, Homo sapiens
tcacacacgtttccaagggca

SEQ ID NO: 7375985 - DNA, 23 bp, Homo sapiens
tcaattatcaatggaaagaagtt

SEQ ID NO: 7375986 - DNA, 22 bp, Homo sapiens
tcaatgctgccaaatcttctag

SEQ ID NO: 7375987 - DNA, 22 bp, Homo sapiens
tcaattcacagctctgctattt

SEQ ID NO: 7375988 - DNA, 22 bp, Homo sapiens
tcaattatttgatatgaaaggg

SEQ ID NO: 7375989 - DNA, 22 bp, Homo sapiens
tcaattcaacacatgcacattg

SEQ ID NO: 7375990 - DNA, 22 bp, Homo sapiens
tcaattctagagccttacattg

SEQ ID NO: 7375991 - DNA, 22 bp, Homo sapiens
tcaattctgcctctaaatattt

SEQ ID NO: 7375992 - DNA, 22 bp, Homo sapiens
tcaattctgcatacatttcact

SEQ ID NO: 7375993 - DNA, 22 bp, Homo sapiens
tcaattctagtggagagagttt

SEQ ID NO: 7375994 - DNA, 22 bp, Homo sapiens
tcaattctgcatacatttcact

SEQ ID NO: 7375995 - DNA, 18 bp, Homo sapiens
tcagaggagatacctaaa

SEQ ID NO: 7375996 - DNA, 22 bp, Homo sapiens
tcagaggctgcatttttatcca

SEQ ID NO: 7375997 - DNA, 20 bp, Homo sapiens
tcagaggctgccagctgggg

SEQ ID NO: 7375998 - DNA, 22 bp, Homo sapiens
tcagaggctcatctgccttgca

SEQ ID NO: 7375999 - DNA, 22 bp, Homo sapiens
tcagaggctcactgtctacttt

SEQ ID NO: 7376000 - DNA, 22 bp, Homo sapiens
tcagaggccttggttatggtat

SEQ ID NO: 7376001 - DNA, 22 bp, Homo sapiens
tcagaggctacagtctgggagt

SEQ ID NO: 7376002 - DNA, 22 bp, Homo sapiens
tcagaggcctatgtctacaact

SEQ ID NO: 7376003 - DNA, 22 bp, Homo sapiens
tcagaggcctgaaagaatttgg

SEQ ID NO: 7376004 - DNA, 22 bp, Homo sapiens
tcagaggcagctgatgttctgt

SEQ ID NO: 7376005 - DNA, 22 bp, Homo sapiens
tcagaggcaaagaactttatta

SEQ ID NO: 7376006 - DNA, 21 bp, Homo sapiens
tcagaggcactgagagcaatg

SEQ ID NO: 7376007 - DNA, 22 bp, Homo sapiens
tcagaggccaaactgagcaggg

SEQ ID NO: 7376008 - DNA, 22 bp, Homo sapiens
tcagaggcatcattcatagtta

SEQ ID NO: 7376009 - DNA, 22 bp, Homo sapiens
tcagaggaatctgtacttgaaa

SEQ ID NO: 7376010 - DNA, 22 bp, Homo sapiens
tcagaggacagcagctaaataa

SEQ ID NO: 7376011 - DNA, 22 bp, Homo sapiens
tcagaacttaaagccgattggg

SEQ ID NO: 7376012 - DNA, 22 bp, Homo sapiens
tcagaactggaagaggttctgc

SEQ ID NO: 7376013 - DNA, 19 bp, Homo sapiens
tcagaactcagaatgtgta

SEQ ID NO: 7376014 - DNA, 22 bp, Homo sapiens
tcagaactacatggacatgtta

SEQ ID NO: 7376015 - DNA, 22 bp, Homo sapiens
tcagaacatgtttgagtaagac

SEQ ID NO: 7376016 - DNA, 22 bp, Homo sapiens
tcagaacatggcatgttccatc

SEQ ID NO: 7376017 - DNA, 22 bp, Homo sapiens
tcaccggtgaccctcggctcgc

SEQ ID NO: 7376018 - DNA, 22 bp, Homo sapiens
tcacatgcacatacttcctgtg

SEQ ID NO: 7376019 - DNA, 22 bp, Homo sapiens
tcacatgccttttactctgcac

SEQ ID NO: 7376020 - DNA, 22 bp, Homo sapiens
tcacatcttgtgatgttttcat

SEQ ID NO: 7376021 - DNA, 22 bp, Homo sapiens
tcacatctttaggcttacaggt

SEQ ID NO: 7376022 - DNA, 20 bp, Homo sapiens
tcacatctggcagctgatga

SEQ ID NO: 7376023 - DNA, 22 bp, Homo sapiens
tcacatctgttgatacagcatc

SEQ ID NO: 7376024 - DNA, 22 bp, Homo sapiens
tcacatctgtgtgattgtcatt

SEQ ID NO: 7376025 - DNA, 22 bp, Homo sapiens
tcacatcttggattacaatttt

SEQ ID NO: 7376026 - DNA, 22 bp, Homo sapiens
tcactgggtaggacatgctgat

SEQ ID NO: 7376027 - DNA, 22 bp, Homo sapiens
tcactggtctttggcttctcag

SEQ ID NO: 7376028 - DNA, 22 bp, Homo sapiens
tcactgtgaatgttatcatctt

SEQ ID NO: 7376029 - DNA, 22 bp, Homo sapiens
tcagaacatcccagatagtaga

SEQ ID NO: 7376030 - DNA, 22 bp, Homo sapiens
tcacgttttactgagtgagata

SEQ ID NO: 7376031 - DNA, 22 bp, Homo sapiens
tcactacaacctccgcctcctg

SEQ ID NO: 7376032 - DNA, 22 bp, Homo sapiens
tcactgggccctgaggtgggac

SEQ ID NO: 7376033 - DNA, 22 bp, Homo sapiens
tcactgggccctgaggtgggac

SEQ ID NO: 7376034 - DNA, 22 bp, Homo sapiens
tcactgggagatgtgggaaggg

SEQ ID NO: 7376035 - DNA, 22 bp, Homo sapiens
tcactggggccatgtgagggac

SEQ ID NO: 7376036 - DNA, 22 bp, Homo sapiens
tcagaggctttcaatgtgtttt

SEQ ID NO: 7376037 - DNA, 22 bp, Homo sapiens
tcagaggcttctggccagtctg

SEQ ID NO: 7376038 - DNA, 22 bp, Homo sapiens
tcagaggcttgaagcccaagcc

SEQ ID NO: 7376039 - DNA, 22 bp, Homo sapiens
tcagaggcttccttcctcggag

SEQ ID NO: 7376040 - DNA, 22 bp, Homo sapiens
tcagaggcttctgctcacctca

SEQ ID NO: 7376041 - DNA, 22 bp, Homo sapiens
tcagaggctggaagagcctcct

SEQ ID NO: 7376042 - DNA, 21 bp, Homo sapiens
tcagaggctgggggaatgccc

SEQ ID NO: 7376043 - DNA, 22 bp, Homo sapiens
tcagagtctgtgcattctgcta

SEQ ID NO: 7376044 - DNA, 22 bp, Homo sapiens
tcagcctcattttctgctctgt

SEQ ID NO: 7376045 - DNA, 22 bp, Homo sapiens
tcagcctccgaaagtgctggga

SEQ ID NO: 7376046 - DNA, 22 bp, Homo sapiens
tcagccagtttgattctatttg

SEQ ID NO: 7376047 - DNA, 22 bp, Homo sapiens
tcagcttcagatcagctagaga

SEQ ID NO: 7376048 - DNA, 22 bp, Homo sapiens
tcagctgtgtatcccagggcct

SEQ ID NO: 7376049 - DNA, 22 bp, Homo sapiens
tcagctgtccgcagcccacttc

SEQ ID NO: 7376050 - DNA, 22 bp, Homo sapiens
tcagctgtatcttgctgcactt

SEQ ID NO: 7376051 - DNA, 22 bp, Homo sapiens
tcagctgtatcagaaatacaat

SEQ ID NO: 7376052 - DNA, 22 bp, Homo sapiens
tcaggaggagctcataagtttg

SEQ ID NO: 7376053 - DNA, 22 bp, Homo sapiens
tcaggaggacagataaggatag

SEQ ID NO: 7376054 - DNA, 22 bp, Homo sapiens
tcaggaggcaagtaggtattga

SEQ ID NO: 7376055 - DNA, 22 bp, Homo sapiens
tcaggaggatgtcggcaaattt

SEQ ID NO: 7376056 - DNA, 22 bp, Homo sapiens
tcaggagggtgacaggccctgg

SEQ ID NO: 7376057 - DNA, 22 bp, Homo sapiens
tcaggagggtctctattttcct

SEQ ID NO: 7376058 - DNA, 22 bp, Homo sapiens
tcaggagggctaagactgtagc

SEQ ID NO: 7376059 - DNA, 22 bp, Homo sapiens
tcaggagggattgttgcctatt

SEQ ID NO: 7376060 - DNA, 22 bp, Homo sapiens
tcaggagctgtgaatacaaagg

SEQ ID NO: 7376061 - DNA, 22 bp, Homo sapiens
tcaggaaaggcagagtgtctgt

SEQ ID NO: 7376062 - DNA, 22 bp, Homo sapiens
tcaggaaagagtaatgtataca

SEQ ID NO: 7376063 - DNA, 22 bp, Homo sapiens
tcaggcaggtggctggctatgg

SEQ ID NO: 7376064 - DNA, 22 bp, Homo sapiens
tcaggcaggctcagaggaaaac

SEQ ID NO: 7376065 - DNA, 22 bp, Homo sapiens
tcaggcaggctcagaggaaaac

SEQ ID NO: 7376066 - DNA, 22 bp, Homo sapiens
tcaggcctttcttcagagcttc

SEQ ID NO: 7376067 - DNA, 22 bp, Homo sapiens
tcaggcaggaagggaggacttg

SEQ ID NO: 7376068 - DNA, 22 bp, Homo sapiens
tcaggcaggaagggaggacttg

SEQ ID NO: 7376069 - DNA, 21 bp, Homo sapiens
tcaggcaggcgcagagggaag

SEQ ID NO: 7376070 - DNA, 22 bp, Homo sapiens
tcaggcaggcagagggcaaatg

SEQ ID NO: 7376071 - DNA, 22 bp, Homo sapiens
tcaggcactggctgagtgatgg

SEQ ID NO: 7376072 - DNA, 22 bp, Homo sapiens
tcaggcagatgcagggatggat

SEQ ID NO: 7376073 - DNA, 22 bp, Homo sapiens
tcaggcaggaagcccctgcaca

SEQ ID NO: 7376074 - DNA, 22 bp, Homo sapiens
tcaggcagctccaggaatggta

SEQ ID NO: 7376075 - DNA, 22 bp, Homo sapiens
tcaggaggtaaggtaaaacaga

SEQ ID NO: 7376076 - DNA, 22 bp, Homo sapiens
tcaggaggtccgcccgggaggg

SEQ ID NO: 7376077 - DNA, 22 bp, Homo sapiens
tcaggaggtaggacatactggt

SEQ ID NO: 7376078 - DNA, 19 bp, Homo sapiens
tcaggaggtcgacctggca

SEQ ID NO: 7376079 - DNA, 22 bp, Homo sapiens
tcaggaggtgtaacgaatacag

SEQ ID NO: 7376080 - DNA, 22 bp, Homo sapiens
tcaggaggtctgctgcggggtg

SEQ ID NO: 7376081 - DNA, 22 bp, Homo sapiens
tcaggcaccccttgagtagggg

SEQ ID NO: 7376082 - DNA, 22 bp, Homo sapiens
tcaggcaccctctattttcatc

SEQ ID NO: 7376083 - DNA, 22 bp, Homo sapiens
tcaggctgaaaggactccagtt

SEQ ID NO: 7376084 - DNA, 22 bp, Homo sapiens
tcaggctctgagctgatgctaa

SEQ ID NO: 7376085 - DNA, 22 bp, Homo sapiens
tcaggcctttgaacttggagtg

SEQ ID NO: 7376086 - DNA, 22 bp, Homo sapiens
tcaggcctttcttcagagcttc

SEQ ID NO: 7376087 - DNA, 22 bp, Homo sapiens
tcaggctccctgctgggctctg

SEQ ID NO: 7376088 - DNA, 22 bp, Homo sapiens
tcagggagaggtgagagcctgt

SEQ ID NO: 7376089 - DNA, 22 bp, Homo sapiens
tcagggagagcctgtctgacgt

SEQ ID NO: 7376090 - DNA, 22 bp, Homo sapiens
tcaggtcccactgctagtaagt

SEQ ID NO: 7376091 - DNA, 22 bp, Homo sapiens
tcaggtgacctgagccactatg

SEQ ID NO: 7376092 - DNA, 22 bp, Homo sapiens
tcaggggcttgaggtgcatgtc

SEQ ID NO: 7376093 - DNA, 22 bp, Homo sapiens
tcaggggcagccggggaagcca

SEQ ID NO: 7376094 - DNA, 22 bp, Homo sapiens
tcataaaagtactcatgttcat

SEQ ID NO: 7376095 - DNA, 22 bp, Homo sapiens
tcatattttgcaaggtcagcta

SEQ ID NO: 7376096 - DNA, 22 bp, Homo sapiens
tcatcctgcactggctcctcct

SEQ ID NO: 7376097 - DNA, 22 bp, Homo sapiens
tcatcccagaccacttattttc

SEQ ID NO: 7376098 - DNA, 22 bp, Homo sapiens
tcatctaagagtcttacattta

SEQ ID NO: 7376099 - DNA, 22 bp, Homo sapiens
tcatctaagagtcttacattta

SEQ ID NO: 7376100 - DNA, 22 bp, Homo sapiens
tcatctaagagtcttacattta

SEQ ID NO: 7376101 - DNA, 22 bp, Homo sapiens
tcatctaagagtcttacattta

SEQ ID NO: 7376102 - DNA, 19 bp, Homo sapiens
tcataaaaatggtaaccca

SEQ ID NO: 7376103 - DNA, 22 bp, Homo sapiens
tcataaaaatagactctaaagt

SEQ ID NO: 7376104 - DNA, 22 bp, Homo sapiens
tcagtttcttctttagataaaa

SEQ ID NO: 7376105 - DNA, 22 bp, Homo sapiens
tcagtttctttactcatagaat

SEQ ID NO: 7376106 - DNA, 22 bp, Homo sapiens
tcagtttctccatcgctccagt

SEQ ID NO: 7376107 - DNA, 22 bp, Homo sapiens
tcagtttcttcatctccctaac

SEQ ID NO: 7376108 - DNA, 22 bp, Homo sapiens
tcagtttctaaatcttaccaat

SEQ ID NO: 7376109 - DNA, 22 bp, Homo sapiens
tcagtttctacctactatgtgt

SEQ ID NO: 7376110 - DNA, 23 bp, Homo sapiens
tcagtttgtataatccatatgca

SEQ ID NO: 7376111 - DNA, 19 bp, Homo sapiens
tcagtggagaaaggggaag

SEQ ID NO: 7376112 - DNA, 22 bp, Homo sapiens
ttgagactcgagtctctcagac

SEQ ID NO: 7376113 - DNA, 22 bp, Homo sapiens
ttgagagaaaaaatttattggt

SEQ ID NO: 7376114 - DNA, 19 bp, Homo sapiens
ttgagaaagttgatttggg

SEQ ID NO: 7376115 - DNA, 18 bp, Homo sapiens
ttgagaaataagcactaa

SEQ ID NO: 7376116 - DNA, 22 bp, Homo sapiens
ttgaggctgcacagtacaggct

SEQ ID NO: 7376117 - DNA, 22 bp, Homo sapiens
ttgagagaggaaacatagtctc

SEQ ID NO: 7376118 - DNA, 22 bp, Homo sapiens
ttgagaggctgttgacattctg

SEQ ID NO: 7376119 - DNA, 22 bp, Homo sapiens
ttgagaggatggattagacaaa

SEQ ID NO: 7376120 - DNA, 19 bp, Homo sapiens
ttgagggcattctggtgtt

SEQ ID NO: 7376121 - DNA, 22 bp, Homo sapiens
ttgaggtaaagctactagttag

SEQ ID NO: 7376122 - DNA, 22 bp, Homo sapiens
ttgaggtaataaacagccattc

SEQ ID NO: 7376123 - DNA, 22 bp, Homo sapiens
ttgaggtaataaacagccattc

SEQ ID NO: 7376124 - DNA, 22 bp, Homo sapiens
ttgaggtagttctattgtgagt

SEQ ID NO: 7376125 - DNA, 22 bp, Homo sapiens
ttgaggtagttctattgtgagt

SEQ ID NO: 7376126 - DNA, 22 bp, Homo sapiens
ttgaggtatattcacatatatc

SEQ ID NO: 7376127 - DNA, 22 bp, Homo sapiens
ttgaggtatattcacatatatc

SEQ ID NO: 7376128 - DNA, 22 bp, Homo sapiens
ttgaggtagtacttattattgg

SEQ ID NO: 7376129 - DNA, 22 bp, Homo sapiens
ttgaaagacattatttatatat

SEQ ID NO: 7376130 - DNA, 22 bp, Homo sapiens
ttgaaacattctcctattgatt

SEQ ID NO: 7376131 - DNA, 19 bp, Homo sapiens
ttgaaagattagctttcta

SEQ ID NO: 7376132 - DNA, 22 bp, Homo sapiens
ttgaaaaaattggtagaggatg

SEQ ID NO: 7376133 - DNA, 22 bp, Homo sapiens
ttgaaaaaattggtagaggatg

SEQ ID NO: 7376134 - DNA, 22 bp, Homo sapiens
ttgaaaatatcacaggagcagc

SEQ ID NO: 7376135 - DNA, 22 bp, Homo sapiens
ttgaaaatatcacaggagcagc

SEQ ID NO: 7376136 - DNA, 22 bp, Homo sapiens
ttcttcagagagtagaagcaag

SEQ ID NO: 7376137 - DNA, 22 bp, Homo sapiens
ttcttcagagagtagaagcaag

SEQ ID NO: 7376138 - DNA, 22 bp, Homo sapiens
ttcttctcctaaggagagtcct

SEQ ID NO: 7376139 - DNA, 22 bp, Homo sapiens
ttcttcctctgtaaaaggtgac

SEQ ID NO: 7376140 - DNA, 22 bp, Homo sapiens
ttcttctacagtgattaatagt

SEQ ID NO: 7376141 - DNA, 22 bp, Homo sapiens
ttctggatgatccatttacaga

SEQ ID NO: 7376142 - DNA, 22 bp, Homo sapiens
ttctggatataacattcagtcc

SEQ ID NO: 7376143 - DNA, 22 bp, Homo sapiens
ttctttggaataagtcaagctg

SEQ ID NO: 7376144 - DNA, 22 bp, Homo sapiens
ttctttggcatttcctgtatgt

SEQ ID NO: 7376145 - DNA, 23 bp, Homo sapiens
ttctttggaattgggctgcaagg

SEQ ID NO: 7376146 - DNA, 22 bp, Homo sapiens
ttctttgggctcagagagggag

SEQ ID NO: 7376147 - DNA, 22 bp, Homo sapiens
ttctttggtgggagattgaggt

SEQ ID NO: 7376148 - DNA, 22 bp, Homo sapiens
ttctttggggtctccagcatag

SEQ ID NO: 7376149 - DNA, 22 bp, Homo sapiens
ttctttggggaatattctggtt

SEQ ID NO: 7376150 - DNA, 22 bp, Homo sapiens
ttctttggctgccagtctggag

SEQ ID NO: 7376151 - DNA, 22 bp, Homo sapiens
ttctttggcttacgtctggcct

SEQ ID NO: 7376152 - DNA, 22 bp, Homo sapiens
ttctttgggattgtagctgtct

SEQ ID NO: 7376153 - DNA, 22 bp, Homo sapiens
ttctttgggattgtagctgtct

SEQ ID NO: 7376154 - DNA, 22 bp, Homo sapiens
ttctttgggcaattgctggccc

SEQ ID NO: 7376155 - DNA, 22 bp, Homo sapiens
ttcttcttgaaactttaggttg

SEQ ID NO: 7376156 - DNA, 22 bp, Homo sapiens
ttcttcttcaagtgctgcattc

SEQ ID NO: 7376157 - DNA, 22 bp, Homo sapiens
ttctttctcaacatgaatgttt

SEQ ID NO: 7376158 - DNA, 22 bp, Homo sapiens
ttctttctcactctttaggaag

SEQ ID NO: 7376159 - DNA, 22 bp, Homo sapiens
ttcttctgttgaaagggtagag

SEQ ID NO: 7376160 - DNA, 22 bp, Homo sapiens
ttcttctgttggcagagcatac

SEQ ID NO: 7376161 - DNA, 22 bp, Homo sapiens
ttcttctgcctcccacctgata

SEQ ID NO: 7376162 - DNA, 22 bp, Homo sapiens
ttcttctgaaacataatcaata

SEQ ID NO: 7376163 - DNA, 22 bp, Homo sapiens
ttcttctgaaacagtgacagac

SEQ ID NO: 7376164 - DNA, 22 bp, Homo sapiens
ttctaaagcctgtcctatcaga

SEQ ID NO: 7376165 - DNA, 22 bp, Homo sapiens
ttctaaatggggatcctttctg

SEQ ID NO: 7376166 - DNA, 22 bp, Homo sapiens
ttctaaatgtaaatagtatgat

SEQ ID NO: 7376167 - DNA, 22 bp, Homo sapiens
ttctaaatgtaaatagtatgat

SEQ ID NO: 7376168 - DNA, 20 bp, Homo sapiens
ttcgctgggagtggccaggc

SEQ ID NO: 7376169 - DNA, 20 bp, Homo sapiens
ttcgctgggagtggccaggc

SEQ ID NO: 7376170 - DNA, 22 bp, Homo sapiens
ttccctgcaacctttccctggg

SEQ ID NO: 7376171 - DNA, 22 bp, Homo sapiens
ttctcagatatttgtatggaac

SEQ ID NO: 7376172 - DNA, 22 bp, Homo sapiens
ttctcagagcactgctgacaaa

SEQ ID NO: 7376173 - DNA, 19 bp, Homo sapiens
ttctccagcctgacctgag

SEQ ID NO: 7376174 - DNA, 22 bp, Homo sapiens
ttctccaggcttgggccaggtc

SEQ ID NO: 7376175 - DNA, 22 bp, Homo sapiens
ttctcaactctcaagagaagct

SEQ ID NO: 7376176 - DNA, 22 bp, Homo sapiens
ttctcaagaacatatgtagggt

SEQ ID NO: 7376177 - DNA, 22 bp, Homo sapiens
ttctaacttttgaggcaatgtg

SEQ ID NO: 7376178 - DNA, 22 bp, Homo sapiens
ttctaagaaatggaaaacgatt

SEQ ID NO: 7376179 - DNA, 22 bp, Homo sapiens
ttctcaaggacaaaatgacatg

SEQ ID NO: 7376180 - DNA, 22 bp, Homo sapiens
ttctcacaaatccatccaggag

SEQ ID NO: 7376181 - DNA, 22 bp, Homo sapiens
ttctcacactttccactgaggt

SEQ ID NO: 7376182 - DNA, 22 bp, Homo sapiens
ttctctgtagttgcctggtgga

SEQ ID NO: 7376183 - DNA, 19 bp, Homo sapiens
ttctctgtgctagactctg

SEQ ID NO: 7376184 - DNA, 22 bp, Homo sapiens
ttctctgttttcccctcgatgt

SEQ ID NO: 7376185 - DNA, 22 bp, Homo sapiens
ttctcttagctgtaaagtcaat

SEQ ID NO: 7376186 - DNA, 21 bp, Homo sapiens
ttctccagggggagctctctc

SEQ ID NO: 7376187 - DNA, 22 bp, Homo sapiens
ttctcctcagcaaggcagcttt

SEQ ID NO: 7376188 - DNA, 22 bp, Homo sapiens
ttctgcctgatgtagtcatacc

SEQ ID NO: 7376189 - DNA, 22 bp, Homo sapiens
ttctgccctttggtaggtaaag

SEQ ID NO: 7376190 - DNA, 22 bp, Homo sapiens
ttctgcccaccacactttatct

SEQ ID NO: 7376191 - DNA, 19 bp, Homo sapiens
ttctgccctctcttctagc

SEQ ID NO: 7376192 - DNA, 22 bp, Homo sapiens
ttctgcacattttagcaaagta

SEQ ID NO: 7376193 - DNA, 22 bp, Homo sapiens
ttctgcagatcaacttgactgc

SEQ ID NO: 7376194 - DNA, 22 bp, Homo sapiens
ttctgcagcatgaggctggagc

SEQ ID NO: 7376195 - DNA, 22 bp, Homo sapiens
tcctctccagcaaactggctat

SEQ ID NO: 7376196 - DNA, 22 bp, Homo sapiens
tcctctgccccagatgaaattt

SEQ ID NO: 7376197 - DNA, 20 bp, Homo sapiens
tcctccttgcagagcccaga

SEQ ID NO: 7376198 - DNA, 19 bp, Homo sapiens
tcctccttacttcctcttg

SEQ ID NO: 7376199 - DNA, 22 bp, Homo sapiens
tcctctggatataagcctcacc

SEQ ID NO: 7376200 - DNA, 22 bp, Homo sapiens
tcctctgctgttctggttcttt

SEQ ID NO: 7376201 - DNA, 21 bp, Homo sapiens
tcctctgctctcataccacaa

SEQ ID NO: 7376202 - DNA, 22 bp, Homo sapiens
tcctctgctccatctttactgt

SEQ ID NO: 7376203 - DNA, 22 bp, Homo sapiens
tcctctggcccagctgcctctg

SEQ ID NO: 7376204 - DNA, 22 bp, Homo sapiens
ttagtggtgttggtgaggactg

SEQ ID NO: 7376205 - DNA, 22 bp, Homo sapiens
ttagtgggatattggctattca

SEQ ID NO: 7376206 - DNA, 22 bp, Homo sapiens
ttagtggggatgtatgggaggc

SEQ ID NO: 7376207 - DNA, 22 bp, Homo sapiens
ttatgtcatgtggtggtgaaga

SEQ ID NO: 7376208 - DNA, 22 bp, Homo sapiens
ttatggaatggagaaagtctgc

SEQ ID NO: 7376209 - DNA, 22 bp, Homo sapiens
ttatggaatttgcaaaaggtta

SEQ ID NO: 7376210 - DNA, 21 bp, Homo sapiens
ttatggagaaggaaagtaagg

SEQ ID NO: 7376211 - DNA, 22 bp, Homo sapiens
ttatgctagttgaaataacaca

SEQ ID NO: 7376212 - DNA, 22 bp, Homo sapiens
ttatggaagtgcaaattgtgtg

SEQ ID NO: 7376213 - DNA, 22 bp, Homo sapiens
ttagttgaatatgcatttttgc

SEQ ID NO: 7376214 - DNA, 22 bp, Homo sapiens
ttagttcactgctatatcatca

SEQ ID NO: 7376215 - DNA, 22 bp, Homo sapiens
ttagttagagccctatgttagg

SEQ ID NO: 7376216 - DNA, 22 bp, Homo sapiens
ttatgcaaggacttattacagt

SEQ ID NO: 7376217 - DNA, 22 bp, Homo sapiens
ttattttaccttcctctgagct

SEQ ID NO: 7376218 - DNA, 22 bp, Homo sapiens
ttattttaccttcctctgagct

SEQ ID NO: 7376219 - DNA, 22 bp, Homo sapiens
ttattttaccttcctctgagct

SEQ ID NO: 7376220 - DNA, 22 bp, Homo sapiens
ttcaaaagtaatcagtattaga

SEQ ID NO: 7376221 - DNA, 22 bp, Homo sapiens
ttcaaaagcggtccaggaagat

SEQ ID NO: 7376222 - DNA, 22 bp, Homo sapiens
ttcaaaagactcagatgtagcg

SEQ ID NO: 7376223 - DNA, 22 bp, Homo sapiens
ttattttggtaaatgtttgcct

SEQ ID NO: 7376224 - DNA, 22 bp, Homo sapiens
ttcaaacaactcatttatgcaa

SEQ ID NO: 7376225 - DNA, 22 bp, Homo sapiens
ttcaaacaaaactctttcctat

SEQ ID NO: 7376226 - DNA, 22 bp, Homo sapiens
ttatttaatgtgatctgaagag

SEQ ID NO: 7376227 - DNA, 22 bp, Homo sapiens
ttatttaaaagtggtaagattc

SEQ ID NO: 7376228 - DNA, 22 bp, Homo sapiens
ttatttaaaatgtaggttggga

SEQ ID NO: 7376229 - DNA, 22 bp, Homo sapiens
ttatttaaaagtggtaagattc

SEQ ID NO: 7376230 - DNA, 22 bp, Homo sapiens
ttatgttatgctatttcagata

SEQ ID NO: 7376231 - DNA, 22 bp, Homo sapiens
ttatgtttgagtatatgactca

SEQ ID NO: 7376232 - DNA, 22 bp, Homo sapiens
ttatgttttatggctatatcat

SEQ ID NO: 7376233 - DNA, 22 bp, Homo sapiens
ttattgtttactagtttgcaga

SEQ ID NO: 7376234 - DNA, 22 bp, Homo sapiens
ttattgtttactagtttgcaga

SEQ ID NO: 7376235 - DNA, 22 bp, Homo sapiens
ttatttgtggcatatgagacga

SEQ ID NO: 7376236 - DNA, 22 bp, Homo sapiens
ttatttagtctagatgaatttt

SEQ ID NO: 7376237 - DNA, 22 bp, Homo sapiens
ttatttaattttctcactcaga

SEQ ID NO: 7376238 - DNA, 22 bp, Homo sapiens
ttccattgagtacctggagaca

SEQ ID NO: 7376239 - DNA, 22 bp, Homo sapiens
ttcccaggtaattctgaggcag

SEQ ID NO: 7376240 - DNA, 22 bp, Homo sapiens
ttcccaggctgtgctaccagag

SEQ ID NO: 7376241 - DNA, 22 bp, Homo sapiens
ttcccatttgtggtagtgaatt

SEQ ID NO: 7376242 - DNA, 19 bp, Homo sapiens
ttcccctccccagggatag

SEQ ID NO: 7376243 - DNA, 22 bp, Homo sapiens
ttcccctctcagatctggccta

SEQ ID NO: 7376244 - DNA, 22 bp, Homo sapiens
ttccaaggctaggttgtaaagg

SEQ ID NO: 7376245 - DNA, 22 bp, Homo sapiens
ttccaaggctgctatttgtttc

SEQ ID NO: 7376246 - DNA, 22 bp, Homo sapiens
ttccaataaaatgttatttgca

SEQ ID NO: 7376247 - DNA, 22 bp, Homo sapiens
ttccaattgtgagattttttaa

SEQ ID NO: 7376248 - DNA, 22 bp, Homo sapiens
ttccaatgtatgatagacttag

SEQ ID NO: 7376249 - DNA, 22 bp, Homo sapiens
ttccaatggaatcatgtcttga

SEQ ID NO: 7376250 - DNA, 22 bp, Homo sapiens
ttccaatgacatttgttttaaa

SEQ ID NO: 7376251 - DNA, 22 bp, Homo sapiens
ttccaatgactagtggcatcct

SEQ ID NO: 7376252 - DNA, 19 bp, Homo sapiens
ttccaaaatcaggatttga

SEQ ID NO: 7376253 - DNA, 22 bp, Homo sapiens
ttccaactttgtcatatattat

SEQ ID NO: 7376254 - DNA, 22 bp, Homo sapiens
ttccaactttgaaaatgttatg

SEQ ID NO: 7376255 - DNA, 22 bp, Homo sapiens
ttccaactttaaaattcattct

SEQ ID NO: 7376256 - DNA, 20 bp, Homo sapiens
ttccaactcacatctctaca

SEQ ID NO: 7376257 - DNA, 22 bp, Homo sapiens
ttccaaggattgaaatgtagtc

SEQ ID NO: 7376258 - DNA, 22 bp, Homo sapiens
ttcaatatctctaagaatgagg

SEQ ID NO: 7376259 - DNA, 22 bp, Homo sapiens
ttcaatatcattgtttagtctc

SEQ ID NO: 7376260 - DNA, 22 bp, Homo sapiens
ttcaaggttcagggagaaattg

SEQ ID NO: 7376261 - DNA, 22 bp, Homo sapiens
ttcagaaatccctcttctaccc

SEQ ID NO: 7376262 - DNA, 22 bp, Homo sapiens
ttcagaagtagctaagcagtca

SEQ ID NO: 7376263 - DNA, 23 bp, Homo sapiens
ttcagaagaaatgagtacaggag

SEQ ID NO: 7376264 - DNA, 22 bp, Homo sapiens
ttcagaaggatgacaccagttg

SEQ ID NO: 7376265 - DNA, 22 bp, Homo sapiens
ttcagaccaagctggtggcatg

SEQ ID NO: 7376266 - DNA, 22 bp, Homo sapiens
ttcatacaatgggatattatga

SEQ ID NO: 7376267 - DNA, 23 bp, Homo sapiens
ttcatacagaaacatcacttcat

SEQ ID NO: 7376268 - DNA, 22 bp, Homo sapiens
ttcatacatgtgtactgttcca

SEQ ID NO: 7376269 - DNA, 22 bp, Homo sapiens
ttcatactgtgtttccaagttt

SEQ ID NO: 7376270 - DNA, 19 bp, Homo sapiens
ttcagacagactaggtata

SEQ ID NO: 7376271 - DNA, 22 bp, Homo sapiens
ttcagaatgtgaccttatttgg

SEQ ID NO: 7376272 - DNA, 22 bp, Homo sapiens
ttcagaatgctatttctgaaat

SEQ ID NO: 7376273 - DNA, 22 bp, Homo sapiens
ttcatattgcttccgtggagtg

SEQ ID NO: 7376274 - DNA, 22 bp, Homo sapiens
ttcatattatgatttgaaatgc

SEQ ID NO: 7376275 - DNA, 22 bp, Homo sapiens
ttcatattcaaatactctgctt

SEQ ID NO: 7376276 - DNA, 22 bp, Homo sapiens
ttcatattatgatttgaaatgc

SEQ ID NO: 7376277 - DNA, 22 bp, Homo sapiens
ttcatattatgatttgaaatgc

SEQ ID NO: 7376278 - DNA, 22 bp, Homo sapiens
ttcatatatatgcactacgtac

SEQ ID NO: 7376279 - DNA, 22 bp, Homo sapiens
ttcatataaatggaatcagaat

SEQ ID NO: 7376280 - DNA, 22 bp, Homo sapiens
ttcatagatctcaattttgagg

SEQ ID NO: 7376281 - DNA, 22 bp, Homo sapiens
ttgtgagagtttaccttgacca

SEQ ID NO: 7376282 - DNA, 22 bp, Homo sapiens
ttgtgcaatagttttctcatga

SEQ ID NO: 7376283 - DNA, 22 bp, Homo sapiens
ttgtgcaaggtctggactatag

SEQ ID NO: 7376284 - DNA, 22 bp, Homo sapiens
ttgtgcaaggctcttggaatgt

SEQ ID NO: 7376285 - DNA, 22 bp, Homo sapiens
ttgtgcaaggtaaagagggctt

SEQ ID NO: 7376286 - DNA, 22 bp, Homo sapiens
ttgtgcaatcccctcattttat

SEQ ID NO: 7376287 - DNA, 22 bp, Homo sapiens
ttgtgcaatggtgtttaggttt

SEQ ID NO: 7376288 - DNA, 22 bp, Homo sapiens
ttgtgcaatttaaaatcttcct

SEQ ID NO: 7376289 - DNA, 22 bp, Homo sapiens
ttgtgcaaagggggttaatcat

SEQ ID NO: 7376290 - DNA, 22 bp, Homo sapiens
ttgtgcaagaagccagcaccaa

SEQ ID NO: 7376291 - DNA, 22 bp, Homo sapiens
ttgtgcaagaattggaaagcaa

SEQ ID NO: 7376292 - DNA, 22 bp, Homo sapiens
ttgtgcagctataaagaaatgg

SEQ ID NO: 7376293 - DNA, 22 bp, Homo sapiens
ttgtagatataaattttattgt

SEQ ID NO: 7376294 - DNA, 22 bp, Homo sapiens
ttgtagatggcttatttctgtg

SEQ ID NO: 7376295 - DNA, 22 bp, Homo sapiens
ttgtagatgtgtttttatctca

SEQ ID NO: 7376296 - DNA, 22 bp, Homo sapiens
ttgtagattggagagtgtgtga

SEQ ID NO: 7376297 - DNA, 22 bp, Homo sapiens
ttgtactggttttgaaatgagc

SEQ ID NO: 7376298 - DNA, 22 bp, Homo sapiens
ttgtactgtggatctgtatttg

SEQ ID NO: 7376299 - DNA, 22 bp, Homo sapiens
ttgggggcatattgagtagtgg

SEQ ID NO: 7376300 - DNA, 22 bp, Homo sapiens
ttgggggcatattgagtagtgg

SEQ ID NO: 7376301 - DNA, 22 bp, Homo sapiens
ttgggggcagagggagcatctg

SEQ ID NO: 7376302 - DNA, 22 bp, Homo sapiens
ttggggtcccacaggctgcctg

SEQ ID NO: 7376303 - DNA, 18 bp, Homo sapiens
ttggggtgaggccaggaa

SEQ ID NO: 7376304 - DNA, 22 bp, Homo sapiens
ttgtactgatatgaagaatcaa

SEQ ID NO: 7376305 - DNA, 22 bp, Homo sapiens
ttgtactgcacccctgggaatg

SEQ ID NO: 7376306 - DNA, 22 bp, Homo sapiens
ttgtatatattcttaaagatgt

SEQ ID NO: 7376307 - DNA, 22 bp, Homo sapiens
ttgtatatattcttaaagatgt

SEQ ID NO: 7376308 - DNA, 22 bp, Homo sapiens
ttgtatcagtgcctataaaatg

SEQ ID NO: 7376309 - DNA, 23 bp, Homo sapiens
ttgtatctctggaaattcttcaa

SEQ ID NO: 7376310 - DNA, 22 bp, Homo sapiens
ttgtatgatcccatttagtgaa

SEQ ID NO: 7376311 - DNA, 22 bp, Homo sapiens
ttgtattaaaatgtgtttctgt

SEQ ID NO: 7376312 - DNA, 22 bp, Homo sapiens
ttgtattaattgaaatgaatgc

SEQ ID NO: 7376313 - DNA, 22 bp, Homo sapiens
ttgtattaattgaaatgaatgc

SEQ ID NO: 7376314 - DNA, 22 bp, Homo sapiens
ttgtattagctgtaaattttct

SEQ ID NO: 7376315 - DNA, 22 bp, Homo sapiens
ttgtatttcctataacctttct

SEQ ID NO: 7376316 - DNA, 22 bp, Homo sapiens
ttgggctgatctgtggaagaag

SEQ ID NO: 7376317 - DNA, 20 bp, Homo sapiens
ttggctcatgcaacacctac

SEQ ID NO: 7376318 - DNA, 22 bp, Homo sapiens
ttggctcatgctgttttgtgca

SEQ ID NO: 7376319 - DNA, 22 bp, Homo sapiens
ttggctcattaaagatgataat

SEQ ID NO: 7376320 - DNA, 22 bp, Homo sapiens
ttggctcagtgtgagggagatg

SEQ ID NO: 7376321 - DNA, 22 bp, Homo sapiens
ttggctcaggacccctgtgact

SEQ ID NO: 7376322 - DNA, 22 bp, Homo sapiens
ttggctcaggctttcattgtaa

SEQ ID NO: 7376323 - DNA, 22 bp, Homo sapiens
ttggctcagcatcttggtgcca

SEQ ID NO: 7376324 - DNA, 22 bp, Homo sapiens
ttggctcagctgggactgttga

SEQ ID NO: 7376325 - DNA, 22 bp, Homo sapiens
ttggctcacctgtctacccaga

SEQ ID NO: 7376326 - DNA, 20 bp, Homo sapiens
ttggctcagatttttatggg

SEQ ID NO: 7376327 - DNA, 22 bp, Homo sapiens
ttggctcacctggagcctgttg

SEQ ID NO: 7376328 - DNA, 22 bp, Homo sapiens
ttggctcacatgattatggagg

SEQ ID NO: 7376329 - DNA, 22 bp, Homo sapiens
ttggctcaaaacttagattcca

SEQ ID NO: 7376330 - DNA, 22 bp, Homo sapiens
ttggctcacaaggacggttgct

SEQ ID NO: 7376331 - DNA, 22 bp, Homo sapiens
ttggctaacacgcgttttgttc

SEQ ID NO: 7376332 - DNA, 22 bp, Homo sapiens
ttggctaacctgggttatcagc

SEQ ID NO: 7376333 - DNA, 22 bp, Homo sapiens
ttggcccagggtcagcggcgct

SEQ ID NO: 7376334 - DNA, 22 bp, Homo sapiens
ttggcccagactcggggactga

SEQ ID NO: 7376335 - DNA, 22 bp, Homo sapiens
ttggcccagcatgcgggtctgt

SEQ ID NO: 7376336 - DNA, 22 bp, Homo sapiens
ttggaagagagccacagttaat

SEQ ID NO: 7376337 - DNA, 22 bp, Homo sapiens
ttggaagagtagagttgaataa

SEQ ID NO: 7376338 - DNA, 21 bp, Homo sapiens
ttggaagataatgcttatgat

SEQ ID NO: 7376339 - DNA, 22 bp, Homo sapiens
ttggaggcaatgggaaggaggc

SEQ ID NO: 7376340 - DNA, 22 bp, Homo sapiens
ttggcactattcactccatggg

SEQ ID NO: 7376341 - DNA, 22 bp, Homo sapiens
ttggcacagccacttctgctgc

SEQ ID NO: 7376342 - DNA, 22 bp, Homo sapiens
ttggcacacagtaagccctaag

SEQ ID NO: 7376343 - DNA, 22 bp, Homo sapiens
ttggcaaaatttaaagaagtga

SEQ ID NO: 7376344 - DNA, 22 bp, Homo sapiens
ttggcactctccctgcactggt

SEQ ID NO: 7376345 - DNA, 22 bp, Homo sapiens
ttggaagacaatgctgattctc

SEQ ID NO: 7376346 - DNA, 22 bp, Homo sapiens
ttggaagacagtgaaacagcac

SEQ ID NO: 7376347 - DNA, 22 bp, Homo sapiens
ttggaagacagccgtctttatt

SEQ ID NO: 7376348 - DNA, 22 bp, Homo sapiens
ttggaagaaatatcaatagtgt

SEQ ID NO: 7376349 - DNA, 22 bp, Homo sapiens
ttggaacatgccggggtccagg

SEQ ID NO: 7376350 - DNA, 23 bp, Homo sapiens
ttgcttctgtgcaattcagtact

SEQ ID NO: 7376351 - DNA, 23 bp, Homo sapiens
ttgcttctgtgcaattcagtact

SEQ ID NO: 7376352 - DNA, 22 bp, Homo sapiens
ttgcttcctctagtttcttgaa

SEQ ID NO: 7376353 - DNA, 22 bp, Homo sapiens
ttgcttcctctgtgcaatcctc

SEQ ID NO: 7376354 - DNA, 22 bp, Homo sapiens
ttgcttcctggatgtgactttg

SEQ ID NO: 7376355 - DNA, 22 bp, Homo sapiens
ttgcttcctggcagggcgagcg

SEQ ID NO: 7376356 - DNA, 22 bp, Homo sapiens
ttgcttccttgagctggtctga

SEQ ID NO: 7376357 - DNA, 22 bp, Homo sapiens
ttgcttcctttacagatgggca

SEQ ID NO: 7376358 - DNA, 22 bp, Homo sapiens
ttgcttgcagacttagcaaatt

SEQ ID NO: 7376359 - DNA, 22 bp, Homo sapiens
ttgcttgcataatgctggcatg

SEQ ID NO: 7376360 - DNA, 22 bp, Homo sapiens
ttgcttgcattgtccctggtga

SEQ ID NO: 7376361 - DNA, 22 bp, Homo sapiens
ttgcttgcctgttaggagaaac

SEQ ID NO: 7376362 - DNA, 22 bp, Homo sapiens
ttgcttgcccaagtgtcaattt

SEQ ID NO: 7376363 - DNA, 22 bp, Homo sapiens
ttgcttgccctgcagcatactt

SEQ ID NO: 7376364 - DNA, 23 bp, Homo sapiens
ttgcttgcctttagtcaggacca

SEQ ID NO: 7376365 - DNA, 22 bp, Homo sapiens
ttgcttgctatccagatcagtc

SEQ ID NO: 7376366 - DNA, 22 bp, Homo sapiens
ttgcttgctcaactctgttgtt

SEQ ID NO: 7376367 - DNA, 22 bp, Homo sapiens
ttgcttgcttctattttataca

SEQ ID NO: 7376368 - DNA, 22 bp, Homo sapiens
ttgcttgcttcttgggagtggt

SEQ ID NO: 7376369 - DNA, 22 bp, Homo sapiens
ttgcttcattaagttctcacag

SEQ ID NO: 7376370 - DNA, 23 bp, Homo sapiens
ttgcttccactgtaagtggagaa

SEQ ID NO: 7376371 - DNA, 22 bp, Homo sapiens
ttgcttccagtccaagtctgtt

SEQ ID NO: 7376372 - DNA, 22 bp, Homo sapiens
ttgcttccccctgttctagttc

SEQ ID NO: 7376373 - DNA, 22 bp, Homo sapiens
ttgcttcctcctagccacttgc

SEQ ID NO: 7376374 - DNA, 22 bp, Homo sapiens
ttgcttcctcgaggccagcgtg

SEQ ID NO: 7376375 - DNA, 22 bp, Homo sapiens
ttgctaaaaatggaattatagg

SEQ ID NO: 7376376 - DNA, 22 bp, Homo sapiens
ttgctaaaaatggaattatagg

SEQ ID NO: 7376377 - DNA, 22 bp, Homo sapiens
ttgctaaaggattttgtattta

SEQ ID NO: 7376378 - DNA, 22 bp, Homo sapiens
ttgctaaatccctataatattc

SEQ ID NO: 7376379 - DNA, 22 bp, Homo sapiens
ttgctaaaaggtgaaaagtgta

SEQ ID NO: 7376380 - DNA, 22 bp, Homo sapiens
ttgctaaatttattttcgaaca

SEQ ID NO: 7376381 - DNA, 19 bp, Homo sapiens
ttgctaaatggaaaagcac

SEQ ID NO: 7376382 - DNA, 22 bp, Homo sapiens
ttgcctttaacccctgaaaggc

SEQ ID NO: 7376383 - DNA, 22 bp, Homo sapiens
ttgcctttgacggtgcagcagt

SEQ ID NO: 7376384 - DNA, 22 bp, Homo sapiens
ttgccttttgctctgggggcag

SEQ ID NO: 7376385 - DNA, 22 bp, Homo sapiens
ttgcctttaagtataactgctg

SEQ ID NO: 7376386 - DNA, 22 bp, Homo sapiens
ttgcctttcccctctggaagca

SEQ ID NO: 7376387 - DNA, 17 bp, Homo sapiens
ttgcctttatggtcact

SEQ ID NO: 7376388 - DNA, 22 bp, Homo sapiens
ttgcctttcccatgtctaggag

SEQ ID NO: 7376389 - DNA, 22 bp, Homo sapiens
ttgcccagagtcacccagctca

SEQ ID NO: 7376390 - DNA, 22 bp, Homo sapiens
ttgcctccttttaaggaaatca

SEQ ID NO: 7376391 - DNA, 22 bp, Homo sapiens
ttgcctcccagcatgggcagct

SEQ ID NO: 7376392 - DNA, 22 bp, Homo sapiens
ttgcctcattttctggtgaaat

SEQ ID NO: 7376393 - DNA, 22 bp, Homo sapiens
ttgcattttggttgtaaatatg

SEQ ID NO: 7376394 - DNA, 22 bp, Homo sapiens
ttgcatttgtttgagtagaatg

SEQ ID NO: 7376395 - DNA, 22 bp, Homo sapiens
ttgcatttgtttgagtagaatg

SEQ ID NO: 7376396 - DNA, 22 bp, Homo sapiens
ttgcattttggttgtaaatatg

SEQ ID NO: 7376397 - DNA, 22 bp, Homo sapiens
ttgccaggcttgtttctaggct

SEQ ID NO: 7376398 - DNA, 22 bp, Homo sapiens
ttgccaggagagccacttgcag

SEQ ID NO: 7376399 - DNA, 22 bp, Homo sapiens
ttgaggtattgatattttatga

SEQ ID NO: 7376400 - DNA, 22 bp, Homo sapiens
ttgaggtattgatattttatga

SEQ ID NO: 7376401 - DNA, 22 bp, Homo sapiens
tttcataagggtttctagactt

SEQ ID NO: 7376402 - DNA, 22 bp, Homo sapiens
tttcatctctctaaaagacagt

SEQ ID NO: 7376403 - DNA, 22 bp, Homo sapiens
tttcatattattccttgagtct

SEQ ID NO: 7376404 - DNA, 22 bp, Homo sapiens
tttcatagtcaagtgtgtatga

SEQ ID NO: 7376405 - DNA, 22 bp, Homo sapiens
tttccagggctctgtagaagaa

SEQ ID NO: 7376406 - DNA, 22 bp, Homo sapiens
tttccaaataaggtcacattct

SEQ ID NO: 7376407 - DNA, 22 bp, Homo sapiens
tttccaaataaggtcacactca

SEQ ID NO: 7376408 - DNA, 22 bp, Homo sapiens
tttcatcttatttgtctacatc

SEQ ID NO: 7376409 - DNA, 22 bp, Homo sapiens
tttccaaataaggtcacattct

SEQ ID NO: 7376410 - DNA, 22 bp, Homo sapiens
tttccaaataaggtcacattct

SEQ ID NO: 7376411 - DNA, 22 bp, Homo sapiens
tttctaaacaaagggagtttgg

SEQ ID NO: 7376412 - DNA, 22 bp, Homo sapiens
tttccttttggctaggtgtgaa

SEQ ID NO: 7376413 - DNA, 22 bp, Homo sapiens
tttccttttataaggcttgagg

SEQ ID NO: 7376414 - DNA, 22 bp, Homo sapiens
tttcctttgtgcaggccttggg

SEQ ID NO: 7376415 - DNA, 22 bp, Homo sapiens
tttccttttaagcagtcggcct

SEQ ID NO: 7376416 - DNA, 22 bp, Homo sapiens
tttctaacagcaaatgtttatc

SEQ ID NO: 7376417 - DNA, 22 bp, Homo sapiens
tttctaaatggtggctgcattg

SEQ ID NO: 7376418 - DNA, 22 bp, Homo sapiens
tttctaagatgtggtttcaagg

SEQ ID NO: 7376419 - DNA, 22 bp, Homo sapiens
tttctaaatggtggctgcattg

SEQ ID NO: 7376420 - DNA, 19 bp, Homo sapiens
tttctaagctaaatgcttc

SEQ ID NO: 7376421 - DNA, 22 bp, Homo sapiens
tttctaagcttagtatgaggca

SEQ ID NO: 7376422 - DNA, 22 bp, Homo sapiens
tttctaaggtgaggtagaaaat

SEQ ID NO: 7376423 - DNA, 21 bp, Homo sapiens
tttctaaggaggaagaaaaga

SEQ ID NO: 7376424 - DNA, 22 bp, Homo sapiens
tttctaaggccagagactgctg

SEQ ID NO: 7376425 - DNA, 22 bp, Homo sapiens
tttccttgcacattggtttcca

SEQ ID NO: 7376426 - DNA, 22 bp, Homo sapiens
tttcctttctggtttggtcata

SEQ ID NO: 7376427 - DNA, 22 bp, Homo sapiens
tttcctttgcccaatacatgtc

SEQ ID NO: 7376428 - DNA, 22 bp, Homo sapiens
tttcctttgagggtcctacact

SEQ ID NO: 7376429 - DNA, 22 bp, Homo sapiens
tttcctttgagggtcctacact

SEQ ID NO: 7376430 - DNA, 22 bp, Homo sapiens
tttcctttgggagcatgaattt

SEQ ID NO: 7376431 - DNA, 22 bp, Homo sapiens
tttcctttgggcacccgagctc

SEQ ID NO: 7376432 - DNA, 22 bp, Homo sapiens
tttcccaaagcctggggtgagt

SEQ ID NO: 7376433 - DNA, 22 bp, Homo sapiens
tttcccaacagtctctctcaaa

SEQ ID NO: 7376434 - DNA, 22 bp, Homo sapiens
tttcccaagaaaaataattgga

SEQ ID NO: 7376435 - DNA, 22 bp, Homo sapiens
tttcccaagaaaaataattgga

SEQ ID NO: 7376436 - DNA, 22 bp, Homo sapiens
tttcccaagaccatagatggaa

SEQ ID NO: 7376437 - DNA, 22 bp, Homo sapiens
tttcccaagaccatagatggaa

SEQ ID NO: 7376438 - DNA, 22 bp, Homo sapiens
tttcccaagtgaagtgaagcca

SEQ ID NO: 7376439 - DNA, 22 bp, Homo sapiens
tttcccaagtgtaaacatggca

SEQ ID NO: 7376440 - DNA, 22 bp, Homo sapiens
tttcccaatgagtccttgagca

SEQ ID NO: 7376441 - DNA, 22 bp, Homo sapiens
tttcccaattgagaggttctgt

SEQ ID NO: 7376442 - DNA, 22 bp, Homo sapiens
tttcacattcagatatagactt

SEQ ID NO: 7376443 - DNA, 22 bp, Homo sapiens
tttcacattagatatgtcattt

SEQ ID NO: 7376444 - DNA, 22 bp, Homo sapiens
tttcacattagatatgtcattt

SEQ ID NO: 7376445 - DNA, 23 bp, Homo sapiens
tttcacattaatgtttagcagga

SEQ ID NO: 7376446 - DNA, 22 bp, Homo sapiens
tttcacattctctggttatcga

SEQ ID NO: 7376447 - DNA, 22 bp, Homo sapiens
tttcacattcttctgaatctac

SEQ ID NO: 7376448 - DNA, 22 bp, Homo sapiens
tttcacattggcttctatttct

SEQ ID NO: 7376449 - DNA, 23 bp, Homo sapiens
tttcacatttactgttagatggc

SEQ ID NO: 7376450 - DNA, 22 bp, Homo sapiens
tttcacatttgttttaagaagt

SEQ ID NO: 7376451 - DNA, 22 bp, Homo sapiens
tttcagtgtatcttccaaaagc

SEQ ID NO: 7376452 - DNA, 22 bp, Homo sapiens
tttcagtgggtttatttcatgt

SEQ ID NO: 7376453 - DNA, 22 bp, Homo sapiens
tttcagtgtcagtaatgcagca

SEQ ID NO: 7376454 - DNA, 22 bp, Homo sapiens
tttcataaacagtagaagacta

SEQ ID NO: 7376455 - DNA, 22 bp, Homo sapiens
tttcacaatcaaatggtgaaat

SEQ ID NO: 7376456 - DNA, 22 bp, Homo sapiens
tttcacatcagaggtagattag

SEQ ID NO: 7376457 - DNA, 22 bp, Homo sapiens
tttcacatatggttgttgattg

SEQ ID NO: 7376458 - DNA, 22 bp, Homo sapiens
tttcacatggtactgcctgttt

SEQ ID NO: 7376459 - DNA, 22 bp, Homo sapiens
tttcacatgtatataggcatta

SEQ ID NO: 7376460 - DNA, 20 bp, Homo sapiens
tttcacatctgtccctttaa

SEQ ID NO: 7376461 - DNA, 22 bp, Homo sapiens
tttcacatggactttttgttct

SEQ ID NO: 7376462 - DNA, 23 bp, Homo sapiens
tttatttatttaggctgagggat

SEQ ID NO: 7376463 - DNA, 22 bp, Homo sapiens
tttatttatccttctggattgc

SEQ ID NO: 7376464 - DNA, 21 bp, Homo sapiens
tttatttatataggacacatg

SEQ ID NO: 7376465 - DNA, 22 bp, Homo sapiens
tttatttataagccacttgctg

SEQ ID NO: 7376466 - DNA, 22 bp, Homo sapiens
tttatttataagccacttgctg

SEQ ID NO: 7376467 - DNA, 22 bp, Homo sapiens
tttatttataagccacttgctg

SEQ ID NO: 7376468 - DNA, 22 bp, Homo sapiens
tttcaagtagccctggctccca

SEQ ID NO: 7376469 - DNA, 20 bp, Homo sapiens
tttcaagtcagcaattctca

SEQ ID NO: 7376470 - DNA, 22 bp, Homo sapiens
tttcacaagtaaagtcctaagt

SEQ ID NO: 7376471 - DNA, 22 bp, Homo sapiens
tttcacaagacagctactgttg

SEQ ID NO: 7376472 - DNA, 22 bp, Homo sapiens
tttcacaactgcttatttgaga

SEQ ID NO: 7376473 - DNA, 22 bp, Homo sapiens
tttcaagtttagtgtgttcaaa

SEQ ID NO: 7376474 - DNA, 22 bp, Homo sapiens
tttcaagttgtttatatccaga

SEQ ID NO: 7376475 - DNA, 22 bp, Homo sapiens
tttcaagttgtttatatccaga

SEQ ID NO: 7376476 - DNA, 20 bp, Homo sapiens
tttcaagttgtaaggtatca

SEQ ID NO: 7376477 - DNA, 22 bp, Homo sapiens
tttcaagtgtcctgattaatgg

SEQ ID NO: 7376478 - DNA, 22 bp, Homo sapiens
tttcaagtggggacatttgaga

SEQ ID NO: 7376479 - DNA, 22 bp, Homo sapiens
tttcaagtgactatggtttttg

SEQ ID NO: 7376480 - DNA, 20 bp, Homo sapiens
tttaagaagtttctgaggaa

SEQ ID NO: 7376481 - DNA, 22 bp, Homo sapiens
tttaagaagttatgttataaat

SEQ ID NO: 7376482 - DNA, 22 bp, Homo sapiens
ttgttcttttgcttagacagat

SEQ ID NO: 7376483 - DNA, 22 bp, Homo sapiens
ttgttcttagtatgcattgttt

SEQ ID NO: 7376484 - DNA, 22 bp, Homo sapiens
ttgttgtcattgtagaggattt

SEQ ID NO: 7376485 - DNA, 22 bp, Homo sapiens
ttgttgggcatgcagtggctgt

SEQ ID NO: 7376486 - DNA, 22 bp, Homo sapiens
ttgtttaaaagaaatcatagaa

SEQ ID NO: 7376487 - DNA, 22 bp, Homo sapiens
ttgtttaaaagaaatcatagaa

SEQ ID NO: 7376488 - DNA, 22 bp, Homo sapiens
ttgttgtcattgtagaggattt

SEQ ID NO: 7376489 - DNA, 22 bp, Homo sapiens
tttaacatgttcaagaaacata

SEQ ID NO: 7376490 - DNA, 22 bp, Homo sapiens
tttaacttgatcagtagagcat

SEQ ID NO: 7376491 - DNA, 23 bp, Homo sapiens
tttaacatttgaacatgtggcca

SEQ ID NO: 7376492 - DNA, 22 bp, Homo sapiens
tttaacatgttcaagaaacata

SEQ ID NO: 7376493 - DNA, 22 bp, Homo sapiens
tttatctgttgtacatttatgc

SEQ ID NO: 7376494 - DNA, 22 bp, Homo sapiens
tttatctgttgtacctgcattg

SEQ ID NO: 7376495 - DNA, 22 bp, Homo sapiens
tttatctgtatatctcaagtgt

SEQ ID NO: 7376496 - DNA, 22 bp, Homo sapiens
tttatctgctatctgctgtgct

SEQ ID NO: 7376497 - DNA, 22 bp, Homo sapiens
tttagcgtagctgacagctaat

SEQ ID NO: 7376498 - DNA, 22 bp, Homo sapiens
tttagctaagacatagattctt

SEQ ID NO: 7376499 - DNA, 22 bp, Homo sapiens
tttagctatggataacaaccac

SEQ ID NO: 7376500 - DNA, 22 bp, Homo sapiens
tttatgttatgggtaggatcaa

SEQ ID NO: 7376501 - DNA, 22 bp, Homo sapiens
tttattgccctgtagtacagga

SEQ ID NO: 7376502 - DNA, 22 bp, Homo sapiens
tttatgacttctaatctgaagc

SEQ ID NO: 7376503 - DNA, 22 bp, Homo sapiens
tttatgacaagcattactgatt

SEQ ID NO: 7376504 - DNA, 22 bp, Homo sapiens
tttatttataagccacttgctg

SEQ ID NO: 7376505 - DNA, 22 bp, Homo sapiens
tttattgggtgcagtgcccaca

SEQ ID NO: 7376506 - DNA, 22 bp, Homo sapiens
tttattgggcctggaggatcta

SEQ ID NO: 7376507 - DNA, 20 bp, Homo sapiens
tttattggcctttcaggaac

SEQ ID NO: 7376508 - DNA, 22 bp, Homo sapiens
tttattgggtgcagtgcccaca

SEQ ID NO: 7376509 - DNA, 22 bp, Homo sapiens
tttattgggcctggaggatcta

SEQ ID NO: 7376510 - DNA, 22 bp, Homo sapiens
tttattggatatttacaagata

SEQ ID NO: 7376511 - DNA, 22 bp, Homo sapiens
tttattggatatttacaagata

SEQ ID NO: 7376512 - DNA, 20 bp, Homo sapiens
tttattggcctttcaggaac

SEQ ID NO: 7376513 - DNA, 22 bp, Homo sapiens
tttattggatgggtcagctcta

SEQ ID NO: 7376514 - DNA, 22 bp, Homo sapiens
tttattggatggatggatggat

SEQ ID NO: 7376515 - DNA, 22 bp, Homo sapiens
tttattggatggatggatggat

SEQ ID NO: 7376516 - DNA, 22 bp, Homo sapiens
tttattggatgggtcagctcta

SEQ ID NO: 7376517 - DNA, 22 bp, Homo sapiens
tttattgctgtgttagggacag

SEQ ID NO: 7376518 - DNA, 22 bp, Homo sapiens
tttattggaacacagccatgac

SEQ ID NO: 7376519 - DNA, 22 bp, Homo sapiens
tttattggaacacagccatgac

SEQ ID NO: 7376520 - DNA, 22 bp, Homo sapiens
tttattgctcagcagttagttg

SEQ ID NO: 7376521 - DNA, 22 bp, Homo sapiens
tttattgctagcccttggtcca

SEQ ID NO: 7376522 - DNA, 22 bp, Homo sapiens
tttattgctggccacctgtagc

SEQ ID NO: 7376523 - DNA, 22 bp, Homo sapiens
tttgcttgattaggatatggaa

SEQ ID NO: 7376524 - DNA, 22 bp, Homo sapiens
tttgcattctagaaaaatttct

SEQ ID NO: 7376525 - DNA, 22 bp, Homo sapiens
tttgcattgcattaagtattct

SEQ ID NO: 7376526 - DNA, 22 bp, Homo sapiens
tttgcatttgttcaagtattga

SEQ ID NO: 7376527 - DNA, 22 bp, Homo sapiens
tttgcattatctcacttatata

SEQ ID NO: 7376528 - DNA, 22 bp, Homo sapiens
tttgcattatatttatagaaga

SEQ ID NO: 7376529 - DNA, 22 bp, Homo sapiens
tttgcatgggaggtagtaatca

SEQ ID NO: 7376530 - DNA, 20 bp, Homo sapiens
tttgagaccagtctgcccaa

SEQ ID NO: 7376531 - DNA, 22 bp, Homo sapiens
tttgtcatcccttttgaaactg

SEQ ID NO: 7376532 - DNA, 22 bp, Homo sapiens
tttgtcatcagttattaatatg

SEQ ID NO: 7376533 - DNA, 19 bp, Homo sapiens
tttgtcatggtgagttgtt

SEQ ID NO: 7376534 - DNA, 22 bp, Homo sapiens
tttgtcataactctgctgcaag

SEQ ID NO: 7376535 - DNA, 22 bp, Homo sapiens
tttggtaaatgcaggttcttct

SEQ ID NO: 7376536 - DNA, 22 bp, Homo sapiens
tttgtcatgttttgtaatgtct

SEQ ID NO: 7376537 - DNA, 22 bp, Homo sapiens
tttgtcattctgtgtatttaaa

SEQ ID NO: 7376538 - DNA, 22 bp, Homo sapiens
tttgtcatttccctgattaaag

SEQ ID NO: 7376539 - DNA, 22 bp, Homo sapiens
tttgtcatttccctgattaaag

SEQ ID NO: 7376540 - DNA, 21 bp, Homo sapiens
tttgtccacctgtgttcacca

SEQ ID NO: 7376541 - DNA, 22 bp, Homo sapiens
tttggggctcagcaggctgttt

SEQ ID NO: 7376542 - DNA, 22 bp, Homo sapiens
tttgggcatatagctgttccct

SEQ ID NO: 7376543 - DNA, 22 bp, Homo sapiens
tttctattggcgtcactgttgt

SEQ ID NO: 7376544 - DNA, 22 bp, Homo sapiens
tttgaaatatgtgatgagagag

SEQ ID NO: 7376545 - DNA, 22 bp, Homo sapiens
tttgaaatatgaggcattatga

SEQ ID NO: 7376546 - DNA, 22 bp, Homo sapiens
tttgaaatatgtgatgagagag

SEQ ID NO: 7376547 - DNA, 22 bp, Homo sapiens
tttgaaattaagatattgtcca

SEQ ID NO: 7376548 - DNA, 22 bp, Homo sapiens
tttgaaatgtatcagtataggt

SEQ ID NO: 7376549 - DNA, 22 bp, Homo sapiens
tttgaaatgtatcagtataggt

SEQ ID NO: 7376550 - DNA, 22 bp, Homo sapiens
tttctagacatttctatgtaca

SEQ ID NO: 7376551 - DNA, 22 bp, Homo sapiens
tttctagatattcgcagataga

SEQ ID NO: 7376552 - DNA, 22 bp, Homo sapiens
tttctagatattcgcagataga

SEQ ID NO: 7376553 - DNA, 22 bp, Homo sapiens
tttctagagttcatcatggtaa

SEQ ID NO: 7376554 - DNA, 22 bp, Homo sapiens
tttctagtggttaagatttaca

SEQ ID NO: 7376555 - DNA, 22 bp, Homo sapiens
tttctagtaaaagctaattacc

SEQ ID NO: 7376556 - DNA, 22 bp, Homo sapiens
tttctagtaatcaatataaagt

SEQ ID NO: 7376557 - DNA, 22 bp, Homo sapiens
tttctagtcagccatatctagt

SEQ ID NO: 7376558 - DNA, 22 bp, Homo sapiens
tttctagtcctcatgcatcatt

SEQ ID NO: 7376559 - DNA, 22 bp, Homo sapiens
tttgagaagtaattcaagacat

SEQ ID NO: 7376560 - DNA, 19 bp, Homo sapiens
tttgagaagttattatcta

SEQ ID NO: 7376561 - DNA, 22 bp, Homo sapiens
tttgagaaggtgacaaattcta

SEQ ID NO: 7376562 - DNA, 22 bp, Homo sapiens
tttgacattatcctgttactgg

SEQ ID NO: 7376563 - DNA, 22 bp, Homo sapiens
tttgacattgaaagcagaatcg

SEQ ID NO: 7376564 - DNA, 22 bp, Homo sapiens
tttgacattgccaatttgctca

SEQ ID NO: 7376565 - DNA, 22 bp, Homo sapiens
tttgacattgccaatttgctca

SEQ ID NO: 7376566 - DNA, 22 bp, Homo sapiens
tttgacattaaggaacatatat

SEQ ID NO: 7376567 - DNA, 22 bp, Homo sapiens
tttgacatgtgcttataacttt

SEQ ID NO: 7376568 - DNA, 22 bp, Homo sapiens
tttgacatggaataactcattt

SEQ ID NO: 7376569 - DNA, 22 bp, Homo sapiens
tttgacatcactgacctgtttt

SEQ ID NO: 7376570 - DNA, 22 bp, Homo sapiens
tttgacatgaagtagcttataa

SEQ ID NO: 7376571 - DNA, 20 bp, Homo sapiens
tttgacatatacagttcagg

SEQ ID NO: 7376572 - DNA, 22 bp, Homo sapiens
tttgacatctaagaattcttac

SEQ ID NO: 7376573 - DNA, 22 bp, Homo sapiens
tttgacatcaataccctagaat

SEQ ID NO: 7376574 - DNA, 22 bp, Homo sapiens
tttgaagacatattgttacata

SEQ ID NO: 7376575 - DNA, 22 bp, Homo sapiens
tttgaacttctacctgtcatat

SEQ ID NO: 7376576 - DNA, 22 bp, Homo sapiens
tttgaagacagatcaatataag

SEQ ID NO: 7376577 - DNA, 22 bp, Homo sapiens
tttgaactacctctccttagca

SEQ ID NO: 7376578 - DNA, 22 bp, Homo sapiens
tttgaacatgctgcatgataat

SEQ ID NO: 7376579 - DNA, 22 bp, Homo sapiens
tttgaacaggagtatctatagt

SEQ ID NO: 7376580 - DNA, 22 bp, Homo sapiens
tttgaacaagagcttcacatta

SEQ ID NO: 7376581 - DNA, 22 bp, Homo sapiens
tttgaaattggctcattggttt

SEQ ID NO: 7376582 - DNA, 22 bp, Homo sapiens
tttgtgcaagagggccacctta

SEQ ID NO: 7376583 - DNA, 22 bp, Homo sapiens
tttgtgcacattgcttttctat

SEQ ID NO: 7376584 - DNA, 22 bp, Homo sapiens
tttgtggcaggagcggagaccg

SEQ ID NO: 7376585 - DNA, 22 bp, Homo sapiens
tttgtggcaggagcggagaccg

SEQ ID NO: 7376586 - DNA, 22 bp, Homo sapiens
tttgtcttgaggctggggaagt

SEQ ID NO: 7376587 - DNA, 22 bp, Homo sapiens
tttgtcttatccaatctctcag

SEQ ID NO: 7376588 - DNA, 22 bp, Homo sapiens
tttgtccttgaatcaattcaca

SEQ ID NO: 7376589 - DNA, 22 bp, Homo sapiens
tttgtgtagtctgttcccactg

SEQ ID NO: 7376590 - DNA, 22 bp, Homo sapiens
ttttattgtcaatgaagacaga

SEQ ID NO: 7376591 - DNA, 22 bp, Homo sapiens
ttttattgtcaatgaagacaga

SEQ ID NO: 7376592 - DNA, 22 bp, Homo sapiens
ttttattgtctcccagttctgg

SEQ ID NO: 7376593 - DNA, 22 bp, Homo sapiens
ttttattgtctcccagttctgg

SEQ ID NO: 7376594 - DNA, 22 bp, Homo sapiens
ttttattgtctcccagttctgg

SEQ ID NO: 7376595 - DNA, 22 bp, Homo sapiens
ttttattgtctgtattgcctat

SEQ ID NO: 7376596 - DNA, 22 bp, Homo sapiens
ttttcaattttgaggcagtggt

SEQ ID NO: 7376597 - DNA, 16 bp, Homo sapiens
ttttattgtgacagcc

SEQ ID NO: 7376598 - DNA, 22 bp, Homo sapiens
ttttattgtctgtattgcctat

SEQ ID NO: 7376599 - DNA, 16 bp, Homo sapiens
ttttattgtgacagcc

SEQ ID NO: 7376600 - DNA, 22 bp, Homo sapiens
ttttacattgggaaatgcctct

SEQ ID NO: 7376601 - DNA, 22 bp, Homo sapiens
ttttacttcattcctgacttca

SEQ ID NO: 7376602 - DNA, 22 bp, Homo sapiens
ttttattggtaatgataaaagt

SEQ ID NO: 7376603 - DNA, 22 bp, Homo sapiens
ttttattggtaatgataaaagt

SEQ ID NO: 7376604 - DNA, 22 bp, Homo sapiens
ttttagaagtgcctatcctatg

SEQ ID NO: 7376605 - DNA, 22 bp, Homo sapiens
ttttattgggagtcctctactg

SEQ ID NO: 7376606 - DNA, 22 bp, Homo sapiens
ttttattgggagtcctctactg

SEQ ID NO: 7376607 - DNA, 22 bp, Homo sapiens
ttttttatctatggtagtacca

SEQ ID NO: 7376608 - DNA, 22 bp, Homo sapiens
ttttttagttaggtcagaatgt

SEQ ID NO: 7376609 - DNA, 22 bp, Homo sapiens
ttttgtgtgtggtgatacaaag

SEQ ID NO: 7376610 - DNA, 22 bp, Homo sapiens
ttttgtgagctccttggaggta

SEQ ID NO: 7376611 - DNA, 22 bp, Homo sapiens
ttttgtgagctgagaaatgtat

SEQ ID NO: 7376612 - DNA, 22 bp, Homo sapiens
ttttgtaatttcctgacgacta

SEQ ID NO: 7376613 - DNA, 22 bp, Homo sapiens
ttttgtgacacttcttgagaca

SEQ ID NO: 7376614 - DNA, 22 bp, Homo sapiens
ttttgtgaatagtttatctaag

SEQ ID NO: 7376615 - DNA, 22 bp, Homo sapiens
ttttgtgagatgcgtatgaatg

SEQ ID NO: 7376616 - DNA, 22 bp, Homo sapiens
ttttccttcacctcttgagcct

SEQ ID NO: 7376617 - DNA, 22 bp, Homo sapiens
ttttccttagcttctctgcgag

SEQ ID NO: 7376618 - DNA, 22 bp, Homo sapiens
ttttccttcatatcccttatgt

SEQ ID NO: 7376619 - DNA, 22 bp, Homo sapiens
ttttcctactgataaacagtta

SEQ ID NO: 7376620 - DNA, 19 bp, Homo sapiens
ttttcccaccctttagaat

SEQ ID NO: 7376621 - DNA, 22 bp, Homo sapiens
ttttggtcagtgtactgggctg

SEQ ID NO: 7376622 - DNA, 22 bp, Homo sapiens
ttttggtctccaagccatgtgt

SEQ ID NO: 7376623 - DNA, 22 bp, Homo sapiens
ttttccttctagagcagatttc

SEQ ID NO: 7376624 - DNA, 18 bp, Homo sapiens
ttttccttccaccttgaa

SEQ ID NO: 7376625 - DNA, 19 bp, Homo sapiens
ttttccttctatatgtttc

SEQ ID NO: 7376626 - DNA, 22 bp, Homo sapiens
ttttggggagaacggttgctat

SEQ ID NO: 7376627 - DNA, 23 bp, Homo sapiens
agctataaaatctgtgacagcag

SEQ ID NO: 7376628 - DNA, 22 bp, Homo sapiens
agctaggggaccaaggtggccc

SEQ ID NO: 7376629 - DNA, 21 bp, Homo sapiens
acagcaagccttcacatgagt

SEQ ID NO: 7376630 - DNA, 23 bp, Homo sapiens
acagcaagaggaccagatgtgag

SEQ ID NO: 7376631 - DNA, 22 bp, Homo sapiens
agctaggataagcagagactgg

SEQ ID NO: 7376632 - DNA, 20 bp, Homo sapiens
agcctgccagctggcccaga

SEQ ID NO: 7376633 - DNA, 22 bp, Homo sapiens
agcctgcctgtgaggctttgag

SEQ ID NO: 7376634 - DNA, 22 bp, Homo sapiens
agcctgcctcagactcaggata

SEQ ID NO: 7376635 - DNA, 17 bp, Homo sapiens
agcctgccccatgctgc

SEQ ID NO: 7376636 - DNA, 22 bp, Homo sapiens
acagcaaaagacaagaacttaa

SEQ ID NO: 7376637 - DNA, 22 bp, Homo sapiens
acagcaagacccctagcatggt

SEQ ID NO: 7376638 - DNA, 22 bp, Homo sapiens
agcctgcgatcccacctggcct

SEQ ID NO: 7376639 - DNA, 22 bp, Homo sapiens
agctatttctcttattatatcc

SEQ ID NO: 7376640 - DNA, 22 bp, Homo sapiens
acagcaggatttggcgatgttg

SEQ ID NO: 7376641 - DNA, 22 bp, Homo sapiens
acagcaggcacacaaggataga

SEQ ID NO: 7376642 - DNA, 22 bp, Homo sapiens
agctctgggctgacatgctccc

SEQ ID NO: 7376643 - DNA, 22 bp, Homo sapiens
agctctatcacctgtcagttgc

SEQ ID NO: 7376644 - DNA, 22 bp, Homo sapiens
agctcgcccctccctcttattt

SEQ ID NO: 7376645 - DNA, 22 bp, Homo sapiens
agctccttgaagggctctggga

SEQ ID NO: 7376646 - DNA, 22 bp, Homo sapiens
acagataaagaaacaatcacag

SEQ ID NO: 7376647 - DNA, 22 bp, Homo sapiens
acagataaagaaacaatcacag

SEQ ID NO: 7376648 - DNA, 22 bp, Homo sapiens
acagagtctgacaggtaggcgc

SEQ ID NO: 7376649 - DNA, 22 bp, Homo sapiens
acagagtcctagctgcaaagaa

SEQ ID NO: 7376650 - DNA, 19 bp, Homo sapiens
acagagtccagaggaaagg

SEQ ID NO: 7376651 - DNA, 22 bp, Homo sapiens
agcccctgctgggtgtagctca

SEQ ID NO: 7376652 - DNA, 22 bp, Homo sapiens
acagagcatgatggaagatcga

SEQ ID NO: 7376653 - DNA, 22 bp, Homo sapiens
acagagcagttctggagctggc

SEQ ID NO: 7376654 - DNA, 22 bp, Homo sapiens
agcccagcggagcgggcccggg

SEQ ID NO: 7376655 - DNA, 22 bp, Homo sapiens
agcccagctgcctgcctgctgt

SEQ ID NO: 7376656 - DNA, 22 bp, Homo sapiens
agcccagctgctatgtacctgg

SEQ ID NO: 7376657 - DNA, 18 bp, Homo sapiens
agcccagcggagtgaatc

SEQ ID NO: 7376658 - DNA, 22 bp, Homo sapiens
agcccagctcctccacagaata

SEQ ID NO: 7376659 - DNA, 22 bp, Homo sapiens
agcccagctttcacccctctgg

SEQ ID NO: 7376660 - DNA, 19 bp, Homo sapiens
agcccagcttatttgtcag

SEQ ID NO: 7376661 - DNA, 22 bp, Homo sapiens
agcccagcttccttctgtctct

SEQ ID NO: 7376662 - DNA, 17 bp, Homo sapiens
acagagcacatcaagat

SEQ ID NO: 7376663 - DNA, 22 bp, Homo sapiens
agccacagtcaacctgtccata

SEQ ID NO: 7376664 - DNA, 22 bp, Homo sapiens
agccagggtgggtgaatgctat

SEQ ID NO: 7376665 - DNA, 22 bp, Homo sapiens
agccatgtcacatatggtcatc

SEQ ID NO: 7376666 - DNA, 22 bp, Homo sapiens
agccatgtatgagggtttccag

SEQ ID NO: 7376667 - DNA, 22 bp, Homo sapiens
agccattcattgtgctctcaga

SEQ ID NO: 7376668 - DNA, 22 bp, Homo sapiens
agccatgttggggaaggtgggc

SEQ ID NO: 7376669 - DNA, 22 bp, Homo sapiens
agccatgtgtctttattctgtt

SEQ ID NO: 7376670 - DNA, 22 bp, Homo sapiens
agccatgttaaatggacttgat

SEQ ID NO: 7376671 - DNA, 22 bp, Homo sapiens
agccatgggagactgtgggaga

SEQ ID NO: 7376672 - DNA, 22 bp, Homo sapiens
agccatggcgccactagaggga

SEQ ID NO: 7376673 - DNA, 22 bp, Homo sapiens
agcagcaggtgacctcgatgcc

SEQ ID NO: 7376674 - DNA, 22 bp, Homo sapiens
agcagcagtacatataagacta

SEQ ID NO: 7376675 - DNA, 22 bp, Homo sapiens
agcagcagtatccttccccggc

SEQ ID NO: 7376676 - DNA, 22 bp, Homo sapiens
agcagcagtcatgcctatgctc

SEQ ID NO: 7376677 - DNA, 22 bp, Homo sapiens
agcagcagtcctttgtgtaatt

SEQ ID NO: 7376678 - DNA, 22 bp, Homo sapiens
agcagcagtgacagccgaaagc

SEQ ID NO: 7376679 - DNA, 23 bp, Homo sapiens
agcagcagtgagaggtgtcttac

SEQ ID NO: 7376680 - DNA, 22 bp, Homo sapiens
agcagcagtgtggtttggggaa

SEQ ID NO: 7376681 - DNA, 23 bp, Homo sapiens
agcagcagtgagaggtgtcttac

SEQ ID NO: 7376682 - DNA, 22 bp, Homo sapiens
agcagcagtgtgtggtcatgtt

SEQ ID NO: 7376683 - DNA, 22 bp, Homo sapiens
agcagcagtgttctggaattct

SEQ ID NO: 7376684 - DNA, 22 bp, Homo sapiens
acacatatgccattacagcaaa

SEQ ID NO: 7376685 - DNA, 22 bp, Homo sapiens
acacatatctaagatagatgac

SEQ ID NO: 7376686 - DNA, 22 bp, Homo sapiens
acacatatctaagatagatgac

SEQ ID NO: 7376687 - DNA, 23 bp, Homo sapiens
acacatatattcagatacagatg

SEQ ID NO: 7376688 - DNA, 22 bp, Homo sapiens
acacatatatttgcatatacac

SEQ ID NO: 7376689 - DNA, 22 bp, Homo sapiens
acacatatgtatgcatcatgtg

SEQ ID NO: 7376690 - DNA, 22 bp, Homo sapiens
acaatttatccattgtatagtt

SEQ ID NO: 7376691 - DNA, 22 bp, Homo sapiens
acaatttatccattgtatagtt

SEQ ID NO: 7376692 - DNA, 20 bp, Homo sapiens
acaattgtccctgtctgtca

SEQ ID NO: 7376693 - DNA, 22 bp, Homo sapiens
acaattgtgagtatgaagtgat

SEQ ID NO: 7376694 - DNA, 22 bp, Homo sapiens
acaattgtggcaatttgtatgt

SEQ ID NO: 7376695 - DNA, 22 bp, Homo sapiens
acaattctgtggttgtctgtgg

SEQ ID NO: 7376696 - DNA, 22 bp, Homo sapiens
acaattgactgtatttttagct

SEQ ID NO: 7376697 - DNA, 22 bp, Homo sapiens
acaattctgatggtttcccagt

SEQ ID NO: 7376698 - DNA, 22 bp, Homo sapiens
agcaccctttgtgagcataagt

SEQ ID NO: 7376699 - DNA, 22 bp, Homo sapiens
agcacctccttagctatgacca

SEQ ID NO: 7376700 - DNA, 22 bp, Homo sapiens
agcaccctcagccttatccaga

SEQ ID NO: 7376701 - DNA, 22 bp, Homo sapiens
acaatttctaatatagatctta

SEQ ID NO: 7376702 - DNA, 22 bp, Homo sapiens
acaattttccccataggttatc

SEQ ID NO: 7376703 - DNA, 22 bp, Homo sapiens
acacattatctcattaaatact

SEQ ID NO: 7376704 - DNA, 22 bp, Homo sapiens
acacatttgctaaaatgagctc

SEQ ID NO: 7376705 - DNA, 22 bp, Homo sapiens
acaccagggatatgaggaagga

SEQ ID NO: 7376706 - DNA, 23 bp, Homo sapiens
acacatttttcccgttctgaggt

SEQ ID NO: 7376707 - DNA, 22 bp, Homo sapiens
acacattttggctaggtggaga

SEQ ID NO: 7376708 - DNA, 22 bp, Homo sapiens
acacattttcaacactgtcaag

SEQ ID NO: 7376709 - DNA, 22 bp, Homo sapiens
acagaaattctgggacagaaaa

SEQ ID NO: 7376710 - DNA, 22 bp, Homo sapiens
acagaaattcaaactggaattt

SEQ ID NO: 7376711 - DNA, 19 bp, Homo sapiens
acagaaattagttattttc

SEQ ID NO: 7376712 - DNA, 22 bp, Homo sapiens
acagaaattgggcaaatggaag

SEQ ID NO: 7376713 - DNA, 22 bp, Homo sapiens
agcagtggtccccaacctttct

SEQ ID NO: 7376714 - DNA, 22 bp, Homo sapiens
agcagttactagttaaatgcat

SEQ ID NO: 7376715 - DNA, 22 bp, Homo sapiens
agcagttacgggcctatctagg

SEQ ID NO: 7376716 - DNA, 22 bp, Homo sapiens
acactgtgcagattccctgtga

SEQ ID NO: 7376717 - DNA, 22 bp, Homo sapiens
agcagtgggtgacagagctgag

SEQ ID NO: 7376718 - DNA, 22 bp, Homo sapiens
agcagtggtccccaacctttct

SEQ ID NO: 7376719 - DNA, 22 bp, Homo sapiens
agcagtgggtggtttttgagca

SEQ ID NO: 7376720 - DNA, 22 bp, Homo sapiens
agcagtgggggagtgttagttt

SEQ ID NO: 7376721 - DNA, 22 bp, Homo sapiens
agcagtgggggagtgttagttt

SEQ ID NO: 7376722 - DNA, 22 bp, Homo sapiens
agcagtggctggatggtgtgct

SEQ ID NO: 7376723 - DNA, 22 bp, Homo sapiens
acaattctctcatatcttatta

SEQ ID NO: 7376724 - DNA, 22 bp, Homo sapiens
acaattagtgatcagtgatgcc

SEQ ID NO: 7376725 - DNA, 22 bp, Homo sapiens
acaattaccctggcttgataaa

SEQ ID NO: 7376726 - DNA, 22 bp, Homo sapiens
acaattaccctggcttgataaa

SEQ ID NO: 7376727 - DNA, 22 bp, Homo sapiens
acaattagcaaggggaagattt

SEQ ID NO: 7376728 - DNA, 22 bp, Homo sapiens
acaattagctgtgtgtctatct

SEQ ID NO: 7376729 - DNA, 22 bp, Homo sapiens
acaatgttttgaaacatctagg

SEQ ID NO: 7376730 - DNA, 22 bp, Homo sapiens
acaatggcatgctagcaaatgg

SEQ ID NO: 7376731 - DNA, 22 bp, Homo sapiens
agcaagcacacttcatgtgaac

SEQ ID NO: 7376732 - DNA, 18 bp, Homo sapiens
agcaagcagttttcatgt

SEQ ID NO: 7376733 - DNA, 22 bp, Homo sapiens
agcaagctgtcaagagagctga

SEQ ID NO: 7376734 - DNA, 22 bp, Homo sapiens
agcacaggtacggagatgctac

SEQ ID NO: 7376735 - DNA, 18 bp, Homo sapiens
acaaatgtagtgtcttaa

SEQ ID NO: 7376736 - DNA, 22 bp, Homo sapiens
acaaatgtctacattgagaata

SEQ ID NO: 7376737 - DNA, 22 bp, Homo sapiens
acaaatgtctacattgagaata

SEQ ID NO: 7376738 - DNA, 22 bp, Homo sapiens
acaaatgtggacatggataatg

SEQ ID NO: 7376739 - DNA, 22 bp, Homo sapiens
acaaatgtgtctaattgtgcct

SEQ ID NO: 7376740 - DNA, 22 bp, Homo sapiens
acaaatgtggacatggataatg

SEQ ID NO: 7376741 - DNA, 22 bp, Homo sapiens
acaaatgtgattgtttctgaaa

SEQ ID NO: 7376742 - DNA, 22 bp, Homo sapiens
acaaatgttggatttgtcttcc

SEQ ID NO: 7376743 - DNA, 22 bp, Homo sapiens
acaaatgttggatttgtcttcc

SEQ ID NO: 7376744 - DNA, 22 bp, Homo sapiens
acaaattatagaaaattgagct

SEQ ID NO: 7376745 - DNA, 22 bp, Homo sapiens
acaaacagctaacatatgttaa

SEQ ID NO: 7376746 - DNA, 22 bp, Homo sapiens
acaaacatcttgacctcagatt

SEQ ID NO: 7376747 - DNA, 22 bp, Homo sapiens
acaaactaaaattctttattga

SEQ ID NO: 7376748 - DNA, 22 bp, Homo sapiens
acaaacagagttgaaaaatagg

SEQ ID NO: 7376749 - DNA, 22 bp, Homo sapiens
acaaacagctaacatatgttaa

SEQ ID NO: 7376750 - DNA, 20 bp, Homo sapiens
acaaaataggtactgggtag

SEQ ID NO: 7376751 - DNA, 22 bp, Homo sapiens
acaaaattacctagttattttc

SEQ ID NO: 7376752 - DNA, 22 bp, Homo sapiens
acaaaattacctagttattttc

SEQ ID NO: 7376753 - DNA, 22 bp, Homo sapiens
acaaaattatgaagaggccttg

SEQ ID NO: 7376754 - DNA, 22 bp, Homo sapiens
acaaaattacctagttattttc

SEQ ID NO: 7376755 - DNA, 22 bp, Homo sapiens
acaaaattgtgttaaactttat

SEQ ID NO: 7376756 - DNA, 22 bp, Homo sapiens
acaaaatttttagacaaggctt

SEQ ID NO: 7376757 - DNA, 22 bp, Homo sapiens
acaaacttcccagacaagctcc

SEQ ID NO: 7376758 - DNA, 22 bp, Homo sapiens
acaaacttcccagacaagctcc

SEQ ID NO: 7376759 - DNA, 22 bp, Homo sapiens
acaaatatggtactcggagaaa

SEQ ID NO: 7376760 - DNA, 19 bp, Homo sapiens
acaaatagttacatatcct

SEQ ID NO: 7376761 - DNA, 22 bp, Homo sapiens
acaaacttccatcatgaatttt

SEQ ID NO: 7376762 - DNA, 22 bp, Homo sapiens
acaaacttccatcatgaatttt

SEQ ID NO: 7376763 - DNA, 22 bp, Homo sapiens
acaaacttatgtttcatatgta

SEQ ID NO: 7376764 - DNA, 22 bp, Homo sapiens
acaaatgagaatgtagacagag

SEQ ID NO: 7376765 - DNA, 22 bp, Homo sapiens
acaaatgagaatgtagacagag

SEQ ID NO: 7376766 - DNA, 22 bp, Homo sapiens
acaaatgattatcacagaggag

SEQ ID NO: 7376767 - DNA, 19 bp, Homo sapiens
acaaatgatgttgcactga

SEQ ID NO: 7376768 - DNA, 22 bp, Homo sapiens
acaaatgattttccaagccagt

SEQ ID NO: 7376769 - DNA, 22 bp, Homo sapiens
aattttctgatgatgaagcacg

SEQ ID NO: 7376770 - DNA, 22 bp, Homo sapiens
aattttctaaggtgatgatctg

SEQ ID NO: 7376771 - DNA, 22 bp, Homo sapiens
agaggccatctgctctgtgggg

SEQ ID NO: 7376772 - DNA, 22 bp, Homo sapiens
acaaaaagggagatgaggtaga

SEQ ID NO: 7376773 - DNA, 22 bp, Homo sapiens
acaaaaagctccattactgtcc

SEQ ID NO: 7376774 - DNA, 22 bp, Homo sapiens
acaaaatagagttctcccctgg

SEQ ID NO: 7376775 - DNA, 20 bp, Homo sapiens
acaaaataggtactgggtag

SEQ ID NO: 7376776 - DNA, 22 bp, Homo sapiens
agaggccatgctagaggcctgg

SEQ ID NO: 7376777 - DNA, 22 bp, Homo sapiens
agaggccatggggcatttttca

SEQ ID NO: 7376778 - DNA, 22 bp, Homo sapiens
agaggccccaggtgagcatgcc

SEQ ID NO: 7376779 - DNA, 22 bp, Homo sapiens
aatttgtatacatgttacattt

SEQ ID NO: 7376780 - DNA, 22 bp, Homo sapiens
aattttattagaaggcaagggg

SEQ ID NO: 7376781 - DNA, 22 bp, Homo sapiens
aattttattaactggatgtagc

SEQ ID NO: 7376782 - DNA, 22 bp, Homo sapiens
aattttattaactggatgtagc

SEQ ID NO: 7376783 - DNA, 22 bp, Homo sapiens
aatttgttacacagcaatataa

SEQ ID NO: 7376784 - DNA, 22 bp, Homo sapiens
aattttatgccttgcacgttgg

SEQ ID NO: 7376785 - DNA, 22 bp, Homo sapiens
aattttatgccttgcacgttgg

SEQ ID NO: 7376786 - DNA, 22 bp, Homo sapiens
aatgtcatagcatttcttcaat

SEQ ID NO: 7376787 - DNA, 22 bp, Homo sapiens
aatgtcatgggaatttattcat

SEQ ID NO: 7376788 - DNA, 22 bp, Homo sapiens
aatgtcatagcatttcttcaat

SEQ ID NO: 7376789 - DNA, 22 bp, Homo sapiens
aatgtcatattagtttgtgcct

SEQ ID NO: 7376790 - DNA, 22 bp, Homo sapiens
aatgtcattgagctccaatcct

SEQ ID NO: 7376791 - DNA, 22 bp, Homo sapiens
agacagggtgatcgcttgagcc

SEQ ID NO: 7376792 - DNA, 22 bp, Homo sapiens
aatgtattctctttataagata

SEQ ID NO: 7376793 - DNA, 22 bp, Homo sapiens
agacagggtcttgatcagagct

SEQ ID NO: 7376794 - DNA, 22 bp, Homo sapiens
aatgtcatttttaaatgtgaga

SEQ ID NO: 7376795 - DNA, 22 bp, Homo sapiens
aatgtcatttaaagacaaagaa

SEQ ID NO: 7376796 - DNA, 22 bp, Homo sapiens
aatgtcatttaggattatgttt

SEQ ID NO: 7376797 - DNA, 22 bp, Homo sapiens
aatgtcattggtaaagattagg

SEQ ID NO: 7376798 - DNA, 22 bp, Homo sapiens
aatgtcatttaaaataattctg

SEQ ID NO: 7376799 - DNA, 22 bp, Homo sapiens
aatgtcttaaagtcgtgttaca

SEQ ID NO: 7376800 - DNA, 22 bp, Homo sapiens
aatgtcttacatttactgagca

SEQ ID NO: 7376801 - DNA, 22 bp, Homo sapiens
aatgtcttcagtgtatacatgg

SEQ ID NO: 7376802 - DNA, 22 bp, Homo sapiens
aatgtgtttagttaatgagttg

SEQ ID NO: 7376803 - DNA, 22 bp, Homo sapiens
aatgcaagatcaaatctaacac

SEQ ID NO: 7376804 - DNA, 22 bp, Homo sapiens
agaaggggcccaaggatgtcag

SEQ ID NO: 7376805 - DNA, 22 bp, Homo sapiens
aatgcaagtcaatgctataccc

SEQ ID NO: 7376806 - DNA, 22 bp, Homo sapiens
aatgcaaggcctgtatctgatt

SEQ ID NO: 7376807 - DNA, 23 bp, Homo sapiens
agacagaggctgaggctggccgc

SEQ ID NO: 7376808 - DNA, 20 bp, Homo sapiens
aattatataactccaacatt

SEQ ID NO: 7376809 - DNA, 22 bp, Homo sapiens
aattagtattgcgattcattag

SEQ ID NO: 7376810 - DNA, 22 bp, Homo sapiens
aattatatgttaatcttcaatt

SEQ ID NO: 7376811 - DNA, 22 bp, Homo sapiens
aattatatgttaatcttcaatt

SEQ ID NO: 7376812 - DNA, 22 bp, Homo sapiens
aattatatgttaatcttcaatt

SEQ ID NO: 7376813 - DNA, 22 bp, Homo sapiens
aattatattgaagttgaatgtc

SEQ ID NO: 7376814 - DNA, 22 bp, Homo sapiens
aattatgcaaccaatgaccacg

SEQ ID NO: 7376815 - DNA, 22 bp, Homo sapiens
aattatgcaaccaatgaccacg

SEQ ID NO: 7376816 - DNA, 23 bp, Homo sapiens
aattatctatttcaaatttagca

SEQ ID NO: 7376817 - DNA, 23 bp, Homo sapiens
aattatctatttcaaatttagca

SEQ ID NO: 7376818 - DNA, 22 bp, Homo sapiens
aattatattgtggtgtgaatgt

SEQ ID NO: 7376819 - DNA, 22 bp, Homo sapiens
aattatattgtggtgtgaatgt

SEQ ID NO: 7376820 - DNA, 23 bp, Homo sapiens
aatttagtttgagacattagcct

SEQ ID NO: 7376821 - DNA, 22 bp, Homo sapiens
aatttagattgataaacatgga

SEQ ID NO: 7376822 - DNA, 22 bp, Homo sapiens
aattactgatctacaaaatcca

SEQ ID NO: 7376823 - DNA, 22 bp, Homo sapiens
aattacctgtcatacatcaagc

SEQ ID NO: 7376824 - DNA, 22 bp, Homo sapiens
aatgtttcgtaaattgtctatg

SEQ ID NO: 7376825 - DNA, 22 bp, Homo sapiens
aatgtttcatttagttgtctcc

SEQ ID NO: 7376826 - DNA, 22 bp, Homo sapiens
aatgtttcattcttgcccattg

SEQ ID NO: 7376827 - DNA, 22 bp, Homo sapiens
aatgtttaatgttagtggtaat

SEQ ID NO: 7376828 - DNA, 22 bp, Homo sapiens
aatgttgtgtttcagttcaaga

SEQ ID NO: 7376829 - DNA, 22 bp, Homo sapiens
aatgttgatgttttcagtgagc

SEQ ID NO: 7376830 - DNA, 22 bp, Homo sapiens
aatgttgcagagtgattgtcca

SEQ ID NO: 7376831 - DNA, 22 bp, Homo sapiens
aatgttgacctcctgaatgttt

SEQ ID NO: 7376832 - DNA, 22 bp, Homo sapiens
aatgttgagaaatgactactct

SEQ ID NO: 7376833 - DNA, 22 bp, Homo sapiens
aatgttatttctgcatagtagt

SEQ ID NO: 7376834 - DNA, 22 bp, Homo sapiens
aatgttattgtcctttccaaaa

SEQ ID NO: 7376835 - DNA, 22 bp, Homo sapiens
aagggccattgctgagagcagt

SEQ ID NO: 7376836 - DNA, 22 bp, Homo sapiens
aaggctttttcactggtgactc

SEQ ID NO: 7376837 - DNA, 22 bp, Homo sapiens
aaggcttttgttcctatttagt

SEQ ID NO: 7376838 - DNA, 22 bp, Homo sapiens
aaggcttttgggaattttcaac

SEQ ID NO: 7376839 - DNA, 22 bp, Homo sapiens
aaggcttttaactactgtttta

SEQ ID NO: 7376840 - DNA, 22 bp, Homo sapiens
aaggcttttaatgagttagaga

SEQ ID NO: 7376841 - DNA, 22 bp, Homo sapiens
aaggcttttgacggttgcctct

SEQ ID NO: 7376842 - DNA, 22 bp, Homo sapiens
aaggctttgtgggctgcaggca

SEQ ID NO: 7376843 - DNA, 22 bp, Homo sapiens
aaggcttttaaactgtcaagga

SEQ ID NO: 7376844 - DNA, 19 bp, Homo sapiens
aaggctttctgagtgaaaa

SEQ ID NO: 7376845 - DNA, 22 bp, Homo sapiens
aaggctttgaaaaccaaaaggt

SEQ ID NO: 7376846 - DNA, 22 bp, Homo sapiens
aaggctttgattccattgccct

SEQ ID NO: 7376847 - DNA, 22 bp, Homo sapiens
aaggctttggcccgagggaaga

SEQ ID NO: 7376848 - DNA, 22 bp, Homo sapiens
aaggctttgtgctgagttgtcg

SEQ ID NO: 7376849 - DNA, 22 bp, Homo sapiens
aaggctttcctgtaggaagaca

SEQ ID NO: 7376850 - DNA, 22 bp, Homo sapiens
aaggctttccttgggcggttac

SEQ ID NO: 7376851 - DNA, 22 bp, Homo sapiens
aaggctttctcaggccctggaa

SEQ ID NO: 7376852 - DNA, 22 bp, Homo sapiens
aaggctttcagctaacttgatt

SEQ ID NO: 7376853 - DNA, 22 bp, Homo sapiens
aaggctttcagctaacttgatt

SEQ ID NO: 7376854 - DNA, 22 bp, Homo sapiens
aaggctttatgtgaccaaaaga

SEQ ID NO: 7376855 - DNA, 22 bp, Homo sapiens
aaggctttccagaaagtcttga

SEQ ID NO: 7376856 - DNA, 22 bp, Homo sapiens
aagggaaggttccattatactt

SEQ ID NO: 7376857 - DNA, 22 bp, Homo sapiens
aagggaaatggccaggcagaga

SEQ ID NO: 7376858 - DNA, 22 bp, Homo sapiens
aagggactttgtcagctttcca

SEQ ID NO: 7376859 - DNA, 22 bp, Homo sapiens
aagggaagtttgcatcctcact

SEQ ID NO: 7376860 - DNA, 22 bp, Homo sapiens
aaggcatgctgagtcctaaaag

SEQ ID NO: 7376861 - DNA, 22 bp, Homo sapiens
aaggcatctggatggaggagga

SEQ ID NO: 7376862 - DNA, 22 bp, Homo sapiens
aaggcatagtctttaagttctg

SEQ ID NO: 7376863 - DNA, 22 bp, Homo sapiens
aaggcatatattctaaacagga

SEQ ID NO: 7376864 - DNA, 22 bp, Homo sapiens
aaggcatatgcatagaagacag

SEQ ID NO: 7376865 - DNA, 22 bp, Homo sapiens
aaggcatatgctgtgtacagtt

SEQ ID NO: 7376866 - DNA, 22 bp, Homo sapiens
acatgtgtacatatatatgtgc

SEQ ID NO: 7376867 - DNA, 22 bp, Homo sapiens
aaggctgagtaaaacagagaac

SEQ ID NO: 7376868 - DNA, 22 bp, Homo sapiens
aaggctgattagactgatagct

SEQ ID NO: 7376869 - DNA, 22 bp, Homo sapiens
aaggctgggaaacatgcaggcc

SEQ ID NO: 7376870 - DNA, 22 bp, Homo sapiens
acatgtgtggccgctgtagaca

SEQ ID NO: 7376871 - DNA, 22 bp, Homo sapiens
acatgtgtatagcctgtataga

SEQ ID NO: 7376872 - DNA, 22 bp, Homo sapiens
acatgtgtacttttaaggatgt

SEQ ID NO: 7376873 - DNA, 22 bp, Homo sapiens
aaggctttatgactccagtgga

SEQ ID NO: 7376874 - DNA, 22 bp, Homo sapiens
aaggctttaaataaccgtaaag

SEQ ID NO: 7376875 - DNA, 17 bp, Homo sapiens
aaggtgagagctgttct

SEQ ID NO: 7376876 - DNA, 22 bp, Homo sapiens
aaggtgactcacaaagccagtt

SEQ ID NO: 7376877 - DNA, 22 bp, Homo sapiens
aaggtgagagggaaattttcca

SEQ ID NO: 7376878 - DNA, 22 bp, Homo sapiens
aaggtgaggattttgttctgct

SEQ ID NO: 7376879 - DNA, 22 bp, Homo sapiens
aaggtgactcacaaagccagtt

SEQ ID NO: 7376880 - DNA, 22 bp, Homo sapiens
accatgctaaaacatgctgcta

SEQ ID NO: 7376881 - DNA, 22 bp, Homo sapiens
accatgtcatttattggccaaa

SEQ ID NO: 7376882 - DNA, 22 bp, Homo sapiens
accatcagtcattgtcagtggg

SEQ ID NO: 7376883 - DNA, 22 bp, Homo sapiens
aagtacatgttgttcaaaagcc

SEQ ID NO: 7376884 - DNA, 22 bp, Homo sapiens
aagtacattatatgagcagaat

SEQ ID NO: 7376885 - DNA, 22 bp, Homo sapiens
aagtacatgttgctcaacagcc

SEQ ID NO: 7376886 - DNA, 22 bp, Homo sapiens
aagtacattatatgagcagaat

SEQ ID NO: 7376887 - DNA, 21 bp, Homo sapiens
aagtagaagggagaagggtta

SEQ ID NO: 7376888 - DNA, 22 bp, Homo sapiens
accccaggagctgtgcctagtc

SEQ ID NO: 7376889 - DNA, 22 bp, Homo sapiens
accccaggaagtggaggtcatg

SEQ ID NO: 7376890 - DNA, 22 bp, Homo sapiens
aagtagaatctcaggtaggcta

SEQ ID NO: 7376891 - DNA, 22 bp, Homo sapiens
accccaggagctgtgcctagtc

SEQ ID NO: 7376892 - DNA, 22 bp, Homo sapiens
aagtatgaatcaaagactatct

SEQ ID NO: 7376893 - DNA, 22 bp, Homo sapiens
aagtcaatcaagggtgtaggca

SEQ ID NO: 7376894 - DNA, 22 bp, Homo sapiens
aagtcaatttatgttctcagac

SEQ ID NO: 7376895 - DNA, 22 bp, Homo sapiens
aagtcaatttatgttctcagac

SEQ ID NO: 7376896 - DNA, 22 bp, Homo sapiens
aagtcaattagtaaacttggaa

SEQ ID NO: 7376897 - DNA, 22 bp, Homo sapiens
aagtcacaagcatatatgcatt

SEQ ID NO: 7376898 - DNA, 22 bp, Homo sapiens
accccaggtctccaggctctgg

SEQ ID NO: 7376899 - DNA, 22 bp, Homo sapiens
accccaggtccaggttacagag

SEQ ID NO: 7376900 - DNA, 22 bp, Homo sapiens
accccaggtcatctgagagtcc

SEQ ID NO: 7376901 - DNA, 22 bp, Homo sapiens
accccaggtcatctgagagtcc

SEQ ID NO: 7376902 - DNA, 22 bp, Homo sapiens
accccaggtctccaggctctgg

SEQ ID NO: 7376903 - DNA, 22 bp, Homo sapiens
accccaggtccaggttacagag

SEQ ID NO: 7376904 - DNA, 22 bp, Homo sapiens
accccaggcccagggaagaggc

SEQ ID NO: 7376905 - DNA, 22 bp, Homo sapiens
accccaggcccagggaagaggc

SEQ ID NO: 7376906 - DNA, 23 bp, Homo sapiens
accccaggcatcgcattcctctt

SEQ ID NO: 7376907 - DNA, 23 bp, Homo sapiens
accccaggcatcgcattcctctt

SEQ ID NO: 7376908 - DNA, 22 bp, Homo sapiens
accccagggctgccagcctcct

SEQ ID NO: 7376909 - DNA, 22 bp, Homo sapiens
accccagggctgccagcctcct

SEQ ID NO: 7376910 - DNA, 22 bp, Homo sapiens
accccagggctgccagcctcct

SEQ ID NO: 7376911 - DNA, 22 bp, Homo sapiens
aaggaaaggatgagcatgcatt

SEQ ID NO: 7376912 - DNA, 22 bp, Homo sapiens
aaggaaatagatgcagatggta

SEQ ID NO: 7376913 - DNA, 22 bp, Homo sapiens
aaggaaatacaacatgtattca

SEQ ID NO: 7376914 - DNA, 22 bp, Homo sapiens
aaggaaagattctctctctaga

SEQ ID NO: 7376915 - DNA, 22 bp, Homo sapiens
aagctttaagtgtcagtcagcc

SEQ ID NO: 7376916 - DNA, 22 bp, Homo sapiens
aaggaaagacatataaatgact

SEQ ID NO: 7376917 - DNA, 22 bp, Homo sapiens
acaggcagtgggccagatttgt

SEQ ID NO: 7376918 - DNA, 22 bp, Homo sapiens
acaggcattgggatggaggttg

SEQ ID NO: 7376919 - DNA, 22 bp, Homo sapiens
acaggccacagtggagtctctg

SEQ ID NO: 7376920 - DNA, 22 bp, Homo sapiens
acaggcatatttctagattaca

SEQ ID NO: 7376921 - DNA, 22 bp, Homo sapiens
acaggtgtggggctgtggtact

SEQ ID NO: 7376922 - DNA, 22 bp, Homo sapiens
acagggcttagaaatctgttgc

SEQ ID NO: 7376923 - DNA, 22 bp, Homo sapiens
acagtacagctgaaactttagt

SEQ ID NO: 7376924 - DNA, 22 bp, Homo sapiens
acagggctgaggctggcttctt

SEQ ID NO: 7376925 - DNA, 22 bp, Homo sapiens
acagggctggcgttgggacaga

SEQ ID NO: 7376926 - DNA, 22 bp, Homo sapiens
acagggctccttgggctgacac

SEQ ID NO: 7376927 - DNA, 22 bp, Homo sapiens
aagctgccatagaacgagaggt

SEQ ID NO: 7376928 - DNA, 23 bp, Homo sapiens
aagctgccagtctgaagcctggg

SEQ ID NO: 7376929 - DNA, 22 bp, Homo sapiens
aagctgcccaagactgaagcat

SEQ ID NO: 7376930 - DNA, 22 bp, Homo sapiens
aagctgccaatggtaagctgct

SEQ ID NO: 7376931 - DNA, 22 bp, Homo sapiens
aagctgccaccagcccagggca

SEQ ID NO: 7376932 - DNA, 22 bp, Homo sapiens
aagctgccacacggtgagtact

SEQ ID NO: 7376933 - DNA, 22 bp, Homo sapiens
aagctgccagctgagctgaggc

SEQ ID NO: 7376934 - DNA, 22 bp, Homo sapiens
aagctgccagattcagtctgct

SEQ ID NO: 7376935 - DNA, 22 bp, Homo sapiens
aagccagggattcctgagggag

SEQ ID NO: 7376936 - DNA, 22 bp, Homo sapiens
aagccagggtcaggggcctcct

SEQ ID NO: 7376937 - DNA, 22 bp, Homo sapiens
aagccagggtcagaatttgggc

SEQ ID NO: 7376938 - DNA, 22 bp, Homo sapiens
aagccaggggttggtatgctat

SEQ ID NO: 7376939 - DNA, 22 bp, Homo sapiens
aagccagggatggaatgatagg

SEQ ID NO: 7376940 - DNA, 22 bp, Homo sapiens
aagccaggtgtttaggccagcg

SEQ ID NO: 7376941 - DNA, 22 bp, Homo sapiens
aagctcttctgtggatttgagt

SEQ ID NO: 7376942 - DNA, 22 bp, Homo sapiens
aagccagggtttgtggatctat

SEQ ID NO: 7376943 - DNA, 18 bp, Homo sapiens
aagccaggtcaagataag

SEQ ID NO: 7376944 - DNA, 22 bp, Homo sapiens
aagccaggtgttgtggtaagag

SEQ ID NO: 7376945 - DNA, 22 bp, Homo sapiens
aaggaacactacaaggctggga

SEQ ID NO: 7376946 - DNA, 22 bp, Homo sapiens
acagtataactccatgccaccc

SEQ ID NO: 7376947 - DNA, 22 bp, Homo sapiens
aaggaaatgaggttgatggatg

SEQ ID NO: 7376948 - DNA, 22 bp, Homo sapiens
acagtagatggctcagagacag

SEQ ID NO: 7376949 - DNA, 22 bp, Homo sapiens
aaggcacttttctaaagacctt

SEQ ID NO: 7376950 - DNA, 22 bp, Homo sapiens
aaggcacttaacgtgggaggat

SEQ ID NO: 7376951 - DNA, 22 bp, Homo sapiens
aaggcacttgcccagagctgca

SEQ ID NO: 7376952 - DNA, 22 bp, Homo sapiens
aaggcacttttcctgagatgat

SEQ ID NO: 7376953 - DNA, 22 bp, Homo sapiens
aaggcacttgcccagagctgca

SEQ ID NO: 7376954 - DNA, 22 bp, Homo sapiens
aaggcactacgctgctggggcg

SEQ ID NO: 7376955 - DNA, 22 bp, Homo sapiens
aaggcagtaggtgtttcaaact

SEQ ID NO: 7376956 - DNA, 22 bp, Homo sapiens
aaggcagtactttatgtccata

SEQ ID NO: 7376957 - DNA, 22 bp, Homo sapiens
aaggcagtctggtttcaaagca

SEQ ID NO: 7376958 - DNA, 22 bp, Homo sapiens
aaggcagtggctggaaaacctg

SEQ ID NO: 7376959 - DNA, 22 bp, Homo sapiens
aaggcaggatgggaaaagattt

SEQ ID NO: 7376960 - DNA, 22 bp, Homo sapiens
aaggcagctttaaaaaagatgc

SEQ ID NO: 7376961 - DNA, 22 bp, Homo sapiens
aaggcagctttaaaaaagatgc

SEQ ID NO: 7376962 - DNA, 22 bp, Homo sapiens
aaggcagcttcaccacagcatt

SEQ ID NO: 7376963 - DNA, 22 bp, Homo sapiens
aaggcagctcagctcatggcag

SEQ ID NO: 7376964 - DNA, 22 bp, Homo sapiens
aaggcagccttttgagttgatt

SEQ ID NO: 7376965 - DNA, 22 bp, Homo sapiens
aaggcagcctttgtttgattga

SEQ ID NO: 7376966 - DNA, 22 bp, Homo sapiens
aaggcagcctctgccagccggg

SEQ ID NO: 7376967 - DNA, 22 bp, Homo sapiens
aaggcagccgtgtgactgcatg

SEQ ID NO: 7376968 - DNA, 22 bp, Homo sapiens
aaggcagccgtgtgactgcatg

SEQ ID NO: 7376969 - DNA, 21 bp, Homo sapiens
acagttctgccggcatctttc

SEQ ID NO: 7376970 - DNA, 22 bp, Homo sapiens
acagttctgagctataattgct

SEQ ID NO: 7376971 - DNA, 22 bp, Homo sapiens
acagttctgcctgtttgagaag

SEQ ID NO: 7376972 - DNA, 19 bp, Homo sapiens
acagttctaatttctgtgg

SEQ ID NO: 7376973 - DNA, 22 bp, Homo sapiens
aagtggactaatacaaggacta

SEQ ID NO: 7376974 - DNA, 20 bp, Homo sapiens
actaacatttgcaaggggct

SEQ ID NO: 7376975 - DNA, 22 bp, Homo sapiens
aagtcaggacttatgctacctg

SEQ ID NO: 7376976 - DNA, 22 bp, Homo sapiens
aagtgcttggctaatggttatg

SEQ ID NO: 7376977 - DNA, 22 bp, Homo sapiens
aagtcagaaaacagagcaatta

SEQ ID NO: 7376978 - DNA, 22 bp, Homo sapiens
aagtcagacagctgagctgcct

SEQ ID NO: 7376979 - DNA, 22 bp, Homo sapiens
aagtcagaccttgttgatagct

SEQ ID NO: 7376980 - DNA, 22 bp, Homo sapiens
aagtcagagcaactgagacatt

SEQ ID NO: 7376981 - DNA, 22 bp, Homo sapiens
aagtcagagatgccaaagatta

SEQ ID NO: 7376982 - DNA, 22 bp, Homo sapiens
aagtcagagcaactgagacatt

SEQ ID NO: 7376983 - DNA, 22 bp, Homo sapiens
actaatgattattgtcattgtg

SEQ ID NO: 7376984 - DNA, 22 bp, Homo sapiens
actaattgaaatgagactggtg

SEQ ID NO: 7376985 - DNA, 22 bp, Homo sapiens
actaagttgtagtcacacatcc

SEQ ID NO: 7376986 - DNA, 22 bp, Homo sapiens
actacaaaagcactgggtatta

SEQ ID NO: 7376987 - DNA, 22 bp, Homo sapiens
actacaaaagcactgggtatta

SEQ ID NO: 7376988 - DNA, 22 bp, Homo sapiens
actaattgctttcttgtgctga

SEQ ID NO: 7376989 - DNA, 22 bp, Homo sapiens
actaattgaaatgtcctggcca

SEQ ID NO: 7376990 - DNA, 22 bp, Homo sapiens
actaattgagtgcatgatcttt

SEQ ID NO: 7376991 - DNA, 22 bp, Homo sapiens
actaattggaacactttttgcc

SEQ ID NO: 7376992 - DNA, 22 bp, Homo sapiens
actaattgtatagttgatgtaa

SEQ ID NO: 7376993 - DNA, 22 bp, Homo sapiens
aagttattggtggagagcactg

SEQ ID NO: 7376994 - DNA, 22 bp, Homo sapiens
aagtttatgttggtaagatatc

SEQ ID NO: 7376995 - DNA, 22 bp, Homo sapiens
aagttggagctggagctatgga

SEQ ID NO: 7376996 - DNA, 22 bp, Homo sapiens
aagtttaaggtggaagtggtgg

SEQ ID NO: 7376997 - DNA, 22 bp, Homo sapiens
aagtttaacttgaattctttct

SEQ ID NO: 7376998 - DNA, 22 bp, Homo sapiens
aataagaatttacttgtcaaga

SEQ ID NO: 7376999 - DNA, 22 bp, Homo sapiens
aagtttctattattacattcgt

SEQ ID NO: 7377000 - DNA, 22 bp, Homo sapiens
aataagacacacaactgtcaag

SEQ ID NO: 7377001 - DNA, 22 bp, Homo sapiens
aagtttcaaatataaaattaca

SEQ ID NO: 7377002 - DNA, 22 bp, Homo sapiens
aagtttctacatctccatcata

SEQ ID NO: 7377003 - DNA, 22 bp, Homo sapiens
aagtttcatgacttggttatta

SEQ ID NO: 7377004 - DNA, 22 bp, Homo sapiens
aagtttcaaatgttgattatgc

SEQ ID NO: 7377005 - DNA, 22 bp, Homo sapiens
aatacaagatttatagttgttt

SEQ ID NO: 7377006 - DNA, 22 bp, Homo sapiens
aataattacccatctttttgta

SEQ ID NO: 7377007 - DNA, 22 bp, Homo sapiens
aataatgtttatttgtattctc

SEQ ID NO: 7377008 - DNA, 22 bp, Homo sapiens
aataatgttgacgatagtctta

SEQ ID NO: 7377009 - DNA, 22 bp, Homo sapiens
actgccttttccattacttaat

SEQ ID NO: 7377010 - DNA, 20 bp, Homo sapiens
actgcctttaggtatccttg

SEQ ID NO: 7377011 - DNA, 22 bp, Homo sapiens
actgccttgtctcttgcctgtt

SEQ ID NO: 7377012 - DNA, 22 bp, Homo sapiens
actgccttgattgccagtttcc

SEQ ID NO: 7377013 - DNA, 20 bp, Homo sapiens
actgccttggttcagtaggt

SEQ ID NO: 7377014 - DNA, 22 bp, Homo sapiens
aataatagttgcaaagtgttta

SEQ ID NO: 7377015 - DNA, 22 bp, Homo sapiens
actgccttatatgctgtgtgtg

SEQ ID NO: 7377016 - DNA, 22 bp, Homo sapiens
actgccttataatatgtcaaca

SEQ ID NO: 7377017 - DNA, 22 bp, Homo sapiens
actgccttcaaacagcgccacc

SEQ ID NO: 7377018 - DNA, 22 bp, Homo sapiens
actgccttcatgcagacccctg

SEQ ID NO: 7377019 - DNA, 22 bp, Homo sapiens
actgccttgattcatgctgatg

SEQ ID NO: 7377020 - DNA, 22 bp, Homo sapiens
actgccttctttaatcctagtt

SEQ ID NO: 7377021 - DNA, 22 bp, Homo sapiens
actgccttgaaagattgttgag

SEQ ID NO: 7377022 - DNA, 22 bp, Homo sapiens
actgccttctgctcagggttca

SEQ ID NO: 7377023 - DNA, 22 bp, Homo sapiens
actgccttccacctatggatga

SEQ ID NO: 7377024 - DNA, 22 bp, Homo sapiens
actgccttcttggccttcaaaa

SEQ ID NO: 7377025 - DNA, 22 bp, Homo sapiens
actgccttagaacaaagcagga

SEQ ID NO: 7377026 - DNA, 22 bp, Homo sapiens
actgcctgtgtcccttcagtgc

SEQ ID NO: 7377027 - DNA, 19 bp, Homo sapiens
aatccaggataagcccctt

SEQ ID NO: 7377028 - DNA, 22 bp, Homo sapiens
aatccatgcatgcaaggaaagg

SEQ ID NO: 7377029 - DNA, 22 bp, Homo sapiens
aatcctcagaagaaatagcaga

SEQ ID NO: 7377030 - DNA, 22 bp, Homo sapiens
aatcctcagtttaagaatctgt

SEQ ID NO: 7377031 - DNA, 22 bp, Homo sapiens
aatcaaaacctacagaggtaat

SEQ ID NO: 7377032 - DNA, 22 bp, Homo sapiens
aatattttaggctttccaggct

SEQ ID NO: 7377033 - DNA, 22 bp, Homo sapiens
aatcaagaataagttgtaaagc

SEQ ID NO: 7377034 - DNA, 18 bp, Homo sapiens
aatcaagagctggctgta

SEQ ID NO: 7377035 - DNA, 22 bp, Homo sapiens
aatcaagagctgactatatttt

SEQ ID NO: 7377036 - DNA, 22 bp, Homo sapiens
aatatatttgaatcaggaacaa

SEQ ID NO: 7377037 - DNA, 22 bp, Homo sapiens
aatatatttgaatcaggaacaa

SEQ ID NO: 7377038 - DNA, 22 bp, Homo sapiens
aatatcagaatgtaatggtcct

SEQ ID NO: 7377039 - DNA, 22 bp, Homo sapiens
aatattcatttgcagaagaagt

SEQ ID NO: 7377040 - DNA, 22 bp, Homo sapiens
aatatatgagggagctatttga

SEQ ID NO: 7377041 - DNA, 22 bp, Homo sapiens
aatatatgagggagctatttga

SEQ ID NO: 7377042 - DNA, 22 bp, Homo sapiens
aatatatagaagtacccgttgt

SEQ ID NO: 7377043 - DNA, 22 bp, Homo sapiens
aatatatgactccactgcatga

SEQ ID NO: 7377044 - DNA, 22 bp, Homo sapiens
aatatatgactccactgcatga

SEQ ID NO: 7377045 - DNA, 22 bp, Homo sapiens
aatacaatcaaattcactagca

SEQ ID NO: 7377046 - DNA, 22 bp, Homo sapiens
aatacagagaatgttatttgga

SEQ ID NO: 7377047 - DNA, 22 bp, Homo sapiens
aatgaacagtgggtgaggtacc

SEQ ID NO: 7377048 - DNA, 22 bp, Homo sapiens
aatgaacaggtgaatgtcagat

SEQ ID NO: 7377049 - DNA, 22 bp, Homo sapiens
agaaatactaggaatattcata

SEQ ID NO: 7377050 - DNA, 18 bp, Homo sapiens
agaaataccagtattgga

SEQ ID NO: 7377051 - DNA, 18 bp, Homo sapiens
agaaataccagtattgga

SEQ ID NO: 7377052 - DNA, 22 bp, Homo sapiens
agaaaacattacataggtgtgt

SEQ ID NO: 7377053 - DNA, 22 bp, Homo sapiens
agaaaacagaaagtcattggtg

SEQ ID NO: 7377054 - DNA, 22 bp, Homo sapiens
agaaaacataggagacaggaaa

SEQ ID NO: 7377055 - DNA, 22 bp, Homo sapiens
aatgaggcttgtggggtagggc

SEQ ID NO: 7377056 - DNA, 21 bp, Homo sapiens
aatgaggcaaggaggaggata

SEQ ID NO: 7377057 - DNA, 21 bp, Homo sapiens
aatgaggcaaggaggaggata

SEQ ID NO: 7377058 - DNA, 20 bp, Homo sapiens
aatgaggcaatggagggcat

SEQ ID NO: 7377059 - DNA, 20 bp, Homo sapiens
aatgaggcaatggagggcat

SEQ ID NO: 7377060 - DNA, 22 bp, Homo sapiens
aatgaggccagtagaaggaagt

SEQ ID NO: 7377061 - DNA, 22 bp, Homo sapiens
aatgaggctggatttggagctc

SEQ ID NO: 7377062 - DNA, 20 bp, Homo sapiens
aatgagttattttgtatatg

SEQ ID NO: 7377063 - DNA, 22 bp, Homo sapiens
aatgagaaaacacagaggaggt

SEQ ID NO: 7377064 - DNA, 19 bp, Homo sapiens
aatgactgagtacattgtc

SEQ ID NO: 7377065 - DNA, 22 bp, Homo sapiens
aatgactttgaaatatttgagt

SEQ ID NO: 7377066 - DNA, 22 bp, Homo sapiens
aatgacttatgggtgaggagag

SEQ ID NO: 7377067 - DNA, 23 bp, Homo sapiens
aatgagagaccatgtggagcaga

SEQ ID NO: 7377068 - DNA, 22 bp, Homo sapiens
aatgagagaagacaggcaagtg

SEQ ID NO: 7377069 - DNA, 20 bp, Homo sapiens
agaaatactttggtataatg

SEQ ID NO: 7377070 - DNA, 22 bp, Homo sapiens
agaaatactgcctaagactgta

SEQ ID NO: 7377071 - DNA, 22 bp, Homo sapiens
aatgacatggagcatcttttca

SEQ ID NO: 7377072 - DNA, 22 bp, Homo sapiens
aatgactgaagcaattgcagtg

SEQ ID NO: 7377073 - DNA, 22 bp, Homo sapiens
aatgactctgctgcagagacac

SEQ ID NO: 7377074 - DNA, 22 bp, Homo sapiens
aaacaatgtacacatgaatgtt

SEQ ID NO: 7377075 - DNA, 22 bp, Homo sapiens
aaacaatgtacatttataatgc

SEQ ID NO: 7377076 - DNA, 22 bp, Homo sapiens
aaacagtgccaggcagatgcca

SEQ ID NO: 7377077 - DNA, 22 bp, Homo sapiens
aaaggtcaaaatcgtgacattg

SEQ ID NO: 7377078 - DNA, 22 bp, Homo sapiens
aaaggtcattgaaaaggaggaa

SEQ ID NO: 7377079 - DNA, 22 bp, Homo sapiens
aaacagttgttatttttatatg

SEQ ID NO: 7377080 - DNA, 22 bp, Homo sapiens
aaacagtgtgtttcagagaggc

SEQ ID NO: 7377081 - DNA, 22 bp, Homo sapiens
aaacagttacgagcgcagacct

SEQ ID NO: 7377082 - DNA, 22 bp, Homo sapiens
aaacagtgcctggcatggagga

SEQ ID NO: 7377083 - DNA, 22 bp, Homo sapiens
aaagttcactgaccagcactgg

SEQ ID NO: 7377084 - DNA, 22 bp, Homo sapiens
aaagttcagtgccttctataca

SEQ ID NO: 7377085 - DNA, 22 bp, Homo sapiens
aaatgcactctgcttctgtgac

SEQ ID NO: 7377086 - DNA, 21 bp, Homo sapiens
aaagagcttttgtgctagtta

SEQ ID NO: 7377087 - DNA, 22 bp, Homo sapiens
aaattaagggtgagaagagttg

SEQ ID NO: 7377088 - DNA, 20 bp, Homo sapiens
aaattactgccacacatttc

SEQ ID NO: 7377089 - DNA, 22 bp, Homo sapiens
aaattagaaatactttcaaagc

SEQ ID NO: 7377090 - DNA, 22 bp, Homo sapiens
aaattactttacactttcatct

SEQ ID NO: 7377091 - DNA, 20 bp, Homo sapiens
aaattactgccacacatttc

SEQ ID NO: 7377092 - DNA, 22 bp, Homo sapiens
aaagagttgaggcagttatcca

SEQ ID NO: 7377093 - DNA, 22 bp, Homo sapiens
aaagagttctgtttgagctgaa

SEQ ID NO: 7377094 - DNA, 22 bp, Homo sapiens
aaagagttggactttctcaggc

SEQ ID NO: 7377095 - DNA, 22 bp, Homo sapiens
aaattaagagtaactctgtaga

SEQ ID NO: 7377096 - DNA, 22 bp, Homo sapiens
aaagagggacaggcgcagacac

SEQ ID NO: 7377097 - DNA, 22 bp, Homo sapiens
aaagaggggactgttaattcca

SEQ ID NO: 7377098 - DNA, 22 bp, Homo sapiens
aaagagttccaagtcattttat

SEQ ID NO: 7377099 - DNA, 22 bp, Homo sapiens
aaagagttctatgatctttcca

SEQ ID NO: 7377100 - DNA, 22 bp, Homo sapiens
aaagaacatcggagtgggcggg

SEQ ID NO: 7377101 - DNA, 22 bp, Homo sapiens
aaagaagtgttgaatttgcaag

SEQ ID NO: 7377102 - DNA, 22 bp, Homo sapiens
aaagaataccctgggtcataaa

SEQ ID NO: 7377103 - DNA, 22 bp, Homo sapiens
aaagaatactccttttgccttg

SEQ ID NO: 7377104 - DNA, 22 bp, Homo sapiens
aaagaatagttaagtttagggc

SEQ ID NO: 7377105 - DNA, 22 bp, Homo sapiens
aaagaatagcctttgtccaaat

SEQ ID NO: 7377106 - DNA, 22 bp, Homo sapiens
aaactgagattgctgctgtctg

SEQ ID NO: 7377107 - DNA, 22 bp, Homo sapiens
aaacaagtttagaataatgaat

SEQ ID NO: 7377108 - DNA, 22 bp, Homo sapiens
aaacaagtttagaataatgaat

SEQ ID NO: 7377109 - DNA, 23 bp, Homo sapiens
aaacaagtctctcaatggcttgc

SEQ ID NO: 7377110 - DNA, 22 bp, Homo sapiens
aaacaagtttgtagactagcca

SEQ ID NO: 7377111 - DNA, 22 bp, Homo sapiens
aaacaagagtcttgctccacct

SEQ ID NO: 7377112 - DNA, 22 bp, Homo sapiens
aaacaaggcacaattcaggatt

SEQ ID NO: 7377113 - DNA, 22 bp, Homo sapiens
aaaattttgccctatccttcat

SEQ ID NO: 7377114 - DNA, 22 bp, Homo sapiens
aaacaaacaattagttgtgtgg

SEQ ID NO: 7377115 - DNA, 22 bp, Homo sapiens
aaagacattagcttagatgtca

SEQ ID NO: 7377116 - DNA, 22 bp, Homo sapiens
aaagactaaatgaatgagctca

SEQ ID NO: 7377117 - DNA, 22 bp, Homo sapiens
aaaatcctctaattctagaata

SEQ ID NO: 7377118 - DNA, 22 bp, Homo sapiens
aaactagattaccactgctaga

SEQ ID NO: 7377119 - DNA, 22 bp, Homo sapiens
aaaagagaatcctgtacagaga

SEQ ID NO: 7377120 - DNA, 22 bp, Homo sapiens
aaaagagaaagtggcaggcttt

SEQ ID NO: 7377121 - DNA, 22 bp, Homo sapiens
aaaagtaattgtggtttttgct

SEQ ID NO: 7377122 - DNA, 22 bp, Homo sapiens
aaaagtattggccaccatttct

SEQ ID NO: 7377123 - DNA, 22 bp, Homo sapiens
aaagaagggacagactgcctct

SEQ ID NO: 7377124 - DNA, 22 bp, Homo sapiens
aaagacatggaactagagatgg

SEQ ID NO: 7377125 - DNA, 22 bp, Homo sapiens
aaaagtatggtggtccttttta

SEQ ID NO: 7377126 - DNA, 22 bp, Homo sapiens
aaaagtattggccaccatttct

SEQ ID NO: 7377127 - DNA, 22 bp, Homo sapiens
aaaagtattggccaccatttct

SEQ ID NO: 7377128 - DNA, 22 bp, Homo sapiens
aaaagtattggccaccatttct

SEQ ID NO: 7377129 - DNA, 22 bp, Homo sapiens
aaaagtatggtggtccttttta

SEQ ID NO: 7377130 - DNA, 22 bp, Homo sapiens
aaaagtatggtggtccttttta

SEQ ID NO: 7377131 - DNA, 22 bp, Homo sapiens
aaaagtatagggtttggagtca

SEQ ID NO: 7377132 - DNA, 22 bp, Homo sapiens
aaaaatcacttttataggcagc

SEQ ID NO: 7377133 - DNA, 22 bp, Homo sapiens
aaacactgtgggacatcttact

SEQ ID NO: 7377134 - DNA, 22 bp, Homo sapiens
aaaaataggtcaaccgtgtatg

SEQ ID NO: 7377135 - DNA, 22 bp, Homo sapiens
aaaaatcacttttataggcagc

SEQ ID NO: 7377136 - DNA, 22 bp, Homo sapiens
aaaaatcacttttataggcagc

SEQ ID NO: 7377137 - DNA, 22 bp, Homo sapiens
aaaaatcacttttataggcagc

SEQ ID NO: 7377138 - DNA, 22 bp, Homo sapiens
aaaaatagaaggattgactgag

SEQ ID NO: 7377139 - DNA, 22 bp, Homo sapiens
aaaaatagcttctcttgtccct

SEQ ID NO: 7377140 - DNA, 22 bp, Homo sapiens
aaaatgaataagttaacccagg

SEQ ID NO: 7377141 - DNA, 21 bp, Homo sapiens
aaacagagctgagtaatagat

SEQ ID NO: 7377142 - DNA, 22 bp, Homo sapiens
aaacagaagggtaggtaaacat

SEQ ID NO: 7377143 - DNA, 22 bp, Homo sapiens
aaacacttcttaggtcttaagt

SEQ ID NO: 7377144 - DNA, 22 bp, Homo sapiens
aaacactgtgtcaaactggggc

SEQ ID NO: 7377145 - DNA, 22 bp, Homo sapiens
aaaaaagattgatggtggatgc

SEQ ID NO: 7377146 - DNA, 22 bp, Homo sapiens
aaaaaattatcatagttcctga

SEQ ID NO: 7377147 - DNA, 22 bp, Homo sapiens
aaaaaattatcatagttcctga

SEQ ID NO: 7377148 - DNA, 22 bp, Homo sapiens
aaaaaattatcatagttcctga

SEQ ID NO: 7377149 - DNA, 22 bp, Homo sapiens
aaaaaattccattctgtgcctt

SEQ ID NO: 7377150 - DNA, 22 bp, Homo sapiens
aaaaacagaatgtgtctaactc

SEQ ID NO: 7377151 - DNA, 22 bp, Homo sapiens
aaaaacactgggctgggagtca

SEQ ID NO: 7377152 - DNA, 20 bp, Homo sapiens
aaaaacagtaatgctgaaga

SEQ ID NO: 7377153 - DNA, 22 bp, Homo sapiens
aaaaaccattgtcttcagtctc

SEQ ID NO: 7377154 - DNA, 22 bp, Homo sapiens
aaaaacctttcccatactaaga

SEQ ID NO: 7377155 - DNA, 22 bp, Homo sapiens
aaaatagttaacgttcagagta

SEQ ID NO: 7377156 - DNA, 22 bp, Homo sapiens
aaaatcttgactgtttttagaa

SEQ ID NO: 7377157 - DNA, 23 bp, Homo sapiens
aaaatcttctgcctatgaagaaa

SEQ ID NO: 7377158 - DNA, 23 bp, Homo sapiens
aaaatcttctgcctatgaagaaa

SEQ ID NO: 7377159 - DNA, 23 bp, Homo sapiens
aaaatcttctgcctatgaagaaa

SEQ ID NO: 7377160 - DNA, 22 bp, Homo sapiens
aaagctgcccttgtgaaacaag

SEQ ID NO: 7377161 - DNA, 22 bp, Homo sapiens
aaagcttagcattttcaaaatg

SEQ ID NO: 7377162 - DNA, 22 bp, Homo sapiens
aaagctttctagctatgttcta

SEQ ID NO: 7377163 - DNA, 22 bp, Homo sapiens
aaagctttgctggaaggaagag

SEQ ID NO: 7377164 - DNA, 22 bp, Homo sapiens
aaagctttgggtaggaatggga

SEQ ID NO: 7377165 - DNA, 18 bp, Homo sapiens
aaagctgttattccagaa

SEQ ID NO: 7377166 - DNA, 22 bp, Homo sapiens
aacagcagcaagtaagcaggtc

SEQ ID NO: 7377167 - DNA, 22 bp, Homo sapiens
aacagcagcaagtaagcaggtc

SEQ ID NO: 7377168 - DNA, 22 bp, Homo sapiens
aaagcgcatagggggcagcaag

SEQ ID NO: 7377169 - DNA, 22 bp, Homo sapiens
aaagcgcatagggggcagcaag

SEQ ID NO: 7377170 - DNA, 22 bp, Homo sapiens
aaagctcttatgtaaacagaaa

SEQ ID NO: 7377171 - DNA, 22 bp, Homo sapiens
aacagcaatagcactattcatt

SEQ ID NO: 7377172 - DNA, 22 bp, Homo sapiens
aaagccatgaatgttatagagg

SEQ ID NO: 7377173 - DNA, 22 bp, Homo sapiens
aaagccatctgctggttcgcat

SEQ ID NO: 7377174 - DNA, 22 bp, Homo sapiens
aaagccatctgtattaagtgaa

SEQ ID NO: 7377175 - DNA, 22 bp, Homo sapiens
aaagccatgggtctttggcata

SEQ ID NO: 7377176 - DNA, 19 bp, Homo sapiens
aacagcaacttcctagtca

SEQ ID NO: 7377177 - DNA, 22 bp, Homo sapiens
aacagatataggcagaactttg

SEQ ID NO: 7377178 - DNA, 22 bp, Homo sapiens
aaagccagttcttagagaaagc

SEQ ID NO: 7377179 - DNA, 22 bp, Homo sapiens
aaagccagtttctggaagtacc

SEQ ID NO: 7377180 - DNA, 22 bp, Homo sapiens
aaagccatatctattctattct

SEQ ID NO: 7377181 - DNA, 22 bp, Homo sapiens
aaagccataagcctaatactaa

SEQ ID NO: 7377182 - DNA, 22 bp, Homo sapiens
aaagccatcagtaaaatgattt

SEQ ID NO: 7377183 - DNA, 22 bp, Homo sapiens
aaagatcagaggatagctgagt

SEQ ID NO: 7377184 - DNA, 21 bp, Homo sapiens
aaattttcttggctgtagtgt

SEQ ID NO: 7377185 - DNA, 22 bp, Homo sapiens
aaattttagactcctgggtcta

SEQ ID NO: 7377186 - DNA, 22 bp, Homo sapiens
aaattttagtaaggaagttgag

SEQ ID NO: 7377187 - DNA, 22 bp, Homo sapiens
aacaaaacatttgtcttgtttc

SEQ ID NO: 7377188 - DNA, 22 bp, Homo sapiens
aacaaacaaacattttgtcatc

SEQ ID NO: 7377189 - DNA, 22 bp, Homo sapiens
aaagagtttggagacaagatca

SEQ ID NO: 7377190 - DNA, 22 bp, Homo sapiens
aaagtaattgtggtttctgtca

SEQ ID NO: 7377191 - DNA, 22 bp, Homo sapiens
aactaagtcatagagtccctca

SEQ ID NO: 7377192 - DNA, 22 bp, Homo sapiens
aaagtactgggattacaggtct

SEQ ID NO: 7377193 - DNA, 22 bp, Homo sapiens
aactaaaactggtttgttctct

SEQ ID NO: 7377194 - DNA, 22 bp, Homo sapiens
aactaaatctggcatttagagc

SEQ ID NO: 7377195 - DNA, 22 bp, Homo sapiens
aactaaatctggcatttagagc

SEQ ID NO: 7377196 - DNA, 22 bp, Homo sapiens
aactaaatgtgtatctactcaa

SEQ ID NO: 7377197 - DNA, 22 bp, Homo sapiens
aactaaagtaaccaaggatatc

SEQ ID NO: 7377198 - DNA, 22 bp, Homo sapiens
aaaggtttccgagctttaattt

SEQ ID NO: 7377199 - DNA, 22 bp, Homo sapiens
aaaggtttccgagctttaattt

SEQ ID NO: 7377200 - DNA, 22 bp, Homo sapiens
aaaggtttattgattctgctct

SEQ ID NO: 7377201 - DNA, 22 bp, Homo sapiens
aaaggtttattgctatggttgt

SEQ ID NO: 7377202 - DNA, 22 bp, Homo sapiens
aaaggtttatttaatcagggag

SEQ ID NO: 7377203 - DNA, 22 bp, Homo sapiens
aaagggcagagttcactagaaa

SEQ ID NO: 7377204 - DNA, 22 bp, Homo sapiens
aaaggttctacttttaaagaat

SEQ ID NO: 7377205 - DNA, 22 bp, Homo sapiens
aaagggcctccgcctgggcagg

SEQ ID NO: 7377206 - DNA, 22 bp, Homo sapiens
aaagcttttcagtatgttcatg

SEQ ID NO: 7377207 - DNA, 22 bp, Homo sapiens
aaagctttgtaaataaacaggt

SEQ ID NO: 7377208 - DNA, 22 bp, Homo sapiens
aaagctttgtaaataaacaggt

SEQ ID NO: 7377209 - DNA, 22 bp, Homo sapiens
aaagtatatttacttactgtga

SEQ ID NO: 7377210 - DNA, 22 bp, Homo sapiens
aaagtatatatgcactttagaa

SEQ ID NO: 7377211 - DNA, 22 bp, Homo sapiens
aaagtatcaagggaagcatttt

SEQ ID NO: 7377212 - DNA, 22 bp, Homo sapiens
aaagtatatatgcactttagaa

SEQ ID NO: 7377213 - DNA, 22 bp, Homo sapiens
aaagtcaaaatgctctcctgtc

SEQ ID NO: 7377214 - DNA, 22 bp, Homo sapiens
aaagtatttttgacaggcatta

SEQ ID NO: 7377215 - DNA, 22 bp, Homo sapiens
aaagtgctttaggatatttgga

SEQ ID NO: 7377216 - DNA, 22 bp, Homo sapiens
aaagtgctttcccacatttgtt

SEQ ID NO: 7377217 - DNA, 22 bp, Homo sapiens
aaagtcaatgatttctcctgga

SEQ ID NO: 7377218 - DNA, 21 bp, Homo sapiens
aaataaggatagatggtttgg

SEQ ID NO: 7377219 - DNA, 22 bp, Homo sapiens
aaataagtaatgtcttcctttt

SEQ ID NO: 7377220 - DNA, 22 bp, Homo sapiens
aaataatcaatttttgtagata

SEQ ID NO: 7377221 - DNA, 22 bp, Homo sapiens
aaataagttagcagattccagt

SEQ ID NO: 7377222 - DNA, 22 bp, Homo sapiens
aaataagttaaactagaatgat

SEQ ID NO: 7377223 - DNA, 22 bp, Homo sapiens
aaataagttaaactagaatgat

SEQ ID NO: 7377224 - DNA, 22 bp, Homo sapiens
aaataagttaaactagaatgat

SEQ ID NO: 7377225 - DNA, 22 bp, Homo sapiens
aaataagtagtttagtgttgtg

SEQ ID NO: 7377226 - DNA, 22 bp, Homo sapiens
aaataagtgtgggccagtcaaa

SEQ ID NO: 7377227 - DNA, 22 bp, Homo sapiens
aaagtgtggcacaagtcacatc

SEQ ID NO: 7377228 - DNA, 22 bp, Homo sapiens
aaataacagtcagggacaacat

SEQ ID NO: 7377229 - DNA, 22 bp, Homo sapiens
aaagtgttgggattacaggcat

SEQ ID NO: 7377230 - DNA, 22 bp, Homo sapiens
aaataattgagttggtcaatat

SEQ ID NO: 7377231 - DNA, 22 bp, Homo sapiens
aaatagacacatgcgttcatat

SEQ ID NO: 7377232 - DNA, 22 bp, Homo sapiens
aaatagacaggcttaaatagga

SEQ ID NO: 7377233 - DNA, 22 bp, Homo sapiens
aaatagcaatgtgaaaagagga

SEQ ID NO: 7377234 - DNA, 22 bp, Homo sapiens
aaatagatttaacatccatccc

SEQ ID NO: 7377235 - DNA, 23 bp, Homo sapiens
aaataggagtatctggatcatga

SEQ ID NO: 7377236 - DNA, 22 bp, Homo sapiens
aaataggagcttaagcacttct

SEQ ID NO: 7377237 - DNA, 22 bp, Homo sapiens
aaatagcagcctttagttaaca

SEQ ID NO: 7377238 - DNA, 22 bp, Homo sapiens
aaatagcagctttgacagcaca

SEQ ID NO: 7377239 - DNA, 22 bp, Homo sapiens
aaatagcattgtatttagctga

SEQ ID NO: 7377240 - DNA, 22 bp, Homo sapiens
aaatagcattgtatttagctga

SEQ ID NO: 7377241 - DNA, 22 bp, Homo sapiens
aaatgtacaacatccatatata

SEQ ID NO: 7377242 - DNA, 22 bp, Homo sapiens
aaatggcagcccagaggtaagg

SEQ ID NO: 7377243 - DNA, 22 bp, Homo sapiens
aaatggcaggctctttgctagt

SEQ ID NO: 7377244 - DNA, 22 bp, Homo sapiens
aaatgtaagtctttgtttctta

SEQ ID NO: 7377245 - DNA, 18 bp, Homo sapiens
aaatggcagaatggatag

SEQ ID NO: 7377246 - DNA, 22 bp, Homo sapiens
aagcatgggaggcctggaggag

SEQ ID NO: 7377247 - DNA, 22 bp, Homo sapiens
aagcatgaatcgactcggcaac

SEQ ID NO: 7377248 - DNA, 22 bp, Homo sapiens
aaatgtagtatgttgcatgtat

SEQ ID NO: 7377249 - DNA, 22 bp, Homo sapiens
aaatgtagacctatagggacct

SEQ ID NO: 7377250 - DNA, 18 bp, Homo sapiens
aaatgtactgtccatggc

SEQ ID NO: 7377251 - DNA, 22 bp, Homo sapiens
aaatgtattgcataggatattt

SEQ ID NO: 7377252 - DNA, 22 bp, Homo sapiens
aaatgtattgcataggatattt

SEQ ID NO: 7377253 - DNA, 22 bp, Homo sapiens
aaatgtagttgaaaagttaagg

SEQ ID NO: 7377254 - DNA, 22 bp, Homo sapiens
aagctcttttcataagagcaaa

SEQ ID NO: 7377255 - DNA, 22 bp, Homo sapiens
aaatgtattgcataggatattt

SEQ ID NO: 7377256 - DNA, 22 bp, Homo sapiens
aagctcttgagtaaactagttt

SEQ ID NO: 7377257 - DNA, 22 bp, Homo sapiens
aaatcctgtccatttaccagat

SEQ ID NO: 7377258 - DNA, 22 bp, Homo sapiens
aaatgcatatcaaagacttgaa

SEQ ID NO: 7377259 - DNA, 22 bp, Homo sapiens
aagcatcaacactatattgatg

SEQ ID NO: 7377260 - DNA, 22 bp, Homo sapiens
acactggtatgactgttccagt

SEQ ID NO: 7377261 - DNA, 21 bp, Homo sapiens
acactggtgcctgatgtcagg

SEQ ID NO: 7377262 - DNA, 22 bp, Homo sapiens
acactgcatttcaacaaggccc

SEQ ID NO: 7377263 - DNA, 22 bp, Homo sapiens
aagatttactttctttgtaata

SEQ ID NO: 7377264 - DNA, 22 bp, Homo sapiens
aagatttattagatgcttacct

SEQ ID NO: 7377265 - DNA, 22 bp, Homo sapiens
aagatttctctcctggaaagca

SEQ ID NO: 7377266 - DNA, 22 bp, Homo sapiens
aagaggcatctcagcttcctct

SEQ ID NO: 7377267 - DNA, 22 bp, Homo sapiens
acacaggtacacatatgtacct

SEQ ID NO: 7377268 - DNA, 22 bp, Homo sapiens
aagattctgtatttctaacaat

SEQ ID NO: 7377269 - DNA, 22 bp, Homo sapiens
aagcatttcaatataatattca

SEQ ID NO: 7377270 - DNA, 22 bp, Homo sapiens
aagcatttatagataagaattt

SEQ ID NO: 7377271 - DNA, 17 bp, Homo sapiens
aagcatttaatttgcta

SEQ ID NO: 7377272 - DNA, 22 bp, Homo sapiens
aagcatttatagataagaattt

SEQ ID NO: 7377273 - DNA, 22 bp, Homo sapiens
aagcatagagacacaaatttgg

SEQ ID NO: 7377274 - DNA, 19 bp, Homo sapiens
aagcattagccaaagcatt

SEQ ID NO: 7377275 - DNA, 22 bp, Homo sapiens
aagcatttcaggtagagatatt

SEQ ID NO: 7377276 - DNA, 22 bp, Homo sapiens
aagcatttcaatataatattca

SEQ ID NO: 7377277 - DNA, 22 bp, Homo sapiens
aagcatttggcatgaaactctt

SEQ ID NO: 7377278 - DNA, 22 bp, Homo sapiens
acagcagctaacccctgggcca

SEQ ID NO: 7377279 - DNA, 22 bp, Homo sapiens
acagcagctaacccctgggcca

SEQ ID NO: 7377280 - DNA, 22 bp, Homo sapiens
aagcagcatgattgtaatacta

SEQ ID NO: 7377281 - DNA, 22 bp, Homo sapiens
aagcagcatgtgggttatcggg

SEQ ID NO: 7377282 - DNA, 22 bp, Homo sapiens
aagcagagtccccttcccatgg

SEQ ID NO: 7377283 - DNA, 22 bp, Homo sapiens
aagcagagtgatataaacatgg

SEQ ID NO: 7377284 - DNA, 22 bp, Homo sapiens
aagcagcatcctgggcagacct

SEQ ID NO: 7377285 - DNA, 23 bp, Homo sapiens
acagacaacactgatgagagaaa

SEQ ID NO: 7377286 - DNA, 22 bp, Homo sapiens
aagcagcattgtggtaggggag

SEQ ID NO: 7377287 - DNA, 22 bp, Homo sapiens
aagcagctgaaggattcagggt

SEQ ID NO: 7377288 - DNA, 22 bp, Homo sapiens
aagcagctgaaggattcagggt

SEQ ID NO: 7377289 - DNA, 22 bp, Homo sapiens
aagcagctgatttcacagctca

SEQ ID NO: 7377290 - DNA, 22 bp, Homo sapiens
aagcagctgatttcacagctca

SEQ ID NO: 7377291 - DNA, 22 bp, Homo sapiens
acagagtattggaaaggcagtg

SEQ ID NO: 7377292 - DNA, 22 bp, Homo sapiens
aagagagaacacagcttgggca

SEQ ID NO: 7377293 - DNA, 22 bp, Homo sapiens
acaaagatgtttaaagcattta

SEQ ID NO: 7377294 - DNA, 22 bp, Homo sapiens
acaaagatcttgctttcctact

SEQ ID NO: 7377295 - DNA, 22 bp, Homo sapiens
acaaagataagtcagaaagtca

SEQ ID NO: 7377296 - DNA, 22 bp, Homo sapiens
aagacatcagtgatgacatttg

SEQ ID NO: 7377297 - DNA, 22 bp, Homo sapiens
aagacatatagttctccccaag

SEQ ID NO: 7377298 - DNA, 22 bp, Homo sapiens
aagacatgttttaagaatattt

SEQ ID NO: 7377299 - DNA, 22 bp, Homo sapiens
acaaagacgggataaggtttgg

SEQ ID NO: 7377300 - DNA, 22 bp, Homo sapiens
aagacattactggaatctgact

SEQ ID NO: 7377301 - DNA, 22 bp, Homo sapiens
acaaagagggaccagtgacttg

SEQ ID NO: 7377302 - DNA, 22 bp, Homo sapiens
acaaagagaccatgagccaaac

SEQ ID NO: 7377303 - DNA, 20 bp, Homo sapiens
acaaggaaccaggaggtggc

SEQ ID NO: 7377304 - DNA, 22 bp, Homo sapiens
aagagatgtgggctgctgtgca

SEQ ID NO: 7377305 - DNA, 22 bp, Homo sapiens
aagagattcctcactcagaatg

SEQ ID NO: 7377306 - DNA, 22 bp, Homo sapiens
aagagatgatggcagccagagg

SEQ ID NO: 7377307 - DNA, 22 bp, Homo sapiens
aagagatgctttacatcggatg

SEQ ID NO: 7377308 - DNA, 22 bp, Homo sapiens
aagagaggggttgcatggaaat

SEQ ID NO: 7377309 - DNA, 22 bp, Homo sapiens
aagagagggatttggtttattg

SEQ ID NO: 7377310 - DNA, 22 bp, Homo sapiens
aagagctgattaagtcatgagg

SEQ ID NO: 7377311 - DNA, 22 bp, Homo sapiens
aagagctgattaagtcatgagg

SEQ ID NO: 7377312 - DNA, 19 bp, Homo sapiens
aagagcagggaaagaattg

SEQ ID NO: 7377313 - DNA, 22 bp, Homo sapiens
acaaggcagtacaatgatgaca

SEQ ID NO: 7377314 - DNA, 22 bp, Homo sapiens
acaaggcactttatgaagagga

SEQ ID NO: 7377315 - DNA, 21 bp, Homo sapiens
aagagctggatcaaggataag

SEQ ID NO: 7377316 - DNA, 22 bp, Homo sapiens
aagagctggcccaatctgagca

SEQ ID NO: 7377317 - DNA, 22 bp, Homo sapiens
aagagctggatgaagaaatcaa

SEQ ID NO: 7377318 - DNA, 22 bp, Homo sapiens
aagaaatacatggtttttgagt

SEQ ID NO: 7377319 - DNA, 22 bp, Homo sapiens
aagaaatacatggtttttgagt

SEQ ID NO: 7377320 - DNA, 22 bp, Homo sapiens
aagaaataagacttctctgtcc

SEQ ID NO: 7377321 - DNA, 22 bp, Homo sapiens
aagaaatattgggccttataaa

SEQ ID NO: 7377322 - DNA, 22 bp, Homo sapiens
aagaaatattgggccttataaa

SEQ ID NO: 7377323 - DNA, 22 bp, Homo sapiens
aacttcatgggttcaaagctgg

SEQ ID NO: 7377324 - DNA, 22 bp, Homo sapiens
aacttcagttgagaaaggcatg

SEQ ID NO: 7377325 - DNA, 22 bp, Homo sapiens
aacttcagggacagaaaagagc

SEQ ID NO: 7377326 - DNA, 22 bp, Homo sapiens
aatgttttacagatcccattag

SEQ ID NO: 7377327 - DNA, 22 bp, Homo sapiens
aatgttttagattactgctggg

SEQ ID NO: 7377328 - DNA, 22 bp, Homo sapiens
aatgttttaaaagagattgaga

SEQ ID NO: 7377329 - DNA, 22 bp, Homo sapiens
aagaaatggcttcatctgagta

SEQ ID NO: 7377330 - DNA, 22 bp, Homo sapiens
aagaaatgcagaaatgtgctgg

SEQ ID NO: 7377331 - DNA, 22 bp, Homo sapiens
aagaaatggaagatccatggtg

SEQ ID NO: 7377332 - DNA, 22 bp, Homo sapiens
aagacagatgcaacctgctagc

SEQ ID NO: 7377333 - DNA, 22 bp, Homo sapiens
aagacaggaacatagcaaatcc

SEQ ID NO: 7377334 - DNA, 22 bp, Homo sapiens
aattgttgagcataaattatcg

SEQ ID NO: 7377335 - DNA, 17 bp, Homo sapiens
aattgtcagcagtagct

SEQ ID NO: 7377336 - DNA, 22 bp, Homo sapiens
aattgtgaacctttacagttgt

SEQ ID NO: 7377337 - DNA, 22 bp, Homo sapiens
aattgtcttctccttcctggca

SEQ ID NO: 7377338 - DNA, 22 bp, Homo sapiens
aattgtcttgaaagcaacactt

SEQ ID NO: 7377339 - DNA, 22 bp, Homo sapiens
aattgtcaaaaattgcaattgt

SEQ ID NO: 7377340 - DNA, 22 bp, Homo sapiens
aattgtcaaacacaaataagag

SEQ ID NO: 7377341 - DNA, 22 bp, Homo sapiens
aagaataaattaagatacttag

SEQ ID NO: 7377342 - DNA, 22 bp, Homo sapiens
aagaataacacttaggttttgc

SEQ ID NO: 7377343 - DNA, 18 bp, Homo sapiens
aagaagttggccaaagag

SEQ ID NO: 7377344 - DNA, 20 bp, Homo sapiens
aagaagttggtaagcagtgc

SEQ ID NO: 7377345 - DNA, 23 bp, Homo sapiens
aagaataaatgacattaaaggtg

SEQ ID NO: 7377346 - DNA, 22 bp, Homo sapiens
aagaataagtagatgggagaag

SEQ ID NO: 7377347 - DNA, 22 bp, Homo sapiens
aagaataagaggatttagaaca

SEQ ID NO: 7377348 - DNA, 22 bp, Homo sapiens
aattggaaaatgctacatatca

SEQ ID NO: 7377349 - DNA, 22 bp, Homo sapiens
aacagcagggatggggtggcca

SEQ ID NO: 7377350 - DNA, 22 bp, Homo sapiens
aacagcagggacttgaatggaa

SEQ ID NO: 7377351 - DNA, 22 bp, Homo sapiens
aacagcagggaaattccaagtc

SEQ ID NO: 7377352 - DNA, 22 bp, Homo sapiens
aacagcagttacttttgcatca

SEQ ID NO: 7377353 - DNA, 22 bp, Homo sapiens
aacagaggctccctgcacttgt

SEQ ID NO: 7377354 - DNA, 22 bp, Homo sapiens
aacagcaggcaccaaggctatg

SEQ ID NO: 7377355 - DNA, 22 bp, Homo sapiens
aacagcaggcaccaaggctatg

SEQ ID NO: 7377356 - DNA, 22 bp, Homo sapiens
aacaggaatgaggagaaaaggt

SEQ ID NO: 7377357 - DNA, 22 bp, Homo sapiens
aagtccaggctggcgtagagtc

SEQ ID NO: 7377358 - DNA, 22 bp, Homo sapiens
aagtccaggtccaggaggttcc

SEQ ID NO: 7377359 - DNA, 17 bp, Homo sapiens
aagtccagagttgagca

SEQ ID NO: 7377360 - DNA, 22 bp, Homo sapiens
aagtccagcatttgggtagatt

SEQ ID NO: 7377361 - DNA, 22 bp, Homo sapiens
aagtccagctctaaatatctga

SEQ ID NO: 7377362 - DNA, 22 bp, Homo sapiens
aagtccaaggctgggtgcagtg

SEQ ID NO: 7377363 - DNA, 22 bp, Homo sapiens
aagtccaaggtcaccattcaca

SEQ ID NO: 7377364 - DNA, 22 bp, Homo sapiens
aagtcatcttgagtctaagatt

SEQ ID NO: 7377365 - DNA, 22 bp, Homo sapiens
aagtcatgtggaagaataacct

SEQ ID NO: 7377366 - DNA, 22 bp, Homo sapiens
aacaaatggaacacaaatcttt

SEQ ID NO: 7377367 - DNA, 22 bp, Homo sapiens
aacaaatggaacacaaatcttt

SEQ ID NO: 7377368 - DNA, 22 bp, Homo sapiens
aacaaatggggccttgtatgaa

SEQ ID NO: 7377369 - DNA, 22 bp, Homo sapiens
aacaaatgattgttggttggag

SEQ ID NO: 7377370 - DNA, 22 bp, Homo sapiens
aacaaatgacctgatttcttcc

SEQ ID NO: 7377371 - DNA, 22 bp, Homo sapiens
aacactcaatttacaaactctg

SEQ ID NO: 7377372 - DNA, 22 bp, Homo sapiens
aacaaatgtaaaatgcagatgc

SEQ ID NO: 7377373 - DNA, 22 bp, Homo sapiens
aacaaatgtaaaatgcagatgc

SEQ ID NO: 7377374 - DNA, 22 bp, Homo sapiens
aacaccttgcagggattatgac

SEQ ID NO: 7377375 - DNA, 19 bp, Homo sapiens
aacaccagagtcaggagtc

SEQ ID NO: 7377376 - DNA, 22 bp, Homo sapiens
aaggtcattttttcctctgttg

SEQ ID NO: 7377377 - DNA, 22 bp, Homo sapiens
aaggtcatggcaaattactttt

SEQ ID NO: 7377378 - DNA, 22 bp, Homo sapiens
aaggtcatttaacaatttatga

SEQ ID NO: 7377379 - DNA, 22 bp, Homo sapiens
aaggtcattggttctgaattct

SEQ ID NO: 7377380 - DNA, 23 bp, Homo sapiens
aaggtcacagaacttagcaagcc

SEQ ID NO: 7377381 - DNA, 22 bp, Homo sapiens
aacactgaaatgtcttaagatt

SEQ ID NO: 7377382 - DNA, 22 bp, Homo sapiens
aacactgaaatgtcttaagatt

SEQ ID NO: 7377383 - DNA, 22 bp, Homo sapiens
aacactgaagtagtgaatactg

SEQ ID NO: 7377384 - DNA, 22 bp, Homo sapiens
aacactgacctctaccctcagt

SEQ ID NO: 7377385 - DNA, 22 bp, Homo sapiens
aacactgacctctaccctcagt

SEQ ID NO: 7377386 - DNA, 22 bp, Homo sapiens
aacactgacgacgtgaactaaa

SEQ ID NO: 7377387 - DNA, 22 bp, Homo sapiens
aacactgacgacgtgaactaaa

SEQ ID NO: 7377388 - DNA, 20 bp, Homo sapiens
aacactgaggcctactcttc

SEQ ID NO: 7377389 - DNA, 22 bp, Homo sapiens
aaggtatagcttgcatacagaa

SEQ ID NO: 7377390 - DNA, 22 bp, Homo sapiens
aaggtatatgtacaatagacat

SEQ ID NO: 7377391 - DNA, 22 bp, Homo sapiens
aaatgttcaccagatccatgac

SEQ ID NO: 7377392 - DNA, 22 bp, Homo sapiens
aaatgttcatttctcactcaca

SEQ ID NO: 7377393 - DNA, 22 bp, Homo sapiens
aaatgttcccaatatgaagctg

SEQ ID NO: 7377394 - DNA, 22 bp, Homo sapiens
aaatgtgttcctttgctacaga

SEQ ID NO: 7377395 - DNA, 22 bp, Homo sapiens
aaatgtgtttcgaaaactggtg

SEQ ID NO: 7377396 - DNA, 22 bp, Homo sapiens
aaatgtgtttagatggtttatt

SEQ ID NO: 7377397 - DNA, 22 bp, Homo sapiens
aaatgtgtttgataggaatatt

SEQ ID NO: 7377398 - DNA, 22 bp, Homo sapiens
aaatgttaggttgtactgagtc

SEQ ID NO: 7377399 - DNA, 22 bp, Homo sapiens
aaatgtgtttgataggaatatt

SEQ ID NO: 7377400 - DNA, 22 bp, Homo sapiens
aaatgtttctacttgtgagcat

SEQ ID NO: 7377401 - DNA, 22 bp, Homo sapiens
aaattcacttgcctgcttagct

SEQ ID NO: 7377402 - DNA, 22 bp, Homo sapiens
aaatgtctacttcccatctgta

SEQ ID NO: 7377403 - DNA, 22 bp, Homo sapiens
aaatgtgcatgagtcagaagtg

SEQ ID NO: 7377404 - DNA, 22 bp, Homo sapiens
aaatgtgcatgagtcagaagtg

SEQ ID NO: 7377405 - DNA, 22 bp, Homo sapiens
aaatgtctatctggcatattcc

SEQ ID NO: 7377406 - DNA, 22 bp, Homo sapiens
aaatgtctatctggcatattcc

SEQ ID NO: 7377407 - DNA, 22 bp, Homo sapiens
aaatgtgtgcacaaagacagct

SEQ ID NO: 7377408 - DNA, 22 bp, Homo sapiens
aaatgtgtcatattcaaagtca

SEQ ID NO: 7377409 - DNA, 22 bp, Homo sapiens
aaatgtgtgcacaaagacagct

SEQ ID NO: 7377410 - DNA, 21 bp, Homo sapiens
aaatgtgttccataatgcttt

SEQ ID NO: 7377411 - DNA, 22 bp, Homo sapiens
aaatgtgttcctttgctacaga

SEQ ID NO: 7377412 - DNA, 22 bp, Homo sapiens
aaatgtgtgtatgtacatatat

SEQ ID NO: 7377413 - DNA, 22 bp, Homo sapiens
aaatgtgtgtatgtacatatat

SEQ ID NO: 7377414 - DNA, 22 bp, Homo sapiens
aaatgtgtatatgaaacatgat

SEQ ID NO: 7377415 - DNA, 22 bp, Homo sapiens
aaatgtgtcagtttcattctct

SEQ ID NO: 7377416 - DNA, 22 bp, Homo sapiens
aaatgtgtcagtttcattctct

SEQ ID NO: 7377417 - DNA, 22 bp, Homo sapiens
aaattctatgtcaatgtttatt

SEQ ID NO: 7377418 - DNA, 22 bp, Homo sapiens
aaattctatgtcaatgtttatt

SEQ ID NO: 7377419 - DNA, 22 bp, Homo sapiens
aaattctgatttaataagtgta

SEQ ID NO: 7377420 - DNA, 19 bp, Homo sapiens
aaattctgacagtctttta

SEQ ID NO: 7377421 - DNA, 22 bp, Homo sapiens
aaattgagctcatttcctctgt

SEQ ID NO: 7377422 - DNA, 22 bp, Homo sapiens
aaattgcaaaagtacttttagg

SEQ ID NO: 7377423 - DNA, 22 bp, Homo sapiens
aaattgaatttgggaaacattg

SEQ ID NO: 7377424 - DNA, 20 bp, Homo sapiens
aacaaactacaaaattatgt

SEQ ID NO: 7377425 - DNA, 22 bp, Homo sapiens
aacaaacattacctggtgctgg

SEQ ID NO: 7377426 - DNA, 22 bp, Homo sapiens
aaattttagaccaggcaaaact

SEQ ID NO: 7377427 - DNA, 22 bp, Homo sapiens
aacaaacagttaagtgtggatg

SEQ ID NO: 7377428 - DNA, 22 bp, Homo sapiens
aacaaagcaccactgagtcagt

SEQ ID NO: 7377429 - DNA, 22 bp, Homo sapiens
aacaaagatgggtgggaaagag

SEQ ID NO: 7377430 - DNA, 22 bp, Homo sapiens
aacaggcaacagttgactctga

SEQ ID NO: 7377431 - DNA, 22 bp, Homo sapiens
aacagtaaaaatcatttagttg

SEQ ID NO: 7377432 - DNA, 22 bp, Homo sapiens
aacagtaaagacagaatttatc

SEQ ID NO: 7377433 - DNA, 22 bp, Homo sapiens
aacatgctctggattgctgtga

SEQ ID NO: 7377434 - DNA, 22 bp, Homo sapiens
aacatgctcttcctggctagtc

SEQ ID NO: 7377435 - DNA, 22 bp, Homo sapiens
aacatgctctgtttcttggatg

SEQ ID NO: 7377436 - DNA, 18 bp, Homo sapiens
aacatgcattagaactgc

SEQ ID NO: 7377437 - DNA, 22 bp, Homo sapiens
aaccaaagaaaactgtggtgag

SEQ ID NO: 7377438 - DNA, 22 bp, Homo sapiens
aaccaaaggaacctgattttct

SEQ ID NO: 7377439 - DNA, 22 bp, Homo sapiens
aataagaactccatttactcgt

SEQ ID NO: 7377440 - DNA, 21 bp, Homo sapiens
aacatttcaggatccaaattg

SEQ ID NO: 7377441 - DNA, 22 bp, Homo sapiens
aataagaaagagtcagcttcag

SEQ ID NO: 7377442 - DNA, 22 bp, Homo sapiens
aataacttgaagatctcttcca

SEQ ID NO: 7377443 - DNA, 22 bp, Homo sapiens
aataacttcatcttcaggatag

SEQ ID NO: 7377444 - DNA, 22 bp, Homo sapiens
aaccaacataggaatgcagaga

SEQ ID NO: 7377445 - DNA, 22 bp, Homo sapiens
aaccactggtctgaggtacaag

SEQ ID NO: 7377446 - DNA, 22 bp, Homo sapiens
aaccagaaggaatctgagctga

SEQ ID NO: 7377447 - DNA, 22 bp, Homo sapiens
aaccagaaggaatctgagctga

SEQ ID NO: 7377448 - DNA, 22 bp, Homo sapiens
aatagtttgaatttatcagatg

SEQ ID NO: 7377449 - DNA, 22 bp, Homo sapiens
aacgtgcattaggacctctcca

SEQ ID NO: 7377450 - DNA, 22 bp, Homo sapiens
aacgtcttctctccaagtaaat

SEQ ID NO: 7377451 - DNA, 22 bp, Homo sapiens
aactacattttacagaagatga

SEQ ID NO: 7377452 - DNA, 22 bp, Homo sapiens
aactgaaacttaggaagtaatc

SEQ ID NO: 7377453 - DNA, 22 bp, Homo sapiens
aatgatatgcaaattatcatca

SEQ ID NO: 7377454 - DNA, 22 bp, Homo sapiens
aatgatatgcaaattatcatca

SEQ ID NO: 7377455 - DNA, 22 bp, Homo sapiens
aatgatatagcagacatagcct

SEQ ID NO: 7377456 - DNA, 22 bp, Homo sapiens
aatgatcattataaagtgctct

SEQ ID NO: 7377457 - DNA, 22 bp, Homo sapiens
aatgatcacctggtaaagagag

SEQ ID NO: 7377458 - DNA, 22 bp, Homo sapiens
aatgatcactgcagttgatgag

SEQ ID NO: 7377459 - DNA, 20 bp, Homo sapiens
aatgatcagcatagcaagga

SEQ ID NO: 7377460 - DNA, 22 bp, Homo sapiens
aactgcttagtgatggatgacc

SEQ ID NO: 7377461 - DNA, 22 bp, Homo sapiens
aactgcttcacttggcatttgg

SEQ ID NO: 7377462 - DNA, 22 bp, Homo sapiens
aactgcctggccaggctgcaac

SEQ ID NO: 7377463 - DNA, 22 bp, Homo sapiens
aactgcctgtaaaatcttgggt

SEQ ID NO: 7377464 - DNA, 22 bp, Homo sapiens
aactgctaactggtttgatact

SEQ ID NO: 7377465 - DNA, 22 bp, Homo sapiens
aacttaggaaaataaggcatga

SEQ ID NO: 7377466 - DNA, 23 bp, Homo sapiens
aacttaatactgggataagatgc

SEQ ID NO: 7377467 - DNA, 22 bp, Homo sapiens
aacttaatgatttcatgcatgt

SEQ ID NO: 7377468 - DNA, 22 bp, Homo sapiens
cacacacagttttgtattctgt

SEQ ID NO: 7377469 - DNA, 22 bp, Homo sapiens
agcagctgctccacttgcttaa

SEQ ID NO: 7377470 - DNA, 21 bp, Homo sapiens
agcagctgcagtttctatctg

SEQ ID NO: 7377471 - DNA, 22 bp, Homo sapiens
agcagctgccactggaatagga

SEQ ID NO: 7377472 - DNA, 22 bp, Homo sapiens
agcagctgccagagagagttcc

SEQ ID NO: 7377473 - DNA, 22 bp, Homo sapiens
agcagctgatggggaaggagtt

SEQ ID NO: 7377474 - DNA, 22 bp, Homo sapiens
agcagctgatggggaaggagtt

SEQ ID NO: 7377475 - DNA, 22 bp, Homo sapiens
agcagctgatcaaagcacttat

SEQ ID NO: 7377476 - DNA, 22 bp, Homo sapiens
agcagctgcagggagggtctgc

SEQ ID NO: 7377477 - DNA, 22 bp, Homo sapiens
agcagctgcagggagggtctgc

SEQ ID NO: 7377478 - DNA, 22 bp, Homo sapiens
agcagctgcagagggctccccc

SEQ ID NO: 7377479 - DNA, 22 bp, Homo sapiens
agcaggagcatttccatgattc

SEQ ID NO: 7377480 - DNA, 22 bp, Homo sapiens
cacacactggagcaaggagatg

SEQ ID NO: 7377481 - DNA, 22 bp, Homo sapiens
cacacactgttaatgtaggagt

SEQ ID NO: 7377482 - DNA, 22 bp, Homo sapiens
agcaggagtgtcccctggctgt

SEQ ID NO: 7377483 - DNA, 22 bp, Homo sapiens
cacacaccaatcaaatgtcaga

SEQ ID NO: 7377484 - DNA, 22 bp, Homo sapiens
cacacacagttttgtattctgt

SEQ ID NO: 7377485 - DNA, 22 bp, Homo sapiens
agcaggcacgctccctgcgcga

SEQ ID NO: 7377486 - DNA, 22 bp, Homo sapiens
agcaggcaccagggctcgtcct

SEQ ID NO: 7377487 - DNA, 22 bp, Homo sapiens
agcaggcacaagaaagggaggt

SEQ ID NO: 7377488 - DNA, 22 bp, Homo sapiens
agcaggagtttgatgcttttat

SEQ ID NO: 7377489 - DNA, 22 bp, Homo sapiens
agcaggagtttgatgcttttat

SEQ ID NO: 7377490 - DNA, 21 bp, Homo sapiens
agcaggcaaaggtgaagtctt

SEQ ID NO: 7377491 - DNA, 22 bp, Homo sapiens
agcaggcaaggtccgtgcctcg

SEQ ID NO: 7377492 - DNA, 22 bp, Homo sapiens
agcaggcaggaaggcagcactg

SEQ ID NO: 7377493 - DNA, 22 bp, Homo sapiens
agcaggcagccatttggaaggc

SEQ ID NO: 7377494 - DNA, 22 bp, Homo sapiens
agcaggcagccatttggaaggc

SEQ ID NO: 7377495 - DNA, 22 bp, Homo sapiens
agcaggcagcctaggaagtgaa

SEQ ID NO: 7377496 - DNA, 22 bp, Homo sapiens
cacagtttgcataggaaaaaca

SEQ ID NO: 7377497 - DNA, 22 bp, Homo sapiens
agcaggctccaggctggccatc

SEQ ID NO: 7377498 - DNA, 22 bp, Homo sapiens
cacccaggctggagtgcagtga

SEQ ID NO: 7377499 - DNA, 22 bp, Homo sapiens
cacccaggctggagtgcagggg

SEQ ID NO: 7377500 - DNA, 22 bp, Homo sapiens
cacccaggctggagtgcagtgg

SEQ ID NO: 7377501 - DNA, 22 bp, Homo sapiens
cacccaggctggagtgcagtga

SEQ ID NO: 7377502 - DNA, 22 bp, Homo sapiens
agcagggtgtggtggccctgga

SEQ ID NO: 7377503 - DNA, 22 bp, Homo sapiens
agcagggggagttagactagat

SEQ ID NO: 7377504 - DNA, 22 bp, Homo sapiens
agcagggggcatccttgccctt

SEQ ID NO: 7377505 - DNA, 22 bp, Homo sapiens
agcaggggcagggttttgtgct

SEQ ID NO: 7377506 - DNA, 22 bp, Homo sapiens
agcatacaccctaaactgctta

SEQ ID NO: 7377507 - DNA, 22 bp, Homo sapiens
cactgcctttggtgggaacact

SEQ ID NO: 7377508 - DNA, 22 bp, Homo sapiens
cactgccttcacctgccctatc

SEQ ID NO: 7377509 - DNA, 23 bp, Homo sapiens
cactgccttcagttgcttcacct

SEQ ID NO: 7377510 - DNA, 22 bp, Homo sapiens
cactgcctgtgagctgtgtgcc

SEQ ID NO: 7377511 - DNA, 22 bp, Homo sapiens
cactgcacttcagcctgggtga

SEQ ID NO: 7377512 - DNA, 22 bp, Homo sapiens
cacctgagcactggggccgccc

SEQ ID NO: 7377513 - DNA, 22 bp, Homo sapiens
cacctctgcctcaagcttccca

SEQ ID NO: 7377514 - DNA, 22 bp, Homo sapiens
cacctctttgatttgaggcaag

SEQ ID NO: 7377515 - DNA, 22 bp, Homo sapiens
cacctctttgatttgaggcaag

SEQ ID NO: 7377516 - DNA, 22 bp, Homo sapiens
cacctctgctgtccacaggatg

SEQ ID NO: 7377517 - DNA, 22 bp, Homo sapiens
cacccagggctgtgcctgccca

SEQ ID NO: 7377518 - DNA, 22 bp, Homo sapiens
caccctgtcagttgcaggatag

SEQ ID NO: 7377519 - DNA, 22 bp, Homo sapiens
cacccaggctggagtgcattgg

SEQ ID NO: 7377520 - DNA, 22 bp, Homo sapiens
cacccaggctggagtgcagtgg

SEQ ID NO: 7377521 - DNA, 22 bp, Homo sapiens
cacctagggtttcgcctttctt

SEQ ID NO: 7377522 - DNA, 22 bp, Homo sapiens
agcacaggtgaaacagtcaggt

SEQ ID NO: 7377523 - DNA, 22 bp, Homo sapiens
agcacagttctttctctagctg

SEQ ID NO: 7377524 - DNA, 22 bp, Homo sapiens
agcacagttttcattgcagggt

SEQ ID NO: 7377525 - DNA, 22 bp, Homo sapiens
caaatagacttcaatctcttga

SEQ ID NO: 7377526 - DNA, 22 bp, Homo sapiens
agcacatgagctgatggtgggc

SEQ ID NO: 7377527 - DNA, 22 bp, Homo sapiens
caaatagtatgagcaatgattc

SEQ ID NO: 7377528 - DNA, 22 bp, Homo sapiens
caaatagtgaaacagatggggg

SEQ ID NO: 7377529 - DNA, 22 bp, Homo sapiens
caaatagtatgagcaatgattc

SEQ ID NO: 7377530 - DNA, 22 bp, Homo sapiens
caaatagattgttcaatcctga

SEQ ID NO: 7377531 - DNA, 22 bp, Homo sapiens
agcaaagcactttgcatacata

SEQ ID NO: 7377532 - DNA, 22 bp, Homo sapiens
agcaaagatgtccggggcaagc

SEQ ID NO: 7377533 - DNA, 21 bp, Homo sapiens
agcacagctttaagccatgtg

SEQ ID NO: 7377534 - DNA, 22 bp, Homo sapiens
agcacaggtgaaacagtcaggt

SEQ ID NO: 7377535 - DNA, 21 bp, Homo sapiens
agcacagctttaagccatgtg

SEQ ID NO: 7377536 - DNA, 22 bp, Homo sapiens
caaaagtcttcctattctctta

SEQ ID NO: 7377537 - DNA, 22 bp, Homo sapiens
agcaaagacagggacgaccaag

SEQ ID NO: 7377538 - DNA, 22 bp, Homo sapiens
agcaaagaaatggaggctcaga

SEQ ID NO: 7377539 - DNA, 22 bp, Homo sapiens
agcacatttaagtatgaaatat

SEQ ID NO: 7377540 - DNA, 22 bp, Homo sapiens
caagacattgattttgtacaga

SEQ ID NO: 7377541 - DNA, 22 bp, Homo sapiens
caagacaatgggtaagtgtaac

SEQ ID NO: 7377542 - DNA, 22 bp, Homo sapiens
caacttgttcttggtagatcta

SEQ ID NO: 7377543 - DNA, 22 bp, Homo sapiens
caacagagggaatggatctcat

SEQ ID NO: 7377544 - DNA, 22 bp, Homo sapiens
caaattaatgtgtctcaaaata

SEQ ID NO: 7377545 - DNA, 22 bp, Homo sapiens
caaatagtgtcacattgtgagg

SEQ ID NO: 7377546 - DNA, 22 bp, Homo sapiens
caaatagtttttcatgtattat

SEQ ID NO: 7377547 - DNA, 22 bp, Homo sapiens
caaatagtttttcatgtattat

SEQ ID NO: 7377548 - DNA, 22 bp, Homo sapiens
caacacttcttatacttactga

SEQ ID NO: 7377549 - DNA, 20 bp, Homo sapiens
caacactgcccattgtttgc

SEQ ID NO: 7377550 - DNA, 23 bp, Homo sapiens
caacactgccttcaggtgaagaa

SEQ ID NO: 7377551 - DNA, 21 bp, Homo sapiens
agcagcagggaagcctcatcc

SEQ ID NO: 7377552 - DNA, 21 bp, Homo sapiens
agcagcagggaagcctcatcc

SEQ ID NO: 7377553 - DNA, 22 bp, Homo sapiens
agcagcaggcttaaggaaaagt

SEQ ID NO: 7377554 - DNA, 22 bp, Homo sapiens
agcagcagggacaaaggaacag

SEQ ID NO: 7377555 - DNA, 22 bp, Homo sapiens
agcagcagggcatgtcttactc

SEQ ID NO: 7377556 - DNA, 22 bp, Homo sapiens
agcagcagggctctgcccgtgc

SEQ ID NO: 7377557 - DNA, 22 bp, Homo sapiens
agcagcagggctctgcccgtgc

SEQ ID NO: 7377558 - DNA, 22 bp, Homo sapiens
agcagcagggtgatagtgccca

SEQ ID NO: 7377559 - DNA, 22 bp, Homo sapiens
caattttttccatgctcttaca

SEQ ID NO: 7377560 - DNA, 22 bp, Homo sapiens
agcagcagggtgatagtgccca

SEQ ID NO: 7377561 - DNA, 22 bp, Homo sapiens
agcagcagggtcattgctcttt

SEQ ID NO: 7377562 - DNA, 22 bp, Homo sapiens
agcagcagggtcattgctcttt

SEQ ID NO: 7377563 - DNA, 22 bp, Homo sapiens
agcagccaaccttacattcatc

SEQ ID NO: 7377564 - DNA, 22 bp, Homo sapiens
cacaaggctttcatctggcata

SEQ ID NO: 7377565 - DNA, 22 bp, Homo sapiens
cacaaggcacattccttgtcca

SEQ ID NO: 7377566 - DNA, 22 bp, Homo sapiens
cacaagatggtttccagatgct

SEQ ID NO: 7377567 - DNA, 22 bp, Homo sapiens
cacaagatggtcacataagtgc

SEQ ID NO: 7377568 - DNA, 22 bp, Homo sapiens
agcagccacccagctgctcatt

SEQ ID NO: 7377569 - DNA, 22 bp, Homo sapiens
agcagcaggaggctgtccacca

SEQ ID NO: 7377570 - DNA, 22 bp, Homo sapiens
agcagcaggagccgtggggtga

SEQ ID NO: 7377571 - DNA, 22 bp, Homo sapiens
agcagcagctctgttgccctac

SEQ ID NO: 7377572 - DNA, 22 bp, Homo sapiens
agcagcagctctgttgccctac

SEQ ID NO: 7377573 - DNA, 22 bp, Homo sapiens
agcagcaggctgggatgagtct

SEQ ID NO: 7377574 - DNA, 22 bp, Homo sapiens
agcagcaggctgtgtggactga

SEQ ID NO: 7377575 - DNA, 22 bp, Homo sapiens
agcagcaggattttcgttggga

SEQ ID NO: 7377576 - DNA, 23 bp, Homo sapiens
agcagcaggaggtattgataagg

SEQ ID NO: 7377577 - DNA, 22 bp, Homo sapiens
agcagcaggctagggaactgct

SEQ ID NO: 7377578 - DNA, 22 bp, Homo sapiens
agcagcaggctagggaactgct

SEQ ID NO: 7377579 - DNA, 22 bp, Homo sapiens
caagagcaggtgctgcttccat

SEQ ID NO: 7377580 - DNA, 17 bp, Homo sapiens
caagagagatgactgga

SEQ ID NO: 7377581 - DNA, 22 bp, Homo sapiens
caagagcatttagttagctggt

SEQ ID NO: 7377582 - DNA, 22 bp, Homo sapiens
caagcagaaatctagaactcca

SEQ ID NO: 7377583 - DNA, 22 bp, Homo sapiens
caagcagaagcctcaggggcat

SEQ ID NO: 7377584 - DNA, 22 bp, Homo sapiens
caagcaacgactttcaagctgt

SEQ ID NO: 7377585 - DNA, 19 bp, Homo sapiens
caagatttgttcacacatg

SEQ ID NO: 7377586 - DNA, 22 bp, Homo sapiens
caagatttggcattctgaggag

SEQ ID NO: 7377587 - DNA, 22 bp, Homo sapiens
cagccctgcagagggcgctcct

SEQ ID NO: 7377588 - DNA, 22 bp, Homo sapiens
agctcagagaatagggcttgag

SEQ ID NO: 7377589 - DNA, 22 bp, Homo sapiens
cagccctgagttagcccacgga

SEQ ID NO: 7377590 - DNA, 22 bp, Homo sapiens
cagccctgagttagcccacgga

SEQ ID NO: 7377591 - DNA, 22 bp, Homo sapiens
cagccctgagttagcccacgga

SEQ ID NO: 7377592 - DNA, 22 bp, Homo sapiens
cagccccatggtgtgctccagc

SEQ ID NO: 7377593 - DNA, 22 bp, Homo sapiens
cagctcaggctctccatgctcc

SEQ ID NO: 7377594 - DNA, 19 bp, Homo sapiens
cagctcaggactcagcccc

SEQ ID NO: 7377595 - DNA, 22 bp, Homo sapiens
agctcagagctcgggaggatgg

SEQ ID NO: 7377596 - DNA, 22 bp, Homo sapiens
agctcagagataatcaagagac

SEQ ID NO: 7377597 - DNA, 22 bp, Homo sapiens
agctcagagggaggtgaagtgg

SEQ ID NO: 7377598 - DNA, 22 bp, Homo sapiens
cagcagctcccatccgctgagc

SEQ ID NO: 7377599 - DNA, 22 bp, Homo sapiens
cagcagctcagtctctcagtag

SEQ ID NO: 7377600 - DNA, 22 bp, Homo sapiens
agcctgagagccaagctgtgca

SEQ ID NO: 7377601 - DNA, 22 bp, Homo sapiens
agcctgagccccatccagctga

SEQ ID NO: 7377602 - DNA, 22 bp, Homo sapiens
agcctgagctgcctgccgcctc

SEQ ID NO: 7377603 - DNA, 22 bp, Homo sapiens
cagcagctcactcaggtggctc

SEQ ID NO: 7377604 - DNA, 22 bp, Homo sapiens
agcctggcactgaggcagggcg

SEQ ID NO: 7377605 - DNA, 23 bp, Homo sapiens
agcctggcacctgcagatcggag

SEQ ID NO: 7377606 - DNA, 20 bp, Homo sapiens
agcctggcaaacacccccag

SEQ ID NO: 7377607 - DNA, 22 bp, Homo sapiens
cagcaggggaactgtgggccag

SEQ ID NO: 7377608 - DNA, 22 bp, Homo sapiens
agcctggcactgccccatccat

SEQ ID NO: 7377609 - DNA, 22 bp, Homo sapiens
agcctctgtagaaagcagtgtg

SEQ ID NO: 7377610 - DNA, 22 bp, Homo sapiens
agcctctgtagaaagcagtgtg

SEQ ID NO: 7377611 - DNA, 22 bp, Homo sapiens
agcctctgtcaagcttttcaaa

SEQ ID NO: 7377612 - DNA, 22 bp, Homo sapiens
agcctctggtcctccctcagct

SEQ ID NO: 7377613 - DNA, 22 bp, Homo sapiens
agcctctgctggccctggcact

SEQ ID NO: 7377614 - DNA, 22 bp, Homo sapiens
agcctccctatgcaccttcagg

SEQ ID NO: 7377615 - DNA, 22 bp, Homo sapiens
cagaggtctgatgcgtccctgc

SEQ ID NO: 7377616 - DNA, 22 bp, Homo sapiens
cagaggtccagcatacatttcc

SEQ ID NO: 7377617 - DNA, 22 bp, Homo sapiens
cagaggtccctatttctttgtt

SEQ ID NO: 7377618 - DNA, 22 bp, Homo sapiens
cagaggtattttgataaacgcc

SEQ ID NO: 7377619 - DNA, 22 bp, Homo sapiens
cagaggtcaggacttcattata

SEQ ID NO: 7377620 - DNA, 22 bp, Homo sapiens
cagaggtagggagctatgttat

SEQ ID NO: 7377621 - DNA, 21 bp, Homo sapiens
cagagggccggcatgtggtct

SEQ ID NO: 7377622 - DNA, 22 bp, Homo sapiens
cagagggccatctctatcttca

SEQ ID NO: 7377623 - DNA, 22 bp, Homo sapiens
cagagggcacatggtttcctca

SEQ ID NO: 7377624 - DNA, 22 bp, Homo sapiens
cagagggagtttctgaggttgc

SEQ ID NO: 7377625 - DNA, 22 bp, Homo sapiens
cagagggatcatcttcctgaag

SEQ ID NO: 7377626 - DNA, 22 bp, Homo sapiens
cagaataagctgtgttgtcaag

SEQ ID NO: 7377627 - DNA, 22 bp, Homo sapiens
cagaataatattggtctcatag

SEQ ID NO: 7377628 - DNA, 22 bp, Homo sapiens
cagaataatattggtctcatag

SEQ ID NO: 7377629 - DNA, 22 bp, Homo sapiens
cagaaggagcgctaaggtccca

SEQ ID NO: 7377630 - DNA, 18 bp, Homo sapiens
cagaaatcacaccagcac

SEQ ID NO: 7377631 - DNA, 22 bp, Homo sapiens
cagaaatattccaagtactgca

SEQ ID NO: 7377632 - DNA, 22 bp, Homo sapiens
cagaaatatttattgagtgaca

SEQ ID NO: 7377633 - DNA, 22 bp, Homo sapiens
cagaaatattccaagtactgca

SEQ ID NO: 7377634 - DNA, 22 bp, Homo sapiens
cagaaatattccaagtactgca

SEQ ID NO: 7377635 - DNA, 22 bp, Homo sapiens
cagaaatatcagttgaaagtgc

SEQ ID NO: 7377636 - DNA, 21 bp, Homo sapiens
cagaaatatgaatgatggtga

SEQ ID NO: 7377637 - DNA, 22 bp, Homo sapiens
cagaaatatcagttgaaagtgc

SEQ ID NO: 7377638 - DNA, 22 bp, Homo sapiens
agcatatacaaactcatataca

SEQ ID NO: 7377639 - DNA, 22 bp, Homo sapiens
agcataggtggagattagtgtt

SEQ ID NO: 7377640 - DNA, 22 bp, Homo sapiens
agcataggcggtggtaggaccc

SEQ ID NO: 7377641 - DNA, 22 bp, Homo sapiens
agcatataaatggacatatttg

SEQ ID NO: 7377642 - DNA, 22 bp, Homo sapiens
agcatataaatggacatatttg

SEQ ID NO: 7377643 - DNA, 22 bp, Homo sapiens
agccacatttttctgctcctga

SEQ ID NO: 7377644 - DNA, 22 bp, Homo sapiens
cagaataccctatagacagaat

SEQ ID NO: 7377645 - DNA, 22 bp, Homo sapiens
agccactgtgtgaccagctgtc

SEQ ID NO: 7377646 - DNA, 19 bp, Homo sapiens
agccagaactagtgtttct

SEQ ID NO: 7377647 - DNA, 22 bp, Homo sapiens
cagaatgtatatgatctaaggt

SEQ ID NO: 7377648 - DNA, 22 bp, Homo sapiens
cagaatgttaccagttagtctg

SEQ ID NO: 7377649 - DNA, 22 bp, Homo sapiens
agccactgtgagaggaccaggg

SEQ ID NO: 7377650 - DNA, 22 bp, Homo sapiens
cagaatgtagatcatcatcaag

SEQ ID NO: 7377651 - DNA, 22 bp, Homo sapiens
cagaatgtatatgatctaaggt

SEQ ID NO: 7377652 - DNA, 22 bp, Homo sapiens
cagaatggcttttatggctcag

SEQ ID NO: 7377653 - DNA, 22 bp, Homo sapiens
agccagagactgtgtctgtaat

SEQ ID NO: 7377654 - DNA, 22 bp, Homo sapiens
agccagagagccccaggttcta

SEQ ID NO: 7377655 - DNA, 22 bp, Homo sapiens
cagacatgatgtaagcagaggc

SEQ ID NO: 7377656 - DNA, 22 bp, Homo sapiens
cagacatgatgtaagcagaggc

SEQ ID NO: 7377657 - DNA, 22 bp, Homo sapiens
agcccagcactgggggcccagc

SEQ ID NO: 7377658 - DNA, 22 bp, Homo sapiens
agcccagcagaaagtccagcct

SEQ ID NO: 7377659 - DNA, 22 bp, Homo sapiens
agcccagcaaaggggtttgaga

SEQ ID NO: 7377660 - DNA, 22 bp, Homo sapiens
agcccagcaaagggaggttcag

SEQ ID NO: 7377661 - DNA, 22 bp, Homo sapiens
agcccagcccgggctgcgcttt

SEQ ID NO: 7377662 - DNA, 22 bp, Homo sapiens
agcccagccactattaaatgtt

SEQ ID NO: 7377663 - DNA, 23 bp, Homo sapiens
agcccagcagagaacctaggtcc

SEQ ID NO: 7377664 - DNA, 22 bp, Homo sapiens
agcccagcagtaagattagaga

SEQ ID NO: 7377665 - DNA, 22 bp, Homo sapiens
agcccagagggtagcagaagaa

SEQ ID NO: 7377666 - DNA, 18 bp, Homo sapiens
agcccaggcatcgtctgc

SEQ ID NO: 7377667 - DNA, 22 bp, Homo sapiens
agcccagggaaccaggaagtgg

SEQ ID NO: 7377668 - DNA, 22 bp, Homo sapiens
cagagggagtttctgaggttgc

SEQ ID NO: 7377669 - DNA, 22 bp, Homo sapiens
cagagggacagtgtaatgcata

SEQ ID NO: 7377670 - DNA, 22 bp, Homo sapiens
cagagggaccagaacatactgt

SEQ ID NO: 7377671 - DNA, 22 bp, Homo sapiens
cagagggacagtatgatgaaag

SEQ ID NO: 7377672 - DNA, 22 bp, Homo sapiens
cagaggctgacaaaatattgct

SEQ ID NO: 7377673 - DNA, 23 bp, Homo sapiens
cagaggcatcggattcaacatca

SEQ ID NO: 7377674 - DNA, 22 bp, Homo sapiens
cagaggcatataattgctgggg

SEQ ID NO: 7377675 - DNA, 22 bp, Homo sapiens
cagaggcatataattgctgggg

SEQ ID NO: 7377676 - DNA, 22 bp, Homo sapiens
cagaggcatactcccagtcttg

SEQ ID NO: 7377677 - DNA, 22 bp, Homo sapiens
cagaggcatactcccagtcttg

SEQ ID NO: 7377678 - DNA, 22 bp, Homo sapiens
agcccaggcagagggatgcttg

SEQ ID NO: 7377679 - DNA, 22 bp, Homo sapiens
cagaggcattactgaaaaggtg

SEQ ID NO: 7377680 - DNA, 23 bp, Homo sapiens
cagaggcatcggattcaacatca

SEQ ID NO: 7377681 - DNA, 22 bp, Homo sapiens
cagaggcattactgaaaaggtg

SEQ ID NO: 7377682 - DNA, 22 bp, Homo sapiens
cagaggcagtggggttgctcct

SEQ ID NO: 7377683 - DNA, 22 bp, Homo sapiens
cagaggcagtggggttgctcct

SEQ ID NO: 7377684 - DNA, 21 bp, Homo sapiens
cagaggcaggtcctgggacgg

SEQ ID NO: 7377685 - DNA, 21 bp, Homo sapiens
cagaggcaggtcctgggacgg

SEQ ID NO: 7377686 - DNA, 22 bp, Homo sapiens
agcccagccggattcccagttc

SEQ ID NO: 7377687 - DNA, 21 bp, Homo sapiens
cagaggcaggctctgtgtgtg

SEQ ID NO: 7377688 - DNA, 21 bp, Homo sapiens
cagaggcaggctctgtgtgtg

SEQ ID NO: 7377689 - DNA, 22 bp, Homo sapiens
atgtggggacaaaatgatggcc

SEQ ID NO: 7377690 - DNA, 22 bp, Homo sapiens
atgtgtacacacatatatgtat

SEQ ID NO: 7377691 - DNA, 22 bp, Homo sapiens
agagcctgtacttttctgtgaa

SEQ ID NO: 7377692 - DNA, 22 bp, Homo sapiens
agagccagatggagccgtgtgt

SEQ ID NO: 7377693 - DNA, 22 bp, Homo sapiens
agagccagcaactctagccctg

SEQ ID NO: 7377694 - DNA, 22 bp, Homo sapiens
atgtatttgcgtatggacatac

SEQ ID NO: 7377695 - DNA, 22 bp, Homo sapiens
atgtatttgcttgttatggatt

SEQ ID NO: 7377696 - DNA, 22 bp, Homo sapiens
atgtatttgcttgttatggatt

SEQ ID NO: 7377697 - DNA, 22 bp, Homo sapiens
atgtatttgcttgttatggatt

SEQ ID NO: 7377698 - DNA, 22 bp, Homo sapiens
agagcagtgctgaagagtaggg

SEQ ID NO: 7377699 - DNA, 22 bp, Homo sapiens
agagccaaggcctcagtctcaa

SEQ ID NO: 7377700 - DNA, 22 bp, Homo sapiens
agagccagaccattgccgtgca

SEQ ID NO: 7377701 - DNA, 22 bp, Homo sapiens
agagccaagttgtcaaggcact

SEQ ID NO: 7377702 - DNA, 22 bp, Homo sapiens
agagccaaggctgagagctatt

SEQ ID NO: 7377703 - DNA, 22 bp, Homo sapiens
agagccaatcttcagagcagag

SEQ ID NO: 7377704 - DNA, 19 bp, Homo sapiens
agagatgctaagagtcttt

SEQ ID NO: 7377705 - DNA, 22 bp, Homo sapiens
agagatgctgtgggtagaggca

SEQ ID NO: 7377706 - DNA, 22 bp, Homo sapiens
agagatgacatgagggacttaa

SEQ ID NO: 7377707 - DNA, 22 bp, Homo sapiens
agagatgactgatggctgatta

SEQ ID NO: 7377708 - DNA, 22 bp, Homo sapiens
agagatgcagggtacatggaat

SEQ ID NO: 7377709 - DNA, 22 bp, Homo sapiens
atgggggcggctgaagcccagg

SEQ ID NO: 7377710 - DNA, 22 bp, Homo sapiens
agagatggatgttattatgggt

SEQ ID NO: 7377711 - DNA, 22 bp, Homo sapiens
atgggggcctgaacaggcaaaa

SEQ ID NO: 7377712 - DNA, 22 bp, Homo sapiens
atggccagcttataggggctca

SEQ ID NO: 7377713 - DNA, 22 bp, Homo sapiens
atggccaggcacctctggctga

SEQ ID NO: 7377714 - DNA, 22 bp, Homo sapiens
atggccagccactcctgatggc

SEQ ID NO: 7377715 - DNA, 22 bp, Homo sapiens
atggccagcccttcccgcagct

SEQ ID NO: 7377716 - DNA, 18 bp, Homo sapiens
agaccagacaagaatggt

SEQ ID NO: 7377717 - DNA, 22 bp, Homo sapiens
agacattttagacataaaagat

SEQ ID NO: 7377718 - DNA, 22 bp, Homo sapiens
agacattttacattcttccatt

SEQ ID NO: 7377719 - DNA, 22 bp, Homo sapiens
agacattttacattcttccatt

SEQ ID NO: 7377720 - DNA, 22 bp, Homo sapiens
agacattttgcattccctgaag

SEQ ID NO: 7377721 - DNA, 22 bp, Homo sapiens
agaccactaaaactttctctat

SEQ ID NO: 7377722 - DNA, 22 bp, Homo sapiens
agacattttgcattccctgaag

SEQ ID NO: 7377723 - DNA, 17 bp, Homo sapiens
atggctcacctgtgggc

SEQ ID NO: 7377724 - DNA, 22 bp, Homo sapiens
atggctcagcccatggaagaaa

SEQ ID NO: 7377725 - DNA, 22 bp, Homo sapiens
atggctcagcgcctttctgtgg

SEQ ID NO: 7377726 - DNA, 22 bp, Homo sapiens
atggctcagcccatggaagaaa

SEQ ID NO: 7377727 - DNA, 21 bp, Homo sapiens
agagacagagaaagtaacatt

SEQ ID NO: 7377728 - DNA, 22 bp, Homo sapiens
agagaccaagggaatagtctca

SEQ ID NO: 7377729 - DNA, 19 bp, Homo sapiens
agacagctctattattttg

SEQ ID NO: 7377730 - DNA, 22 bp, Homo sapiens
agacagctagggctgcagggac

SEQ ID NO: 7377731 - DNA, 22 bp, Homo sapiens
agacagctatcaacaactttct

SEQ ID NO: 7377732 - DNA, 22 bp, Homo sapiens
agacagccaatgctggaagatg

SEQ ID NO: 7377733 - DNA, 22 bp, Homo sapiens
agacagcaggggagtctggttt

SEQ ID NO: 7377734 - DNA, 22 bp, Homo sapiens
agacaggcagaggctgcagagg

SEQ ID NO: 7377735 - DNA, 22 bp, Homo sapiens
agacagctgggagtgtccttct

SEQ ID NO: 7377736 - DNA, 22 bp, Homo sapiens
agacagctgctcgcagagctat

SEQ ID NO: 7377737 - DNA, 22 bp, Homo sapiens
agacagctgttccttcatgttt

SEQ ID NO: 7377738 - DNA, 22 bp, Homo sapiens
agacatttggaagatacacata

SEQ ID NO: 7377739 - DNA, 22 bp, Homo sapiens
agacatttggagccaactttcc

SEQ ID NO: 7377740 - DNA, 22 bp, Homo sapiens
agacatttggagccaactttcc

SEQ ID NO: 7377741 - DNA, 23 bp, Homo sapiens
agacattttaataaggacttttt

SEQ ID NO: 7377742 - DNA, 22 bp, Homo sapiens
agacatttcctagacatcaatg

SEQ ID NO: 7377743 - DNA, 22 bp, Homo sapiens
atgacaaaatgaatgcagctag

SEQ ID NO: 7377744 - DNA, 22 bp, Homo sapiens
atgcacttaaataacataactt

SEQ ID NO: 7377745 - DNA, 17 bp, Homo sapiens
agacagacctctgcatc

SEQ ID NO: 7377746 - DNA, 22 bp, Homo sapiens
atgcaccccagaagctgcagtg

SEQ ID NO: 7377747 - DNA, 22 bp, Homo sapiens
atgcactgggtgaggaaggaga

SEQ ID NO: 7377748 - DNA, 22 bp, Homo sapiens
atgcactgcccctctgcacctc

SEQ ID NO: 7377749 - DNA, 22 bp, Homo sapiens
atgcacctgaactccatcagct

SEQ ID NO: 7377750 - DNA, 22 bp, Homo sapiens
atgaaactctaacttaacaagt

SEQ ID NO: 7377751 - DNA, 22 bp, Homo sapiens
agaagtttggatgccatcatag

SEQ ID NO: 7377752 - DNA, 22 bp, Homo sapiens
agaagtttgggggcgaaggcag

SEQ ID NO: 7377753 - DNA, 22 bp, Homo sapiens
agaagtttgctcacttgggaca

SEQ ID NO: 7377754 - DNA, 22 bp, Homo sapiens
agaagtttgaaattaggagaaa

SEQ ID NO: 7377755 - DNA, 22 bp, Homo sapiens
agaagtttctctgaacgtgtag

SEQ ID NO: 7377756 - DNA, 22 bp, Homo sapiens
agaagtttctttgaacgtgtag

SEQ ID NO: 7377757 - DNA, 22 bp, Homo sapiens
agaagtttggtcctataaactc

SEQ ID NO: 7377758 - DNA, 20 bp, Homo sapiens
agaagtttgggggtgtggag

SEQ ID NO: 7377759 - DNA, 22 bp, Homo sapiens
agaagtttaaccaggtgctact

SEQ ID NO: 7377760 - DNA, 22 bp, Homo sapiens
agaagtttccagtctagtaagg

SEQ ID NO: 7377761 - DNA, 22 bp, Homo sapiens
agaagtttcacaatgggtttta

SEQ ID NO: 7377762 - DNA, 22 bp, Homo sapiens
agaagtttatttatgccccaat

SEQ ID NO: 7377763 - DNA, 22 bp, Homo sapiens
atctcaggaggaccctgatgct

SEQ ID NO: 7377764 - DNA, 16 bp, Homo sapiens
atctcaggagagtctt

SEQ ID NO: 7377765 - DNA, 22 bp, Homo sapiens
agaagtcaatagttgtttgatg

SEQ ID NO: 7377766 - DNA, 22 bp, Homo sapiens
agaagggaactcagagatgatt

SEQ ID NO: 7377767 - DNA, 21 bp, Homo sapiens
agaagtcaattgaactgaaat

SEQ ID NO: 7377768 - DNA, 22 bp, Homo sapiens
agaagtcatttatgttagatga

SEQ ID NO: 7377769 - DNA, 22 bp, Homo sapiens
agacaaataactttttatgtcc

SEQ ID NO: 7377770 - DNA, 22 bp, Homo sapiens
agacaaatgaacaaatatgtga

SEQ ID NO: 7377771 - DNA, 22 bp, Homo sapiens
agacaaatggtaattatgtcta

SEQ ID NO: 7377772 - DNA, 22 bp, Homo sapiens
agacaaattgggacattgtgtt

SEQ ID NO: 7377773 - DNA, 22 bp, Homo sapiens
atgaaatttgaccaattattta

SEQ ID NO: 7377774 - DNA, 22 bp, Homo sapiens
atgaaattgatcttgaactttt

SEQ ID NO: 7377775 - DNA, 22 bp, Homo sapiens
atgaaatttgctgctaagttcc

SEQ ID NO: 7377776 - DNA, 22 bp, Homo sapiens
atgaaagatgatttaaagtact

SEQ ID NO: 7377777 - DNA, 22 bp, Homo sapiens
atgaaagctcagtgcactgaca

SEQ ID NO: 7377778 - DNA, 22 bp, Homo sapiens
atgaaagtagggtaaaatcaca

SEQ ID NO: 7377779 - DNA, 22 bp, Homo sapiens
atgaaagtggcttgattaaatg

SEQ ID NO: 7377780 - DNA, 22 bp, Homo sapiens
atgaaagtggcttgattaaatg

SEQ ID NO: 7377781 - DNA, 18 bp, Homo sapiens
agagggaatcagttggat

SEQ ID NO: 7377782 - DNA, 18 bp, Homo sapiens
agagggaaagcaggctga

SEQ ID NO: 7377783 - DNA, 22 bp, Homo sapiens
agagggaaatccaggagtgctt

SEQ ID NO: 7377784 - DNA, 22 bp, Homo sapiens
agaggctgtctcatattttgta

SEQ ID NO: 7377785 - DNA, 21 bp, Homo sapiens
agagggagagtggcccttcca

SEQ ID NO: 7377786 - DNA, 21 bp, Homo sapiens
agagggagagtggcccttcca

SEQ ID NO: 7377787 - DNA, 22 bp, Homo sapiens
agagggagaaaagaatcagttg

SEQ ID NO: 7377788 - DNA, 22 bp, Homo sapiens
agagggagaagctaaaataact

SEQ ID NO: 7377789 - DNA, 22 bp, Homo sapiens
agagggagaagctaaaataact

SEQ ID NO: 7377790 - DNA, 22 bp, Homo sapiens
agagggagaaaagaatcagttg

SEQ ID NO: 7377791 - DNA, 22 bp, Homo sapiens
agagggagaaaagaatcagttg

SEQ ID NO: 7377792 - DNA, 21 bp, Homo sapiens
agagggagagtggcccttcca

SEQ ID NO: 7377793 - DNA, 21 bp, Homo sapiens
agagggagagtggcccttcca

SEQ ID NO: 7377794 - DNA, 22 bp, Homo sapiens
attccagttctcctctctaaag

SEQ ID NO: 7377795 - DNA, 21 bp, Homo sapiens
attccagtataagcctctttg

SEQ ID NO: 7377796 - DNA, 22 bp, Homo sapiens
attccagtgtcatgctctcagg

SEQ ID NO: 7377797 - DNA, 22 bp, Homo sapiens
attccagttagtggcagcttat

SEQ ID NO: 7377798 - DNA, 22 bp, Homo sapiens
attccagttagtggcagcttat

SEQ ID NO: 7377799 - DNA, 22 bp, Homo sapiens
attgataaattgcaatggggct

SEQ ID NO: 7377800 - DNA, 22 bp, Homo sapiens
agaggcgcagactcttgagtgt

SEQ ID NO: 7377801 - DNA, 21 bp, Homo sapiens
agaggcggggttttggaggcc

SEQ ID NO: 7377802 - DNA, 22 bp, Homo sapiens
agaggctagagatctgtcctac

SEQ ID NO: 7377803 - DNA, 22 bp, Homo sapiens
attcatttgctattgtgtatgg

SEQ ID NO: 7377804 - DNA, 22 bp, Homo sapiens
attcatttgctattgtgtatgg

SEQ ID NO: 7377805 - DNA, 22 bp, Homo sapiens
agaggcctgtgtgctccagtgg

SEQ ID NO: 7377806 - DNA, 22 bp, Homo sapiens
attcatttaggtattcacttac

SEQ ID NO: 7377807 - DNA, 22 bp, Homo sapiens
attcatttagagggattaagca

SEQ ID NO: 7377808 - DNA, 22 bp, Homo sapiens
attcatttagagggattaagca

SEQ ID NO: 7377809 - DNA, 18 bp, Homo sapiens
attcaggggctgaatgtg

SEQ ID NO: 7377810 - DNA, 22 bp, Homo sapiens
agaggcaggaggttgacttgag

SEQ ID NO: 7377811 - DNA, 20 bp, Homo sapiens
attcatgtctttataaaagc

SEQ ID NO: 7377812 - DNA, 22 bp, Homo sapiens
agaggcaggaagagctgatttt

SEQ ID NO: 7377813 - DNA, 22 bp, Homo sapiens
agaggcagccgtatttcaaagg

SEQ ID NO: 7377814 - DNA, 22 bp, Homo sapiens
agaggcagcagtcatactacag

SEQ ID NO: 7377815 - DNA, 22 bp, Homo sapiens
agaggcagaagtgttcaaaccc

SEQ ID NO: 7377816 - DNA, 17 bp, Homo sapiens
agaggcagatacttgga

SEQ ID NO: 7377817 - DNA, 22 bp, Homo sapiens
agagctgtttattgatgtcaca

SEQ ID NO: 7377818 - DNA, 22 bp, Homo sapiens
agagctgtgtcctgtgcactag

SEQ ID NO: 7377819 - DNA, 22 bp, Homo sapiens
agagctgtgctttgcaccacgt

SEQ ID NO: 7377820 - DNA, 22 bp, Homo sapiens
atgtgtaggtgaatcgaggctg

SEQ ID NO: 7377821 - DNA, 15 bp, Homo sapiens
atgtgtagtcaccag

SEQ ID NO: 7377822 - DNA, 22 bp, Homo sapiens
atgtgtagggaagtgaaatgta

SEQ ID NO: 7377823 - DNA, 22 bp, Homo sapiens
atgtgtagaactgtaatgccca

SEQ ID NO: 7377824 - DNA, 22 bp, Homo sapiens
agaggacacatctttcctcaaa

SEQ ID NO: 7377825 - DNA, 22 bp, Homo sapiens
agaggacagcccccttgtctgg

SEQ ID NO: 7377826 - DNA, 22 bp, Homo sapiens
agaggacagagtgctggattta

SEQ ID NO: 7377827 - DNA, 22 bp, Homo sapiens
atgtttatggagcaggtattag

SEQ ID NO: 7377828 - DNA, 22 bp, Homo sapiens
atgtttatgttgggctatattt

SEQ ID NO: 7377829 - DNA, 22 bp, Homo sapiens
atgtttatgttgggctatattt

SEQ ID NO: 7377830 - DNA, 22 bp, Homo sapiens
agaggaagctgagatgcctctt

SEQ ID NO: 7377831 - DNA, 22 bp, Homo sapiens
atgtttatgcaaacatgtgagt

SEQ ID NO: 7377832 - DNA, 22 bp, Homo sapiens
atgtttatgcaaacatgtgagt

SEQ ID NO: 7377833 - DNA, 22 bp, Homo sapiens
atgtttatgcaaacatgtgagt

SEQ ID NO: 7377834 - DNA, 22 bp, Homo sapiens
atgtttatgcaaacatgtgagt

SEQ ID NO: 7377835 - DNA, 22 bp, Homo sapiens
agaggagctgggaggccctcgt

SEQ ID NO: 7377836 - DNA, 22 bp, Homo sapiens
agaggacaggttttccatgggc

SEQ ID NO: 7377837 - DNA, 22 bp, Homo sapiens
agaggaggaagagctttaaaat

SEQ ID NO: 7377838 - DNA, 22 bp, Homo sapiens
agaggaggccaggcccacacct

SEQ ID NO: 7377839 - DNA, 22 bp, Homo sapiens
agaggaggctctgggatcgtcc

SEQ ID NO: 7377840 - DNA, 22 bp, Homo sapiens
agaggaggctgggtccagataa

SEQ ID NO: 7377841 - DNA, 22 bp, Homo sapiens
attataggcttgagccaccgtg

SEQ ID NO: 7377842 - DNA, 22 bp, Homo sapiens
agaggcactccagccactggtc

SEQ ID NO: 7377843 - DNA, 22 bp, Homo sapiens
attattcaacacttgagaaatt

SEQ ID NO: 7377844 - DNA, 22 bp, Homo sapiens
attattcaacacttgagaaatt

SEQ ID NO: 7377845 - DNA, 22 bp, Homo sapiens
attattattgttgatgttaggg

SEQ ID NO: 7377846 - DNA, 22 bp, Homo sapiens
attattattgttgatgttaggg

SEQ ID NO: 7377847 - DNA, 21 bp, Homo sapiens
attattatttctgtgtccagc

SEQ ID NO: 7377848 - DNA, 22 bp, Homo sapiens
attattaaagcttaggtcttat

SEQ ID NO: 7377849 - DNA, 22 bp, Homo sapiens
attataggcttgagccaccgtg

SEQ ID NO: 7377850 - DNA, 22 bp, Homo sapiens
atttccttcagtgtttaatact

SEQ ID NO: 7377851 - DNA, 22 bp, Homo sapiens
agatagacatacaatgtatgaa

SEQ ID NO: 7377852 - DNA, 22 bp, Homo sapiens
atttctcattttgcttcaaagg

SEQ ID NO: 7377853 - DNA, 22 bp, Homo sapiens
atttctcattaagatcttccaa

SEQ ID NO: 7377854 - DNA, 22 bp, Homo sapiens
atttccttcatcagcctatcct

SEQ ID NO: 7377855 - DNA, 22 bp, Homo sapiens
atttctctcattgttagctagg

SEQ ID NO: 7377856 - DNA, 22 bp, Homo sapiens
atttctctcattgttagctagg

SEQ ID NO: 7377857 - DNA, 22 bp, Homo sapiens
atttgcttttactatgttaaaa

SEQ ID NO: 7377858 - DNA, 22 bp, Homo sapiens
atttggaattctatttcagtag

SEQ ID NO: 7377859 - DNA, 17 bp, Homo sapiens
atttggaatttctcttc

SEQ ID NO: 7377860 - DNA, 22 bp, Homo sapiens
atttggatatcactgaatacat

SEQ ID NO: 7377861 - DNA, 22 bp, Homo sapiens
atttctcttagcaagacattac

SEQ ID NO: 7377862 - DNA, 22 bp, Homo sapiens
atttctcttagcaagacattac

SEQ ID NO: 7377863 - DNA, 22 bp, Homo sapiens
atttgctttgggacagcttaaa

SEQ ID NO: 7377864 - DNA, 22 bp, Homo sapiens
caaaaaacacagatgtctgtgt

SEQ ID NO: 7377865 - DNA, 22 bp, Homo sapiens
caaaaaacacagatgtctgtgt

SEQ ID NO: 7377866 - DNA, 22 bp, Homo sapiens
caaaagcagttctatctgagtt

SEQ ID NO: 7377867 - DNA, 21 bp, Homo sapiens
caaaaggataggaaattaggg

SEQ ID NO: 7377868 - DNA, 22 bp, Homo sapiens
atttggcatagagtatcattct

SEQ ID NO: 7377869 - DNA, 22 bp, Homo sapiens
atttgtgataatttgttacagc

SEQ ID NO: 7377870 - DNA, 22 bp, Homo sapiens
atttcactgcttgagctgcagc

SEQ ID NO: 7377871 - DNA, 22 bp, Homo sapiens
atttcacattaatttgatgctc

SEQ ID NO: 7377872 - DNA, 22 bp, Homo sapiens
atttcacagctgtcagtgttac

SEQ ID NO: 7377873 - DNA, 22 bp, Homo sapiens
atttcacagctgctgttcaggt

SEQ ID NO: 7377874 - DNA, 22 bp, Homo sapiens
atttcacagctgctgttcaggt

SEQ ID NO: 7377875 - DNA, 22 bp, Homo sapiens
atttcacaaagaacagatgcag

SEQ ID NO: 7377876 - DNA, 22 bp, Homo sapiens
agataaattcctaagatttcag

SEQ ID NO: 7377877 - DNA, 22 bp, Homo sapiens
atttattgaagcttattacgtt

SEQ ID NO: 7377878 - DNA, 22 bp, Homo sapiens
agagtttttcatttacccgttg

SEQ ID NO: 7377879 - DNA, 22 bp, Homo sapiens
agaggtgaaagaatttggctct

SEQ ID NO: 7377880 - DNA, 22 bp, Homo sapiens
agaggtgacataggagaggctc

SEQ ID NO: 7377881 - DNA, 22 bp, Homo sapiens
agagttggcccacgtgtaggcg

SEQ ID NO: 7377882 - DNA, 22 bp, Homo sapiens
agagttgctatagaaggatgga

SEQ ID NO: 7377883 - DNA, 22 bp, Homo sapiens
attgctcctgatgcatagagct

SEQ ID NO: 7377884 - DNA, 22 bp, Homo sapiens
agaggtcagctgcatgccacat

SEQ ID NO: 7377885 - DNA, 22 bp, Homo sapiens
agaggtcagaggtcgccaggtc

SEQ ID NO: 7377886 - DNA, 21 bp, Homo sapiens
agaggtcattgggctggttct

SEQ ID NO: 7377887 - DNA, 22 bp, Homo sapiens
agaggtattagatttgcatagg

SEQ ID NO: 7377888 - DNA, 22 bp, Homo sapiens
agaggtatgttcacttcccttt

SEQ ID NO: 7377889 - DNA, 22 bp, Homo sapiens
agaggtattgcacgtgctctct

SEQ ID NO: 7377890 - DNA, 22 bp, Homo sapiens
agaggtcactccaccttcttct

SEQ ID NO: 7377891 - DNA, 22 bp, Homo sapiens
agaggtcaatgggacttggatc

SEQ ID NO: 7377892 - DNA, 22 bp, Homo sapiens
agaggtcagaacaggaaagtgt

SEQ ID NO: 7377893 - DNA, 22 bp, Homo sapiens
agtccaggcgggtatagaggct

SEQ ID NO: 7377894 - DNA, 22 bp, Homo sapiens
actcaggcttcaggcacagctg

SEQ ID NO: 7377895 - DNA, 22 bp, Homo sapiens
actcaggctacaggggcagaag

SEQ ID NO: 7377896 - DNA, 22 bp, Homo sapiens
actcaggcctccttctgtcctt

SEQ ID NO: 7377897 - DNA, 22 bp, Homo sapiens
agtcaaataagactgtcataag

SEQ ID NO: 7377898 - DNA, 22 bp, Homo sapiens
agtcaaataagactgtcataag

SEQ ID NO: 7377899 - DNA, 20 bp, Homo sapiens
actagtctaaaagggctgac

SEQ ID NO: 7377900 - DNA, 21 bp, Homo sapiens
actagctttctggagaagtgt

SEQ ID NO: 7377901 - DNA, 22 bp, Homo sapiens
agtcaaagctacaggcatttga

SEQ ID NO: 7377902 - DNA, 22 bp, Homo sapiens
agtaaaattaatggatcagaag

SEQ ID NO: 7377903 - DNA, 22 bp, Homo sapiens
agtaaaatcaccatctctttgt

SEQ ID NO: 7377904 - DNA, 22 bp, Homo sapiens
agtaaaatcaccatctctttgt

SEQ ID NO: 7377905 - DNA, 22 bp, Homo sapiens
agtaaaacagagaaatcactca

SEQ ID NO: 7377906 - DNA, 22 bp, Homo sapiens
agtaaacactaaaatgactgcg

SEQ ID NO: 7377907 - DNA, 22 bp, Homo sapiens
agtaaacactaaaatgactgcg

SEQ ID NO: 7377908 - DNA, 22 bp, Homo sapiens
agtaaacactgtctttatatat

SEQ ID NO: 7377909 - DNA, 22 bp, Homo sapiens
actagattttggccattataca

SEQ ID NO: 7377910 - DNA, 22 bp, Homo sapiens
actagattttggccattataca

SEQ ID NO: 7377911 - DNA, 22 bp, Homo sapiens
agtaaacaggcatgatagtgtt

SEQ ID NO: 7377912 - DNA, 22 bp, Homo sapiens
agtaaacagaaagcaagatgat

SEQ ID NO: 7377913 - DNA, 22 bp, Homo sapiens
agtaaacagaaagcaagatgat

SEQ ID NO: 7377914 - DNA, 22 bp, Homo sapiens
acgcctgtaatcccagcacttt

SEQ ID NO: 7377915 - DNA, 22 bp, Homo sapiens
acgcccggtctccatagttttt

SEQ ID NO: 7377916 - DNA, 22 bp, Homo sapiens
acgcccagactcccatactttg

SEQ ID NO: 7377917 - DNA, 22 bp, Homo sapiens
agtaaaaattgaggtgcaaaat

SEQ ID NO: 7377918 - DNA, 20 bp, Homo sapiens
acctggctctcaggagcaac

SEQ ID NO: 7377919 - DNA, 22 bp, Homo sapiens
acctcctccaaggagccatagg

SEQ ID NO: 7377920 - DNA, 19 bp, Homo sapiens
accctctccccactgggtc

SEQ ID NO: 7377921 - DNA, 19 bp, Homo sapiens
accctctctgtagaaagat

SEQ ID NO: 7377922 - DNA, 19 bp, Homo sapiens
accctctcagtgcctgagg

SEQ ID NO: 7377923 - DNA, 22 bp, Homo sapiens
acctgaatccaaactcaacaat

SEQ ID NO: 7377924 - DNA, 22 bp, Homo sapiens
acctctggccttcaggcatcat

SEQ ID NO: 7377925 - DNA, 22 bp, Homo sapiens
acctctgggaaaagtatggaaa

SEQ ID NO: 7377926 - DNA, 22 bp, Homo sapiens
acctctgtatagttgcctgtgg

SEQ ID NO: 7377927 - DNA, 22 bp, Homo sapiens
acctgagacttgggatgggaat

SEQ ID NO: 7377928 - DNA, 22 bp, Homo sapiens
acctgcagctaaagatgtaggg

SEQ ID NO: 7377929 - DNA, 22 bp, Homo sapiens
acctgcaggcacaggtgtgcgc

SEQ ID NO: 7377930 - DNA, 22 bp, Homo sapiens
agtgtagaaggagaaatggatc

SEQ ID NO: 7377931 - DNA, 22 bp, Homo sapiens
agtgtagacataggtctggtct

SEQ ID NO: 7377932 - DNA, 22 bp, Homo sapiens
agtgtagatgaaattaaaccca

SEQ ID NO: 7377933 - DNA, 22 bp, Homo sapiens
agtgtacagtttgtagtactac

SEQ ID NO: 7377934 - DNA, 22 bp, Homo sapiens
actgcacttcagcctgggtgtc

SEQ ID NO: 7377935 - DNA, 19 bp, Homo sapiens
actgcactttagcctgggc

SEQ ID NO: 7377936 - DNA, 22 bp, Homo sapiens
actgcacttcagcctgggtgtc

SEQ ID NO: 7377937 - DNA, 22 bp, Homo sapiens
actgcagaggtggggtgcagag

SEQ ID NO: 7377938 - DNA, 21 bp, Homo sapiens
agtggggtctctgtggaggcc

SEQ ID NO: 7377939 - DNA, 22 bp, Homo sapiens
actgcacttcagcctgggtgac

SEQ ID NO: 7377940 - DNA, 21 bp, Homo sapiens
actggaagtgggtcaggaagt

SEQ ID NO: 7377941 - DNA, 22 bp, Homo sapiens
agtgtagtggcattgacttcgt

SEQ ID NO: 7377942 - DNA, 21 bp, Homo sapiens
agtgtagttctagtttttaac

SEQ ID NO: 7377943 - DNA, 22 bp, Homo sapiens
agtgtattaaaatgctcctaag

SEQ ID NO: 7377944 - DNA, 23 bp, Homo sapiens
actgctttattcatgaggctctc

SEQ ID NO: 7377945 - DNA, 22 bp, Homo sapiens
agtgtattagcaagctctccag

SEQ ID NO: 7377946 - DNA, 22 bp, Homo sapiens
agtgttcttcctatctgctgtt

SEQ ID NO: 7377947 - DNA, 21 bp, Homo sapiens
agtgtgtgataggcaggaaga

SEQ ID NO: 7377948 - DNA, 22 bp, Homo sapiens
agtgttggaccgaggtggagcc

SEQ ID NO: 7377949 - DNA, 22 bp, Homo sapiens
agtgttggagtcttggctgcag

SEQ ID NO: 7377950 - DNA, 22 bp, Homo sapiens
agtgttgggtctttagaattta

SEQ ID NO: 7377951 - DNA, 23 bp, Homo sapiens
agtgttggttgggaagccaagca

SEQ ID NO: 7377952 - DNA, 18 bp, Homo sapiens
actggctttagcatcaga

SEQ ID NO: 7377953 - DNA, 22 bp, Homo sapiens
actcctgtgggcatggcacccc

SEQ ID NO: 7377954 - DNA, 22 bp, Homo sapiens
agtctttaagtaatgataggca

SEQ ID NO: 7377955 - DNA, 22 bp, Homo sapiens
agtcttctttgtgttctctcat

SEQ ID NO: 7377956 - DNA, 22 bp, Homo sapiens
agtcttctttgtgttctctcat

SEQ ID NO: 7377957 - DNA, 22 bp, Homo sapiens
agtcttctttcatttactcagt

SEQ ID NO: 7377958 - DNA, 22 bp, Homo sapiens
agtcttcttgatcttttcagtg

SEQ ID NO: 7377959 - DNA, 20 bp, Homo sapiens
agtctgtcaatttacagtgg

SEQ ID NO: 7377960 - DNA, 22 bp, Homo sapiens
agtcttctgggtgtttccagag

SEQ ID NO: 7377961 - DNA, 22 bp, Homo sapiens
agtctgtctaatattattcagg

SEQ ID NO: 7377962 - DNA, 22 bp, Homo sapiens
agtctgtcagtcattctaacaa

SEQ ID NO: 7377963 - DNA, 23 bp, Homo sapiens
actcgtggaattctctgcgatcg

SEQ ID NO: 7377964 - DNA, 22 bp, Homo sapiens
actctgtgttttggtggcagca

SEQ ID NO: 7377965 - DNA, 22 bp, Homo sapiens
actctgtgaactctatcagata

SEQ ID NO: 7377966 - DNA, 22 bp, Homo sapiens
agtgcaattttgctttcccaat

SEQ ID NO: 7377967 - DNA, 22 bp, Homo sapiens
actcttcagtacaataatatct

SEQ ID NO: 7377968 - DNA, 22 bp, Homo sapiens
ataaaatttgctactgttaaat

SEQ ID NO: 7377969 - DNA, 22 bp, Homo sapiens
ataaaatttgctactgttaaat

SEQ ID NO: 7377970 - DNA, 22 bp, Homo sapiens
ataaacaagactggccaacttt

SEQ ID NO: 7377971 - DNA, 22 bp, Homo sapiens
ataaacaagactggccaacttt

SEQ ID NO: 7377972 - DNA, 22 bp, Homo sapiens
ataaacaagactggccaacttt

SEQ ID NO: 7377973 - DNA, 22 bp, Homo sapiens
ataaaatttgctactgttaaat

SEQ ID NO: 7377974 - DNA, 22 bp, Homo sapiens
ataatctggtctttgtatgagt

SEQ ID NO: 7377975 - DNA, 22 bp, Homo sapiens
ataatctgagctatttcatgag

SEQ ID NO: 7377976 - DNA, 22 bp, Homo sapiens
ataatgaatgcagagttatttt

SEQ ID NO: 7377977 - DNA, 20 bp, Homo sapiens
actgggagctaacggagatt

SEQ ID NO: 7377978 - DNA, 22 bp, Homo sapiens
actgtcacctaaattttcattg

SEQ ID NO: 7377979 - DNA, 22 bp, Homo sapiens
actgtcactaactaagtctagt

SEQ ID NO: 7377980 - DNA, 22 bp, Homo sapiens
actgtcaccatcagagcgggaa

SEQ ID NO: 7377981 - DNA, 22 bp, Homo sapiens
actgtcactactatgtgtttgt

SEQ ID NO: 7377982 - DNA, 22 bp, Homo sapiens
actgtcactccaactgagtcgt

SEQ ID NO: 7377983 - DNA, 22 bp, Homo sapiens
actgtcaatgggttcattgagt

SEQ ID NO: 7377984 - DNA, 19 bp, Homo sapiens
actgtcacataaaggaagg

SEQ ID NO: 7377985 - DNA, 22 bp, Homo sapiens
actgtcacttgcaactgtgagg

SEQ ID NO: 7377986 - DNA, 22 bp, Homo sapiens
actgtcactgacagaatcaaca

SEQ ID NO: 7377987 - DNA, 22 bp, Homo sapiens
actgtcactgtgatgttagaga

SEQ ID NO: 7377988 - DNA, 22 bp, Homo sapiens
actgtcagggatcatgaaagct

SEQ ID NO: 7377989 - DNA, 22 bp, Homo sapiens
actgtcaggatggcagcttgtt

SEQ ID NO: 7377990 - DNA, 22 bp, Homo sapiens
actgtagtctaaatatagtctt

SEQ ID NO: 7377991 - DNA, 22 bp, Homo sapiens
actgtcaaaagagattatatta

SEQ ID NO: 7377992 - DNA, 22 bp, Homo sapiens
atacaggtaggggacatacatc

SEQ ID NO: 7377993 - DNA, 22 bp, Homo sapiens
atacaggtgtacacacatgcaa

SEQ ID NO: 7377994 - DNA, 22 bp, Homo sapiens
atacagcttacagttctaatgc

SEQ ID NO: 7377995 - DNA, 22 bp, Homo sapiens
atacagggacatccagtttttc

SEQ ID NO: 7377996 - DNA, 22 bp, Homo sapiens
atacagcagtgaataagataaa

SEQ ID NO: 7377997 - DNA, 22 bp, Homo sapiens
acttaaatagaactcctcaata

SEQ ID NO: 7377998 - DNA, 22 bp, Homo sapiens
acttaaagttataatttgctaa

SEQ ID NO: 7377999 - DNA, 22 bp, Homo sapiens
acttaaagtagttttactgtgg

SEQ ID NO: 7378000 - DNA, 22 bp, Homo sapiens
ataatgcatttagaataattca

SEQ ID NO: 7378001 - DNA, 23 bp, Homo sapiens
acttaaatggttctttatctcag

SEQ ID NO: 7378002 - DNA, 21 bp, Homo sapiens
acttaaattccttgatattta

SEQ ID NO: 7378003 - DNA, 22 bp, Homo sapiens
acttacaagttccctttctcag

SEQ ID NO: 7378004 - DNA, 22 bp, Homo sapiens
acttacaatcaaccaccttgga

SEQ ID NO: 7378005 - DNA, 22 bp, Homo sapiens
acttagaatatgttcaagattt

SEQ ID NO: 7378006 - DNA, 22 bp, Homo sapiens
acttagaagatgcagtaaagca

SEQ ID NO: 7378007 - DNA, 22 bp, Homo sapiens
acttctgtatgtcctgcattca

SEQ ID NO: 7378008 - DNA, 22 bp, Homo sapiens
atacattagtgaacaaaagaga

SEQ ID NO: 7378009 - DNA, 22 bp, Homo sapiens
atacattagtgaacaaaagaga

SEQ ID NO: 7378010 - DNA, 22 bp, Homo sapiens
atacattagctcatatgattaa

SEQ ID NO: 7378011 - DNA, 22 bp, Homo sapiens
atacatgttgtaccatatgttt

SEQ ID NO: 7378012 - DNA, 22 bp, Homo sapiens
atacatgttgagaaaatatctg

SEQ ID NO: 7378013 - DNA, 21 bp, Homo sapiens
atactggagccatccccaaag

SEQ ID NO: 7378014 - DNA, 22 bp, Homo sapiens
atactggagaagccaagaagcc

SEQ ID NO: 7378015 - DNA, 22 bp, Homo sapiens
atactgaattaggtaaagcata

SEQ ID NO: 7378016 - DNA, 22 bp, Homo sapiens
atactgtatcacttgtgagtga

SEQ ID NO: 7378017 - DNA, 22 bp, Homo sapiens
atactgtatatttcacatcttg

SEQ ID NO: 7378018 - DNA, 22 bp, Homo sapiens
atactgtatatttcacatcttg

SEQ ID NO: 7378019 - DNA, 22 bp, Homo sapiens
actttatttcctattgcatcca

SEQ ID NO: 7378020 - DNA, 22 bp, Homo sapiens
actttatgacaccctttagtga

SEQ ID NO: 7378021 - DNA, 22 bp, Homo sapiens
actttcatgttcatttggaacc

SEQ ID NO: 7378022 - DNA, 22 bp, Homo sapiens
atatgcttacagcttaaaatcc

SEQ ID NO: 7378023 - DNA, 22 bp, Homo sapiens
atatgcttatgatgtctcaagt

SEQ ID NO: 7378024 - DNA, 22 bp, Homo sapiens
atatgcttgggactgatacagt

SEQ ID NO: 7378025 - DNA, 22 bp, Homo sapiens
atatggatgagataatgagcca

SEQ ID NO: 7378026 - DNA, 20 bp, Homo sapiens
atatttcaggtagtgtgccc

SEQ ID NO: 7378027 - DNA, 21 bp, Homo sapiens
atatttctcataaggttatgg

SEQ ID NO: 7378028 - DNA, 21 bp, Homo sapiens
atatttctcataaggttatgg

SEQ ID NO: 7378029 - DNA, 22 bp, Homo sapiens
atatttcatggggttccatact

SEQ ID NO: 7378030 - DNA, 22 bp, Homo sapiens
atatttcatggggttccatact

SEQ ID NO: 7378031 - DNA, 22 bp, Homo sapiens
atatttataagcaagcaggact

SEQ ID NO: 7378032 - DNA, 22 bp, Homo sapiens
atatttataagcaagcaggact

SEQ ID NO: 7378033 - DNA, 22 bp, Homo sapiens
atattcttccaaaacatcattt

SEQ ID NO: 7378034 - DNA, 22 bp, Homo sapiens
atattcttccaaaacatcattt

SEQ ID NO: 7378035 - DNA, 22 bp, Homo sapiens
atattcatcgtgtagaaatact

SEQ ID NO: 7378036 - DNA, 22 bp, Homo sapiens
atattccagttatatcaaatca

SEQ ID NO: 7378037 - DNA, 22 bp, Homo sapiens
atattctataagcagttggaag

SEQ ID NO: 7378038 - DNA, 22 bp, Homo sapiens
atattctagccaaagtgtgagc

SEQ ID NO: 7378039 - DNA, 22 bp, Homo sapiens
agaaaagtgctctagtgagagc

SEQ ID NO: 7378040 - DNA, 21 bp, Homo sapiens
agaaaagtagagttttcagag

SEQ ID NO: 7378041 - DNA, 22 bp, Homo sapiens
agaaaaggttgaaagtaggatt

SEQ ID NO: 7378042 - DNA, 23 bp, Homo sapiens
agaaaagttcatacctttttaac

SEQ ID NO: 7378043 - DNA, 23 bp, Homo sapiens
agaaaagttcatacctttttaac

SEQ ID NO: 7378044 - DNA, 23 bp, Homo sapiens
agaaaagttcatacctttttaac

SEQ ID NO: 7378045 - DNA, 22 bp, Homo sapiens
atcatcctagaaggaagctagg

SEQ ID NO: 7378046 - DNA, 22 bp, Homo sapiens
atctaaaaggagctctttatct

SEQ ID NO: 7378047 - DNA, 22 bp, Homo sapiens
atctcacatcctcagtagtgca

SEQ ID NO: 7378048 - DNA, 22 bp, Homo sapiens
atctcacactgggtttgagggt

SEQ ID NO: 7378049 - DNA, 22 bp, Homo sapiens
agaaattatgcagtagttttat

SEQ ID NO: 7378050 - DNA, 22 bp, Homo sapiens
agaacacactgggggaaacaag

SEQ ID NO: 7378051 - DNA, 20 bp, Homo sapiens
agaacactggtgtattgtga

SEQ ID NO: 7378052 - DNA, 22 bp, Homo sapiens
agaacactgggaagttactaac

SEQ ID NO: 7378053 - DNA, 22 bp, Homo sapiens
agaacactgctagtataatcac

SEQ ID NO: 7378054 - DNA, 22 bp, Homo sapiens
agaacacatagagaagttttat

SEQ ID NO: 7378055 - DNA, 22 bp, Homo sapiens
agaaattaggaaagtaacactt

SEQ ID NO: 7378056 - DNA, 22 bp, Homo sapiens
agaacagcctatagtggccttt

SEQ ID NO: 7378057 - DNA, 22 bp, Homo sapiens
agaacagcaggaaggccaggta

SEQ ID NO: 7378058 - DNA, 22 bp, Homo sapiens
agaacactgtaaagtcattgaa

SEQ ID NO: 7378059 - DNA, 22 bp, Homo sapiens
agaaagggtcactgaaagagga

SEQ ID NO: 7378060 - DNA, 22 bp, Homo sapiens
agaaaggtcacttagcctcagc

SEQ ID NO: 7378061 - DNA, 22 bp, Homo sapiens
acatgctttgcacttacatcat

SEQ ID NO: 7378062 - DNA, 22 bp, Homo sapiens
acatgctttgatgtattttgca

SEQ ID NO: 7378063 - DNA, 22 bp, Homo sapiens
acatgctttaacttattttgat

SEQ ID NO: 7378064 - DNA, 22 bp, Homo sapiens
acatgcttttcccacaattata

SEQ ID NO: 7378065 - DNA, 22 bp, Homo sapiens
acatgctatgagagattacttc

SEQ ID NO: 7378066 - DNA, 22 bp, Homo sapiens
acatgcttccaaattatgttgg

SEQ ID NO: 7378067 - DNA, 22 bp, Homo sapiens
acatgcttccaaattatgttgg

SEQ ID NO: 7378068 - DNA, 22 bp, Homo sapiens
acatgcttctgtttcaagaact

SEQ ID NO: 7378069 - DNA, 22 bp, Homo sapiens
acatcacagtagttaagccaga

SEQ ID NO: 7378070 - DNA, 22 bp, Homo sapiens
acatccatcttatgagataggt

SEQ ID NO: 7378071 - DNA, 22 bp, Homo sapiens
acatcagtcttttgcatacata

SEQ ID NO: 7378072 - DNA, 23 bp, Homo sapiens
acatcatgatagccaacttggga

SEQ ID NO: 7378073 - DNA, 22 bp, Homo sapiens
aggcctgaaggaagatgagctg

SEQ ID NO: 7378074 - DNA, 22 bp, Homo sapiens
aggcctcttgtcttcctcacat

SEQ ID NO: 7378075 - DNA, 22 bp, Homo sapiens
aggcctgaagtgtggagtgggg

SEQ ID NO: 7378076 - DNA, 20 bp, Homo sapiens
aggcctgagagatgactggg

SEQ ID NO: 7378077 - DNA, 22 bp, Homo sapiens
aggcctgagcagaggagtggac

SEQ ID NO: 7378078 - DNA, 22 bp, Homo sapiens
aggcctctgggtctcctctgac

SEQ ID NO: 7378079 - DNA, 22 bp, Homo sapiens
acatgtttggctctatgctata

SEQ ID NO: 7378080 - DNA, 22 bp, Homo sapiens
acatgtttaagtttgttatatg

SEQ ID NO: 7378081 - DNA, 22 bp, Homo sapiens
acatgtttgataaatatttggg

SEQ ID NO: 7378082 - DNA, 22 bp, Homo sapiens
acatgtttaagtttaatgaaaa

SEQ ID NO: 7378083 - DNA, 22 bp, Homo sapiens
acatgtttaagtttaatgaaaa

SEQ ID NO: 7378084 - DNA, 22 bp, Homo sapiens
acatgtttaagtttgttatatg

SEQ ID NO: 7378085 - DNA, 22 bp, Homo sapiens
acatgtttaagtttaatgaaaa

SEQ ID NO: 7378086 - DNA, 22 bp, Homo sapiens
aggccagggtagggcccattgt

SEQ ID NO: 7378087 - DNA, 22 bp, Homo sapiens
acatgttagggacagagtatgt

SEQ ID NO: 7378088 - DNA, 22 bp, Homo sapiens
acatgttagctactattgttat

SEQ ID NO: 7378089 - DNA, 22 bp, Homo sapiens
acatttctttctattcagtagc

SEQ ID NO: 7378090 - DNA, 22 bp, Homo sapiens
acatttcttgatgcctctgtga

SEQ ID NO: 7378091 - DNA, 22 bp, Homo sapiens
acatttcttgatgcctctgtga

SEQ ID NO: 7378092 - DNA, 22 bp, Homo sapiens
acatttctcttgatgtctctat

SEQ ID NO: 7378093 - DNA, 22 bp, Homo sapiens
acatttcttttcatctctatat

SEQ ID NO: 7378094 - DNA, 18 bp, Homo sapiens
acatttctatgcttctgg

SEQ ID NO: 7378095 - DNA, 22 bp, Homo sapiens
acatttctcagggagttttgct

SEQ ID NO: 7378096 - DNA, 22 bp, Homo sapiens
aggcctgaggttcctgtgctca

SEQ ID NO: 7378097 - DNA, 22 bp, Homo sapiens
aggcctgaggttcctgtgctca

SEQ ID NO: 7378098 - DNA, 22 bp, Homo sapiens
acattgcaataataattctctt

SEQ ID NO: 7378099 - DNA, 22 bp, Homo sapiens
aggctgagaaagtgggaagatg

SEQ ID NO: 7378100 - DNA, 22 bp, Homo sapiens
acatttctagttgttcatctcc

SEQ ID NO: 7378101 - DNA, 22 bp, Homo sapiens
acatttctatagtgcatctgtt

SEQ ID NO: 7378102 - DNA, 22 bp, Homo sapiens
acatttctatagtgcatctgtt

SEQ ID NO: 7378103 - DNA, 18 bp, Homo sapiens
acatttctatgcttctgg

SEQ ID NO: 7378104 - DNA, 22 bp, Homo sapiens
acatttctaatttaatgtaaca

SEQ ID NO: 7378105 - DNA, 22 bp, Homo sapiens
acatttcagaatcacacagctt

SEQ ID NO: 7378106 - DNA, 22 bp, Homo sapiens
acattgtataatgattatcaca

SEQ ID NO: 7378107 - DNA, 22 bp, Homo sapiens
acattgtatacagacttagtca

SEQ ID NO: 7378108 - DNA, 22 bp, Homo sapiens
acatttcactgttcacagcagg

SEQ ID NO: 7378109 - DNA, 22 bp, Homo sapiens
acattgtagacttttcatatgt

SEQ ID NO: 7378110 - DNA, 22 bp, Homo sapiens
acattgtagacttttcatatgt

SEQ ID NO: 7378111 - DNA, 22 bp, Homo sapiens
acattgtagacttttcatatgt

SEQ ID NO: 7378112 - DNA, 22 bp, Homo sapiens
acattgtaaatacctttatcac

SEQ ID NO: 7378113 - DNA, 22 bp, Homo sapiens
agggcagcaatgcagctgctgc

SEQ ID NO: 7378114 - DNA, 22 bp, Homo sapiens
agggcagcaaagtttgacctca

SEQ ID NO: 7378115 - DNA, 22 bp, Homo sapiens
agggcagcagctcctcctagct

SEQ ID NO: 7378116 - DNA, 22 bp, Homo sapiens
agggcagcaatttggttcctgg

SEQ ID NO: 7378117 - DNA, 22 bp, Homo sapiens
agggcagcaatttggttcctgg

SEQ ID NO: 7378118 - DNA, 22 bp, Homo sapiens
agggcagcaatgcagctgctgc

SEQ ID NO: 7378119 - DNA, 22 bp, Homo sapiens
agggagaggctgaactatccta

SEQ ID NO: 7378120 - DNA, 17 bp, Homo sapiens
accagcctctcctgggg

SEQ ID NO: 7378121 - DNA, 22 bp, Homo sapiens
agggagagacatttccttcttg

SEQ ID NO: 7378122 - DNA, 22 bp, Homo sapiens
agggagagaagttatacaagat

SEQ ID NO: 7378123 - DNA, 22 bp, Homo sapiens
agggagaggagcgtttcacatc

SEQ ID NO: 7378124 - DNA, 22 bp, Homo sapiens
acatttgtctggctagaaagtt

SEQ ID NO: 7378125 - DNA, 22 bp, Homo sapiens
accagagctcttcagcacagga

SEQ ID NO: 7378126 - DNA, 22 bp, Homo sapiens
accagcagctgccagagtggag

SEQ ID NO: 7378127 - DNA, 21 bp, Homo sapiens
accagcaggagatcagaagga

SEQ ID NO: 7378128 - DNA, 22 bp, Homo sapiens
accagcagcctagagcgttctt

SEQ ID NO: 7378129 - DNA, 22 bp, Homo sapiens
accagcagagttgaggaggaca

SEQ ID NO: 7378130 - DNA, 22 bp, Homo sapiens
accagcaggccaggggcactgc

SEQ ID NO: 7378131 - DNA, 22 bp, Homo sapiens
accagcaggtggcagtatgtat

SEQ ID NO: 7378132 - DNA, 22 bp, Homo sapiens
accagcagttatgaggccagga

SEQ ID NO: 7378133 - DNA, 22 bp, Homo sapiens
agggagacaaaagcagctgcca

SEQ ID NO: 7378134 - DNA, 22 bp, Homo sapiens
agggagacaaaagcagctgcca

SEQ ID NO: 7378135 - DNA, 22 bp, Homo sapiens
agggagacacatgaggaagtca

SEQ ID NO: 7378136 - DNA, 22 bp, Homo sapiens
agggagacaaaagcagctgcca

SEQ ID NO: 7378137 - DNA, 22 bp, Homo sapiens
agggagacacatgaggaagtca

SEQ ID NO: 7378138 - DNA, 22 bp, Homo sapiens
aggctttacgtcttcccctggg

SEQ ID NO: 7378139 - DNA, 21 bp, Homo sapiens
aggctttacctctgggtaggt

SEQ ID NO: 7378140 - DNA, 22 bp, Homo sapiens
aggctttaattatctacaggag

SEQ ID NO: 7378141 - DNA, 22 bp, Homo sapiens
aggctttaagcaagcatattgt

SEQ ID NO: 7378142 - DNA, 22 bp, Homo sapiens
aggctttaagtggcctacagct

SEQ ID NO: 7378143 - DNA, 23 bp, Homo sapiens
aggctttaatctgatattcagat

SEQ ID NO: 7378144 - DNA, 22 bp, Homo sapiens
aggcttggttaattctgtgtga

SEQ ID NO: 7378145 - DNA, 22 bp, Homo sapiens
aggcttgggactgcttaggagc

SEQ ID NO: 7378146 - DNA, 22 bp, Homo sapiens
acccaggacaaaataaccaggt

SEQ ID NO: 7378147 - DNA, 22 bp, Homo sapiens
acccaggacacagagatgaccc

SEQ ID NO: 7378148 - DNA, 22 bp, Homo sapiens
acccaggaaaacatggtgcaga

SEQ ID NO: 7378149 - DNA, 19 bp, Homo sapiens
acccagcccaggagtggca

SEQ ID NO: 7378150 - DNA, 22 bp, Homo sapiens
acccagcccagaatctggggcc

SEQ ID NO: 7378151 - DNA, 22 bp, Homo sapiens
acccagcctacaaagctcacct

SEQ ID NO: 7378152 - DNA, 22 bp, Homo sapiens
acccagccacagcattgaggga

SEQ ID NO: 7378153 - DNA, 22 bp, Homo sapiens
acccagccatgttcagttctct

SEQ ID NO: 7378154 - DNA, 22 bp, Homo sapiens
agggggcattatgaggcttttc

SEQ ID NO: 7378155 - DNA, 22 bp, Homo sapiens
agggggaggctgtgctgcgtct

SEQ ID NO: 7378156 - DNA, 22 bp, Homo sapiens
agggggagtttcagttagaaag

SEQ ID NO: 7378157 - DNA, 22 bp, Homo sapiens
agggggcaggagagacctgctg

SEQ ID NO: 7378158 - DNA, 22 bp, Homo sapiens
acaggggcaggcaggacccttt

SEQ ID NO: 7378159 - DNA, 22 bp, Homo sapiens
aggacacacaaagagtgagaac

SEQ ID NO: 7378160 - DNA, 22 bp, Homo sapiens
acagggagccccagcatttcca

SEQ ID NO: 7378161 - DNA, 18 bp, Homo sapiens
acagggagggcgctgggg

SEQ ID NO: 7378162 - DNA, 18 bp, Homo sapiens
acagggagggcgctgggg

SEQ ID NO: 7378163 - DNA, 22 bp, Homo sapiens
aggaagaaactgagctctgaca

SEQ ID NO: 7378164 - DNA, 22 bp, Homo sapiens
aggaagaacctaagaaagtctc

SEQ ID NO: 7378165 - DNA, 23 bp, Homo sapiens
aggaagagagagtgcctctttct

SEQ ID NO: 7378166 - DNA, 22 bp, Homo sapiens
acaggcagggacctcttgagtt

SEQ ID NO: 7378167 - DNA, 22 bp, Homo sapiens
acaggcagggaccttggctaag

SEQ ID NO: 7378168 - DNA, 22 bp, Homo sapiens
acagggaatggagggatcagta

SEQ ID NO: 7378169 - DNA, 22 bp, Homo sapiens
acagggacctgtgagctccata

SEQ ID NO: 7378170 - DNA, 22 bp, Homo sapiens
acagggagatatcttcaatatc

SEQ ID NO: 7378171 - DNA, 22 bp, Homo sapiens
acagggagatgggtgaaagcgg

SEQ ID NO: 7378172 - DNA, 22 bp, Homo sapiens
acaggcaggcgggacagcccga

SEQ ID NO: 7378173 - DNA, 22 bp, Homo sapiens
acaggcaggcttcggccagagc

SEQ ID NO: 7378174 - DNA, 22 bp, Homo sapiens
acaggcagcgtcattgctgctc

SEQ ID NO: 7378175 - DNA, 22 bp, Homo sapiens
acaggcagccctctccctggtt

SEQ ID NO: 7378176 - DNA, 22 bp, Homo sapiens
acaggcagattaagggtaggca

SEQ ID NO: 7378177 - DNA, 17 bp, Homo sapiens
acaggcagatcacctga

SEQ ID NO: 7378178 - DNA, 22 bp, Homo sapiens
acaggcagatgttttagttgta

SEQ ID NO: 7378179 - DNA, 22 bp, Homo sapiens
acaggcagcaaaatcagcctca

SEQ ID NO: 7378180 - DNA, 22 bp, Homo sapiens
acaggcagcaaaatcagcctca

SEQ ID NO: 7378181 - DNA, 22 bp, Homo sapiens
acaggcacaggtgtgccccacc

SEQ ID NO: 7378182 - DNA, 22 bp, Homo sapiens
agctggtgtgccagttccagtt

SEQ ID NO: 7378183 - DNA, 22 bp, Homo sapiens
agctggtgtcacctccagtcca

SEQ ID NO: 7378184 - DNA, 22 bp, Homo sapiens
acaggagtagggctggtggaga

SEQ ID NO: 7378185 - DNA, 22 bp, Homo sapiens
acaggaggggcatgaaagacgg

SEQ ID NO: 7378186 - DNA, 22 bp, Homo sapiens
acaggagggacaccttcctgct

SEQ ID NO: 7378187 - DNA, 22 bp, Homo sapiens
acaggagggacaccttcctgct

SEQ ID NO: 7378188 - DNA, 23 bp, Homo sapiens
acaggaggggacaggtggccgtg

SEQ ID NO: 7378189 - DNA, 21 bp, Homo sapiens
acagctgcctgccatgggggt

SEQ ID NO: 7378190 - DNA, 22 bp, Homo sapiens
acagctgccaagacagagcagg

SEQ ID NO: 7378191 - DNA, 22 bp, Homo sapiens
acagctgctcacctgtgagccc

SEQ ID NO: 7378192 - DNA, 22 bp, Homo sapiens
acagctgctctacaggttattt

SEQ ID NO: 7378193 - DNA, 22 bp, Homo sapiens
acagctgctctacaggttattt

SEQ ID NO: 7378194 - DNA, 22 bp, Homo sapiens
acagctgctctacaggttattt

SEQ ID NO: 7378195 - DNA, 22 bp, Homo sapiens
acagctgtatccccagagctca

SEQ ID NO: 7378196 - DNA, 22 bp, Homo sapiens
agctctggttattgaagcaggg

SEQ ID NO: 7378197 - DNA, 22 bp, Homo sapiens
agctgactgatgaagaggcctt

SEQ ID NO: 7378198 - DNA, 22 bp, Homo sapiens
agctgacctggaagggggcacg

SEQ ID NO: 7378199 - DNA, 22 bp, Homo sapiens
agctgagagctgtgtcaagata

SEQ ID NO: 7378200 - DNA, 22 bp, Homo sapiens
acagtctctgttgctgctgttt

SEQ ID NO: 7378201 - DNA, 22 bp, Homo sapiens
acagtcagggcttactcaggga

SEQ ID NO: 7378202 - DNA, 22 bp, Homo sapiens
acagtcatagcagcctttgtta

SEQ ID NO: 7378203 - DNA, 22 bp, Homo sapiens
acagtcaatgagtgagtgaatg

SEQ ID NO: 7378204 - DNA, 22 bp, Homo sapiens
acagtgggatgaggctggcccc

SEQ ID NO: 7378205 - DNA, 20 bp, Homo sapiens
acagtgggtggggagcactg

SEQ ID NO: 7378206 - DNA, 22 bp, Homo sapiens
aggacacagctcttcagtaaga

SEQ ID NO: 7378207 - DNA, 22 bp, Homo sapiens
aggacacagacttagatttaaa

SEQ ID NO: 7378208 - DNA, 22 bp, Homo sapiens
acagtatatatggttatctgat

SEQ ID NO: 7378209 - DNA, 22 bp, Homo sapiens
acagtacaccactgtgtacagt

SEQ ID NO: 7378210 - DNA, 22 bp, Homo sapiens
aggagcagaatttaatgtgcag

SEQ ID NO: 7378211 - DNA, 22 bp, Homo sapiens
aggagattggctgaaaaatatt

SEQ ID NO: 7378212 - DNA, 22 bp, Homo sapiens
aggagatggagctcagtgggca

SEQ ID NO: 7378213 - DNA, 22 bp, Homo sapiens
aggagcagaactgttgtggagg

SEQ ID NO: 7378214 - DNA, 22 bp, Homo sapiens
aggagcagaactgttgtggagg

SEQ ID NO: 7378215 - DNA, 22 bp, Homo sapiens
aggagcagaactgattctgact

SEQ ID NO: 7378216 - DNA, 22 bp, Homo sapiens
acagtttgagaaccactagcct

SEQ ID NO: 7378217 - DNA, 21 bp, Homo sapiens
acagtttattagagtaagtgc

SEQ ID NO: 7378218 - DNA, 22 bp, Homo sapiens
aggcactgggtaattagtagct

SEQ ID NO: 7378219 - DNA, 22 bp, Homo sapiens
aggcactgggtaattagtagct

SEQ ID NO: 7378220 - DNA, 22 bp, Homo sapiens
aggcactgggggatgagcaagg

SEQ ID NO: 7378221 - DNA, 22 bp, Homo sapiens
aggcactgggggatgagcaagg

SEQ ID NO: 7378222 - DNA, 22 bp, Homo sapiens
aggcactgggggatgagcaagg

SEQ ID NO: 7378223 - DNA, 20 bp, Homo sapiens
aggcactggggataggtaag

SEQ ID NO: 7378224 - DNA, 22 bp, Homo sapiens
aggcactgggaatatgctgagg

SEQ ID NO: 7378225 - DNA, 22 bp, Homo sapiens
aggcactgggaatatgctgagg

SEQ ID NO: 7378226 - DNA, 22 bp, Homo sapiens
aggcactgggaatatgctgagg

SEQ ID NO: 7378227 - DNA, 20 bp, Homo sapiens
aggcactggatttcttatat

SEQ ID NO: 7378228 - DNA, 20 bp, Homo sapiens
aggcactggatttcttatat

SEQ ID NO: 7378229 - DNA, 18 bp, Homo sapiens
aggcactggaattaaggg

SEQ ID NO: 7378230 - DNA, 22 bp, Homo sapiens
aggcactgcttctaagtaggaa

SEQ ID NO: 7378231 - DNA, 21 bp, Homo sapiens
aggatggaaaggactaggggt

SEQ ID NO: 7378232 - DNA, 22 bp, Homo sapiens
aggatgaggctggcaggtcttg

SEQ ID NO: 7378233 - DNA, 22 bp, Homo sapiens
acagtttaggatgagagaacac

SEQ ID NO: 7378234 - DNA, 22 bp, Homo sapiens
acagtttataaaaataatgagg

SEQ ID NO: 7378235 - DNA, 22 bp, Homo sapiens
acagtttagaatgccacatagt

SEQ ID NO: 7378236 - DNA, 22 bp, Homo sapiens
aggcagctctgtggcctcccag

SEQ ID NO: 7378237 - DNA, 21 bp, Homo sapiens
aggcagctcaggcccagagag

SEQ ID NO: 7378238 - DNA, 22 bp, Homo sapiens
aggcagctgaccacagtatgat

SEQ ID NO: 7378239 - DNA, 22 bp, Homo sapiens
aggcagctgaggtctggcgccc

SEQ ID NO: 7378240 - DNA, 21 bp, Homo sapiens
aggcagctggaaggcctggct

SEQ ID NO: 7378241 - DNA, 22 bp, Homo sapiens
aggcagctggaaaactccaggc

SEQ ID NO: 7378242 - DNA, 22 bp, Homo sapiens
aggcagctgccctctccttcct

SEQ ID NO: 7378243 - DNA, 22 bp, Homo sapiens
aggcagctggacataactaacc

SEQ ID NO: 7378244 - DNA, 20 bp, Homo sapiens
acatatcatggtagagtcct

SEQ ID NO: 7378245 - DNA, 22 bp, Homo sapiens
acatatgttgtaaacattccaa

SEQ ID NO: 7378246 - DNA, 22 bp, Homo sapiens
acatattggcaaactggaggca

SEQ ID NO: 7378247 - DNA, 22 bp, Homo sapiens
acatatttccatgcagcatgtc

SEQ ID NO: 7378248 - DNA, 22 bp, Homo sapiens
acatattttgaaagctttctaa

SEQ ID NO: 7378249 - DNA, 22 bp, Homo sapiens
acatatttccatgcagcatgtc

SEQ ID NO: 7378250 - DNA, 22 bp, Homo sapiens
acatagcaagtgctcaataaat

SEQ ID NO: 7378251 - DNA, 21 bp, Homo sapiens
acatacattatctttttaaaa

SEQ ID NO: 7378252 - DNA, 22 bp, Homo sapiens
acatagaacttcgatgtctttt

SEQ ID NO: 7378253 - DNA, 22 bp, Homo sapiens
acatagctcagtatcacttact

SEQ ID NO: 7378254 - DNA, 22 bp, Homo sapiens
aggcagctaagatggataatga

SEQ ID NO: 7378255 - DNA, 22 bp, Homo sapiens
aggcagctagagagtgaaactg

SEQ ID NO: 7378256 - DNA, 17 bp, Homo sapiens
aggcagctcagaacatc

SEQ ID NO: 7378257 - DNA, 20 bp, Homo sapiens
cagtgcctatcattaattcc

SEQ ID NO: 7378258 - DNA, 22 bp, Homo sapiens
cagtgcctgccttttattttgt

SEQ ID NO: 7378259 - DNA, 22 bp, Homo sapiens
cagtgcctggatagcaacatga

SEQ ID NO: 7378260 - DNA, 20 bp, Homo sapiens
cagtgcctgccccttgggtt

SEQ ID NO: 7378261 - DNA, 22 bp, Homo sapiens
cagtggcatggttgactgcagt

SEQ ID NO: 7378262 - DNA, 22 bp, Homo sapiens
cagtggcatggttgactgcagt

SEQ ID NO: 7378263 - DNA, 18 bp, Homo sapiens
cagtggcatagttgagta

SEQ ID NO: 7378264 - DNA, 22 bp, Homo sapiens
cagtggcatacttggctgatat

SEQ ID NO: 7378265 - DNA, 18 bp, Homo sapiens
cagtggcatagttgagta

SEQ ID NO: 7378266 - DNA, 18 bp, Homo sapiens
cagtggcatagttgagta

SEQ ID NO: 7378267 - DNA, 22 bp, Homo sapiens
cagtggccatggtggcaggggt

SEQ ID NO: 7378268 - DNA, 22 bp, Homo sapiens
aggagaagtaaggctagatgat

SEQ ID NO: 7378269 - DNA, 22 bp, Homo sapiens
aggagaaggaggcccctcacac

SEQ ID NO: 7378270 - DNA, 19 bp, Homo sapiens
aggagaagtagcagaaatt

SEQ ID NO: 7378271 - DNA, 22 bp, Homo sapiens
aggaccctgaggtctcctgtga

SEQ ID NO: 7378272 - DNA, 22 bp, Homo sapiens
aggaccctgctcaagcatctcc

SEQ ID NO: 7378273 - DNA, 21 bp, Homo sapiens
aggacctagaaaagtgcctag

SEQ ID NO: 7378274 - DNA, 22 bp, Homo sapiens
aggacccagaaggtgcagcaga

SEQ ID NO: 7378275 - DNA, 22 bp, Homo sapiens
aggaccctgagcgggcatgccg

SEQ ID NO: 7378276 - DNA, 22 bp, Homo sapiens
aggacccagaggcagaggacgt

SEQ ID NO: 7378277 - DNA, 22 bp, Homo sapiens
aggacgctctcgctgaacttct

SEQ ID NO: 7378278 - DNA, 22 bp, Homo sapiens
aggaccaccggtccatccaccc

SEQ ID NO: 7378279 - DNA, 22 bp, Homo sapiens
caggtgccatagacgggcctgg

SEQ ID NO: 7378280 - DNA, 22 bp, Homo sapiens
caggtgcacattactgtgttgg

SEQ ID NO: 7378281 - DNA, 22 bp, Homo sapiens
catagtaagtgcataataaatg

SEQ ID NO: 7378282 - DNA, 22 bp, Homo sapiens
catagcttaggggttaaactca

SEQ ID NO: 7378283 - DNA, 22 bp, Homo sapiens
catagattcttatttccatctt

SEQ ID NO: 7378284 - DNA, 22 bp, Homo sapiens
aggagggagcttaagccaggca

SEQ ID NO: 7378285 - DNA, 22 bp, Homo sapiens
aggagggagcttaagccaggca

SEQ ID NO: 7378286 - DNA, 22 bp, Homo sapiens
aggagggagcttaagccaggca

SEQ ID NO: 7378287 - DNA, 22 bp, Homo sapiens
catatttcagtctaagatgtgt

SEQ ID NO: 7378288 - DNA, 22 bp, Homo sapiens
catattgtctattgctgttttt

SEQ ID NO: 7378289 - DNA, 22 bp, Homo sapiens
catatttagtgtttggagatcg

SEQ ID NO: 7378290 - DNA, 22 bp, Homo sapiens
catatttagtgtttggagatcg

SEQ ID NO: 7378291 - DNA, 22 bp, Homo sapiens
catatttatagatctggcattt

SEQ ID NO: 7378292 - DNA, 22 bp, Homo sapiens
cagtttatgcagctggaataga

SEQ ID NO: 7378293 - DNA, 22 bp, Homo sapiens
cagtggtagaagccaagtagat

SEQ ID NO: 7378294 - DNA, 22 bp, Homo sapiens
cagtttcagaatcaaaacatca

SEQ ID NO: 7378295 - DNA, 22 bp, Homo sapiens
cagtttcagaatcaaaacatca

SEQ ID NO: 7378296 - DNA, 22 bp, Homo sapiens
cagtttctcaggcctctcccag

SEQ ID NO: 7378297 - DNA, 22 bp, Homo sapiens
cagtttctctcaataagcatcg

SEQ ID NO: 7378298 - DNA, 22 bp, Homo sapiens
cagtttctacgacttaagcaca

SEQ ID NO: 7378299 - DNA, 22 bp, Homo sapiens
cagtttctctcatacatatttg

SEQ ID NO: 7378300 - DNA, 22 bp, Homo sapiens
cagttttagggcaatgtgaaga

SEQ ID NO: 7378301 - DNA, 20 bp, Homo sapiens
ccaataaagctctataggga

SEQ ID NO: 7378302 - DNA, 23 bp, Homo sapiens
aggcagcaggttgtccagggtga

SEQ ID NO: 7378303 - DNA, 22 bp, Homo sapiens
aggcagcagggccactggctga

SEQ ID NO: 7378304 - DNA, 19 bp, Homo sapiens
aggcagcaggccagggatg

SEQ ID NO: 7378305 - DNA, 22 bp, Homo sapiens
ccaagcaaggctaattcacttg

SEQ ID NO: 7378306 - DNA, 22 bp, Homo sapiens
ccaagcaggatattctgtgtca

SEQ ID NO: 7378307 - DNA, 16 bp, Homo sapiens
ccaagcagcagcagct

SEQ ID NO: 7378308 - DNA, 22 bp, Homo sapiens
ccaagcagaaccattcaggcac

SEQ ID NO: 7378309 - DNA, 22 bp, Homo sapiens
ccaagcagagcagcctctctgg

SEQ ID NO: 7378310 - DNA, 22 bp, Homo sapiens
cattaaatatcaacctagacta

SEQ ID NO: 7378311 - DNA, 15 bp, Homo sapiens
aggcactgtgggacc

SEQ ID NO: 7378312 - DNA, 22 bp, Homo sapiens
aggcactgtggaagacatggtt

SEQ ID NO: 7378313 - DNA, 22 bp, Homo sapiens
aggcactgtggaagacatggtt

SEQ ID NO: 7378314 - DNA, 22 bp, Homo sapiens
aggcactgtgcttcttatatgt

SEQ ID NO: 7378315 - DNA, 22 bp, Homo sapiens
aggcactgtgcttcttatatgt

SEQ ID NO: 7378316 - DNA, 22 bp, Homo sapiens
aggcactgtgctgatgtcttat

SEQ ID NO: 7378317 - DNA, 22 bp, Homo sapiens
aggcactgtgcagtcccaagca

SEQ ID NO: 7378318 - DNA, 22 bp, Homo sapiens
aggcactgtgcagtcccaagca

SEQ ID NO: 7378319 - DNA, 22 bp, Homo sapiens
aggcactgtgctgatgtcttat

SEQ ID NO: 7378320 - DNA, 22 bp, Homo sapiens
aggcactggtctaccccttagt

SEQ ID NO: 7378321 - DNA, 22 bp, Homo sapiens
aggcactggtctaccccttagt

SEQ ID NO: 7378322 - DNA, 22 bp, Homo sapiens
aggcactgtactaggtacaggg

SEQ ID NO: 7378323 - DNA, 21 bp, Homo sapiens
aggcagcaggatccagggaca

SEQ ID NO: 7378324 - DNA, 22 bp, Homo sapiens
catttgtttagaagtctttata

SEQ ID NO: 7378325 - DNA, 22 bp, Homo sapiens
catttgttggtcagattgtagt

SEQ ID NO: 7378326 - DNA, 22 bp, Homo sapiens
catttgttgggacaatgaaaag

SEQ ID NO: 7378327 - DNA, 22 bp, Homo sapiens
catttgaaattcttagaacaaa

SEQ ID NO: 7378328 - DNA, 22 bp, Homo sapiens
cattaacaatgactgcttgact

SEQ ID NO: 7378329 - DNA, 22 bp, Homo sapiens
catttgttaagaaggaaaaagg

SEQ ID NO: 7378330 - DNA, 22 bp, Homo sapiens
catttgttctgatttcaaaagg

SEQ ID NO: 7378331 - DNA, 22 bp, Homo sapiens
catttgttaattactattatct

SEQ ID NO: 7378332 - DNA, 22 bp, Homo sapiens
aggagggagcttaagccaggca

SEQ ID NO: 7378333 - DNA, 22 bp, Homo sapiens
aggagggatagaaaaatacttg

SEQ ID NO: 7378334 - DNA, 21 bp, Homo sapiens
aggagggcacaaggccaggaa

SEQ ID NO: 7378335 - DNA, 20 bp, Homo sapiens
aggaggggatagaatcaaag

SEQ ID NO: 7378336 - DNA, 22 bp, Homo sapiens
catggagataaactgaaatatt

SEQ ID NO: 7378337 - DNA, 22 bp, Homo sapiens
catggcaataggaatgatgtga

SEQ ID NO: 7378338 - DNA, 22 bp, Homo sapiens
aggcactgcagattacaggcgc

SEQ ID NO: 7378339 - DNA, 22 bp, Homo sapiens
aggcactgcagattacaggcgc

SEQ ID NO: 7378340 - DNA, 19 bp, Homo sapiens
catggtgaaaccccgtctc

SEQ ID NO: 7378341 - DNA, 22 bp, Homo sapiens
aggatttctgtgcctggaaaat

SEQ ID NO: 7378342 - DNA, 21 bp, Homo sapiens
aggatttactattaactgtgt

SEQ ID NO: 7378343 - DNA, 22 bp, Homo sapiens
cagggcctgcaagagacctggg

SEQ ID NO: 7378344 - DNA, 22 bp, Homo sapiens
cagggctcgctgccagcttcag

SEQ ID NO: 7378345 - DNA, 22 bp, Homo sapiens
cagggtgcatacccatgcatac

SEQ ID NO: 7378346 - DNA, 22 bp, Homo sapiens
cagggtgcagtgtcgctgctag

SEQ ID NO: 7378347 - DNA, 22 bp, Homo sapiens
caggtgagctctatctagggag

SEQ ID NO: 7378348 - DNA, 22 bp, Homo sapiens
caggcctgtctgcacatgaggc

SEQ ID NO: 7378349 - DNA, 22 bp, Homo sapiens
caggctcactgtaaggtcagct

SEQ ID NO: 7378350 - DNA, 22 bp, Homo sapiens
caggctcagctctggccagtgc

SEQ ID NO: 7378351 - DNA, 22 bp, Homo sapiens
caggctcagaagccagtggagc

SEQ ID NO: 7378352 - DNA, 22 bp, Homo sapiens
caggctgcggccgtgtgagcat

SEQ ID NO: 7378353 - DNA, 19 bp, Homo sapiens
cagggatgggtagggactc

SEQ ID NO: 7378354 - DNA, 22 bp, Homo sapiens
cagggatgggatggagtcagtt

SEQ ID NO: 7378355 - DNA, 22 bp, Homo sapiens
cagggagctggtgccagccgac

SEQ ID NO: 7378356 - DNA, 22 bp, Homo sapiens
cagggagctttcccaggaccct

SEQ ID NO: 7378357 - DNA, 22 bp, Homo sapiens
cagggagctggtgccagccgac

SEQ ID NO: 7378358 - DNA, 22 bp, Homo sapiens
cagggagctgacaaccaaggag

SEQ ID NO: 7378359 - DNA, 22 bp, Homo sapiens
cagggagctggagttggagtac

SEQ ID NO: 7378360 - DNA, 22 bp, Homo sapiens
cagggagctattagggttagtg

SEQ ID NO: 7378361 - DNA, 22 bp, Homo sapiens
cagggagctctgggccggactc

SEQ ID NO: 7378362 - DNA, 22 bp, Homo sapiens
cagggagctggctggcgtgagt

SEQ ID NO: 7378363 - DNA, 22 bp, Homo sapiens
cagggagctggctggcgtgagt

SEQ ID NO: 7378364 - DNA, 22 bp, Homo sapiens
cagggagctggctggctgtgcc

SEQ ID NO: 7378365 - DNA, 22 bp, Homo sapiens
cagggagctggctggctgtgcc

SEQ ID NO: 7378366 - DNA, 22 bp, Homo sapiens
cagggagctattagggttagtg

SEQ ID NO: 7378367 - DNA, 22 bp, Homo sapiens
cagggagcggagtcccatgcct

SEQ ID NO: 7378368 - DNA, 22 bp, Homo sapiens
cagggagaaatctccaggaggt

SEQ ID NO: 7378369 - DNA, 22 bp, Homo sapiens
agctgctgggaccccagatcca

SEQ ID NO: 7378370 - DNA, 19 bp, Homo sapiens
agctgctggcccagggacc

SEQ ID NO: 7378371 - DNA, 22 bp, Homo sapiens
caggcactggccagtcagcaca

SEQ ID NO: 7378372 - DNA, 22 bp, Homo sapiens
caggcactgcactaccactttt

SEQ ID NO: 7378373 - DNA, 22 bp, Homo sapiens
caggcactgtgcaagggtctcg

SEQ ID NO: 7378374 - DNA, 22 bp, Homo sapiens
caggcactgtgctagatccttg

SEQ ID NO: 7378375 - DNA, 22 bp, Homo sapiens
caggcactgtgctgagctctgc

SEQ ID NO: 7378376 - DNA, 22 bp, Homo sapiens
caggaggattgcttgaggccag

SEQ ID NO: 7378377 - DNA, 22 bp, Homo sapiens
caggaggagcattagcgtctca

SEQ ID NO: 7378378 - DNA, 22 bp, Homo sapiens
agctgggctggagctccaagcg

SEQ ID NO: 7378379 - DNA, 18 bp, Homo sapiens
agctggccctggctgccg

SEQ ID NO: 7378380 - DNA, 22 bp, Homo sapiens
caggcatagaagggcaagaata

SEQ ID NO: 7378381 - DNA, 22 bp, Homo sapiens
agctggcccactgtgtggtcca

SEQ ID NO: 7378382 - DNA, 20 bp, Homo sapiens
agctggcccccggtggcctg

SEQ ID NO: 7378383 - DNA, 22 bp, Homo sapiens
agctggccattgtgagtggcct

SEQ ID NO: 7378384 - DNA, 22 bp, Homo sapiens
caggcacttctgctgcttgtct

SEQ ID NO: 7378385 - DNA, 22 bp, Homo sapiens
caggcactgtgttaggcactgt

SEQ ID NO: 7378386 - DNA, 22 bp, Homo sapiens
caggcactgtgttaggcactgt

SEQ ID NO: 7378387 - DNA, 18 bp, Homo sapiens
agctgcagaccaggaggt

SEQ ID NO: 7378388 - DNA, 19 bp, Homo sapiens
agctgcagaccagaagtgc

SEQ ID NO: 7378389 - DNA, 22 bp, Homo sapiens
caggaaggaccgtccagatcag

SEQ ID NO: 7378390 - DNA, 22 bp, Homo sapiens
agctgcagcactccagtagccg

SEQ ID NO: 7378391 - DNA, 22 bp, Homo sapiens
caggaaggcgcggctgtgcctg

SEQ ID NO: 7378392 - DNA, 22 bp, Homo sapiens
agctgcatgtcttattgagctg

SEQ ID NO: 7378393 - DNA, 20 bp, Homo sapiens
agctgcatatttatgtgtac

SEQ ID NO: 7378394 - DNA, 22 bp, Homo sapiens
cagctctgggtgacaggagggc

SEQ ID NO: 7378395 - DNA, 22 bp, Homo sapiens
cagctctgggtaggaggaatct

SEQ ID NO: 7378396 - DNA, 22 bp, Homo sapiens
cagctctggggcagagtgacta

SEQ ID NO: 7378397 - DNA, 22 bp, Homo sapiens
cagctgagaaaggcaggctcac

SEQ ID NO: 7378398 - DNA, 22 bp, Homo sapiens
cagctgacatggtatttgtgcc

SEQ ID NO: 7378399 - DNA, 22 bp, Homo sapiens
cagctgacagtgaggtgggggc

SEQ ID NO: 7378400 - DNA, 22 bp, Homo sapiens
cagctgacccgtgggaggcggg

SEQ ID NO: 7378401 - DNA, 22 bp, Homo sapiens
cagctgacccagtgaggaggca

SEQ ID NO: 7378402 - DNA, 22 bp, Homo sapiens
cagctgacaagagtccttggag

SEQ ID NO: 7378403 - DNA, 22 bp, Homo sapiens
cagctgagaaatggggaaaggg

SEQ ID NO: 7378404 - DNA, 22 bp, Homo sapiens
agctgcaccggctggaccactg

SEQ ID NO: 7378405 - DNA, 22 bp, Homo sapiens
aggcatgcgccaatttattaga

SEQ ID NO: 7378406 - DNA, 22 bp, Homo sapiens
aggcatgcatcactattcttag

SEQ ID NO: 7378407 - DNA, 22 bp, Homo sapiens
aggccagaagccagaaatgctt

SEQ ID NO: 7378408 - DNA, 22 bp, Homo sapiens
ccagcagagctggaagtgtgct

SEQ ID NO: 7378409 - DNA, 22 bp, Homo sapiens
ccagcagaggcatcatccttcc

SEQ ID NO: 7378410 - DNA, 22 bp, Homo sapiens
ccagcagagggcgcttcacacc

SEQ ID NO: 7378411 - DNA, 19 bp, Homo sapiens
ccagcagacacagctgccc

SEQ ID NO: 7378412 - DNA, 22 bp, Homo sapiens
ccagcagagcatggggaggaag

SEQ ID NO: 7378413 - DNA, 22 bp, Homo sapiens
ccagcagagctcaaacttcctg

SEQ ID NO: 7378414 - DNA, 19 bp, Homo sapiens
ccagagttcttgccattct

SEQ ID NO: 7378415 - DNA, 19 bp, Homo sapiens
ccagcagaagccactcctg

SEQ ID NO: 7378416 - DNA, 22 bp, Homo sapiens
ccagcagaagctcccgctgggt

SEQ ID NO: 7378417 - DNA, 22 bp, Homo sapiens
ccagcagacacacaggcgtggg

SEQ ID NO: 7378418 - DNA, 23 bp, Homo sapiens
ccacaggcacagaggcttgcatc

SEQ ID NO: 7378419 - DNA, 22 bp, Homo sapiens
ccacaggacggaggtctggccg

SEQ ID NO: 7378420 - DNA, 17 bp, Homo sapiens
aggcaggtaagagttat

SEQ ID NO: 7378421 - DNA, 17 bp, Homo sapiens
ccacagctgggtgcctt

SEQ ID NO: 7378422 - DNA, 22 bp, Homo sapiens
ccacaggacacaactgctgacc

SEQ ID NO: 7378423 - DNA, 22 bp, Homo sapiens
aggcaggggagctggaagggta

SEQ ID NO: 7378424 - DNA, 22 bp, Homo sapiens
ccagcttggagtaacaaatggt

SEQ ID NO: 7378425 - DNA, 21 bp, Homo sapiens
ccagctttcccaagtcccttt

SEQ ID NO: 7378426 - DNA, 22 bp, Homo sapiens
ccagctttatagcttcaaagga

SEQ ID NO: 7378427 - DNA, 22 bp, Homo sapiens
aggcccagctggacaaactgct

SEQ ID NO: 7378428 - DNA, 22 bp, Homo sapiens
aggcccagctggacaaactgct

SEQ ID NO: 7378429 - DNA, 22 bp, Homo sapiens
aggcccagcccgtcctcgtgct

SEQ ID NO: 7378430 - DNA, 19 bp, Homo sapiens
aggcccagcgctgggggct

SEQ ID NO: 7378431 - DNA, 21 bp, Homo sapiens
aggcccagagtcttgggggga

SEQ ID NO: 7378432 - DNA, 22 bp, Homo sapiens
aggcccagagcaggaaagggtt

SEQ ID NO: 7378433 - DNA, 22 bp, Homo sapiens
ccagcctgaaatgcctcatcct

SEQ ID NO: 7378434 - DNA, 22 bp, Homo sapiens
aggcccagagagccagttagtg

SEQ ID NO: 7378435 - DNA, 22 bp, Homo sapiens
ccagccctgccagagagagctg

SEQ ID NO: 7378436 - DNA, 22 bp, Homo sapiens
ccagcctcatcgcctgcctgtc

SEQ ID NO: 7378437 - DNA, 22 bp, Homo sapiens
ccagcctccatgtagatagctg

SEQ ID NO: 7378438 - DNA, 22 bp, Homo sapiens
ccagcctgaaatgcctcatcct

SEQ ID NO: 7378439 - DNA, 22 bp, Homo sapiens
ccaggagatttttccatagcac

SEQ ID NO: 7378440 - DNA, 22 bp, Homo sapiens
ccaggagcaaagatcactggga

SEQ ID NO: 7378441 - DNA, 22 bp, Homo sapiens
aggccctggcactgcctgggag

SEQ ID NO: 7378442 - DNA, 22 bp, Homo sapiens
aggccctggcactgcctgggag

SEQ ID NO: 7378443 - DNA, 22 bp, Homo sapiens
aggccctggcccccagagattc

SEQ ID NO: 7378444 - DNA, 22 bp, Homo sapiens
ccagcttttcagaatctgcctg

SEQ ID NO: 7378445 - DNA, 22 bp, Homo sapiens
aggccctggcctgactcaatgt

SEQ ID NO: 7378446 - DNA, 22 bp, Homo sapiens
aggccctggcccccagagattc

SEQ ID NO: 7378447 - DNA, 18 bp, Homo sapiens
aggccctggcctcgaaca

SEQ ID NO: 7378448 - DNA, 22 bp, Homo sapiens
aggccctggctgggtttcttta

SEQ ID NO: 7378449 - DNA, 22 bp, Homo sapiens
aggccctgggagcagagatgca

SEQ ID NO: 7378450 - DNA, 22 bp, Homo sapiens
aggccctggggtctgttaaatt

SEQ ID NO: 7378451 - DNA, 22 bp, Homo sapiens
aggccctgggttagggcccact

SEQ ID NO: 7378452 - DNA, 22 bp, Homo sapiens
aggccctgggcagttctgtagc

SEQ ID NO: 7378453 - DNA, 22 bp, Homo sapiens
ccatgtggctagcgtgcctgca

SEQ ID NO: 7378454 - DNA, 22 bp, Homo sapiens
ccatgggagatgatggggagtg

SEQ ID NO: 7378455 - DNA, 22 bp, Homo sapiens
aggctgcctcttttgagagggt

SEQ ID NO: 7378456 - DNA, 21 bp, Homo sapiens
cccagagcctagggagggcac

SEQ ID NO: 7378457 - DNA, 22 bp, Homo sapiens
cccagagccggtggtgctcaca

SEQ ID NO: 7378458 - DNA, 20 bp, Homo sapiens
cccagagccatagccagaca

SEQ ID NO: 7378459 - DNA, 22 bp, Homo sapiens
cccagagcatgtgctgcctttg

SEQ ID NO: 7378460 - DNA, 23 bp, Homo sapiens
cccagagcacagcctccagatgc

SEQ ID NO: 7378461 - DNA, 22 bp, Homo sapiens
aggctctgtgacaatcaagctg

SEQ ID NO: 7378462 - DNA, 22 bp, Homo sapiens
aggctgaggtgtgctgtgatcg

SEQ ID NO: 7378463 - DNA, 22 bp, Homo sapiens
aggctgaggtgtgctgtgatcg

SEQ ID NO: 7378464 - DNA, 22 bp, Homo sapiens
ccagggagcctggtgtgtcagc

SEQ ID NO: 7378465 - DNA, 22 bp, Homo sapiens
ccagggagcccacaggacaatg

SEQ ID NO: 7378466 - DNA, 22 bp, Homo sapiens
ccagggaatcaggcagaagtca

SEQ ID NO: 7378467 - DNA, 22 bp, Homo sapiens
ccagggaagtcacattgtctag

SEQ ID NO: 7378468 - DNA, 22 bp, Homo sapiens
ccagggaagtagttgtgagagc

SEQ ID NO: 7378469 - DNA, 17 bp, Homo sapiens
ccagggaggggccgcgc

SEQ ID NO: 7378470 - DNA, 22 bp, Homo sapiens
ccagggaggagcatttcatggt

SEQ ID NO: 7378471 - DNA, 22 bp, Homo sapiens
ccagggaaggctgctggctgtg

SEQ ID NO: 7378472 - DNA, 22 bp, Homo sapiens
ccaggaggatcatcctgttttc

SEQ ID NO: 7378473 - DNA, 22 bp, Homo sapiens
ccaggaggaaattctaaaggta

SEQ ID NO: 7378474 - DNA, 22 bp, Homo sapiens
ccaggaggaaagaccagcccat

SEQ ID NO: 7378475 - DNA, 22 bp, Homo sapiens
agggccctggggtgcactgaca

SEQ ID NO: 7378476 - DNA, 22 bp, Homo sapiens
agggccctctggcaggccaggc

SEQ ID NO: 7378477 - DNA, 22 bp, Homo sapiens
agggctcctatgatgctctgcc

SEQ ID NO: 7378478 - DNA, 22 bp, Homo sapiens
agggctctcttggacaactgct

SEQ ID NO: 7378479 - DNA, 22 bp, Homo sapiens
cctccccacgggcagccggcgc

SEQ ID NO: 7378480 - DNA, 22 bp, Homo sapiens
cctccccacgggcagccggcgc

SEQ ID NO: 7378481 - DNA, 22 bp, Homo sapiens
ccctggaggcaaaggttgcagt

SEQ ID NO: 7378482 - DNA, 22 bp, Homo sapiens
ccctggaggctggaggcagtag

SEQ ID NO: 7378483 - DNA, 22 bp, Homo sapiens
agggccagagtctgtgtagata

SEQ ID NO: 7378484 - DNA, 22 bp, Homo sapiens
agggccagaatccctcagtcta

SEQ ID NO: 7378485 - DNA, 22 bp, Homo sapiens
ccctttcccttctggctcaggg

SEQ ID NO: 7378486 - DNA, 21 bp, Homo sapiens
ccgccgctgatagctctgggc

SEQ ID NO: 7378487 - DNA, 22 bp, Homo sapiens
ccgaggtcctggacttggccct

SEQ ID NO: 7378488 - DNA, 22 bp, Homo sapiens
ccgaggacattgggcttctgtt

SEQ ID NO: 7378489 - DNA, 22 bp, Homo sapiens
cctgaggaccagcacccatctg

SEQ ID NO: 7378490 - DNA, 22 bp, Homo sapiens
aggggagagttaatgtgaatgt

SEQ ID NO: 7378491 - DNA, 22 bp, Homo sapiens
cctgaggacatcagcatcacct

SEQ ID NO: 7378492 - DNA, 22 bp, Homo sapiens
cctgaggacagtgtgaccatgg

SEQ ID NO: 7378493 - DNA, 19 bp, Homo sapiens
cctctgccagcccgcctct

SEQ ID NO: 7378494 - DNA, 18 bp, Homo sapiens
cctctgccatagccagca

SEQ ID NO: 7378495 - DNA, 18 bp, Homo sapiens
agggctgatgagtttggg

SEQ ID NO: 7378496 - DNA, 22 bp, Homo sapiens
cctcctggaaaaattccctggc

SEQ ID NO: 7378497 - DNA, 22 bp, Homo sapiens
cctcctgcacctccaggaactc

SEQ ID NO: 7378498 - DNA, 20 bp, Homo sapiens
ccctctgcacatggctgtgg

SEQ ID NO: 7378499 - DNA, 22 bp, Homo sapiens
ccctctgcaggctggacctgcc

SEQ ID NO: 7378500 - DNA, 22 bp, Homo sapiens
ccctctgctcaggtgcataggc

SEQ ID NO: 7378501 - DNA, 22 bp, Homo sapiens
ccctctgcctgcgccctggtgt

SEQ ID NO: 7378502 - DNA, 22 bp, Homo sapiens
ccctctgctcaggtgcataggc

SEQ ID NO: 7378503 - DNA, 22 bp, Homo sapiens
ccctctggctcttctcaggccg

SEQ ID NO: 7378504 - DNA, 18 bp, Homo sapiens
ccctcttgcacaaagcaa

SEQ ID NO: 7378505 - DNA, 22 bp, Homo sapiens
ccctggaggaccccaatgtggc

SEQ ID NO: 7378506 - DNA, 22 bp, Homo sapiens
agggcagagacatgcttcctga

SEQ ID NO: 7378507 - DNA, 22 bp, Homo sapiens
agggagtggttaagaaggtgca

SEQ ID NO: 7378508 - DNA, 17 bp, Homo sapiens
agggagtcagtaggagc

SEQ ID NO: 7378509 - DNA, 22 bp, Homo sapiens
agggagtcatatatacctgcat

SEQ ID NO: 7378510 - DNA, 22 bp, Homo sapiens
agggagtccattttagaggtgg

SEQ ID NO: 7378511 - DNA, 21 bp, Homo sapiens
agggagtctggaggaagcgtt

SEQ ID NO: 7378512 - DNA, 22 bp, Homo sapiens
agggagaaggtccatgcctgtc

SEQ ID NO: 7378513 - DNA, 17 bp, Homo sapiens
agggagtcagaggatcg

SEQ ID NO: 7378514 - DNA, 22 bp, Homo sapiens
agggagaaggtttagctgtgag

SEQ ID NO: 7378515 - DNA, 22 bp, Homo sapiens
agggagaacagttgcagcagac

SEQ ID NO: 7378516 - DNA, 22 bp, Homo sapiens
agggagaaaattggatgcacaa

SEQ ID NO: 7378517 - DNA, 22 bp, Homo sapiens
agggatcatcctgcaagtgcct

SEQ ID NO: 7378518 - DNA, 18 bp, Homo sapiens
agggatcatcactgcagc

SEQ ID NO: 7378519 - DNA, 22 bp, Homo sapiens
agggatcagtagggacggcagc

SEQ ID NO: 7378520 - DNA, 22 bp, Homo sapiens
agggatgctgctaagtggtcta

SEQ ID NO: 7378521 - DNA, 22 bp, Homo sapiens
agggatgctgctaagtggtcta

SEQ ID NO: 7378522 - DNA, 22 bp, Homo sapiens
aggcttctgctgtattaacact

SEQ ID NO: 7378523 - DNA, 22 bp, Homo sapiens
aggcttcctggaggaagaggta

SEQ ID NO: 7378524 - DNA, 22 bp, Homo sapiens
cccagggctgcagatggaggct

SEQ ID NO: 7378525 - DNA, 21 bp, Homo sapiens
cccagggaagccgcagtcacc

SEQ ID NO: 7378526 - DNA, 22 bp, Homo sapiens
cccagggccctggacagctaca

SEQ ID NO: 7378527 - DNA, 22 bp, Homo sapiens
agggaagaagctggtagtaggt

SEQ ID NO: 7378528 - DNA, 22 bp, Homo sapiens
agggaagaagctggtagtaggt

SEQ ID NO: 7378529 - DNA, 23 bp, Homo sapiens
agggaagaaacatgaagggctgt

SEQ ID NO: 7378530 - DNA, 22 bp, Homo sapiens
cccaggggtaaggcgcagcgtg

SEQ ID NO: 7378531 - DNA, 22 bp, Homo sapiens
cccaggggaggtcctcagggaa

SEQ ID NO: 7378532 - DNA, 22 bp, Homo sapiens
cccagggcttttctcactagac

SEQ ID NO: 7378533 - DNA, 22 bp, Homo sapiens
cccaggatggggctgcagttat

SEQ ID NO: 7378534 - DNA, 23 bp, Homo sapiens
cccaggagtttcactgcaaaggt

SEQ ID NO: 7378535 - DNA, 20 bp, Homo sapiens
agggaacaatggacgctgtc

SEQ ID NO: 7378536 - DNA, 23 bp, Homo sapiens
agggaacaagcaagctgctagtc

SEQ ID NO: 7378537 - DNA, 22 bp, Homo sapiens
agggaacagtgaaaggcatcag

SEQ ID NO: 7378538 - DNA, 22 bp, Homo sapiens
ctgaagctaggtcaaaaaaggg

SEQ ID NO: 7378539 - DNA, 22 bp, Homo sapiens
ctgagaggatgctgcagtggag

SEQ ID NO: 7378540 - DNA, 22 bp, Homo sapiens
ctgagaggatgctgcagtggag

SEQ ID NO: 7378541 - DNA, 22 bp, Homo sapiens
ctgagaggaacatcttatgctt

SEQ ID NO: 7378542 - DNA, 22 bp, Homo sapiens
ctgagagcagggacttgagcca

SEQ ID NO: 7378543 - DNA, 22 bp, Homo sapiens
ctgagaggcacaaggcatttcg

SEQ ID NO: 7378544 - DNA, 22 bp, Homo sapiens
ctgagaggcggaggttgcagtg

SEQ ID NO: 7378545 - DNA, 22 bp, Homo sapiens
ctgagaggcggagcttgcagtg

SEQ ID NO: 7378546 - DNA, 22 bp, Homo sapiens
ctgagaggcggagcttgcagtg

SEQ ID NO: 7378547 - DNA, 21 bp, Homo sapiens
agtgtgtgtggaatgagaata

SEQ ID NO: 7378548 - DNA, 22 bp, Homo sapiens
agtggggacttatgccagcatt

SEQ ID NO: 7378549 - DNA, 22 bp, Homo sapiens
agtggggaggtccaggccaccc

SEQ ID NO: 7378550 - DNA, 22 bp, Homo sapiens
agtggggaggtccaggccaccc

SEQ ID NO: 7378551 - DNA, 20 bp, Homo sapiens
agtggggagtcaggagtgcc

SEQ ID NO: 7378552 - DNA, 20 bp, Homo sapiens
agtggggagtcaggagtgcc

SEQ ID NO: 7378553 - DNA, 22 bp, Homo sapiens
agtggggacttatgccagcatt

SEQ ID NO: 7378554 - DNA, 22 bp, Homo sapiens
agtggggacaatgagagcaggt

SEQ ID NO: 7378555 - DNA, 22 bp, Homo sapiens
agtggggacttatgccagcatt

SEQ ID NO: 7378556 - DNA, 22 bp, Homo sapiens
agtggggaagagcatgggccct

SEQ ID NO: 7378557 - DNA, 22 bp, Homo sapiens
agtggggacaatgagagcaggt

SEQ ID NO: 7378558 - DNA, 22 bp, Homo sapiens
agtggggaagattttgcagtca

SEQ ID NO: 7378559 - DNA, 22 bp, Homo sapiens
agtggggaagattttgcagtca

SEQ ID NO: 7378560 - DNA, 23 bp, Homo sapiens
agtgtctgagtgcaggctgtgca

SEQ ID NO: 7378561 - DNA, 21 bp, Homo sapiens
agtgtctgagcgctgcttctg

SEQ ID NO: 7378562 - DNA, 22 bp, Homo sapiens
agtgtctgatcagttgactaga

SEQ ID NO: 7378563 - DNA, 22 bp, Homo sapiens
agtgtctgaaggatttggcttc

SEQ ID NO: 7378564 - DNA, 22 bp, Homo sapiens
agtgtctgaagcctcagcccga

SEQ ID NO: 7378565 - DNA, 22 bp, Homo sapiens
agtgtcctctattatgacttta

SEQ ID NO: 7378566 - DNA, 22 bp, Homo sapiens
agtgtctgaactgggtgctgac

SEQ ID NO: 7378567 - DNA, 20 bp, Homo sapiens
agtggggagtcaggagtgcc

SEQ ID NO: 7378568 - DNA, 22 bp, Homo sapiens
ctcttaaagaatgttccagctg

SEQ ID NO: 7378569 - DNA, 22 bp, Homo sapiens
agtgtctgcagtgatgtctctt

SEQ ID NO: 7378570 - DNA, 19 bp, Homo sapiens
ctcttacagaatagacaca

SEQ ID NO: 7378571 - DNA, 22 bp, Homo sapiens
ctcttacattcttttactagca

SEQ ID NO: 7378572 - DNA, 22 bp, Homo sapiens
ctcttagaaactatagagatta

SEQ ID NO: 7378573 - DNA, 22 bp, Homo sapiens
ctcttagaaagaaacacactgg

SEQ ID NO: 7378574 - DNA, 22 bp, Homo sapiens
ctcttagagagttgttgatcag

SEQ ID NO: 7378575 - DNA, 22 bp, Homo sapiens
ctcttagatatggagaattacc

SEQ ID NO: 7378576 - DNA, 22 bp, Homo sapiens
agtggcagccttgttcattatg

SEQ ID NO: 7378577 - DNA, 22 bp, Homo sapiens
ctctctggtcccagattccaga

SEQ ID NO: 7378578 - DNA, 22 bp, Homo sapiens
agtggcagctgtcatgccctag

SEQ ID NO: 7378579 - DNA, 22 bp, Homo sapiens
agtggctggagccccaggctgg

SEQ ID NO: 7378580 - DNA, 22 bp, Homo sapiens
ctctgagaggtgagaagcagca

SEQ ID NO: 7378581 - DNA, 22 bp, Homo sapiens
ctctgagacttagcatctacat

SEQ ID NO: 7378582 - DNA, 22 bp, Homo sapiens
agtgggcccttgtcacactgat

SEQ ID NO: 7378583 - DNA, 22 bp, Homo sapiens
agtgggctggtggcagggagaa

SEQ ID NO: 7378584 - DNA, 22 bp, Homo sapiens
agtgggcttactgagggagtgt

SEQ ID NO: 7378585 - DNA, 22 bp, Homo sapiens
agtggggaagagcatgggccct

SEQ ID NO: 7378586 - DNA, 22 bp, Homo sapiens
agtggggaagagcatgggccct

SEQ ID NO: 7378587 - DNA, 22 bp, Homo sapiens
agtgggcaggcagggtgcgcag

SEQ ID NO: 7378588 - DNA, 22 bp, Homo sapiens
agtgggagggccatatggtgaa

SEQ ID NO: 7378589 - DNA, 22 bp, Homo sapiens
ctctgagcagaggccgtggcta

SEQ ID NO: 7378590 - DNA, 22 bp, Homo sapiens
ctcaggcagtgccctctggccg

SEQ ID NO: 7378591 - DNA, 22 bp, Homo sapiens
ctcaggatgcaattccatcaag

SEQ ID NO: 7378592 - DNA, 19 bp, Homo sapiens
agtctgtggatttgtgggt

SEQ ID NO: 7378593 - DNA, 22 bp, Homo sapiens
agtctgtctctgctaatcacta

SEQ ID NO: 7378594 - DNA, 22 bp, Homo sapiens
agtctgtgagtgatgtacctgc

SEQ ID NO: 7378595 - DNA, 22 bp, Homo sapiens
agtcattttgctaaatgagggt

SEQ ID NO: 7378596 - DNA, 22 bp, Homo sapiens
agtccaaacaaacttcccgagg

SEQ ID NO: 7378597 - DNA, 22 bp, Homo sapiens
agtccaaagcagatgagggcca

SEQ ID NO: 7378598 - DNA, 22 bp, Homo sapiens
agtccaaagcagatgagggcca

SEQ ID NO: 7378599 - DNA, 22 bp, Homo sapiens
agtccaaagcagatgagggcca

SEQ ID NO: 7378600 - DNA, 22 bp, Homo sapiens
agtcatttctgcttccatggct

SEQ ID NO: 7378601 - DNA, 22 bp, Homo sapiens
agtcatttatcttagccattat

SEQ ID NO: 7378602 - DNA, 18 bp, Homo sapiens
agtcatttacttttgtga

SEQ ID NO: 7378603 - DNA, 20 bp, Homo sapiens
agtctgcctgctccttctcc

SEQ ID NO: 7378604 - DNA, 22 bp, Homo sapiens
agtctgccaagccagatcatgt

SEQ ID NO: 7378605 - DNA, 22 bp, Homo sapiens
agtctgcactcaggtggaggtc

SEQ ID NO: 7378606 - DNA, 22 bp, Homo sapiens
ctcccagggtctaggctgctgg

SEQ ID NO: 7378607 - DNA, 21 bp, Homo sapiens
ctcccagggtgactgttcaac

SEQ ID NO: 7378608 - DNA, 22 bp, Homo sapiens
ctcccagggtagggagagacta

SEQ ID NO: 7378609 - DNA, 22 bp, Homo sapiens
agtgcagcatgctggggaggct

SEQ ID NO: 7378610 - DNA, 22 bp, Homo sapiens
agtgcagcagctgctccttaac

SEQ ID NO: 7378611 - DNA, 22 bp, Homo sapiens
agtgcagccgagatcaggtgct

SEQ ID NO: 7378612 - DNA, 22 bp, Homo sapiens
ctcctccttcctgtgttgtgca

SEQ ID NO: 7378613 - DNA, 22 bp, Homo sapiens
ctcctcctggacacaggctgtg

SEQ ID NO: 7378614 - DNA, 22 bp, Homo sapiens
agtgcagctttttctttacatg

SEQ ID NO: 7378615 - DNA, 22 bp, Homo sapiens
agtgcacttttgggggatgtta

SEQ ID NO: 7378616 - DNA, 22 bp, Homo sapiens
agtgcacagcgtgatgtattgg

SEQ ID NO: 7378617 - DNA, 22 bp, Homo sapiens
agtgcactgagctaggagtgga

SEQ ID NO: 7378618 - DNA, 22 bp, Homo sapiens
agtgaccgaggcacttggcaac

SEQ ID NO: 7378619 - DNA, 22 bp, Homo sapiens
agtgacagtatttgttgccaat

SEQ ID NO: 7378620 - DNA, 22 bp, Homo sapiens
agtgacagtctgatttctcaaa

SEQ ID NO: 7378621 - DNA, 22 bp, Homo sapiens
agtgacagtttcaggcattttt

SEQ ID NO: 7378622 - DNA, 22 bp, Homo sapiens
agtgacagtctcagagatcagg

SEQ ID NO: 7378623 - DNA, 22 bp, Homo sapiens
agtgacagtctcagagatcagg

SEQ ID NO: 7378624 - DNA, 22 bp, Homo sapiens
agtgacagtctcagagatcagg

SEQ ID NO: 7378625 - DNA, 22 bp, Homo sapiens
cctgggcagtgctggagttgaa

SEQ ID NO: 7378626 - DNA, 22 bp, Homo sapiens
aggtatgagagccactctgtag

SEQ ID NO: 7378627 - DNA, 22 bp, Homo sapiens
aggtatgtgctattgttatatt

SEQ ID NO: 7378628 - DNA, 22 bp, Homo sapiens
aggtatgtatgtgtgtatattt

SEQ ID NO: 7378629 - DNA, 22 bp, Homo sapiens
aggtatgtatgtgtgtatattt

SEQ ID NO: 7378630 - DNA, 22 bp, Homo sapiens
aggtattcagagagatgctttt

SEQ ID NO: 7378631 - DNA, 22 bp, Homo sapiens
aggtattattagcatctctatt

SEQ ID NO: 7378632 - DNA, 22 bp, Homo sapiens
aggtattattagcatctctatt

SEQ ID NO: 7378633 - DNA, 22 bp, Homo sapiens
aggtattattagcatctctatt

SEQ ID NO: 7378634 - DNA, 22 bp, Homo sapiens
aggtatgtggttccatgatgag

SEQ ID NO: 7378635 - DNA, 22 bp, Homo sapiens
cctggctcaaggcgaggactcc

SEQ ID NO: 7378636 - DNA, 22 bp, Homo sapiens
aggtatatattctggtccttat

SEQ ID NO: 7378637 - DNA, 22 bp, Homo sapiens
cctggagcccctctggccagcc

SEQ ID NO: 7378638 - DNA, 22 bp, Homo sapiens
cctggccagcagccccttcctc

SEQ ID NO: 7378639 - DNA, 22 bp, Homo sapiens
cctgcctggatcagccatcctg

SEQ ID NO: 7378640 - DNA, 22 bp, Homo sapiens
cctgcctggagctgagtgtgga

SEQ ID NO: 7378641 - DNA, 22 bp, Homo sapiens
cgcgaggtggaggttgcagtga

SEQ ID NO: 7378642 - DNA, 22 bp, Homo sapiens
cgcctttaaattgttttacact

SEQ ID NO: 7378643 - DNA, 19 bp, Homo sapiens
cgcctggcaggccctgcgc

SEQ ID NO: 7378644 - DNA, 22 bp, Homo sapiens
cgtgcgcctcagcctcgtgcgc

SEQ ID NO: 7378645 - DNA, 22 bp, Homo sapiens
ctaaacaagatactaatgaggt

SEQ ID NO: 7378646 - DNA, 22 bp, Homo sapiens
ctaaaattatcaagataattcc

SEQ ID NO: 7378647 - DNA, 22 bp, Homo sapiens
ctaaacatggcttagaacactc

SEQ ID NO: 7378648 - DNA, 22 bp, Homo sapiens
ctaaacaagggattataattga

SEQ ID NO: 7378649 - DNA, 22 bp, Homo sapiens
ctaaacaagggattataattga

SEQ ID NO: 7378650 - DNA, 22 bp, Homo sapiens
ctaaacaatgaacaaagcactg

SEQ ID NO: 7378651 - DNA, 22 bp, Homo sapiens
agtcagggcctggcctgctgaa

SEQ ID NO: 7378652 - DNA, 22 bp, Homo sapiens
agtcaggggatctagacttgaa

SEQ ID NO: 7378653 - DNA, 22 bp, Homo sapiens
ctacactagagttgcaatggaa

SEQ ID NO: 7378654 - DNA, 22 bp, Homo sapiens
ctacactgagagctcttcaggg

SEQ ID NO: 7378655 - DNA, 22 bp, Homo sapiens
agtcagagagctctcagcatag

SEQ ID NO: 7378656 - DNA, 23 bp, Homo sapiens
agtcagagcagaagggctgcttg

SEQ ID NO: 7378657 - DNA, 22 bp, Homo sapiens
agtcagagctatgttgttatat

SEQ ID NO: 7378658 - DNA, 23 bp, Homo sapiens
agtcagagagtgtgagacaactg

SEQ ID NO: 7378659 - DNA, 22 bp, Homo sapiens
agtcagagaaaacagccctgtg

SEQ ID NO: 7378660 - DNA, 22 bp, Homo sapiens
agtcagagaatgttttcatgga

SEQ ID NO: 7378661 - DNA, 22 bp, Homo sapiens
agtcagagaataaagaatgcat

SEQ ID NO: 7378662 - DNA, 22 bp, Homo sapiens
agtcagagtcgccgacagtcaa

SEQ ID NO: 7378663 - DNA, 22 bp, Homo sapiens
agtaatttgttataaagcaata

SEQ ID NO: 7378664 - DNA, 22 bp, Homo sapiens
agtacaaaggcccttgattact

SEQ ID NO: 7378665 - DNA, 22 bp, Homo sapiens
agtacaaaggcccttgattact

SEQ ID NO: 7378666 - DNA, 22 bp, Homo sapiens
aggtttccagcatggggaaggc

SEQ ID NO: 7378667 - DNA, 19 bp, Homo sapiens
aggtttctaactattcaag

SEQ ID NO: 7378668 - DNA, 22 bp, Homo sapiens
aggtttctcctttaaagcatgg

SEQ ID NO: 7378669 - DNA, 21 bp, Homo sapiens
aggtttctcttttatggaggg

SEQ ID NO: 7378670 - DNA, 20 bp, Homo sapiens
cctttattatttgtatgatg

SEQ ID NO: 7378671 - DNA, 20 bp, Homo sapiens
cctttattatttgtatgatg

SEQ ID NO: 7378672 - DNA, 22 bp, Homo sapiens
cctttattcaattagtcctaat

SEQ ID NO: 7378673 - DNA, 22 bp, Homo sapiens
cctttatgagatcctggggtga

SEQ ID NO: 7378674 - DNA, 22 bp, Homo sapiens
aggtgtggctggggcagaggcc

SEQ ID NO: 7378675 - DNA, 22 bp, Homo sapiens
cctggtgcccccaagccagctg

SEQ ID NO: 7378676 - DNA, 22 bp, Homo sapiens
aggttacagtgattataggttt

SEQ ID NO: 7378677 - DNA, 22 bp, Homo sapiens
aggttaaaaaggattcagttaa

SEQ ID NO: 7378678 - DNA, 22 bp, Homo sapiens
aggttaaaaaggattcagttaa

SEQ ID NO: 7378679 - DNA, 22 bp, Homo sapiens
aggttattctctatctcatccc

SEQ ID NO: 7378680 - DNA, 22 bp, Homo sapiens
aggttatttcatccttccctgg

SEQ ID NO: 7378681 - DNA, 22 bp, Homo sapiens
agttttctgatgtgtagtgaga

SEQ ID NO: 7378682 - DNA, 22 bp, Homo sapiens
agttttctttcgcaaaggtaca

SEQ ID NO: 7378683 - DNA, 22 bp, Homo sapiens
agttttctttcgcaaaggtaca

SEQ ID NO: 7378684 - DNA, 22 bp, Homo sapiens
agttttctcacatcaaaaatga

SEQ ID NO: 7378685 - DNA, 22 bp, Homo sapiens
agttttcagtaaatattagtga

SEQ ID NO: 7378686 - DNA, 22 bp, Homo sapiens
agttttcagtaaatattagtga

SEQ ID NO: 7378687 - DNA, 22 bp, Homo sapiens
ataataaaccaggatgggtctg

SEQ ID NO: 7378688 - DNA, 22 bp, Homo sapiens
ataataatgaaagccactgtgt

SEQ ID NO: 7378689 - DNA, 22 bp, Homo sapiens
ataagtgtgtaaggcattctgt

SEQ ID NO: 7378690 - DNA, 22 bp, Homo sapiens
ctgccctgtctgcagcctggct

SEQ ID NO: 7378691 - DNA, 22 bp, Homo sapiens
agtttcttcatccaaaaaatgg

SEQ ID NO: 7378692 - DNA, 22 bp, Homo sapiens
agtttcttattcttagttatgt

SEQ ID NO: 7378693 - DNA, 22 bp, Homo sapiens
agtttctgcaaatcatttttat

SEQ ID NO: 7378694 - DNA, 22 bp, Homo sapiens
agtttctttagatagaaagttc

SEQ ID NO: 7378695 - DNA, 22 bp, Homo sapiens
agtttcacagtctgtcattgtt

SEQ ID NO: 7378696 - DNA, 22 bp, Homo sapiens
agtttcacatgcatggatgtgt

SEQ ID NO: 7378697 - DNA, 22 bp, Homo sapiens
agtttcactaaggtctgtgtgt

SEQ ID NO: 7378698 - DNA, 22 bp, Homo sapiens
agtttctagcctcactgtttag

SEQ ID NO: 7378699 - DNA, 22 bp, Homo sapiens
ctgagttctgcccaaggtctgg

SEQ ID NO: 7378700 - DNA, 22 bp, Homo sapiens
ctgagtgggtttctgcttgtca

SEQ ID NO: 7378701 - DNA, 22 bp, Homo sapiens
agttttcaatatatgatagtga

SEQ ID NO: 7378702 - DNA, 22 bp, Homo sapiens
ctgatatttctcttaacactag

SEQ ID NO: 7378703 - DNA, 22 bp, Homo sapiens
ctgagaggcggaggttgcagtg

SEQ ID NO: 7378704 - DNA, 22 bp, Homo sapiens
agtgttactggttcatgaatct

SEQ ID NO: 7378705 - DNA, 22 bp, Homo sapiens
agtgttcatttattcattcact

SEQ ID NO: 7378706 - DNA, 22 bp, Homo sapiens
agtttacaacagtagctatgga

SEQ ID NO: 7378707 - DNA, 19 bp, Homo sapiens
agtttattataggtgattc

SEQ ID NO: 7378708 - DNA, 17 bp, Homo sapiens
agtttatttagccttct

SEQ ID NO: 7378709 - DNA, 22 bp, Homo sapiens
agtttatttctccatttaccta

SEQ ID NO: 7378710 - DNA, 22 bp, Homo sapiens
agtttcacacaacatttgcatg

SEQ ID NO: 7378711 - DNA, 22 bp, Homo sapiens
agtttcacagaatatgaaggtt

SEQ ID NO: 7378712 - DNA, 22 bp, Homo sapiens
agtttattctctggtcttagta

SEQ ID NO: 7378713 - DNA, 20 bp, Homo sapiens
agtttattccaggagaactg

SEQ ID NO: 7378714 - DNA, 22 bp, Homo sapiens
agtttattctctggtcttagta

SEQ ID NO: 7378715 - DNA, 22 bp, Homo sapiens
agtttattgtatatggtagttt

SEQ ID NO: 7378716 - DNA, 22 bp, Homo sapiens
ctggccaggctctcacgtggtc

SEQ ID NO: 7378717 - DNA, 22 bp, Homo sapiens
atagaaacagggaagcaaagca

SEQ ID NO: 7378718 - DNA, 22 bp, Homo sapiens
atagaaacagggaagcaaagca

SEQ ID NO: 7378719 - DNA, 22 bp, Homo sapiens
atagaaacagaggtcaggcatt

SEQ ID NO: 7378720 - DNA, 22 bp, Homo sapiens
atagaaaacagatgtccttaaa

SEQ ID NO: 7378721 - DNA, 22 bp, Homo sapiens
atactttgctacattgtacatt

SEQ ID NO: 7378722 - DNA, 22 bp, Homo sapiens
atactttgggggttagtgtaga

SEQ ID NO: 7378723 - DNA, 22 bp, Homo sapiens
atagaaatggcagctggtgcta

SEQ ID NO: 7378724 - DNA, 18 bp, Homo sapiens
atagaaacctttaatcag

SEQ ID NO: 7378725 - DNA, 19 bp, Homo sapiens
atagaaagggttaaagaca

SEQ ID NO: 7378726 - DNA, 22 bp, Homo sapiens
atagaatagcatagaaaattga

SEQ ID NO: 7378727 - DNA, 22 bp, Homo sapiens
atagaaatgtattttggactag

SEQ ID NO: 7378728 - DNA, 22 bp, Homo sapiens
ataggctttttaactctccaaa

SEQ ID NO: 7378729 - DNA, 22 bp, Homo sapiens
atagggaggaactgagtcagga

SEQ ID NO: 7378730 - DNA, 22 bp, Homo sapiens
ataggcagaaatgctccctatt

SEQ ID NO: 7378731 - DNA, 22 bp, Homo sapiens
ataggcagactctttttggagg

SEQ ID NO: 7378732 - DNA, 22 bp, Homo sapiens
ataggcaagcacaaagtcagga

SEQ ID NO: 7378733 - DNA, 22 bp, Homo sapiens
atagcagtgacattttaatgtg

SEQ ID NO: 7378734 - DNA, 22 bp, Homo sapiens
ataggtctgaaagtgtatcctg

SEQ ID NO: 7378735 - DNA, 22 bp, Homo sapiens
atagacaatggtttgccaagaa

SEQ ID NO: 7378736 - DNA, 22 bp, Homo sapiens
atagacaacacttattattcct

SEQ ID NO: 7378737 - DNA, 22 bp, Homo sapiens
atagacaacacttattattcct

SEQ ID NO: 7378738 - DNA, 22 bp, Homo sapiens
atagacatagccgtaatttatt

SEQ ID NO: 7378739 - DNA, 22 bp, Homo sapiens
atagacatatggctttgtttct

SEQ ID NO: 7378740 - DNA, 22 bp, Homo sapiens
atagaattctttgaaatttatg

SEQ ID NO: 7378741 - DNA, 22 bp, Homo sapiens
atagaatttgtacttgtagaac

SEQ ID NO: 7378742 - DNA, 20 bp, Homo sapiens
atagacaaagacatgccaga

SEQ ID NO: 7378743 - DNA, 20 bp, Homo sapiens
atagacaaagacatgccaga

SEQ ID NO: 7378744 - DNA, 22 bp, Homo sapiens
atagacaaacacgaagatgaca

SEQ ID NO: 7378745 - DNA, 22 bp, Homo sapiens
atagaattcgtgtttgtaattc

SEQ ID NO: 7378746 - DNA, 22 bp, Homo sapiens
atagaattcgtgtttgtaattc

SEQ ID NO: 7378747 - DNA, 22 bp, Homo sapiens
atagaattcgtgtttgtaattc

SEQ ID NO: 7378748 - DNA, 22 bp, Homo sapiens
atagaattcgtgtttgtaattc

SEQ ID NO: 7378749 - DNA, 22 bp, Homo sapiens
atagaattacagtgtgtttgga

SEQ ID NO: 7378750 - DNA, 21 bp, Homo sapiens
atacagaaggtggcaaagtac

SEQ ID NO: 7378751 - DNA, 22 bp, Homo sapiens
ctggaaatcactactagtcaat

SEQ ID NO: 7378752 - DNA, 22 bp, Homo sapiens
atacagaagcctgtatttctgg

SEQ ID NO: 7378753 - DNA, 21 bp, Homo sapiens
atacagaaggtggcaaagtac

SEQ ID NO: 7378754 - DNA, 22 bp, Homo sapiens
atacatatatggtacttcctgg

SEQ ID NO: 7378755 - DNA, 22 bp, Homo sapiens
ctggaagaccccccaggactca

SEQ ID NO: 7378756 - DNA, 22 bp, Homo sapiens
ctggaagacgtttgaagccatg

SEQ ID NO: 7378757 - DNA, 22 bp, Homo sapiens
atacatgactcacacattctgc

SEQ ID NO: 7378758 - DNA, 22 bp, Homo sapiens
atacatgaggaggctggaaaca

SEQ ID NO: 7378759 - DNA, 22 bp, Homo sapiens
atacatctggatgtatgcattt

SEQ ID NO: 7378760 - DNA, 22 bp, Homo sapiens
ataattgatgaggctttggaca

SEQ ID NO: 7378761 - DNA, 20 bp, Homo sapiens
ataattatttacttttgtgc

SEQ ID NO: 7378762 - DNA, 22 bp, Homo sapiens
ataatgttgatgattgtctttg

SEQ ID NO: 7378763 - DNA, 22 bp, Homo sapiens
atacagaactctcagttgtata

SEQ ID NO: 7378764 - DNA, 22 bp, Homo sapiens
atacagaagaactatagccact

SEQ ID NO: 7378765 - DNA, 22 bp, Homo sapiens
atacagaaaagtggatagccag

SEQ ID NO: 7378766 - DNA, 20 bp, Homo sapiens
ataatttaccctgcaccact

SEQ ID NO: 7378767 - DNA, 20 bp, Homo sapiens
atacacattcatagaaaaat

SEQ ID NO: 7378768 - DNA, 22 bp, Homo sapiens
ataatttacaactgcttttaat

SEQ ID NO: 7378769 - DNA, 22 bp, Homo sapiens
atcattcagcctaagcaagtac

SEQ ID NO: 7378770 - DNA, 22 bp, Homo sapiens
atcattcaagtgctctaaaatg

SEQ ID NO: 7378771 - DNA, 22 bp, Homo sapiens
ctgtgtgtgaacacagcccagc

SEQ ID NO: 7378772 - DNA, 22 bp, Homo sapiens
ctgtgtcccacacgaggtgtat

SEQ ID NO: 7378773 - DNA, 22 bp, Homo sapiens
ctgtgtccccctcagccaggtg

SEQ ID NO: 7378774 - DNA, 22 bp, Homo sapiens
atcattagaccaaactagagct

SEQ ID NO: 7378775 - DNA, 22 bp, Homo sapiens
ctgtttattacactggatagca

SEQ ID NO: 7378776 - DNA, 22 bp, Homo sapiens
ctgtttatggaggtaaggcatc

SEQ ID NO: 7378777 - DNA, 22 bp, Homo sapiens
ctgtttcaaaactagtacaaca

SEQ ID NO: 7378778 - DNA, 22 bp, Homo sapiens
ctgttatttggaggatgcttgg

SEQ ID NO: 7378779 - DNA, 19 bp, Homo sapiens
ctgttattgtcagagctcc

SEQ ID NO: 7378780 - DNA, 23 bp, Homo sapiens
ctgttattccaggctgatgggtg

SEQ ID NO: 7378781 - DNA, 22 bp, Homo sapiens
ctgttattcaagacaaaggcag

SEQ ID NO: 7378782 - DNA, 22 bp, Homo sapiens
ctgttattaaaaagctcaggct

SEQ ID NO: 7378783 - DNA, 22 bp, Homo sapiens
ctgttacttcaatcttctcccg

SEQ ID NO: 7378784 - DNA, 22 bp, Homo sapiens
atcaggccagcaatccctgggc

SEQ ID NO: 7378785 - DNA, 22 bp, Homo sapiens
atcaggccagcaatccctgggc

SEQ ID NO: 7378786 - DNA, 22 bp, Homo sapiens
ctgtttcaaagggtactgtgag

SEQ ID NO: 7378787 - DNA, 19 bp, Homo sapiens
ctgtttcaagtaggaggag

SEQ ID NO: 7378788 - DNA, 22 bp, Homo sapiens
ctgtttcaagtgaagtcagaca

SEQ ID NO: 7378789 - DNA, 22 bp, Homo sapiens
ctgtttcacgtgtttaagccca

SEQ ID NO: 7378790 - DNA, 22 bp, Homo sapiens
ctgtttcaatttgaggatcagc

SEQ ID NO: 7378791 - DNA, 22 bp, Homo sapiens
ctgtttcaccactggctctttg

SEQ ID NO: 7378792 - DNA, 22 bp, Homo sapiens
ctgtttcagaacttcttaaaaa

SEQ ID NO: 7378793 - DNA, 22 bp, Homo sapiens
ctgtttcatagagttgtgaatt

SEQ ID NO: 7378794 - DNA, 22 bp, Homo sapiens
ctgtttcagctactgttccatg

SEQ ID NO: 7378795 - DNA, 22 bp, Homo sapiens
ctgtttcatgtcttccgcagct

SEQ ID NO: 7378796 - DNA, 22 bp, Homo sapiens
ctgtttcatgaatgcaatttca

SEQ ID NO: 7378797 - DNA, 22 bp, Homo sapiens
ctgtttctccacactcttccca

SEQ ID NO: 7378798 - DNA, 23 bp, Homo sapiens
cttcacaatcaaaatcagttctg

SEQ ID NO: 7378799 - DNA, 22 bp, Homo sapiens
cttcacaattctaacagggcaa

SEQ ID NO: 7378800 - DNA, 22 bp, Homo sapiens
cttcagagtgcagaagattggg

SEQ ID NO: 7378801 - DNA, 22 bp, Homo sapiens
cttcagaatccagaatcagaat

SEQ ID NO: 7378802 - DNA, 22 bp, Homo sapiens
cttcagaatgggactgtgtttg

SEQ ID NO: 7378803 - DNA, 22 bp, Homo sapiens
cttcagaattcctcagcctcag

SEQ ID NO: 7378804 - DNA, 17 bp, Homo sapiens
atccttctgttctttct

SEQ ID NO: 7378805 - DNA, 18 bp, Homo sapiens
atccttggggctgctgct

SEQ ID NO: 7378806 - DNA, 22 bp, Homo sapiens
atctcagtcaggttgaatttgg

SEQ ID NO: 7378807 - DNA, 22 bp, Homo sapiens
atctatttctgctaataacaat

SEQ ID NO: 7378808 - DNA, 22 bp, Homo sapiens
atctcaggtgaaacttctaggt

SEQ ID NO: 7378809 - DNA, 21 bp, Homo sapiens
atctggaaattctgccagaga

SEQ ID NO: 7378810 - DNA, 22 bp, Homo sapiens
cttcatgctcccatttcctaca

SEQ ID NO: 7378811 - DNA, 22 bp, Homo sapiens
ctgtatatgtgcatacacacac

SEQ ID NO: 7378812 - DNA, 22 bp, Homo sapiens
ctgtatctgtcagctggtctcg

SEQ ID NO: 7378813 - DNA, 22 bp, Homo sapiens
atattttcacagaacttgcaaa

SEQ ID NO: 7378814 - DNA, 22 bp, Homo sapiens
atattttcactgaaccaaagta

SEQ ID NO: 7378815 - DNA, 22 bp, Homo sapiens
ctgtatttagttaaaatgctaa

SEQ ID NO: 7378816 - DNA, 22 bp, Homo sapiens
ctgtattgaagtgttggctgag

SEQ ID NO: 7378817 - DNA, 22 bp, Homo sapiens
ctggggaggatgctacgacctg

SEQ ID NO: 7378818 - DNA, 22 bp, Homo sapiens
ctgggccatggaagtctctgcc

SEQ ID NO: 7378819 - DNA, 22 bp, Homo sapiens
ctgggccatctctctgcaagtg

SEQ ID NO: 7378820 - DNA, 17 bp, Homo sapiens
ctgggcctctgcccttt

SEQ ID NO: 7378821 - DNA, 21 bp, Homo sapiens
atatcaatacagcaggacttc

SEQ ID NO: 7378822 - DNA, 22 bp, Homo sapiens
atatcaaagctagtggaaattt

SEQ ID NO: 7378823 - DNA, 22 bp, Homo sapiens
atatcaaaataaacagcatgca

SEQ ID NO: 7378824 - DNA, 22 bp, Homo sapiens
atatattttttgagacagagtc

SEQ ID NO: 7378825 - DNA, 22 bp, Homo sapiens
atatcaaaataaacagcatgca

SEQ ID NO: 7378826 - DNA, 22 bp, Homo sapiens
atatcaaacgaagttattttaa

SEQ ID NO: 7378827 - DNA, 22 bp, Homo sapiens
atatcaaacgaagttattttaa

SEQ ID NO: 7378828 - DNA, 22 bp, Homo sapiens
atatcattatgttatgagcaca

SEQ ID NO: 7378829 - DNA, 22 bp, Homo sapiens
atatcattatgttatgagcaca

SEQ ID NO: 7378830 - DNA, 22 bp, Homo sapiens
atatcacagtagttgtttagtt

SEQ ID NO: 7378831 - DNA, 22 bp, Homo sapiens
atatattttttgagacagagtc

SEQ ID NO: 7378832 - DNA, 22 bp, Homo sapiens
atatattttttgagacagagtc

SEQ ID NO: 7378833 - DNA, 22 bp, Homo sapiens
atatattttttgagacagagtc

SEQ ID NO: 7378834 - DNA, 22 bp, Homo sapiens
atatattttgcggtcacgtggc

SEQ ID NO: 7378835 - DNA, 22 bp, Homo sapiens
atatattttgcggtcacgtggc

SEQ ID NO: 7378836 - DNA, 22 bp, Homo sapiens
atatattttgcggtcacgtggc

SEQ ID NO: 7378837 - DNA, 22 bp, Homo sapiens
atatattttgcggtcacgtggc

SEQ ID NO: 7378838 - DNA, 22 bp, Homo sapiens
atatattttgcggtcacgtggc

SEQ ID NO: 7378839 - DNA, 22 bp, Homo sapiens
atatattttgaatagcctctgt

SEQ ID NO: 7378840 - DNA, 22 bp, Homo sapiens
atatattttgaatagcctctgt

SEQ ID NO: 7378841 - DNA, 22 bp, Homo sapiens
atagtctttactgctgaattga

SEQ ID NO: 7378842 - DNA, 22 bp, Homo sapiens
atagtgaaaatgctgtcagcat

SEQ ID NO: 7378843 - DNA, 22 bp, Homo sapiens
atagtatttccagaaatagtct

SEQ ID NO: 7378844 - DNA, 22 bp, Homo sapiens
atagtactccaccagtacatgt

SEQ ID NO: 7378845 - DNA, 22 bp, Homo sapiens
atagtcaaccttgtaattagcc

SEQ ID NO: 7378846 - DNA, 22 bp, Homo sapiens
atagtcttcagcactttgatca

SEQ ID NO: 7378847 - DNA, 22 bp, Homo sapiens
attcttttaaatggcagtagta

SEQ ID NO: 7378848 - DNA, 22 bp, Homo sapiens
attcttttgtcctagcttgata

SEQ ID NO: 7378849 - DNA, 22 bp, Homo sapiens
attcttttttaaggaatagaac

SEQ ID NO: 7378850 - DNA, 22 bp, Homo sapiens
attcttttgtcctagcttgata

SEQ ID NO: 7378851 - DNA, 22 bp, Homo sapiens
attcttttaagccccagggatt

SEQ ID NO: 7378852 - DNA, 22 bp, Homo sapiens
attcttttcccaactgctttaa

SEQ ID NO: 7378853 - DNA, 22 bp, Homo sapiens
gcagggcagtgtgtctgtgggg

SEQ ID NO: 7378854 - DNA, 20 bp, Homo sapiens
gcaggcagggaatgggggtg

SEQ ID NO: 7378855 - DNA, 22 bp, Homo sapiens
attctgcatggtggtgtctctg

SEQ ID NO: 7378856 - DNA, 22 bp, Homo sapiens
attctgcacatccaagaacagg

SEQ ID NO: 7378857 - DNA, 22 bp, Homo sapiens
attgcacatctgcactacagcc

SEQ ID NO: 7378858 - DNA, 19 bp, Homo sapiens
gcatgcttggtggcttctg

SEQ ID NO: 7378859 - DNA, 22 bp, Homo sapiens
gcatgcttttatatctgtttaa

SEQ ID NO: 7378860 - DNA, 22 bp, Homo sapiens
attgcaaataatgcgagccagt

SEQ ID NO: 7378861 - DNA, 22 bp, Homo sapiens
attgcaaataactgtactgaat

SEQ ID NO: 7378862 - DNA, 22 bp, Homo sapiens
attgcaaaggtcccattcaaga

SEQ ID NO: 7378863 - DNA, 22 bp, Homo sapiens
attcttttttaaggaatagaac

SEQ ID NO: 7378864 - DNA, 22 bp, Homo sapiens
attcatgaaatgattgagaagt

SEQ ID NO: 7378865 - DNA, 19 bp, Homo sapiens
attcatgaaggcttgaagg

SEQ ID NO: 7378866 - DNA, 22 bp, Homo sapiens
attcatgaccccatggttgatt

SEQ ID NO: 7378867 - DNA, 22 bp, Homo sapiens
attcatgaccccatggttgatt

SEQ ID NO: 7378868 - DNA, 22 bp, Homo sapiens
attcacaagttgatggatattt

SEQ ID NO: 7378869 - DNA, 19 bp, Homo sapiens
attcatttttgccttctaa

SEQ ID NO: 7378870 - DNA, 22 bp, Homo sapiens
attcacaactgatccttgctca

SEQ ID NO: 7378871 - DNA, 22 bp, Homo sapiens
attcaataaatatgctacatgg

SEQ ID NO: 7378872 - DNA, 22 bp, Homo sapiens
attccacataggccttcatgac

SEQ ID NO: 7378873 - DNA, 22 bp, Homo sapiens
attccacagtgccttccgtgaa

SEQ ID NO: 7378874 - DNA, 22 bp, Homo sapiens
gcaggcaggagcccaactgcct

SEQ ID NO: 7378875 - DNA, 20 bp, Homo sapiens
gcaggcagggaatgggggtg

SEQ ID NO: 7378876 - DNA, 22 bp, Homo sapiens
gcaggcaaggtagacagaggaa

SEQ ID NO: 7378877 - DNA, 22 bp, Homo sapiens
gcagcttgtcagacctttactg

SEQ ID NO: 7378878 - DNA, 22 bp, Homo sapiens
gcagcttggatttctgtagttt

SEQ ID NO: 7378879 - DNA, 22 bp, Homo sapiens
gcagcttcctgagtgtggacag

SEQ ID NO: 7378880 - DNA, 22 bp, Homo sapiens
gcagcttcagccagagggccag

SEQ ID NO: 7378881 - DNA, 22 bp, Homo sapiens
gcagcttcaagatactttttct

SEQ ID NO: 7378882 - DNA, 19 bp, Homo sapiens
gcagctgtgggaagagcca

SEQ ID NO: 7378883 - DNA, 22 bp, Homo sapiens
gcagctgtgtaatgagcccaca

SEQ ID NO: 7378884 - DNA, 21 bp, Homo sapiens
attctgagtcttggggtctca

SEQ ID NO: 7378885 - DNA, 22 bp, Homo sapiens
attctgagtggaaactatcaat

SEQ ID NO: 7378886 - DNA, 22 bp, Homo sapiens
attctgagtagaaattattctt

SEQ ID NO: 7378887 - DNA, 23 bp, Homo sapiens
attctgagtcagaaagtttgggg

SEQ ID NO: 7378888 - DNA, 21 bp, Homo sapiens
attctgagttgtcagtcttca

SEQ ID NO: 7378889 - DNA, 22 bp, Homo sapiens
attctgagacaattgccgtcag

SEQ ID NO: 7378890 - DNA, 22 bp, Homo sapiens
attctgaggacagagtctagca

SEQ ID NO: 7378891 - DNA, 22 bp, Homo sapiens
attctgagaaatgcattgtcag

SEQ ID NO: 7378892 - DNA, 22 bp, Homo sapiens
attctctgtttccaagatgaaa

SEQ ID NO: 7378893 - DNA, 22 bp, Homo sapiens
attctcttctgatgtcttgcca

SEQ ID NO: 7378894 - DNA, 20 bp, Homo sapiens
gatggatttcaacacctttc

SEQ ID NO: 7378895 - DNA, 22 bp, Homo sapiens
atgttatttctgaaagatcatt

SEQ ID NO: 7378896 - DNA, 22 bp, Homo sapiens
atgttatttctgaaagatcatt

SEQ ID NO: 7378897 - DNA, 22 bp, Homo sapiens
atgttatttcaaaattcccttg

SEQ ID NO: 7378898 - DNA, 22 bp, Homo sapiens
atgttatttattgaaacacttt

SEQ ID NO: 7378899 - DNA, 22 bp, Homo sapiens
gatggcagcagcagccagggat

SEQ ID NO: 7378900 - DNA, 22 bp, Homo sapiens
gatggcagcatattgacagcat

SEQ ID NO: 7378901 - DNA, 22 bp, Homo sapiens
gatggcaggcaggtgagtagag

SEQ ID NO: 7378902 - DNA, 22 bp, Homo sapiens
gatggcagtggagttagtgatt

SEQ ID NO: 7378903 - DNA, 22 bp, Homo sapiens
gatggcagtcaaccaggtgagg

SEQ ID NO: 7378904 - DNA, 22 bp, Homo sapiens
gagtgggcttggggagagtttg

SEQ ID NO: 7378905 - DNA, 22 bp, Homo sapiens
gagtggggaaagccaggacaga

SEQ ID NO: 7378906 - DNA, 22 bp, Homo sapiens
gagtggggaaagccaggacaga

SEQ ID NO: 7378907 - DNA, 20 bp, Homo sapiens
gagtgggccatggagtgaga

SEQ ID NO: 7378908 - DNA, 22 bp, Homo sapiens
gagtggggcgaagtcggcgagt

SEQ ID NO: 7378909 - DNA, 22 bp, Homo sapiens
atgttatgtctgggaaggggta

SEQ ID NO: 7378910 - DNA, 22 bp, Homo sapiens
atgttattaaagtacagattct

SEQ ID NO: 7378911 - DNA, 22 bp, Homo sapiens
atgttattcaatttgaatccaa

SEQ ID NO: 7378912 - DNA, 23 bp, Homo sapiens
atgttattattagcagtcttgcc

SEQ ID NO: 7378913 - DNA, 22 bp, Homo sapiens
attaaattggatctgcatagtt

SEQ ID NO: 7378914 - DNA, 22 bp, Homo sapiens
attaaattggatctgcatagtt

SEQ ID NO: 7378915 - DNA, 22 bp, Homo sapiens
attaaattggatctgcatagtt

SEQ ID NO: 7378916 - DNA, 22 bp, Homo sapiens
attaaattggacgctgggggaa

SEQ ID NO: 7378917 - DNA, 22 bp, Homo sapiens
gattcttaagacattatgtatt

SEQ ID NO: 7378918 - DNA, 22 bp, Homo sapiens
attaaattttcactaggctccc

SEQ ID NO: 7378919 - DNA, 22 bp, Homo sapiens
attaacatgcagccagacacac

SEQ ID NO: 7378920 - DNA, 22 bp, Homo sapiens
gattctcttggatgtaggcata

SEQ ID NO: 7378921 - DNA, 22 bp, Homo sapiens
gatgtctttttccaggctcttt

SEQ ID NO: 7378922 - DNA, 20 bp, Homo sapiens
gatgtcttttctggtctcct

SEQ ID NO: 7378923 - DNA, 22 bp, Homo sapiens
gatgtctttgctgttatccact

SEQ ID NO: 7378924 - DNA, 22 bp, Homo sapiens
gatgtctttgccatgcatgtgt

SEQ ID NO: 7378925 - DNA, 22 bp, Homo sapiens
gatgtctttctgtgtgcctaga

SEQ ID NO: 7378926 - DNA, 22 bp, Homo sapiens
gatgtctttgaggctcactgct

SEQ ID NO: 7378927 - DNA, 22 bp, Homo sapiens
gatgtctttagggcaaaatatt

SEQ ID NO: 7378928 - DNA, 22 bp, Homo sapiens
gatgtctttctaatactggctt

SEQ ID NO: 7378929 - DNA, 20 bp, Homo sapiens
gatgtcttggtcacagtggc

SEQ ID NO: 7378930 - DNA, 22 bp, Homo sapiens
gatgtcttgttgatttcattct

SEQ ID NO: 7378931 - DNA, 22 bp, Homo sapiens
gatgtcttggtcaacttgggct

SEQ ID NO: 7378932 - DNA, 22 bp, Homo sapiens
gatgtcttctcaactgtagacc

SEQ ID NO: 7378933 - DNA, 22 bp, Homo sapiens
gatgtcttcccatgttcatgtg

SEQ ID NO: 7378934 - DNA, 22 bp, Homo sapiens
gatgtcttggcttgctctctgt

SEQ ID NO: 7378935 - DNA, 22 bp, Homo sapiens
gattcattctcagtttctagag

SEQ ID NO: 7378936 - DNA, 22 bp, Homo sapiens
gattcagcttctgagcagtaat

SEQ ID NO: 7378937 - DNA, 22 bp, Homo sapiens
gcacacagattaggaaacagaa

SEQ ID NO: 7378938 - DNA, 22 bp, Homo sapiens
gcacacagccagctgagggcta

SEQ ID NO: 7378939 - DNA, 22 bp, Homo sapiens
gcacagggcctggcacataaga

SEQ ID NO: 7378940 - DNA, 22 bp, Homo sapiens
gcacagggccctgtgcgtaggt

SEQ ID NO: 7378941 - DNA, 22 bp, Homo sapiens
gcaccaggcagctgagcaggcc

SEQ ID NO: 7378942 - DNA, 22 bp, Homo sapiens
attataggcttgagccaccgtg

SEQ ID NO: 7378943 - DNA, 22 bp, Homo sapiens
attaagaatcacacggctgtgt

SEQ ID NO: 7378944 - DNA, 21 bp, Homo sapiens
attaacttgttaacctaaagt

SEQ ID NO: 7378945 - DNA, 22 bp, Homo sapiens
attagttgtgtggttctcaatt

SEQ ID NO: 7378946 - DNA, 22 bp, Homo sapiens
attatccagcaccaatgtcaga

SEQ ID NO: 7378947 - DNA, 22 bp, Homo sapiens
gcacacagaatcagtgggcata

SEQ ID NO: 7378948 - DNA, 22 bp, Homo sapiens
attatcagaaattcaaagggtg

SEQ ID NO: 7378949 - DNA, 22 bp, Homo sapiens
attatcagccgtcccactacat

SEQ ID NO: 7378950 - DNA, 22 bp, Homo sapiens
attatataaaattctggaagct

SEQ ID NO: 7378951 - DNA, 22 bp, Homo sapiens
attatataggacttgcccttcc

SEQ ID NO: 7378952 - DNA, 22 bp, Homo sapiens
attatattgagtataaccagag

SEQ ID NO: 7378953 - DNA, 22 bp, Homo sapiens
attatattgagtataaccagag

SEQ ID NO: 7378954 - DNA, 22 bp, Homo sapiens
attatattgagtataaccagag

SEQ ID NO: 7378955 - DNA, 22 bp, Homo sapiens
gcagagaggatattattgtcca

SEQ ID NO: 7378956 - DNA, 22 bp, Homo sapiens
gcagagagttgggctgcgccag

SEQ ID NO: 7378957 - DNA, 22 bp, Homo sapiens
gcagagactccactgtcttgtg

SEQ ID NO: 7378958 - DNA, 22 bp, Homo sapiens
gcagagatctgagaaggctgcc

SEQ ID NO: 7378959 - DNA, 19 bp, Homo sapiens
gcagagatgtggtagcttg

SEQ ID NO: 7378960 - DNA, 22 bp, Homo sapiens
attatgcatatacatttgacta

SEQ ID NO: 7378961 - DNA, 22 bp, Homo sapiens
attatgcatttgttagtattaa

SEQ ID NO: 7378962 - DNA, 22 bp, Homo sapiens
gcacccagaataaggacaggac

SEQ ID NO: 7378963 - DNA, 22 bp, Homo sapiens
gcacccacttaggccagtcaat

SEQ ID NO: 7378964 - DNA, 22 bp, Homo sapiens
attatgtgtaacgagtttattg

SEQ ID NO: 7378965 - DNA, 21 bp, Homo sapiens
attatgttcccatctgtttgg

SEQ ID NO: 7378966 - DNA, 22 bp, Homo sapiens
attatgtgtaacgagtttattg

SEQ ID NO: 7378967 - DNA, 22 bp, Homo sapiens
attatggatggaggcattagtc

SEQ ID NO: 7378968 - DNA, 22 bp, Homo sapiens
attatggacatcaaataactct

SEQ ID NO: 7378969 - DNA, 17 bp, Homo sapiens
gccctgcctgctgccct

SEQ ID NO: 7378970 - DNA, 22 bp, Homo sapiens
atttcccactctactacatgct

SEQ ID NO: 7378971 - DNA, 22 bp, Homo sapiens
atttcccaatacgctaagtgga

SEQ ID NO: 7378972 - DNA, 22 bp, Homo sapiens
atttcccaggactagaaatata

SEQ ID NO: 7378973 - DNA, 22 bp, Homo sapiens
gccctgtgcaggtgtgcagcag

SEQ ID NO: 7378974 - DNA, 22 bp, Homo sapiens
gccctgtgatggagactagagg

SEQ ID NO: 7378975 - DNA, 22 bp, Homo sapiens
atttcttcaggtcagaaataga

SEQ ID NO: 7378976 - DNA, 22 bp, Homo sapiens
atttcttcaggtcagaaataga

SEQ ID NO: 7378977 - DNA, 22 bp, Homo sapiens
atttcttatgaatattgactgt

SEQ ID NO: 7378978 - DNA, 22 bp, Homo sapiens
atttcttatgaatattgactgt

SEQ ID NO: 7378979 - DNA, 22 bp, Homo sapiens
atttcttcaggtcagaaataga

SEQ ID NO: 7378980 - DNA, 22 bp, Homo sapiens
gcccagtagttcaaggttgcag

SEQ ID NO: 7378981 - DNA, 22 bp, Homo sapiens
gcccagtctcttctggccctgt

SEQ ID NO: 7378982 - DNA, 22 bp, Homo sapiens
gcccagggtgaagtgcagttgt

SEQ ID NO: 7378983 - DNA, 22 bp, Homo sapiens
gcccagggtgaagtgcagttgt

SEQ ID NO: 7378984 - DNA, 22 bp, Homo sapiens
gcccagggtgcttagaacccat

SEQ ID NO: 7378985 - DNA, 22 bp, Homo sapiens
atttcaaggctattaatataaa

SEQ ID NO: 7378986 - DNA, 22 bp, Homo sapiens
atttcaaggactacttttcaat

SEQ ID NO: 7378987 - DNA, 22 bp, Homo sapiens
atttcaaggctacagaaacctt

SEQ ID NO: 7378988 - DNA, 19 bp, Homo sapiens
atttcaagaggtttattgg

SEQ ID NO: 7378989 - DNA, 22 bp, Homo sapiens
gcccagggtctacaaaaatatt

SEQ ID NO: 7378990 - DNA, 22 bp, Homo sapiens
gccatgctggaggcttcgattt

SEQ ID NO: 7378991 - DNA, 23 bp, Homo sapiens
gccatgagttccctttcacttgt

SEQ ID NO: 7378992 - DNA, 22 bp, Homo sapiens
gccatgcttggtatgctgtgag

SEQ ID NO: 7378993 - DNA, 22 bp, Homo sapiens
gccatgcttggtatgctgtgag

SEQ ID NO: 7378994 - DNA, 22 bp, Homo sapiens
atttattggtttgcatggtgaa

SEQ ID NO: 7378995 - DNA, 19 bp, Homo sapiens
atttattgtatgattccat

SEQ ID NO: 7378996 - DNA, 22 bp, Homo sapiens
atttattggtttgcatggtgaa

SEQ ID NO: 7378997 - DNA, 22 bp, Homo sapiens
gccagaggttcaacaactgtct

SEQ ID NO: 7378998 - DNA, 22 bp, Homo sapiens
attgtactagaaattgtattca

SEQ ID NO: 7378999 - DNA, 22 bp, Homo sapiens
attgtactcacaaaacatgagt

SEQ ID NO: 7379000 - DNA, 22 bp, Homo sapiens
attgtactccagcctgggtgac

SEQ ID NO: 7379001 - DNA, 22 bp, Homo sapiens
attgtactccctctcctgcccg

SEQ ID NO: 7379002 - DNA, 22 bp, Homo sapiens
attgtactggtaaagaagtggg

SEQ ID NO: 7379003 - DNA, 22 bp, Homo sapiens
attgtactctagcctctgggca

SEQ ID NO: 7379004 - DNA, 20 bp, Homo sapiens
attgtacttctgttgatggt

SEQ ID NO: 7379005 - DNA, 20 bp, Homo sapiens
attgtacttcagtgtgaagc

SEQ ID NO: 7379006 - DNA, 22 bp, Homo sapiens
attgtactacaccatagtactg

SEQ ID NO: 7379007 - DNA, 22 bp, Homo sapiens
attgtactacaccatagtactg

SEQ ID NO: 7379008 - DNA, 22 bp, Homo sapiens
gccagctgccaagttgtgagat

SEQ ID NO: 7379009 - DNA, 22 bp, Homo sapiens
atttatcaccagttagctgact

SEQ ID NO: 7379010 - DNA, 22 bp, Homo sapiens
atttatcatcagaccttttaaa

SEQ ID NO: 7379011 - DNA, 22 bp, Homo sapiens
atttatgacaaccaaagagtga

SEQ ID NO: 7379012 - DNA, 22 bp, Homo sapiens
atttatctctggaaactaagca

SEQ ID NO: 7379013 - DNA, 22 bp, Homo sapiens
atttatctctggaaactaagca

SEQ ID NO: 7379014 - DNA, 22 bp, Homo sapiens
atttatgacgtgttcggtcaat

SEQ ID NO: 7379015 - DNA, 22 bp, Homo sapiens
atttatgactggtgaatagaac

SEQ ID NO: 7379016 - DNA, 22 bp, Homo sapiens
atttatgacagaagatatgctg

SEQ ID NO: 7379017 - DNA, 22 bp, Homo sapiens
atttatgacagaagatatgctg

SEQ ID NO: 7379018 - DNA, 22 bp, Homo sapiens
gccagctggagactggcagggg

SEQ ID NO: 7379019 - DNA, 22 bp, Homo sapiens
atttatgattagcctattgttg

SEQ ID NO: 7379020 - DNA, 22 bp, Homo sapiens
atttatgagctgaaccatgaaa

SEQ ID NO: 7379021 - DNA, 22 bp, Homo sapiens
attttcatcatgggtttaacat

SEQ ID NO: 7379022 - DNA, 22 bp, Homo sapiens
attttcatggcttctgctcagt

SEQ ID NO: 7379023 - DNA, 22 bp, Homo sapiens
attttccagcctttctagaact

SEQ ID NO: 7379024 - DNA, 22 bp, Homo sapiens
attttccaaaataattgttact

SEQ ID NO: 7379025 - DNA, 21 bp, Homo sapiens
attttcattaattcagtgtgg

SEQ ID NO: 7379026 - DNA, 21 bp, Homo sapiens
attttcattaattcagtgtgg

SEQ ID NO: 7379027 - DNA, 21 bp, Homo sapiens
attttcattaattcagtgtgg

SEQ ID NO: 7379028 - DNA, 22 bp, Homo sapiens
gccttccctggctaggcaagca

SEQ ID NO: 7379029 - DNA, 22 bp, Homo sapiens
gccttccctctcatcctgctgg

SEQ ID NO: 7379030 - DNA, 22 bp, Homo sapiens
gccttcccaccctgcgaggctg

SEQ ID NO: 7379031 - DNA, 19 bp, Homo sapiens
gccttcccaccacccgtcc

SEQ ID NO: 7379032 - DNA, 22 bp, Homo sapiens
gccttcccaagacgcctgagtt

SEQ ID NO: 7379033 - DNA, 22 bp, Homo sapiens
gccttcccaagacgcctgagtt

SEQ ID NO: 7379034 - DNA, 22 bp, Homo sapiens
attttcctctggtttccccaga

SEQ ID NO: 7379035 - DNA, 22 bp, Homo sapiens
gcctgtgctgttccctctgcca

SEQ ID NO: 7379036 - DNA, 22 bp, Homo sapiens
attttctagatagatgatgcat

SEQ ID NO: 7379037 - DNA, 22 bp, Homo sapiens
atttgtatcttctaatattatc

SEQ ID NO: 7379038 - DNA, 22 bp, Homo sapiens
atttgtcaataagatgaacata

SEQ ID NO: 7379039 - DNA, 22 bp, Homo sapiens
atttgtcaacaggcatttaggt

SEQ ID NO: 7379040 - DNA, 22 bp, Homo sapiens
atttgtcaaaacacagagaaca

SEQ ID NO: 7379041 - DNA, 22 bp, Homo sapiens
atttgtatcaatctcaatatat

SEQ ID NO: 7379042 - DNA, 22 bp, Homo sapiens
atttgtcatatataatactctt

SEQ ID NO: 7379043 - DNA, 22 bp, Homo sapiens
atttgtctagtggtattcacgt

SEQ ID NO: 7379044 - DNA, 22 bp, Homo sapiens
atttgtaatttcttatctgtgt

SEQ ID NO: 7379045 - DNA, 22 bp, Homo sapiens
atttggggctcaccagggctga

SEQ ID NO: 7379046 - DNA, 22 bp, Homo sapiens
atttcttcctctgtcagtaact

SEQ ID NO: 7379047 - DNA, 22 bp, Homo sapiens
atttcttcctctgtcagtaact

SEQ ID NO: 7379048 - DNA, 22 bp, Homo sapiens
atttcttcctctgtcagtaact

SEQ ID NO: 7379049 - DNA, 22 bp, Homo sapiens
atttcttcctctgtcagtaact

SEQ ID NO: 7379050 - DNA, 22 bp, Homo sapiens
atttggaattcgagtaattcca

SEQ ID NO: 7379051 - DNA, 22 bp, Homo sapiens
atttggaatgtgtttgatcacc

SEQ ID NO: 7379052 - DNA, 22 bp, Homo sapiens
gctccagggaacagaatgtact

SEQ ID NO: 7379053 - DNA, 22 bp, Homo sapiens
caaaagcagttctatctgagtt

SEQ ID NO: 7379054 - DNA, 20 bp, Homo sapiens
caaaagcaatgaagttatga

SEQ ID NO: 7379055 - DNA, 22 bp, Homo sapiens
caaaagcagcaagtttatatgt

SEQ ID NO: 7379056 - DNA, 22 bp, Homo sapiens
caaagaatgagtgagtacataa

SEQ ID NO: 7379057 - DNA, 22 bp, Homo sapiens
caaagaagagatttacagagct

SEQ ID NO: 7379058 - DNA, 22 bp, Homo sapiens
attttgcacactatgcagcttt

SEQ ID NO: 7379059 - DNA, 22 bp, Homo sapiens
attttgaatcaccttggaagaa

SEQ ID NO: 7379060 - DNA, 22 bp, Homo sapiens
attttgaagggaattgaagttc

SEQ ID NO: 7379061 - DNA, 21 bp, Homo sapiens
caaaagagactgattcttgga

SEQ ID NO: 7379062 - DNA, 22 bp, Homo sapiens
caaaagcaaagtccctgaatgt

SEQ ID NO: 7379063 - DNA, 22 bp, Homo sapiens
atgcatttgtaaaatataatcg

SEQ ID NO: 7379064 - DNA, 22 bp, Homo sapiens
gaatttcaagcagtgcaatgtt

SEQ ID NO: 7379065 - DNA, 22 bp, Homo sapiens
gaagtattactctgaatgtatt

SEQ ID NO: 7379066 - DNA, 22 bp, Homo sapiens
atgcatttgacgggatatattt

SEQ ID NO: 7379067 - DNA, 22 bp, Homo sapiens
gaagtctgctgctcaggagttt

SEQ ID NO: 7379068 - DNA, 22 bp, Homo sapiens
gaagtctggctgacgagagtta

SEQ ID NO: 7379069 - DNA, 20 bp, Homo sapiens
gaagtcatatgaagcagctt

SEQ ID NO: 7379070 - DNA, 22 bp, Homo sapiens
gaagtcatccactatgggggag

SEQ ID NO: 7379071 - DNA, 22 bp, Homo sapiens
gaagtcatctggcactcttcta

SEQ ID NO: 7379072 - DNA, 22 bp, Homo sapiens
gaagtcatgaggcacagtcctg

SEQ ID NO: 7379073 - DNA, 22 bp, Homo sapiens
gaagtcatgctcccatcttgct

SEQ ID NO: 7379074 - DNA, 19 bp, Homo sapiens
gaagtcattctgaaattct

SEQ ID NO: 7379075 - DNA, 22 bp, Homo sapiens
gaagtcattgagttttaaacag

SEQ ID NO: 7379076 - DNA, 22 bp, Homo sapiens
atgctacattttggtttataaa

SEQ ID NO: 7379077 - DNA, 22 bp, Homo sapiens
atgctatagaaatatttaaatt

SEQ ID NO: 7379078 - DNA, 22 bp, Homo sapiens
gacagcttagtgaaaatgtaaa

SEQ ID NO: 7379079 - DNA, 22 bp, Homo sapiens
atgctaaactatgatcattttc

SEQ ID NO: 7379080 - DNA, 22 bp, Homo sapiens
atgctacagagtttgaatatgt

SEQ ID NO: 7379081 - DNA, 22 bp, Homo sapiens
gaatttcattgctctgctgtgt

SEQ ID NO: 7379082 - DNA, 22 bp, Homo sapiens
gaatttcctctaaacccctgag

SEQ ID NO: 7379083 - DNA, 22 bp, Homo sapiens
gaatttcatttgtttcctacca

SEQ ID NO: 7379084 - DNA, 22 bp, Homo sapiens
gaatttggatctttgatagagt

SEQ ID NO: 7379085 - DNA, 22 bp, Homo sapiens
gaattttagaatatgtgggctt

SEQ ID NO: 7379086 - DNA, 22 bp, Homo sapiens
gaattttaataaaggtttatca

SEQ ID NO: 7379087 - DNA, 22 bp, Homo sapiens
gaattttaagtgttcgcctctt

SEQ ID NO: 7379088 - DNA, 22 bp, Homo sapiens
atgagcagtttttaagtagcaa

SEQ ID NO: 7379089 - DNA, 22 bp, Homo sapiens
atgagcatatgggaggagtact

SEQ ID NO: 7379090 - DNA, 22 bp, Homo sapiens
gaagagagcagcaaactggagt

SEQ ID NO: 7379091 - DNA, 22 bp, Homo sapiens
gaagagagagtggggttctgcg

SEQ ID NO: 7379092 - DNA, 22 bp, Homo sapiens
gaagagagccgcgggacatcag

SEQ ID NO: 7379093 - DNA, 22 bp, Homo sapiens
gaagagagcagcaaactggagt

SEQ ID NO: 7379094 - DNA, 22 bp, Homo sapiens
gaagagagaacattacataaac

SEQ ID NO: 7379095 - DNA, 22 bp, Homo sapiens
gaagagagagccctggggtccg

SEQ ID NO: 7379096 - DNA, 22 bp, Homo sapiens
gaagagaaggtgtaggccatcc

SEQ ID NO: 7379097 - DNA, 22 bp, Homo sapiens
atgatgtaagggtaattgtcta

SEQ ID NO: 7379098 - DNA, 22 bp, Homo sapiens
atgatgtaaaataagttgtgag

SEQ ID NO: 7379099 - DNA, 22 bp, Homo sapiens
gaagagcatttgcccaggctgt

SEQ ID NO: 7379100 - DNA, 22 bp, Homo sapiens
gaagagatgacaaaggagcatg

SEQ ID NO: 7379101 - DNA, 21 bp, Homo sapiens
gaagagagtcctcatcctgag

SEQ ID NO: 7379102 - DNA, 22 bp, Homo sapiens
gaagagcatatgaagagcatat

SEQ ID NO: 7379103 - DNA, 22 bp, Homo sapiens
gaagagcatatgaagagcatat

SEQ ID NO: 7379104 - DNA, 22 bp, Homo sapiens
gaagctccgtactatgactttt

SEQ ID NO: 7379105 - DNA, 22 bp, Homo sapiens
gaagctccgtactatgactttt

SEQ ID NO: 7379106 - DNA, 22 bp, Homo sapiens
gaagctgcaataattgttttga

SEQ ID NO: 7379107 - DNA, 22 bp, Homo sapiens
gaagcgtgcaggtccgtatact

SEQ ID NO: 7379108 - DNA, 22 bp, Homo sapiens
gaaggagggagcggcgcggatt

SEQ ID NO: 7379109 - DNA, 22 bp, Homo sapiens
gaaggaggctccccaaagtctg

SEQ ID NO: 7379110 - DNA, 22 bp, Homo sapiens
gaaggagggagcggcgcggatt

SEQ ID NO: 7379111 - DNA, 22 bp, Homo sapiens
atgcaggagttcgaggctgtat

SEQ ID NO: 7379112 - DNA, 22 bp, Homo sapiens
atgcaggaggactaaagggatg

SEQ ID NO: 7379113 - DNA, 22 bp, Homo sapiens
atgcaggagagcatgtttaaga

SEQ ID NO: 7379114 - DNA, 22 bp, Homo sapiens
atgcaggagccctcttgagggc

SEQ ID NO: 7379115 - DNA, 22 bp, Homo sapiens
atgcaggagaccaattggatgg

SEQ ID NO: 7379116 - DNA, 22 bp, Homo sapiens
cttctcctgtaagaagatcaaa

SEQ ID NO: 7379117 - DNA, 22 bp, Homo sapiens
atctttcagggccatttgtatt

SEQ ID NO: 7379118 - DNA, 22 bp, Homo sapiens
atctttgggatatttgtgatta

SEQ ID NO: 7379119 - DNA, 22 bp, Homo sapiens
atctttgggatcctgatttact

SEQ ID NO: 7379120 - DNA, 20 bp, Homo sapiens
atctttggctcagaagcctt

SEQ ID NO: 7379121 - DNA, 22 bp, Homo sapiens
atctttggccacttgtgctgca

SEQ ID NO: 7379122 - DNA, 22 bp, Homo sapiens
atctttggatcgctcccccttc

SEQ ID NO: 7379123 - DNA, 22 bp, Homo sapiens
atctttggaaagccaagcacag

SEQ ID NO: 7379124 - DNA, 22 bp, Homo sapiens
atctttggacggtcccaactga

SEQ ID NO: 7379125 - DNA, 22 bp, Homo sapiens
ctttacataaggataaacctgg

SEQ ID NO: 7379126 - DNA, 22 bp, Homo sapiens
ctttactgttcttctgtgggaa

SEQ ID NO: 7379127 - DNA, 22 bp, Homo sapiens
ctttagaaatctggatgtattt

SEQ ID NO: 7379128 - DNA, 22 bp, Homo sapiens
ctttattgtccttcttaggtgg

SEQ ID NO: 7379129 - DNA, 22 bp, Homo sapiens
ctttattagatgtagactttct

SEQ ID NO: 7379130 - DNA, 22 bp, Homo sapiens
ctttattcctacaagattttct

SEQ ID NO: 7379131 - DNA, 22 bp, Homo sapiens
ctttattctgcaaattgccttg

SEQ ID NO: 7379132 - DNA, 22 bp, Homo sapiens
ctttggaaagtaagcagctaga

SEQ ID NO: 7379133 - DNA, 19 bp, Homo sapiens
ctttgccaaaagaggccat

SEQ ID NO: 7379134 - DNA, 22 bp, Homo sapiens
ctttcaaaacgctctgtatgca

SEQ ID NO: 7379135 - DNA, 22 bp, Homo sapiens
ctttgccatgttgcctgcagaa

SEQ ID NO: 7379136 - DNA, 22 bp, Homo sapiens
ctttgccagagaggctggcaca

SEQ ID NO: 7379137 - DNA, 20 bp, Homo sapiens
ctttgcctattctctgcctg

SEQ ID NO: 7379138 - DNA, 22 bp, Homo sapiens
atgaatttttctaagcttttgt

SEQ ID NO: 7379139 - DNA, 22 bp, Homo sapiens
ctttggcttttagatatccatt

SEQ ID NO: 7379140 - DNA, 19 bp, Homo sapiens
ctttttcaccttctagaag

SEQ ID NO: 7379141 - DNA, 22 bp, Homo sapiens
ctttttatctcttaatgatgtt

SEQ ID NO: 7379142 - DNA, 19 bp, Homo sapiens
ctttttcaccttctagaag

SEQ ID NO: 7379143 - DNA, 19 bp, Homo sapiens
ctttttcaccttctagaag

SEQ ID NO: 7379144 - DNA, 22 bp, Homo sapiens
ctttttcattggctttaggaca

SEQ ID NO: 7379145 - DNA, 22 bp, Homo sapiens
atgagaaatttattacaagcta

SEQ ID NO: 7379146 - DNA, 22 bp, Homo sapiens
atgagaaagagttgtatctaga

SEQ ID NO: 7379147 - DNA, 22 bp, Homo sapiens
atgagaatggtgattctgcaga

SEQ ID NO: 7379148 - DNA, 22 bp, Homo sapiens
atgagcagatatggattttaga

SEQ ID NO: 7379149 - DNA, 22 bp, Homo sapiens
atgagcaagagctatgtacaga

SEQ ID NO: 7379150 - DNA, 22 bp, Homo sapiens
atgagcaaccttctcctccagc

SEQ ID NO: 7379151 - DNA, 22 bp, Homo sapiens
atgagatgttcaggagtctgag

SEQ ID NO: 7379152 - DNA, 22 bp, Homo sapiens
gaggcacagagccctaggagct

SEQ ID NO: 7379153 - DNA, 22 bp, Homo sapiens
gaggcacaccagggagtcttgt

SEQ ID NO: 7379154 - DNA, 22 bp, Homo sapiens
gaggaggggacagtacttgtgc

SEQ ID NO: 7379155 - DNA, 22 bp, Homo sapiens
gaggaggggcacttgtctccta

SEQ ID NO: 7379156 - DNA, 23 bp, Homo sapiens
gaggagggtcgtgctgtgttcct

SEQ ID NO: 7379157 - DNA, 23 bp, Homo sapiens
gaggagggtcgtgctgtgttcct

SEQ ID NO: 7379158 - DNA, 18 bp, Homo sapiens
gaggcacatagttggggc

SEQ ID NO: 7379159 - DNA, 22 bp, Homo sapiens
gaggcacatatatacagagccc

SEQ ID NO: 7379160 - DNA, 22 bp, Homo sapiens
atgtatcaactgcaggcaagtt

SEQ ID NO: 7379161 - DNA, 22 bp, Homo sapiens
gaggcacagtgtttggtcagtg

SEQ ID NO: 7379162 - DNA, 22 bp, Homo sapiens
gaggcacagttcttcctccaga

SEQ ID NO: 7379163 - DNA, 22 bp, Homo sapiens
gaggcacagtcccgaggcaagg

SEQ ID NO: 7379164 - DNA, 22 bp, Homo sapiens
gaggcacagtcccgaggcaagg

SEQ ID NO: 7379165 - DNA, 22 bp, Homo sapiens
gaggcacagagtaggtgcacac

SEQ ID NO: 7379166 - DNA, 22 bp, Homo sapiens
atgggcagctgcagcagtggtg

SEQ ID NO: 7379167 - DNA, 22 bp, Homo sapiens
gaggaggggacagtacttgtgc

SEQ ID NO: 7379168 - DNA, 22 bp, Homo sapiens
gaggagggctttgttgatgtta

SEQ ID NO: 7379169 - DNA, 22 bp, Homo sapiens
gaggagggcctggtgtcccttc

SEQ ID NO: 7379170 - DNA, 22 bp, Homo sapiens
gaggagggagctggaagctctt

SEQ ID NO: 7379171 - DNA, 22 bp, Homo sapiens
gaggagggcagttcctctttta

SEQ ID NO: 7379172 - DNA, 22 bp, Homo sapiens
gaggagctgggtcagggagaca

SEQ ID NO: 7379173 - DNA, 22 bp, Homo sapiens
atgtatgtctgatgcacatgca

SEQ ID NO: 7379174 - DNA, 22 bp, Homo sapiens
atgtatgttagtgtattatcta

SEQ ID NO: 7379175 - DNA, 22 bp, Homo sapiens
atgtatgtttctatatatgaca

SEQ ID NO: 7379176 - DNA, 22 bp, Homo sapiens
atgtatgtttctatatatgaca

SEQ ID NO: 7379177 - DNA, 22 bp, Homo sapiens
atgtattcaagccacatacatt

SEQ ID NO: 7379178 - DNA, 22 bp, Homo sapiens
atgtatcagataaagcatgtgg

SEQ ID NO: 7379179 - DNA, 22 bp, Homo sapiens
atgtatcagaaatagcattggc

SEQ ID NO: 7379180 - DNA, 22 bp, Homo sapiens
atgtatgtagtgtacatataca

SEQ ID NO: 7379181 - DNA, 23 bp, Homo sapiens
atgtatttaaatttcagtgatga

SEQ ID NO: 7379182 - DNA, 22 bp, Homo sapiens
atgtatttctatgtagtgaaga

SEQ ID NO: 7379183 - DNA, 22 bp, Homo sapiens
gaggcctgggttggaggtgcat

SEQ ID NO: 7379184 - DNA, 22 bp, Homo sapiens
atgtgcttgtaatgttaaatgt

SEQ ID NO: 7379185 - DNA, 22 bp, Homo sapiens
atgtgctttaaagaagccagct

SEQ ID NO: 7379186 - DNA, 22 bp, Homo sapiens
atgtgcttgaagcctcagagaa

SEQ ID NO: 7379187 - DNA, 22 bp, Homo sapiens
gaggctgaacaggttctcatga

SEQ ID NO: 7379188 - DNA, 22 bp, Homo sapiens
atgtcagaatctacattctact

SEQ ID NO: 7379189 - DNA, 22 bp, Homo sapiens
atgtcagatcctcagaaagtct

SEQ ID NO: 7379190 - DNA, 22 bp, Homo sapiens
atgtcagatcctcagaaagtct

SEQ ID NO: 7379191 - DNA, 22 bp, Homo sapiens
atgtcagattcctaaatatctt

SEQ ID NO: 7379192 - DNA, 22 bp, Homo sapiens
atgtcatattactaatgctggc

SEQ ID NO: 7379193 - DNA, 22 bp, Homo sapiens
atgtcagttgctgcttgaggta

SEQ ID NO: 7379194 - DNA, 22 bp, Homo sapiens
atgtcatctcttaaaaattgca

SEQ ID NO: 7379195 - DNA, 22 bp, Homo sapiens
atgtggctagtgcagatgaata

SEQ ID NO: 7379196 - DNA, 22 bp, Homo sapiens
atgttactgtgatcatgatact

SEQ ID NO: 7379197 - DNA, 22 bp, Homo sapiens
atgttacttagaataattctgg

SEQ ID NO: 7379198 - DNA, 22 bp, Homo sapiens
atgttaggcaatctttcttgtt

SEQ ID NO: 7379199 - DNA, 22 bp, Homo sapiens
atgttataaatagagacactgg

SEQ ID NO: 7379200 - DNA, 22 bp, Homo sapiens
gaggttccagacagcttaggga

SEQ ID NO: 7379201 - DNA, 22 bp, Homo sapiens
gaggttccccattgtactggct

SEQ ID NO: 7379202 - DNA, 22 bp, Homo sapiens
atggcaagcaagctgaagagat

SEQ ID NO: 7379203 - DNA, 22 bp, Homo sapiens
atggcaattgtaaatggaaaga

SEQ ID NO: 7379204 - DNA, 22 bp, Homo sapiens
atggcacagtgggaaatgacct

SEQ ID NO: 7379205 - DNA, 22 bp, Homo sapiens
atggcagaagtcaagatgagtt

SEQ ID NO: 7379206 - DNA, 22 bp, Homo sapiens
atggcagaatatctgcatcgca

SEQ ID NO: 7379207 - DNA, 22 bp, Homo sapiens
gagacagcttaattggtggtca

SEQ ID NO: 7379208 - DNA, 22 bp, Homo sapiens
atggatctgtatccaaaaatac

SEQ ID NO: 7379209 - DNA, 22 bp, Homo sapiens
atgctgtcgaaaccaaacatct

SEQ ID NO: 7379210 - DNA, 16 bp, Homo sapiens
atgctgctattagagg

SEQ ID NO: 7379211 - DNA, 22 bp, Homo sapiens
atgcttaacttcctagtctata

SEQ ID NO: 7379212 - DNA, 22 bp, Homo sapiens
atgcttaactctgtacatagtt

SEQ ID NO: 7379213 - DNA, 22 bp, Homo sapiens
gagaagttcattactctgccca

SEQ ID NO: 7379214 - DNA, 22 bp, Homo sapiens
gagaagttctaattggctcttt

SEQ ID NO: 7379215 - DNA, 22 bp, Homo sapiens
gagaataaatctaaagtttctt

SEQ ID NO: 7379216 - DNA, 22 bp, Homo sapiens
gagaagtttctggtttgcatag

SEQ ID NO: 7379217 - DNA, 22 bp, Homo sapiens
gagaagtttcttcctaggtttg

SEQ ID NO: 7379218 - DNA, 22 bp, Homo sapiens
gagccccaggacagctctagtt

SEQ ID NO: 7379219 - DNA, 22 bp, Homo sapiens
gagccccaggacagctctagtt

SEQ ID NO: 7379220 - DNA, 21 bp, Homo sapiens
atgggcagaggcagagaggct

SEQ ID NO: 7379221 - DNA, 22 bp, Homo sapiens
gagcccagtctgctcctgcgcc

SEQ ID NO: 7379222 - DNA, 22 bp, Homo sapiens
gagctgccctgagctttgcatg

SEQ ID NO: 7379223 - DNA, 18 bp, Homo sapiens
gagctgccatatttagtt

SEQ ID NO: 7379224 - DNA, 22 bp, Homo sapiens
gagctgccagtgtatgaattct

SEQ ID NO: 7379225 - DNA, 22 bp, Homo sapiens
gagctgcatgcggaaacctgtt

SEQ ID NO: 7379226 - DNA, 22 bp, Homo sapiens
gagctgccaagattacaatcag

SEQ ID NO: 7379227 - DNA, 22 bp, Homo sapiens
gagctgccagacatgggaatga

SEQ ID NO: 7379228 - DNA, 22 bp, Homo sapiens
gagctgcacatctgaggctaat

SEQ ID NO: 7379229 - DNA, 22 bp, Homo sapiens
gagctgcacatctgaggctaat

SEQ ID NO: 7379230 - DNA, 22 bp, Homo sapiens
gagctgcagaaggggttttcct

SEQ ID NO: 7379231 - DNA, 22 bp, Homo sapiens
gagctgcagagctcgaaggaac

SEQ ID NO: 7379232 - DNA, 19 bp, Homo sapiens
gagcacagcggcatttggt

SEQ ID NO: 7379233 - DNA, 22 bp, Homo sapiens
atgggagccatcgcatttgctg

SEQ ID NO: 7379234 - DNA, 22 bp, Homo sapiens
atgggagtgtgcttgaggagtt

SEQ ID NO: 7379235 - DNA, 22 bp, Homo sapiens
atggctcatttatcttgcagcc

SEQ ID NO: 7379236 - DNA, 21 bp, Homo sapiens
atggctcaggccatcaatgga

SEQ ID NO: 7379237 - DNA, 22 bp, Homo sapiens
atggccgcctgtccttcccgcc

SEQ ID NO: 7379238 - DNA, 22 bp, Homo sapiens
cactgcactccagcctgggtga

SEQ ID NO: 7379239 - DNA, 22 bp, Homo sapiens
cactgcactccagcctgggtga

SEQ ID NO: 7379240 - DNA, 22 bp, Homo sapiens
cactgcactccagcttgggtga

SEQ ID NO: 7379241 - DNA, 22 bp, Homo sapiens
cactgcactccagcttgggtga

SEQ ID NO: 7379242 - DNA, 22 bp, Homo sapiens
cactgcactccagcctgggtga

SEQ ID NO: 7379243 - DNA, 22 bp, Homo sapiens
cactgcactccagcttgggcaa

SEQ ID NO: 7379244 - DNA, 22 bp, Homo sapiens
cactgcactccagcctgggcaa

SEQ ID NO: 7379245 - DNA, 22 bp, Homo sapiens
cactgcactccagcctgggtca

SEQ ID NO: 7379246 - DNA, 22 bp, Homo sapiens
cactgcactccagcctgggtca

SEQ ID NO: 7379247 - DNA, 22 bp, Homo sapiens
cactgcactccagcctgggtca

SEQ ID NO: 7379248 - DNA, 22 bp, Homo sapiens
cactgtcacgttctgaaactgt

SEQ ID NO: 7379249 - DNA, 22 bp, Homo sapiens
cactgtaatagcattataagtg

SEQ ID NO: 7379250 - DNA, 22 bp, Homo sapiens
cacttgcttaccggagaggtgc

SEQ ID NO: 7379251 - DNA, 22 bp, Homo sapiens
cacttctgttgccttgtgcaat

SEQ ID NO: 7379252 - DNA, 23 bp, Homo sapiens
cacttcccctgtggcgagcctgc

SEQ ID NO: 7379253 - DNA, 22 bp, Homo sapiens
cacttgttggtggtgaaatcac

SEQ ID NO: 7379254 - DNA, 22 bp, Homo sapiens
cacttcaacagttatttcttag

SEQ ID NO: 7379255 - DNA, 22 bp, Homo sapiens
cacttcaacctctgagtcctgg

SEQ ID NO: 7379256 - DNA, 22 bp, Homo sapiens
cacttcaagagcaagggtgcca

SEQ ID NO: 7379257 - DNA, 22 bp, Homo sapiens
cacttcaaatatggcttcatga

SEQ ID NO: 7379258 - DNA, 22 bp, Homo sapiens
cacttcaaatatggcttcatga

SEQ ID NO: 7379259 - DNA, 22 bp, Homo sapiens
cacttcaaataagctcttctca

SEQ ID NO: 7379260 - DNA, 22 bp, Homo sapiens
cacttcagctacaatcacatga

SEQ ID NO: 7379261 - DNA, 22 bp, Homo sapiens
cacttcattgggaccagggctg

SEQ ID NO: 7379262 - DNA, 22 bp, Homo sapiens
cacttcattgggaccagggctg

SEQ ID NO: 7379263 - DNA, 19 bp, Homo sapiens
cacttcaatcctttatcaa

SEQ ID NO: 7379264 - DNA, 22 bp, Homo sapiens
cacttcaaggaatatctagaaa

SEQ ID NO: 7379265 - DNA, 22 bp, Homo sapiens
cacttcaattaacttcagcatt

SEQ ID NO: 7379266 - DNA, 22 bp, Homo sapiens
cacttcaatctctgcctccatc

SEQ ID NO: 7379267 - DNA, 22 bp, Homo sapiens
cactgcactccagcctggcgac

SEQ ID NO: 7379268 - DNA, 22 bp, Homo sapiens
cactgcaacctccacctcctgg

SEQ ID NO: 7379269 - DNA, 22 bp, Homo sapiens
cactgcactccagcctgggaga

SEQ ID NO: 7379270 - DNA, 22 bp, Homo sapiens
cactgcactccagcctgggaga

SEQ ID NO: 7379271 - DNA, 22 bp, Homo sapiens
ggccagggccaaggctttccca

SEQ ID NO: 7379272 - DNA, 21 bp, Homo sapiens
cactccacttagaacagggtt

SEQ ID NO: 7379273 - DNA, 22 bp, Homo sapiens
cactcatattggaacaagcttg

SEQ ID NO: 7379274 - DNA, 22 bp, Homo sapiens
cactcaatacaatggttggcac

SEQ ID NO: 7379275 - DNA, 21 bp, Homo sapiens
cactcaataaatgtcatatgc

SEQ ID NO: 7379276 - DNA, 22 bp, Homo sapiens
ggccagggaggagaggcccctg

SEQ ID NO: 7379277 - DNA, 22 bp, Homo sapiens
cacctgcctggtccttagggct

SEQ ID NO: 7379278 - DNA, 22 bp, Homo sapiens
cacctggaccctgggaggaggg

SEQ ID NO: 7379279 - DNA, 22 bp, Homo sapiens
cacctggcccagctccagtgct

SEQ ID NO: 7379280 - DNA, 22 bp, Homo sapiens
caccctgggagtggaagtcagt

SEQ ID NO: 7379281 - DNA, 22 bp, Homo sapiens
cacctgccaaatggggatgctg

SEQ ID NO: 7379282 - DNA, 22 bp, Homo sapiens
cacctgccccagtcttggagct

SEQ ID NO: 7379283 - DNA, 22 bp, Homo sapiens
cacctgcctgcaggggctccac

SEQ ID NO: 7379284 - DNA, 22 bp, Homo sapiens
caccaggcacatagtaggcact

SEQ ID NO: 7379285 - DNA, 22 bp, Homo sapiens
cacattcacttctctgtccacc

SEQ ID NO: 7379286 - DNA, 22 bp, Homo sapiens
cacattcacatttttccctcta

SEQ ID NO: 7379287 - DNA, 22 bp, Homo sapiens
cacattcaggattttccatgtc

SEQ ID NO: 7379288 - DNA, 22 bp, Homo sapiens
cacattcaggattttccatgtc

SEQ ID NO: 7379289 - DNA, 22 bp, Homo sapiens
cacattcagctcattaatggtc

SEQ ID NO: 7379290 - DNA, 22 bp, Homo sapiens
cacattcacatttttccctcta

SEQ ID NO: 7379291 - DNA, 22 bp, Homo sapiens
cacattcaattacacagatagg

SEQ ID NO: 7379292 - DNA, 22 bp, Homo sapiens
cacattaaatagtagggatgct

SEQ ID NO: 7379293 - DNA, 22 bp, Homo sapiens
cacatgtgcagttacatgaatt

SEQ ID NO: 7379294 - DNA, 22 bp, Homo sapiens
caccactgcttcctgccatctg

SEQ ID NO: 7379295 - DNA, 22 bp, Homo sapiens
cacattcatggagtttgcctgt

SEQ ID NO: 7379296 - DNA, 22 bp, Homo sapiens
cacattcagggcagaccactca

SEQ ID NO: 7379297 - DNA, 22 bp, Homo sapiens
cacattcagggaacattggagg

SEQ ID NO: 7379298 - DNA, 22 bp, Homo sapiens
cacattcaggtggcatgttaga

SEQ ID NO: 7379299 - DNA, 22 bp, Homo sapiens
cacattcaggtggcatgttaga

SEQ ID NO: 7379300 - DNA, 22 bp, Homo sapiens
cacattcatcagtgttgtactg

SEQ ID NO: 7379301 - DNA, 22 bp, Homo sapiens
ggcagaggtgacagtgtctttt

SEQ ID NO: 7379302 - DNA, 22 bp, Homo sapiens
ggcagatgacagaccagtatgt

SEQ ID NO: 7379303 - DNA, 22 bp, Homo sapiens
cacatgaaggctggggtcgtga

SEQ ID NO: 7379304 - DNA, 22 bp, Homo sapiens
cacatgaaggctggggtcgtga

SEQ ID NO: 7379305 - DNA, 22 bp, Homo sapiens
cacaggcagccttgtagaagaa

SEQ ID NO: 7379306 - DNA, 22 bp, Homo sapiens
cacaggcagccttgtagaagaa

SEQ ID NO: 7379307 - DNA, 22 bp, Homo sapiens
cacaggcagccttgtagaagaa

SEQ ID NO: 7379308 - DNA, 23 bp, Homo sapiens
cacaggcagaaatcaagacggta

SEQ ID NO: 7379309 - DNA, 23 bp, Homo sapiens
cacaggcagaaatcaagacggta

SEQ ID NO: 7379310 - DNA, 22 bp, Homo sapiens
cacaggcacgcctctggccagg

SEQ ID NO: 7379311 - DNA, 22 bp, Homo sapiens
cacaggcacgcctctggccagg

SEQ ID NO: 7379312 - DNA, 22 bp, Homo sapiens
cacaggcacccctgactgctca

SEQ ID NO: 7379313 - DNA, 22 bp, Homo sapiens
cacaggcacccctgactgctca

SEQ ID NO: 7379314 - DNA, 22 bp, Homo sapiens
cacaggcacccctgactgctca

SEQ ID NO: 7379315 - DNA, 20 bp, Homo sapiens
cacaggccccaagacctgta

SEQ ID NO: 7379316 - DNA, 22 bp, Homo sapiens
cacaggccagtaagactgtgtt

SEQ ID NO: 7379317 - DNA, 20 bp, Homo sapiens
cacaggccttgtgagcagac

SEQ ID NO: 7379318 - DNA, 22 bp, Homo sapiens
cacaggtaatagcctaggctat

SEQ ID NO: 7379319 - DNA, 22 bp, Homo sapiens
cacagggcaggtactctcagag

SEQ ID NO: 7379320 - DNA, 22 bp, Homo sapiens
cacagtgcatgatgggcagaag

SEQ ID NO: 7379321 - DNA, 22 bp, Homo sapiens
ggcaaggggtcaggctgagaca

SEQ ID NO: 7379322 - DNA, 22 bp, Homo sapiens
ggcaaggtgctacagacagtga

SEQ ID NO: 7379323 - DNA, 22 bp, Homo sapiens
caaagtcttctcattatgtctt

SEQ ID NO: 7379324 - DNA, 22 bp, Homo sapiens
caaagtcttcagttgattctga

SEQ ID NO: 7379325 - DNA, 22 bp, Homo sapiens
gctgccctgacaagctactccc

SEQ ID NO: 7379326 - DNA, 22 bp, Homo sapiens
gctgccctcccagggcaagctt

SEQ ID NO: 7379327 - DNA, 22 bp, Homo sapiens
gctgccctgactccagcagcct

SEQ ID NO: 7379328 - DNA, 22 bp, Homo sapiens
gctgccctgactccagcagcct

SEQ ID NO: 7379329 - DNA, 21 bp, Homo sapiens
gctgccctggctcagcattca

SEQ ID NO: 7379330 - DNA, 22 bp, Homo sapiens
gctgccctgcatctgtgccttc

SEQ ID NO: 7379331 - DNA, 22 bp, Homo sapiens
caagaaattctgttcagatagc

SEQ ID NO: 7379332 - DNA, 22 bp, Homo sapiens
caagaaattctgttcagatagc

SEQ ID NO: 7379333 - DNA, 22 bp, Homo sapiens
caagaaatttcttaagaactaa

SEQ ID NO: 7379334 - DNA, 22 bp, Homo sapiens
caagaacattgtgatcacttca

SEQ ID NO: 7379335 - DNA, 22 bp, Homo sapiens
gctgcctgcacagagctgcttt

SEQ ID NO: 7379336 - DNA, 22 bp, Homo sapiens
caactttctgttaaatgttagt

SEQ ID NO: 7379337 - DNA, 22 bp, Homo sapiens
caagaaatctagaagtcagtgg

SEQ ID NO: 7379338 - DNA, 22 bp, Homo sapiens
caagaaattctgttcagatagc

SEQ ID NO: 7379339 - DNA, 22 bp, Homo sapiens
caacaatatgccagactcaatt

SEQ ID NO: 7379340 - DNA, 22 bp, Homo sapiens
caacaatatgccagactcaatt

SEQ ID NO: 7379341 - DNA, 22 bp, Homo sapiens
caaattttgtgtgttctctagt

SEQ ID NO: 7379342 - DNA, 22 bp, Homo sapiens
caacaagcgctcagagcaaagc

SEQ ID NO: 7379343 - DNA, 22 bp, Homo sapiens
caacaatatgctgagtttttca

SEQ ID NO: 7379344 - DNA, 22 bp, Homo sapiens
caacaatatgctgagtttttca

SEQ ID NO: 7379345 - DNA, 22 bp, Homo sapiens
caactttagaccccaagtagct

SEQ ID NO: 7379346 - DNA, 22 bp, Homo sapiens
caactttagcaatgttagtata

SEQ ID NO: 7379347 - DNA, 22 bp, Homo sapiens
caacactgacaatggactgatt

SEQ ID NO: 7379348 - DNA, 22 bp, Homo sapiens
caagaataaaatacatgttgat

SEQ ID NO: 7379349 - DNA, 22 bp, Homo sapiens
caagaataaaatacatgttgat

SEQ ID NO: 7379350 - DNA, 22 bp, Homo sapiens
caagaataaccagacaatagca

SEQ ID NO: 7379351 - DNA, 22 bp, Homo sapiens
caagaataaccagacaatagca

SEQ ID NO: 7379352 - DNA, 22 bp, Homo sapiens
caagaatagctacctcccatat

SEQ ID NO: 7379353 - DNA, 22 bp, Homo sapiens
caagaatataaatactttcaaa

SEQ ID NO: 7379354 - DNA, 22 bp, Homo sapiens
caagaatatatatggagtggag

SEQ ID NO: 7379355 - DNA, 22 bp, Homo sapiens
gctgctttgacagtgggaacag

SEQ ID NO: 7379356 - DNA, 22 bp, Homo sapiens
gctgctttctgaaggtgcactg

SEQ ID NO: 7379357 - DNA, 22 bp, Homo sapiens
gctgcctgcctagttccacagt

SEQ ID NO: 7379358 - DNA, 22 bp, Homo sapiens
gctgcctgccttgcctggagga

SEQ ID NO: 7379359 - DNA, 21 bp, Homo sapiens
gctgcctgcccctcgggggct

SEQ ID NO: 7379360 - DNA, 18 bp, Homo sapiens
gctgcctgcattcctcac

SEQ ID NO: 7379361 - DNA, 22 bp, Homo sapiens
caagccatattttgaagaatga

SEQ ID NO: 7379362 - DNA, 22 bp, Homo sapiens
caagccattctcctgcctcagc

SEQ ID NO: 7379363 - DNA, 22 bp, Homo sapiens
caagccatactgggtgaaatca

SEQ ID NO: 7379364 - DNA, 17 bp, Homo sapiens
gctggctgacccatgcc

SEQ ID NO: 7379365 - DNA, 23 bp, Homo sapiens
caagctgcagtttggttggtggg

SEQ ID NO: 7379366 - DNA, 22 bp, Homo sapiens
cacacaggagagtgctggaggt

SEQ ID NO: 7379367 - DNA, 22 bp, Homo sapiens
ggaccagagaagtgagcacctg

SEQ ID NO: 7379368 - DNA, 22 bp, Homo sapiens
ggaccagagctcgggcttctca

SEQ ID NO: 7379369 - DNA, 22 bp, Homo sapiens
ggaccagagggatgacatttgg

SEQ ID NO: 7379370 - DNA, 22 bp, Homo sapiens
cacacagggagaaagaaagcct

SEQ ID NO: 7379371 - DNA, 22 bp, Homo sapiens
cacacagtgggaaaacctgaag

SEQ ID NO: 7379372 - DNA, 22 bp, Homo sapiens
ggagagaggagcccactgctgt

SEQ ID NO: 7379373 - DNA, 22 bp, Homo sapiens
ggagagaggctggccgtgatga

SEQ ID NO: 7379374 - DNA, 20 bp, Homo sapiens
ggagagcagggaagacagta

SEQ ID NO: 7379375 - DNA, 22 bp, Homo sapiens
ggagagcagggaggctgctctg

SEQ ID NO: 7379376 - DNA, 22 bp, Homo sapiens
ggagagcattcttagtctgttt

SEQ ID NO: 7379377 - DNA, 22 bp, Homo sapiens
ggagaagggacagactcagctt

SEQ ID NO: 7379378 - DNA, 22 bp, Homo sapiens
cacaaatgtagtagcttaaaac

SEQ ID NO: 7379379 - DNA, 22 bp, Homo sapiens
cacaaatggttgtagacattaa

SEQ ID NO: 7379380 - DNA, 22 bp, Homo sapiens
ggaagctggacaggctttgagt

SEQ ID NO: 7379381 - DNA, 22 bp, Homo sapiens
ggaagctggggagctttggaga

SEQ ID NO: 7379382 - DNA, 22 bp, Homo sapiens
ggaagctggtaattgttgggac

SEQ ID NO: 7379383 - DNA, 22 bp, Homo sapiens
caaggctgctgcgggtcgcacc

SEQ ID NO: 7379384 - DNA, 22 bp, Homo sapiens
caaggctgctggcttctgagct

SEQ ID NO: 7379385 - DNA, 22 bp, Homo sapiens
caataaggttttgactattgag

SEQ ID NO: 7379386 - DNA, 22 bp, Homo sapiens
caataaggatttgtggaccaca

SEQ ID NO: 7379387 - DNA, 22 bp, Homo sapiens
caataaggtgaggctcaaggga

SEQ ID NO: 7379388 - DNA, 22 bp, Homo sapiens
caatatataggaacaacttagg

SEQ ID NO: 7379389 - DNA, 22 bp, Homo sapiens
caatagtaaattacggaggaga

SEQ ID NO: 7379390 - DNA, 22 bp, Homo sapiens
caatatataatgagtactttcc

SEQ ID NO: 7379391 - DNA, 22 bp, Homo sapiens
caatagtgtctgcttgtttcta

SEQ ID NO: 7379392 - DNA, 22 bp, Homo sapiens
caattcttcctgttggatatgc

SEQ ID NO: 7379393 - DNA, 22 bp, Homo sapiens
caattctttcagctgcatttgt

SEQ ID NO: 7379394 - DNA, 22 bp, Homo sapiens
caattcatgttaaacagaagca

SEQ ID NO: 7379395 - DNA, 22 bp, Homo sapiens
caatttcaagattctgttcttt

SEQ ID NO: 7379396 - DNA, 22 bp, Homo sapiens
caattgtattactgagcttata

SEQ ID NO: 7379397 - DNA, 22 bp, Homo sapiens
caattgtcagtgctgtttaaat

SEQ ID NO: 7379398 - DNA, 22 bp, Homo sapiens
caattctttgtagaagctctcc

SEQ ID NO: 7379399 - DNA, 22 bp, Homo sapiens
caattgctttgtggaagccttt

SEQ ID NO: 7379400 - DNA, 22 bp, Homo sapiens
caattgacaatgacagtgtcaa

SEQ ID NO: 7379401 - DNA, 22 bp, Homo sapiens
caatgttttgttgaatgaatag

SEQ ID NO: 7379402 - DNA, 22 bp, Homo sapiens
caattcatctgggtaggtagcc

SEQ ID NO: 7379403 - DNA, 22 bp, Homo sapiens
caatttcagtctcagagagttc

SEQ ID NO: 7379404 - DNA, 17 bp, Homo sapiens
caatttcataggttttg

SEQ ID NO: 7379405 - DNA, 22 bp, Homo sapiens
caatttcagacctttccttgga

SEQ ID NO: 7379406 - DNA, 22 bp, Homo sapiens
caatttcaatgaggccacaggg

SEQ ID NO: 7379407 - DNA, 22 bp, Homo sapiens
caatttcactaataatatttac

SEQ ID NO: 7379408 - DNA, 22 bp, Homo sapiens
caatttcactaataatatttac

SEQ ID NO: 7379409 - DNA, 22 bp, Homo sapiens
caatttcaatacaaaatacatt

SEQ ID NO: 7379410 - DNA, 22 bp, Homo sapiens
caatttcaatacaaaatacatt

SEQ ID NO: 7379411 - DNA, 18 bp, Homo sapiens
caatttcatccttaagcc

SEQ ID NO: 7379412 - DNA, 20 bp, Homo sapiens
caatttcatcatttcctgtg

SEQ ID NO: 7379413 - DNA, 20 bp, Homo sapiens
caatttcatcatttcctgtg

SEQ ID NO: 7379414 - DNA, 22 bp, Homo sapiens
caatttcatcttgtgcttcaat

SEQ ID NO: 7379415 - DNA, 22 bp, Homo sapiens
caatttcagtgctgtggagagg

SEQ ID NO: 7379416 - DNA, 22 bp, Homo sapiens
caatttcatgccatgtattgct

SEQ ID NO: 7379417 - DNA, 22 bp, Homo sapiens
caatttcatggataaaagatgt

SEQ ID NO: 7379418 - DNA, 21 bp, Homo sapiens
caatttcatgggaagatggga

SEQ ID NO: 7379419 - DNA, 22 bp, Homo sapiens
caatttcatggataaaagatgt

SEQ ID NO: 7379420 - DNA, 22 bp, Homo sapiens
caatttcattaatagatataga

SEQ ID NO: 7379421 - DNA, 22 bp, Homo sapiens
caatttccttcatagatgactg

SEQ ID NO: 7379422 - DNA, 22 bp, Homo sapiens
caatttcattaatagatataga

SEQ ID NO: 7379423 - DNA, 22 bp, Homo sapiens
cagaaaatagagtttctctgag

SEQ ID NO: 7379424 - DNA, 22 bp, Homo sapiens
cagaaaatagagtttctctgag

SEQ ID NO: 7379425 - DNA, 22 bp, Homo sapiens
cagacaaagcggaaactgttta

SEQ ID NO: 7379426 - DNA, 22 bp, Homo sapiens
cagacaactggactaagatcac

SEQ ID NO: 7379427 - DNA, 22 bp, Homo sapiens
cagaataaacagaaacgtagct

SEQ ID NO: 7379428 - DNA, 22 bp, Homo sapiens
cagaataaaagtcccaaggcat

SEQ ID NO: 7379429 - DNA, 22 bp, Homo sapiens
cagaataaaggtacaattgagt

SEQ ID NO: 7379430 - DNA, 22 bp, Homo sapiens
cagaaacagagaaatattggct

SEQ ID NO: 7379431 - DNA, 20 bp, Homo sapiens
gggagctggaattgtcttag

SEQ ID NO: 7379432 - DNA, 21 bp, Homo sapiens
gggagctggaaactgggtgac

SEQ ID NO: 7379433 - DNA, 22 bp, Homo sapiens
gggaggagtgaagattcacctg

SEQ ID NO: 7379434 - DNA, 22 bp, Homo sapiens
gggaggagggtgctggctaaac

SEQ ID NO: 7379435 - DNA, 22 bp, Homo sapiens
gggaggcacgaggcgcgcagtg

SEQ ID NO: 7379436 - DNA, 22 bp, Homo sapiens
gggaggcagtgctggaggctgg

SEQ ID NO: 7379437 - DNA, 22 bp, Homo sapiens
gggaggcagtgctggaggctgg

SEQ ID NO: 7379438 - DNA, 22 bp, Homo sapiens
cagacacagatatgcatatggc

SEQ ID NO: 7379439 - DNA, 22 bp, Homo sapiens
gggagcatttattttccgttag

SEQ ID NO: 7379440 - DNA, 22 bp, Homo sapiens
gggagccaaggagagaggcctt

SEQ ID NO: 7379441 - DNA, 22 bp, Homo sapiens
gggagctgatcaggtggattca

SEQ ID NO: 7379442 - DNA, 22 bp, Homo sapiens
cagagcagtggagagtaggtct

SEQ ID NO: 7379443 - DNA, 22 bp, Homo sapiens
cagagcagtgaggagttgtgta

SEQ ID NO: 7379444 - DNA, 22 bp, Homo sapiens
cagagccaacgccacctgccca

SEQ ID NO: 7379445 - DNA, 20 bp, Homo sapiens
cagagccaagagcagcatct

SEQ ID NO: 7379446 - DNA, 20 bp, Homo sapiens
cagagccaagagcagcatct

SEQ ID NO: 7379447 - DNA, 22 bp, Homo sapiens
gggcaggggtagcattccaagt

SEQ ID NO: 7379448 - DNA, 22 bp, Homo sapiens
cagagcaggcccactgccctcc

SEQ ID NO: 7379449 - DNA, 22 bp, Homo sapiens
gggcaggtacaagatgcttctt

SEQ ID NO: 7379450 - DNA, 22 bp, Homo sapiens
cagagacaatgtctctgcttgt

SEQ ID NO: 7379451 - DNA, 22 bp, Homo sapiens
cagagacacttaacaggaatgg

SEQ ID NO: 7379452 - DNA, 22 bp, Homo sapiens
cagagacaacaagtttaactat

SEQ ID NO: 7379453 - DNA, 22 bp, Homo sapiens
gggatgaattgagtcagaaggg

SEQ ID NO: 7379454 - DNA, 22 bp, Homo sapiens
gggatgagagtagggtgtgaaa

SEQ ID NO: 7379455 - DNA, 22 bp, Homo sapiens
cagagaggaggctatatgcaaa

SEQ ID NO: 7379456 - DNA, 22 bp, Homo sapiens
cagagcagaaacctgggtgatt

SEQ ID NO: 7379457 - DNA, 19 bp, Homo sapiens
gggctggagggatagagcc

SEQ ID NO: 7379458 - DNA, 22 bp, Homo sapiens
cagagccagcccactgttcccg

SEQ ID NO: 7379459 - DNA, 22 bp, Homo sapiens
cagagccagcagtggggacagg

SEQ ID NO: 7379460 - DNA, 22 bp, Homo sapiens
cagagccagagacctgctgtgc

SEQ ID NO: 7379461 - DNA, 22 bp, Homo sapiens
cagagccacttggagatgagaa

SEQ ID NO: 7379462 - DNA, 22 bp, Homo sapiens
cagagccagaactagaccttgt

SEQ ID NO: 7379463 - DNA, 21 bp, Homo sapiens
cagagccagactgctgaattt

SEQ ID NO: 7379464 - DNA, 22 bp, Homo sapiens
gggctggagttgggaagacaaa

SEQ ID NO: 7379465 - DNA, 22 bp, Homo sapiens
gggtaaaggtcgccctcaaggt

SEQ ID NO: 7379466 - DNA, 22 bp, Homo sapiens
ggggcctgtagagcttcaggga

SEQ ID NO: 7379467 - DNA, 22 bp, Homo sapiens
ggggccttggatctgtgccccg

SEQ ID NO: 7379468 - DNA, 22 bp, Homo sapiens
ggggcagagagaaggaagcttg

SEQ ID NO: 7379469 - DNA, 22 bp, Homo sapiens
ggggcagaagtagtgcccctga

SEQ ID NO: 7379470 - DNA, 22 bp, Homo sapiens
ggggcagagtagctggggtgtg

SEQ ID NO: 7379471 - DNA, 21 bp, Homo sapiens
ggggcagagctaggccctgca

SEQ ID NO: 7379472 - DNA, 22 bp, Homo sapiens
ggggcctctgcagtcacgctgg

SEQ ID NO: 7379473 - DNA, 21 bp, Homo sapiens
ggggcctctccacacagccgg

SEQ ID NO: 7379474 - DNA, 22 bp, Homo sapiens
ggggcagctaccggaagtaggg

SEQ ID NO: 7379475 - DNA, 22 bp, Homo sapiens
ggggcagagtctggactgttgt

SEQ ID NO: 7379476 - DNA, 23 bp, Homo sapiens
ggtcctgcccccggtcgcccaaa

SEQ ID NO: 7379477 - DNA, 22 bp, Homo sapiens
ggtcctgcctgctgtccttcaa

SEQ ID NO: 7379478 - DNA, 22 bp, Homo sapiens
cagatgcaggtctgctcacctg

SEQ ID NO: 7379479 - DNA, 22 bp, Homo sapiens
cagatgcagcaaaatgacaggc

SEQ ID NO: 7379480 - DNA, 22 bp, Homo sapiens
cagatgcatgagttcattagga

SEQ ID NO: 7379481 - DNA, 22 bp, Homo sapiens
cagattaacacggagcttaaca

SEQ ID NO: 7379482 - DNA, 22 bp, Homo sapiens
cagatggcacagatttagagtg

SEQ ID NO: 7379483 - DNA, 22 bp, Homo sapiens
ggtcctgcgtctggctcgcccg

SEQ ID NO: 7379484 - DNA, 22 bp, Homo sapiens
ggtcaaagttgaagaagggcat

SEQ ID NO: 7379485 - DNA, 22 bp, Homo sapiens
ggtcaaagggtgagatggcagg

SEQ ID NO: 7379486 - DNA, 18 bp, Homo sapiens
ggtcaagaaagtaaggca

SEQ ID NO: 7379487 - DNA, 18 bp, Homo sapiens
ggtcaagaaagtaaggca

SEQ ID NO: 7379488 - DNA, 22 bp, Homo sapiens
gggtcctgcgtgggcccaggac

SEQ ID NO: 7379489 - DNA, 22 bp, Homo sapiens
gggtccctggaattacttgaca

SEQ ID NO: 7379490 - DNA, 22 bp, Homo sapiens
gggtccctcgttctgggatctg

SEQ ID NO: 7379491 - DNA, 20 bp, Homo sapiens
gggtccctccggcctgctat

SEQ ID NO: 7379492 - DNA, 21 bp, Homo sapiens
gggtagcagaggaggccgtgg

SEQ ID NO: 7379493 - DNA, 22 bp, Homo sapiens
gggtcccagcataggggaagca

SEQ ID NO: 7379494 - DNA, 22 bp, Homo sapiens
ggtataaatgatcagatcgctg

SEQ ID NO: 7379495 - DNA, 22 bp, Homo sapiens
cagccctgtccaatgtctgctc

SEQ ID NO: 7379496 - DNA, 22 bp, Homo sapiens
cagccctggccccaggtggtct

SEQ ID NO: 7379497 - DNA, 22 bp, Homo sapiens
cagccctgtccctgagggacct

SEQ ID NO: 7379498 - DNA, 22 bp, Homo sapiens
cagccctgtccagcagagggtg

SEQ ID NO: 7379499 - DNA, 22 bp, Homo sapiens
cagccctgtccagcagagggtg

SEQ ID NO: 7379500 - DNA, 23 bp, Homo sapiens
gtgagcagcaccatgaggctaga

SEQ ID NO: 7379501 - DNA, 23 bp, Homo sapiens
gtgagcagcaccatgaggctaga

SEQ ID NO: 7379502 - DNA, 18 bp, Homo sapiens
gtgagcagagagcatcac

SEQ ID NO: 7379503 - DNA, 18 bp, Homo sapiens
gtgagcagagagcatcac

SEQ ID NO: 7379504 - DNA, 22 bp, Homo sapiens
gtgagcagaacaggtggcttct

SEQ ID NO: 7379505 - DNA, 22 bp, Homo sapiens
cagccctctgaagaggcgcttg

SEQ ID NO: 7379506 - DNA, 22 bp, Homo sapiens
cagccctcctaccctgccaggc

SEQ ID NO: 7379507 - DNA, 22 bp, Homo sapiens
cagccctcctttcactcccagg

SEQ ID NO: 7379508 - DNA, 22 bp, Homo sapiens
gtgagagatcccccactcatct

SEQ ID NO: 7379509 - DNA, 22 bp, Homo sapiens
gtgagagatgctttcttaacgc

SEQ ID NO: 7379510 - DNA, 22 bp, Homo sapiens
gtgagagggctgggctcatgat

SEQ ID NO: 7379511 - DNA, 22 bp, Homo sapiens
gtgaatttctgactaaaagtgc

SEQ ID NO: 7379512 - DNA, 22 bp, Homo sapiens
gtgaattaggctatggcagagg

SEQ ID NO: 7379513 - DNA, 22 bp, Homo sapiens
gtcacacaggttgaaatgcagt

SEQ ID NO: 7379514 - DNA, 22 bp, Homo sapiens
gtcacacaatagtaagtggtcc

SEQ ID NO: 7379515 - DNA, 22 bp, Homo sapiens
gtattttacttacgcatgactt

SEQ ID NO: 7379516 - DNA, 22 bp, Homo sapiens
gtagggagcccagagcccagtg

SEQ ID NO: 7379517 - DNA, 22 bp, Homo sapiens
gtcacactcttccctccacatg

SEQ ID NO: 7379518 - DNA, 22 bp, Homo sapiens
gtcagcagaaacgccacatgca

SEQ ID NO: 7379519 - DNA, 22 bp, Homo sapiens
gtcagcagcatgtttaatcaaa

SEQ ID NO: 7379520 - DNA, 22 bp, Homo sapiens
cagccagctggtgcggcagagc

SEQ ID NO: 7379521 - DNA, 22 bp, Homo sapiens
gtccagccaccctggaggcacg

SEQ ID NO: 7379522 - DNA, 22 bp, Homo sapiens
cagccaggcccagatcatgctg

SEQ ID NO: 7379523 - DNA, 22 bp, Homo sapiens
cagattcaacctaagacaatct

SEQ ID NO: 7379524 - DNA, 22 bp, Homo sapiens
cagattctccaggggctgcaga

SEQ ID NO: 7379525 - DNA, 22 bp, Homo sapiens
cagatttaggtcactagaattt

SEQ ID NO: 7379526 - DNA, 22 bp, Homo sapiens
cagatttcagctcatatattat

SEQ ID NO: 7379527 - DNA, 22 bp, Homo sapiens
cagcagccgagagggggctctg

SEQ ID NO: 7379528 - DNA, 19 bp, Homo sapiens
cagcagccagggggcccct

SEQ ID NO: 7379529 - DNA, 22 bp, Homo sapiens
cagcagccactagagggctcac

SEQ ID NO: 7379530 - DNA, 20 bp, Homo sapiens
cagcagccaaacttctattc

SEQ ID NO: 7379531 - DNA, 22 bp, Homo sapiens
gtacacagagtggtggaagaaa

SEQ ID NO: 7379532 - DNA, 20 bp, Homo sapiens
gtacacttcatgtttcacct

SEQ ID NO: 7379533 - DNA, 22 bp, Homo sapiens
gtactcagtaatataacatatt

SEQ ID NO: 7379534 - DNA, 22 bp, Homo sapiens
gtactttcaggctttcccttaa

SEQ ID NO: 7379535 - DNA, 22 bp, Homo sapiens
gtagaaatagtggttgacagga

SEQ ID NO: 7379536 - DNA, 22 bp, Homo sapiens
gtactgtgctagttgatgggag

SEQ ID NO: 7379537 - DNA, 22 bp, Homo sapiens
gtacttctcaaactagaaacta

SEQ ID NO: 7379538 - DNA, 22 bp, Homo sapiens
gtacttctcaaactagaaacta

SEQ ID NO: 7379539 - DNA, 22 bp, Homo sapiens
gtacttctttagtcaatatgta

SEQ ID NO: 7379540 - DNA, 22 bp, Homo sapiens
gtagaaatatttatctctgaga

SEQ ID NO: 7379541 - DNA, 22 bp, Homo sapiens
gtaggcagggctgtggggagaa

SEQ ID NO: 7379542 - DNA, 22 bp, Homo sapiens
tgcagaggtgttgctgagataa

SEQ ID NO: 7379543 - DNA, 22 bp, Homo sapiens
tgcagaggtttccaggcaagtt

SEQ ID NO: 7379544 - DNA, 22 bp, Homo sapiens
tgcagaggtgtgcattcttaag

SEQ ID NO: 7379545 - DNA, 22 bp, Homo sapiens
tgcagaggtgaaagactagcaa

SEQ ID NO: 7379546 - DNA, 22 bp, Homo sapiens
tgcagaggtgttgctgagataa

SEQ ID NO: 7379547 - DNA, 22 bp, Homo sapiens
tgcagaggtgtgcattcttaag

SEQ ID NO: 7379548 - DNA, 22 bp, Homo sapiens
tgcagaggtgaaagactagcaa

SEQ ID NO: 7379549 - DNA, 15 bp, Homo sapiens
tgcagaggtacctgg

SEQ ID NO: 7379550 - DNA, 22 bp, Homo sapiens
cccacccagcctggctgagggg

SEQ ID NO: 7379551 - DNA, 22 bp, Homo sapiens
cccacaggctaggggtagggca

SEQ ID NO: 7379552 - DNA, 22 bp, Homo sapiens
cccacaggtccccatgaactcg

SEQ ID NO: 7379553 - DNA, 22 bp, Homo sapiens
cccacagggctgctgatggcag

SEQ ID NO: 7379554 - DNA, 22 bp, Homo sapiens
cccacaggtggaagcctcggaa

SEQ ID NO: 7379555 - DNA, 22 bp, Homo sapiens
cccacaggtgtgagcttgctgg

SEQ ID NO: 7379556 - DNA, 22 bp, Homo sapiens
cccacaggtggaagcctcggaa

SEQ ID NO: 7379557 - DNA, 22 bp, Homo sapiens
cccacaggcaggtgcatgggct

SEQ ID NO: 7379558 - DNA, 22 bp, Homo sapiens
cccacaggccctgctgccttga

SEQ ID NO: 7379559 - DNA, 22 bp, Homo sapiens
cccacaggcaggtgcatgggct

SEQ ID NO: 7379560 - DNA, 22 bp, Homo sapiens
cccacaggcaggtgcatgggct

SEQ ID NO: 7379561 - DNA, 22 bp, Homo sapiens
cccacaggcaggggcagagaca

SEQ ID NO: 7379562 - DNA, 19 bp, Homo sapiens
cccacaggaggacatatgg

SEQ ID NO: 7379563 - DNA, 22 bp, Homo sapiens
cccacaggacgggctaaagagt

SEQ ID NO: 7379564 - DNA, 22 bp, Homo sapiens
tgcagcagtcagtcaggcctgg

SEQ ID NO: 7379565 - DNA, 22 bp, Homo sapiens
tgcagcagtgttccttggcttg

SEQ ID NO: 7379566 - DNA, 22 bp, Homo sapiens
tgcagcaggtatggcaagctcc

SEQ ID NO: 7379567 - DNA, 22 bp, Homo sapiens
tgcagcaggtgacaacgagtgg

SEQ ID NO: 7379568 - DNA, 22 bp, Homo sapiens
tgcagaggtttttaatacattt

SEQ ID NO: 7379569 - DNA, 22 bp, Homo sapiens
tgcagaggtttgtggtgttgct

SEQ ID NO: 7379570 - DNA, 22 bp, Homo sapiens
cccaagccagaccctgaccctg

SEQ ID NO: 7379571 - DNA, 22 bp, Homo sapiens
tgattatattctaacttcataa

SEQ ID NO: 7379572 - DNA, 21 bp, Homo sapiens
tgatgaggtcatagcaccctc

SEQ ID NO: 7379573 - DNA, 22 bp, Homo sapiens
tgatgaggcatatgctacacat

SEQ ID NO: 7379574 - DNA, 22 bp, Homo sapiens
tgaggcagtgatgtttaagcac

SEQ ID NO: 7379575 - DNA, 18 bp, Homo sapiens
tgaggcagtcagtgatgg

SEQ ID NO: 7379576 - DNA, 22 bp, Homo sapiens
tgaggcaggtggattacaaggt

SEQ ID NO: 7379577 - DNA, 22 bp, Homo sapiens
tgaggcagtattctccattcca

SEQ ID NO: 7379578 - DNA, 22 bp, Homo sapiens
tgaggcaggtaagcaagttttg

SEQ ID NO: 7379579 - DNA, 21 bp, Homo sapiens
tgaggcaggggtgcttttgtc

SEQ ID NO: 7379580 - DNA, 22 bp, Homo sapiens
tgaggcagtattttagtgactt

SEQ ID NO: 7379581 - DNA, 22 bp, Homo sapiens
tgaggcagtcaccccctcctgc

SEQ ID NO: 7379582 - DNA, 22 bp, Homo sapiens
cccaggagcttctctctgcctc

SEQ ID NO: 7379583 - DNA, 22 bp, Homo sapiens
cccaggagacagaaacagaggt

SEQ ID NO: 7379584 - DNA, 19 bp, Homo sapiens
tgcatatatctatgaaaga

SEQ ID NO: 7379585 - DNA, 22 bp, Homo sapiens
tgcatatcttcaatgctgttgc

SEQ ID NO: 7379586 - DNA, 22 bp, Homo sapiens
tgcatattataaagagaattag

SEQ ID NO: 7379587 - DNA, 22 bp, Homo sapiens
cccaggaggcctgcctggccgg

SEQ ID NO: 7379588 - DNA, 22 bp, Homo sapiens
cccaggaggcagaggttgcagt

SEQ ID NO: 7379589 - DNA, 22 bp, Homo sapiens
cccaggaggccaaggttgcagt

SEQ ID NO: 7379590 - DNA, 22 bp, Homo sapiens
cccaggaggcagagatagcagt

SEQ ID NO: 7379591 - DNA, 22 bp, Homo sapiens
cccaggaggaggaaaaagctcg

SEQ ID NO: 7379592 - DNA, 19 bp, Homo sapiens
cccaggagtctggctggtt

SEQ ID NO: 7379593 - DNA, 22 bp, Homo sapiens
cccaggaggcggaggttgcagt

SEQ ID NO: 7379594 - DNA, 21 bp, Homo sapiens
cccaggaggctgagaagagca

SEQ ID NO: 7379595 - DNA, 22 bp, Homo sapiens
tgcagcatctccttaaatcttg

SEQ ID NO: 7379596 - DNA, 17 bp, Homo sapiens
tgcagcagttcccatct

SEQ ID NO: 7379597 - DNA, 22 bp, Homo sapiens
tgcagcagtttaatgcagggtt

SEQ ID NO: 7379598 - DNA, 22 bp, Homo sapiens
cccagcccccgagtgtctggaa

SEQ ID NO: 7379599 - DNA, 22 bp, Homo sapiens
cccagctccaagggacagcgaa

SEQ ID NO: 7379600 - DNA, 22 bp, Homo sapiens
tgcaggtggacacgggagacgg

SEQ ID NO: 7379601 - DNA, 22 bp, Homo sapiens
cccaggaaatagccaggaggtg

SEQ ID NO: 7379602 - DNA, 22 bp, Homo sapiens
cccagctcccatgttctccaat

SEQ ID NO: 7379603 - DNA, 22 bp, Homo sapiens
cccagctccagagccagaaaca

SEQ ID NO: 7379604 - DNA, 22 bp, Homo sapiens
cccaggacccttcaatggctcc

SEQ ID NO: 7379605 - DNA, 22 bp, Homo sapiens
cccaggaccgcgcggctgagcg

SEQ ID NO: 7379606 - DNA, 21 bp, Homo sapiens
cccaggagaagaaaagatgca

SEQ ID NO: 7379607 - DNA, 22 bp, Homo sapiens
tgagataactctgatttatgtt

SEQ ID NO: 7379608 - DNA, 22 bp, Homo sapiens
tgagataacaaaattatcttca

SEQ ID NO: 7379609 - DNA, 22 bp, Homo sapiens
tgagataacaaaattatcttca

SEQ ID NO: 7379610 - DNA, 21 bp, Homo sapiens
tgagataaatttccttactac

SEQ ID NO: 7379611 - DNA, 22 bp, Homo sapiens
tgagataaggatgttatactcg

SEQ ID NO: 7379612 - DNA, 22 bp, Homo sapiens
tgagataataaatagctttctt

SEQ ID NO: 7379613 - DNA, 22 bp, Homo sapiens
tgagcacctggaccagattctg

SEQ ID NO: 7379614 - DNA, 22 bp, Homo sapiens
ccagggtggcgtagatgctggg

SEQ ID NO: 7379615 - DNA, 22 bp, Homo sapiens
ccagggtggcgtagatgctggg

SEQ ID NO: 7379616 - DNA, 22 bp, Homo sapiens
ccagggtgtagggattccagat

SEQ ID NO: 7379617 - DNA, 22 bp, Homo sapiens
tgaggaatgctgagcagaggaa

SEQ ID NO: 7379618 - DNA, 22 bp, Homo sapiens
tgagcagaaaagaatgctgagc

SEQ ID NO: 7379619 - DNA, 22 bp, Homo sapiens
tgagcagaacacgggatccatg

SEQ ID NO: 7379620 - DNA, 22 bp, Homo sapiens
tgagcagaagattggaacttac

SEQ ID NO: 7379621 - DNA, 22 bp, Homo sapiens
tgagcagaagccctcctggact

SEQ ID NO: 7379622 - DNA, 22 bp, Homo sapiens
tgagcagagacgggggcctcca

SEQ ID NO: 7379623 - DNA, 22 bp, Homo sapiens
tgagcagacttgatgaggcagc

SEQ ID NO: 7379624 - DNA, 22 bp, Homo sapiens
tgagcagaagttataaataaga

SEQ ID NO: 7379625 - DNA, 22 bp, Homo sapiens
tgagcagaatgttcagataaat

SEQ ID NO: 7379626 - DNA, 22 bp, Homo sapiens
tgagcagactctgcagagccac

SEQ ID NO: 7379627 - DNA, 22 bp, Homo sapiens
tgagcagactctgcagagccac

SEQ ID NO: 7379628 - DNA, 22 bp, Homo sapiens
tgagcccagtctgtctgacatg

SEQ ID NO: 7379629 - DNA, 22 bp, Homo sapiens
tgagctggcaggggctcaggga

SEQ ID NO: 7379630 - DNA, 22 bp, Homo sapiens
tgagaaaaggttgagatgataa

SEQ ID NO: 7379631 - DNA, 22 bp, Homo sapiens
ccagggtcttcgaggcagcaat

SEQ ID NO: 7379632 - DNA, 22 bp, Homo sapiens
tgacttttggacctcactgtcc

SEQ ID NO: 7379633 - DNA, 22 bp, Homo sapiens
tgactttagagatgggaggtca

SEQ ID NO: 7379634 - DNA, 22 bp, Homo sapiens
tgactttacagatatgtttcct

SEQ ID NO: 7379635 - DNA, 22 bp, Homo sapiens
tgaccctgcttcttggtgcagg

SEQ ID NO: 7379636 - DNA, 22 bp, Homo sapiens
tgactttaagctatctgattct

SEQ ID NO: 7379637 - DNA, 22 bp, Homo sapiens
tgactttaataggattttgcat

SEQ ID NO: 7379638 - DNA, 22 bp, Homo sapiens
tgacatttttgtacaaagtcag

SEQ ID NO: 7379639 - DNA, 22 bp, Homo sapiens
ccagggcccacggccagaatag

SEQ ID NO: 7379640 - DNA, 22 bp, Homo sapiens
ccagggccaagagacctcgagg

SEQ ID NO: 7379641 - DNA, 21 bp, Homo sapiens
ccagggaagaaatgagggcag

SEQ ID NO: 7379642 - DNA, 22 bp, Homo sapiens
ccagggaagaaagatgaagtgc

SEQ ID NO: 7379643 - DNA, 22 bp, Homo sapiens
ccagggaaactttggagtggag

SEQ ID NO: 7379644 - DNA, 22 bp, Homo sapiens
ccagggcatgtaactaatggtg

SEQ ID NO: 7379645 - DNA, 21 bp, Homo sapiens
ccagcctcagatcagggagct

SEQ ID NO: 7379646 - DNA, 22 bp, Homo sapiens
tcttgggggactttggcatgga

SEQ ID NO: 7379647 - DNA, 22 bp, Homo sapiens
tcttggtcttctactcatcagc

SEQ ID NO: 7379648 - DNA, 22 bp, Homo sapiens
tcttgtttctgtatataatgac

SEQ ID NO: 7379649 - DNA, 22 bp, Homo sapiens
tcttgtgtggtggaagatatgg

SEQ ID NO: 7379650 - DNA, 22 bp, Homo sapiens
tctgcagaattgtctcaagcta

SEQ ID NO: 7379651 - DNA, 22 bp, Homo sapiens
tctgcagagcattatagcaaaa

SEQ ID NO: 7379652 - DNA, 22 bp, Homo sapiens
ccagcccttgaggtctgtccat

SEQ ID NO: 7379653 - DNA, 22 bp, Homo sapiens
ccagcctcactggcatcaccta

SEQ ID NO: 7379654 - DNA, 22 bp, Homo sapiens
ccagccctttgtggttcactga

SEQ ID NO: 7379655 - DNA, 22 bp, Homo sapiens
ccaggctcaggcctgctcgttg

SEQ ID NO: 7379656 - DNA, 19 bp, Homo sapiens
ccaggcctggcgtctccgc

SEQ ID NO: 7379657 - DNA, 22 bp, Homo sapiens
tctttattttatgcttgtgcaa

SEQ ID NO: 7379658 - DNA, 22 bp, Homo sapiens
tctttaagagttcatttgcatg

SEQ ID NO: 7379659 - DNA, 22 bp, Homo sapiens
tctttatttaagtctgttgtaa

SEQ ID NO: 7379660 - DNA, 22 bp, Homo sapiens
tctttatttctgaatcccccat

SEQ ID NO: 7379661 - DNA, 22 bp, Homo sapiens
tgaaacagattgatggtttcta

SEQ ID NO: 7379662 - DNA, 21 bp, Homo sapiens
tgaaacagatggaagtatttg

SEQ ID NO: 7379663 - DNA, 22 bp, Homo sapiens
tgaaagcagcaccaataccatt

SEQ ID NO: 7379664 - DNA, 22 bp, Homo sapiens
tgaaagcatgcttgccaagctt

SEQ ID NO: 7379665 - DNA, 22 bp, Homo sapiens
tgaaagctctgtcatcattcct

SEQ ID NO: 7379666 - DNA, 22 bp, Homo sapiens
tgaaagcttgttggaaatgtag

SEQ ID NO: 7379667 - DNA, 22 bp, Homo sapiens
tgaaagctttgggacagtgtga

SEQ ID NO: 7379668 - DNA, 22 bp, Homo sapiens
ccaggctgcagtcaaggggcat

SEQ ID NO: 7379669 - DNA, 22 bp, Homo sapiens
tgaaagggaacctgctggactg

SEQ ID NO: 7379670 - DNA, 22 bp, Homo sapiens
tgaacacagggccaaacttgag

SEQ ID NO: 7379671 - DNA, 18 bp, Homo sapiens
tgaacacagtacaattcc

SEQ ID NO: 7379672 - DNA, 22 bp, Homo sapiens
tgaacacagggaatgggggttt

SEQ ID NO: 7379673 - DNA, 21 bp, Homo sapiens
tgaacacagatttgtctgatt

SEQ ID NO: 7379674 - DNA, 22 bp, Homo sapiens
tgaacacagcatattttgttac

SEQ ID NO: 7379675 - DNA, 22 bp, Homo sapiens
tgaacacataaaagcaaagggt

SEQ ID NO: 7379676 - DNA, 22 bp, Homo sapiens
tgaacacagttctgatgagctt

SEQ ID NO: 7379677 - DNA, 22 bp, Homo sapiens
tgaacacataaggctttcctgt

SEQ ID NO: 7379678 - DNA, 22 bp, Homo sapiens
tgaacacatattaggtgctcat

SEQ ID NO: 7379679 - DNA, 22 bp, Homo sapiens
tgaacacacacctatgtacaaa

SEQ ID NO: 7379680 - DNA, 22 bp, Homo sapiens
tgaagatttccaccaaatcaca

SEQ ID NO: 7379681 - DNA, 22 bp, Homo sapiens
tgaagatttaagcatctcaatt

SEQ ID NO: 7379682 - DNA, 22 bp, Homo sapiens
tgaagattgccctgtctcctgt

SEQ ID NO: 7379683 - DNA, 22 bp, Homo sapiens
tgaagattgtgcttggcctgta

SEQ ID NO: 7379684 - DNA, 22 bp, Homo sapiens
tgaagataaattgtactgaaga

SEQ ID NO: 7379685 - DNA, 22 bp, Homo sapiens
tgaagagatagaagtacatgct

SEQ ID NO: 7379686 - DNA, 22 bp, Homo sapiens
tgaagagaagaaaattatcttt

SEQ ID NO: 7379687 - DNA, 22 bp, Homo sapiens
tgaacaggctgtactcatgagg

SEQ ID NO: 7379688 - DNA, 20 bp, Homo sapiens
tgaagagtgcgcacattgcc

SEQ ID NO: 7379689 - DNA, 20 bp, Homo sapiens
tgaagaggaagaggacggcc

SEQ ID NO: 7379690 - DNA, 22 bp, Homo sapiens
tgaagagattaagttggttttg

SEQ ID NO: 7379691 - DNA, 22 bp, Homo sapiens
tgaagaggccaaactatcattg

SEQ ID NO: 7379692 - DNA, 22 bp, Homo sapiens
tgaacacattttcttcagtaga

SEQ ID NO: 7379693 - DNA, 22 bp, Homo sapiens
tgaacacatttgggaaaatctt

SEQ ID NO: 7379694 - DNA, 22 bp, Homo sapiens
tgaacacatttctggccaattt

SEQ ID NO: 7379695 - DNA, 22 bp, Homo sapiens
tgaacacatctgcgtgtgtctc

SEQ ID NO: 7379696 - DNA, 22 bp, Homo sapiens
cctcccctcagacagagactgg

SEQ ID NO: 7379697 - DNA, 22 bp, Homo sapiens
tggctcagcggtggcagcagac

SEQ ID NO: 7379698 - DNA, 22 bp, Homo sapiens
tggctcagcggtggcagcagac

SEQ ID NO: 7379699 - DNA, 22 bp, Homo sapiens
cctcccgtatatgtcctgggct

SEQ ID NO: 7379700 - DNA, 19 bp, Homo sapiens
cctccccttggaccagcaa

SEQ ID NO: 7379701 - DNA, 22 bp, Homo sapiens
cctcccctgctcagaactctgg

SEQ ID NO: 7379702 - DNA, 23 bp, Homo sapiens
cctccccttcccacagctgggtg

SEQ ID NO: 7379703 - DNA, 22 bp, Homo sapiens
tggctcagcgcggcctggtctt

SEQ ID NO: 7379704 - DNA, 22 bp, Homo sapiens
tggctaggctggtgtcaagctc

SEQ ID NO: 7379705 - DNA, 22 bp, Homo sapiens
tggctaacaaggtgaaaccccg

SEQ ID NO: 7379706 - DNA, 22 bp, Homo sapiens
tggctacagcaagaggaaagaa

SEQ ID NO: 7379707 - DNA, 22 bp, Homo sapiens
tggcctcagattattgcacagt

SEQ ID NO: 7379708 - DNA, 21 bp, Homo sapiens
tggcctcccacacttccatgg

SEQ ID NO: 7379709 - DNA, 22 bp, Homo sapiens
tggcctcccctaacagcctctt

SEQ ID NO: 7379710 - DNA, 22 bp, Homo sapiens
tggccctgcttatgtctctctt

SEQ ID NO: 7379711 - DNA, 21 bp, Homo sapiens
tggccctggccacggctgcca

SEQ ID NO: 7379712 - DNA, 21 bp, Homo sapiens
tggccctggccacggctgcca

SEQ ID NO: 7379713 - DNA, 22 bp, Homo sapiens
tggcctcaatctgtcctccagc

SEQ ID NO: 7379714 - DNA, 22 bp, Homo sapiens
cctcagccttggccccaggcag

SEQ ID NO: 7379715 - DNA, 22 bp, Homo sapiens
tggcctcggcatccagcaagag

SEQ ID NO: 7379716 - DNA, 22 bp, Homo sapiens
cctcagctgcttccctggagcc

SEQ ID NO: 7379717 - DNA, 22 bp, Homo sapiens
cctcagctgcttccctggagcc

SEQ ID NO: 7379718 - DNA, 22 bp, Homo sapiens
ccctttccatggctctcctagg

SEQ ID NO: 7379719 - DNA, 22 bp, Homo sapiens
ccctgtggcaggaggaggagca

SEQ ID NO: 7379720 - DNA, 22 bp, Homo sapiens
ccctgtggatttcagtttgtgt

SEQ ID NO: 7379721 - DNA, 22 bp, Homo sapiens
ccctgtgccagagaggcaggag

SEQ ID NO: 7379722 - DNA, 22 bp, Homo sapiens
ccctgtgcctagttggcctaaa

SEQ ID NO: 7379723 - DNA, 22 bp, Homo sapiens
ccctgtggaggcagcatcctgc

SEQ ID NO: 7379724 - DNA, 22 bp, Homo sapiens
ccctgtggaggaggagagcagt

SEQ ID NO: 7379725 - DNA, 22 bp, Homo sapiens
ccctgtgcacacacttcactct

SEQ ID NO: 7379726 - DNA, 22 bp, Homo sapiens
ccctgtgcatattgccagatac

SEQ ID NO: 7379727 - DNA, 22 bp, Homo sapiens
ccctgtgatgtagctagagtag

SEQ ID NO: 7379728 - DNA, 22 bp, Homo sapiens
ccctgtgacgagcacggccagt

SEQ ID NO: 7379729 - DNA, 20 bp, Homo sapiens
ccctgtgattggcaagtgtc

SEQ ID NO: 7379730 - DNA, 22 bp, Homo sapiens
ccctggtggtacggcactggca

SEQ ID NO: 7379731 - DNA, 22 bp, Homo sapiens
ccctgggatggattggcaggaa

SEQ ID NO: 7379732 - DNA, 22 bp, Homo sapiens
ccctggagctgcttgcatgttg

SEQ ID NO: 7379733 - DNA, 23 bp, Homo sapiens
ccctgtagcccaggacaggcttt

SEQ ID NO: 7379734 - DNA, 22 bp, Homo sapiens
ccctgtcacaatggatgacatt

SEQ ID NO: 7379735 - DNA, 22 bp, Homo sapiens
ccctgtccttggctgtgaggct

SEQ ID NO: 7379736 - DNA, 22 bp, Homo sapiens
ccctggtgtggatgtgattggc

SEQ ID NO: 7379737 - DNA, 22 bp, Homo sapiens
ccctggtgtccactggaggaag

SEQ ID NO: 7379738 - DNA, 22 bp, Homo sapiens
cctcacagaggggcagccatct

SEQ ID NO: 7379739 - DNA, 22 bp, Homo sapiens
cctcacagcccttggcccagga

SEQ ID NO: 7379740 - DNA, 22 bp, Homo sapiens
cctcacagagcccagatgtcta

SEQ ID NO: 7379741 - DNA, 22 bp, Homo sapiens
cctatttgtaggctgggccagt

SEQ ID NO: 7379742 - DNA, 22 bp, Homo sapiens
cctcacagcttttcaaagtgga

SEQ ID NO: 7379743 - DNA, 22 bp, Homo sapiens
cctcacatgaatgtaagctcca

SEQ ID NO: 7379744 - DNA, 22 bp, Homo sapiens
cctcacagtttggctaactgtg

SEQ ID NO: 7379745 - DNA, 22 bp, Homo sapiens
ccggctactcgggaggctgacg

SEQ ID NO: 7379746 - DNA, 22 bp, Homo sapiens
ccgtctgcagcctccaggagtt

SEQ ID NO: 7379747 - DNA, 22 bp, Homo sapiens
tggaagggaacaggtgggtgtt

SEQ ID NO: 7379748 - DNA, 22 bp, Homo sapiens
tggaagggaaagtttggggtcc

SEQ ID NO: 7379749 - DNA, 22 bp, Homo sapiens
tggaagaatttggggataaatt

SEQ ID NO: 7379750 - DNA, 22 bp, Homo sapiens
tggaagacactatttaccaggt

SEQ ID NO: 7379751 - DNA, 22 bp, Homo sapiens
tggaagaatatgggggtacaga

SEQ ID NO: 7379752 - DNA, 22 bp, Homo sapiens
tggaagaaggcagagaggcatt

SEQ ID NO: 7379753 - DNA, 18 bp, Homo sapiens
tgcctgccccgtaagggt

SEQ ID NO: 7379754 - DNA, 22 bp, Homo sapiens
tgcctcataacactcctggagt

SEQ ID NO: 7379755 - DNA, 22 bp, Homo sapiens
tgctttcagctggtaaagaaac

SEQ ID NO: 7379756 - DNA, 22 bp, Homo sapiens
tgctttcagatatctgtttcaa

SEQ ID NO: 7379757 - DNA, 22 bp, Homo sapiens
tgctttcaatgaattgtatact

SEQ ID NO: 7379758 - DNA, 22 bp, Homo sapiens
tgctttattttaaatatgccat

SEQ ID NO: 7379759 - DNA, 22 bp, Homo sapiens
tgctttatttataaaatagcaa

SEQ ID NO: 7379760 - DNA, 22 bp, Homo sapiens
tgctttattggaacctcatcct

SEQ ID NO: 7379761 - DNA, 22 bp, Homo sapiens
tgctttattgcatcagtgtggg

SEQ ID NO: 7379762 - DNA, 23 bp, Homo sapiens
ccctgcactaagaggagaaggtg

SEQ ID NO: 7379763 - DNA, 22 bp, Homo sapiens
ccctgcagaccaatgccataga

SEQ ID NO: 7379764 - DNA, 22 bp, Homo sapiens
tggacaggtgcacacagcagcc

SEQ ID NO: 7379765 - DNA, 22 bp, Homo sapiens
ccctgcagtcctttcttggctc

SEQ ID NO: 7379766 - DNA, 22 bp, Homo sapiens
tggacaggttgagtaggaggag

SEQ ID NO: 7379767 - DNA, 22 bp, Homo sapiens
tggacagttactgagcttgagt

SEQ ID NO: 7379768 - DNA, 23 bp, Homo sapiens
tggacagtagggtagacagtgcc

SEQ ID NO: 7379769 - DNA, 22 bp, Homo sapiens
ccctgctgaatcccatggagtc

SEQ ID NO: 7379770 - DNA, 22 bp, Homo sapiens
ccctgctgaagaacgttcatac

SEQ ID NO: 7379771 - DNA, 22 bp, Homo sapiens
ccctgctagttgtctcagtgat

SEQ ID NO: 7379772 - DNA, 22 bp, Homo sapiens
tggaggccaggaaggcagcgag

SEQ ID NO: 7379773 - DNA, 22 bp, Homo sapiens
tggaggccagaggtactgggac

SEQ ID NO: 7379774 - DNA, 22 bp, Homo sapiens
ccctgctgaatcccatggagtc

SEQ ID NO: 7379775 - DNA, 19 bp, Homo sapiens
tggaggccaggacacaggt

SEQ ID NO: 7379776 - DNA, 23 bp, Homo sapiens
ccctggagctagtctgagcagag

SEQ ID NO: 7379777 - DNA, 22 bp, Homo sapiens
tgggagcctggcaggccagagg

SEQ ID NO: 7379778 - DNA, 23 bp, Homo sapiens
tgggagctcaagggaggctgccc

SEQ ID NO: 7379779 - DNA, 22 bp, Homo sapiens
tgggagccattttagaggctgc

SEQ ID NO: 7379780 - DNA, 22 bp, Homo sapiens
tgggagcccaagggagctgccg

SEQ ID NO: 7379781 - DNA, 22 bp, Homo sapiens
tgggagcagttcaggtgtggct

SEQ ID NO: 7379782 - DNA, 22 bp, Homo sapiens
tgggagcagttcaggtgtggct

SEQ ID NO: 7379783 - DNA, 22 bp, Homo sapiens
tgggagcaggtgtgctagggaa

SEQ ID NO: 7379784 - DNA, 22 bp, Homo sapiens
tgggagcagttgcatctccagt

SEQ ID NO: 7379785 - DNA, 22 bp, Homo sapiens
tgggagcagttgtgaagctcag

SEQ ID NO: 7379786 - DNA, 22 bp, Homo sapiens
cctctggccacatgggacatag

SEQ ID NO: 7379787 - DNA, 22 bp, Homo sapiens
cctctggcaacttcacagccca

SEQ ID NO: 7379788 - DNA, 23 bp, Homo sapiens
tggctctctcagtgctgcagagg

SEQ ID NO: 7379789 - DNA, 22 bp, Homo sapiens
tggctctcagctcccagcagcc

SEQ ID NO: 7379790 - DNA, 22 bp, Homo sapiens
tggctctgaccaggtagaggag

SEQ ID NO: 7379791 - DNA, 22 bp, Homo sapiens
tgggagcaggtgtgctagggaa

SEQ ID NO: 7379792 - DNA, 22 bp, Homo sapiens
tgggagcaggctgatgataggt

SEQ ID NO: 7379793 - DNA, 22 bp, Homo sapiens
tgggccagatccatggcaataa

SEQ ID NO: 7379794 - DNA, 21 bp, Homo sapiens
tgggccagatctgagtttcta

SEQ ID NO: 7379795 - DNA, 22 bp, Homo sapiens
tgggccagcaattgctgctcag

SEQ ID NO: 7379796 - DNA, 22 bp, Homo sapiens
tgggccagaagtatgcatgttt

SEQ ID NO: 7379797 - DNA, 22 bp, Homo sapiens
tgggccagagagtaagaaaggt

SEQ ID NO: 7379798 - DNA, 22 bp, Homo sapiens
tgggccagaggcatggagctat

SEQ ID NO: 7379799 - DNA, 22 bp, Homo sapiens
cctctggcctaggccgggagag

SEQ ID NO: 7379800 - DNA, 22 bp, Homo sapiens
tgggccagcaattgctgctcag

SEQ ID NO: 7379801 - DNA, 22 bp, Homo sapiens
cctcttgattggttggaagcgg

SEQ ID NO: 7379802 - DNA, 22 bp, Homo sapiens
cctcttgccaatcagctacaga

SEQ ID NO: 7379803 - DNA, 22 bp, Homo sapiens
cctgaatactggtgctgaaagt

SEQ ID NO: 7379804 - DNA, 22 bp, Homo sapiens
tgggggtgtgccagggacctcc

SEQ ID NO: 7379805 - DNA, 21 bp, Homo sapiens
cctgagggtggttgtgaagat

SEQ ID NO: 7379806 - DNA, 22 bp, Homo sapiens
tgggggtggttcttgcctccag

SEQ ID NO: 7379807 - DNA, 22 bp, Homo sapiens
tgggggtgtcctggtgcacaca

SEQ ID NO: 7379808 - DNA, 22 bp, Homo sapiens
cctgcacagaccaaagaggaca

SEQ ID NO: 7379809 - DNA, 22 bp, Homo sapiens
cctgcacaggccaggcatctga

SEQ ID NO: 7379810 - DNA, 22 bp, Homo sapiens
cctgatggctgtctgggcctga

SEQ ID NO: 7379811 - DNA, 22 bp, Homo sapiens
cctgccagagcagcttgtcctc

SEQ ID NO: 7379812 - DNA, 22 bp, Homo sapiens
cctgccagacgcaccagggggc

SEQ ID NO: 7379813 - DNA, 22 bp, Homo sapiens
cctgagaccaagttgcagccat

SEQ ID NO: 7379814 - DNA, 22 bp, Homo sapiens
cctgagacatgaaccaggctcc

SEQ ID NO: 7379815 - DNA, 22 bp, Homo sapiens
cctgacagttaattgtcctgta

SEQ ID NO: 7379816 - DNA, 22 bp, Homo sapiens
cctgacagtggtagccttggca

SEQ ID NO: 7379817 - DNA, 22 bp, Homo sapiens
cctgaggggctgcaggccagct

SEQ ID NO: 7379818 - DNA, 22 bp, Homo sapiens
cctgaggctccacctccagaga

SEQ ID NO: 7379819 - DNA, 20 bp, Homo sapiens
cctgcctgcctcggctcatt

SEQ ID NO: 7379820 - DNA, 22 bp, Homo sapiens
cctgcctgtcatcgcctgcgcc

SEQ ID NO: 7379821 - DNA, 22 bp, Homo sapiens
cctgcctgtactagagacccag

SEQ ID NO: 7379822 - DNA, 22 bp, Homo sapiens
cctgcctgtaagatgggtacaa

SEQ ID NO: 7379823 - DNA, 20 bp, Homo sapiens
cctgcctgtgtttgtgatga

SEQ ID NO: 7379824 - DNA, 22 bp, Homo sapiens
cctgccaggctttgggcttctg

SEQ ID NO: 7379825 - DNA, 22 bp, Homo sapiens
cctgccaggctttcaggtttgg

SEQ ID NO: 7379826 - DNA, 22 bp, Homo sapiens
cctgccaggcgagtctaggcca

SEQ ID NO: 7379827 - DNA, 22 bp, Homo sapiens
cctgccaggccagtgagcttcc

SEQ ID NO: 7379828 - DNA, 22 bp, Homo sapiens
cctgccagggccagaggccagc

SEQ ID NO: 7379829 - DNA, 22 bp, Homo sapiens
cctgccagtcactatgtcacct

SEQ ID NO: 7379830 - DNA, 22 bp, Homo sapiens
cctgccagggccttggaagaaa

SEQ ID NO: 7379831 - DNA, 18 bp, Homo sapiens
cctgccagtctggagcag

SEQ ID NO: 7379832 - DNA, 22 bp, Homo sapiens
cctgctggccactgctccacct

SEQ ID NO: 7379833 - DNA, 22 bp, Homo sapiens
cctgctggctggtagagttccg

SEQ ID NO: 7379834 - DNA, 22 bp, Homo sapiens
cctgctgtctctgggcaggcag

SEQ ID NO: 7379835 - DNA, 22 bp, Homo sapiens
cctgctgctatgaaggtgacag

SEQ ID NO: 7379836 - DNA, 22 bp, Homo sapiens
cctgccttccagccttgggctc

SEQ ID NO: 7379837 - DNA, 22 bp, Homo sapiens
cctgccttcagccctgaagtct

SEQ ID NO: 7379838 - DNA, 21 bp, Homo sapiens
tgtaagtttcatctgaattgg

SEQ ID NO: 7379839 - DNA, 21 bp, Homo sapiens
tgtaagtttcatctgaattgg

SEQ ID NO: 7379840 - DNA, 22 bp, Homo sapiens
cctgcttaacattgccatgaca

SEQ ID NO: 7379841 - DNA, 22 bp, Homo sapiens
tgtaaagacagataaaacagca

SEQ ID NO: 7379842 - DNA, 22 bp, Homo sapiens
cctggaaaacatgggaatcaca

SEQ ID NO: 7379843 - DNA, 22 bp, Homo sapiens
tgtacattgtcactcatcaagt

SEQ ID NO: 7379844 - DNA, 22 bp, Homo sapiens
tgtacatattcaagcacttcta

SEQ ID NO: 7379845 - DNA, 22 bp, Homo sapiens
tgtacatacatagatatacaca

SEQ ID NO: 7379846 - DNA, 22 bp, Homo sapiens
tgtaattttacgtgacacagtt

SEQ ID NO: 7379847 - DNA, 22 bp, Homo sapiens
tgtaatttgcatggctgaatgc

SEQ ID NO: 7379848 - DNA, 22 bp, Homo sapiens
tgtaattatttctgtgcagtca

SEQ ID NO: 7379849 - DNA, 22 bp, Homo sapiens
tgtaatttgcatggctgaatgc

SEQ ID NO: 7379850 - DNA, 22 bp, Homo sapiens
tgtaatttcctgatgttagaac

SEQ ID NO: 7379851 - DNA, 22 bp, Homo sapiens
tgtaatttcctgatgttagaac

SEQ ID NO: 7379852 - DNA, 22 bp, Homo sapiens
tgtaatttcctgatgttagaac

SEQ ID NO: 7379853 - DNA, 22 bp, Homo sapiens
tgtcaacacacctatctcaatt

SEQ ID NO: 7379854 - DNA, 22 bp, Homo sapiens
tgtcaacaacagcattttctat

SEQ ID NO: 7379855 - DNA, 22 bp, Homo sapiens
tgtcaacagatactagagagct

SEQ ID NO: 7379856 - DNA, 22 bp, Homo sapiens
tgtcaacatttatcaagttatt

SEQ ID NO: 7379857 - DNA, 22 bp, Homo sapiens
tgtcaacagatctcaaagctgg

SEQ ID NO: 7379858 - DNA, 22 bp, Homo sapiens
tgtcaacattggctgacagttg

SEQ ID NO: 7379859 - DNA, 22 bp, Homo sapiens
tgtcaagtctagttgctggctt

SEQ ID NO: 7379860 - DNA, 22 bp, Homo sapiens
tgtcaagatgacagatagatga

SEQ ID NO: 7379861 - DNA, 22 bp, Homo sapiens
tgtcaaggacgtgcatgaaccc

SEQ ID NO: 7379862 - DNA, 18 bp, Homo sapiens
cctggagctccacagcaa

SEQ ID NO: 7379863 - DNA, 18 bp, Homo sapiens
cctggagctccacagcaa

SEQ ID NO: 7379864 - DNA, 22 bp, Homo sapiens
cctggaggagcgctgaccagct

SEQ ID NO: 7379865 - DNA, 22 bp, Homo sapiens
cctggaggcggaggttgcagtg

SEQ ID NO: 7379866 - DNA, 22 bp, Homo sapiens
ccaccgctgaaggcactggcat

SEQ ID NO: 7379867 - DNA, 22 bp, Homo sapiens
tcggaaggggccgcgctcggac

SEQ ID NO: 7379868 - DNA, 22 bp, Homo sapiens
ccaccagaccaccaagagcaac

SEQ ID NO: 7379869 - DNA, 22 bp, Homo sapiens
ccaccagaaagactctgtgtga

SEQ ID NO: 7379870 - DNA, 22 bp, Homo sapiens
ccaccagaagctgggagaagct

SEQ ID NO: 7379871 - DNA, 22 bp, Homo sapiens
ccacatttttgatactctcact

SEQ ID NO: 7379872 - DNA, 22 bp, Homo sapiens
ccaccaagtcccactataattt

SEQ ID NO: 7379873 - DNA, 22 bp, Homo sapiens
ccaccagagcttcgtggcttaa

SEQ ID NO: 7379874 - DNA, 22 bp, Homo sapiens
ccaccagagggcagactgtgat

SEQ ID NO: 7379875 - DNA, 22 bp, Homo sapiens
ccaccagatttactttactatt

SEQ ID NO: 7379876 - DNA, 22 bp, Homo sapiens
tcctttccagcctcacctcagc

SEQ ID NO: 7379877 - DNA, 22 bp, Homo sapiens
ccaccaggacagccctgagggg

SEQ ID NO: 7379878 - DNA, 22 bp, Homo sapiens
tcctttccatgcttctagaggc

SEQ ID NO: 7379879 - DNA, 22 bp, Homo sapiens
tcgcgcccccaagcgtcattgg

SEQ ID NO: 7379880 - DNA, 22 bp, Homo sapiens
tcctctgagcctcagtttctca

SEQ ID NO: 7379881 - DNA, 22 bp, Homo sapiens
tcctctgagtaaagaagattgc

SEQ ID NO: 7379882 - DNA, 21 bp, Homo sapiens
tcctctgcagtgaggtggcct

SEQ ID NO: 7379883 - DNA, 22 bp, Homo sapiens
tcctctgccaaagggagttgcc

SEQ ID NO: 7379884 - DNA, 22 bp, Homo sapiens
tcctctgaagaaaaggagcagg

SEQ ID NO: 7379885 - DNA, 22 bp, Homo sapiens
tcctctgaaatctagattgtga

SEQ ID NO: 7379886 - DNA, 19 bp, Homo sapiens
tcctctgaaggttctttta

SEQ ID NO: 7379887 - DNA, 23 bp, Homo sapiens
ccacatggcaagatgatgcattc

SEQ ID NO: 7379888 - DNA, 22 bp, Homo sapiens
ccacattcaccagctgcacgac

SEQ ID NO: 7379889 - DNA, 22 bp, Homo sapiens
ccacattcagtccaggcttgga

SEQ ID NO: 7379890 - DNA, 21 bp, Homo sapiens
ccacattctcattctgactgc

SEQ ID NO: 7379891 - DNA, 22 bp, Homo sapiens
tctcccacagtctcccatggct

SEQ ID NO: 7379892 - DNA, 22 bp, Homo sapiens
tctccctcattcctgcttccat

SEQ ID NO: 7379893 - DNA, 23 bp, Homo sapiens
tctccctgaggttgttagcatta

SEQ ID NO: 7379894 - DNA, 20 bp, Homo sapiens
tctccctgcccatctcagat

SEQ ID NO: 7379895 - DNA, 20 bp, Homo sapiens
tctccctgcccatctcagat

SEQ ID NO: 7379896 - DNA, 19 bp, Homo sapiens
ccactttgcagatagtgag

SEQ ID NO: 7379897 - DNA, 22 bp, Homo sapiens
tctcagtttcctcatatgtaaa

SEQ ID NO: 7379898 - DNA, 20 bp, Homo sapiens
tctcagtttctagagtcagg

SEQ ID NO: 7379899 - DNA, 22 bp, Homo sapiens
tctatattccagatacagatta

SEQ ID NO: 7379900 - DNA, 22 bp, Homo sapiens
tctatattccagatacagatta

SEQ ID NO: 7379901 - DNA, 22 bp, Homo sapiens
tctgcagaagctcactaaatcc

SEQ ID NO: 7379902 - DNA, 19 bp, Homo sapiens
tctgcagaaggcatacatg

SEQ ID NO: 7379903 - DNA, 22 bp, Homo sapiens
ccagccctgtaaggatgaggca

SEQ ID NO: 7379904 - DNA, 22 bp, Homo sapiens
ccagccctgtttatgtgtcact

SEQ ID NO: 7379905 - DNA, 22 bp, Homo sapiens
tctctgttcatggcactatgtc

SEQ ID NO: 7379906 - DNA, 22 bp, Homo sapiens
tctctgtgtgttggctgtatat

SEQ ID NO: 7379907 - DNA, 22 bp, Homo sapiens
tctctgatgattggaagcttag

SEQ ID NO: 7379908 - DNA, 22 bp, Homo sapiens
tctctgcacagaagtagatagc

SEQ ID NO: 7379909 - DNA, 22 bp, Homo sapiens
tctctgcatccccagggctctc

SEQ ID NO: 7379910 - DNA, 22 bp, Homo sapiens
tctctgcacttgcacataagct

SEQ ID NO: 7379911 - DNA, 22 bp, Homo sapiens
tctctcttgtcaccccatctgc

SEQ ID NO: 7379912 - DNA, 20 bp, Homo sapiens
tctctgagtttcctaatttg

SEQ ID NO: 7379913 - DNA, 17 bp, Homo sapiens
tctcctggctctatcag

SEQ ID NO: 7379914 - DNA, 22 bp, Homo sapiens
tctctgcccaagtttctcaagt

SEQ ID NO: 7379915 - DNA, 22 bp, Homo sapiens
tctctgccaccatgagatgggc

SEQ ID NO: 7379916 - DNA, 22 bp, Homo sapiens
tctctgccacagcttctgcctt

SEQ ID NO: 7379917 - DNA, 22 bp, Homo sapiens
tctctgcccatcctcagtccac

SEQ ID NO: 7379918 - DNA, 22 bp, Homo sapiens
ccagcagctccctcagggtccg

SEQ ID NO: 7379919 - DNA, 22 bp, Homo sapiens
ccagcagaggggcggagtgcag

SEQ ID NO: 7379920 - DNA, 22 bp, Homo sapiens
ccagcagagtatcaatgtattt

SEQ ID NO: 7379921 - DNA, 22 bp, Homo sapiens
ccagcagagggtcttggccatt

SEQ ID NO: 7379922 - DNA, 22 bp, Homo sapiens
ccagcagagtctaggaaggagg

SEQ ID NO: 7379923 - DNA, 22 bp, Homo sapiens
ccagcagagtggggtttagagt

SEQ ID NO: 7379924 - DNA, 22 bp, Homo sapiens
ccagcagagttggtttctggta

SEQ ID NO: 7379925 - DNA, 22 bp, Homo sapiens
ccagcagcagcgtccaaggaga

SEQ ID NO: 7379926 - DNA, 22 bp, Homo sapiens
cattcacatcttgttccatcac

SEQ ID NO: 7379927 - DNA, 22 bp, Homo sapiens
cattcacatcttgttccatcac

SEQ ID NO: 7379928 - DNA, 22 bp, Homo sapiens
cattcacattcttcttactgtt

SEQ ID NO: 7379929 - DNA, 22 bp, Homo sapiens
cattcacaatagttgaaaggtg

SEQ ID NO: 7379930 - DNA, 22 bp, Homo sapiens
cattcacaactgagcattgttg

SEQ ID NO: 7379931 - DNA, 22 bp, Homo sapiens
cattcacaaagctgattgatgg

SEQ ID NO: 7379932 - DNA, 22 bp, Homo sapiens
cattcacaatggattgcttcaa

SEQ ID NO: 7379933 - DNA, 22 bp, Homo sapiens
cattcacaaaaccacatgccat

SEQ ID NO: 7379934 - DNA, 22 bp, Homo sapiens
cattcacaaaaccacatgccat

SEQ ID NO: 7379935 - DNA, 22 bp, Homo sapiens
cattcaaatgtgccactgtcct

SEQ ID NO: 7379936 - DNA, 22 bp, Homo sapiens
cattcaagagtggacataatgc

SEQ ID NO: 7379937 - DNA, 22 bp, Homo sapiens
catgttggtgtgctgcacccat

SEQ ID NO: 7379938 - DNA, 22 bp, Homo sapiens
catgttggtgtgctgcacccgt

SEQ ID NO: 7379939 - DNA, 22 bp, Homo sapiens
catgttgtattctttggctggt

SEQ ID NO: 7379940 - DNA, 22 bp, Homo sapiens
catgttaactaagattaactat

SEQ ID NO: 7379941 - DNA, 22 bp, Homo sapiens
catgttaatatgcattgagtac

SEQ ID NO: 7379942 - DNA, 22 bp, Homo sapiens
catgttaagtgtttgataacca

SEQ ID NO: 7379943 - DNA, 22 bp, Homo sapiens
catgttaatgaatttttgcagt

SEQ ID NO: 7379944 - DNA, 22 bp, Homo sapiens
catgttggcactgtctctgcct

SEQ ID NO: 7379945 - DNA, 22 bp, Homo sapiens
catgttcatcagatcaattgta

SEQ ID NO: 7379946 - DNA, 20 bp, Homo sapiens
tcccactcttgtgttttcag

SEQ ID NO: 7379947 - DNA, 22 bp, Homo sapiens
tcccagagcccaagttggagag

SEQ ID NO: 7379948 - DNA, 22 bp, Homo sapiens
tcccagaggaaatggcagctga

SEQ ID NO: 7379949 - DNA, 22 bp, Homo sapiens
tcccagccacaggtgtagccct

SEQ ID NO: 7379950 - DNA, 22 bp, Homo sapiens
tcccagagctctggaggttgga

SEQ ID NO: 7379951 - DNA, 22 bp, Homo sapiens
tcccagagcctctgccactctg

SEQ ID NO: 7379952 - DNA, 22 bp, Homo sapiens
tcccagccattcctttaggtgt

SEQ ID NO: 7379953 - DNA, 22 bp, Homo sapiens
tcccagcccagacttctccagt

SEQ ID NO: 7379954 - DNA, 22 bp, Homo sapiens
tcccagcccagatttgtgtgac

SEQ ID NO: 7379955 - DNA, 22 bp, Homo sapiens
tcccagccaggctctaccactt

SEQ ID NO: 7379956 - DNA, 22 bp, Homo sapiens
tcccagccacagtttccacctg

SEQ ID NO: 7379957 - DNA, 22 bp, Homo sapiens
tcccagcccaggtatgatgata

SEQ ID NO: 7379958 - DNA, 22 bp, Homo sapiens
tcccaggacatgggctctgctc

SEQ ID NO: 7379959 - DNA, 22 bp, Homo sapiens
tcccgtcttgctgttgtctgcg

SEQ ID NO: 7379960 - DNA, 22 bp, Homo sapiens
tcccgtaggttgctgtagtcgg

SEQ ID NO: 7379961 - DNA, 22 bp, Homo sapiens
tccccaggaaattctgattctt

SEQ ID NO: 7379962 - DNA, 22 bp, Homo sapiens
tccccactgggcctcctctttc

SEQ ID NO: 7379963 - DNA, 22 bp, Homo sapiens
tcccaggaggtgcttcctagga

SEQ ID NO: 7379964 - DNA, 22 bp, Homo sapiens
cattgaaatatggaaactgatg

SEQ ID NO: 7379965 - DNA, 22 bp, Homo sapiens
tccccactcctgggcagatgcg

SEQ ID NO: 7379966 - DNA, 22 bp, Homo sapiens
tcccagggtcctcttctggaat

SEQ ID NO: 7379967 - DNA, 22 bp, Homo sapiens
cattgcacaccagcctgggcaa

SEQ ID NO: 7379968 - DNA, 22 bp, Homo sapiens
cattgcaccacattgcatccct

SEQ ID NO: 7379969 - DNA, 22 bp, Homo sapiens
cattgcaacttcaaactcctgg

SEQ ID NO: 7379970 - DNA, 22 bp, Homo sapiens
tcctcaggagagctcctatgcc

SEQ ID NO: 7379971 - DNA, 22 bp, Homo sapiens
tccctagtcgcatctgtggaga

SEQ ID NO: 7379972 - DNA, 22 bp, Homo sapiens
tccctaggtcctagtcacagta

SEQ ID NO: 7379973 - DNA, 20 bp, Homo sapiens
tccctaggcaggagggcact

SEQ ID NO: 7379974 - DNA, 22 bp, Homo sapiens
tcctctccatattttctgattt

SEQ ID NO: 7379975 - DNA, 22 bp, Homo sapiens
catttgtatagtgcttagacca

SEQ ID NO: 7379976 - DNA, 22 bp, Homo sapiens
catttgtatcatatgtatctta

SEQ ID NO: 7379977 - DNA, 22 bp, Homo sapiens
catttggtggctacagagtaac

SEQ ID NO: 7379978 - DNA, 22 bp, Homo sapiens
tcctcagggaagatgagcctca

SEQ ID NO: 7379979 - DNA, 17 bp, Homo sapiens
tccagcctcctctgctg

SEQ ID NO: 7379980 - DNA, 22 bp, Homo sapiens
tccagagagatagtggctaata

SEQ ID NO: 7379981 - DNA, 22 bp, Homo sapiens
tccagactgccctgcacatgtg

SEQ ID NO: 7379982 - DNA, 20 bp, Homo sapiens
tccaggcagctcagagtgtc

SEQ ID NO: 7379983 - DNA, 22 bp, Homo sapiens
tccaggccccactgaagcccct

SEQ ID NO: 7379984 - DNA, 22 bp, Homo sapiens
catgttaaaatatacattctga

SEQ ID NO: 7379985 - DNA, 22 bp, Homo sapiens
catgttaaattgagtttgcaat

SEQ ID NO: 7379986 - DNA, 22 bp, Homo sapiens
catgttaaaatatacattctga

SEQ ID NO: 7379987 - DNA, 23 bp, Homo sapiens
catgtgtgtgtgaagaaggcgac

SEQ ID NO: 7379988 - DNA, 22 bp, Homo sapiens
catgtgtttcgagactgttgag

SEQ ID NO: 7379989 - DNA, 22 bp, Homo sapiens
catgtgtgtccatgtgactaag

SEQ ID NO: 7379990 - DNA, 22 bp, Homo sapiens
catgtgtgtggacgagcgtggc

SEQ ID NO: 7379991 - DNA, 22 bp, Homo sapiens
tcatttatttgactttggagtg

SEQ ID NO: 7379992 - DNA, 22 bp, Homo sapiens
tccacaggtatttctccttgct

SEQ ID NO: 7379993 - DNA, 22 bp, Homo sapiens
tccacaggtcagggagataggc

SEQ ID NO: 7379994 - DNA, 22 bp, Homo sapiens
tccacaggtatgaggccccacc

SEQ ID NO: 7379995 - DNA, 22 bp, Homo sapiens
tccacaggtccggcatgaacag

SEQ ID NO: 7379996 - DNA, 22 bp, Homo sapiens
tccacaggtcctctttgcaaag

SEQ ID NO: 7379997 - DNA, 22 bp, Homo sapiens
tccacatgacttctaataactg

SEQ ID NO: 7379998 - DNA, 22 bp, Homo sapiens
tcattctctgggatgcagtttg

SEQ ID NO: 7379999 - DNA, 22 bp, Homo sapiens
tcattctcagactcttggcctc

SEQ ID NO: 7380000 - DNA, 22 bp, Homo sapiens
tcattgaaaactcagcatctac

SEQ ID NO: 7380001 - DNA, 22 bp, Homo sapiens
tcattctgcatcactcttgctc

SEQ ID NO: 7380002 - DNA, 22 bp, Homo sapiens
tcattcttgatcactagttagt

SEQ ID NO: 7380003 - DNA, 22 bp, Homo sapiens
tcattctggatgactttctaga

SEQ ID NO: 7380004 - DNA, 19 bp, Homo sapiens
tcattgaacataattactt

SEQ ID NO: 7380005 - DNA, 22 bp, Homo sapiens
tcatttatgcaggaatggcata

SEQ ID NO: 7380006 - DNA, 22 bp, Homo sapiens
catgaaaaatttactgttaaca

SEQ ID NO: 7380007 - DNA, 22 bp, Homo sapiens
catgaaaaatttactgttaaca

SEQ ID NO: 7380008 - DNA, 22 bp, Homo sapiens
catctttgtaacttccacataa

SEQ ID NO: 7380009 - DNA, 22 bp, Homo sapiens
tcatgcactacataacgatgtt

SEQ ID NO: 7380010 - DNA, 21 bp, Homo sapiens
tcatgaagcatcacttctgcc

SEQ ID NO: 7380011 - DNA, 22 bp, Homo sapiens
caggttccctagcagcaaagcc

SEQ ID NO: 7380012 - DNA, 22 bp, Homo sapiens
caggttccagttgcagggactt

SEQ ID NO: 7380013 - DNA, 22 bp, Homo sapiens
caggttcccaggtccagggctt

SEQ ID NO: 7380014 - DNA, 22 bp, Homo sapiens
cagggtggccctgtggtctcat

SEQ ID NO: 7380015 - DNA, 22 bp, Homo sapiens
cagggtgggcacccagcctcca

SEQ ID NO: 7380016 - DNA, 22 bp, Homo sapiens
tatttcatctggaacaaggtaa

SEQ ID NO: 7380017 - DNA, 22 bp, Homo sapiens
tatttcatgtgcaccataattc

SEQ ID NO: 7380018 - DNA, 22 bp, Homo sapiens
tatttcatgtgcaccataattc

SEQ ID NO: 7380019 - DNA, 22 bp, Homo sapiens
caggtttctagttctaagaata

SEQ ID NO: 7380020 - DNA, 22 bp, Homo sapiens
tatttcagtcacttcttctctg

SEQ ID NO: 7380021 - DNA, 22 bp, Homo sapiens
caggttcccttgcagctaagtg

SEQ ID NO: 7380022 - DNA, 22 bp, Homo sapiens
caggttctatactgaataattt

SEQ ID NO: 7380023 - DNA, 22 bp, Homo sapiens
tatttcttttcgtgacttattg

SEQ ID NO: 7380024 - DNA, 21 bp, Homo sapiens
tatttctttgactctctccct

SEQ ID NO: 7380025 - DNA, 22 bp, Homo sapiens
tatttctttcaggtatgtgttg

SEQ ID NO: 7380026 - DNA, 22 bp, Homo sapiens
tatttcttgttccctccaagtt

SEQ ID NO: 7380027 - DNA, 22 bp, Homo sapiens
cagtcccacaagatctccacaa

SEQ ID NO: 7380028 - DNA, 20 bp, Homo sapiens
cagtccaatcagaggccacc

SEQ ID NO: 7380029 - DNA, 22 bp, Homo sapiens
cagtccagagcccaccagagga

SEQ ID NO: 7380030 - DNA, 22 bp, Homo sapiens
cagtagcatgtaataaagacag

SEQ ID NO: 7380031 - DNA, 22 bp, Homo sapiens
cagtaggaaggatgcagaaaaa

SEQ ID NO: 7380032 - DNA, 22 bp, Homo sapiens
cagtaggcaggttgtcttctta

SEQ ID NO: 7380033 - DNA, 18 bp, Homo sapiens
cagtataaccagcaactc

SEQ ID NO: 7380034 - DNA, 22 bp, Homo sapiens
cagtgagataccacagagcaaa

SEQ ID NO: 7380035 - DNA, 22 bp, Homo sapiens
tcacacttatcccactcagtca

SEQ ID NO: 7380036 - DNA, 22 bp, Homo sapiens
tcacagactcttgattgtctaa

SEQ ID NO: 7380037 - DNA, 22 bp, Homo sapiens
cagtgagaaaactaagacatta

SEQ ID NO: 7380038 - DNA, 22 bp, Homo sapiens
tcacaacaggaaggaccagctg

SEQ ID NO: 7380039 - DNA, 22 bp, Homo sapiens
tatttcttttcgtgacttattg

SEQ ID NO: 7380040 - DNA, 22 bp, Homo sapiens
tatttcttttcgtgacttattg

SEQ ID NO: 7380041 - DNA, 22 bp, Homo sapiens
tatttgaaagtgtacaaaaact

SEQ ID NO: 7380042 - DNA, 22 bp, Homo sapiens
tcaatgaagagatttaaatcat

SEQ ID NO: 7380043 - DNA, 20 bp, Homo sapiens
tcaatgagatttaaaaggat

SEQ ID NO: 7380044 - DNA, 22 bp, Homo sapiens
tcaatgagccagaatgtagtac

SEQ ID NO: 7380045 - DNA, 22 bp, Homo sapiens
tcaatgagctggggacgtgtac

SEQ ID NO: 7380046 - DNA, 22 bp, Homo sapiens
tcaatgaggtaatcagtcaccc

SEQ ID NO: 7380047 - DNA, 22 bp, Homo sapiens
tcaatgaggtgattgctgtcct

SEQ ID NO: 7380048 - DNA, 22 bp, Homo sapiens
tcaatgagaaagacacagtctt

SEQ ID NO: 7380049 - DNA, 22 bp, Homo sapiens
tcaatgagaatagctttcctta

SEQ ID NO: 7380050 - DNA, 20 bp, Homo sapiens
tcacaggagggaaggcaggt

SEQ ID NO: 7380051 - DNA, 20 bp, Homo sapiens
tcacaggagggaaggcaggt

SEQ ID NO: 7380052 - DNA, 22 bp, Homo sapiens
tcacagttcatctgataaacta

SEQ ID NO: 7380053 - DNA, 22 bp, Homo sapiens
tcagctgccccagtggccccag

SEQ ID NO: 7380054 - DNA, 22 bp, Homo sapiens
cagtttatagttgttatgtgtg

SEQ ID NO: 7380055 - DNA, 19 bp, Homo sapiens
cataaatgtacaagataca

SEQ ID NO: 7380056 - DNA, 22 bp, Homo sapiens
cataaaatggcttgttctttaa

SEQ ID NO: 7380057 - DNA, 19 bp, Homo sapiens
tcagcagattttgcaaaca

SEQ ID NO: 7380058 - DNA, 21 bp, Homo sapiens
tcagcagcatctgcctagagt

SEQ ID NO: 7380059 - DNA, 22 bp, Homo sapiens
tcagcagagtttcatcttggga

SEQ ID NO: 7380060 - DNA, 22 bp, Homo sapiens
tcagcagatgtggtgaaaagtc

SEQ ID NO: 7380061 - DNA, 22 bp, Homo sapiens
tcagcagatgatttccatacaa

SEQ ID NO: 7380062 - DNA, 22 bp, Homo sapiens
tcagcagatgggttgtgttggc

SEQ ID NO: 7380063 - DNA, 22 bp, Homo sapiens
tcagcagagtggaacattgtca

SEQ ID NO: 7380064 - DNA, 22 bp, Homo sapiens
tcagcagaggcagactctcctt

SEQ ID NO: 7380065 - DNA, 22 bp, Homo sapiens
tcagcagaggggaaggcatctg

SEQ ID NO: 7380066 - DNA, 22 bp, Homo sapiens
tcagcagaggagtgtcttgccc

SEQ ID NO: 7380067 - DNA, 22 bp, Homo sapiens
tcagcagaatcttcctacacct

SEQ ID NO: 7380068 - DNA, 22 bp, Homo sapiens
tcagcagaatgtggcatgtcac

SEQ ID NO: 7380069 - DNA, 22 bp, Homo sapiens
tcagcagacctgttatttggat

SEQ ID NO: 7380070 - DNA, 22 bp, Homo sapiens
tcagcagacagttagctatatt

SEQ ID NO: 7380071 - DNA, 22 bp, Homo sapiens
tcagcagacattattttctggc

SEQ ID NO: 7380072 - DNA, 22 bp, Homo sapiens
tcagcagagcgagaccaagtca

SEQ ID NO: 7380073 - DNA, 22 bp, Homo sapiens
tcagcagagctcaggctccagc

SEQ ID NO: 7380074 - DNA, 22 bp, Homo sapiens
tcagcagaggagtgtcttgccc

SEQ ID NO: 7380075 - DNA, 22 bp, Homo sapiens
tcagcagactaggcagattact

SEQ ID NO: 7380076 - DNA, 22 bp, Homo sapiens
cagttaacttcatatgatcatt

SEQ ID NO: 7380077 - DNA, 22 bp, Homo sapiens
cagttaatgtcctatacaatag

SEQ ID NO: 7380078 - DNA, 22 bp, Homo sapiens
cagttaatgtcctatacaatag

SEQ ID NO: 7380079 - DNA, 22 bp, Homo sapiens
cagttaatgtcctatacaatag

SEQ ID NO: 7380080 - DNA, 22 bp, Homo sapiens
cagttaaaggcccaatatctgg

SEQ ID NO: 7380081 - DNA, 22 bp, Homo sapiens
cagttactgtatgtcaaagact

SEQ ID NO: 7380082 - DNA, 22 bp, Homo sapiens
tcagcagaagtatagaggccat

SEQ ID NO: 7380083 - DNA, 21 bp, Homo sapiens
tcagcagaatatgaactgcac

SEQ ID NO: 7380084 - DNA, 22 bp, Homo sapiens
cagtgtctccagatgctccaat

SEQ ID NO: 7380085 - DNA, 22 bp, Homo sapiens
cagtgtctggttggctctacgt

SEQ ID NO: 7380086 - DNA, 22 bp, Homo sapiens
tcagactggattttcacgtttt

SEQ ID NO: 7380087 - DNA, 22 bp, Homo sapiens
tcagactgaaagatacacctct

SEQ ID NO: 7380088 - DNA, 19 bp, Homo sapiens
tcagactgaaagtttagat

SEQ ID NO: 7380089 - DNA, 22 bp, Homo sapiens
cagtgtctccagatgctccaat

SEQ ID NO: 7380090 - DNA, 22 bp, Homo sapiens
tcagagaaatgacaatatatag

SEQ ID NO: 7380091 - DNA, 21 bp, Homo sapiens
cagtggcagttcttgcctctg

SEQ ID NO: 7380092 - DNA, 21 bp, Homo sapiens
cagtggcagttcttgcctctg

SEQ ID NO: 7380093 - DNA, 22 bp, Homo sapiens
cagtggctgagagtggacactg

SEQ ID NO: 7380094 - DNA, 22 bp, Homo sapiens
cagtggcagttagaaaatattc

SEQ ID NO: 7380095 - DNA, 22 bp, Homo sapiens
cagtggcagttagaaaatattc

SEQ ID NO: 7380096 - DNA, 22 bp, Homo sapiens
cagtggctggttagggacagga

SEQ ID NO: 7380097 - DNA, 22 bp, Homo sapiens
cagtggcttacaatgaactaga

SEQ ID NO: 7380098 - DNA, 22 bp, Homo sapiens
cagtggcttctcatgtcattca

SEQ ID NO: 7380099 - DNA, 22 bp, Homo sapiens
cagtggcttaaataagattagg

SEQ ID NO: 7380100 - DNA, 22 bp, Homo sapiens
cagtggcttacaatgaactaga

SEQ ID NO: 7380101 - DNA, 22 bp, Homo sapiens
cagtgccatattgaaagacatt

SEQ ID NO: 7380102 - DNA, 22 bp, Homo sapiens
cagtgccatgtctgagccccta

SEQ ID NO: 7380103 - DNA, 22 bp, Homo sapiens
cagtgccatgtctgagccccta

SEQ ID NO: 7380104 - DNA, 22 bp, Homo sapiens
cagtgccaaggagaaggacagc

SEQ ID NO: 7380105 - DNA, 22 bp, Homo sapiens
cagtgccagaggtactagtgga

SEQ ID NO: 7380106 - DNA, 22 bp, Homo sapiens
cagtgggatatgggggcagcat

SEQ ID NO: 7380107 - DNA, 22 bp, Homo sapiens
cagtgggatatgggggcagcat

SEQ ID NO: 7380108 - DNA, 22 bp, Homo sapiens
cagtgggaagggcagaggcttt

SEQ ID NO: 7380109 - DNA, 22 bp, Homo sapiens
cagtggggaggccaggatagaa

SEQ ID NO: 7380110 - DNA, 22 bp, Homo sapiens
cagtgggggggccatgctgcag

SEQ ID NO: 7380111 - DNA, 22 bp, Homo sapiens
cagtgggggtgaggccgaggta

SEQ ID NO: 7380112 - DNA, 22 bp, Homo sapiens
tagagctggaaaactgcaggta

SEQ ID NO: 7380113 - DNA, 22 bp, Homo sapiens
tagaggaactgcctttcttctg

SEQ ID NO: 7380114 - DNA, 21 bp, Homo sapiens
tagaatcactaataagatgta

SEQ ID NO: 7380115 - DNA, 21 bp, Homo sapiens
tagaatcactaataagatgta

SEQ ID NO: 7380116 - DNA, 22 bp, Homo sapiens
tagcaagatgatgaattattca

SEQ ID NO: 7380117 - DNA, 22 bp, Homo sapiens
tagcaagatccttccctggcgt

SEQ ID NO: 7380118 - DNA, 22 bp, Homo sapiens
tagcaagtgttggtgaagatgt

SEQ ID NO: 7380119 - DNA, 22 bp, Homo sapiens
tagcaaggtgaagtatgggtga

SEQ ID NO: 7380120 - DNA, 22 bp, Homo sapiens
tagcaaggcttccaatgaacag

SEQ ID NO: 7380121 - DNA, 22 bp, Homo sapiens
tagcaaggcgtggcactcaaat

SEQ ID NO: 7380122 - DNA, 22 bp, Homo sapiens
tagcaaggacgtccaaagaact

SEQ ID NO: 7380123 - DNA, 22 bp, Homo sapiens
tagcaaggacaacatatgagag

SEQ ID NO: 7380124 - DNA, 20 bp, Homo sapiens
cagggcacactgcagcctcg

SEQ ID NO: 7380125 - DNA, 22 bp, Homo sapiens
cagggcaaagagagcacatgct

SEQ ID NO: 7380126 - DNA, 22 bp, Homo sapiens
tagataaattagaaagtttact

SEQ ID NO: 7380127 - DNA, 22 bp, Homo sapiens
tagataagaatggcatcttctc

SEQ ID NO: 7380128 - DNA, 22 bp, Homo sapiens
tagataatttggcatcatattg

SEQ ID NO: 7380129 - DNA, 22 bp, Homo sapiens
tagataatttggcatcatattg

SEQ ID NO: 7380130 - DNA, 22 bp, Homo sapiens
tagaataatctgaggaaatgct

SEQ ID NO: 7380131 - DNA, 22 bp, Homo sapiens
tactatgtgaaaatactatagt

SEQ ID NO: 7380132 - DNA, 22 bp, Homo sapiens
tactatttggaattttaaattg

SEQ ID NO: 7380133 - DNA, 22 bp, Homo sapiens
tactatgttcttcctaaatagt

SEQ ID NO: 7380134 - DNA, 21 bp, Homo sapiens
tactgtagccttgcactgtag

SEQ ID NO: 7380135 - DNA, 21 bp, Homo sapiens
tactgtagccttgcactgtag

SEQ ID NO: 7380136 - DNA, 22 bp, Homo sapiens
tactgtaggtgggtcactagta

SEQ ID NO: 7380137 - DNA, 22 bp, Homo sapiens
tactcatttcaaacagcacaaa

SEQ ID NO: 7380138 - DNA, 22 bp, Homo sapiens
tactcacattctgtttcttgct

SEQ ID NO: 7380139 - DNA, 20 bp, Homo sapiens
tactcacaaatggtttagca

SEQ ID NO: 7380140 - DNA, 22 bp, Homo sapiens
tactcaatctaggtggcttacc

SEQ ID NO: 7380141 - DNA, 22 bp, Homo sapiens
tactcaatgaagtagcctggtt

SEQ ID NO: 7380142 - DNA, 22 bp, Homo sapiens
tactcaatttcttatgggtttc

SEQ ID NO: 7380143 - DNA, 22 bp, Homo sapiens
tactcaaactcactaagacaga

SEQ ID NO: 7380144 - DNA, 22 bp, Homo sapiens
tactatttttgcaacgtataca

SEQ ID NO: 7380145 - DNA, 22 bp, Homo sapiens
cagggctcagggactgcagaaa

SEQ ID NO: 7380146 - DNA, 22 bp, Homo sapiens
cagggccttcgtaagtgtccgg

SEQ ID NO: 7380147 - DNA, 22 bp, Homo sapiens
cagggcctgtcacgacgctcat

SEQ ID NO: 7380148 - DNA, 22 bp, Homo sapiens
taggagagctgaactattgtct

SEQ ID NO: 7380149 - DNA, 22 bp, Homo sapiens
taggacccctgtggtagatggg

SEQ ID NO: 7380150 - DNA, 22 bp, Homo sapiens
taggacatgtgttttatatatg

SEQ ID NO: 7380151 - DNA, 22 bp, Homo sapiens
cagggcagcttcctttgttagg

SEQ ID NO: 7380152 - DNA, 22 bp, Homo sapiens
cagggcagccaggccccgtggg

SEQ ID NO: 7380153 - DNA, 20 bp, Homo sapiens
tagctaccttgatcccctgg

SEQ ID NO: 7380154 - DNA, 22 bp, Homo sapiens
taggacatgctacataaatagg

SEQ ID NO: 7380155 - DNA, 22 bp, Homo sapiens
taggaacaagtttccttgctgt

SEQ ID NO: 7380156 - DNA, 22 bp, Homo sapiens
taggaaatttgaaatatgtggg

SEQ ID NO: 7380157 - DNA, 22 bp, Homo sapiens
cagggcaggaatttgacattgc

SEQ ID NO: 7380158 - DNA, 22 bp, Homo sapiens
taggaaattgccaatatatgac

SEQ ID NO: 7380159 - DNA, 22 bp, Homo sapiens
tagggaaggagaccaagccaca

SEQ ID NO: 7380160 - DNA, 22 bp, Homo sapiens
tagggaagtgtataggggtcat

SEQ ID NO: 7380161 - DNA, 22 bp, Homo sapiens
taggtaggtgcaattaaaagta

SEQ ID NO: 7380162 - DNA, 22 bp, Homo sapiens
taggtagctttggcgtttcttg

SEQ ID NO: 7380163 - DNA, 22 bp, Homo sapiens
taggtagctttggcgtttcttg

SEQ ID NO: 7380164 - DNA, 22 bp, Homo sapiens
tatcattctaattctcctcgta

SEQ ID NO: 7380165 - DNA, 22 bp, Homo sapiens
tatcatgtgactccaatgtgga

SEQ ID NO: 7380166 - DNA, 22 bp, Homo sapiens
cagggtggccaggtagataata

SEQ ID NO: 7380167 - DNA, 22 bp, Homo sapiens
cagggtggccctgtggtctcat

SEQ ID NO: 7380168 - DNA, 22 bp, Homo sapiens
cagggtggcaggcaccatggcc

SEQ ID NO: 7380169 - DNA, 22 bp, Homo sapiens
cagggtggcactcagcgcatct

SEQ ID NO: 7380170 - DNA, 22 bp, Homo sapiens
tatatttaaatccaggttgaaa

SEQ ID NO: 7380171 - DNA, 22 bp, Homo sapiens
tatattgtaggtgctatttgaa

SEQ ID NO: 7380172 - DNA, 19 bp, Homo sapiens
ctgcctgttatggagagaa

SEQ ID NO: 7380173 - DNA, 22 bp, Homo sapiens
ctgccttgaggaggttgtggga

SEQ ID NO: 7380174 - DNA, 22 bp, Homo sapiens
ctgcctgtgggtacaagtggaa

SEQ ID NO: 7380175 - DNA, 22 bp, Homo sapiens
ctgcctttgaaagttctgttga

SEQ ID NO: 7380176 - DNA, 22 bp, Homo sapiens
ctgcctttgcccttgacactgt

SEQ ID NO: 7380177 - DNA, 22 bp, Homo sapiens
ctgccttttcatctgagctgga

SEQ ID NO: 7380178 - DNA, 22 bp, Homo sapiens
ctgcctttgtgatcagttcttt

SEQ ID NO: 7380179 - DNA, 22 bp, Homo sapiens
ctgccttttaaagccagtgtta

SEQ ID NO: 7380180 - DNA, 22 bp, Homo sapiens
ctgcctttggaagtccagagct

SEQ ID NO: 7380181 - DNA, 22 bp, Homo sapiens
ctgcctttggggagttagaggg

SEQ ID NO: 7380182 - DNA, 22 bp, Homo sapiens
ctgctgactcttcctggagtga

SEQ ID NO: 7380183 - DNA, 22 bp, Homo sapiens
ctgctcttgagggactgcggtc

SEQ ID NO: 7380184 - DNA, 19 bp, Homo sapiens
ctgctgggtgctgagggag

SEQ ID NO: 7380185 - DNA, 22 bp, Homo sapiens
ctgctggtgatgtctgggcatg

SEQ ID NO: 7380186 - DNA, 22 bp, Homo sapiens
ctggagataagcagtcccaggc

SEQ ID NO: 7380187 - DNA, 22 bp, Homo sapiens
ctgctgtgagcactccagcctg

SEQ ID NO: 7380188 - DNA, 22 bp, Homo sapiens
ctggaaggagaaggaggctgtg

SEQ ID NO: 7380189 - DNA, 22 bp, Homo sapiens
ctggaagagtgactttgcattt

SEQ ID NO: 7380190 - DNA, 22 bp, Homo sapiens
ctggaagagtcctaaacagata

SEQ ID NO: 7380191 - DNA, 22 bp, Homo sapiens
ctggaagagtaatataaattag

SEQ ID NO: 7380192 - DNA, 22 bp, Homo sapiens
ctggaagaggggaaatgccatg

SEQ ID NO: 7380193 - DNA, 22 bp, Homo sapiens
ctggaagaggacacacgaatca

SEQ ID NO: 7380194 - DNA, 22 bp, Homo sapiens
ctggaaggagaaggaggctgtg

SEQ ID NO: 7380195 - DNA, 22 bp, Homo sapiens
ctggaaggagcccgggcggatc

SEQ ID NO: 7380196 - DNA, 22 bp, Homo sapiens
ctggaaggagcccgggcggatc

SEQ ID NO: 7380197 - DNA, 22 bp, Homo sapiens
ctggaaggtggatggcgaggcc

SEQ ID NO: 7380198 - DNA, 22 bp, Homo sapiens
ctgagcagtttcttagggctca

SEQ ID NO: 7380199 - DNA, 22 bp, Homo sapiens
ctgagcagtctgactcaagcta

SEQ ID NO: 7380200 - DNA, 22 bp, Homo sapiens
ttttggaacacagacattagaa

SEQ ID NO: 7380201 - DNA, 22 bp, Homo sapiens
ttttggaatcatttacagagca

SEQ ID NO: 7380202 - DNA, 22 bp, Homo sapiens
ttttggaaccaacagtgcacct

SEQ ID NO: 7380203 - DNA, 19 bp, Homo sapiens
ttttggaaatgtgaacagc

SEQ ID NO: 7380204 - DNA, 22 bp, Homo sapiens
ctcttccttaagactataaaga

SEQ ID NO: 7380205 - DNA, 22 bp, Homo sapiens
ctgaggctgcccagggccaggt

SEQ ID NO: 7380206 - DNA, 22 bp, Homo sapiens
ctgaggctctgggtgtcactgt

SEQ ID NO: 7380207 - DNA, 22 bp, Homo sapiens
ctgaggccgttggtgggcctta

SEQ ID NO: 7380208 - DNA, 22 bp, Homo sapiens
ctgaggcctggccccaccacag

SEQ ID NO: 7380209 - DNA, 22 bp, Homo sapiens
ctgaggcctggtgaggtggtga

SEQ ID NO: 7380210 - DNA, 22 bp, Homo sapiens
ctgcaggacgaccgcctcatct

SEQ ID NO: 7380211 - DNA, 22 bp, Homo sapiens
ctgcaggactgaaagatgaggt

SEQ ID NO: 7380212 - DNA, 22 bp, Homo sapiens
ctgcaggagcaaagcctctgct

SEQ ID NO: 7380213 - DNA, 22 bp, Homo sapiens
ctgcaggacagggccggaggcc

SEQ ID NO: 7380214 - DNA, 22 bp, Homo sapiens
ctgcaggaattcaaagtgagct

SEQ ID NO: 7380215 - DNA, 22 bp, Homo sapiens
ctgcaggacagggaggagcaag

SEQ ID NO: 7380216 - DNA, 22 bp, Homo sapiens
ctgcaggaaggggacggagtgg

SEQ ID NO: 7380217 - DNA, 22 bp, Homo sapiens
ctgcaggaatctgtgctaggtg

SEQ ID NO: 7380218 - DNA, 22 bp, Homo sapiens
ctgcaggagcaagcctgggaga

SEQ ID NO: 7380219 - DNA, 22 bp, Homo sapiens
ctgcaggagggctggggaagcc

SEQ ID NO: 7380220 - DNA, 22 bp, Homo sapiens
ctgcaggagtgaaagcaggcct

SEQ ID NO: 7380221 - DNA, 22 bp, Homo sapiens
ctgcaggaggatcctgagagtg

SEQ ID NO: 7380222 - DNA, 22 bp, Homo sapiens
ctgcaggattctcccagttgga

SEQ ID NO: 7380223 - DNA, 22 bp, Homo sapiens
ctgcaggatttcatgggctgac

SEQ ID NO: 7380224 - DNA, 22 bp, Homo sapiens
ctgcaggatttcatgggctgac

SEQ ID NO: 7380225 - DNA, 22 bp, Homo sapiens
ctgcaggcatctaactgtgggc

SEQ ID NO: 7380226 - DNA, 21 bp, Homo sapiens
ctgcaggatgctgaagccagg

SEQ ID NO: 7380227 - DNA, 22 bp, Homo sapiens
ctgccattggattttcacattt

SEQ ID NO: 7380228 - DNA, 22 bp, Homo sapiens
ctgcccagtttgggagcctttc

SEQ ID NO: 7380229 - DNA, 22 bp, Homo sapiens
ctgcccaggctgaaggaacatc

SEQ ID NO: 7380230 - DNA, 22 bp, Homo sapiens
tttgagaaactgattattatgg

SEQ ID NO: 7380231 - DNA, 22 bp, Homo sapiens
tttgagaaaggggatttaattc

SEQ ID NO: 7380232 - DNA, 22 bp, Homo sapiens
tttgcaaacacttaagaagaga

SEQ ID NO: 7380233 - DNA, 22 bp, Homo sapiens
tttgcaaacacttaagaagaga

SEQ ID NO: 7380234 - DNA, 22 bp, Homo sapiens
tttgcaaacattcagggctcca

SEQ ID NO: 7380235 - DNA, 22 bp, Homo sapiens
tttgcaaacggccctgagtccc

SEQ ID NO: 7380236 - DNA, 22 bp, Homo sapiens
tttgcaaaatgaggtgaagagt

SEQ ID NO: 7380237 - DNA, 22 bp, Homo sapiens
tttgagaagatgtaatgttaag

SEQ ID NO: 7380238 - DNA, 22 bp, Homo sapiens
tttgagaagagtttgaggtatt

SEQ ID NO: 7380239 - DNA, 22 bp, Homo sapiens
ctctggcctggggcctgctccc

SEQ ID NO: 7380240 - DNA, 22 bp, Homo sapiens
ctctggcctgcttcctcaggta

SEQ ID NO: 7380241 - DNA, 22 bp, Homo sapiens
ctctggccgagcatgggggtta

SEQ ID NO: 7380242 - DNA, 22 bp, Homo sapiens
tttgcaaagaaattattgctgt

SEQ ID NO: 7380243 - DNA, 22 bp, Homo sapiens
ctctgcaccttgtaggaggcaa

SEQ ID NO: 7380244 - DNA, 22 bp, Homo sapiens
ctctgcacctacacaacaggaa

SEQ ID NO: 7380245 - DNA, 22 bp, Homo sapiens
ctctgcactgtccggctttctt

SEQ ID NO: 7380246 - DNA, 22 bp, Homo sapiens
tttgaccagaggtccctggaaa

SEQ ID NO: 7380247 - DNA, 22 bp, Homo sapiens
tttgaccttgttggtaggtatt

SEQ ID NO: 7380248 - DNA, 20 bp, Homo sapiens
tttgacctttatgaagataa

SEQ ID NO: 7380249 - DNA, 22 bp, Homo sapiens
tttgacctccagaactataaga

SEQ ID NO: 7380250 - DNA, 19 bp, Homo sapiens
tttgaaagagttttattgg

SEQ ID NO: 7380251 - DNA, 22 bp, Homo sapiens
tttgaaagagctgatacatgaa

SEQ ID NO: 7380252 - DNA, 22 bp, Homo sapiens
ctctgaggttcctttgccctcg

SEQ ID NO: 7380253 - DNA, 23 bp, Homo sapiens
ctctgcaccaggtggttttcagc

SEQ ID NO: 7380254 - DNA, 22 bp, Homo sapiens
ctctgcacccccggctcctcgt

SEQ ID NO: 7380255 - DNA, 22 bp, Homo sapiens
ctctgcacacaagtaatttcat

SEQ ID NO: 7380256 - DNA, 22 bp, Homo sapiens
ctctgaaggtttctgttactgt

SEQ ID NO: 7380257 - DNA, 22 bp, Homo sapiens
ctctgaagggagggccaagccc

SEQ ID NO: 7380258 - DNA, 22 bp, Homo sapiens
tttgaaaaaggcctttggtatg

SEQ ID NO: 7380259 - DNA, 22 bp, Homo sapiens
tttgaaaaaggcctttggtatg

SEQ ID NO: 7380260 - DNA, 22 bp, Homo sapiens
tttgaaacctagttatatgact

SEQ ID NO: 7380261 - DNA, 22 bp, Homo sapiens
ttttgcctgtgaatactatctt

SEQ ID NO: 7380262 - DNA, 22 bp, Homo sapiens
ttttgcctgcactgtatatata

SEQ ID NO: 7380263 - DNA, 22 bp, Homo sapiens
tttgttcattttgagctcatca

SEQ ID NO: 7380264 - DNA, 22 bp, Homo sapiens
ctctgtgcttatgctccatggg

SEQ ID NO: 7380265 - DNA, 22 bp, Homo sapiens
ctctggctatctgtttctatgt

SEQ ID NO: 7380266 - DNA, 21 bp, Homo sapiens
tttgttcaggcaagttacagt

SEQ ID NO: 7380267 - DNA, 22 bp, Homo sapiens
tttcctttctcaagagccggca

SEQ ID NO: 7380268 - DNA, 22 bp, Homo sapiens
tttcctttctagaagcctaaat

SEQ ID NO: 7380269 - DNA, 22 bp, Homo sapiens
tttccacagctgtataaaataa

SEQ ID NO: 7380270 - DNA, 22 bp, Homo sapiens
tttcctttctagaagcctaaat

SEQ ID NO: 7380271 - DNA, 22 bp, Homo sapiens
tttccactcctattgcatctca

SEQ ID NO: 7380272 - DNA, 22 bp, Homo sapiens
tttccaatttggtagtcatcgg

SEQ ID NO: 7380273 - DNA, 22 bp, Homo sapiens
tttccaatttttaagtggatga

SEQ ID NO: 7380274 - DNA, 22 bp, Homo sapiens
tttccaataaagtgtcattgtt

SEQ ID NO: 7380275 - DNA, 22 bp, Homo sapiens
tttccaataaagtgtcattgtt

SEQ ID NO: 7380276 - DNA, 22 bp, Homo sapiens
tttccaagagcttatttctgaa

SEQ ID NO: 7380277 - DNA, 18 bp, Homo sapiens
tttcattataaagcaggc

SEQ ID NO: 7380278 - DNA, 22 bp, Homo sapiens
tttcattagtatgacagcacgc

SEQ ID NO: 7380279 - DNA, 22 bp, Homo sapiens
tttcatgttacatttaaaatgt

SEQ ID NO: 7380280 - DNA, 22 bp, Homo sapiens
tttcatgttggggagttgagtg

SEQ ID NO: 7380281 - DNA, 22 bp, Homo sapiens
tttcatgtttatggaaaatgag

SEQ ID NO: 7380282 - DNA, 18 bp, Homo sapiens
ctctctttccactctttg

SEQ ID NO: 7380283 - DNA, 22 bp, Homo sapiens
ctctctttctgaatgaggacta

SEQ ID NO: 7380284 - DNA, 22 bp, Homo sapiens
ctctgaaagacaagctctcatt

SEQ ID NO: 7380285 - DNA, 22 bp, Homo sapiens
tttctcaagttcagatatttga

SEQ ID NO: 7380286 - DNA, 18 bp, Homo sapiens
ctctctggtctggatccc

SEQ ID NO: 7380287 - DNA, 22 bp, Homo sapiens
tttctcaaggtgtcatgtattt

SEQ ID NO: 7380288 - DNA, 22 bp, Homo sapiens
tttctcaaggtgtcatgtattt

SEQ ID NO: 7380289 - DNA, 22 bp, Homo sapiens
tttctcaagctgtttgccaatt

SEQ ID NO: 7380290 - DNA, 22 bp, Homo sapiens
tttctcaacctcaacactattt

SEQ ID NO: 7380291 - DNA, 22 bp, Homo sapiens
tttctcaactgtattatgcaga

SEQ ID NO: 7380292 - DNA, 22 bp, Homo sapiens
tttctcaactgtattatgcaga

SEQ ID NO: 7380293 - DNA, 22 bp, Homo sapiens
tttctcaaaattcagtggtatc

SEQ ID NO: 7380294 - DNA, 22 bp, Homo sapiens
tttctcaacagagtatgccctt

SEQ ID NO: 7380295 - DNA, 22 bp, Homo sapiens
tttctcaaattgcatgagtagc

SEQ ID NO: 7380296 - DNA, 22 bp, Homo sapiens
tttctcaaatactgttccagga

SEQ ID NO: 7380297 - DNA, 22 bp, Homo sapiens
tttctacatgtcagtaactgat

SEQ ID NO: 7380298 - DNA, 23 bp, Homo sapiens
tttatattcctaatgtcttgagc

SEQ ID NO: 7380299 - DNA, 22 bp, Homo sapiens
tttatgattattttaaagcagc

SEQ ID NO: 7380300 - DNA, 22 bp, Homo sapiens
tttatgattattttaaagcagc

SEQ ID NO: 7380301 - DNA, 22 bp, Homo sapiens
tttatgattaatccaattctgt

SEQ ID NO: 7380302 - DNA, 22 bp, Homo sapiens
ctccaggcccctggccttctgc

SEQ ID NO: 7380303 - DNA, 22 bp, Homo sapiens
tttatgcagatttgtacagtga

SEQ ID NO: 7380304 - DNA, 22 bp, Homo sapiens
tttatgcatctctaggaagggc

SEQ ID NO: 7380305 - DNA, 22 bp, Homo sapiens
tttatgggcatccagggggtat

SEQ ID NO: 7380306 - DNA, 22 bp, Homo sapiens
tttattcacttcagtgccaaag

SEQ ID NO: 7380307 - DNA, 22 bp, Homo sapiens
tttattcagcagcagcagtggt

SEQ ID NO: 7380308 - DNA, 22 bp, Homo sapiens
tttattcactggggtctgcccg

SEQ ID NO: 7380309 - DNA, 22 bp, Homo sapiens
tttattcacttcagtgccaaag

SEQ ID NO: 7380310 - DNA, 22 bp, Homo sapiens
tttatgtaagtggaatgatgcc

SEQ ID NO: 7380311 - DNA, 19 bp, Homo sapiens
tttattcacctttaccttg

SEQ ID NO: 7380312 - DNA, 22 bp, Homo sapiens
tttattcactcattcagccagt

SEQ ID NO: 7380313 - DNA, 23 bp, Homo sapiens
tttcagaagtggtcctaggaagc

SEQ ID NO: 7380314 - DNA, 22 bp, Homo sapiens
ctccttcccctactcagcatcc

SEQ ID NO: 7380315 - DNA, 22 bp, Homo sapiens
ctccttcccatgagtgtgggca

SEQ ID NO: 7380316 - DNA, 22 bp, Homo sapiens
ctccttcctgcagatctgagat

SEQ ID NO: 7380317 - DNA, 22 bp, Homo sapiens
tttcatgttacagtgtaaaagt

SEQ ID NO: 7380318 - DNA, 22 bp, Homo sapiens
tttcagaacataatgtgagcat

SEQ ID NO: 7380319 - DNA, 22 bp, Homo sapiens
tttcacatatcaactctatcct

SEQ ID NO: 7380320 - DNA, 22 bp, Homo sapiens
tttcagaaggggagaaaggtca

SEQ ID NO: 7380321 - DNA, 22 bp, Homo sapiens
tttcagaaccgctaaaataaat

SEQ ID NO: 7380322 - DNA, 22 bp, Homo sapiens
tttcagaaatggcactgaaatc

SEQ ID NO: 7380323 - DNA, 22 bp, Homo sapiens
tttcacatataggggaagctac

SEQ ID NO: 7380324 - DNA, 22 bp, Homo sapiens
tttattcattgtttcgtcgcag

SEQ ID NO: 7380325 - DNA, 22 bp, Homo sapiens
tttattcatcatctgttcatat

SEQ ID NO: 7380326 - DNA, 22 bp, Homo sapiens
tttattcatcatctgttcatat

SEQ ID NO: 7380327 - DNA, 22 bp, Homo sapiens
tttattcatcatctgttcatat

SEQ ID NO: 7380328 - DNA, 20 bp, Homo sapiens
tttattcagcctaccctctt

SEQ ID NO: 7380329 - DNA, 22 bp, Homo sapiens
ctcaggaaaatattgaagaagt

SEQ ID NO: 7380330 - DNA, 22 bp, Homo sapiens
ctcaggaaaggccatgcaaggg

SEQ ID NO: 7380331 - DNA, 23 bp, Homo sapiens
ctcagaggcctgtccagggtggt

SEQ ID NO: 7380332 - DNA, 19 bp, Homo sapiens
ctcagctgtagctcatgtg

SEQ ID NO: 7380333 - DNA, 22 bp, Homo sapiens
ttgcagttgctttctatattga

SEQ ID NO: 7380334 - DNA, 22 bp, Homo sapiens
ttgcagtttgcttttaatggga

SEQ ID NO: 7380335 - DNA, 22 bp, Homo sapiens
ttgccctgcctccctgaggtga

SEQ ID NO: 7380336 - DNA, 22 bp, Homo sapiens
ttgccctgcagcggtgagtggt

SEQ ID NO: 7380337 - DNA, 22 bp, Homo sapiens
ttgccctagggtcttatcctcc

SEQ ID NO: 7380338 - DNA, 18 bp, Homo sapiens
ctcagggcatcagtctgg

SEQ ID NO: 7380339 - DNA, 22 bp, Homo sapiens
ctcagggctggaaagccaggaa

SEQ ID NO: 7380340 - DNA, 22 bp, Homo sapiens
ctcagggcggcgggcagcccag

SEQ ID NO: 7380341 - DNA, 22 bp, Homo sapiens
ctcagggcttgagtgtccagga

SEQ ID NO: 7380342 - DNA, 22 bp, Homo sapiens
ctcaggtcacaggatggccagg

SEQ ID NO: 7380343 - DNA, 17 bp, Homo sapiens
ttggctctattgcctct

SEQ ID NO: 7380344 - DNA, 22 bp, Homo sapiens
ttggaaaagtgaaactagatgc

SEQ ID NO: 7380345 - DNA, 22 bp, Homo sapiens
ttggaagatctaacagaggcat

SEQ ID NO: 7380346 - DNA, 22 bp, Homo sapiens
ttggaagattacttagttttct

SEQ ID NO: 7380347 - DNA, 22 bp, Homo sapiens
ttggaagcgagcacatggagga

SEQ ID NO: 7380348 - DNA, 22 bp, Homo sapiens
ttggaaggagtctttggggatg

SEQ ID NO: 7380349 - DNA, 22 bp, Homo sapiens
ttggaaggagcctaaaagagac

SEQ ID NO: 7380350 - DNA, 22 bp, Homo sapiens
ttggagggacagatggctaggc

SEQ ID NO: 7380351 - DNA, 22 bp, Homo sapiens
ttggaaggttctggtcatggtt

SEQ ID NO: 7380352 - DNA, 22 bp, Homo sapiens
ttggaaggtgagtccctgggtt

SEQ ID NO: 7380353 - DNA, 22 bp, Homo sapiens
ttggaagggatattggcatatg

SEQ ID NO: 7380354 - DNA, 22 bp, Homo sapiens
ctcagagaaaaggagcaagggt

SEQ ID NO: 7380355 - DNA, 21 bp, Homo sapiens
ttctttctgaatctgaagtat

SEQ ID NO: 7380356 - DNA, 22 bp, Homo sapiens
ttctttctgaatacagttgagt

SEQ ID NO: 7380357 - DNA, 22 bp, Homo sapiens
ttctggattttccaactcactg

SEQ ID NO: 7380358 - DNA, 22 bp, Homo sapiens
ttctggattatgtgtaagtgaa

SEQ ID NO: 7380359 - DNA, 22 bp, Homo sapiens
ttctggatgttgtagtctgaga

SEQ ID NO: 7380360 - DNA, 22 bp, Homo sapiens
ctcacccctgtaattccagcac

SEQ ID NO: 7380361 - DNA, 22 bp, Homo sapiens
ctcacctccaggagctgctggc

SEQ ID NO: 7380362 - DNA, 22 bp, Homo sapiens
ctcacaggttctgcagctcaca

SEQ ID NO: 7380363 - DNA, 22 bp, Homo sapiens
ctagaggctcagcagatgcctg

SEQ ID NO: 7380364 - DNA, 22 bp, Homo sapiens
ttctatgcctgagaagaagccg

SEQ ID NO: 7380365 - DNA, 22 bp, Homo sapiens
ctagagaattgtcttgagagtt

SEQ ID NO: 7380366 - DNA, 22 bp, Homo sapiens
ctagagaaaatgttaatacagt

SEQ ID NO: 7380367 - DNA, 22 bp, Homo sapiens
ctaaaaatccacactaggtgaa

SEQ ID NO: 7380368 - DNA, 22 bp, Homo sapiens
cgttcctctactccagctaccc

SEQ ID NO: 7380369 - DNA, 22 bp, Homo sapiens
ttctatgtcagtgtgctctgtg

SEQ ID NO: 7380370 - DNA, 22 bp, Homo sapiens
ttctatgtggatatagaactgc

SEQ ID NO: 7380371 - DNA, 22 bp, Homo sapiens
ttctattgggcagcattgcttc

SEQ ID NO: 7380372 - DNA, 22 bp, Homo sapiens
ttctgcagtgaatgactcaata

SEQ ID NO: 7380373 - DNA, 22 bp, Homo sapiens
ttctgcagtgaatgactcaata

SEQ ID NO: 7380374 - DNA, 22 bp, Homo sapiens
ttctgcagtgttaacaatgtca

SEQ ID NO: 7380375 - DNA, 22 bp, Homo sapiens
ttctgcagctgtctcgcaggca

SEQ ID NO: 7380376 - DNA, 22 bp, Homo sapiens
ttctgaagctcccttttgtagt

SEQ ID NO: 7380377 - DNA, 22 bp, Homo sapiens
ttctgcatgatattaaatgtaa

SEQ ID NO: 7380378 - DNA, 22 bp, Homo sapiens
ttctggatgctgttaagatgta

SEQ ID NO: 7380379 - DNA, 22 bp, Homo sapiens
ttatttattgtgtacctactgt

SEQ ID NO: 7380380 - DNA, 22 bp, Homo sapiens
ttatttcatataatgttatcaa

SEQ ID NO: 7380381 - DNA, 22 bp, Homo sapiens
ttatttattgtgtacctactgt

SEQ ID NO: 7380382 - DNA, 20 bp, Homo sapiens
ttatttcagttgctagattg

SEQ ID NO: 7380383 - DNA, 22 bp, Homo sapiens
ttatttcatgtaaaatttatgt

SEQ ID NO: 7380384 - DNA, 22 bp, Homo sapiens
ttatttcatgtaaaatttatgt

SEQ ID NO: 7380385 - DNA, 21 bp, Homo sapiens
cgctgccttgggagtggacct

SEQ ID NO: 7380386 - DNA, 22 bp, Homo sapiens
cgctgccttcatcccacgccta

SEQ ID NO: 7380387 - DNA, 22 bp, Homo sapiens
cgctgcctccaggtgcagcagg

SEQ ID NO: 7380388 - DNA, 22 bp, Homo sapiens
cgctgcctctctggggccctgg

SEQ ID NO: 7380389 - DNA, 22 bp, Homo sapiens
cgagcagaagcctggtggtctg

SEQ ID NO: 7380390 - DNA, 22 bp, Homo sapiens
ttattcagctctctagaggcac

SEQ ID NO: 7380391 - DNA, 22 bp, Homo sapiens
ttattcagcagggacttccttt

SEQ ID NO: 7380392 - DNA, 22 bp, Homo sapiens
ttattcagcatttagaggaagg

SEQ ID NO: 7380393 - DNA, 16 bp, Homo sapiens
ttattgaggccaagga

SEQ ID NO: 7380394 - DNA, 22 bp, Homo sapiens
ttattcaggaaggtgttactta

SEQ ID NO: 7380395 - DNA, 22 bp, Homo sapiens
ttattgagtatctgcttggtgt

SEQ ID NO: 7380396 - DNA, 22 bp, Homo sapiens
cgaacacacttgggagttctga

SEQ ID NO: 7380397 - DNA, 21 bp, Homo sapiens
cgaagtttgggcagaggggtc

SEQ ID NO: 7380398 - DNA, 22 bp, Homo sapiens
cgaagtttggggagaggagtct

SEQ ID NO: 7380399 - DNA, 22 bp, Homo sapiens
cgagaggctggacagggctggg

SEQ ID NO: 7380400 - DNA, 22 bp, Homo sapiens
cgaaaatagatctgtttcccag

SEQ ID NO: 7380401 - DNA, 21 bp, Homo sapiens
cctttttgcttatggacagac

SEQ ID NO: 7380402 - DNA, 22 bp, Homo sapiens
cctttttctgagttgtagcttc

SEQ ID NO: 7380403 - DNA, 22 bp, Homo sapiens
cctttttcagcttctagaggct

SEQ ID NO: 7380404 - DNA, 22 bp, Homo sapiens
ccttttgctctcccatccagaa

SEQ ID NO: 7380405 - DNA, 22 bp, Homo sapiens
ttcaaattaccacatttgctta

SEQ ID NO: 7380406 - DNA, 22 bp, Homo sapiens
cggaggttgaggctgcagtgag

SEQ ID NO: 7380407 - DNA, 22 bp, Homo sapiens
ttcaaattaccacatttgctta

SEQ ID NO: 7380408 - DNA, 22 bp, Homo sapiens
ttcaaatggttagactgttagc

SEQ ID NO: 7380409 - DNA, 22 bp, Homo sapiens
ttcaaattaccacatttgctta

SEQ ID NO: 7380410 - DNA, 22 bp, Homo sapiens
ttcaaattaccacatttgctta

SEQ ID NO: 7380411 - DNA, 22 bp, Homo sapiens
ttcaaattaccacatttgctta

SEQ ID NO: 7380412 - DNA, 22 bp, Homo sapiens
ttcaaagtgcatgttcctcaga

SEQ ID NO: 7380413 - DNA, 22 bp, Homo sapiens
ttcaaagtgctgttcaaagtag

SEQ ID NO: 7380414 - DNA, 22 bp, Homo sapiens
ttcaaatgatggcagtcctggc

SEQ ID NO: 7380415 - DNA, 22 bp, Homo sapiens
cggcagctgattgcagagcacc

SEQ ID NO: 7380416 - DNA, 22 bp, Homo sapiens
cggcagctccgcgccgtaggac

SEQ ID NO: 7380417 - DNA, 22 bp, Homo sapiens
cggcagctcgagggccacccgt

SEQ ID NO: 7380418 - DNA, 22 bp, Homo sapiens
cggcaaagaacgctttttcaga

SEQ ID NO: 7380419 - DNA, 22 bp, Homo sapiens
cggagttagggaattgcattct

SEQ ID NO: 7380420 - DNA, 22 bp, Homo sapiens
cggggccctggggctgaaggtc

SEQ ID NO: 7380421 - DNA, 22 bp, Homo sapiens
tgtcagcaacccatcactccca

SEQ ID NO: 7380422 - DNA, 22 bp, Homo sapiens
ttaaattattgagggattgtca

SEQ ID NO: 7380423 - DNA, 22 bp, Homo sapiens
ttaaattattgagggattgtca

SEQ ID NO: 7380424 - DNA, 22 bp, Homo sapiens
ttaaattagtcaagcttctctg

SEQ ID NO: 7380425 - DNA, 22 bp, Homo sapiens
ttaaattagtcaagcttctctg

SEQ ID NO: 7380426 - DNA, 22 bp, Homo sapiens
tgtcagcagaagtggtgcactc

SEQ ID NO: 7380427 - DNA, 22 bp, Homo sapiens
tgtcagcatcatttgttgaagg

SEQ ID NO: 7380428 - DNA, 22 bp, Homo sapiens
tgtcagcattgcgtcactgagc

SEQ ID NO: 7380429 - DNA, 22 bp, Homo sapiens
tgtcagcattgatgaaatgtgg

SEQ ID NO: 7380430 - DNA, 22 bp, Homo sapiens
ttaaattttagaaacagactct

SEQ ID NO: 7380431 - DNA, 22 bp, Homo sapiens
ttaagatttgtagagaaaaagc

SEQ ID NO: 7380432 - DNA, 22 bp, Homo sapiens
ttaaattgtcatttgagcaatg

SEQ ID NO: 7380433 - DNA, 22 bp, Homo sapiens
ttaaattccagcctcataatag

SEQ ID NO: 7380434 - DNA, 22 bp, Homo sapiens
ttaaatttctacgtgatccagg

SEQ ID NO: 7380435 - DNA, 22 bp, Homo sapiens
ttaaatttctacgtgatccagg

SEQ ID NO: 7380436 - DNA, 22 bp, Homo sapiens
ttaaatttctacgtgatccagg

SEQ ID NO: 7380437 - DNA, 22 bp, Homo sapiens
ttaaattttagaaacagactct

SEQ ID NO: 7380438 - DNA, 22 bp, Homo sapiens
ttaaattcattccaacttttga

SEQ ID NO: 7380439 - DNA, 22 bp, Homo sapiens
ttaaattatttctagtgaggtg

SEQ ID NO: 7380440 - DNA, 22 bp, Homo sapiens
ttaaattatttctagtgaggtg

SEQ ID NO: 7380441 - DNA, 22 bp, Homo sapiens
ttaaattattgagggattgtca

SEQ ID NO: 7380442 - DNA, 22 bp, Homo sapiens
ttaaattatttctagtgaggtg

SEQ ID NO: 7380443 - DNA, 22 bp, Homo sapiens
ttacagtttatccaggaagagc

SEQ ID NO: 7380444 - DNA, 22 bp, Homo sapiens
ttacagtttaccaagaatattg

SEQ ID NO: 7380445 - DNA, 22 bp, Homo sapiens
ttacagtttacataagaattgt

SEQ ID NO: 7380446 - DNA, 21 bp, Homo sapiens
ttacagttgatggagtattcc

SEQ ID NO: 7380447 - DNA, 22 bp, Homo sapiens
ttacaaagcaggtcagctgaaa

SEQ ID NO: 7380448 - DNA, 22 bp, Homo sapiens
ttaagcatggaagtgaaataat

SEQ ID NO: 7380449 - DNA, 22 bp, Homo sapiens
ccttaaattctccatttgaaag

SEQ ID NO: 7380450 - DNA, 22 bp, Homo sapiens
ccttaaattctccatttgaaag

SEQ ID NO: 7380451 - DNA, 22 bp, Homo sapiens
ccttaagtacctgactagcatg

SEQ ID NO: 7380452 - DNA, 23 bp, Homo sapiens
ccttaaatatctaccctgtggca

SEQ ID NO: 7380453 - DNA, 22 bp, Homo sapiens
ccttaaaagaactatctcttct

SEQ ID NO: 7380454 - DNA, 22 bp, Homo sapiens
ccttagaaggctgaataattct

SEQ ID NO: 7380455 - DNA, 22 bp, Homo sapiens
ttacaaagagtgccagagtgtg

SEQ ID NO: 7380456 - DNA, 22 bp, Homo sapiens
ttacaaagagtgccagagtgtg

SEQ ID NO: 7380457 - DNA, 22 bp, Homo sapiens
ccttcaaattctcttagctgaa

SEQ ID NO: 7380458 - DNA, 22 bp, Homo sapiens
ttacataacggtatgaaaaatg

SEQ ID NO: 7380459 - DNA, 22 bp, Homo sapiens
ccttcaaattctcttagctgaa

SEQ ID NO: 7380460 - DNA, 22 bp, Homo sapiens
ccttcaaaacactagtttttga

SEQ ID NO: 7380461 - DNA, 22 bp, Homo sapiens
ccttcaaactttcattaaccag

SEQ ID NO: 7380462 - DNA, 22 bp, Homo sapiens
ccttcaaaacactagtttttga

SEQ ID NO: 7380463 - DNA, 22 bp, Homo sapiens
ttagcaaagaagatgtgagttt

SEQ ID NO: 7380464 - DNA, 22 bp, Homo sapiens
ttagcaaatatcttgaaacagg

SEQ ID NO: 7380465 - DNA, 22 bp, Homo sapiens
ttagcaaatatcttgaaacagg

SEQ ID NO: 7380466 - DNA, 22 bp, Homo sapiens
ttagcaaatatcttgaaacagg

SEQ ID NO: 7380467 - DNA, 22 bp, Homo sapiens
ttagcaaactctgttagattct

SEQ ID NO: 7380468 - DNA, 22 bp, Homo sapiens
ttagcaagaaagattgcagcac

SEQ ID NO: 7380469 - DNA, 22 bp, Homo sapiens
ttagcaaatatcttgaaacagg

SEQ ID NO: 7380470 - DNA, 22 bp, Homo sapiens
ttagcaagataacagtaatttt

SEQ ID NO: 7380471 - DNA, 22 bp, Homo sapiens
ttagcaccagctatggatgtgc

SEQ ID NO: 7380472 - DNA, 22 bp, Homo sapiens
ccttgaaagtatatgctcaatt

SEQ ID NO: 7380473 - DNA, 22 bp, Homo sapiens
ccttgaaaccctgacactctgt

SEQ ID NO: 7380474 - DNA, 22 bp, Homo sapiens
ccttgaaagccaggcagaggaa

SEQ ID NO: 7380475 - DNA, 22 bp, Homo sapiens
ccttgaaaccacatcttagaaa

SEQ ID NO: 7380476 - DNA, 22 bp, Homo sapiens
ttataaagatccttccagagtt

SEQ ID NO: 7380477 - DNA, 22 bp, Homo sapiens
ccttgcagctgattatttttca

SEQ ID NO: 7380478 - DNA, 22 bp, Homo sapiens
ccttgccccatctgggaatccc

SEQ ID NO: 7380479 - DNA, 22 bp, Homo sapiens
ccttgcagacatcagtagtggc

SEQ ID NO: 7380480 - DNA, 22 bp, Homo sapiens
ccttgcaggggaacaggcagtg

SEQ ID NO: 7380481 - DNA, 22 bp, Homo sapiens
ccttgcagggaaactggaccca

SEQ ID NO: 7380482 - DNA, 22 bp, Homo sapiens
ccttgactgtaatggagtaggg

SEQ ID NO: 7380483 - DNA, 22 bp, Homo sapiens
ccttgaaatgttctcactgggg

SEQ ID NO: 7380484 - DNA, 22 bp, Homo sapiens
ccttgagccagggagctggcag

SEQ ID NO: 7380485 - DNA, 22 bp, Homo sapiens
ccttgattcctaagagggggca

SEQ ID NO: 7380486 - DNA, 22 bp, Homo sapiens
ttatatttctggtagccttcag

SEQ ID NO: 7380487 - DNA, 22 bp, Homo sapiens
ttatattgtgtaataagtgaag

SEQ ID NO: 7380488 - DNA, 22 bp, Homo sapiens
ttatatttctggtagccttcag

SEQ ID NO: 7380489 - DNA, 22 bp, Homo sapiens
ttatcataagtaattgaaataa

SEQ ID NO: 7380490 - DNA, 22 bp, Homo sapiens
ttatcatgacttcaagcatcca

SEQ ID NO: 7380491 - DNA, 22 bp, Homo sapiens
ttataaaggtttgtgcatattt

SEQ ID NO: 7380492 - DNA, 23 bp, Homo sapiens
ttataaatattttcaggtgtgtt

SEQ ID NO: 7380493 - DNA, 23 bp, Homo sapiens
ttataaatattttcaggtgtgtt

SEQ ID NO: 7380494 - DNA, 22 bp, Homo sapiens
gaggagagaagctaacggtgct

SEQ ID NO: 7380495 - DNA, 22 bp, Homo sapiens
gaggagagagggactgtctgca

SEQ ID NO: 7380496 - DNA, 22 bp, Homo sapiens
gaggagtgccagccgtggagtc

SEQ ID NO: 7380497 - DNA, 18 bp, Homo sapiens
gaggatggaaggagatgc

SEQ ID NO: 7380498 - DNA, 22 bp, Homo sapiens
gaggatggaggcagttagggcc

SEQ ID NO: 7380499 - DNA, 22 bp, Homo sapiens
gaggatggaggcagttagggcc

SEQ ID NO: 7380500 - DNA, 18 bp, Homo sapiens
gaggatggaaggagatgc

SEQ ID NO: 7380501 - DNA, 22 bp, Homo sapiens
gaggagacatatttttgaagca

SEQ ID NO: 7380502 - DNA, 22 bp, Homo sapiens
gaggagagaacattcctccata

SEQ ID NO: 7380503 - DNA, 17 bp, Homo sapiens
gaggacagggaagtagg

SEQ ID NO: 7380504 - DNA, 22 bp, Homo sapiens
gaggacagtgtgatctgccagc

SEQ ID NO: 7380505 - DNA, 22 bp, Homo sapiens
gaggccacttcctactggagga

SEQ ID NO: 7380506 - DNA, 22 bp, Homo sapiens
gaggccagaagtgcctcgggct

SEQ ID NO: 7380507 - DNA, 22 bp, Homo sapiens
gaggccagactgccttttatga

SEQ ID NO: 7380508 - DNA, 22 bp, Homo sapiens
gaggccagatactctcttctgc

SEQ ID NO: 7380509 - DNA, 22 bp, Homo sapiens
gaggcatgtctggcctgtccca

SEQ ID NO: 7380510 - DNA, 22 bp, Homo sapiens
gaggccacggaagggagctgtg

SEQ ID NO: 7380511 - DNA, 22 bp, Homo sapiens
gaggccactgtccctgccttcc

SEQ ID NO: 7380512 - DNA, 22 bp, Homo sapiens
gaggccacggttttccttgggg

SEQ ID NO: 7380513 - DNA, 22 bp, Homo sapiens
gaggccacgtgcttatgtttct

SEQ ID NO: 7380514 - DNA, 22 bp, Homo sapiens
gaggatggtatgaggcaagcaa

SEQ ID NO: 7380515 - DNA, 22 bp, Homo sapiens
gaggatggtgagcaggacccag

SEQ ID NO: 7380516 - DNA, 22 bp, Homo sapiens
gaggcaacaatgatggtgtgta

SEQ ID NO: 7380517 - DNA, 22 bp, Homo sapiens
gaggcaaagcatgtggctcagg

SEQ ID NO: 7380518 - DNA, 22 bp, Homo sapiens
gaggcaacttcctgtcctctcc

SEQ ID NO: 7380519 - DNA, 22 bp, Homo sapiens
gaggcaagaaaggactttctag

SEQ ID NO: 7380520 - DNA, 22 bp, Homo sapiens
gagctcagggcattgagcaaga

SEQ ID NO: 7380521 - DNA, 22 bp, Homo sapiens
gagctcagtgtagtcatggctt

SEQ ID NO: 7380522 - DNA, 22 bp, Homo sapiens
gagctcattgtggatggatggg

SEQ ID NO: 7380523 - DNA, 22 bp, Homo sapiens
gagctcagcccaaagagcagtg

SEQ ID NO: 7380524 - DNA, 22 bp, Homo sapiens
gagctcagattctggtgtcaga

SEQ ID NO: 7380525 - DNA, 18 bp, Homo sapiens
gagctcagcgtgtttcta

SEQ ID NO: 7380526 - DNA, 22 bp, Homo sapiens
gagctcagaggattctggggag

SEQ ID NO: 7380527 - DNA, 22 bp, Homo sapiens
gagctcagaggcgtctttgtcc

SEQ ID NO: 7380528 - DNA, 22 bp, Homo sapiens
gagctcagagcctatagttggt

SEQ ID NO: 7380529 - DNA, 22 bp, Homo sapiens
gagcaggcctggggtgaggcct

SEQ ID NO: 7380530 - DNA, 22 bp, Homo sapiens
gagcaggatggcacttctgtga

SEQ ID NO: 7380531 - DNA, 22 bp, Homo sapiens
gagcaggatgggagctggggcc

SEQ ID NO: 7380532 - DNA, 22 bp, Homo sapiens
gagctgtgccaatctgtctggg

SEQ ID NO: 7380533 - DNA, 17 bp, Homo sapiens
gaggacagggaagtagg

SEQ ID NO: 7380534 - DNA, 22 bp, Homo sapiens
gagctggttctgtccagggaat

SEQ ID NO: 7380535 - DNA, 22 bp, Homo sapiens
gagctgtgattggtgtctcact

SEQ ID NO: 7380536 - DNA, 22 bp, Homo sapiens
gagctgtgacacgcagcccagg

SEQ ID NO: 7380537 - DNA, 22 bp, Homo sapiens
gagctgtgaaaagtgcctgggg

SEQ ID NO: 7380538 - DNA, 22 bp, Homo sapiens
gaggtgggagggcagtccctaa

SEQ ID NO: 7380539 - DNA, 22 bp, Homo sapiens
gagtaaggctgctgatggagtg

SEQ ID NO: 7380540 - DNA, 22 bp, Homo sapiens
gagtaaggctgctgatggagtg

SEQ ID NO: 7380541 - DNA, 22 bp, Homo sapiens
gagtacagctcttttgttttca

SEQ ID NO: 7380542 - DNA, 22 bp, Homo sapiens
gagtaattgtgtctggcacact

SEQ ID NO: 7380543 - DNA, 22 bp, Homo sapiens
gaggtgagaagggggtcagatg

SEQ ID NO: 7380544 - DNA, 22 bp, Homo sapiens
gaggtggctgcttgctgggaaa

SEQ ID NO: 7380545 - DNA, 18 bp, Homo sapiens
gaggtcctgctctagccc

SEQ ID NO: 7380546 - DNA, 22 bp, Homo sapiens
gaggtctgagtgcggaaagcct

SEQ ID NO: 7380547 - DNA, 22 bp, Homo sapiens
gaggcctgtagtcatggatgta

SEQ ID NO: 7380548 - DNA, 22 bp, Homo sapiens
gaggcgagaagctggagatggt

SEQ ID NO: 7380549 - DNA, 19 bp, Homo sapiens
gaggcgaggcgtgcaggag

SEQ ID NO: 7380550 - DNA, 22 bp, Homo sapiens
gaggcggcggccgagcctggct

SEQ ID NO: 7380551 - DNA, 22 bp, Homo sapiens
gaggctagatgtttgctgggag

SEQ ID NO: 7380552 - DNA, 22 bp, Homo sapiens
gaggctaagcactggcatttct

SEQ ID NO: 7380553 - DNA, 22 bp, Homo sapiens
gagggccagagtcctggggtca

SEQ ID NO: 7380554 - DNA, 22 bp, Homo sapiens
gagggaagaggcctgacatttt

SEQ ID NO: 7380555 - DNA, 22 bp, Homo sapiens
gagggaagagggtttgaattca

SEQ ID NO: 7380556 - DNA, 22 bp, Homo sapiens
gagggaaggagagttgtagctg

SEQ ID NO: 7380557 - DNA, 22 bp, Homo sapiens
gagggaaggtcacccttgtagc

SEQ ID NO: 7380558 - DNA, 22 bp, Homo sapiens
gagggaagattccccatatggg

SEQ ID NO: 7380559 - DNA, 22 bp, Homo sapiens
gagggaaggacccattttaagt

SEQ ID NO: 7380560 - DNA, 22 bp, Homo sapiens
gagggaagaggcctgacatttt

SEQ ID NO: 7380561 - DNA, 22 bp, Homo sapiens
gagggccagaaagttattgaga

SEQ ID NO: 7380562 - DNA, 22 bp, Homo sapiens
gagggccacttgaatgttttca

SEQ ID NO: 7380563 - DNA, 22 bp, Homo sapiens
gagggccacgttcagggctctc

SEQ ID NO: 7380564 - DNA, 22 bp, Homo sapiens
gagggagaattgcagccagcgt

SEQ ID NO: 7380565 - DNA, 22 bp, Homo sapiens
gagggaagtcataatgttctag

SEQ ID NO: 7380566 - DNA, 22 bp, Homo sapiens
gagggagaaggactatcaggct

SEQ ID NO: 7380567 - DNA, 22 bp, Homo sapiens
gagggagaaggactatcaggct

SEQ ID NO: 7380568 - DNA, 22 bp, Homo sapiens
gagcaacactccacattgctag

SEQ ID NO: 7380569 - DNA, 22 bp, Homo sapiens
gagcaacagggcgaggagaact

SEQ ID NO: 7380570 - DNA, 22 bp, Homo sapiens
gagcaagactacaggcagatga

SEQ ID NO: 7380571 - DNA, 22 bp, Homo sapiens
gagatttttcaacaagaatagg

SEQ ID NO: 7380572 - DNA, 22 bp, Homo sapiens
gagcaaagcttttagggccttt

SEQ ID NO: 7380573 - DNA, 22 bp, Homo sapiens
gagcaaatggagcttgtctact

SEQ ID NO: 7380574 - DNA, 22 bp, Homo sapiens
gagaggcaggaatcctgggtga

SEQ ID NO: 7380575 - DNA, 22 bp, Homo sapiens
gagaggcaggcgctgcaatggt

SEQ ID NO: 7380576 - DNA, 22 bp, Homo sapiens
gagaggcaggcgctgcaatggt

SEQ ID NO: 7380577 - DNA, 22 bp, Homo sapiens
gagaggcaggaatcctgggtga

SEQ ID NO: 7380578 - DNA, 22 bp, Homo sapiens
gagaggcaggaatcctgggtga

SEQ ID NO: 7380579 - DNA, 22 bp, Homo sapiens
gagaggcagaggcctgaaaccg

SEQ ID NO: 7380580 - DNA, 22 bp, Homo sapiens
gagaggcagaggcctgaaaccg

SEQ ID NO: 7380581 - DNA, 22 bp, Homo sapiens
gagcacagaactaaatgctggt

SEQ ID NO: 7380582 - DNA, 22 bp, Homo sapiens
gagcaagactacaggcagatga

SEQ ID NO: 7380583 - DNA, 22 bp, Homo sapiens
gagcaagactcactgcatcttg

SEQ ID NO: 7380584 - DNA, 22 bp, Homo sapiens
gagcaagattaaaaggctgggt

SEQ ID NO: 7380585 - DNA, 22 bp, Homo sapiens
gagcaagagtgttggactttga

SEQ ID NO: 7380586 - DNA, 22 bp, Homo sapiens
gagcaagattaaaaggctgggt

SEQ ID NO: 7380587 - DNA, 22 bp, Homo sapiens
gagcaaggatgggtctatagta

SEQ ID NO: 7380588 - DNA, 22 bp, Homo sapiens
gagcaaggcggcatctctctga

SEQ ID NO: 7380589 - DNA, 22 bp, Homo sapiens
gagcaaggtagctctctggggc

SEQ ID NO: 7380590 - DNA, 22 bp, Homo sapiens
gagcaaggagggtggggccttt

SEQ ID NO: 7380591 - DNA, 22 bp, Homo sapiens
gagcaaggagggtggggccttt

SEQ ID NO: 7380592 - DNA, 22 bp, Homo sapiens
gagcaaggatgggtctatagta

SEQ ID NO: 7380593 - DNA, 22 bp, Homo sapiens
gagcaaggatggccggggccgt

SEQ ID NO: 7380594 - DNA, 22 bp, Homo sapiens
gagcaggaaggccagaagggtc

SEQ ID NO: 7380595 - DNA, 22 bp, Homo sapiens
gagcaggaacagatcccttgga

SEQ ID NO: 7380596 - DNA, 22 bp, Homo sapiens
gagcaggacagcagcttcctgg

SEQ ID NO: 7380597 - DNA, 18 bp, Homo sapiens
gagcagaggagggttttt

SEQ ID NO: 7380598 - DNA, 22 bp, Homo sapiens
gagcagagcttctcaaagtaaa

SEQ ID NO: 7380599 - DNA, 22 bp, Homo sapiens
gagcagagcttctcaaagtaaa

SEQ ID NO: 7380600 - DNA, 16 bp, Homo sapiens
gagcagagcggttcca

SEQ ID NO: 7380601 - DNA, 18 bp, Homo sapiens
gagcagaggctcaactgg

SEQ ID NO: 7380602 - DNA, 19 bp, Homo sapiens
gagcagcttcctatctggt

SEQ ID NO: 7380603 - DNA, 19 bp, Homo sapiens
gagcagcttcctatctggt

SEQ ID NO: 7380604 - DNA, 22 bp, Homo sapiens
gagcagcttgcgctgtcttcac

SEQ ID NO: 7380605 - DNA, 23 bp, Homo sapiens
gagcagagcgggcgggggtcctg

SEQ ID NO: 7380606 - DNA, 22 bp, Homo sapiens
gagcagagacagtacaactggc

SEQ ID NO: 7380607 - DNA, 22 bp, Homo sapiens
gagcagagaatccagctaagtg

SEQ ID NO: 7380608 - DNA, 22 bp, Homo sapiens
gagcacagtgtgttgtgatttc

SEQ ID NO: 7380609 - DNA, 20 bp, Homo sapiens
gagcacagtaatgactgcta

SEQ ID NO: 7380610 - DNA, 22 bp, Homo sapiens
gagcacagtaaagcagtgtcac

SEQ ID NO: 7380611 - DNA, 22 bp, Homo sapiens
gagcagaacaggccgggtggga

SEQ ID NO: 7380612 - DNA, 22 bp, Homo sapiens
gagcagaactactcacatatcg

SEQ ID NO: 7380613 - DNA, 22 bp, Homo sapiens
gagcagacgctgcagtcttggg

SEQ ID NO: 7380614 - DNA, 22 bp, Homo sapiens
gagcacttagatgctatgaatg

SEQ ID NO: 7380615 - DNA, 22 bp, Homo sapiens
gagcagaaagttatgtcttgca

SEQ ID NO: 7380616 - DNA, 22 bp, Homo sapiens
gagcagaaagttatgtcttgca

SEQ ID NO: 7380617 - DNA, 22 bp, Homo sapiens
gagagagaaaatgactccggac

SEQ ID NO: 7380618 - DNA, 22 bp, Homo sapiens
gagagagaaggcctgtgggtgt

SEQ ID NO: 7380619 - DNA, 22 bp, Homo sapiens
gagagcatgtggtctagtttta

SEQ ID NO: 7380620 - DNA, 22 bp, Homo sapiens
gagagcaggaggcagcgggacg

SEQ ID NO: 7380621 - DNA, 22 bp, Homo sapiens
gagaggagtccctatcacagtt

SEQ ID NO: 7380622 - DNA, 22 bp, Homo sapiens
gagaggagtaggctgatggtgc

SEQ ID NO: 7380623 - DNA, 22 bp, Homo sapiens
gagaggagtagacactttggtt

SEQ ID NO: 7380624 - DNA, 22 bp, Homo sapiens
gagaggaggtggctatgacagc

SEQ ID NO: 7380625 - DNA, 22 bp, Homo sapiens
gagaggagacttatccagattg

SEQ ID NO: 7380626 - DNA, 22 bp, Homo sapiens
gagaagaacttgggcaaagtca

SEQ ID NO: 7380627 - DNA, 22 bp, Homo sapiens
gagaaagggaacttacagagtg

SEQ ID NO: 7380628 - DNA, 22 bp, Homo sapiens
gactattttgcacaaaacaatt

SEQ ID NO: 7380629 - DNA, 22 bp, Homo sapiens
gagagaatgtacatgctagggg

SEQ ID NO: 7380630 - DNA, 18 bp, Homo sapiens
gacatagctcagagctca

SEQ ID NO: 7380631 - DNA, 22 bp, Homo sapiens
gacatagctcagagctcagcac

SEQ ID NO: 7380632 - DNA, 22 bp, Homo sapiens
gacagctggcagtggaaaggtg

SEQ ID NO: 7380633 - DNA, 22 bp, Homo sapiens
gacagcctcatgaggagcaaaa

SEQ ID NO: 7380634 - DNA, 22 bp, Homo sapiens
gacagcctcatgtgcatgaact

SEQ ID NO: 7380635 - DNA, 22 bp, Homo sapiens
gacatgttatctctggcttcaa

SEQ ID NO: 7380636 - DNA, 22 bp, Homo sapiens
gacattcaactttgatgattat

SEQ ID NO: 7380637 - DNA, 22 bp, Homo sapiens
gacctggaagaactgaggcctt

SEQ ID NO: 7380638 - DNA, 22 bp, Homo sapiens
gacatgcatgaatgcaggtctc

SEQ ID NO: 7380639 - DNA, 22 bp, Homo sapiens
gaccttgtgatccacccgcctt

SEQ ID NO: 7380640 - DNA, 22 bp, Homo sapiens
gacctggtccttgtactttgaa

SEQ ID NO: 7380641 - DNA, 22 bp, Homo sapiens
gacctggggtggaaggaaggca

SEQ ID NO: 7380642 - DNA, 19 bp, Homo sapiens
gaatgtttgtattcagcgc

SEQ ID NO: 7380643 - DNA, 22 bp, Homo sapiens
gaatgctttgggaattcagaat

SEQ ID NO: 7380644 - DNA, 22 bp, Homo sapiens
gaatgcttggaacctgaagttc

SEQ ID NO: 7380645 - DNA, 22 bp, Homo sapiens
gaatgctgagtcttatctctta

SEQ ID NO: 7380646 - DNA, 22 bp, Homo sapiens
gaattaattgtgtggtttgaat

SEQ ID NO: 7380647 - DNA, 22 bp, Homo sapiens
gaattaaaatagttttggtcga

SEQ ID NO: 7380648 - DNA, 22 bp, Homo sapiens
gaagaatatggctctcagcaat

SEQ ID NO: 7380649 - DNA, 22 bp, Homo sapiens
gaagaatatataatgattttgt

SEQ ID NO: 7380650 - DNA, 22 bp, Homo sapiens
gaagaatattcttgatcttaga

SEQ ID NO: 7380651 - DNA, 18 bp, Homo sapiens
gacaaaagtacagacaga

SEQ ID NO: 7380652 - DNA, 18 bp, Homo sapiens
gacaaaagtacagacaga

SEQ ID NO: 7380653 - DNA, 22 bp, Homo sapiens
gacaaaagtgttttgaacaagg

SEQ ID NO: 7380654 - DNA, 22 bp, Homo sapiens
gacaaaagtgttttgaacaagg

SEQ ID NO: 7380655 - DNA, 21 bp, Homo sapiens
gacaaacatttcatagcttta

SEQ ID NO: 7380656 - DNA, 22 bp, Homo sapiens
gaattttattactagtcaactg

SEQ ID NO: 7380657 - DNA, 22 bp, Homo sapiens
gaatttttctggaagcaattat

SEQ ID NO: 7380658 - DNA, 20 bp, Homo sapiens
gaattttatgaacactacca

SEQ ID NO: 7380659 - DNA, 22 bp, Homo sapiens
gaaattaaccacctttggcttt

SEQ ID NO: 7380660 - DNA, 23 bp, Homo sapiens
gaaatgtttcttgattaatccta

SEQ ID NO: 7380661 - DNA, 22 bp, Homo sapiens
gaaattattgctagagactgca

SEQ ID NO: 7380662 - DNA, 22 bp, Homo sapiens
gaaattattgctagagactgca

SEQ ID NO: 7380663 - DNA, 22 bp, Homo sapiens
gaaattaagcaggggtctgtgg

SEQ ID NO: 7380664 - DNA, 22 bp, Homo sapiens
gaaattaagcaggggtctgtgg

SEQ ID NO: 7380665 - DNA, 22 bp, Homo sapiens
gaagaacacttcatgattcatt

SEQ ID NO: 7380666 - DNA, 22 bp, Homo sapiens
gaagaacaagcagtgctttcct

SEQ ID NO: 7380667 - DNA, 22 bp, Homo sapiens
gaagaaattgaattcatgagct

SEQ ID NO: 7380668 - DNA, 22 bp, Homo sapiens
gaacttgttgtaagaaaatatg

SEQ ID NO: 7380669 - DNA, 22 bp, Homo sapiens
gaagaagacatggaacaatagt

SEQ ID NO: 7380670 - DNA, 22 bp, Homo sapiens
gaagaagacatggaacaatagt

SEQ ID NO: 7380671 - DNA, 22 bp, Homo sapiens
gaagaagagataatggggagca

SEQ ID NO: 7380672 - DNA, 19 bp, Homo sapiens
gaagaagcttgagaagtag

SEQ ID NO: 7380673 - DNA, 22 bp, Homo sapiens
gaagaaggaagatcatgcttga

SEQ ID NO: 7380674 - DNA, 17 bp, Homo sapiens
gaagaaggaatctagaa

SEQ ID NO: 7380675 - DNA, 22 bp, Homo sapiens
gaaatattgggactcagagctt

SEQ ID NO: 7380676 - DNA, 22 bp, Homo sapiens
gaaatgtcaagatatgtttgga

SEQ ID NO: 7380677 - DNA, 22 bp, Homo sapiens
gaaatgtcatagtcttcaagcc

SEQ ID NO: 7380678 - DNA, 22 bp, Homo sapiens
gaaatgtctttgacaagagagg

SEQ ID NO: 7380679 - DNA, 22 bp, Homo sapiens
gaaatgtctcttgatttttgga

SEQ ID NO: 7380680 - DNA, 22 bp, Homo sapiens
gaaatgtctgccaggcacatag

SEQ ID NO: 7380681 - DNA, 22 bp, Homo sapiens
gaaatgtctctggatttgcttt

SEQ ID NO: 7380682 - DNA, 20 bp, Homo sapiens
gaaatgtctatgataatgat

SEQ ID NO: 7380683 - DNA, 22 bp, Homo sapiens
gaaatgtcctcatgaaggaagt

SEQ ID NO: 7380684 - DNA, 22 bp, Homo sapiens
gaaatgtcattgccttcagccc

SEQ ID NO: 7380685 - DNA, 22 bp, Homo sapiens
gaaagacatagttgcaagatgg

SEQ ID NO: 7380686 - DNA, 22 bp, Homo sapiens
gaaagagaacctgggcctagat

SEQ ID NO: 7380687 - DNA, 22 bp, Homo sapiens
gaaatacaggaatgccacacag

SEQ ID NO: 7380688 - DNA, 22 bp, Homo sapiens
gaaatacagaaagggctgaatg

SEQ ID NO: 7380689 - DNA, 22 bp, Homo sapiens
gaaatattacagtggaggggat

SEQ ID NO: 7380690 - DNA, 22 bp, Homo sapiens
gaaatattcttgtcttgttttc

SEQ ID NO: 7380691 - DNA, 20 bp, Homo sapiens
ctttggcaatgagaacaggg

SEQ ID NO: 7380692 - DNA, 22 bp, Homo sapiens
ctttggaagtgaccacaatcct

SEQ ID NO: 7380693 - DNA, 22 bp, Homo sapiens
ctttggcaatgaaacacaagaa

SEQ ID NO: 7380694 - DNA, 22 bp, Homo sapiens
ctttggaggtcatagccaagag

SEQ ID NO: 7380695 - DNA, 22 bp, Homo sapiens
gaaaaagtgaccttggtagcta

SEQ ID NO: 7380696 - DNA, 22 bp, Homo sapiens
gaaaaatgctccaaatctgtgg

SEQ ID NO: 7380697 - DNA, 22 bp, Homo sapiens
gaaaaatgctccaaatctgtgg

SEQ ID NO: 7380698 - DNA, 22 bp, Homo sapiens
gaaaaatgagctgatgtcaggg

SEQ ID NO: 7380699 - DNA, 22 bp, Homo sapiens
gaaaaatgagctgatgtcaggg

SEQ ID NO: 7380700 - DNA, 22 bp, Homo sapiens
gaaaaatgagctgatgtcaggg

SEQ ID NO: 7380701 - DNA, 22 bp, Homo sapiens
gaaactctcgcatcctgggaac

SEQ ID NO: 7380702 - DNA, 22 bp, Homo sapiens
cttggaaaggaatcttttacca

SEQ ID NO: 7380703 - DNA, 22 bp, Homo sapiens
cttggaaagttatcattttcct

SEQ ID NO: 7380704 - DNA, 22 bp, Homo sapiens
cttggaaagaatatatgatgct

SEQ ID NO: 7380705 - DNA, 22 bp, Homo sapiens
cttgcttggagaagagatcagt

SEQ ID NO: 7380706 - DNA, 22 bp, Homo sapiens
cttgcttgaggtatggaatggg

SEQ ID NO: 7380707 - DNA, 22 bp, Homo sapiens
cttgcttgattatgatcataaa

SEQ ID NO: 7380708 - DNA, 22 bp, Homo sapiens
cttggacccactcccagaattg

SEQ ID NO: 7380709 - DNA, 22 bp, Homo sapiens
cttgcctacttgtcaaccagca

SEQ ID NO: 7380710 - DNA, 22 bp, Homo sapiens
cttcttcttcccccttcagggg

SEQ ID NO: 7380711 - DNA, 22 bp, Homo sapiens
cttcttctctacatcctttgat

SEQ ID NO: 7380712 - DNA, 22 bp, Homo sapiens
cttcttccaagcttatgctcaa

SEQ ID NO: 7380713 - DNA, 22 bp, Homo sapiens
cttcttccagttataagagctt

SEQ ID NO: 7380714 - DNA, 22 bp, Homo sapiens
ctttctaaatgttccttgatta

SEQ ID NO: 7380715 - DNA, 22 bp, Homo sapiens
ctttctaattctcccatagtct

SEQ ID NO: 7380716 - DNA, 23 bp, Homo sapiens
ctttcctttctttgacacccagc

SEQ ID NO: 7380717 - DNA, 22 bp, Homo sapiens
ctttccttctcgtggttctcac

SEQ ID NO: 7380718 - DNA, 22 bp, Homo sapiens
ctttccttaataagcaggtata

SEQ ID NO: 7380719 - DNA, 22 bp, Homo sapiens
ctttcctccactccctaggctt

SEQ ID NO: 7380720 - DNA, 22 bp, Homo sapiens
ctttctcttcactgtcatgatc

SEQ ID NO: 7380721 - DNA, 20 bp, Homo sapiens
cttcaaaggcagtaacagcc

SEQ ID NO: 7380722 - DNA, 22 bp, Homo sapiens
cttcacatctccctaaaacagc

SEQ ID NO: 7380723 - DNA, 22 bp, Homo sapiens
cttcacatctccctaaaacagc

SEQ ID NO: 7380724 - DNA, 22 bp, Homo sapiens
cttcacatgggtactgctgatc

SEQ ID NO: 7380725 - DNA, 22 bp, Homo sapiens
cttcacatgttggagtcctttg

SEQ ID NO: 7380726 - DNA, 22 bp, Homo sapiens
cttcacattagtttggatcaaa

SEQ ID NO: 7380727 - DNA, 22 bp, Homo sapiens
cttcacattgggcttgatatga

SEQ ID NO: 7380728 - DNA, 22 bp, Homo sapiens
cttcagaaataacaacaattac

SEQ ID NO: 7380729 - DNA, 22 bp, Homo sapiens
cttcagaaataacaacaattac

SEQ ID NO: 7380730 - DNA, 22 bp, Homo sapiens
cttcagaaactagtaacagcta

SEQ ID NO: 7380731 - DNA, 21 bp, Homo sapiens
cttccccaggctggtctgtat

SEQ ID NO: 7380732 - DNA, 22 bp, Homo sapiens
cttcttcataggcagtcctgtt

SEQ ID NO: 7380733 - DNA, 22 bp, Homo sapiens
cttcttcagcacaatattgatg

SEQ ID NO: 7380734 - DNA, 22 bp, Homo sapiens
cttcttcagaggccagcctctg

SEQ ID NO: 7380735 - DNA, 22 bp, Homo sapiens
cttctgtgaagagcagaaccat

SEQ ID NO: 7380736 - DNA, 22 bp, Homo sapiens
cttctgtagccagtaacatata

SEQ ID NO: 7380737 - DNA, 20 bp, Homo sapiens
ctgtggaattttaccatgcg

SEQ ID NO: 7380738 - DNA, 22 bp, Homo sapiens
ctgtggaatcgggaaaagacag

SEQ ID NO: 7380739 - DNA, 22 bp, Homo sapiens
ctgtctgttatctcaccagtcc

SEQ ID NO: 7380740 - DNA, 22 bp, Homo sapiens
ctgtgacagtttctcagacttt

SEQ ID NO: 7380741 - DNA, 22 bp, Homo sapiens
ctggttctgattttgctgcatt

SEQ ID NO: 7380742 - DNA, 22 bp, Homo sapiens
ctggttctgatgttcttggctt

SEQ ID NO: 7380743 - DNA, 22 bp, Homo sapiens
ctgtccatattcaaggggtagg

SEQ ID NO: 7380744 - DNA, 22 bp, Homo sapiens
ctgtccatggtgctggacggtc

SEQ ID NO: 7380745 - DNA, 19 bp, Homo sapiens
ctgtcccagactctgctct

SEQ ID NO: 7380746 - DNA, 22 bp, Homo sapiens
ctgtcccaggagctgtaagaca

SEQ ID NO: 7380747 - DNA, 22 bp, Homo sapiens
ctgtcccatccttactctaccc

SEQ ID NO: 7380748 - DNA, 22 bp, Homo sapiens
ctgtgtgtgctacaggcttcca

SEQ ID NO: 7380749 - DNA, 23 bp, Homo sapiens
ctgtgtgtgccgagggtggccac

SEQ ID NO: 7380750 - DNA, 22 bp, Homo sapiens
ctgtgtgtgagaagcaggttga

SEQ ID NO: 7380751 - DNA, 22 bp, Homo sapiens
ctgtgtctttcctactttgtgg

SEQ ID NO: 7380752 - DNA, 22 bp, Homo sapiens
ctgtgtcttctgttttgaagtt

SEQ ID NO: 7380753 - DNA, 22 bp, Homo sapiens
ctgggagtgttctaggtcacat

SEQ ID NO: 7380754 - DNA, 22 bp, Homo sapiens
ctgggatggctccgctgctgct

SEQ ID NO: 7380755 - DNA, 22 bp, Homo sapiens
ctgggatgctccggcctggatg

SEQ ID NO: 7380756 - DNA, 22 bp, Homo sapiens
ctgggcccacgagggctctggg

SEQ ID NO: 7380757 - DNA, 22 bp, Homo sapiens
ctgggccagcaactgcaatgga

SEQ ID NO: 7380758 - DNA, 22 bp, Homo sapiens
ctgggagtcaccaggagcaagg

SEQ ID NO: 7380759 - DNA, 22 bp, Homo sapiens
ctgggagtctaagctagcaccg

SEQ ID NO: 7380760 - DNA, 22 bp, Homo sapiens
ctggagctccagggtctcctct

SEQ ID NO: 7380761 - DNA, 22 bp, Homo sapiens
ctgggctcagtgtctcactcct

SEQ ID NO: 7380762 - DNA, 22 bp, Homo sapiens
ctgggttgccctgggcctgtga

SEQ ID NO: 7380763 - DNA, 22 bp, Homo sapiens
ctgggttttattacagtgagct

SEQ ID NO: 7380764 - DNA, 22 bp, Homo sapiens
ctggtgtggcggcgccctgtag

SEQ ID NO: 7380765 - DNA, 22 bp, Homo sapiens
ctggtcacctccttcccagcta

SEQ ID NO: 7380766 - DNA, 22 bp, Homo sapiens
ctgggggccttacggaactcca

SEQ ID NO: 7380767 - DNA, 22 bp, Homo sapiens
ctgggggcagcaagaagccatg

SEQ ID NO: 7380768 - DNA, 22 bp, Homo sapiens
ctgggctcctaaccatccaggt

SEQ ID NO: 7380769 - DNA, 22 bp, Homo sapiens
ctggggtggtgcaggcctcatg

SEQ ID NO: 7380770 - DNA, 22 bp, Homo sapiens
ctgggggtcttgaaagggagag

SEQ ID NO: 7380771 - DNA, 22 bp, Homo sapiens
gcaggcccagagtcgctggcct

SEQ ID NO: 7380772 - DNA, 22 bp, Homo sapiens
gcagctgtagaggggagaaaga

SEQ ID NO: 7380773 - DNA, 22 bp, Homo sapiens
gcagctgtatcacttttaaaca

SEQ ID NO: 7380774 - DNA, 22 bp, Homo sapiens
gcagctgtcagaagttggaatc

SEQ ID NO: 7380775 - DNA, 22 bp, Homo sapiens
gcagctgtcagaagttggaatc

SEQ ID NO: 7380776 - DNA, 22 bp, Homo sapiens
gcaggccctcctctagcaaggc

SEQ ID NO: 7380777 - DNA, 19 bp, Homo sapiens
gcaggcccagtcgggctgg

SEQ ID NO: 7380778 - DNA, 18 bp, Homo sapiens
gcaggccctgtttctggg

SEQ ID NO: 7380779 - DNA, 22 bp, Homo sapiens
gcaggcccttagccttggtggg

SEQ ID NO: 7380780 - DNA, 20 bp, Homo sapiens
gcaggccctctctctagtct

SEQ ID NO: 7380781 - DNA, 22 bp, Homo sapiens
gcagggcagctgaagctaggtg

SEQ ID NO: 7380782 - DNA, 19 bp, Homo sapiens
gcagggtggcagagctctt

SEQ ID NO: 7380783 - DNA, 22 bp, Homo sapiens
gcagggccagtgcagagaggaa

SEQ ID NO: 7380784 - DNA, 22 bp, Homo sapiens
gcagggccaggtacaagaagca

SEQ ID NO: 7380785 - DNA, 22 bp, Homo sapiens
gcagggccagggctcaggctgt

SEQ ID NO: 7380786 - DNA, 22 bp, Homo sapiens
gcagggccagggctcaggctgt

SEQ ID NO: 7380787 - DNA, 22 bp, Homo sapiens
gcagggcatgggccctgtctgc

SEQ ID NO: 7380788 - DNA, 22 bp, Homo sapiens
gcagggcagggcaagaactggg

SEQ ID NO: 7380789 - DNA, 22 bp, Homo sapiens
gcaggtgatgtgatgtgagcat

SEQ ID NO: 7380790 - DNA, 22 bp, Homo sapiens
gcaggtgaatgatggactagga

SEQ ID NO: 7380791 - DNA, 19 bp, Homo sapiens
gcaggtagagacagcagcc

SEQ ID NO: 7380792 - DNA, 22 bp, Homo sapiens
gcaggtagtgatcgagggtgac

SEQ ID NO: 7380793 - DNA, 22 bp, Homo sapiens
gcagcagattgttttttcacct

SEQ ID NO: 7380794 - DNA, 22 bp, Homo sapiens
gcagcagatgtgggcccagagc

SEQ ID NO: 7380795 - DNA, 22 bp, Homo sapiens
gcagcagcagcaattttctgtc

SEQ ID NO: 7380796 - DNA, 22 bp, Homo sapiens
gcagcagaaggccaaggggagc

SEQ ID NO: 7380797 - DNA, 22 bp, Homo sapiens
gcagcagaagtagaagtacagg

SEQ ID NO: 7380798 - DNA, 22 bp, Homo sapiens
gcagcaatcttcacagtgtcat

SEQ ID NO: 7380799 - DNA, 21 bp, Homo sapiens
gcagccagccgagaccatgcc

SEQ ID NO: 7380800 - DNA, 22 bp, Homo sapiens
gcagccagcaggaagcgggaga

SEQ ID NO: 7380801 - DNA, 22 bp, Homo sapiens
gcagctggctcagagaggtggg

SEQ ID NO: 7380802 - DNA, 22 bp, Homo sapiens
gcagctggctcagagaggtggg

SEQ ID NO: 7380803 - DNA, 22 bp, Homo sapiens
gcagctgggacactgaggccag

SEQ ID NO: 7380804 - DNA, 22 bp, Homo sapiens
gcagctgggtctgtgtgggctg

SEQ ID NO: 7380805 - DNA, 22 bp, Homo sapiens
gcagctggggaggtcgtgggga

SEQ ID NO: 7380806 - DNA, 22 bp, Homo sapiens
gcagctggttaatgggagaatt

SEQ ID NO: 7380807 - DNA, 23 bp, Homo sapiens
gcagctggttagaagggaaggag

SEQ ID NO: 7380808 - DNA, 23 bp, Homo sapiens
gcagctggttagaagggaaggag

SEQ ID NO: 7380809 - DNA, 22 bp, Homo sapiens
gcaataaagtagcagctcatca

SEQ ID NO: 7380810 - DNA, 22 bp, Homo sapiens
gcaataaataacatggaagaca

SEQ ID NO: 7380811 - DNA, 22 bp, Homo sapiens
gcaataaataacatggaagaca

SEQ ID NO: 7380812 - DNA, 22 bp, Homo sapiens
gcaataaagattttactgtcag

SEQ ID NO: 7380813 - DNA, 22 bp, Homo sapiens
gcaataaactctctcaagccac

SEQ ID NO: 7380814 - DNA, 22 bp, Homo sapiens
gcaataaacatgtttgatgcgc

SEQ ID NO: 7380815 - DNA, 22 bp, Homo sapiens
gcaataaaatgtaatgattggg

SEQ ID NO: 7380816 - DNA, 21 bp, Homo sapiens
gcaaggcaatgccatgatttc

SEQ ID NO: 7380817 - DNA, 22 bp, Homo sapiens
gcaaggcagcatccttttgagg

SEQ ID NO: 7380818 - DNA, 22 bp, Homo sapiens
gagtagacaaggtacatgttct

SEQ ID NO: 7380819 - DNA, 22 bp, Homo sapiens
gcaaggagcacctttctggaac

SEQ ID NO: 7380820 - DNA, 22 bp, Homo sapiens
gcaaggagcctggaggtgagtg

SEQ ID NO: 7380821 - DNA, 22 bp, Homo sapiens
gcaaggaggctggtggaggaag

SEQ ID NO: 7380822 - DNA, 22 bp, Homo sapiens
gcacagagagcagtgggggaca

SEQ ID NO: 7380823 - DNA, 22 bp, Homo sapiens
gcacatggcggccagcaggtga

SEQ ID NO: 7380824 - DNA, 22 bp, Homo sapiens
gcacatggacaatggaggtgca

SEQ ID NO: 7380825 - DNA, 17 bp, Homo sapiens
gcacatgtgttctttta

SEQ ID NO: 7380826 - DNA, 22 bp, Homo sapiens
gcacatgtgggaatggtgctga

SEQ ID NO: 7380827 - DNA, 22 bp, Homo sapiens
gcacatgtcttattcactgtta

SEQ ID NO: 7380828 - DNA, 22 bp, Homo sapiens
gcacagcacagcaacatgtttt

SEQ ID NO: 7380829 - DNA, 22 bp, Homo sapiens
gcacagcagctgggggccctgg

SEQ ID NO: 7380830 - DNA, 22 bp, Homo sapiens
gcagacacttcccactgcagcg

SEQ ID NO: 7380831 - DNA, 22 bp, Homo sapiens
gcagacacagggaaggcaagga

SEQ ID NO: 7380832 - DNA, 22 bp, Homo sapiens
gcagacagaagctaagtagaca

SEQ ID NO: 7380833 - DNA, 22 bp, Homo sapiens
gcagacacttcccactgcagcg

SEQ ID NO: 7380834 - DNA, 22 bp, Homo sapiens
gcagacaggcccagtggaggga

SEQ ID NO: 7380835 - DNA, 22 bp, Homo sapiens
gcagacagatgagggtgctggg

SEQ ID NO: 7380836 - DNA, 19 bp, Homo sapiens
gcaccagattgagtgacac

SEQ ID NO: 7380837 - DNA, 22 bp, Homo sapiens
gcaccagagggggctctgcagg

SEQ ID NO: 7380838 - DNA, 22 bp, Homo sapiens
gcacccagagggcagggtctcc

SEQ ID NO: 7380839 - DNA, 22 bp, Homo sapiens
gcagaaggatccgcaggtgcaa

SEQ ID NO: 7380840 - DNA, 22 bp, Homo sapiens
gcacccagcccagggcgtgatg

SEQ ID NO: 7380841 - DNA, 22 bp, Homo sapiens
gcacccagaggtcagcagtgct

SEQ ID NO: 7380842 - DNA, 22 bp, Homo sapiens
gcagagtcagcctccgagacag

SEQ ID NO: 7380843 - DNA, 23 bp, Homo sapiens
gcagagtcaagtagtcatgagtg

SEQ ID NO: 7380844 - DNA, 19 bp, Homo sapiens
gcagagtcaagagctgctg

SEQ ID NO: 7380845 - DNA, 19 bp, Homo sapiens
gcagagtcaagagctgctg

SEQ ID NO: 7380846 - DNA, 23 bp, Homo sapiens
gcagaggttatgttttttaggct

SEQ ID NO: 7380847 - DNA, 22 bp, Homo sapiens
gcagagtcaggtccaaggactg

SEQ ID NO: 7380848 - DNA, 22 bp, Homo sapiens
gcagagtcaggattccatccca

SEQ ID NO: 7380849 - DNA, 22 bp, Homo sapiens
gcagagtctgggcagcctccat

SEQ ID NO: 7380850 - DNA, 22 bp, Homo sapiens
gcagagtcccagcaggtggtgg

SEQ ID NO: 7380851 - DNA, 22 bp, Homo sapiens
gcagagtctgggctacctcttg

SEQ ID NO: 7380852 - DNA, 22 bp, Homo sapiens
gcagagtctggtaggtgctggt

SEQ ID NO: 7380853 - DNA, 22 bp, Homo sapiens
gcagagtgaaagaatatattaa

SEQ ID NO: 7380854 - DNA, 22 bp, Homo sapiens
gcagacagggctacagaggtac

SEQ ID NO: 7380855 - DNA, 22 bp, Homo sapiens
gcagacagggctacagaggtac

SEQ ID NO: 7380856 - DNA, 22 bp, Homo sapiens
gcagaggtgtgggaggggccac

SEQ ID NO: 7380857 - DNA, 22 bp, Homo sapiens
gcagaggtggcatctgggctct

SEQ ID NO: 7380858 - DNA, 22 bp, Homo sapiens
gcagaggtggatgcaattgggg

SEQ ID NO: 7380859 - DNA, 22 bp, Homo sapiens
gcagagtgaggaagagcttcca

SEQ ID NO: 7380860 - DNA, 22 bp, Homo sapiens
gcagagtgccagtatttgttgt

SEQ ID NO: 7380861 - DNA, 22 bp, Homo sapiens
gcagagtgagccgaggctgctc

SEQ ID NO: 7380862 - DNA, 22 bp, Homo sapiens
gcagagtgaagcatttctttct

SEQ ID NO: 7380863 - DNA, 22 bp, Homo sapiens
gcagatttctaataagcaatgt

SEQ ID NO: 7380864 - DNA, 22 bp, Homo sapiens
gcataaactccaaaaggcaggg

SEQ ID NO: 7380865 - DNA, 22 bp, Homo sapiens
gcagtttcagacatatctccat

SEQ ID NO: 7380866 - DNA, 22 bp, Homo sapiens
gcagtttctgaatttatccaag

SEQ ID NO: 7380867 - DNA, 21 bp, Homo sapiens
gcagtttatgtaatatgcact

SEQ ID NO: 7380868 - DNA, 22 bp, Homo sapiens
gcattcttcacagtattcctcc

SEQ ID NO: 7380869 - DNA, 22 bp, Homo sapiens
gcattcttggtggagtgctaaa

SEQ ID NO: 7380870 - DNA, 22 bp, Homo sapiens
gcattgaaatggcaaaaagaga

SEQ ID NO: 7380871 - DNA, 22 bp, Homo sapiens
gcagttgcaggatttgtgttgt

SEQ ID NO: 7380872 - DNA, 22 bp, Homo sapiens
gcagttggcagggagcccagat

SEQ ID NO: 7380873 - DNA, 22 bp, Homo sapiens
gcagttcctacagtggaaagcg

SEQ ID NO: 7380874 - DNA, 22 bp, Homo sapiens
gccaccctggacgcactgttcg

SEQ ID NO: 7380875 - DNA, 22 bp, Homo sapiens
gccaccctggacgcactgttcg

SEQ ID NO: 7380876 - DNA, 22 bp, Homo sapiens
gccacccttatcccatgcttct

SEQ ID NO: 7380877 - DNA, 21 bp, Homo sapiens
gccactgtgcacactaaccca

SEQ ID NO: 7380878 - DNA, 22 bp, Homo sapiens
gccacctgtttcagatgtggtt

SEQ ID NO: 7380879 - DNA, 22 bp, Homo sapiens
gccactgttgctcctcaggaaa

SEQ ID NO: 7380880 - DNA, 22 bp, Homo sapiens
gccacctgccaacttgctggaa

SEQ ID NO: 7380881 - DNA, 22 bp, Homo sapiens
gcatttaaatttgaacttcaga

SEQ ID NO: 7380882 - DNA, 22 bp, Homo sapiens
gcatttagctttaaaatatttc

SEQ ID NO: 7380883 - DNA, 22 bp, Homo sapiens
gcatttaaatttgaacttcaga

SEQ ID NO: 7380884 - DNA, 22 bp, Homo sapiens
gcatttaaatttgaacttcaga

SEQ ID NO: 7380885 - DNA, 22 bp, Homo sapiens
gcattggcatttctccagcgga

SEQ ID NO: 7380886 - DNA, 22 bp, Homo sapiens
gccaccctggaccaccctgggc

SEQ ID NO: 7380887 - DNA, 22 bp, Homo sapiens
gccaccctgcaaatgcccagga

SEQ ID NO: 7380888 - DNA, 22 bp, Homo sapiens
gccaccctgagctgggccaggg

SEQ ID NO: 7380889 - DNA, 18 bp, Homo sapiens
gccaccctcctcgtctcc

SEQ ID NO: 7380890 - DNA, 22 bp, Homo sapiens
gccaccctgacgccgcagaccc

SEQ ID NO: 7380891 - DNA, 18 bp, Homo sapiens
gcatttatgcggggctac

SEQ ID NO: 7380892 - DNA, 22 bp, Homo sapiens
gcatttattatctgccaggcac

SEQ ID NO: 7380893 - DNA, 22 bp, Homo sapiens
gcccaagccgccttccagagac

SEQ ID NO: 7380894 - DNA, 20 bp, Homo sapiens
gcccaagcgccggccgcaga

SEQ ID NO: 7380895 - DNA, 22 bp, Homo sapiens
gcccaagcagcttcccgagctt

SEQ ID NO: 7380896 - DNA, 22 bp, Homo sapiens
gccaggctctcagtgactgccc

SEQ ID NO: 7380897 - DNA, 21 bp, Homo sapiens
gccatttcacacagacatttg

SEQ ID NO: 7380898 - DNA, 22 bp, Homo sapiens
gccaggcattattccgatccct

SEQ ID NO: 7380899 - DNA, 22 bp, Homo sapiens
gccaggaaggctccctggtcac

SEQ ID NO: 7380900 - DNA, 22 bp, Homo sapiens
gccagctgcaaagtatgttgaa

SEQ ID NO: 7380901 - DNA, 21 bp, Homo sapiens
gccagctgggtcttgcaggag

SEQ ID NO: 7380902 - DNA, 22 bp, Homo sapiens
gccagctgtaggtggtgggttg

SEQ ID NO: 7380903 - DNA, 20 bp, Homo sapiens
gccagctggtcccaattatg

SEQ ID NO: 7380904 - DNA, 22 bp, Homo sapiens
gccagctgtaagctggggtgat

SEQ ID NO: 7380905 - DNA, 22 bp, Homo sapiens
gccagctgacaccttgattttg

SEQ ID NO: 7380906 - DNA, 22 bp, Homo sapiens
gccagctgagaaatcattgata

SEQ ID NO: 7380907 - DNA, 22 bp, Homo sapiens
gccctgctctggtctctgcccg

SEQ ID NO: 7380908 - DNA, 22 bp, Homo sapiens
gccctgctcctccgtcccacga

SEQ ID NO: 7380909 - DNA, 22 bp, Homo sapiens
gccctgctcatttcacgtgttt

SEQ ID NO: 7380910 - DNA, 22 bp, Homo sapiens
gccctgctcttttgcccaccca

SEQ ID NO: 7380911 - DNA, 22 bp, Homo sapiens
gccctgctgagtccggctcaga

SEQ ID NO: 7380912 - DNA, 22 bp, Homo sapiens
gccctgctgagtccggctcaga

SEQ ID NO: 7380913 - DNA, 22 bp, Homo sapiens
gccctgcttctggcatgcagaa

SEQ ID NO: 7380914 - DNA, 22 bp, Homo sapiens
gcctcagtgatatgtgggacaa

SEQ ID NO: 7380915 - DNA, 19 bp, Homo sapiens
gcctcatttccacctcccc

SEQ ID NO: 7380916 - DNA, 22 bp, Homo sapiens
gcctcaggtgcatctctcattc

SEQ ID NO: 7380917 - DNA, 22 bp, Homo sapiens
gcctcaggtaaaacttgagttt

SEQ ID NO: 7380918 - DNA, 22 bp, Homo sapiens
gccctggagagggatatggcat

SEQ ID NO: 7380919 - DNA, 22 bp, Homo sapiens
gccctggacagtgacggtgacc

SEQ ID NO: 7380920 - DNA, 22 bp, Homo sapiens
gccctggacagtgacggtgacc

SEQ ID NO: 7380921 - DNA, 22 bp, Homo sapiens
gccctggaatctctccatggga

SEQ ID NO: 7380922 - DNA, 22 bp, Homo sapiens
gccctggaatctctccatggga

SEQ ID NO: 7380923 - DNA, 22 bp, Homo sapiens
gccctcagagttccccacagtg

SEQ ID NO: 7380924 - DNA, 22 bp, Homo sapiens
gccctagcgccagctcagcacc

SEQ ID NO: 7380925 - DNA, 22 bp, Homo sapiens
gcccggccaggaacagagtata

SEQ ID NO: 7380926 - DNA, 22 bp, Homo sapiens
gcccctggctggccagctcctc

SEQ ID NO: 7380927 - DNA, 22 bp, Homo sapiens
gcccctccgggcgcgtcatagc

SEQ ID NO: 7380928 - DNA, 22 bp, Homo sapiens
gccccaggggaggtgccctgca

SEQ ID NO: 7380929 - DNA, 22 bp, Homo sapiens
gccccaggtggtaaacctaaga

SEQ ID NO: 7380930 - DNA, 22 bp, Homo sapiens
gccccaggtggtaaacctaaga

SEQ ID NO: 7380931 - DNA, 22 bp, Homo sapiens
gccccaggttgcctgtcccagg

SEQ ID NO: 7380932 - DNA, 22 bp, Homo sapiens
gcccctccatccatcaccgggg

SEQ ID NO: 7380933 - DNA, 22 bp, Homo sapiens
gcccctcccagtcaggagcact

SEQ ID NO: 7380934 - DNA, 22 bp, Homo sapiens
gcctggagaggaagccggtgga

SEQ ID NO: 7380935 - DNA, 16 bp, Homo sapiens
gcctggagtggcaggg

SEQ ID NO: 7380936 - DNA, 22 bp, Homo sapiens
gcctggagacagcagaggcggc

SEQ ID NO: 7380937 - DNA, 22 bp, Homo sapiens
gcctgcagggcctgggcctacc

SEQ ID NO: 7380938 - DNA, 22 bp, Homo sapiens
gcctgccaaaagaagctgctgg

SEQ ID NO: 7380939 - DNA, 21 bp, Homo sapiens
gcctgcagttttgaagccctt

SEQ ID NO: 7380940 - DNA, 22 bp, Homo sapiens
gcctgcagttctgtgctaggca

SEQ ID NO: 7380941 - DNA, 21 bp, Homo sapiens
gcctgcagaccccaccaggct

SEQ ID NO: 7380942 - DNA, 22 bp, Homo sapiens
gcctgcagaggtgctgctagct

SEQ ID NO: 7380943 - DNA, 22 bp, Homo sapiens
gcctgcaggctgtagtttgtga

SEQ ID NO: 7380944 - DNA, 17 bp, Homo sapiens
gcctgcaggcccgcaga

SEQ ID NO: 7380945 - DNA, 22 bp, Homo sapiens
gcctgcagccagggagttctct

SEQ ID NO: 7380946 - DNA, 22 bp, Homo sapiens
gcctgcagcatgctaggtcttg

SEQ ID NO: 7380947 - DNA, 22 bp, Homo sapiens
gcctgcagatatataggatggt

SEQ ID NO: 7380948 - DNA, 22 bp, Homo sapiens
gcctccctccaccactgcaggt

SEQ ID NO: 7380949 - DNA, 22 bp, Homo sapiens
gcctcccctgcaattgtccttg

SEQ ID NO: 7380950 - DNA, 22 bp, Homo sapiens
gcctccccaggggtgtcatgag

SEQ ID NO: 7380951 - DNA, 22 bp, Homo sapiens
gcctgaggaattgagggggtaa

SEQ ID NO: 7380952 - DNA, 22 bp, Homo sapiens
gcctgagggctcctagcaggct

SEQ ID NO: 7380953 - DNA, 22 bp, Homo sapiens
gcctgagtcaagatgtggcacc

SEQ ID NO: 7380954 - DNA, 18 bp, Homo sapiens
gcctccctggctacactt

SEQ ID NO: 7380955 - DNA, 22 bp, Homo sapiens
gcctccctgtagaggccagcct

SEQ ID NO: 7380956 - DNA, 22 bp, Homo sapiens
ggaggaggcggcagaagttcct

SEQ ID NO: 7380957 - DNA, 22 bp, Homo sapiens
ggaggaggggcgctttgtctat

SEQ ID NO: 7380958 - DNA, 22 bp, Homo sapiens
ggaggaggggtgactgaatgct

SEQ ID NO: 7380959 - DNA, 22 bp, Homo sapiens
ggagctgtgggacgctgtccca

SEQ ID NO: 7380960 - DNA, 22 bp, Homo sapiens
ggagctgtgttatccattccca

SEQ ID NO: 7380961 - DNA, 22 bp, Homo sapiens
ggagctgtgctgggtgatcagg

SEQ ID NO: 7380962 - DNA, 22 bp, Homo sapiens
ggagctgcatttagggagcctt

SEQ ID NO: 7380963 - DNA, 20 bp, Homo sapiens
ggagctgccctgggctggag

SEQ ID NO: 7380964 - DNA, 22 bp, Homo sapiens
ggagctggctacagagaactcc

SEQ ID NO: 7380965 - DNA, 22 bp, Homo sapiens
ggagcctggtatagtgttgcat

SEQ ID NO: 7380966 - DNA, 22 bp, Homo sapiens
ggagaaaggcatagcagaacct

SEQ ID NO: 7380967 - DNA, 22 bp, Homo sapiens
ggagaaagtacagcaggcaaca

SEQ ID NO: 7380968 - DNA, 22 bp, Homo sapiens
ggagaagaggagctggaagcct

SEQ ID NO: 7380969 - DNA, 18 bp, Homo sapiens
ggagaagaacagatgtgg

SEQ ID NO: 7380970 - DNA, 22 bp, Homo sapiens
ggagaagaggagctggaagcct

SEQ ID NO: 7380971 - DNA, 22 bp, Homo sapiens
ggagccaggcaatctgtacttt

SEQ ID NO: 7380972 - DNA, 22 bp, Homo sapiens
ggagaagattggaattaagcac

SEQ ID NO: 7380973 - DNA, 22 bp, Homo sapiens
ggagaagcagcttcttgatgaa

SEQ ID NO: 7380974 - DNA, 22 bp, Homo sapiens
ggagccagggaagctgcttcct

SEQ ID NO: 7380975 - DNA, 22 bp, Homo sapiens
ggagccatgttttcagcatgat

SEQ ID NO: 7380976 - DNA, 18 bp, Homo sapiens
ggagcccacggcgtccca

SEQ ID NO: 7380977 - DNA, 18 bp, Homo sapiens
ggagccagtctgtctctg

SEQ ID NO: 7380978 - DNA, 22 bp, Homo sapiens
ggagcctggcaatgctgcgtcc

SEQ ID NO: 7380979 - DNA, 22 bp, Homo sapiens
ggagcctggcaatgctgcgtcc

SEQ ID NO: 7380980 - DNA, 22 bp, Homo sapiens
ggacaggatgctgaagatgaag

SEQ ID NO: 7380981 - DNA, 22 bp, Homo sapiens
ggacaggatgctgaagatgaag

SEQ ID NO: 7380982 - DNA, 22 bp, Homo sapiens
ggacaggagtgaggcgggttcc

SEQ ID NO: 7380983 - DNA, 22 bp, Homo sapiens
ggacagagggttgacagagtat

SEQ ID NO: 7380984 - DNA, 22 bp, Homo sapiens
ggagaaagctgtagtggaatgt

SEQ ID NO: 7380985 - DNA, 22 bp, Homo sapiens
ggagaaagaagacgaacattgt

SEQ ID NO: 7380986 - DNA, 22 bp, Homo sapiens
ggagaaagctatgtgggggagt

SEQ ID NO: 7380987 - DNA, 22 bp, Homo sapiens
ggactggtggctccttgggcag

SEQ ID NO: 7380988 - DNA, 22 bp, Homo sapiens
ggacaggcccggggagcctgga

SEQ ID NO: 7380989 - DNA, 22 bp, Homo sapiens
gctgtccatgtctggcctcagt

SEQ ID NO: 7380990 - DNA, 22 bp, Homo sapiens
gctgtccaggagtgcagagatt

SEQ ID NO: 7380991 - DNA, 22 bp, Homo sapiens
gctgtcctgggaacaggcacta

SEQ ID NO: 7380992 - DNA, 22 bp, Homo sapiens
gctgtccttcctggctggggtg

SEQ ID NO: 7380993 - DNA, 23 bp, Homo sapiens
gctgtcctcctgggcccagcagc

SEQ ID NO: 7380994 - DNA, 22 bp, Homo sapiens
gctgtcctctgatctctggagg

SEQ ID NO: 7380995 - DNA, 22 bp, Homo sapiens
gctgtctgtctctgtcccacca

SEQ ID NO: 7380996 - DNA, 22 bp, Homo sapiens
gctgtgtgctaggatatgtttt

SEQ ID NO: 7380997 - DNA, 18 bp, Homo sapiens
gctgtgtgcacctgataa

SEQ ID NO: 7380998 - DNA, 22 bp, Homo sapiens
gctgtgtgactgagagcctggc

SEQ ID NO: 7380999 - DNA, 19 bp, Homo sapiens
gctgtgtgaccttgggcaa

SEQ ID NO: 7381000 - DNA, 22 bp, Homo sapiens
gctgtatgtgaggccacagtga

SEQ ID NO: 7381001 - DNA, 19 bp, Homo sapiens
gctgtattaaagatacatg

SEQ ID NO: 7381002 - DNA, 22 bp, Homo sapiens
gctgtattcaacagtgaaaaga

SEQ ID NO: 7381003 - DNA, 22 bp, Homo sapiens
gctgtatttaacaactggctca

SEQ ID NO: 7381004 - DNA, 22 bp, Homo sapiens
gctgtcacatcaaggcactaaa

SEQ ID NO: 7381005 - DNA, 22 bp, Homo sapiens
gctgtcacacatgggatctcag

SEQ ID NO: 7381006 - DNA, 22 bp, Homo sapiens
gctgtcacatttggagcactgg

SEQ ID NO: 7381007 - DNA, 22 bp, Homo sapiens
gctgtcaccaaagcaggcactg

SEQ ID NO: 7381008 - DNA, 22 bp, Homo sapiens
gctgtcacacatggccccagct

SEQ ID NO: 7381009 - DNA, 22 bp, Homo sapiens
gctgtcacacatgggatctcag

SEQ ID NO: 7381010 - DNA, 22 bp, Homo sapiens
gctgtcacaaatatttctcagc

SEQ ID NO: 7381011 - DNA, 22 bp, Homo sapiens
gctgtcacaaatatttctcagc

SEQ ID NO: 7381012 - DNA, 22 bp, Homo sapiens
gctgtcacaaattgggttcttt

SEQ ID NO: 7381013 - DNA, 22 bp, Homo sapiens
gctgtcacaagcatctggggca

SEQ ID NO: 7381014 - DNA, 22 bp, Homo sapiens
gctgtcactcaccaggcctgca

SEQ ID NO: 7381015 - DNA, 22 bp, Homo sapiens
gctgtcactctccggccttccc

SEQ ID NO: 7381016 - DNA, 22 bp, Homo sapiens
gctgtcactggcatgttccggg

SEQ ID NO: 7381017 - DNA, 22 bp, Homo sapiens
gctggccacactgctgatggag

SEQ ID NO: 7381018 - DNA, 22 bp, Homo sapiens
gctggccaaagtgtacctggag

SEQ ID NO: 7381019 - DNA, 22 bp, Homo sapiens
gctggccaggaagagtctcaga

SEQ ID NO: 7381020 - DNA, 23 bp, Homo sapiens
gcttttaaacctgtgactgccgc

SEQ ID NO: 7381021 - DNA, 22 bp, Homo sapiens
gcttttaattagttgcttccat

SEQ ID NO: 7381022 - DNA, 22 bp, Homo sapiens
gcttttatttcttcacaaaagt

SEQ ID NO: 7381023 - DNA, 22 bp, Homo sapiens
gcttttcatgacaactcagcga

SEQ ID NO: 7381024 - DNA, 18 bp, Homo sapiens
gctttttagtgcatcttc

SEQ ID NO: 7381025 - DNA, 22 bp, Homo sapiens
gctttatgctacgatttctagt

SEQ ID NO: 7381026 - DNA, 22 bp, Homo sapiens
gctttatagccctattacatga

SEQ ID NO: 7381027 - DNA, 22 bp, Homo sapiens
gctttatagccctattacatga

SEQ ID NO: 7381028 - DNA, 22 bp, Homo sapiens
gcttaaaagccacttagtctat

SEQ ID NO: 7381029 - DNA, 22 bp, Homo sapiens
gcttaaattgtttgtggatagt

SEQ ID NO: 7381030 - DNA, 22 bp, Homo sapiens
gcttaaattgtttgtggatagt

SEQ ID NO: 7381031 - DNA, 22 bp, Homo sapiens
gcttaaagttgtaaattagaga

SEQ ID NO: 7381032 - DNA, 22 bp, Homo sapiens
gcttaaatcccaatgctagacc

SEQ ID NO: 7381033 - DNA, 22 bp, Homo sapiens
gctttacataaacatttattat

SEQ ID NO: 7381034 - DNA, 22 bp, Homo sapiens
gctggaggtttcacctgagttt

SEQ ID NO: 7381035 - DNA, 22 bp, Homo sapiens
gctggaggtagggaggtcctgt

SEQ ID NO: 7381036 - DNA, 22 bp, Homo sapiens
gctggaggtagggaggtcctgt

SEQ ID NO: 7381037 - DNA, 22 bp, Homo sapiens
gctgcctgaagtgtctacactg

SEQ ID NO: 7381038 - DNA, 22 bp, Homo sapiens
gctgcctctgtagctttggacc

SEQ ID NO: 7381039 - DNA, 22 bp, Homo sapiens
gctgcctccactggctcccagt

SEQ ID NO: 7381040 - DNA, 23 bp, Homo sapiens
gctgcctcctacaaaagcccagc

SEQ ID NO: 7381041 - DNA, 22 bp, Homo sapiens
gctgcctccgccggctccacag

SEQ ID NO: 7381042 - DNA, 22 bp, Homo sapiens
gctgcctcccccatggctggaa

SEQ ID NO: 7381043 - DNA, 22 bp, Homo sapiens
gctgcctcccccatggctggaa

SEQ ID NO: 7381044 - DNA, 22 bp, Homo sapiens
gctgcctcctgagatttgggca

SEQ ID NO: 7381045 - DNA, 22 bp, Homo sapiens
gctgcctcctgagatttgggca

SEQ ID NO: 7381046 - DNA, 22 bp, Homo sapiens
gctgcctctgcgactctgggcg

SEQ ID NO: 7381047 - DNA, 22 bp, Homo sapiens
gctgcagggagctggaaggctc

SEQ ID NO: 7381048 - DNA, 22 bp, Homo sapiens
gctgcagggaatgtatggattt

SEQ ID NO: 7381049 - DNA, 22 bp, Homo sapiens
gctgcaggctgtggcaggggag

SEQ ID NO: 7381050 - DNA, 22 bp, Homo sapiens
gctgcaggctctgcaggaattg

SEQ ID NO: 7381051 - DNA, 22 bp, Homo sapiens
gctgcaggctctgcaggaattg

SEQ ID NO: 7381052 - DNA, 21 bp, Homo sapiens
gctgcagggcccagggcaccc

SEQ ID NO: 7381053 - DNA, 22 bp, Homo sapiens
gctgcagggctctcacaggggg

SEQ ID NO: 7381054 - DNA, 22 bp, Homo sapiens
gctgatagactgaatgttggga

SEQ ID NO: 7381055 - DNA, 18 bp, Homo sapiens
gctgcaggccctccgagg

SEQ ID NO: 7381056 - DNA, 18 bp, Homo sapiens
gctgcaggcgcctgcggt

SEQ ID NO: 7381057 - DNA, 22 bp, Homo sapiens
gctgcaggcgcctgcggtctct

SEQ ID NO: 7381058 - DNA, 22 bp, Homo sapiens
gctgagtgattgatattttagt

SEQ ID NO: 7381059 - DNA, 22 bp, Homo sapiens
gctgagtgaggtccagagcttg

SEQ ID NO: 7381060 - DNA, 22 bp, Homo sapiens
gctgagtgattcatacgctgct

SEQ ID NO: 7381061 - DNA, 22 bp, Homo sapiens
gctgagtgaaagtttgctgtgt

SEQ ID NO: 7381062 - DNA, 22 bp, Homo sapiens
gctgagtgaggaaaaggttata

SEQ ID NO: 7381063 - DNA, 22 bp, Homo sapiens
gctgagtgaggctgtcaaaatg

SEQ ID NO: 7381064 - DNA, 22 bp, Homo sapiens
gctgagtgtaatgatggcagag

SEQ ID NO: 7381065 - DNA, 22 bp, Homo sapiens
gctgagtggagcagtcagcgct

SEQ ID NO: 7381066 - DNA, 17 bp, Homo sapiens
gctgagtgcagggagtc

SEQ ID NO: 7381067 - DNA, 22 bp, Homo sapiens
gctctgtggtggggcagagttt

SEQ ID NO: 7381068 - DNA, 22 bp, Homo sapiens
gctagaggcaacaactttatag

SEQ ID NO: 7381069 - DNA, 22 bp, Homo sapiens
gctagcctgcagtggctatggt

SEQ ID NO: 7381070 - DNA, 22 bp, Homo sapiens
gctagcctgcagtggctatggt

SEQ ID NO: 7381071 - DNA, 22 bp, Homo sapiens
gctagcctccattttattacta

SEQ ID NO: 7381072 - DNA, 22 bp, Homo sapiens
gctcagtgaatttttgcccatg

SEQ ID NO: 7381073 - DNA, 20 bp, Homo sapiens
gctcagtggagaaatgcacc

SEQ ID NO: 7381074 - DNA, 22 bp, Homo sapiens
gctcagggcctggctgcggact

SEQ ID NO: 7381075 - DNA, 22 bp, Homo sapiens
gctcagggcgcgagggacgtgg

SEQ ID NO: 7381076 - DNA, 22 bp, Homo sapiens
gctcagggagtttcacagtgta

SEQ ID NO: 7381077 - DNA, 22 bp, Homo sapiens
gctcagggccatggaccagcag

SEQ ID NO: 7381078 - DNA, 22 bp, Homo sapiens
gctcagggagtttcacagtgta

SEQ ID NO: 7381079 - DNA, 22 bp, Homo sapiens
gctcagggagagagggcagccg

SEQ ID NO: 7381080 - DNA, 22 bp, Homo sapiens
gctaggttggggaagttctcct

SEQ ID NO: 7381081 - DNA, 22 bp, Homo sapiens
gctctgtatgagggtgagagat

SEQ ID NO: 7381082 - DNA, 20 bp, Homo sapiens
gctctgtctggcctactttt

SEQ ID NO: 7381083 - DNA, 22 bp, Homo sapiens
gctctgtccagcgtgcacagaa

SEQ ID NO: 7381084 - DNA, 22 bp, Homo sapiens
gctcccaggatgaggagccagg

SEQ ID NO: 7381085 - DNA, 22 bp, Homo sapiens
gctccccttggtcctcctggga

SEQ ID NO: 7381086 - DNA, 20 bp, Homo sapiens
gctccccttctctgggcctc

SEQ ID NO: 7381087 - DNA, 22 bp, Homo sapiens
gctctccaggtccaagaatcca

SEQ ID NO: 7381088 - DNA, 21 bp, Homo sapiens
gctctccagggccagcccagg

SEQ ID NO: 7381089 - DNA, 19 bp, Homo sapiens
gctctccctctcagttgag

SEQ ID NO: 7381090 - DNA, 22 bp, Homo sapiens
ggaggcaaagcactttgcttgg

SEQ ID NO: 7381091 - DNA, 22 bp, Homo sapiens
ggaggcaacacagggtgtgttt

SEQ ID NO: 7381092 - DNA, 22 bp, Homo sapiens
ggaggcaacatgcttgtttcta

SEQ ID NO: 7381093 - DNA, 17 bp, Homo sapiens
ggaggcaacagacaggg

SEQ ID NO: 7381094 - DNA, 22 bp, Homo sapiens
ggaggcacacctcagactggga

SEQ ID NO: 7381095 - DNA, 22 bp, Homo sapiens
ggaggaggggtttacattggaa

SEQ ID NO: 7381096 - DNA, 23 bp, Homo sapiens
ggaggagttcccagccctcctgg

SEQ ID NO: 7381097 - DNA, 22 bp, Homo sapiens
ggcacctggtaagtgctcagta

SEQ ID NO: 7381098 - DNA, 22 bp, Homo sapiens
ggcacctgtctgctcacagtga

SEQ ID NO: 7381099 - DNA, 22 bp, Homo sapiens
ggcacctgtgtaagatctggaa

SEQ ID NO: 7381100 - DNA, 22 bp, Homo sapiens
ggcacctggtaagtgctcagta

SEQ ID NO: 7381101 - DNA, 22 bp, Homo sapiens
ggcacctggatgtagcagtgaa

SEQ ID NO: 7381102 - DNA, 22 bp, Homo sapiens
ggcacctggaggtttactggat

SEQ ID NO: 7381103 - DNA, 22 bp, Homo sapiens
ggcacctctgggctctgttagg

SEQ ID NO: 7381104 - DNA, 22 bp, Homo sapiens
ggaggcagaacttcccgtcagt

SEQ ID NO: 7381105 - DNA, 22 bp, Homo sapiens
ggcaccaggctgggcataggcc

SEQ ID NO: 7381106 - DNA, 22 bp, Homo sapiens
ggcactgagcgggctctgagcg

SEQ ID NO: 7381107 - DNA, 22 bp, Homo sapiens
ggcactgagctgccttggggca

SEQ ID NO: 7381108 - DNA, 22 bp, Homo sapiens
ggcactgagaggctcttcctaa

SEQ ID NO: 7381109 - DNA, 21 bp, Homo sapiens
ggcactgagccagatggactc

SEQ ID NO: 7381110 - DNA, 22 bp, Homo sapiens
ggcactgactgtgcagcgcacc

SEQ ID NO: 7381111 - DNA, 22 bp, Homo sapiens
ggcactgagaacaggctgactt

SEQ ID NO: 7381112 - DNA, 22 bp, Homo sapiens
ggcactgacactagcatggcac

SEQ ID NO: 7381113 - DNA, 22 bp, Homo sapiens
ggcactcaataaatgttgccaa

SEQ ID NO: 7381114 - DNA, 22 bp, Homo sapiens
ggcactgaagtgggtgttgggt

SEQ ID NO: 7381115 - DNA, 22 bp, Homo sapiens
ggcactgaatttcttggcatct

SEQ ID NO: 7381116 - DNA, 23 bp, Homo sapiens
ggcactgaagctacaatggtgag

SEQ ID NO: 7381117 - DNA, 22 bp, Homo sapiens
ggcactgaaccaggacacaagc

SEQ ID NO: 7381118 - DNA, 22 bp, Homo sapiens
ggcactgatctgatttccctcc

SEQ ID NO: 7381119 - DNA, 22 bp, Homo sapiens
ggcactgataatgtcctctctc

SEQ ID NO: 7381120 - DNA, 22 bp, Homo sapiens
ggcactgattccattcatgaag

SEQ ID NO: 7381121 - DNA, 22 bp, Homo sapiens
ggcagaggtgaagttcacaagg

SEQ ID NO: 7381122 - DNA, 22 bp, Homo sapiens
ggcagatgttatatgatctgag

SEQ ID NO: 7381123 - DNA, 22 bp, Homo sapiens
ggcagcagaactggccctgtat

SEQ ID NO: 7381124 - DNA, 22 bp, Homo sapiens
ggcagcactgcagcttgttggg

SEQ ID NO: 7381125 - DNA, 22 bp, Homo sapiens
ggcagcaatgctgtgcaggcat

SEQ ID NO: 7381126 - DNA, 22 bp, Homo sapiens
ggcagtgagtcccggagaggcc

SEQ ID NO: 7381127 - DNA, 17 bp, Homo sapiens
ggcagtggaggaagaga

SEQ ID NO: 7381128 - DNA, 21 bp, Homo sapiens
ggcagcctctgtggaagggga

SEQ ID NO: 7381129 - DNA, 23 bp, Homo sapiens
ggcagcctctgactctgctttgc

SEQ ID NO: 7381130 - DNA, 22 bp, Homo sapiens
ggcagcctggagactttgtgaa

SEQ ID NO: 7381131 - DNA, 22 bp, Homo sapiens
ggcagcctcaggttttctttga

SEQ ID NO: 7381132 - DNA, 20 bp, Homo sapiens
ggcagcgggttcgggcgcag

SEQ ID NO: 7381133 - DNA, 22 bp, Homo sapiens
ggcagctagagctctttaaagt

SEQ ID NO: 7381134 - DNA, 22 bp, Homo sapiens
ggcagctcacctctggtccagg

SEQ ID NO: 7381135 - DNA, 21 bp, Homo sapiens
ggcagctcccagtttgggtgt

SEQ ID NO: 7381136 - DNA, 21 bp, Homo sapiens
ggcagctcagcagatggggac

SEQ ID NO: 7381137 - DNA, 20 bp, Homo sapiens
ggcagctcactactttctgt

SEQ ID NO: 7381138 - DNA, 22 bp, Homo sapiens
ggcagctcacgggcatggggtg

SEQ ID NO: 7381139 - DNA, 22 bp, Homo sapiens
ggcagctcacgggcatggggtg

SEQ ID NO: 7381140 - DNA, 22 bp, Homo sapiens
ggcaggcttgatatggggggac

SEQ ID NO: 7381141 - DNA, 22 bp, Homo sapiens
ggcaggctgttcacctgctttt

SEQ ID NO: 7381142 - DNA, 20 bp, Homo sapiens
ggcaggctttatatggaggg

SEQ ID NO: 7381143 - DNA, 21 bp, Homo sapiens
ggccacagttagggctcagga

SEQ ID NO: 7381144 - DNA, 22 bp, Homo sapiens
ggccacagtgggaaatcctggg

SEQ ID NO: 7381145 - DNA, 22 bp, Homo sapiens
ggccacagcagatgcttcagat

SEQ ID NO: 7381146 - DNA, 22 bp, Homo sapiens
ggcagtgggaaataagtgagaa

SEQ ID NO: 7381147 - DNA, 22 bp, Homo sapiens
ggccagctgcctgaccttctgt

SEQ ID NO: 7381148 - DNA, 22 bp, Homo sapiens
ggcccagctctattgaattaca

SEQ ID NO: 7381149 - DNA, 22 bp, Homo sapiens
ggccagctggatgtgggtgacg

SEQ ID NO: 7381150 - DNA, 20 bp, Homo sapiens
ggcccagtgaaccaggacgg

SEQ ID NO: 7381151 - DNA, 22 bp, Homo sapiens
ggcccagtgctgttcacccagt

SEQ ID NO: 7381152 - DNA, 22 bp, Homo sapiens
ggcccagtgtaccccaggcagt

SEQ ID NO: 7381153 - DNA, 22 bp, Homo sapiens
ggcccagtgtaccccaggcagt

SEQ ID NO: 7381154 - DNA, 22 bp, Homo sapiens
ggcccagctgggcggggacacg

SEQ ID NO: 7381155 - DNA, 22 bp, Homo sapiens
ggcccagctgtatattacagtt

SEQ ID NO: 7381156 - DNA, 22 bp, Homo sapiens
ggcccagctttcattccttgct

SEQ ID NO: 7381157 - DNA, 22 bp, Homo sapiens
ggcccagctgtgcttccagccc

SEQ ID NO: 7381158 - DNA, 22 bp, Homo sapiens
ggcccaggatgcaagaactgaa

SEQ ID NO: 7381159 - DNA, 22 bp, Homo sapiens
ggcccaggatgcaagaactgaa

SEQ ID NO: 7381160 - DNA, 22 bp, Homo sapiens
ggcctctgcaggcctcgacaag

SEQ ID NO: 7381161 - DNA, 22 bp, Homo sapiens
ggcctctgccccagccacacct

SEQ ID NO: 7381162 - DNA, 22 bp, Homo sapiens
ggcccatgcatcctgtgcagcc

SEQ ID NO: 7381163 - DNA, 22 bp, Homo sapiens
ggcctctctgagagcagacgtt

SEQ ID NO: 7381164 - DNA, 18 bp, Homo sapiens
ggcctctggactggcagc

SEQ ID NO: 7381165 - DNA, 22 bp, Homo sapiens
ggctcactgcaaactgtgcctc

SEQ ID NO: 7381166 - DNA, 22 bp, Homo sapiens
ggctctgcctgcccagcagcac

SEQ ID NO: 7381167 - DNA, 23 bp, Homo sapiens
ggctctgaggatggagctggtgg

SEQ ID NO: 7381168 - DNA, 22 bp, Homo sapiens
ggctctgaggcagatcgatggg

SEQ ID NO: 7381169 - DNA, 22 bp, Homo sapiens
ggctctgaagggtgacaggttt

SEQ ID NO: 7381170 - DNA, 22 bp, Homo sapiens
ggctctgaattattcctgagtc

SEQ ID NO: 7381171 - DNA, 22 bp, Homo sapiens
ggctcactgcaacttccgcctc

SEQ ID NO: 7381172 - DNA, 22 bp, Homo sapiens
ggctcactgcaacttccgcctc

SEQ ID NO: 7381173 - DNA, 22 bp, Homo sapiens
ggctcagcaatgatgagcccct

SEQ ID NO: 7381174 - DNA, 22 bp, Homo sapiens
ggctctgaaattctcactttta

SEQ ID NO: 7381175 - DNA, 22 bp, Homo sapiens
gggaagagtaactagcccatgt

SEQ ID NO: 7381176 - DNA, 22 bp, Homo sapiens
gggaagagtaactagcccatgt

SEQ ID NO: 7381177 - DNA, 22 bp, Homo sapiens
gggaagagtgtcggttgaagtg

SEQ ID NO: 7381178 - DNA, 22 bp, Homo sapiens
gggaagcaggtgcagctcgcct

SEQ ID NO: 7381179 - DNA, 22 bp, Homo sapiens
gggagatggctcagaggccgcg

SEQ ID NO: 7381180 - DNA, 22 bp, Homo sapiens
gggagccacagtagcagctact

SEQ ID NO: 7381181 - DNA, 23 bp, Homo sapiens
gggagatgggaaatgaaggctct

SEQ ID NO: 7381182 - DNA, 22 bp, Homo sapiens
gggagccacagtagcagctact

SEQ ID NO: 7381183 - DNA, 22 bp, Homo sapiens
gggagccacagtgaggtgcatg

SEQ ID NO: 7381184 - DNA, 22 bp, Homo sapiens
gggagccacagtgaggtgcatg

SEQ ID NO: 7381185 - DNA, 19 bp, Homo sapiens
gggagccagaccctttgct

SEQ ID NO: 7381186 - DNA, 22 bp, Homo sapiens
gggagccagagtcacctagaga

SEQ ID NO: 7381187 - DNA, 22 bp, Homo sapiens
gggagccactcagctgagagtt

SEQ ID NO: 7381188 - DNA, 23 bp, Homo sapiens
gggagccaggacctcgcgcccca

SEQ ID NO: 7381189 - DNA, 22 bp, Homo sapiens
gggagccagcctttgcctataa

SEQ ID NO: 7381190 - DNA, 22 bp, Homo sapiens
gggagccccacctcggtgcccg

SEQ ID NO: 7381191 - DNA, 22 bp, Homo sapiens
gggagccatgctggtcttcttt

SEQ ID NO: 7381192 - DNA, 22 bp, Homo sapiens
gggaagagggagctggaatgat

SEQ ID NO: 7381193 - DNA, 22 bp, Homo sapiens
ggctgcagttgtgtgaaggccg

SEQ ID NO: 7381194 - DNA, 22 bp, Homo sapiens
ggctgcctcagatttgctgact

SEQ ID NO: 7381195 - DNA, 22 bp, Homo sapiens
ggctgcctcctcgagacaggat

SEQ ID NO: 7381196 - DNA, 22 bp, Homo sapiens
ggctgcctcctcgagacaggat

SEQ ID NO: 7381197 - DNA, 22 bp, Homo sapiens
ggctgcctccactgcttgtccc

SEQ ID NO: 7381198 - DNA, 22 bp, Homo sapiens
ggctgcctcccaggagaatctg

SEQ ID NO: 7381199 - DNA, 20 bp, Homo sapiens
ggctgcctccttcctttcct

SEQ ID NO: 7381200 - DNA, 19 bp, Homo sapiens
ggctgcctcctgggagatt

SEQ ID NO: 7381201 - DNA, 22 bp, Homo sapiens
ggctgcctctatttaggatcaa

SEQ ID NO: 7381202 - DNA, 20 bp, Homo sapiens
ggctgcctccttcctttcct

SEQ ID NO: 7381203 - DNA, 22 bp, Homo sapiens
ggctgcctctatttaggatcaa

SEQ ID NO: 7381204 - DNA, 22 bp, Homo sapiens
ggctgcctcctgctgggctgga

SEQ ID NO: 7381205 - DNA, 19 bp, Homo sapiens
ggctgcctcctgggagatt

SEQ ID NO: 7381206 - DNA, 22 bp, Homo sapiens
ggctgcctcctgctgggctgga

SEQ ID NO: 7381207 - DNA, 17 bp, Homo sapiens
ggctgcagtccaggagg

SEQ ID NO: 7381208 - DNA, 22 bp, Homo sapiens
ggctgcctggacctcctctttc

SEQ ID NO: 7381209 - DNA, 22 bp, Homo sapiens
ggctgcctgctcctcctgcacg

SEQ ID NO: 7381210 - DNA, 17 bp, Homo sapiens
ggctggagcagctcccc

SEQ ID NO: 7381211 - DNA, 22 bp, Homo sapiens
ggctgcctgctcaggtgcggcg

SEQ ID NO: 7381212 - DNA, 22 bp, Homo sapiens
ggctgcctgctcaggtgcggcg

SEQ ID NO: 7381213 - DNA, 22 bp, Homo sapiens
ggctgcctgccgcccacttggc

SEQ ID NO: 7381214 - DNA, 22 bp, Homo sapiens
ggctgcctgcctccaagccggg

SEQ ID NO: 7381215 - DNA, 22 bp, Homo sapiens
ggctgcctgaggctgaggcccg

SEQ ID NO: 7381216 - DNA, 22 bp, Homo sapiens
ggctgcctgaggctgaggcccg

SEQ ID NO: 7381217 - DNA, 22 bp, Homo sapiens
ggctgcctgaactttggggaaa

SEQ ID NO: 7381218 - DNA, 22 bp, Homo sapiens
ggctgcctgaactttggggaaa

SEQ ID NO: 7381219 - DNA, 22 bp, Homo sapiens
ggctgcctctttcttagtgtct

SEQ ID NO: 7381220 - DNA, 22 bp, Homo sapiens
ggctgcctgaggcagtgagaga

SEQ ID NO: 7381221 - DNA, 22 bp, Homo sapiens
ggctgcctctggaagctggaga

SEQ ID NO: 7381222 - DNA, 22 bp, Homo sapiens
ggctgcctctgatgtgcagacg

SEQ ID NO: 7381223 - DNA, 22 bp, Homo sapiens
ggctggagtgggctccagagtt

SEQ ID NO: 7381224 - DNA, 21 bp, Homo sapiens
gggcaggtctctgatgtcaac

SEQ ID NO: 7381225 - DNA, 22 bp, Homo sapiens
gggcaggtctgggtcagcctga

SEQ ID NO: 7381226 - DNA, 17 bp, Homo sapiens
gggcagggactcctggg

SEQ ID NO: 7381227 - DNA, 20 bp, Homo sapiens
gggcagagccagccagtccc

SEQ ID NO: 7381228 - DNA, 20 bp, Homo sapiens
gggcagagccagccagtccc

SEQ ID NO: 7381229 - DNA, 18 bp, Homo sapiens
gggatcaggctgcctagg

SEQ ID NO: 7381230 - DNA, 20 bp, Homo sapiens
gggatcaggaaaggaggcta

SEQ ID NO: 7381231 - DNA, 22 bp, Homo sapiens
gggcactgtgctaggtgctgag

SEQ ID NO: 7381232 - DNA, 22 bp, Homo sapiens
gggcactgtacactgtgcatgg

SEQ ID NO: 7381233 - DNA, 19 bp, Homo sapiens
gggatcagcccagggctct

SEQ ID NO: 7381234 - DNA, 20 bp, Homo sapiens
gggatcaggaaaggaggcta

SEQ ID NO: 7381235 - DNA, 22 bp, Homo sapiens
gggatcagcaagccactgcacc

SEQ ID NO: 7381236 - DNA, 22 bp, Homo sapiens
gggatcagaaacatagccctga

SEQ ID NO: 7381237 - DNA, 22 bp, Homo sapiens
gggatcagattccctgtcccaa

SEQ ID NO: 7381238 - DNA, 22 bp, Homo sapiens
gggataggtttggaagaggtgg

SEQ ID NO: 7381239 - DNA, 22 bp, Homo sapiens
gggagtggttgatggtgaaaat

SEQ ID NO: 7381240 - DNA, 22 bp, Homo sapiens
gggagtgggtttggcctaggcc

SEQ ID NO: 7381241 - DNA, 22 bp, Homo sapiens
gggagctatgacactagcacca

SEQ ID NO: 7381242 - DNA, 22 bp, Homo sapiens
gggagctatttatagaggctga

SEQ ID NO: 7381243 - DNA, 22 bp, Homo sapiens
gggagcgggactgcgcaggctt

SEQ ID NO: 7381244 - DNA, 22 bp, Homo sapiens
gggaggttgaggctgcagtgag

SEQ ID NO: 7381245 - DNA, 22 bp, Homo sapiens
gggagtggattatgtggaccca

SEQ ID NO: 7381246 - DNA, 22 bp, Homo sapiens
gggagtggagagcaatggatga

SEQ ID NO: 7381247 - DNA, 22 bp, Homo sapiens
gggagtcagtgaaggagtcaga

SEQ ID NO: 7381248 - DNA, 22 bp, Homo sapiens
gggctcagaggagtggcctggg

SEQ ID NO: 7381249 - DNA, 22 bp, Homo sapiens
gggctcagttctgcttcatgct

SEQ ID NO: 7381250 - DNA, 21 bp, Homo sapiens
gggctcagcgctcggctcctc

SEQ ID NO: 7381251 - DNA, 22 bp, Homo sapiens
gggctcagctccttccttccta

SEQ ID NO: 7381252 - DNA, 22 bp, Homo sapiens
gggcccaggcctccttccttcc

SEQ ID NO: 7381253 - DNA, 22 bp, Homo sapiens
gggcccagtaccctctgccaag

SEQ ID NO: 7381254 - DNA, 22 bp, Homo sapiens
gggcccctgggaattctgtgat

SEQ ID NO: 7381255 - DNA, 22 bp, Homo sapiens
gggccccactggggctgcctgc

SEQ ID NO: 7381256 - DNA, 22 bp, Homo sapiens
gggcaggtggcagggtctctgg

SEQ ID NO: 7381257 - DNA, 22 bp, Homo sapiens
gggcaggtggcaaagccagagg

SEQ ID NO: 7381258 - DNA, 22 bp, Homo sapiens
gggcaggtgttgtcaatctaat

SEQ ID NO: 7381259 - DNA, 22 bp, Homo sapiens
gggcaggtgtttccaaggtgag

SEQ ID NO: 7381260 - DNA, 22 bp, Homo sapiens
gggccctggggatgtggacgcg

SEQ ID NO: 7381261 - DNA, 22 bp, Homo sapiens
gggccctgggattcagagcaag

SEQ ID NO: 7381262 - DNA, 22 bp, Homo sapiens
gggccctggggatgtggacgcg

SEQ ID NO: 7381263 - DNA, 22 bp, Homo sapiens
gggccctgcctaaggaacacac

SEQ ID NO: 7381264 - DNA, 22 bp, Homo sapiens
gggccctgcgactcgcggcgga

SEQ ID NO: 7381265 - DNA, 22 bp, Homo sapiens
gggccctgcctaaggaacacac

SEQ ID NO: 7381266 - DNA, 22 bp, Homo sapiens
gggccctgccccgtggctctga

SEQ ID NO: 7381267 - DNA, 22 bp, Homo sapiens
gggccctgatctgtgagcgcag

SEQ ID NO: 7381268 - DNA, 22 bp, Homo sapiens
gggccctgccccgtggctctga

SEQ ID NO: 7381269 - DNA, 22 bp, Homo sapiens
gggccctctgcagctgcccagg

SEQ ID NO: 7381270 - DNA, 22 bp, Homo sapiens
gggccctgatctgtgagcgcag

SEQ ID NO: 7381271 - DNA, 22 bp, Homo sapiens
gggcctcacctctccaccgcct

SEQ ID NO: 7381272 - DNA, 19 bp, Homo sapiens
gggcctcacccacacctcc

SEQ ID NO: 7381273 - DNA, 18 bp, Homo sapiens
gggctcacacaggtcatc

SEQ ID NO: 7381274 - DNA, 22 bp, Homo sapiens
gggctcactcatgcaactgcag

SEQ ID NO: 7381275 - DNA, 22 bp, Homo sapiens
gggccctggggcctgatttgca

SEQ ID NO: 7381276 - DNA, 22 bp, Homo sapiens
gggccctgtgatttcttgagga

SEQ ID NO: 7381277 - DNA, 22 bp, Homo sapiens
gggccctggggcctgatttgca

SEQ ID NO: 7381278 - DNA, 22 bp, Homo sapiens
gggccggagctgggtcccgcgc

SEQ ID NO: 7381279 - DNA, 22 bp, Homo sapiens
gggccctgtgatttcttgagga

SEQ ID NO: 7381280 - DNA, 22 bp, Homo sapiens
gtacaaaagttattgcggtttt

SEQ ID NO: 7381281 - DNA, 22 bp, Homo sapiens
gtagtacatgaagcacttggca

SEQ ID NO: 7381282 - DNA, 22 bp, Homo sapiens
gtagtctgaacagtaattttgt

SEQ ID NO: 7381283 - DNA, 22 bp, Homo sapiens
gtaggtatagattctctgagga

SEQ ID NO: 7381284 - DNA, 19 bp, Homo sapiens
gtagtacaattaggacaat

SEQ ID NO: 7381285 - DNA, 22 bp, Homo sapiens
gtagtacagtgagacaatgttt

SEQ ID NO: 7381286 - DNA, 22 bp, Homo sapiens
gtagtacatcgttatgtaatat

SEQ ID NO: 7381287 - DNA, 22 bp, Homo sapiens
gtagtacatgaagcacttggca

SEQ ID NO: 7381288 - DNA, 22 bp, Homo sapiens
gtaggcagaccagtggatgggt

SEQ ID NO: 7381289 - DNA, 22 bp, Homo sapiens
gtaggcaaattatggaacattg

SEQ ID NO: 7381290 - DNA, 22 bp, Homo sapiens
gtattttatggcatgcagtggc

SEQ ID NO: 7381291 - DNA, 22 bp, Homo sapiens
gtattttatggcatgcagtggc

SEQ ID NO: 7381292 - DNA, 22 bp, Homo sapiens
gtatttttaggtaaggaaagta

SEQ ID NO: 7381293 - DNA, 22 bp, Homo sapiens
gtattttatggcctggggccta

SEQ ID NO: 7381294 - DNA, 22 bp, Homo sapiens
gtattttatggcctggggccta

SEQ ID NO: 7381295 - DNA, 22 bp, Homo sapiens
gtagttctgcagtgtcacctga

SEQ ID NO: 7381296 - DNA, 22 bp, Homo sapiens
gtcaaataattttctcaatagt

SEQ ID NO: 7381297 - DNA, 22 bp, Homo sapiens
gtcaaatatatgcaaaactatt

SEQ ID NO: 7381298 - DNA, 22 bp, Homo sapiens
gtatttttcagttaggagctta

SEQ ID NO: 7381299 - DNA, 22 bp, Homo sapiens
gtatttttagtagagtcggggt

SEQ ID NO: 7381300 - DNA, 22 bp, Homo sapiens
gtatttttaggtaaggaaagta

SEQ ID NO: 7381301 - DNA, 22 bp, Homo sapiens
gtccaggcacctcccttgtgct

SEQ ID NO: 7381302 - DNA, 23 bp, Homo sapiens
gtcctctggagagaaaggcagta

SEQ ID NO: 7381303 - DNA, 22 bp, Homo sapiens
gtcctctgtccctggggcacgg

SEQ ID NO: 7381304 - DNA, 22 bp, Homo sapiens
gtcctctgggctttgagcagtc

SEQ ID NO: 7381305 - DNA, 22 bp, Homo sapiens
gtcgtggagctcacagtgtgcc

SEQ ID NO: 7381306 - DNA, 18 bp, Homo sapiens
gtcacctggatcagatta

SEQ ID NO: 7381307 - DNA, 22 bp, Homo sapiens
gtcacctggaggctgattaatg

SEQ ID NO: 7381308 - DNA, 22 bp, Homo sapiens
gtccagaaggaggtcaagttgg

SEQ ID NO: 7381309 - DNA, 22 bp, Homo sapiens
gtccagcccgggctccgccagc

SEQ ID NO: 7381310 - DNA, 22 bp, Homo sapiens
gtccagccctctgcctccaggt

SEQ ID NO: 7381311 - DNA, 22 bp, Homo sapiens
gtccagcccctgactcccaggc

SEQ ID NO: 7381312 - DNA, 22 bp, Homo sapiens
gtctacactgaatttccacaga

SEQ ID NO: 7381313 - DNA, 22 bp, Homo sapiens
gtctcccaatccgggacagcct

SEQ ID NO: 7381314 - DNA, 22 bp, Homo sapiens
gtctttagttgaaacatgtggt

SEQ ID NO: 7381315 - DNA, 22 bp, Homo sapiens
gtctttagagctcctggcatct

SEQ ID NO: 7381316 - DNA, 22 bp, Homo sapiens
gtgaaaaatgatttgttaactg

SEQ ID NO: 7381317 - DNA, 22 bp, Homo sapiens
gtgaaaaatcatcatgacttga

SEQ ID NO: 7381318 - DNA, 22 bp, Homo sapiens
gtgaaaaatcatcatgacttga

SEQ ID NO: 7381319 - DNA, 22 bp, Homo sapiens
gtgaaaaatcatcatgacttga

SEQ ID NO: 7381320 - DNA, 22 bp, Homo sapiens
gtcttttttacaccttacatca

SEQ ID NO: 7381321 - DNA, 22 bp, Homo sapiens
gtctttatttgagattgtcatt

SEQ ID NO: 7381322 - DNA, 22 bp, Homo sapiens
gtgaggagctgacactggggtg

SEQ ID NO: 7381323 - DNA, 22 bp, Homo sapiens
gtgagccaataccatgctgttc

SEQ ID NO: 7381324 - DNA, 22 bp, Homo sapiens
gtgagctggaatagtggagaaa

SEQ ID NO: 7381325 - DNA, 17 bp, Homo sapiens
gtgagctgagtcaggac

SEQ ID NO: 7381326 - DNA, 22 bp, Homo sapiens
gtgagctgttggagtggcagag

SEQ ID NO: 7381327 - DNA, 22 bp, Homo sapiens
gtgccagaggccccaaacaagt

SEQ ID NO: 7381328 - DNA, 22 bp, Homo sapiens
gtgccagagtttgaggacaatt

SEQ ID NO: 7381329 - DNA, 22 bp, Homo sapiens
gtgccagagacatgactagctg

SEQ ID NO: 7381330 - DNA, 22 bp, Homo sapiens
gtgccagagattcctaaacttt

SEQ ID NO: 7381331 - DNA, 22 bp, Homo sapiens
gtgccagaaggttcccgctgca

SEQ ID NO: 7381332 - DNA, 22 bp, Homo sapiens
gtgcaggatctcagaacaagtg

SEQ ID NO: 7381333 - DNA, 22 bp, Homo sapiens
gtgcaggatgttgggaatcagg

SEQ ID NO: 7381334 - DNA, 22 bp, Homo sapiens
gtgcaggagtaggagagggctt

SEQ ID NO: 7381335 - DNA, 22 bp, Homo sapiens
gtgcaggaggtaacatagcaaa

SEQ ID NO: 7381336 - DNA, 22 bp, Homo sapiens
gtgcaggatttatagcccagct

SEQ ID NO: 7381337 - DNA, 23 bp, Homo sapiens
gtgctgcaaaatcggccactgca

SEQ ID NO: 7381338 - DNA, 22 bp, Homo sapiens
gtgctgcagggtcagcaccctc

SEQ ID NO: 7381339 - DNA, 22 bp, Homo sapiens
gtgcccagctccacctcacaga

SEQ ID NO: 7381340 - DNA, 22 bp, Homo sapiens
ggggaggagccatgtaactagt

SEQ ID NO: 7381341 - DNA, 22 bp, Homo sapiens
ggggaggaagctggaacacggg

SEQ ID NO: 7381342 - DNA, 22 bp, Homo sapiens
ggggaggaagctggaacacggg

SEQ ID NO: 7381343 - DNA, 20 bp, Homo sapiens
ggggcagtggctcatgcctg

SEQ ID NO: 7381344 - DNA, 22 bp, Homo sapiens
ggggccagagaggacccaggtg

SEQ ID NO: 7381345 - DNA, 22 bp, Homo sapiens
ggggccagcaatgttgaggaat

SEQ ID NO: 7381346 - DNA, 22 bp, Homo sapiens
ggggtgggagtgccatccttga

SEQ ID NO: 7381347 - DNA, 22 bp, Homo sapiens
gggtgaggcccatttgaggcca

SEQ ID NO: 7381348 - DNA, 22 bp, Homo sapiens
gggtgcaggcagcccaggcagg

SEQ ID NO: 7381349 - DNA, 18 bp, Homo sapiens
gggtgcaggcactgactg

SEQ ID NO: 7381350 - DNA, 22 bp, Homo sapiens
gggtgcagcagagctcctctgt

SEQ ID NO: 7381351 - DNA, 22 bp, Homo sapiens
ggttcacactttcatgatttca

SEQ ID NO: 7381352 - DNA, 22 bp, Homo sapiens
ggttagagggcatgcgatcttt

SEQ ID NO: 7381353 - DNA, 22 bp, Homo sapiens
ggttatcagttcacttatgtaa

SEQ ID NO: 7381354 - DNA, 22 bp, Homo sapiens
gtaattttggagtataacctgg

SEQ ID NO: 7381355 - DNA, 22 bp, Homo sapiens
gtaatttttagttcattctatc

SEQ ID NO: 7381356 - DNA, 22 bp, Homo sapiens
gtaatttttagttcattctatc

SEQ ID NO: 7381357 - DNA, 17 bp, Homo sapiens
ggttcagttctgcattc

SEQ ID NO: 7381358 - DNA, 22 bp, Homo sapiens
ggtggggattcctgatcactgt

SEQ ID NO: 7381359 - DNA, 22 bp, Homo sapiens
ggtggggagtcaggcattcttg

SEQ ID NO: 7381360 - DNA, 22 bp, Homo sapiens
ggtggcagagacataggacata

SEQ ID NO: 7381361 - DNA, 22 bp, Homo sapiens
ggtggcagagaggaggtagttt

SEQ ID NO: 7381362 - DNA, 22 bp, Homo sapiens
ggtaaaaatcacaaatacttta

SEQ ID NO: 7381363 - DNA, 22 bp, Homo sapiens
ggtcccagctggtcactgtcag

SEQ ID NO: 7381364 - DNA, 22 bp, Homo sapiens
ggtccccccatggtgagcactg

SEQ ID NO: 7381365 - DNA, 23 bp, Homo sapiens
ggtcccagtggagaggcctcacc

SEQ ID NO: 7381366 - DNA, 22 bp, Homo sapiens
ggtcccagtcctctccctgcta

SEQ ID NO: 7381367 - DNA, 22 bp, Homo sapiens
ggtgagcaaagcttcatctgta

SEQ ID NO: 7381368 - DNA, 22 bp, Homo sapiens
ggtgacagcgggtcaagaggag

SEQ ID NO: 7381369 - DNA, 22 bp, Homo sapiens
ggtccctggaaggcactagtga

SEQ ID NO: 7381370 - DNA, 22 bp, Homo sapiens
ggtgacagccgcttggcgctag

SEQ ID NO: 7381371 - DNA, 21 bp, Homo sapiens
ggtgacacgtggccccgctct

SEQ ID NO: 7381372 - DNA, 22 bp, Homo sapiens
ggtgaggaattggggactgacc

SEQ ID NO: 7381373 - DNA, 22 bp, Homo sapiens
ggtgaggaaagatggtgacagt

SEQ ID NO: 7381374 - DNA, 22 bp, Homo sapiens
ggtgagcaaagcttcatctgta

SEQ ID NO: 7381375 - DNA, 22 bp, Homo sapiens
ggtggaagccttcagaacagca

SEQ ID NO: 7381376 - DNA, 22 bp, Homo sapiens
tccctctgctagtgcttgagct

SEQ ID NO: 7381377 - DNA, 19 bp, Homo sapiens
tccctcagtctgccaggcc

SEQ ID NO: 7381378 - DNA, 20 bp, Homo sapiens
tcccaggctgggctccagct

SEQ ID NO: 7381379 - DNA, 23 bp, Homo sapiens
tcccagggaaggtgagcgaggct

SEQ ID NO: 7381380 - DNA, 23 bp, Homo sapiens
tcccagggaaggtgagcgaggct

SEQ ID NO: 7381381 - DNA, 22 bp, Homo sapiens
tcccagggacaccaagctgttt

SEQ ID NO: 7381382 - DNA, 20 bp, Homo sapiens
tcccaggctccaccctagac

SEQ ID NO: 7381383 - DNA, 21 bp, Homo sapiens
tccctcagacagggtgcctat

SEQ ID NO: 7381384 - DNA, 22 bp, Homo sapiens
tccctcagcaggaactggcctg

SEQ ID NO: 7381385 - DNA, 22 bp, Homo sapiens
tccctcagattggcaattagat

SEQ ID NO: 7381386 - DNA, 22 bp, Homo sapiens
tcccagggactggatgatgcag

SEQ ID NO: 7381387 - DNA, 22 bp, Homo sapiens
tcccagggactctctgccttcc

SEQ ID NO: 7381388 - DNA, 22 bp, Homo sapiens
tcccagggacccagcctgatac

SEQ ID NO: 7381389 - DNA, 22 bp, Homo sapiens
tcccagggacccagcctgatac

SEQ ID NO: 7381390 - DNA, 22 bp, Homo sapiens
tccctggaacagagagacaacg

SEQ ID NO: 7381391 - DNA, 22 bp, Homo sapiens
tccctggacaacagacttcact

SEQ ID NO: 7381392 - DNA, 22 bp, Homo sapiens
tccctggagataacttctggga

SEQ ID NO: 7381393 - DNA, 22 bp, Homo sapiens
tccctggagataacttctggga

SEQ ID NO: 7381394 - DNA, 22 bp, Homo sapiens
tccctggagataacttctggga

SEQ ID NO: 7381395 - DNA, 22 bp, Homo sapiens
tccctggacaacagacttcact

SEQ ID NO: 7381396 - DNA, 22 bp, Homo sapiens
tccctggacagccttgcctggg

SEQ ID NO: 7381397 - DNA, 23 bp, Homo sapiens
tccctggaggcaggtccagggcc

SEQ ID NO: 7381398 - DNA, 22 bp, Homo sapiens
tccctggaggtgtttgctcagg

SEQ ID NO: 7381399 - DNA, 22 bp, Homo sapiens
tccctgggaccggcagctcaca

SEQ ID NO: 7381400 - DNA, 20 bp, Homo sapiens
tcctaaagtcattgaatttc

SEQ ID NO: 7381401 - DNA, 22 bp, Homo sapiens
tccctgggcaagtttactcttc

SEQ ID NO: 7381402 - DNA, 22 bp, Homo sapiens
tcctagctggcctctcaccagc

SEQ ID NO: 7381403 - DNA, 20 bp, Homo sapiens
tcctagcttctctctgtaca

SEQ ID NO: 7381404 - DNA, 19 bp, Homo sapiens
tcctagcacctggcacata

SEQ ID NO: 7381405 - DNA, 22 bp, Homo sapiens
tcctagcttgtcagttctctaa

SEQ ID NO: 7381406 - DNA, 22 bp, Homo sapiens
tcctcaggggtttcaggtgtac

SEQ ID NO: 7381407 - DNA, 22 bp, Homo sapiens
tcctcaggggtttcaggtgtac

SEQ ID NO: 7381408 - DNA, 22 bp, Homo sapiens
tcctcaggtcaaagcaggagaa

SEQ ID NO: 7381409 - DNA, 21 bp, Homo sapiens
tcctcagggccccagagcact

SEQ ID NO: 7381410 - DNA, 19 bp, Homo sapiens
tcctcaggggctcacagac

SEQ ID NO: 7381411 - DNA, 19 bp, Homo sapiens
tcctcaggggctcacagac

SEQ ID NO: 7381412 - DNA, 22 bp, Homo sapiens
tcctcaaatatttacttactga

SEQ ID NO: 7381413 - DNA, 22 bp, Homo sapiens
tcctcaaattagcagatcatag

SEQ ID NO: 7381414 - DNA, 22 bp, Homo sapiens
tcctcaaagttgtataaatatt

SEQ ID NO: 7381415 - DNA, 22 bp, Homo sapiens
tccaggtctggttggacaggtt

SEQ ID NO: 7381416 - DNA, 22 bp, Homo sapiens
tccagggacagcgctggagcta

SEQ ID NO: 7381417 - DNA, 22 bp, Homo sapiens
tccagggacacagagtccttct

SEQ ID NO: 7381418 - DNA, 22 bp, Homo sapiens
tccagggaaggtgtgaggctgg

SEQ ID NO: 7381419 - DNA, 21 bp, Homo sapiens
tccagggaacttctcaggaat

SEQ ID NO: 7381420 - DNA, 22 bp, Homo sapiens
tccagggaagagcagaggctac

SEQ ID NO: 7381421 - DNA, 22 bp, Homo sapiens
tcccagccggtgcctgggtccc

SEQ ID NO: 7381422 - DNA, 22 bp, Homo sapiens
tcccagcctcctgacagttttg

SEQ ID NO: 7381423 - DNA, 22 bp, Homo sapiens
tcccagaggcagttggtaactt

SEQ ID NO: 7381424 - DNA, 22 bp, Homo sapiens
tcccagagcccaagttggagag

SEQ ID NO: 7381425 - DNA, 22 bp, Homo sapiens
tcccagagtattagcaattgct

SEQ ID NO: 7381426 - DNA, 22 bp, Homo sapiens
tcccagccttccttgtggtgaa

SEQ ID NO: 7381427 - DNA, 22 bp, Homo sapiens
tcccagcctttctttctccagc

SEQ ID NO: 7381428 - DNA, 22 bp, Homo sapiens
tcccaggctaccagtgaggtca

SEQ ID NO: 7381429 - DNA, 22 bp, Homo sapiens
tcccaggcgcctggtggggagc

SEQ ID NO: 7381430 - DNA, 22 bp, Homo sapiens
tcccagccttccagtctggttt

SEQ ID NO: 7381431 - DNA, 22 bp, Homo sapiens
tcccagccttatctcccctggc

SEQ ID NO: 7381432 - DNA, 22 bp, Homo sapiens
tcccagcctgacagtgcatcaa

SEQ ID NO: 7381433 - DNA, 22 bp, Homo sapiens
tcccagcctggaccctgccagt

SEQ ID NO: 7381434 - DNA, 22 bp, Homo sapiens
tcccaagatgacacagtggacg

SEQ ID NO: 7381435 - DNA, 22 bp, Homo sapiens
tcccagagacagagcctcctcc

SEQ ID NO: 7381436 - DNA, 22 bp, Homo sapiens
tcccagagacatcatttctccg

SEQ ID NO: 7381437 - DNA, 22 bp, Homo sapiens
tcccagagccaagctatggatg

SEQ ID NO: 7381438 - DNA, 22 bp, Homo sapiens
tccattatacttctgattcaaa

SEQ ID NO: 7381439 - DNA, 22 bp, Homo sapiens
tcctgcagctgaagctcatgtg

SEQ ID NO: 7381440 - DNA, 18 bp, Homo sapiens
tcctgcagcttctatgta

SEQ ID NO: 7381441 - DNA, 22 bp, Homo sapiens
tcctgcaggccagaggggtgag

SEQ ID NO: 7381442 - DNA, 22 bp, Homo sapiens
tcctgcaggcttgagtcctcag

SEQ ID NO: 7381443 - DNA, 22 bp, Homo sapiens
tcctgcaggcctgttcccagta

SEQ ID NO: 7381444 - DNA, 20 bp, Homo sapiens
tcctgcagtcgctagcgccc

SEQ ID NO: 7381445 - DNA, 22 bp, Homo sapiens
tcctgcagtctgcactctgcct

SEQ ID NO: 7381446 - DNA, 22 bp, Homo sapiens
tcctgcaggtggatgattctct

SEQ ID NO: 7381447 - DNA, 22 bp, Homo sapiens
tcctgcagccactgcaggcaga

SEQ ID NO: 7381448 - DNA, 22 bp, Homo sapiens
tcctgcagccaagggtcatcga

SEQ ID NO: 7381449 - DNA, 22 bp, Homo sapiens
tcctgcagagccgccctcaggt

SEQ ID NO: 7381450 - DNA, 22 bp, Homo sapiens
tcctgcagagtcccactgattt

SEQ ID NO: 7381451 - DNA, 22 bp, Homo sapiens
tcctgcagatcaaagcctttga

SEQ ID NO: 7381452 - DNA, 22 bp, Homo sapiens
tcctgcagacctcagtcaggtc

SEQ ID NO: 7381453 - DNA, 22 bp, Homo sapiens
tcctgcagacctcagtcaggtc

SEQ ID NO: 7381454 - DNA, 22 bp, Homo sapiens
tcctgcctgcaatcccagcact

SEQ ID NO: 7381455 - DNA, 22 bp, Homo sapiens
tcctgcctcttgccttcttcac

SEQ ID NO: 7381456 - DNA, 19 bp, Homo sapiens
tcctgaaaacttctggaat

SEQ ID NO: 7381457 - DNA, 22 bp, Homo sapiens
tcctcaggtgactaggtatctt

SEQ ID NO: 7381458 - DNA, 22 bp, Homo sapiens
tcctctggggcgtggtcctgga

SEQ ID NO: 7381459 - DNA, 22 bp, Homo sapiens
tcctcttctgcctatatctgcc

SEQ ID NO: 7381460 - DNA, 22 bp, Homo sapiens
tcctctttctcaacattagtta

SEQ ID NO: 7381461 - DNA, 20 bp, Homo sapiens
tcctgagcctccaccatgtc

SEQ ID NO: 7381462 - DNA, 22 bp, Homo sapiens
tcctgagaggtttataacgcag

SEQ ID NO: 7381463 - DNA, 22 bp, Homo sapiens
tcctgagatgagacagtgctgc

SEQ ID NO: 7381464 - DNA, 22 bp, Homo sapiens
tcagggccggggctgtggcgag

SEQ ID NO: 7381465 - DNA, 22 bp, Homo sapiens
tcagggctgcatacaggagata

SEQ ID NO: 7381466 - DNA, 22 bp, Homo sapiens
tcagggctgcatacaggagata

SEQ ID NO: 7381467 - DNA, 22 bp, Homo sapiens
tcagggctgactgctactctcc

SEQ ID NO: 7381468 - DNA, 22 bp, Homo sapiens
tcagggctcaccagcctctgcc

SEQ ID NO: 7381469 - DNA, 22 bp, Homo sapiens
tcagggctcagcatctggcatt

SEQ ID NO: 7381470 - DNA, 22 bp, Homo sapiens
tcagtatagctaaaagtttgtc

SEQ ID NO: 7381471 - DNA, 22 bp, Homo sapiens
tcagtataattgctggcactga

SEQ ID NO: 7381472 - DNA, 22 bp, Homo sapiens
tcaggagacttatgtcacagtg

SEQ ID NO: 7381473 - DNA, 22 bp, Homo sapiens
tcaggctgttagccacctcctc

SEQ ID NO: 7381474 - DNA, 22 bp, Homo sapiens
tcagtgtttcctgtggtacagc

SEQ ID NO: 7381475 - DNA, 22 bp, Homo sapiens
tcagtgtttgtggcaaatgtta

SEQ ID NO: 7381476 - DNA, 22 bp, Homo sapiens
tcagtgtttttaaagcaatata

SEQ ID NO: 7381477 - DNA, 22 bp, Homo sapiens
tcagtgttgtgcacatacaaaa

SEQ ID NO: 7381478 - DNA, 22 bp, Homo sapiens
tcagtgtttattcaatgttatt

SEQ ID NO: 7381479 - DNA, 22 bp, Homo sapiens
tcagtgttgaattttttgcaaa

SEQ ID NO: 7381480 - DNA, 22 bp, Homo sapiens
tcagtgttggagataattgcac

SEQ ID NO: 7381481 - DNA, 22 bp, Homo sapiens
tcatacataacttgtacagtga

SEQ ID NO: 7381482 - DNA, 22 bp, Homo sapiens
tcatacattcagcagatatttg

SEQ ID NO: 7381483 - DNA, 22 bp, Homo sapiens
tcatacattcagcagatatttg

SEQ ID NO: 7381484 - DNA, 22 bp, Homo sapiens
tcatacattcagcagatatttg

SEQ ID NO: 7381485 - DNA, 22 bp, Homo sapiens
tcatagaaatggaaagtatatt

SEQ ID NO: 7381486 - DNA, 22 bp, Homo sapiens
tcatagaatgagttaatgaact

SEQ ID NO: 7381487 - DNA, 22 bp, Homo sapiens
tcatctttgtatccctaacaca

SEQ ID NO: 7381488 - DNA, 22 bp, Homo sapiens
tcatctttcctcaaaagatcca

SEQ ID NO: 7381489 - DNA, 22 bp, Homo sapiens
tcatctttaccccttgcttcaa

SEQ ID NO: 7381490 - DNA, 22 bp, Homo sapiens
tcatgaaaatagatcagaaatt

SEQ ID NO: 7381491 - DNA, 22 bp, Homo sapiens
tccaaacgggagccaaatgagc

SEQ ID NO: 7381492 - DNA, 22 bp, Homo sapiens
tccaaagaacattgctgagacc

SEQ ID NO: 7381493 - DNA, 21 bp, Homo sapiens
tccaaaggagactgagtgtgt

SEQ ID NO: 7381494 - DNA, 21 bp, Homo sapiens
tccaaaaaggagcgtccttct

SEQ ID NO: 7381495 - DNA, 22 bp, Homo sapiens
tcatttttttccggtaggaata

SEQ ID NO: 7381496 - DNA, 22 bp, Homo sapiens
tcatttttctcttacacgtaga

SEQ ID NO: 7381497 - DNA, 22 bp, Homo sapiens
tcatttgtacttgtgtgcttgt

SEQ ID NO: 7381498 - DNA, 21 bp, Homo sapiens
tcatttgtgatctgatttcca

SEQ ID NO: 7381499 - DNA, 22 bp, Homo sapiens
tcatttgtggaagtgattgtgg

SEQ ID NO: 7381500 - DNA, 19 bp, Homo sapiens
tcatttgttagtagaagtt

SEQ ID NO: 7381501 - DNA, 22 bp, Homo sapiens
tcatttgtgtgagtgatttgac

SEQ ID NO: 7381502 - DNA, 22 bp, Homo sapiens
tcatttgttcatctgctcttct

SEQ ID NO: 7381503 - DNA, 22 bp, Homo sapiens
tccaaggagtcttaagttacat

SEQ ID NO: 7381504 - DNA, 22 bp, Homo sapiens
tccaaattgacagtagtgatta

SEQ ID NO: 7381505 - DNA, 22 bp, Homo sapiens
tccaaattctatgttctttcca

SEQ ID NO: 7381506 - DNA, 22 bp, Homo sapiens
tccaaatttaccttacagatat

SEQ ID NO: 7381507 - DNA, 22 bp, Homo sapiens
tccaaattctatgttctttcca

SEQ ID NO: 7381508 - DNA, 22 bp, Homo sapiens
tccaatatttctcatatatgga

SEQ ID NO: 7381509 - DNA, 17 bp, Homo sapiens
tcatttctaggcactcc

SEQ ID NO: 7381510 - DNA, 22 bp, Homo sapiens
tcatttcagccatttttaaatg

SEQ ID NO: 7381511 - DNA, 22 bp, Homo sapiens
tcatttcagccatttttaaatg

SEQ ID NO: 7381512 - DNA, 23 bp, Homo sapiens
tcatttcacagtgagcttcctag

SEQ ID NO: 7381513 - DNA, 22 bp, Homo sapiens
tcatttatattgtattctgtag

SEQ ID NO: 7381514 - DNA, 22 bp, Homo sapiens
tcatttatattgtattctgtag

SEQ ID NO: 7381515 - DNA, 22 bp, Homo sapiens
tcatttctctgagtctgataat

SEQ ID NO: 7381516 - DNA, 22 bp, Homo sapiens
tcatttctgagccttccatgat

SEQ ID NO: 7381517 - DNA, 22 bp, Homo sapiens
tcatttctgttgtgcatcactg

SEQ ID NO: 7381518 - DNA, 22 bp, Homo sapiens
tcatttaattggttttgctcgt

SEQ ID NO: 7381519 - DNA, 22 bp, Homo sapiens
tcatttacagactgtgtgggtg

SEQ ID NO: 7381520 - DNA, 22 bp, Homo sapiens
tcatttacatagaaacaatata

SEQ ID NO: 7381521 - DNA, 22 bp, Homo sapiens
tcattgttcctatttggcaaga

SEQ ID NO: 7381522 - DNA, 21 bp, Homo sapiens
tcatgcaggcagagtttggta

SEQ ID NO: 7381523 - DNA, 22 bp, Homo sapiens
tcatgcaggtttccagccagat

SEQ ID NO: 7381524 - DNA, 22 bp, Homo sapiens
tcatgcagcttttccattcagc

SEQ ID NO: 7381525 - DNA, 22 bp, Homo sapiens
tcatgcagttactgttatgcaa

SEQ ID NO: 7381526 - DNA, 22 bp, Homo sapiens
tcatgcaggtttccagccagat

SEQ ID NO: 7381527 - DNA, 22 bp, Homo sapiens
tcagaacagaagaaggaacacg

SEQ ID NO: 7381528 - DNA, 22 bp, Homo sapiens
tcagaaaggttctatgttttac

SEQ ID NO: 7381529 - DNA, 22 bp, Homo sapiens
tcagaaagcttagtgtcttgca

SEQ ID NO: 7381530 - DNA, 22 bp, Homo sapiens
tcagaaagctgattcttgatac

SEQ ID NO: 7381531 - DNA, 22 bp, Homo sapiens
tcagaagccaccttttgttggg

SEQ ID NO: 7381532 - DNA, 22 bp, Homo sapiens
tcagaagttaatatataaattt

SEQ ID NO: 7381533 - DNA, 22 bp, Homo sapiens
tcagaatatgctaatgacattt

SEQ ID NO: 7381534 - DNA, 23 bp, Homo sapiens
tcagaagtttggttgtaacatgg

SEQ ID NO: 7381535 - DNA, 22 bp, Homo sapiens
tcactgcaacctccacctcctg

SEQ ID NO: 7381536 - DNA, 22 bp, Homo sapiens
tcactgcatcccatctccagcc

SEQ ID NO: 7381537 - DNA, 22 bp, Homo sapiens
tcactgcaacctccacctcctg

SEQ ID NO: 7381538 - DNA, 22 bp, Homo sapiens
tcactgcgcttcagcctgggtg

SEQ ID NO: 7381539 - DNA, 22 bp, Homo sapiens
tcactgcaacctccacctcctg

SEQ ID NO: 7381540 - DNA, 22 bp, Homo sapiens
tcactgcaacctccacctcctg

SEQ ID NO: 7381541 - DNA, 22 bp, Homo sapiens
tcactgcaacctccacctcccg

SEQ ID NO: 7381542 - DNA, 22 bp, Homo sapiens
tcactgcaacctccacctcccg

SEQ ID NO: 7381543 - DNA, 22 bp, Homo sapiens
tcacatttgcaattgcattgtt

SEQ ID NO: 7381544 - DNA, 22 bp, Homo sapiens
tcacattttagtaccatgattt

SEQ ID NO: 7381545 - DNA, 22 bp, Homo sapiens
tcacatttgttcctctgcactt

SEQ ID NO: 7381546 - DNA, 22 bp, Homo sapiens
tcactgcaacctccacctcccg

SEQ ID NO: 7381547 - DNA, 22 bp, Homo sapiens
tcactgcaacctccacctcccg

SEQ ID NO: 7381548 - DNA, 22 bp, Homo sapiens
tcactgcaacctccacctcccg

SEQ ID NO: 7381549 - DNA, 22 bp, Homo sapiens
tcacagtttcttttctgataaa

SEQ ID NO: 7381550 - DNA, 22 bp, Homo sapiens
tcacagttttagaaaatagata

SEQ ID NO: 7381551 - DNA, 22 bp, Homo sapiens
tcacagtgcaggatcagttaat

SEQ ID NO: 7381552 - DNA, 21 bp, Homo sapiens
tcacatgcttattcctggaat

SEQ ID NO: 7381553 - DNA, 21 bp, Homo sapiens
tcacatttctcatgggtaaat

SEQ ID NO: 7381554 - DNA, 22 bp, Homo sapiens
tcacatttctcagcactgatga

SEQ ID NO: 7381555 - DNA, 22 bp, Homo sapiens
tcacatttatttcaaagttact

SEQ ID NO: 7381556 - DNA, 22 bp, Homo sapiens
tcaacttggagcacatttggct

SEQ ID NO: 7381557 - DNA, 22 bp, Homo sapiens
tcaacctctggagaaatcagga

SEQ ID NO: 7381558 - DNA, 22 bp, Homo sapiens
tcaaccttgtgagaactgagtc

SEQ ID NO: 7381559 - DNA, 22 bp, Homo sapiens
tcaactttagtgtagctattta

SEQ ID NO: 7381560 - DNA, 22 bp, Homo sapiens
tcaacatttatgaagctgtggc

SEQ ID NO: 7381561 - DNA, 22 bp, Homo sapiens
tcaacactaaagaataatcttt

SEQ ID NO: 7381562 - DNA, 22 bp, Homo sapiens
tcagctgccccatgtgttcact

SEQ ID NO: 7381563 - DNA, 22 bp, Homo sapiens
tcagctgccccgggcactgccc

SEQ ID NO: 7381564 - DNA, 22 bp, Homo sapiens
tcagctgcctttcccatgctag

SEQ ID NO: 7381565 - DNA, 22 bp, Homo sapiens
tcagctgcctctccctggaaga

SEQ ID NO: 7381566 - DNA, 22 bp, Homo sapiens
tcagctgctgtggtatgtacat

SEQ ID NO: 7381567 - DNA, 22 bp, Homo sapiens
tcagctgctctgttgagctgaa

SEQ ID NO: 7381568 - DNA, 22 bp, Homo sapiens
tcagctgcttcatgttctgaat

SEQ ID NO: 7381569 - DNA, 22 bp, Homo sapiens
tcagctgcgacaggggcctgag

SEQ ID NO: 7381570 - DNA, 22 bp, Homo sapiens
tcagctgctcaaatttatgtca

SEQ ID NO: 7381571 - DNA, 22 bp, Homo sapiens
tcagcagttttatatgcagctt

SEQ ID NO: 7381572 - DNA, 22 bp, Homo sapiens
tcagcagttgccccctcccagc

SEQ ID NO: 7381573 - DNA, 22 bp, Homo sapiens
tcagcagtgtcagttcccagag

SEQ ID NO: 7381574 - DNA, 22 bp, Homo sapiens
tcagcagtgtgcccagaggctg

SEQ ID NO: 7381575 - DNA, 22 bp, Homo sapiens
tcagcagtgtgcttggaatgga

SEQ ID NO: 7381576 - DNA, 22 bp, Homo sapiens
tcagcagttattcccctacaga

SEQ ID NO: 7381577 - DNA, 22 bp, Homo sapiens
tcagcagttcaaccccgtcaga

SEQ ID NO: 7381578 - DNA, 22 bp, Homo sapiens
tcagccagaggcttcttggttt

SEQ ID NO: 7381579 - DNA, 23 bp, Homo sapiens
tcagctgcttcctcctgcctgcc

SEQ ID NO: 7381580 - DNA, 22 bp, Homo sapiens
tcagcaagaagtcatttgtagc

SEQ ID NO: 7381581 - DNA, 22 bp, Homo sapiens
tcagcagtgggtcctgagggtg

SEQ ID NO: 7381582 - DNA, 22 bp, Homo sapiens
tcagcagtgtagtttatcattc

SEQ ID NO: 7381583 - DNA, 22 bp, Homo sapiens
tcagagttcctcatagatccag

SEQ ID NO: 7381584 - DNA, 22 bp, Homo sapiens
tcagacagaaagatgagtatgg

SEQ ID NO: 7381585 - DNA, 22 bp, Homo sapiens
tcagacagaaggactatttgaa

SEQ ID NO: 7381586 - DNA, 22 bp, Homo sapiens
tcagacagaaggactatttgaa

SEQ ID NO: 7381587 - DNA, 22 bp, Homo sapiens
tcagacaagttgatgtacctgg

SEQ ID NO: 7381588 - DNA, 18 bp, Homo sapiens
tcagacaagttagacagg

SEQ ID NO: 7381589 - DNA, 22 bp, Homo sapiens
tcagacaagtaaaataatgtaa

SEQ ID NO: 7381590 - DNA, 22 bp, Homo sapiens
tcagaattttctggaatggagc

SEQ ID NO: 7381591 - DNA, 21 bp, Homo sapiens
tcagaattacccctggatctg

SEQ ID NO: 7381592 - DNA, 22 bp, Homo sapiens
tagctgcctttgggctcctgct

SEQ ID NO: 7381593 - DNA, 19 bp, Homo sapiens
tagctgcctgttacctcca

SEQ ID NO: 7381594 - DNA, 22 bp, Homo sapiens
tagctgcctagacagctatagc

SEQ ID NO: 7381595 - DNA, 22 bp, Homo sapiens
tagctgcctatgtgataagaga

SEQ ID NO: 7381596 - DNA, 22 bp, Homo sapiens
tagctgccagaccattcttact

SEQ ID NO: 7381597 - DNA, 22 bp, Homo sapiens
tagctgccattgctccaggaag

SEQ ID NO: 7381598 - DNA, 22 bp, Homo sapiens
tagctgcccatctttcctttag

SEQ ID NO: 7381599 - DNA, 17 bp, Homo sapiens
tagctgccccgaatgct

SEQ ID NO: 7381600 - DNA, 22 bp, Homo sapiens
tagctgacgctaaataaatgtt

SEQ ID NO: 7381601 - DNA, 22 bp, Homo sapiens
tagctgccaaaagggtgggcta

SEQ ID NO: 7381602 - DNA, 22 bp, Homo sapiens
tagctgagagctcacttgagga

SEQ ID NO: 7381603 - DNA, 22 bp, Homo sapiens
tagcaacatggttatcacatta

SEQ ID NO: 7381604 - DNA, 22 bp, Homo sapiens
tagcaacaatggaagtaacttc

SEQ ID NO: 7381605 - DNA, 22 bp, Homo sapiens
tagcaaatgtgttatgctatgc

SEQ ID NO: 7381606 - DNA, 22 bp, Homo sapiens
tagcaaatgtgttatgctatgc

SEQ ID NO: 7381607 - DNA, 22 bp, Homo sapiens
tagcaaatgtgttatgctatgc

SEQ ID NO: 7381608 - DNA, 22 bp, Homo sapiens
tagcaagaagggagatggggtt

SEQ ID NO: 7381609 - DNA, 22 bp, Homo sapiens
tagcaaaggatgactatgtacc

SEQ ID NO: 7381610 - DNA, 22 bp, Homo sapiens
tagcaaataaaacagtattgaa

SEQ ID NO: 7381611 - DNA, 22 bp, Homo sapiens
tagcaaataaaacagtattgaa

SEQ ID NO: 7381612 - DNA, 22 bp, Homo sapiens
tagcaaatacatgatgtaattt

SEQ ID NO: 7381613 - DNA, 22 bp, Homo sapiens
tagcaaatgcctggttaattag

SEQ ID NO: 7381614 - DNA, 22 bp, Homo sapiens
tagcaaatgtaaaatgcctaca

SEQ ID NO: 7381615 - DNA, 21 bp, Homo sapiens
tagcaaatggagagtaagaga

SEQ ID NO: 7381616 - DNA, 22 bp, Homo sapiens
tagcaaatgggcttgttttcca

SEQ ID NO: 7381617 - DNA, 22 bp, Homo sapiens
tagatctgatacaattcatctg

SEQ ID NO: 7381618 - DNA, 22 bp, Homo sapiens
tagatctgatacaattcatctg

SEQ ID NO: 7381619 - DNA, 22 bp, Homo sapiens
tagatctgatacaattcatctg

SEQ ID NO: 7381620 - DNA, 22 bp, Homo sapiens
tagatgaccttgtgttaggcaa

SEQ ID NO: 7381621 - DNA, 22 bp, Homo sapiens
tagcaaaagctcaacaggaagg

SEQ ID NO: 7381622 - DNA, 22 bp, Homo sapiens
tagcaaaatgtggatgtagttg

SEQ ID NO: 7381623 - DNA, 22 bp, Homo sapiens
tagcaaaagctcaacaggaagg

SEQ ID NO: 7381624 - DNA, 22 bp, Homo sapiens
tagcaaactcatacatgtgggt

SEQ ID NO: 7381625 - DNA, 22 bp, Homo sapiens
tagcaaaatgtggatgtagttg

SEQ ID NO: 7381626 - DNA, 18 bp, Homo sapiens
tagcaaagatgtggattg

SEQ ID NO: 7381627 - DNA, 22 bp, Homo sapiens
tagcaaagcgaaagagatttat

SEQ ID NO: 7381628 - DNA, 22 bp, Homo sapiens
tagaacatcaggttgaatttgg

SEQ ID NO: 7381629 - DNA, 22 bp, Homo sapiens
tagaacatgctcatgtataaat

SEQ ID NO: 7381630 - DNA, 22 bp, Homo sapiens
tagaacatgtgaaaatatagcc

SEQ ID NO: 7381631 - DNA, 22 bp, Homo sapiens
tagaaatgtaggcttcctgaca

SEQ ID NO: 7381632 - DNA, 22 bp, Homo sapiens
tagaaatgggttacatttagag

SEQ ID NO: 7381633 - DNA, 22 bp, Homo sapiens
tagaaatgggttacatttagag

SEQ ID NO: 7381634 - DNA, 22 bp, Homo sapiens
tagaaatggggaagtagttagg

SEQ ID NO: 7381635 - DNA, 22 bp, Homo sapiens
tagaagattctgccaagagcgc

SEQ ID NO: 7381636 - DNA, 22 bp, Homo sapiens
tagaagattctaaagtggagag

SEQ ID NO: 7381637 - DNA, 22 bp, Homo sapiens
tagaagattccagaggcaaagc

SEQ ID NO: 7381638 - DNA, 22 bp, Homo sapiens
tagaagatgggattcaagtccc

SEQ ID NO: 7381639 - DNA, 22 bp, Homo sapiens
tagaagataagacaagtgctgc

SEQ ID NO: 7381640 - DNA, 22 bp, Homo sapiens
tagactggtgaattagggggaa

SEQ ID NO: 7381641 - DNA, 19 bp, Homo sapiens
tagactctaatgttaagct

SEQ ID NO: 7381642 - DNA, 22 bp, Homo sapiens
tagactctgcatttacctccca

SEQ ID NO: 7381643 - DNA, 22 bp, Homo sapiens
tagactctgcatttacctccca

SEQ ID NO: 7381644 - DNA, 22 bp, Homo sapiens
tagactcttggggaaatctgca

SEQ ID NO: 7381645 - DNA, 23 bp, Homo sapiens
tagactgcaggctccttgagggc

SEQ ID NO: 7381646 - DNA, 22 bp, Homo sapiens
tagatactcagaaatgctttca

SEQ ID NO: 7381647 - DNA, 22 bp, Homo sapiens
tagatacttataatcttccaag

SEQ ID NO: 7381648 - DNA, 22 bp, Homo sapiens
tagatacttattcgttgtttac

SEQ ID NO: 7381649 - DNA, 22 bp, Homo sapiens
tagatacatacattttaaaatg

SEQ ID NO: 7381650 - DNA, 20 bp, Homo sapiens
tagagagatatgggggttcc

SEQ ID NO: 7381651 - DNA, 23 bp, Homo sapiens
tagagaaagccaccgagtctctc

SEQ ID NO: 7381652 - DNA, 22 bp, Homo sapiens
tagagaaataagctttgccttg

SEQ ID NO: 7381653 - DNA, 22 bp, Homo sapiens
tagagaaacagaaccaacaggg

SEQ ID NO: 7381654 - DNA, 21 bp, Homo sapiens
tagagaaaagaagctgttcct

SEQ ID NO: 7381655 - DNA, 22 bp, Homo sapiens
tagtgcatacctaacatttttg

SEQ ID NO: 7381656 - DNA, 22 bp, Homo sapiens
tagtgcaattccccatactaac

SEQ ID NO: 7381657 - DNA, 21 bp, Homo sapiens
tagggggcagtgggatgctta

SEQ ID NO: 7381658 - DNA, 22 bp, Homo sapiens
tagtgcttaacacaaagtgatt

SEQ ID NO: 7381659 - DNA, 22 bp, Homo sapiens
tagtgcttattactgtgctgtc

SEQ ID NO: 7381660 - DNA, 22 bp, Homo sapiens
tagtttcatatgcaaaatagta

SEQ ID NO: 7381661 - DNA, 22 bp, Homo sapiens
tagtttcagattgctttcatat

SEQ ID NO: 7381662 - DNA, 22 bp, Homo sapiens
tagtttatgattttttggaagg

SEQ ID NO: 7381663 - DNA, 22 bp, Homo sapiens
tagtttttactgcgagttataa

SEQ ID NO: 7381664 - DNA, 22 bp, Homo sapiens
tagttctggtatttgctgacaa

SEQ ID NO: 7381665 - DNA, 22 bp, Homo sapiens
tagttcttcatgaattcagctt

SEQ ID NO: 7381666 - DNA, 22 bp, Homo sapiens
tagttgctaaaaagtgcctaac

SEQ ID NO: 7381667 - DNA, 22 bp, Homo sapiens
tagtttagaatgttgcaataca

SEQ ID NO: 7381668 - DNA, 22 bp, Homo sapiens
tagttattattgttactatcag

SEQ ID NO: 7381669 - DNA, 23 bp, Homo sapiens
tagttattttctctgtaatttgc

SEQ ID NO: 7381670 - DNA, 22 bp, Homo sapiens
tagttcaggaagagaaacaaca

SEQ ID NO: 7381671 - DNA, 22 bp, Homo sapiens
tagctgtcagctgcaggcaggc

SEQ ID NO: 7381672 - DNA, 22 bp, Homo sapiens
tagctgtacaaacttgtgcaag

SEQ ID NO: 7381673 - DNA, 22 bp, Homo sapiens
taggcagctgcaaacttcggtc

SEQ ID NO: 7381674 - DNA, 22 bp, Homo sapiens
taggcagccagcatcagttggg

SEQ ID NO: 7381675 - DNA, 22 bp, Homo sapiens
taggcagcgcttggctgtgctt

SEQ ID NO: 7381676 - DNA, 22 bp, Homo sapiens
taggcagcatggattctgaata

SEQ ID NO: 7381677 - DNA, 22 bp, Homo sapiens
taggcagcagtgctatgattct

SEQ ID NO: 7381678 - DNA, 22 bp, Homo sapiens
taggcagattccatattttggc

SEQ ID NO: 7381679 - DNA, 23 bp, Homo sapiens
taggcaggactcagatatgacag

SEQ ID NO: 7381680 - DNA, 22 bp, Homo sapiens
taggcagcttaggttagaagtg

SEQ ID NO: 7381681 - DNA, 20 bp, Homo sapiens
taggcagcttgacccttggt

SEQ ID NO: 7381682 - DNA, 22 bp, Homo sapiens
taggcccagttccgcctcccgg

SEQ ID NO: 7381683 - DNA, 22 bp, Homo sapiens
tcaaataccagcaatttcatgt

SEQ ID NO: 7381684 - DNA, 22 bp, Homo sapiens
tcaaataccagcaatttcatgt

SEQ ID NO: 7381685 - DNA, 22 bp, Homo sapiens
tcaaatacagaagatcctttcc

SEQ ID NO: 7381686 - DNA, 22 bp, Homo sapiens
tcaaatacatggtcaatcaact

SEQ ID NO: 7381687 - DNA, 22 bp, Homo sapiens
tcaaataggcttgtagtgactg

SEQ ID NO: 7381688 - DNA, 22 bp, Homo sapiens
tcaaataggtatgagtagaaat

SEQ ID NO: 7381689 - DNA, 22 bp, Homo sapiens
tcaaatagttgacattaacttg

SEQ ID NO: 7381690 - DNA, 21 bp, Homo sapiens
tcaaatcaggtatcactattg

SEQ ID NO: 7381691 - DNA, 21 bp, Homo sapiens
tcaaatcaggtatcactattg

SEQ ID NO: 7381692 - DNA, 22 bp, Homo sapiens
tcaaatattggctatttcacat

SEQ ID NO: 7381693 - DNA, 22 bp, Homo sapiens
tcaaatgaagacagttgacttg

SEQ ID NO: 7381694 - DNA, 22 bp, Homo sapiens
tcaaagtagccggatggaattt

SEQ ID NO: 7381695 - DNA, 22 bp, Homo sapiens
tcaaagtagagttcagtgcagc

SEQ ID NO: 7381696 - DNA, 22 bp, Homo sapiens
tcaaagtactactcagttcagc

SEQ ID NO: 7381697 - DNA, 22 bp, Homo sapiens
tcaaaggttaactctgttgttc

SEQ ID NO: 7381698 - DNA, 22 bp, Homo sapiens
tcaaataaggagtcatgaccat

SEQ ID NO: 7381699 - DNA, 22 bp, Homo sapiens
tcaaataatgccattcatcatc

SEQ ID NO: 7381700 - DNA, 22 bp, Homo sapiens
tcaaagtattttaactgtatcc

SEQ ID NO: 7381701 - DNA, 22 bp, Homo sapiens
tatttttgcctctcagataaaa

SEQ ID NO: 7381702 - DNA, 22 bp, Homo sapiens
tcaaaaataagatattctggac

SEQ ID NO: 7381703 - DNA, 22 bp, Homo sapiens
tattttgttaataatccagtcc

SEQ ID NO: 7381704 - DNA, 22 bp, Homo sapiens
tattttgagcccctgacatcta

SEQ ID NO: 7381705 - DNA, 22 bp, Homo sapiens
tattttgaggtatttttgagct

SEQ ID NO: 7381706 - DNA, 22 bp, Homo sapiens
tattttgacgattttatgcaaa

SEQ ID NO: 7381707 - DNA, 22 bp, Homo sapiens
tcaaagatagatgttgagaaat

SEQ ID NO: 7381708 - DNA, 22 bp, Homo sapiens
tcaaagagctattcagttgtgg

SEQ ID NO: 7381709 - DNA, 17 bp, Homo sapiens
tcaaagaatgcatgcag

SEQ ID NO: 7381710 - DNA, 22 bp, Homo sapiens
tcaaagaatgttatgagggtag

SEQ ID NO: 7381711 - DNA, 22 bp, Homo sapiens
tcaaagaacatcatctgaaatg

SEQ ID NO: 7381712 - DNA, 22 bp, Homo sapiens
tcaaagaagattaccctcccat

SEQ ID NO: 7381713 - DNA, 20 bp, Homo sapiens
tcaaagaagattcagctcaa

SEQ ID NO: 7381714 - DNA, 22 bp, Homo sapiens
tcaaagaagtgcaaacctcatc

SEQ ID NO: 7381715 - DNA, 22 bp, Homo sapiens
tcaaacttggtaagagaaatac

SEQ ID NO: 7381716 - DNA, 22 bp, Homo sapiens
tcaaaaatggtctttgagctgc

SEQ ID NO: 7381717 - DNA, 22 bp, Homo sapiens
tatttcttgttattctcgttga

SEQ ID NO: 7381718 - DNA, 22 bp, Homo sapiens
tatttgaaggcatacattttga

SEQ ID NO: 7381719 - DNA, 22 bp, Homo sapiens
tatttgaagggagaaagtgcca

SEQ ID NO: 7381720 - DNA, 22 bp, Homo sapiens
tatttgatagagataaatgata

SEQ ID NO: 7381721 - DNA, 22 bp, Homo sapiens
tatttgcaggcttttgtcatgg

SEQ ID NO: 7381722 - DNA, 23 bp, Homo sapiens
tatttgctactggtaattctgga

SEQ ID NO: 7381723 - DNA, 22 bp, Homo sapiens
tatttgcaacataaaactctga

SEQ ID NO: 7381724 - DNA, 22 bp, Homo sapiens
tatttgcaaagaactacactag

SEQ ID NO: 7381725 - DNA, 22 bp, Homo sapiens
tatttggaaggtataaacacaa

SEQ ID NO: 7381726 - DNA, 22 bp, Homo sapiens
tatttggaaatgataaagtact

SEQ ID NO: 7381727 - DNA, 22 bp, Homo sapiens
tatttggaaagtttatctatct

SEQ ID NO: 7381728 - DNA, 23 bp, Homo sapiens
tatttggaaagagggaagaagac

SEQ ID NO: 7381729 - DNA, 22 bp, Homo sapiens
tatttggaaaggacatgtaagt

SEQ ID NO: 7381730 - DNA, 22 bp, Homo sapiens
tatttgctttgctttatagaga

SEQ ID NO: 7381731 - DNA, 22 bp, Homo sapiens
tatttggaaacaattcacatgc

SEQ ID NO: 7381732 - DNA, 22 bp, Homo sapiens
tattttgacgattttatgcaaa

SEQ ID NO: 7381733 - DNA, 22 bp, Homo sapiens
tattttgacgattttatgcaaa

SEQ ID NO: 7381734 - DNA, 23 bp, Homo sapiens
tattttccaaatgatgactacat

SEQ ID NO: 7381735 - DNA, 22 bp, Homo sapiens
tatttggagcctatccatagat

SEQ ID NO: 7381736 - DNA, 22 bp, Homo sapiens
tatttggagataagatttttag

SEQ ID NO: 7381737 - DNA, 23 bp, Homo sapiens
tattacaattggtcttattaaga

SEQ ID NO: 7381738 - DNA, 22 bp, Homo sapiens
tattgtctcacagttttggagg

SEQ ID NO: 7381739 - DNA, 22 bp, Homo sapiens
tattgtctgtttgaatgactat

SEQ ID NO: 7381740 - DNA, 22 bp, Homo sapiens
tattgtctgtttgaatgactat

SEQ ID NO: 7381741 - DNA, 22 bp, Homo sapiens
tattgtctgcaaaggtttataa

SEQ ID NO: 7381742 - DNA, 22 bp, Homo sapiens
tattgtattaaggattcaagta

SEQ ID NO: 7381743 - DNA, 22 bp, Homo sapiens
tattgtgttttctctgtgcgga

SEQ ID NO: 7381744 - DNA, 22 bp, Homo sapiens
tattgttcttcactggtcttat

SEQ ID NO: 7381745 - DNA, 22 bp, Homo sapiens
tattgtgtttgcaagtcctatt

SEQ ID NO: 7381746 - DNA, 22 bp, Homo sapiens
tattgtcttcaactctactttt

SEQ ID NO: 7381747 - DNA, 22 bp, Homo sapiens
tatttaactggaaacacaatga

SEQ ID NO: 7381748 - DNA, 22 bp, Homo sapiens
tatgggtctggaaaatggcttg

SEQ ID NO: 7381749 - DNA, 22 bp, Homo sapiens
tatgtactcatcaactattgaa

SEQ ID NO: 7381750 - DNA, 22 bp, Homo sapiens
tatgtactctaatttgtctcat

SEQ ID NO: 7381751 - DNA, 22 bp, Homo sapiens
tatggttatcctcaaaagagga

SEQ ID NO: 7381752 - DNA, 22 bp, Homo sapiens
tatggaaagggagtttaatttg

SEQ ID NO: 7381753 - DNA, 22 bp, Homo sapiens
tatggaaaaatgtatcttgtca

SEQ ID NO: 7381754 - DNA, 22 bp, Homo sapiens
tatggaaactaattcatttttc

SEQ ID NO: 7381755 - DNA, 22 bp, Homo sapiens
tatggaaactaattcatttttc

SEQ ID NO: 7381756 - DNA, 20 bp, Homo sapiens
tatgctttttataagattga

SEQ ID NO: 7381757 - DNA, 22 bp, Homo sapiens
tatggaaaaatgtatcttgtca

SEQ ID NO: 7381758 - DNA, 22 bp, Homo sapiens
tatgctttaacattaaacaaca

SEQ ID NO: 7381759 - DNA, 22 bp, Homo sapiens
tattaacacgtataaagtgttt

SEQ ID NO: 7381760 - DNA, 22 bp, Homo sapiens
tatgtcaactgtgctggttaat

SEQ ID NO: 7381761 - DNA, 22 bp, Homo sapiens
tatgtattctgagtacaagttc

SEQ ID NO: 7381762 - DNA, 22 bp, Homo sapiens
tatgtatatatgttgggtagaa

SEQ ID NO: 7381763 - DNA, 22 bp, Homo sapiens
tatgtatccgtgtgtgtacaga

SEQ ID NO: 7381764 - DNA, 22 bp, Homo sapiens
tatgtatatgtgtgttgacaac

SEQ ID NO: 7381765 - DNA, 22 bp, Homo sapiens
tatgtagcaatagcatcatact

SEQ ID NO: 7381766 - DNA, 18 bp, Homo sapiens
tatgtataacatagttca

SEQ ID NO: 7381767 - DNA, 22 bp, Homo sapiens
tatgtatagagtcttttaaatt

SEQ ID NO: 7381768 - DNA, 22 bp, Homo sapiens
tatgtataatcacagagtgtca

SEQ ID NO: 7381769 - DNA, 22 bp, Homo sapiens
tatgaaaatttagctgaagcat

SEQ ID NO: 7381770 - DNA, 22 bp, Homo sapiens
tatcttttgagttctcaagatg

SEQ ID NO: 7381771 - DNA, 22 bp, Homo sapiens
tatcattttactgtgacatttt

SEQ ID NO: 7381772 - DNA, 22 bp, Homo sapiens
tatcattttactgtgacatttt

SEQ ID NO: 7381773 - DNA, 22 bp, Homo sapiens
tatccaaagagattcatgttct

SEQ ID NO: 7381774 - DNA, 22 bp, Homo sapiens
tatccaaaggaacaatcacagc

SEQ ID NO: 7381775 - DNA, 22 bp, Homo sapiens
tatgaaatttaaacacagatca

SEQ ID NO: 7381776 - DNA, 22 bp, Homo sapiens
tatgaaatttaaacacagatca

SEQ ID NO: 7381777 - DNA, 22 bp, Homo sapiens
tatgaaatttaaacacagatca

SEQ ID NO: 7381778 - DNA, 22 bp, Homo sapiens
tatgaaattgccatttttatgg

SEQ ID NO: 7381779 - DNA, 22 bp, Homo sapiens
tataaagtgtgaactgtgagta

SEQ ID NO: 7381780 - DNA, 22 bp, Homo sapiens
tataaagttggggctgaagtaa

SEQ ID NO: 7381781 - DNA, 22 bp, Homo sapiens
tataaagtgtgaactgtgagta

SEQ ID NO: 7381782 - DNA, 22 bp, Homo sapiens
tataaagctgactcatgaaact

SEQ ID NO: 7381783 - DNA, 22 bp, Homo sapiens
tataaactcctcttgcattcct

SEQ ID NO: 7381784 - DNA, 22 bp, Homo sapiens
tataaagaaatgatttccagaa

SEQ ID NO: 7381785 - DNA, 22 bp, Homo sapiens
tataaaatggcatcagctccaa

SEQ ID NO: 7381786 - DNA, 22 bp, Homo sapiens
tataaaattctcagtttggggt

SEQ ID NO: 7381787 - DNA, 22 bp, Homo sapiens
tatcacatttggagatttatga

SEQ ID NO: 7381788 - DNA, 22 bp, Homo sapiens
tatcacatcaatgttttaaaat

SEQ ID NO: 7381789 - DNA, 22 bp, Homo sapiens
tatcagatatagcattcactgg

SEQ ID NO: 7381790 - DNA, 22 bp, Homo sapiens
tatcagcaccgcggacagcatc

SEQ ID NO: 7381791 - DNA, 22 bp, Homo sapiens
tatcatttaacagaatcattgc

SEQ ID NO: 7381792 - DNA, 22 bp, Homo sapiens
gtttgtcaggaggttgaagtca

SEQ ID NO: 7381793 - DNA, 22 bp, Homo sapiens
gtttgcagttgtcatcctcctg

SEQ ID NO: 7381794 - DNA, 22 bp, Homo sapiens
gtttcacagcaaagttccctgt

SEQ ID NO: 7381795 - DNA, 22 bp, Homo sapiens
gtttgaaaaaagcagtatgtaa

SEQ ID NO: 7381796 - DNA, 22 bp, Homo sapiens
gtttcttatttcaactggaaca

SEQ ID NO: 7381797 - DNA, 22 bp, Homo sapiens
gttgaaaatacagattcctagg

SEQ ID NO: 7381798 - DNA, 22 bp, Homo sapiens
gttcttttggtagagtgtgcat

SEQ ID NO: 7381799 - DNA, 19 bp, Homo sapiens
gttcttttcacctctgtgc

SEQ ID NO: 7381800 - DNA, 19 bp, Homo sapiens
gttcttttcacctctgtgc

SEQ ID NO: 7381801 - DNA, 22 bp, Homo sapiens
gttcttctcttgtaatggaatc

SEQ ID NO: 7381802 - DNA, 22 bp, Homo sapiens
gtttatattcaacggagtatct

SEQ ID NO: 7381803 - DNA, 22 bp, Homo sapiens
gttgagagttaagcgggctaat

SEQ ID NO: 7381804 - DNA, 22 bp, Homo sapiens
gtttattaactgtcaagtgatt

SEQ ID NO: 7381805 - DNA, 22 bp, Homo sapiens
gtttattatacaacaaaagcta

SEQ ID NO: 7381806 - DNA, 22 bp, Homo sapiens
gtttattatacaacaaaagcta

SEQ ID NO: 7381807 - DNA, 22 bp, Homo sapiens
gtttcaaagcacagctcacatt

SEQ ID NO: 7381808 - DNA, 22 bp, Homo sapiens
gttaaataacctcatgtccgtt

SEQ ID NO: 7381809 - DNA, 22 bp, Homo sapiens
gttaaatgcagattctgactca

SEQ ID NO: 7381810 - DNA, 22 bp, Homo sapiens
gttaaattcgatgatggataaa

SEQ ID NO: 7381811 - DNA, 20 bp, Homo sapiens
gtgtttcatgtgatacaatg

SEQ ID NO: 7381812 - DNA, 22 bp, Homo sapiens
gttatataagacaaatcagagt

SEQ ID NO: 7381813 - DNA, 22 bp, Homo sapiens
gttatataattcctgtggtagt

SEQ ID NO: 7381814 - DNA, 22 bp, Homo sapiens
gttatataagacaaatcagagt

SEQ ID NO: 7381815 - DNA, 22 bp, Homo sapiens
gttatatatagtatttctctga

SEQ ID NO: 7381816 - DNA, 22 bp, Homo sapiens
gttatatatagtatttctctga

SEQ ID NO: 7381817 - DNA, 22 bp, Homo sapiens
gttatgaaataaatatagatca

SEQ ID NO: 7381818 - DNA, 22 bp, Homo sapiens
gttatattggcagaagagaaga

SEQ ID NO: 7381819 - DNA, 21 bp, Homo sapiens
gttattggttacactgcactt

SEQ ID NO: 7381820 - DNA, 22 bp, Homo sapiens
gttattgggtgcctcaggccct

SEQ ID NO: 7381821 - DNA, 20 bp, Homo sapiens
gttattggtcatttttgcca

SEQ ID NO: 7381822 - DNA, 22 bp, Homo sapiens
gttattggcagcatttcagagt

SEQ ID NO: 7381823 - DNA, 20 bp, Homo sapiens
gttattggaaatattgtgtg

SEQ ID NO: 7381824 - DNA, 22 bp, Homo sapiens
gttattggaaagcctggagggc

SEQ ID NO: 7381825 - DNA, 22 bp, Homo sapiens
gttatttataaggtgtaactcc

SEQ ID NO: 7381826 - DNA, 22 bp, Homo sapiens
gttcttcagtcacatcacagaa

SEQ ID NO: 7381827 - DNA, 22 bp, Homo sapiens
gttctgctgtaatatctctgct

SEQ ID NO: 7381828 - DNA, 22 bp, Homo sapiens
gttctgcttccttgcttgcgca

SEQ ID NO: 7381829 - DNA, 22 bp, Homo sapiens
taagaccaaagttctgtaggga

SEQ ID NO: 7381830 - DNA, 22 bp, Homo sapiens
taagactgtgagctcagagact

SEQ ID NO: 7381831 - DNA, 22 bp, Homo sapiens
taagacatgagactcagccagt

SEQ ID NO: 7381832 - DNA, 22 bp, Homo sapiens
taagacatcctggatgttcaaa

SEQ ID NO: 7381833 - DNA, 22 bp, Homo sapiens
taacatgtccctgattctttgt

SEQ ID NO: 7381834 - DNA, 18 bp, Homo sapiens
taacatgttttcattaag

SEQ ID NO: 7381835 - DNA, 22 bp, Homo sapiens
taacatgtggagagaatggtga

SEQ ID NO: 7381836 - DNA, 22 bp, Homo sapiens
taagacaaatactatttcaaga

SEQ ID NO: 7381837 - DNA, 22 bp, Homo sapiens
taagagcattgtaaaataatct

SEQ ID NO: 7381838 - DNA, 22 bp, Homo sapiens
taagagcagaggttgaataaat

SEQ ID NO: 7381839 - DNA, 22 bp, Homo sapiens
taagagcactgaagtcttctta

SEQ ID NO: 7381840 - DNA, 22 bp, Homo sapiens
taagagattctaaagctactgg

SEQ ID NO: 7381841 - DNA, 22 bp, Homo sapiens
taagagatgcttttctaaataa

SEQ ID NO: 7381842 - DNA, 22 bp, Homo sapiens
taaatgtgtgtagccatctgtg

SEQ ID NO: 7381843 - DNA, 22 bp, Homo sapiens
taaatgtttagtcttatttggg

SEQ ID NO: 7381844 - DNA, 22 bp, Homo sapiens
taacatcaaactgcattttcta

SEQ ID NO: 7381845 - DNA, 22 bp, Homo sapiens
taacatcaaacatgttttaaag

SEQ ID NO: 7381846 - DNA, 22 bp, Homo sapiens
taacagtatagcctaacatttc

SEQ ID NO: 7381847 - DNA, 22 bp, Homo sapiens
taaaagtggataagctgtagga

SEQ ID NO: 7381848 - DNA, 22 bp, Homo sapiens
taaaaggaggttgaagctgtca

SEQ ID NO: 7381849 - DNA, 19 bp, Homo sapiens
taaaaggatgtggaaggat

SEQ ID NO: 7381850 - DNA, 22 bp, Homo sapiens
taaaagattttataggaacaag

SEQ ID NO: 7381851 - DNA, 22 bp, Homo sapiens
taaaaggcacttggatgctgag

SEQ ID NO: 7381852 - DNA, 22 bp, Homo sapiens
taaaaggattagcaggatgggc

SEQ ID NO: 7381853 - DNA, 22 bp, Homo sapiens
taaaaggcaatactagatgagt

SEQ ID NO: 7381854 - DNA, 22 bp, Homo sapiens
taaaacttctcatttttatggt

SEQ ID NO: 7381855 - DNA, 21 bp, Homo sapiens
taaaactgtaactttgtcctg

SEQ ID NO: 7381856 - DNA, 22 bp, Homo sapiens
taaaactgcttggtatggtcta

SEQ ID NO: 7381857 - DNA, 21 bp, Homo sapiens
gttttaagggagaaaacctag

SEQ ID NO: 7381858 - DNA, 22 bp, Homo sapiens
taaatgcaatgtgctttaccag

SEQ ID NO: 7381859 - DNA, 22 bp, Homo sapiens
taaatgatttatgtatgtgaaa

SEQ ID NO: 7381860 - DNA, 22 bp, Homo sapiens
taaatgatttatgtatgtgaaa

SEQ ID NO: 7381861 - DNA, 22 bp, Homo sapiens
taaagcaatttgagcaagttct

SEQ ID NO: 7381862 - DNA, 22 bp, Homo sapiens
taaagcaattactcagtggctt

SEQ ID NO: 7381863 - DNA, 22 bp, Homo sapiens
taaagcaatgaaagttttgcag

SEQ ID NO: 7381864 - DNA, 22 bp, Homo sapiens
taaagcaaggaatagagtagtc

SEQ ID NO: 7381865 - DNA, 22 bp, Homo sapiens
taaagcaaggaatagagtagtc

SEQ ID NO: 7381866 - DNA, 22 bp, Homo sapiens
taaagatgttctcatttcatag

SEQ ID NO: 7381867 - DNA, 23 bp, Homo sapiens
taaagcaaagtcaagtgcactcc

SEQ ID NO: 7381868 - DNA, 22 bp, Homo sapiens
taaagcaaaaatgaactgccat

SEQ ID NO: 7381869 - DNA, 22 bp, Homo sapiens
taaagattgctcaaaactgtga

SEQ ID NO: 7381870 - DNA, 22 bp, Homo sapiens
tacacacatgcatttgccttat

SEQ ID NO: 7381871 - DNA, 22 bp, Homo sapiens
tacacacagaggccatgggatt

SEQ ID NO: 7381872 - DNA, 22 bp, Homo sapiens
tacacacagaggccatgggatt

SEQ ID NO: 7381873 - DNA, 22 bp, Homo sapiens
tacacataaaatgctcatggta

SEQ ID NO: 7381874 - DNA, 20 bp, Homo sapiens
tacagaatgcaataaaatgg

SEQ ID NO: 7381875 - DNA, 22 bp, Homo sapiens
tacacataggagggtaataaaa

SEQ ID NO: 7381876 - DNA, 22 bp, Homo sapiens
tacacataggtctgaataaaaa

SEQ ID NO: 7381877 - DNA, 22 bp, Homo sapiens
tacagaattagattattagaga

SEQ ID NO: 7381878 - DNA, 22 bp, Homo sapiens
tacagaatgtgtatcattacca

SEQ ID NO: 7381879 - DNA, 22 bp, Homo sapiens
tacacaatgacttaagatgtca

SEQ ID NO: 7381880 - DNA, 22 bp, Homo sapiens
tacaagataagaattggcaagg

SEQ ID NO: 7381881 - DNA, 22 bp, Homo sapiens
tacaacttacttgaatggcttt

SEQ ID NO: 7381882 - DNA, 22 bp, Homo sapiens
tacaacattgtgttgcttcata

SEQ ID NO: 7381883 - DNA, 22 bp, Homo sapiens
tacaacatttacgttaggctgt

SEQ ID NO: 7381884 - DNA, 22 bp, Homo sapiens
tacaagaaatttctgcatatat

SEQ ID NO: 7381885 - DNA, 22 bp, Homo sapiens
tacaagaaactacatgaatgca

SEQ ID NO: 7381886 - DNA, 22 bp, Homo sapiens
tacaacattgtgttgcttcata

SEQ ID NO: 7381887 - DNA, 22 bp, Homo sapiens
tacaacatgtggtcctttatga

SEQ ID NO: 7381888 - DNA, 22 bp, Homo sapiens
tacaacatgtaaagtggtttaa

SEQ ID NO: 7381889 - DNA, 22 bp, Homo sapiens
tacaacataacgggcattcagt

SEQ ID NO: 7381890 - DNA, 21 bp, Homo sapiens
taatttattcagcacagtgtt

SEQ ID NO: 7381891 - DNA, 22 bp, Homo sapiens
taagccatcatcatggctttgg

SEQ ID NO: 7381892 - DNA, 22 bp, Homo sapiens
taagccatacatttcagactct

SEQ ID NO: 7381893 - DNA, 22 bp, Homo sapiens
taaggaaagtgccatgatttct

SEQ ID NO: 7381894 - DNA, 22 bp, Homo sapiens
taaggaaaatggacatcaaaca

SEQ ID NO: 7381895 - DNA, 22 bp, Homo sapiens
taaggaaaatggacatcaaaca

SEQ ID NO: 7381896 - DNA, 21 bp, Homo sapiens
taatataggttcacaactagt

SEQ ID NO: 7381897 - DNA, 22 bp, Homo sapiens
taatatatacctttgttaggaa

SEQ ID NO: 7381898 - DNA, 22 bp, Homo sapiens
taaggagagaatttagaggttt

SEQ ID NO: 7381899 - DNA, 22 bp, Homo sapiens
taaggaggcagtcattatcagg

SEQ ID NO: 7381900 - DNA, 22 bp, Homo sapiens
taaggacattggttttgagtaa

SEQ ID NO: 7381901 - DNA, 22 bp, Homo sapiens
taaggaggcgaggtggtgagca

SEQ ID NO: 7381902 - DNA, 22 bp, Homo sapiens
taaggaggctgctgtgaagaaa

SEQ ID NO: 7381903 - DNA, 22 bp, Homo sapiens
taaggaggtgcccactctcagg

SEQ ID NO: 7381904 - DNA, 22 bp, Homo sapiens
taaggagggggaatgattggca

SEQ ID NO: 7381905 - DNA, 22 bp, Homo sapiens
taaggaggttggtgggttggat

SEQ ID NO: 7381906 - DNA, 21 bp, Homo sapiens
taatcttcgaaaatgtattag

SEQ ID NO: 7381907 - DNA, 22 bp, Homo sapiens
taatctgtaatttttgcaatag

SEQ ID NO: 7381908 - DNA, 22 bp, Homo sapiens
taatctgtattcctactttgca

SEQ ID NO: 7381909 - DNA, 22 bp, Homo sapiens
taatctgttaatatttgtatcc

SEQ ID NO: 7381910 - DNA, 22 bp, Homo sapiens
taatctgttgttaatattgact

SEQ ID NO: 7381911 - DNA, 22 bp, Homo sapiens
taattattctagtcacatagca

SEQ ID NO: 7381912 - DNA, 22 bp, Homo sapiens
taattattctagtcacatagca

SEQ ID NO: 7381913 - DNA, 22 bp, Homo sapiens
taattattatgacaacaattgc

SEQ ID NO: 7381914 - DNA, 22 bp, Homo sapiens
taattattatgacaacaattgc

SEQ ID NO: 7381915 - DNA, 22 bp, Homo sapiens
taattattatgacaacaattgc

SEQ ID NO: 7381916 - DNA, 23 bp, Homo sapiens
taatatcctgcaatgcacagaac

SEQ ID NO: 7381917 - DNA, 22 bp, Homo sapiens
taattatttgaagacattagag

SEQ ID NO: 7381918 - DNA, 22 bp, Homo sapiens
taattatttgaagacattagag

SEQ ID NO: 7381919 - DNA, 22 bp, Homo sapiens
taattattgtctgaagagttat

SEQ ID NO: 7381920 - DNA, 22 bp, Homo sapiens
taattccttaagctgaagactt

SEQ ID NO: 7381921 - DNA, 22 bp, Homo sapiens
taattgcagggtgtcagaatac

SEQ ID NO: 7381922 - DNA, 22 bp, Homo sapiens
taattgcagggtgtcagaatac

SEQ ID NO: 7381923 - DNA, 22 bp, Homo sapiens
taattgcagctatcattttagt

SEQ ID NO: 7381924 - DNA, 22 bp, Homo sapiens
taatttatgatgcaaagaaaag

SEQ ID NO: 7381925 - DNA, 22 bp, Homo sapiens
tacagacagtttttcagatatt

SEQ ID NO: 7381926 - DNA, 20 bp, Homo sapiens
tacagtgtatgtatttaggc

SEQ ID NO: 7381927 - DNA, 22 bp, Homo sapiens
tacagttaaaaagttcaatggt

SEQ ID NO: 7381928 - DNA, 22 bp, Homo sapiens
tacagtgtgacatttctacaaa

SEQ ID NO: 7381929 - DNA, 22 bp, Homo sapiens
tacagtgtctggatatcaaagg

SEQ ID NO: 7381930 - DNA, 22 bp, Homo sapiens
tacagtgtctgcaactgcacac

SEQ ID NO: 7381931 - DNA, 22 bp, Homo sapiens
tacagtgtctggatatcaaagg

SEQ ID NO: 7381932 - DNA, 20 bp, Homo sapiens
taccaacagcaggaagcata

SEQ ID NO: 7381933 - DNA, 22 bp, Homo sapiens
taccaaagttttctgagtgata

SEQ ID NO: 7381934 - DNA, 22 bp, Homo sapiens
taccaaagattaaatagcaaca

SEQ ID NO: 7381935 - DNA, 18 bp, Homo sapiens
taccaaaggctttctttt

SEQ ID NO: 7381936 - DNA, 22 bp, Homo sapiens
taccaaatgtaatcattctaat

SEQ ID NO: 7381937 - DNA, 22 bp, Homo sapiens
tacatgctcagtaactttcagt

SEQ ID NO: 7381938 - DNA, 22 bp, Homo sapiens
tacatgcatgtgtgtaaatata

SEQ ID NO: 7381939 - DNA, 22 bp, Homo sapiens
tacatgcttctatatgtgaagt

SEQ ID NO: 7381940 - DNA, 21 bp, Homo sapiens
tactgtagccttgcactgtag

SEQ ID NO: 7381941 - DNA, 22 bp, Homo sapiens
tactgtttgcagtttgcagtat

SEQ ID NO: 7381942 - DNA, 22 bp, Homo sapiens
tactgttttctataatggctgt

SEQ ID NO: 7381943 - DNA, 22 bp, Homo sapiens
tactgttttctttatagtacag

SEQ ID NO: 7381944 - DNA, 22 bp, Homo sapiens
tactgtttttaaaattgcatcc

SEQ ID NO: 7381945 - DNA, 22 bp, Homo sapiens
tactgttttctttatagtacag

SEQ ID NO: 7381946 - DNA, 22 bp, Homo sapiens
tactgtttttgcctctttagaa

SEQ ID NO: 7381947 - DNA, 22 bp, Homo sapiens
taccatttcagtaaaaacttag

SEQ ID NO: 7381948 - DNA, 20 bp, Homo sapiens
taccacttatttgaataatt

SEQ ID NO: 7381949 - DNA, 22 bp, Homo sapiens
tactacatacagaatttagaga

SEQ ID NO: 7381950 - DNA, 22 bp, Homo sapiens
taccatttgagagagaacataa

SEQ ID NO: 7381951 - DNA, 22 bp, Homo sapiens
ttggagaatgttttcctgcagt

SEQ ID NO: 7381952 - DNA, 18 bp, Homo sapiens
ttggacctgtgtcagggc

SEQ ID NO: 7381953 - DNA, 22 bp, Homo sapiens
ttggacagtactttaaagcaga

SEQ ID NO: 7381954 - DNA, 21 bp, Homo sapiens
ttggcagtcagaaatgtgagg

SEQ ID NO: 7381955 - DNA, 22 bp, Homo sapiens
ttgggacaaagactccttgaat

SEQ ID NO: 7381956 - DNA, 22 bp, Homo sapiens
ttgggacaagagatagctctga

SEQ ID NO: 7381957 - DNA, 20 bp, Homo sapiens
ttgggacacttgctttgcta

SEQ ID NO: 7381958 - DNA, 22 bp, Homo sapiens
ttgggacagcactgctacccct

SEQ ID NO: 7381959 - DNA, 22 bp, Homo sapiens
ttgggacagcaaccatctgcta

SEQ ID NO: 7381960 - DNA, 22 bp, Homo sapiens
ttgggacagcaacggttctgtt

SEQ ID NO: 7381961 - DNA, 22 bp, Homo sapiens
ttgggacagagctggggctgga

SEQ ID NO: 7381962 - DNA, 22 bp, Homo sapiens
ttgggacagaaaaggagaagat

SEQ ID NO: 7381963 - DNA, 22 bp, Homo sapiens
ttggcccacagtaccatgctgt

SEQ ID NO: 7381964 - DNA, 22 bp, Homo sapiens
ttggcccactctcagaatgtgg

SEQ ID NO: 7381965 - DNA, 22 bp, Homo sapiens
ttggccatctaagcccagccac

SEQ ID NO: 7381966 - DNA, 22 bp, Homo sapiens
ttgggcccatggggctaagcta

SEQ ID NO: 7381967 - DNA, 22 bp, Homo sapiens
ttgggagatattgttctttaca

SEQ ID NO: 7381968 - DNA, 22 bp, Homo sapiens
ttgggagctggaagcaaggcct

SEQ ID NO: 7381969 - DNA, 22 bp, Homo sapiens
ttgggacatctggcatacagtt

SEQ ID NO: 7381970 - DNA, 22 bp, Homo sapiens
ttgggacagctgtggtagtgag

SEQ ID NO: 7381971 - DNA, 22 bp, Homo sapiens
ttgggacattatcagtctgcag

SEQ ID NO: 7381972 - DNA, 22 bp, Homo sapiens
ttgggacatgtaagctggaagt

SEQ ID NO: 7381973 - DNA, 20 bp, Homo sapiens
ttgtgtaggtctaatgcata

SEQ ID NO: 7381974 - DNA, 22 bp, Homo sapiens
ttgtgtagctaaaaccaagaaa

SEQ ID NO: 7381975 - DNA, 22 bp, Homo sapiens
ttgtcattggggttatttgtta

SEQ ID NO: 7381976 - DNA, 22 bp, Homo sapiens
ttgtcatagcttcatgggtagc

SEQ ID NO: 7381977 - DNA, 22 bp, Homo sapiens
ttgtcacacccttttttatacc

SEQ ID NO: 7381978 - DNA, 22 bp, Homo sapiens
ttgtcaagtaaggctgacattt

SEQ ID NO: 7381979 - DNA, 22 bp, Homo sapiens
ttgtcaagattgagagatgact

SEQ ID NO: 7381980 - DNA, 22 bp, Homo sapiens
ttgtcaagaaaaatggatgaag

SEQ ID NO: 7381981 - DNA, 22 bp, Homo sapiens
ttgtaaactggatagacctatt

SEQ ID NO: 7381982 - DNA, 22 bp, Homo sapiens
ttgtaaactgctgcaggagtgc

SEQ ID NO: 7381983 - DNA, 22 bp, Homo sapiens
ttgtaaacatagagatttaggt

SEQ ID NO: 7381984 - DNA, 22 bp, Homo sapiens
ttgtaaacatctgttgcttaga

SEQ ID NO: 7381985 - DNA, 22 bp, Homo sapiens
ttgtaaacttgtttgaaggtat

SEQ ID NO: 7381986 - DNA, 22 bp, Homo sapiens
ttgtaaatgaccttttctaatt

SEQ ID NO: 7381987 - DNA, 22 bp, Homo sapiens
ttgtacagggaagtaatacaag

SEQ ID NO: 7381988 - DNA, 22 bp, Homo sapiens
ttgtaagtcacaccagggcagg

SEQ ID NO: 7381989 - DNA, 22 bp, Homo sapiens
ttgacacagatcaatattcaac

SEQ ID NO: 7381990 - DNA, 22 bp, Homo sapiens
ttgacaagaacaccggtttgag

SEQ ID NO: 7381991 - DNA, 22 bp, Homo sapiens
ttgacaaaaacctcatttcacc

SEQ ID NO: 7381992 - DNA, 22 bp, Homo sapiens
ttgcagaatacttattctgtat

SEQ ID NO: 7381993 - DNA, 22 bp, Homo sapiens
ttgcagagccatgaggctggct

SEQ ID NO: 7381994 - DNA, 22 bp, Homo sapiens
ttgcagagaggttaggaactca

SEQ ID NO: 7381995 - DNA, 22 bp, Homo sapiens
ttgcagttgctgtatttaagga

SEQ ID NO: 7381996 - DNA, 22 bp, Homo sapiens
ttgcaggaagcacaagtctgag

SEQ ID NO: 7381997 - DNA, 22 bp, Homo sapiens
ttgcaggacaatgatggtccct

SEQ ID NO: 7381998 - DNA, 22 bp, Homo sapiens
ttgcaggattttagagatgaca

SEQ ID NO: 7381999 - DNA, 22 bp, Homo sapiens
ttgcaggaaactgagtgtgagc

SEQ ID NO: 7382000 - DNA, 22 bp, Homo sapiens
ttgctgtgaaaccatgggaagt

SEQ ID NO: 7382001 - DNA, 22 bp, Homo sapiens
ttgctctgaaccacaccatcac

SEQ ID NO: 7382002 - DNA, 22 bp, Homo sapiens
ttgcatttcactttcagtaggc

SEQ ID NO: 7382003 - DNA, 22 bp, Homo sapiens
ttgctctgattaggtggaaaca

SEQ ID NO: 7382004 - DNA, 22 bp, Homo sapiens
ttgcattctgttaaaatgtatt

SEQ ID NO: 7382005 - DNA, 22 bp, Homo sapiens
ttgcattctggtgaggttgcct

SEQ ID NO: 7382006 - DNA, 22 bp, Homo sapiens
ttgcattcccagccaagttagt

SEQ ID NO: 7382007 - DNA, 21 bp, Homo sapiens
ttgcattcctgttagtataag

SEQ ID NO: 7382008 - DNA, 22 bp, Homo sapiens
ttgcattccagtccccactgtg

SEQ ID NO: 7382009 - DNA, 22 bp, Homo sapiens
ttgcattccatggttttccttc

SEQ ID NO: 7382010 - DNA, 22 bp, Homo sapiens
ttgcttatttgattaaatgtct

SEQ ID NO: 7382011 - DNA, 22 bp, Homo sapiens
ttgcttcagagggagacacttt

SEQ ID NO: 7382012 - DNA, 22 bp, Homo sapiens
ttggaaagaagggctgagcaag

SEQ ID NO: 7382013 - DNA, 22 bp, Homo sapiens
ttggaaactttcaagcataatg

SEQ ID NO: 7382014 - DNA, 22 bp, Homo sapiens
ttggaaatgcaaatatattgaa

SEQ ID NO: 7382015 - DNA, 22 bp, Homo sapiens
ttggaaatgatttctattatta

SEQ ID NO: 7382016 - DNA, 23 bp, Homo sapiens
ttggaaatggggagaacagattc

SEQ ID NO: 7382017 - DNA, 23 bp, Homo sapiens
ttggaaatggggagaacagattc

SEQ ID NO: 7382018 - DNA, 22 bp, Homo sapiens
tttcacagcttccacttaagga

SEQ ID NO: 7382019 - DNA, 22 bp, Homo sapiens
tttcacattttatacttaagcc

SEQ ID NO: 7382020 - DNA, 22 bp, Homo sapiens
tttcactgttaggagtatgcta

SEQ ID NO: 7382021 - DNA, 22 bp, Homo sapiens
tttcagaaagcatcatcaaagt

SEQ ID NO: 7382022 - DNA, 22 bp, Homo sapiens
tttcagaaagctgaacatatga

SEQ ID NO: 7382023 - DNA, 22 bp, Homo sapiens
tttcagaaaacttatcatcagt

SEQ ID NO: 7382024 - DNA, 22 bp, Homo sapiens
tttcagagcctttatctctcta

SEQ ID NO: 7382025 - DNA, 22 bp, Homo sapiens
tttcagagatgtctagcctatt

SEQ ID NO: 7382026 - DNA, 22 bp, Homo sapiens
tttcagagaactgagtccttgc

SEQ ID NO: 7382027 - DNA, 22 bp, Homo sapiens
tttcagacaggacttcatatgt

SEQ ID NO: 7382028 - DNA, 22 bp, Homo sapiens
tttcatgattaacttagtgaat

SEQ ID NO: 7382029 - DNA, 22 bp, Homo sapiens
tttcatgaggtctttcagcaag

SEQ ID NO: 7382030 - DNA, 22 bp, Homo sapiens
tttcatgtgttgaatgtgtaca

SEQ ID NO: 7382031 - DNA, 22 bp, Homo sapiens
tttcatgtggcgatgtctctgg

SEQ ID NO: 7382032 - DNA, 22 bp, Homo sapiens
tttcatgtgcaattagcaatat

SEQ ID NO: 7382033 - DNA, 22 bp, Homo sapiens
tttcatgtactgtcgaagttga

SEQ ID NO: 7382034 - DNA, 22 bp, Homo sapiens
tttcatgtctgaattctttagt

SEQ ID NO: 7382035 - DNA, 22 bp, Homo sapiens
tttccccaggtagatagataat

SEQ ID NO: 7382036 - DNA, 22 bp, Homo sapiens
tttcattgatgggtgatagaaa

SEQ ID NO: 7382037 - DNA, 18 bp, Homo sapiens
tttcattgagtgtgatat

SEQ ID NO: 7382038 - DNA, 22 bp, Homo sapiens
tttcattgatgggtgatagaaa

SEQ ID NO: 7382039 - DNA, 22 bp, Homo sapiens
tttcattgagactatagacatc

SEQ ID NO: 7382040 - DNA, 22 bp, Homo sapiens
tttcattattcatgctagttat

SEQ ID NO: 7382041 - DNA, 21 bp, Homo sapiens
tttattctcagatacagggag

SEQ ID NO: 7382042 - DNA, 22 bp, Homo sapiens
tttattctataggcattaagca

SEQ ID NO: 7382043 - DNA, 20 bp, Homo sapiens
tttattcacagagaagagtt

SEQ ID NO: 7382044 - DNA, 19 bp, Homo sapiens
tttattcacctttaccttg

SEQ ID NO: 7382045 - DNA, 22 bp, Homo sapiens
tttattctagctcagaatagtt

SEQ ID NO: 7382046 - DNA, 22 bp, Homo sapiens
tttattgaacacttgcactggc

SEQ ID NO: 7382047 - DNA, 22 bp, Homo sapiens
tttattctgtgctacatgaaga

SEQ ID NO: 7382048 - DNA, 22 bp, Homo sapiens
tttattgagtatctactatgtg

SEQ ID NO: 7382049 - DNA, 22 bp, Homo sapiens
tttcaaagggaagttatgaagt

SEQ ID NO: 7382050 - DNA, 22 bp, Homo sapiens
tttcacagaaaggataacatta

SEQ ID NO: 7382051 - DNA, 22 bp, Homo sapiens
tttcacacttgatttgcagtta

SEQ ID NO: 7382052 - DNA, 22 bp, Homo sapiens
tttcacagagaaatataacagg

SEQ ID NO: 7382053 - DNA, 22 bp, Homo sapiens
tttcacagaggaggaagctgag

SEQ ID NO: 7382054 - DNA, 22 bp, Homo sapiens
tttcacacaacgtgaatatact

SEQ ID NO: 7382055 - DNA, 17 bp, Homo sapiens
tttcaacatcactcagc

SEQ ID NO: 7382056 - DNA, 22 bp, Homo sapiens
tttcaacatataccataatgcc

SEQ ID NO: 7382057 - DNA, 22 bp, Homo sapiens
tttcaacatacctcagtgtatg

SEQ ID NO: 7382058 - DNA, 22 bp, Homo sapiens
tttcaacataatgcctgctagg

SEQ ID NO: 7382059 - DNA, 22 bp, Homo sapiens
tttcaacatataccataatgcc

SEQ ID NO: 7382060 - DNA, 22 bp, Homo sapiens
tttcaacagctctcaaatgatc

SEQ ID NO: 7382061 - DNA, 22 bp, Homo sapiens
tttcaacaggatgataataggc

SEQ ID NO: 7382062 - DNA, 22 bp, Homo sapiens
tttcaagacgttaagtcagctt

SEQ ID NO: 7382063 - DNA, 22 bp, Homo sapiens
tttcaagcagcgtgaaaaacga

SEQ ID NO: 7382064 - DNA, 22 bp, Homo sapiens
tttcaagaggccagagcgaggc

SEQ ID NO: 7382065 - DNA, 22 bp, Homo sapiens
tttcaagaagcaaattaaagtc

SEQ ID NO: 7382066 - DNA, 22 bp, Homo sapiens
tttcaagaattgaagaggattt

SEQ ID NO: 7382067 - DNA, 22 bp, Homo sapiens
tttaaacatcttgttgccttaa

SEQ ID NO: 7382068 - DNA, 22 bp, Homo sapiens
tttaaactaacagtacacgttg

SEQ ID NO: 7382069 - DNA, 17 bp, Homo sapiens
tttaaactactacaagg

SEQ ID NO: 7382070 - DNA, 22 bp, Homo sapiens
tttaaagaaattcctcatcttt

SEQ ID NO: 7382071 - DNA, 22 bp, Homo sapiens
tttaaagtttttgcacattctg

SEQ ID NO: 7382072 - DNA, 22 bp, Homo sapiens
tttaaagtggtccatttcagaa

SEQ ID NO: 7382073 - DNA, 22 bp, Homo sapiens
tttaaatgcagacgttgattca

SEQ ID NO: 7382074 - DNA, 22 bp, Homo sapiens
tttaaataggactcctgggggt

SEQ ID NO: 7382075 - DNA, 22 bp, Homo sapiens
tttaaatgcagacgttgattca

SEQ ID NO: 7382076 - DNA, 22 bp, Homo sapiens
tttaaataggactcctgggggt

SEQ ID NO: 7382077 - DNA, 22 bp, Homo sapiens
tttaaatgtgttcttagtagct

SEQ ID NO: 7382078 - DNA, 22 bp, Homo sapiens
tttaaatgtgttcttagtagct

SEQ ID NO: 7382079 - DNA, 22 bp, Homo sapiens
tttaaatggcattttcccagat

SEQ ID NO: 7382080 - DNA, 22 bp, Homo sapiens
tttaaatgttcatgatactgaa

SEQ ID NO: 7382081 - DNA, 22 bp, Homo sapiens
tttaaatgtttaaaactcgtga

SEQ ID NO: 7382082 - DNA, 22 bp, Homo sapiens
tttaatggcaagaaggctgcag

SEQ ID NO: 7382083 - DNA, 22 bp, Homo sapiens
tttaatgtgagtccctttcaag

SEQ ID NO: 7382084 - DNA, 22 bp, Homo sapiens
tttacagtctctatagtcaaaa

SEQ ID NO: 7382085 - DNA, 22 bp, Homo sapiens
tttaaggtggacatctaagtca

SEQ ID NO: 7382086 - DNA, 22 bp, Homo sapiens
tttaaggtacagctagcagcat

SEQ ID NO: 7382087 - DNA, 22 bp, Homo sapiens
tttaagcacagggataaagtta

SEQ ID NO: 7382088 - DNA, 22 bp, Homo sapiens
tttaagatggtattttataaag

SEQ ID NO: 7382089 - DNA, 22 bp, Homo sapiens
tttaagattcagtaaggcaaac

SEQ ID NO: 7382090 - DNA, 22 bp, Homo sapiens
tttattcaagatgaggttcatg

SEQ ID NO: 7382091 - DNA, 22 bp, Homo sapiens
tttatctgagctgatagatagt

SEQ ID NO: 7382092 - DNA, 22 bp, Homo sapiens
tttatcatcttgtttttaaagc

SEQ ID NO: 7382093 - DNA, 21 bp, Homo sapiens
tttatcatcacgagcttgagc

SEQ ID NO: 7382094 - DNA, 22 bp, Homo sapiens
tttatcatcttgtttttaaagc

SEQ ID NO: 7382095 - DNA, 23 bp, Homo sapiens
tttatattcctaatgtcttgagc

SEQ ID NO: 7382096 - DNA, 22 bp, Homo sapiens
tttatattgggagtcgttttga

SEQ ID NO: 7382097 - DNA, 22 bp, Homo sapiens
tttatatagagatttgtgcatg

SEQ ID NO: 7382098 - DNA, 22 bp, Homo sapiens
tttatattgtaaaaatggttct

SEQ ID NO: 7382099 - DNA, 20 bp, Homo sapiens
tttacattttgaaacagtga

SEQ ID NO: 7382100 - DNA, 22 bp, Homo sapiens
tttaccaaagtactctgaggca

SEQ ID NO: 7382101 - DNA, 22 bp, Homo sapiens
tttagagaccctctgctatttt

SEQ ID NO: 7382102 - DNA, 22 bp, Homo sapiens
tttagagagaaataaatgagat

SEQ ID NO: 7382103 - DNA, 22 bp, Homo sapiens
ttcctgggtggtcctggtagag

SEQ ID NO: 7382104 - DNA, 22 bp, Homo sapiens
ttcctggggtactggagaaaat

SEQ ID NO: 7382105 - DNA, 22 bp, Homo sapiens
ttcctggtctatttagaattgc

SEQ ID NO: 7382106 - DNA, 22 bp, Homo sapiens
ttccagttctatgaattcaaga

SEQ ID NO: 7382107 - DNA, 22 bp, Homo sapiens
ttccagttctggctttgccact

SEQ ID NO: 7382108 - DNA, 22 bp, Homo sapiens
ttccagttggagcctgccttta

SEQ ID NO: 7382109 - DNA, 22 bp, Homo sapiens
ttcctgagcttttaacctagtc

SEQ ID NO: 7382110 - DNA, 22 bp, Homo sapiens
ttcctgcgcccttctcgcccgc

SEQ ID NO: 7382111 - DNA, 22 bp, Homo sapiens
ttctctcttactgccatgctgt

SEQ ID NO: 7382112 - DNA, 19 bp, Homo sapiens
ttctctgctacattctcag

SEQ ID NO: 7382113 - DNA, 22 bp, Homo sapiens
ttctctgctataggcagggagg

SEQ ID NO: 7382114 - DNA, 22 bp, Homo sapiens
ttctctgcctcacaggtctaag

SEQ ID NO: 7382115 - DNA, 22 bp, Homo sapiens
ttctctgcctcacaggtctaag

SEQ ID NO: 7382116 - DNA, 22 bp, Homo sapiens
ttctctgcctctagctatattc

SEQ ID NO: 7382117 - DNA, 22 bp, Homo sapiens
ttctctgctctcacatacagaa

SEQ ID NO: 7382118 - DNA, 22 bp, Homo sapiens
ttctctaagagttatatgaatt

SEQ ID NO: 7382119 - DNA, 22 bp, Homo sapiens
ttctctaagccttagtttcttc

SEQ ID NO: 7382120 - DNA, 22 bp, Homo sapiens
ttctctaatacattttgacaaa

SEQ ID NO: 7382121 - DNA, 22 bp, Homo sapiens
ttctctaatacattttgacaaa

SEQ ID NO: 7382122 - DNA, 22 bp, Homo sapiens
ttctctaatggtgatgattaga

SEQ ID NO: 7382123 - DNA, 20 bp, Homo sapiens
ttctctagccttcccctggg

SEQ ID NO: 7382124 - DNA, 22 bp, Homo sapiens
ttctctagttttgacgaggatt

SEQ ID NO: 7382125 - DNA, 22 bp, Homo sapiens
ttctctaagagatgcagaagtt

SEQ ID NO: 7382126 - DNA, 22 bp, Homo sapiens
ttctccagaccctcctgcagac

SEQ ID NO: 7382127 - DNA, 22 bp, Homo sapiens
ttctccagaccactgcctctgt

SEQ ID NO: 7382128 - DNA, 22 bp, Homo sapiens
ttctccaaggatacagtcctgt

SEQ ID NO: 7382129 - DNA, 22 bp, Homo sapiens
ttctccaagtagaagctaagtt

SEQ ID NO: 7382130 - DNA, 22 bp, Homo sapiens
ttctcaggtcaccagggtgcca

SEQ ID NO: 7382131 - DNA, 22 bp, Homo sapiens
ttctcaggtagtgctgatgctg

SEQ ID NO: 7382132 - DNA, 22 bp, Homo sapiens
ttctcaggtagtgctgatgctg

SEQ ID NO: 7382133 - DNA, 22 bp, Homo sapiens
ttctcagggtcttgtgcaaggg

SEQ ID NO: 7382134 - DNA, 22 bp, Homo sapiens
ttctcagggttggcctcaaatc

SEQ ID NO: 7382135 - DNA, 22 bp, Homo sapiens
ttctcagggtttgtgcaggctt

SEQ ID NO: 7382136 - DNA, 22 bp, Homo sapiens
ttctcaggaactcagtgtcagc

SEQ ID NO: 7382137 - DNA, 22 bp, Homo sapiens
ttctcaggaactcagtgtcagc

SEQ ID NO: 7382138 - DNA, 22 bp, Homo sapiens
ttctcagatgattcagataaac

SEQ ID NO: 7382139 - DNA, 22 bp, Homo sapiens
ttctcaggcacttcttccccgc

SEQ ID NO: 7382140 - DNA, 22 bp, Homo sapiens
ttctcaggcccctgcctggact

SEQ ID NO: 7382141 - DNA, 23 bp, Homo sapiens
ttctcaggagcccccaggtcagg

SEQ ID NO: 7382142 - DNA, 22 bp, Homo sapiens
ttctcagggtctggatggcctg

SEQ ID NO: 7382143 - DNA, 22 bp, Homo sapiens
ttctcagggtctggatggcctg

SEQ ID NO: 7382144 - DNA, 22 bp, Homo sapiens
ttctcagggccctgtgttagct

SEQ ID NO: 7382145 - DNA, 22 bp, Homo sapiens
ttctcagggtagaggtgacact

SEQ ID NO: 7382146 - DNA, 22 bp, Homo sapiens
ttctcagggcatctcatgaccc

SEQ ID NO: 7382147 - DNA, 22 bp, Homo sapiens
ttctcaggctctgagaccctat

SEQ ID NO: 7382148 - DNA, 22 bp, Homo sapiens
ttctcaggctgtggagccgtct

SEQ ID NO: 7382149 - DNA, 22 bp, Homo sapiens
ttctcaggctgtggagccgtct

SEQ ID NO: 7382150 - DNA, 22 bp, Homo sapiens
ttctcagatccatcagaagtcc

SEQ ID NO: 7382151 - DNA, 22 bp, Homo sapiens
ttctcagatccatcagaagtcc

SEQ ID NO: 7382152 - DNA, 22 bp, Homo sapiens
ttccttggtagggacaactctg

SEQ ID NO: 7382153 - DNA, 22 bp, Homo sapiens
ttccttggtgtaactgctccta

SEQ ID NO: 7382154 - DNA, 19 bp, Homo sapiens
ttctggacagcagaaacca

SEQ ID NO: 7382155 - DNA, 22 bp, Homo sapiens
ttctgtctgtaaacttctcaat

SEQ ID NO: 7382156 - DNA, 23 bp, Homo sapiens
ttctgtcttgctgtcagctttct

SEQ ID NO: 7382157 - DNA, 19 bp, Homo sapiens
ttctgtaaggacattaatc

SEQ ID NO: 7382158 - DNA, 22 bp, Homo sapiens
ttctgtctggaaaaggacatag

SEQ ID NO: 7382159 - DNA, 22 bp, Homo sapiens
ttctgtctgatggtgccagaac

SEQ ID NO: 7382160 - DNA, 22 bp, Homo sapiens
ttctgtctgatggtgccagaac

SEQ ID NO: 7382161 - DNA, 22 bp, Homo sapiens
ttctgtgcccattttaaaatgg

SEQ ID NO: 7382162 - DNA, 22 bp, Homo sapiens
ttcttatattgggtcatggata

SEQ ID NO: 7382163 - DNA, 22 bp, Homo sapiens
ttcttatagaagcaaccattgt

SEQ ID NO: 7382164 - DNA, 22 bp, Homo sapiens
ttcttagttcaactaaaattta

SEQ ID NO: 7382165 - DNA, 22 bp, Homo sapiens
ttcttagagatggttaaaaata

SEQ ID NO: 7382166 - DNA, 22 bp, Homo sapiens
ttcttagagatggttaaaaata

SEQ ID NO: 7382167 - DNA, 22 bp, Homo sapiens
ttcttagtagcatagctatatt

SEQ ID NO: 7382168 - DNA, 20 bp, Homo sapiens
ttgaaattggatggtagcta

SEQ ID NO: 7382169 - DNA, 22 bp, Homo sapiens
ttgaaatggcagcagctgacct

SEQ ID NO: 7382170 - DNA, 19 bp, Homo sapiens
ttgaaattgtttgatatgg

SEQ ID NO: 7382171 - DNA, 22 bp, Homo sapiens
ttgaaattgggtgtggctgtca

SEQ ID NO: 7382172 - DNA, 22 bp, Homo sapiens
ttgaacattaacttcagtctat

SEQ ID NO: 7382173 - DNA, 22 bp, Homo sapiens
ttgaacaatttggtatacaaac

SEQ ID NO: 7382174 - DNA, 22 bp, Homo sapiens
ttgaactttgaaccattcctat

SEQ ID NO: 7382175 - DNA, 22 bp, Homo sapiens
ttgaagaaattattttatatag

SEQ ID NO: 7382176 - DNA, 22 bp, Homo sapiens
ttgaagaaagtcatatataatg

SEQ ID NO: 7382177 - DNA, 23 bp, Homo sapiens
ttgaatttctcttgcaatattta

SEQ ID NO: 7382178 - DNA, 22 bp, Homo sapiens
ttctttttaaagtgtgtatgca

SEQ ID NO: 7382179 - DNA, 22 bp, Homo sapiens
ttcttttgggaattacgtatgc

SEQ ID NO: 7382180 - DNA, 22 bp, Homo sapiens
ttcttttgcaagactattgatt

SEQ ID NO: 7382181 - DNA, 20 bp, Homo sapiens
ttcttttgataagcttgaca

SEQ ID NO: 7382182 - DNA, 22 bp, Homo sapiens
ttgaaatcaggaaagttccagg

SEQ ID NO: 7382183 - DNA, 22 bp, Homo sapiens
ttgaaatgcatcatcatttaga

SEQ ID NO: 7382184 - DNA, 22 bp, Homo sapiens
ttctttgttgtactttcctaca

SEQ ID NO: 7382185 - DNA, 20 bp, Homo sapiens
ttctttgttccttacatttg

SEQ ID NO: 7382186 - DNA, 20 bp, Homo sapiens
ttctttgttccttacatttg

SEQ ID NO: 7382187 - DNA, 22 bp, Homo sapiens
ttctttggtgttacccagctca

SEQ ID NO: 7382188 - DNA, 19 bp, Homo sapiens
ttctttggtggtggtgacc

SEQ ID NO: 7382189 - DNA, 22 bp, Homo sapiens
ttctttgtgcatccaattttct

SEQ ID NO: 7382190 - DNA, 22 bp, Homo sapiens
ttcttcaaccatctacataaac

SEQ ID NO: 7382191 - DNA, 22 bp, Homo sapiens
ttcttcaacaaggacactgtta

SEQ ID NO: 7382192 - DNA, 22 bp, Homo sapiens
ttcttcaaccatctacataaac

SEQ ID NO: 7382193 - DNA, 22 bp, Homo sapiens
ttcttcaaccatctacataaac

SEQ ID NO: 7382194 - DNA, 22 bp, Homo sapiens
ttcttcaaatgctgaaagtcta

SEQ ID NO: 7382195 - DNA, 22 bp, Homo sapiens
ttcttcaaatagcagggagtca

SEQ ID NO: 7382196 - DNA, 22 bp, Homo sapiens
ttcttcaattttccatatactg

SEQ ID NO: 7382197 - DNA, 22 bp, Homo sapiens
ttcttcaattttccatatactg

SEQ ID NO: 7382198 - DNA, 22 bp, Homo sapiens
ttcttcaattttccatatactg

SEQ ID NO: 7382199 - DNA, 22 bp, Homo sapiens
ttcttcaagggtaaaggcaacg

SEQ ID NO: 7382200 - DNA, 22 bp, Homo sapiens
ttcttcaattttccatatactg

SEQ ID NO: 7382201 - DNA, 22 bp, Homo sapiens
ttcttcaattattggaaagaaa

SEQ ID NO: 7382202 - DNA, 22 bp, Homo sapiens
ttcttattcttgaaatgtggga

SEQ ID NO: 7382203 - DNA, 23 bp, Homo sapiens
ttcttatttactttggaatctcc

SEQ ID NO: 7382204 - DNA, 22 bp, Homo sapiens
ttcttcaaacaaaagtggcatg

SEQ ID NO: 7382205 - DNA, 21 bp, Homo sapiens
ttcttcaaagaagaaggcaca

SEQ ID NO: 7382206 - DNA, 21 bp, Homo sapiens
ttcttcaaagaagaaggcaca

SEQ ID NO: 7382207 - DNA, 22 bp, Homo sapiens
ttcttcaaaatccagcatgatt

SEQ ID NO: 7382208 - DNA, 22 bp, Homo sapiens
ttcttcaaagtaatagagacta

SEQ ID NO: 7382209 - DNA, 22 bp, Homo sapiens
ttcttcaaagtaatagagacta

SEQ ID NO: 7382210 - DNA, 22 bp, Homo sapiens
ttcttcaaaatccagcatgatt

SEQ ID NO: 7382211 - DNA, 22 bp, Homo sapiens
ttcttcaaaatccagcatgatt

SEQ ID NO: 7382212 - DNA, 22 bp, Homo sapiens
tcctgctgccatttcaagtgct

SEQ ID NO: 7382213 - DNA, 22 bp, Homo sapiens
tcctgctgctcacctttttgtc

SEQ ID NO: 7382214 - DNA, 22 bp, Homo sapiens
tcctgctgctacctggcccacg

SEQ ID NO: 7382215 - DNA, 22 bp, Homo sapiens
tcctgctgctacctggcccacg

SEQ ID NO: 7382216 - DNA, 20 bp, Homo sapiens
tcctgctgccacctcttctt

SEQ ID NO: 7382217 - DNA, 22 bp, Homo sapiens
tcctgctgagcgtctgtcattt

SEQ ID NO: 7382218 - DNA, 22 bp, Homo sapiens
tcctgctgagcgtctgtcattt

SEQ ID NO: 7382219 - DNA, 22 bp, Homo sapiens
tcctgctgagcatgttctgccc

SEQ ID NO: 7382220 - DNA, 22 bp, Homo sapiens
tcctgctgagcatgttctgccc

SEQ ID NO: 7382221 - DNA, 23 bp, Homo sapiens
tcctgctgaaagctccagctggc

SEQ ID NO: 7382222 - DNA, 21 bp, Homo sapiens
tcctgctgagaaacagatggt

SEQ ID NO: 7382223 - DNA, 20 bp, Homo sapiens
tcctgctgaccttcacaagc

SEQ ID NO: 7382224 - DNA, 22 bp, Homo sapiens
tcctgctgacaaggaaagcatg

SEQ ID NO: 7382225 - DNA, 22 bp, Homo sapiens
tcctgctgaccagtaaatgaat

SEQ ID NO: 7382226 - DNA, 22 bp, Homo sapiens
ttagctgaaaaaattcatgcaa

SEQ ID NO: 7382227 - DNA, 22 bp, Homo sapiens
ttagctgagattaagtgaactt

SEQ ID NO: 7382228 - DNA, 22 bp, Homo sapiens
ttagcttgcaaatggaaatgat

SEQ ID NO: 7382229 - DNA, 22 bp, Homo sapiens
ttagcttgtgccatatgaaact

SEQ ID NO: 7382230 - DNA, 22 bp, Homo sapiens
tcctgctggaagtagggaatga

SEQ ID NO: 7382231 - DNA, 22 bp, Homo sapiens
tcctgctggaatggaaaatgaa

SEQ ID NO: 7382232 - DNA, 22 bp, Homo sapiens
tcctgctggactctgagtacaa

SEQ ID NO: 7382233 - DNA, 22 bp, Homo sapiens
ttagccaggggagcagcttgtc

SEQ ID NO: 7382234 - DNA, 22 bp, Homo sapiens
tcctgctgctcttgggaaacct

SEQ ID NO: 7382235 - DNA, 22 bp, Homo sapiens
tcctgctggaaacttcctcttg

SEQ ID NO: 7382236 - DNA, 21 bp, Homo sapiens
tcctgctgctcctgtcgtgtt

SEQ ID NO: 7382237 - DNA, 21 bp, Homo sapiens
tcctgctgctcctgtcgtgtt

SEQ ID NO: 7382238 - DNA, 22 bp, Homo sapiens
ttatagggtttctgggagtggg

SEQ ID NO: 7382239 - DNA, 22 bp, Homo sapiens
ttatataaagataacttttctt

SEQ ID NO: 7382240 - DNA, 22 bp, Homo sapiens
ttatagcagcatgatttacaat

SEQ ID NO: 7382241 - DNA, 21 bp, Homo sapiens
ttagctttctagaatctttgt

SEQ ID NO: 7382242 - DNA, 22 bp, Homo sapiens
ttagctttcctactaataaata

SEQ ID NO: 7382243 - DNA, 22 bp, Homo sapiens
ttaggaaacgctgctattgact

SEQ ID NO: 7382244 - DNA, 22 bp, Homo sapiens
ttaggaaagttcttcagacatg

SEQ ID NO: 7382245 - DNA, 22 bp, Homo sapiens
ttcaaacagttgcacaacttat

SEQ ID NO: 7382246 - DNA, 22 bp, Homo sapiens
ttattgtgtgcgttagcctatg

SEQ ID NO: 7382247 - DNA, 22 bp, Homo sapiens
ttattgtggactactgttctgg

SEQ ID NO: 7382248 - DNA, 22 bp, Homo sapiens
ttattgtggcagaggtatggtt

SEQ ID NO: 7382249 - DNA, 22 bp, Homo sapiens
ttcaaacagatgactctgctct

SEQ ID NO: 7382250 - DNA, 22 bp, Homo sapiens
ttattgggtcccaacaagttgc

SEQ ID NO: 7382251 - DNA, 22 bp, Homo sapiens
ttattggccaactgccttggag

SEQ ID NO: 7382252 - DNA, 22 bp, Homo sapiens
ttattggagctggaggctgttt

SEQ ID NO: 7382253 - DNA, 22 bp, Homo sapiens
ttattgagcaactctggggctc

SEQ ID NO: 7382254 - DNA, 22 bp, Homo sapiens
ttattgagcacctactatgtgt

SEQ ID NO: 7382255 - DNA, 22 bp, Homo sapiens
ttattgaaggaactgaaataaa

SEQ ID NO: 7382256 - DNA, 22 bp, Homo sapiens
ttattgacttgtttgtcctggt

SEQ ID NO: 7382257 - DNA, 22 bp, Homo sapiens
ttattgagaccgtaagtcaggt

SEQ ID NO: 7382258 - DNA, 22 bp, Homo sapiens
ttattacaatgcagaaaataga

SEQ ID NO: 7382259 - DNA, 22 bp, Homo sapiens
ttattaatgagtacaagttatt

SEQ ID NO: 7382260 - DNA, 22 bp, Homo sapiens
ttattaatgagtacaagttatt

SEQ ID NO: 7382261 - DNA, 22 bp, Homo sapiens
ttatatatatgtagaggtcacg

SEQ ID NO: 7382262 - DNA, 22 bp, Homo sapiens
ttatatatatgtagaggtcacg

SEQ ID NO: 7382263 - DNA, 22 bp, Homo sapiens
ttatatatcttgatttgttcca

SEQ ID NO: 7382264 - DNA, 22 bp, Homo sapiens
ttatatgattgaagtgcataag

SEQ ID NO: 7382265 - DNA, 22 bp, Homo sapiens
ttatatgagtatcatatcactt

SEQ ID NO: 7382266 - DNA, 22 bp, Homo sapiens
ttatatgattgaagtgcataag

SEQ ID NO: 7382267 - DNA, 22 bp, Homo sapiens
ttattaaaatgcggatttggct

SEQ ID NO: 7382268 - DNA, 22 bp, Homo sapiens
ttattataatgagggataaaaa

SEQ ID NO: 7382269 - DNA, 22 bp, Homo sapiens
ttattataatgagggataaaaa

SEQ ID NO: 7382270 - DNA, 22 bp, Homo sapiens
ttattacaatgcagaaaataga

SEQ ID NO: 7382271 - DNA, 22 bp, Homo sapiens
ttattacactgaaagaattgcg

SEQ ID NO: 7382272 - DNA, 22 bp, Homo sapiens
ttattctttaaacatatatgtt

SEQ ID NO: 7382273 - DNA, 22 bp, Homo sapiens
ttattatagattatgcaagatt

SEQ ID NO: 7382274 - DNA, 22 bp, Homo sapiens
ttcaaagataatgtagcatttt

SEQ ID NO: 7382275 - DNA, 22 bp, Homo sapiens
ttcaaagagaaattgtattttc

SEQ ID NO: 7382276 - DNA, 22 bp, Homo sapiens
ttcaaagctgcagactcctggg

SEQ ID NO: 7382277 - DNA, 19 bp, Homo sapiens
ttcacagctctgtgtcagt

SEQ ID NO: 7382278 - DNA, 22 bp, Homo sapiens
ttcacagctcatactgttctca

SEQ ID NO: 7382279 - DNA, 22 bp, Homo sapiens
ttcacagctcatactgttctca

SEQ ID NO: 7382280 - DNA, 23 bp, Homo sapiens
ttcacagattaaatatttcttct

SEQ ID NO: 7382281 - DNA, 22 bp, Homo sapiens
ttcacagatgtattggaactcc

SEQ ID NO: 7382282 - DNA, 22 bp, Homo sapiens
ttcacagatttccctgcacatg

SEQ ID NO: 7382283 - DNA, 20 bp, Homo sapiens
ttcacagaggactcaggtca

SEQ ID NO: 7382284 - DNA, 22 bp, Homo sapiens
ttcagcagagaaattacataat

SEQ ID NO: 7382285 - DNA, 22 bp, Homo sapiens
ttcagcagagaaattacataat

SEQ ID NO: 7382286 - DNA, 18 bp, Homo sapiens
ttcagcagcagacacact

SEQ ID NO: 7382287 - DNA, 22 bp, Homo sapiens
ttcagcaactgagtgtctttta

SEQ ID NO: 7382288 - DNA, 22 bp, Homo sapiens
ttcagactagacacatttcaag

SEQ ID NO: 7382289 - DNA, 22 bp, Homo sapiens
ttcagaccttaaattcttctgt

SEQ ID NO: 7382290 - DNA, 22 bp, Homo sapiens
ttcacaggatatatgtgcaggg

SEQ ID NO: 7382291 - DNA, 23 bp, Homo sapiens
ttccagtgagactgagaggtctt

SEQ ID NO: 7382292 - DNA, 22 bp, Homo sapiens
ttcatttgtccaaatactatgt

SEQ ID NO: 7382293 - DNA, 22 bp, Homo sapiens
ttcatttgtaactctgttaggg

SEQ ID NO: 7382294 - DNA, 22 bp, Homo sapiens
ttcatttgtctgctatagatcc

SEQ ID NO: 7382295 - DNA, 22 bp, Homo sapiens
ttcatttgtggtgaatgaagtg

SEQ ID NO: 7382296 - DNA, 22 bp, Homo sapiens
ttcagttctacaagagctttgt

SEQ ID NO: 7382297 - DNA, 22 bp, Homo sapiens
ttcagttttattgtactgctat

SEQ ID NO: 7382298 - DNA, 22 bp, Homo sapiens
ttcagttttattgtactgctat

SEQ ID NO: 7382299 - DNA, 22 bp, Homo sapiens
ttcagtttgtttgactgttaga

SEQ ID NO: 7382300 - DNA, 22 bp, Homo sapiens
ttcagttttgcttttaatcatg

SEQ ID NO: 7382301 - DNA, 22 bp, Homo sapiens
ttcatttgcactggattactgg

SEQ ID NO: 7382302 - DNA, 22 bp, Homo sapiens
ttcatttgagtttatagttgct

SEQ ID NO: 7382303 - DNA, 22 bp, Homo sapiens
ttcatttaatcagaatctctaa

SEQ ID NO: 7382304 - DNA, 22 bp, Homo sapiens
ttcattggtcctgctcctggac

SEQ ID NO: 7382305 - DNA, 22 bp, Homo sapiens
ttcattggtactaggacaggac

SEQ ID NO: 7382306 - DNA, 22 bp, Homo sapiens
ttcattgtagcttgactaatta

SEQ ID NO: 7382307 - DNA, 22 bp, Homo sapiens
ttcattgctattcactgtactg

SEQ ID NO: 7382308 - DNA, 22 bp, Homo sapiens
ttcattggcacaggggcaggtt

SEQ ID NO: 7382309 - DNA, 22 bp, Homo sapiens
ttcattggctaaagacctggga

SEQ ID NO: 7382310 - DNA, 22 bp, Homo sapiens
tttttagagtgttaccagtata

SEQ ID NO: 7382311 - DNA, 22 bp, Homo sapiens
tttttataactcttttgtgaca

SEQ ID NO: 7382312 - DNA, 22 bp, Homo sapiens
tttttataccacctctcactta

SEQ ID NO: 7382313 - DNA, 22 bp, Homo sapiens
tttttatactttgctcaagatt

SEQ ID NO: 7382314 - DNA, 22 bp, Homo sapiens
tttttatactttgctcaagatt

SEQ ID NO: 7382315 - DNA, 22 bp, Homo sapiens
tttttataggtcagggcaagtc

SEQ ID NO: 7382316 - DNA, 22 bp, Homo sapiens
tttttatctacagattctcagc

SEQ ID NO: 7382317 - DNA, 22 bp, Homo sapiens
tttttatatgaaggatagtgcg

SEQ ID NO: 7382318 - DNA, 22 bp, Homo sapiens
tttttcaagacaacctgcatgt

SEQ ID NO: 7382319 - DNA, 22 bp, Homo sapiens
tttttcagccatgaattacact

SEQ ID NO: 7382320 - DNA, 22 bp, Homo sapiens
tttttcacacatgtggcttgat

SEQ ID NO: 7382321 - DNA, 22 bp, Homo sapiens
ttttaaaggatactcttgtcta

SEQ ID NO: 7382322 - DNA, 22 bp, Homo sapiens
ttttaaaggatactcttgtcta

SEQ ID NO: 7382323 - DNA, 22 bp, Homo sapiens
ttttaaagagatgctgtgcata

SEQ ID NO: 7382324 - DNA, 22 bp, Homo sapiens
ttttaaagagatgctgtgcata

SEQ ID NO: 7382325 - DNA, 22 bp, Homo sapiens
ttttaacactcagcactatctc

SEQ ID NO: 7382326 - DNA, 22 bp, Homo sapiens
ttttaaaggctgtatgaccaag

SEQ ID NO: 7382327 - DNA, 22 bp, Homo sapiens
ttttaaaggctgtatgaccaag

SEQ ID NO: 7382328 - DNA, 22 bp, Homo sapiens
ttttaaatctccagttgacccc

SEQ ID NO: 7382329 - DNA, 22 bp, Homo sapiens
ttttaatcctcttggtatctta

SEQ ID NO: 7382330 - DNA, 22 bp, Homo sapiens
ttttaagaaatgtatgactgtc

SEQ ID NO: 7382331 - DNA, 22 bp, Homo sapiens
ttttaagaaatgtatgactgtc

SEQ ID NO: 7382332 - DNA, 22 bp, Homo sapiens
ttttaatactgctattgtagga

SEQ ID NO: 7382333 - DNA, 22 bp, Homo sapiens
ttttaatcatgcttctatgtcc

SEQ ID NO: 7382334 - DNA, 22 bp, Homo sapiens
tttgtgttttagctggtgaggc

SEQ ID NO: 7382335 - DNA, 22 bp, Homo sapiens
tttgtgttttcactagcagtgt

SEQ ID NO: 7382336 - DNA, 22 bp, Homo sapiens
tttgttataacaataaaaagtc

SEQ ID NO: 7382337 - DNA, 22 bp, Homo sapiens
tttgttataacaataaaaagtc

SEQ ID NO: 7382338 - DNA, 22 bp, Homo sapiens
tttgtgtggatggaaggcagta

SEQ ID NO: 7382339 - DNA, 22 bp, Homo sapiens
tttgtgtggcgttggccggcgg

SEQ ID NO: 7382340 - DNA, 22 bp, Homo sapiens
tttgtaaaaggaggaagcatgg

SEQ ID NO: 7382341 - DNA, 22 bp, Homo sapiens
tttgtaaaaggaggaagcatgg

SEQ ID NO: 7382342 - DNA, 22 bp, Homo sapiens
tttgtaaatagcagtactcatg

SEQ ID NO: 7382343 - DNA, 22 bp, Homo sapiens
ttttcttatggtgaagcacaaa

SEQ ID NO: 7382344 - DNA, 22 bp, Homo sapiens
ttttcttatggtgaagcacaaa

SEQ ID NO: 7382345 - DNA, 22 bp, Homo sapiens
ttttctgacctatctacattta

SEQ ID NO: 7382346 - DNA, 22 bp, Homo sapiens
ttttcatttttgtagatgcaag

SEQ ID NO: 7382347 - DNA, 22 bp, Homo sapiens
ttttcattgttcctcgagcatt

SEQ ID NO: 7382348 - DNA, 22 bp, Homo sapiens
ttttccaaagtaccatgtccct

SEQ ID NO: 7382349 - DNA, 22 bp, Homo sapiens
ttttccaaattagaagtagaga

SEQ ID NO: 7382350 - DNA, 22 bp, Homo sapiens
ttttccaaattagaagtagaga

SEQ ID NO: 7382351 - DNA, 22 bp, Homo sapiens
ttttctcttgttaatgtactga

SEQ ID NO: 7382352 - DNA, 22 bp, Homo sapiens
ttttctcaggtgcttatctaag

SEQ ID NO: 7382353 - DNA, 22 bp, Homo sapiens
ttttctcagctgcactgtatta

SEQ ID NO: 7382354 - DNA, 22 bp, Homo sapiens
ttttcattgtaaatcaggaaac

SEQ ID NO: 7382355 - DNA, 22 bp, Homo sapiens
ttttcacacaaggtgataagtt

SEQ ID NO: 7382356 - DNA, 22 bp, Homo sapiens
ttttattgcaataaagtgtgta

SEQ ID NO: 7382357 - DNA, 22 bp, Homo sapiens
ttttattgcaataaagtgtgta

SEQ ID NO: 7382358 - DNA, 21 bp, Homo sapiens
ttttattgatgaatggccact

SEQ ID NO: 7382359 - DNA, 22 bp, Homo sapiens
ttttattggagtgataccaagc

SEQ ID NO: 7382360 - DNA, 22 bp, Homo sapiens
ttttattggagtgataccaagc

SEQ ID NO: 7382361 - DNA, 22 bp, Homo sapiens
ttttattggagtgataccaagc

SEQ ID NO: 7382362 - DNA, 21 bp, Homo sapiens
tttgaaagctacatctatagc

SEQ ID NO: 7382363 - DNA, 22 bp, Homo sapiens
tttgaagactactgggagtgaa

SEQ ID NO: 7382364 - DNA, 22 bp, Homo sapiens
tttgacaagagggcatcttcag

SEQ ID NO: 7382365 - DNA, 22 bp, Homo sapiens
tttgacaattaggtagaaaaag

SEQ ID NO: 7382366 - DNA, 22 bp, Homo sapiens
tttgacaacacgttatttgcct

SEQ ID NO: 7382367 - DNA, 22 bp, Homo sapiens
tttgacaaaggaaaaatgcaca

SEQ ID NO: 7382368 - DNA, 22 bp, Homo sapiens
tttgacaaataggggaataagg

SEQ ID NO: 7382369 - DNA, 22 bp, Homo sapiens
tttgacaaaattatgctaatat

SEQ ID NO: 7382370 - DNA, 19 bp, Homo sapiens
tttcctaaaaagctgtgct

SEQ ID NO: 7382371 - DNA, 21 bp, Homo sapiens
tttctttctggctctcacagt

SEQ ID NO: 7382372 - DNA, 22 bp, Homo sapiens
tttcttttacagtgtggctatt

SEQ ID NO: 7382373 - DNA, 19 bp, Homo sapiens
tttcttttcccctcagcac

SEQ ID NO: 7382374 - DNA, 22 bp, Homo sapiens
tttcttttccaatatccctact

SEQ ID NO: 7382375 - DNA, 22 bp, Homo sapiens
tttcttttgctgagaggggcac

SEQ ID NO: 7382376 - DNA, 22 bp, Homo sapiens
tttcttttgccctgtgggttag

SEQ ID NO: 7382377 - DNA, 22 bp, Homo sapiens
tttcttttgaatagtgtgtggt

SEQ ID NO: 7382378 - DNA, 22 bp, Homo sapiens
tttggaaaattttctaagtctg

SEQ ID NO: 7382379 - DNA, 22 bp, Homo sapiens
tttggaaacacggtcatcttcc

SEQ ID NO: 7382380 - DNA, 22 bp, Homo sapiens
tttggaaacatctcagaaaata

SEQ ID NO: 7382381 - DNA, 22 bp, Homo sapiens
tttggaaactgatggtacattc

SEQ ID NO: 7382382 - DNA, 22 bp, Homo sapiens
tttggaaagacacacagtttta

SEQ ID NO: 7382383 - DNA, 22 bp, Homo sapiens
tttggaaactgcctcagctctt

SEQ ID NO: 7382384 - DNA, 22 bp, Homo sapiens
tttggaaaaagacagcttatga

SEQ ID NO: 7382385 - DNA, 22 bp, Homo sapiens
tttggaaaaagcctgaacatag

SEQ ID NO: 7382386 - DNA, 22 bp, Homo sapiens
tttggaaaatattgaactggtt

SEQ ID NO: 7382387 - DNA, 22 bp, Homo sapiens
tttggaaagtgtacaaatttga

SEQ ID NO: 7382388 - DNA, 22 bp, Homo sapiens
tttggaaaggtttggccattat

SEQ ID NO: 7382389 - DNA, 17 bp, Homo sapiens
tttggaaagtgatcatt

SEQ ID NO: 7382390 - DNA, 22 bp, Homo sapiens
tttggaaagtgtgatttcaagg

SEQ ID NO: 7382391 - DNA, 22 bp, Homo sapiens
tttggaaagttgtcactttaga

SEQ ID NO: 7382392 - DNA, 22 bp, Homo sapiens
tttggaaatgaccccgtctaag

SEQ ID NO: 7382393 - DNA, 22 bp, Homo sapiens
tttggaaatacgcgtaggcaga

SEQ ID NO: 7382394 - DNA, 22 bp, Homo sapiens
tttggaaataattccatctcat

SEQ ID NO: 7382395 - DNA, 22 bp, Homo sapiens
tttggaaatttcatcaatagcc

SEQ ID NO: 7382396 - DNA, 22 bp, Homo sapiens
tttggaaattactcattgtcct

SEQ ID NO: 7382397 - DNA, 22 bp, Homo sapiens
tttggaaatgagaagccacctt

SEQ ID NO: 7382398 - DNA, 22 bp, Homo sapiens
tttggaaattttcatccagaca

SEQ ID NO: 7382399 - DNA, 22 bp, Homo sapiens
tttggtattgcacactgtcttc

SEQ ID NO: 7382400 - DNA, 22 bp, Homo sapiens
tttggtcaaatattatcctgag

SEQ ID NO: 7382401 - DNA, 22 bp, Homo sapiens
tttggtcagggtaggacagttg

SEQ ID NO: 7382402 - DNA, 22 bp, Homo sapiens
tttggtgagctgcgagtgagga

SEQ ID NO: 7382403 - DNA, 22 bp, Homo sapiens
tttggttaatttaggcttgcat

SEQ ID NO: 7382404 - DNA, 22 bp, Homo sapiens
tttgatgaaagctactatttac

SEQ ID NO: 7382405 - DNA, 22 bp, Homo sapiens
tttgattctgtaaaataacagg

SEQ ID NO: 7382406 - DNA, 19 bp, Homo sapiens
tttgatagggcataatata

SEQ ID NO: 7382407 - DNA, 19 bp, Homo sapiens
tttgatagggcataatata

SEQ ID NO: 7382408 - DNA, 22 bp, Homo sapiens
tttgatagttgattaaattcca

SEQ ID NO: 7382409 - DNA, 17 bp, Homo sapiens
tttgatagaatcagagt

SEQ ID NO: 7382410 - DNA, 19 bp, Homo sapiens
tttgatatctgaattatgc

SEQ ID NO: 7382411 - DNA, 22 bp, Homo sapiens
tttgatatcttggtatacagat

SEQ ID NO: 7382412 - DNA, 22 bp, Homo sapiens
tttgataatacacaagagaaag

SEQ ID NO: 7382413 - DNA, 22 bp, Homo sapiens
tttgataacagtgaatatcatg

SEQ ID NO: 7382414 - DNA, 22 bp, Homo sapiens
tttgagtaggcttatattttgg

SEQ ID NO: 7382415 - DNA, 22 bp, Homo sapiens
tttgaggttagctagcagatca

SEQ ID NO: 7382416 - DNA, 22 bp, Homo sapiens
aaggcaattggcttgtataaga

SEQ ID NO: 7382417 - DNA, 22 bp, Homo sapiens
aaggcacagaggcagggcactt

SEQ ID NO: 7382418 - DNA, 22 bp, Homo sapiens
aaggcacacagttagatagagc

SEQ ID NO: 7382419 - DNA, 22 bp, Homo sapiens
aaggcacacagttagatagagc

SEQ ID NO: 7382420 - DNA, 22 bp, Homo sapiens
aaggcacaacacaagagggtga

SEQ ID NO: 7382421 - DNA, 22 bp, Homo sapiens
aaggcacagaggcagggcactt

SEQ ID NO: 7382422 - DNA, 22 bp, Homo sapiens
aaggcacagaggcagggcactt

SEQ ID NO: 7382423 - DNA, 22 bp, Homo sapiens
aaggcacatattttagagtcac

SEQ ID NO: 7382424 - DNA, 17 bp, Homo sapiens
aaggcacagggcactgg

SEQ ID NO: 7382425 - DNA, 22 bp, Homo sapiens
aaggcacagccacttgatcatc

SEQ ID NO: 7382426 - DNA, 22 bp, Homo sapiens
aaggcacagccacttgatcatc

SEQ ID NO: 7382427 - DNA, 18 bp, Homo sapiens
aaggcacaggagaacatt

SEQ ID NO: 7382428 - DNA, 18 bp, Homo sapiens
aaggcacaggagaacatt

SEQ ID NO: 7382429 - DNA, 22 bp, Homo sapiens
aaggcaatgagggagatagagt

SEQ ID NO: 7382430 - DNA, 22 bp, Homo sapiens
aaggcaatgactgatttagaat

SEQ ID NO: 7382431 - DNA, 22 bp, Homo sapiens
aaggcaaatgtgttcttttagt

SEQ ID NO: 7382432 - DNA, 22 bp, Homo sapiens
aaggccagagtactagaggctg

SEQ ID NO: 7382433 - DNA, 22 bp, Homo sapiens
aaggcacattcctgaaaacaat

SEQ ID NO: 7382434 - DNA, 22 bp, Homo sapiens
aaggcacatattttagagtcac

SEQ ID NO: 7382435 - DNA, 22 bp, Homo sapiens
aaggcacatgacctaggcctgg

SEQ ID NO: 7382436 - DNA, 22 bp, Homo sapiens
aaggccagccctaatgatgctc

SEQ ID NO: 7382437 - DNA, 22 bp, Homo sapiens
aaggccagagttgaactgctcc

SEQ ID NO: 7382438 - DNA, 22 bp, Homo sapiens
aaggccagattctctctagggg

SEQ ID NO: 7382439 - DNA, 22 bp, Homo sapiens
aaggccagattctctctagggg

SEQ ID NO: 7382440 - DNA, 22 bp, Homo sapiens
acatctcatgaatgataaatca

SEQ ID NO: 7382441 - DNA, 22 bp, Homo sapiens
acatctcatgaatgataaatca

SEQ ID NO: 7382442 - DNA, 22 bp, Homo sapiens
acatcctcggggaaaggcactg

SEQ ID NO: 7382443 - DNA, 22 bp, Homo sapiens
acatcctcccgatctactggct

SEQ ID NO: 7382444 - DNA, 22 bp, Homo sapiens
acatcctcccgatctactggct

SEQ ID NO: 7382445 - DNA, 22 bp, Homo sapiens
acatcctcccgatctactggct

SEQ ID NO: 7382446 - DNA, 22 bp, Homo sapiens
acatctcaaattccaggctcca

SEQ ID NO: 7382447 - DNA, 22 bp, Homo sapiens
aaggaatcacttctttaaatga

SEQ ID NO: 7382448 - DNA, 21 bp, Homo sapiens
aaggaatgaatggatggatga

SEQ ID NO: 7382449 - DNA, 22 bp, Homo sapiens
aaggaaggttcatagtcaaaga

SEQ ID NO: 7382450 - DNA, 20 bp, Homo sapiens
aaggaatatttgtatctggg

SEQ ID NO: 7382451 - DNA, 22 bp, Homo sapiens
aaggaaggtactcagtgattct

SEQ ID NO: 7382452 - DNA, 22 bp, Homo sapiens
aaggaagggaaatagtgatgtc

SEQ ID NO: 7382453 - DNA, 22 bp, Homo sapiens
aaggacaggagaaaacgggatc

SEQ ID NO: 7382454 - DNA, 22 bp, Homo sapiens
aaggacacctgcagagggacca

SEQ ID NO: 7382455 - DNA, 22 bp, Homo sapiens
aaggacaagtagtatttgcatc

SEQ ID NO: 7382456 - DNA, 22 bp, Homo sapiens
aaggcaaaagaggtgtcatcac

SEQ ID NO: 7382457 - DNA, 22 bp, Homo sapiens
aaggatgaacattaatacatca

SEQ ID NO: 7382458 - DNA, 22 bp, Homo sapiens
aaggatgattggtaatgacact

SEQ ID NO: 7382459 - DNA, 22 bp, Homo sapiens
aaggatgattggtaatgacact

SEQ ID NO: 7382460 - DNA, 22 bp, Homo sapiens
aaggatcatgtatatgtttaag

SEQ ID NO: 7382461 - DNA, 22 bp, Homo sapiens
aagctgttctgaatcagtaagt

SEQ ID NO: 7382462 - DNA, 22 bp, Homo sapiens
aagcttcttagaatgcatgtgc

SEQ ID NO: 7382463 - DNA, 22 bp, Homo sapiens
aagcttctttacaggagagatt

SEQ ID NO: 7382464 - DNA, 22 bp, Homo sapiens
aagctgtgcctttgcctagaat

SEQ ID NO: 7382465 - DNA, 22 bp, Homo sapiens
aagctgtgtattacagaatatt

SEQ ID NO: 7382466 - DNA, 21 bp, Homo sapiens
acctcctggcatcctgttccc

SEQ ID NO: 7382467 - DNA, 22 bp, Homo sapiens
acctatttatgcaattatgaaa

SEQ ID NO: 7382468 - DNA, 17 bp, Homo sapiens
acctattgatctgtcac

SEQ ID NO: 7382469 - DNA, 22 bp, Homo sapiens
acccagggctcaagcgtaggca

SEQ ID NO: 7382470 - DNA, 22 bp, Homo sapiens
acccagggcttaaggcggtgca

SEQ ID NO: 7382471 - DNA, 21 bp, Homo sapiens
acccaggggaagcagaaactg

SEQ ID NO: 7382472 - DNA, 21 bp, Homo sapiens
acccaggggaagcagaaactg

SEQ ID NO: 7382473 - DNA, 22 bp, Homo sapiens
acccaggggcagccttgctgtg

SEQ ID NO: 7382474 - DNA, 22 bp, Homo sapiens
acccagggccacagcccgcagt

SEQ ID NO: 7382475 - DNA, 22 bp, Homo sapiens
acccagggctcaagcgtaggca

SEQ ID NO: 7382476 - DNA, 22 bp, Homo sapiens
acccagggagtgctcctgttct

SEQ ID NO: 7382477 - DNA, 22 bp, Homo sapiens
acccagggcagccagcggggag

SEQ ID NO: 7382478 - DNA, 22 bp, Homo sapiens
acccagggtagaacctcagagc

SEQ ID NO: 7382479 - DNA, 22 bp, Homo sapiens
acccagggtagaacctcagagc

SEQ ID NO: 7382480 - DNA, 19 bp, Homo sapiens
acccaggggtttatgtgtg

SEQ ID NO: 7382481 - DNA, 22 bp, Homo sapiens
acccaggggcgaagctggccac

SEQ ID NO: 7382482 - DNA, 22 bp, Homo sapiens
aagtccctggtgctggctgcgc

SEQ ID NO: 7382483 - DNA, 22 bp, Homo sapiens
aagtccctggttcctagcaaaa

SEQ ID NO: 7382484 - DNA, 22 bp, Homo sapiens
aagtccctttaatcagtgcctt

SEQ ID NO: 7382485 - DNA, 22 bp, Homo sapiens
aagtaggaatccgaatgagtag

SEQ ID NO: 7382486 - DNA, 22 bp, Homo sapiens
aagtataagctattcttcatga

SEQ ID NO: 7382487 - DNA, 22 bp, Homo sapiens
aagtagttagtccgcctgctct

SEQ ID NO: 7382488 - DNA, 22 bp, Homo sapiens
aagtataagctattcttcatga

SEQ ID NO: 7382489 - DNA, 22 bp, Homo sapiens
aagtatatactaaatgttaatc

SEQ ID NO: 7382490 - DNA, 22 bp, Homo sapiens
aagtatatactaaatgttaatc

SEQ ID NO: 7382491 - DNA, 22 bp, Homo sapiens
aagtcatcactcctctgaactt

SEQ ID NO: 7382492 - DNA, 22 bp, Homo sapiens
aagtcatctgaaactggcttat

SEQ ID NO: 7382493 - DNA, 22 bp, Homo sapiens
aagggcagagggaatcccacat

SEQ ID NO: 7382494 - DNA, 22 bp, Homo sapiens
acatttcagatgtaatgtgatg

SEQ ID NO: 7382495 - DNA, 22 bp, Homo sapiens
acatttcagattcatgaagtga

SEQ ID NO: 7382496 - DNA, 22 bp, Homo sapiens
acatttcagatgtaatgtgatg

SEQ ID NO: 7382497 - DNA, 20 bp, Homo sapiens
aagggcagagggaacagact

SEQ ID NO: 7382498 - DNA, 22 bp, Homo sapiens
aagggcacagggaaagagtgca

SEQ ID NO: 7382499 - DNA, 22 bp, Homo sapiens
aagggcacagggaaagagtgca

SEQ ID NO: 7382500 - DNA, 22 bp, Homo sapiens
aagggcaagatcctaagcatcc

SEQ ID NO: 7382501 - DNA, 22 bp, Homo sapiens
aagggaggtaaagctatttaaa

SEQ ID NO: 7382502 - DNA, 20 bp, Homo sapiens
aagggagaataatgattgta

SEQ ID NO: 7382503 - DNA, 22 bp, Homo sapiens
acatttcagtaagtgttaattt

SEQ ID NO: 7382504 - DNA, 22 bp, Homo sapiens
acatttcagcgtgcatgacatg

SEQ ID NO: 7382505 - DNA, 22 bp, Homo sapiens
acatttcagcgtgcatgacatg

SEQ ID NO: 7382506 - DNA, 22 bp, Homo sapiens
acatttcagtgagctattgaag

SEQ ID NO: 7382507 - DNA, 22 bp, Homo sapiens
accagagggagacttcctcttc

SEQ ID NO: 7382508 - DNA, 22 bp, Homo sapiens
accagaggaggaattaccttcc

SEQ ID NO: 7382509 - DNA, 22 bp, Homo sapiens
accagaggcagtttcggctggt

SEQ ID NO: 7382510 - DNA, 22 bp, Homo sapiens
aatctacatgcaatatttttag

SEQ ID NO: 7382511 - DNA, 22 bp, Homo sapiens
aatctacatgcaatatttttag

SEQ ID NO: 7382512 - DNA, 22 bp, Homo sapiens
aatctagtttcagactttgagt

SEQ ID NO: 7382513 - DNA, 22 bp, Homo sapiens
aatcctgtcttgccatccaata

SEQ ID NO: 7382514 - DNA, 22 bp, Homo sapiens
aatcacatcactgagaatgagg

SEQ ID NO: 7382515 - DNA, 22 bp, Homo sapiens
aatcacagttagtaagggagaa

SEQ ID NO: 7382516 - DNA, 22 bp, Homo sapiens
agaaagctggagtcaagcagag

SEQ ID NO: 7382517 - DNA, 22 bp, Homo sapiens
agaaagctggagtcaagcagag

SEQ ID NO: 7382518 - DNA, 22 bp, Homo sapiens
agaaactgacaggaaatgaatt

SEQ ID NO: 7382519 - DNA, 22 bp, Homo sapiens
agaaaggattagtttggtataa

SEQ ID NO: 7382520 - DNA, 22 bp, Homo sapiens
aatagccactttagagcaggtg

SEQ ID NO: 7382521 - DNA, 22 bp, Homo sapiens
aatagctgattaatgtactacc

SEQ ID NO: 7382522 - DNA, 22 bp, Homo sapiens
aatagtaaaagatacagctaat

SEQ ID NO: 7382523 - DNA, 22 bp, Homo sapiens
aataggcagcttagcaggggct

SEQ ID NO: 7382524 - DNA, 22 bp, Homo sapiens
aataggcagttggatatgcaag

SEQ ID NO: 7382525 - DNA, 22 bp, Homo sapiens
aatagcttttgtatgatgaaat

SEQ ID NO: 7382526 - DNA, 22 bp, Homo sapiens
aataggaaaatatttaacaaga

SEQ ID NO: 7382527 - DNA, 22 bp, Homo sapiens
aatagcttgcctaatcctcatg

SEQ ID NO: 7382528 - DNA, 22 bp, Homo sapiens
aatagctttggtcaccatctgg

SEQ ID NO: 7382529 - DNA, 22 bp, Homo sapiens
acttttaaggggccttgattta

SEQ ID NO: 7382530 - DNA, 22 bp, Homo sapiens
aatcaagagttgtgtaatattt

SEQ ID NO: 7382531 - DNA, 22 bp, Homo sapiens
actttgtttggctattagagtc

SEQ ID NO: 7382532 - DNA, 22 bp, Homo sapiens
actttgtttccatatttgtagc

SEQ ID NO: 7382533 - DNA, 22 bp, Homo sapiens
acttttaaatgagtttcagttg

SEQ ID NO: 7382534 - DNA, 22 bp, Homo sapiens
actttgttgaagaatatgttag

SEQ ID NO: 7382535 - DNA, 22 bp, Homo sapiens
actttgttgatgaaatagtttt

SEQ ID NO: 7382536 - DNA, 22 bp, Homo sapiens
aatgcattccactgagatttgt

SEQ ID NO: 7382537 - DNA, 22 bp, Homo sapiens
aatgcattctcggtttgtgtgt

SEQ ID NO: 7382538 - DNA, 22 bp, Homo sapiens
aatgcattagctacatatgtct

SEQ ID NO: 7382539 - DNA, 22 bp, Homo sapiens
aatgccattttaggcatgtcct

SEQ ID NO: 7382540 - DNA, 22 bp, Homo sapiens
aatgcctcttttctccagtcca

SEQ ID NO: 7382541 - DNA, 23 bp, Homo sapiens
aatgccatattggatttcttcag

SEQ ID NO: 7382542 - DNA, 18 bp, Homo sapiens
aatgcatttatggagatg

SEQ ID NO: 7382543 - DNA, 22 bp, Homo sapiens
aatgcattttattatatgtgac

SEQ ID NO: 7382544 - DNA, 22 bp, Homo sapiens
agaaggaagccaggagggtgca

SEQ ID NO: 7382545 - DNA, 21 bp, Homo sapiens
agaactaagactcagcagtac

SEQ ID NO: 7382546 - DNA, 22 bp, Homo sapiens
agaacacacgtcagagtttcct

SEQ ID NO: 7382547 - DNA, 22 bp, Homo sapiens
agaagaaagattgaaggttcct

SEQ ID NO: 7382548 - DNA, 22 bp, Homo sapiens
agaagaaactgtcggggatatt

SEQ ID NO: 7382549 - DNA, 22 bp, Homo sapiens
aatgaataccgtttcactcagt

SEQ ID NO: 7382550 - DNA, 22 bp, Homo sapiens
aagtgtctgcaaaatgacagag

SEQ ID NO: 7382551 - DNA, 22 bp, Homo sapiens
aagtgggtcagggacagatctt

SEQ ID NO: 7382552 - DNA, 22 bp, Homo sapiens
acctgcctatggagccacatgg

SEQ ID NO: 7382553 - DNA, 22 bp, Homo sapiens
aagtgtgggactagggctccag

SEQ ID NO: 7382554 - DNA, 22 bp, Homo sapiens
aagtgtgttctctgataaactc

SEQ ID NO: 7382555 - DNA, 22 bp, Homo sapiens
aagtgtttatttataacgatct

SEQ ID NO: 7382556 - DNA, 22 bp, Homo sapiens
aagtgtttacttaaagtcatgg

SEQ ID NO: 7382557 - DNA, 22 bp, Homo sapiens
actcttgtctcaacttttgtat

SEQ ID NO: 7382558 - DNA, 18 bp, Homo sapiens
aagttccacaagagatct

SEQ ID NO: 7382559 - DNA, 18 bp, Homo sapiens
actgcaggagaggtgagg

SEQ ID NO: 7382560 - DNA, 22 bp, Homo sapiens
actgcactccagcctgggtgac

SEQ ID NO: 7382561 - DNA, 21 bp, Homo sapiens
aataaaacagttggtgtcaat

SEQ ID NO: 7382562 - DNA, 22 bp, Homo sapiens
aataaaatgaactggtagagtt

SEQ ID NO: 7382563 - DNA, 22 bp, Homo sapiens
aagtttttggtagagaaaagta

SEQ ID NO: 7382564 - DNA, 22 bp, Homo sapiens
aagtttttcacattgctgttgt

SEQ ID NO: 7382565 - DNA, 22 bp, Homo sapiens
actgggagggtcttgaagaggg

SEQ ID NO: 7382566 - DNA, 22 bp, Homo sapiens
actgggagtcatgaggaaggag

SEQ ID NO: 7382567 - DNA, 22 bp, Homo sapiens
actgggagttctccatgtccct

SEQ ID NO: 7382568 - DNA, 22 bp, Homo sapiens
aataaaatggtcagttttctca

SEQ ID NO: 7382569 - DNA, 22 bp, Homo sapiens
actggctgagtttatgttcaca

SEQ ID NO: 7382570 - DNA, 22 bp, Homo sapiens
actggctgatatggctaggaag

SEQ ID NO: 7382571 - DNA, 22 bp, Homo sapiens
actgggaggcatctggagctga

SEQ ID NO: 7382572 - DNA, 22 bp, Homo sapiens
aataatacttcgtaaagttgtt

SEQ ID NO: 7382573 - DNA, 22 bp, Homo sapiens
aataatacatgagattaatgtt

SEQ ID NO: 7382574 - DNA, 22 bp, Homo sapiens
actgtacatgcatcttgtctat

SEQ ID NO: 7382575 - DNA, 22 bp, Homo sapiens
actgtacacgtgtcatttacag

SEQ ID NO: 7382576 - DNA, 22 bp, Homo sapiens
actgtaaggtaaggataaaacc

SEQ ID NO: 7382577 - DNA, 22 bp, Homo sapiens
acacaagaataatgatgaaggt

SEQ ID NO: 7382578 - DNA, 21 bp, Homo sapiens
acacaagcactcgtacatacg

SEQ ID NO: 7382579 - DNA, 22 bp, Homo sapiens
acacaagattgtgtattgaatt

SEQ ID NO: 7382580 - DNA, 17 bp, Homo sapiens
acacaagcaccttgagg

SEQ ID NO: 7382581 - DNA, 22 bp, Homo sapiens
acacaataaatttatcctttga

SEQ ID NO: 7382582 - DNA, 22 bp, Homo sapiens
acacaagtccctccatactctc

SEQ ID NO: 7382583 - DNA, 22 bp, Homo sapiens
acacaatgtgcaggacacctgt

SEQ ID NO: 7382584 - DNA, 22 bp, Homo sapiens
acacacaactcattgtgtaata

SEQ ID NO: 7382585 - DNA, 22 bp, Homo sapiens
agcagggactgagccagtggga

SEQ ID NO: 7382586 - DNA, 22 bp, Homo sapiens
agcagggactgagccagtggga

SEQ ID NO: 7382587 - DNA, 22 bp, Homo sapiens
acacatctcaggggacactctc

SEQ ID NO: 7382588 - DNA, 22 bp, Homo sapiens
acacatcatgccaagtttcacc

SEQ ID NO: 7382589 - DNA, 19 bp, Homo sapiens
agcaggccacagggccagc

SEQ ID NO: 7382590 - DNA, 22 bp, Homo sapiens
agccagaggaagcctggccctc

SEQ ID NO: 7382591 - DNA, 22 bp, Homo sapiens
acacttcacccctgctcccagt

SEQ ID NO: 7382592 - DNA, 22 bp, Homo sapiens
agccagagattgagatgcaggc

SEQ ID NO: 7382593 - DNA, 23 bp, Homo sapiens
acacttcacccattgtgatagga

SEQ ID NO: 7382594 - DNA, 22 bp, Homo sapiens
acacttcaaatggttggaaaat

SEQ ID NO: 7382595 - DNA, 22 bp, Homo sapiens
acacttcaaatggttggaaaat

SEQ ID NO: 7382596 - DNA, 23 bp, Homo sapiens
acacttcacccattgtgatagga

SEQ ID NO: 7382597 - DNA, 22 bp, Homo sapiens
acacttaagcatgaagtataaa

SEQ ID NO: 7382598 - DNA, 22 bp, Homo sapiens
acacttcaaagggtgacttgat

SEQ ID NO: 7382599 - DNA, 22 bp, Homo sapiens
acacttacggttccttcatcca

SEQ ID NO: 7382600 - DNA, 22 bp, Homo sapiens
acactgttgctggcacagacag

SEQ ID NO: 7382601 - DNA, 22 bp, Homo sapiens
agccagaggccagcctgcctca

SEQ ID NO: 7382602 - DNA, 22 bp, Homo sapiens
agccagaggtcatgagcacagg

SEQ ID NO: 7382603 - DNA, 19 bp, Homo sapiens
agccagagtggcccagggg

SEQ ID NO: 7382604 - DNA, 22 bp, Homo sapiens
agccagctgtactgcctgctca

SEQ ID NO: 7382605 - DNA, 22 bp, Homo sapiens
agccagctgtcctccctttcct

SEQ ID NO: 7382606 - DNA, 22 bp, Homo sapiens
agccaggaagaaggtcacacca

SEQ ID NO: 7382607 - DNA, 22 bp, Homo sapiens
agccaggaagagaggcctcacc

SEQ ID NO: 7382608 - DNA, 22 bp, Homo sapiens
agccaggaaccagctacagtct

SEQ ID NO: 7382609 - DNA, 22 bp, Homo sapiens
agccaggaagaaggtcacacca

SEQ ID NO: 7382610 - DNA, 22 bp, Homo sapiens
agccagctgttctggggcagca

SEQ ID NO: 7382611 - DNA, 22 bp, Homo sapiens
agccaggaaccagctacagtct

SEQ ID NO: 7382612 - DNA, 22 bp, Homo sapiens
agccaaggcagctagagctctg

SEQ ID NO: 7382613 - DNA, 22 bp, Homo sapiens
agccaagggtcagctgcacaga

SEQ ID NO: 7382614 - DNA, 22 bp, Homo sapiens
agccaaggtatcatgagaggca

SEQ ID NO: 7382615 - DNA, 22 bp, Homo sapiens
agccaaggtatcatgagaggca

SEQ ID NO: 7382616 - DNA, 22 bp, Homo sapiens
agccaaggtcgccccagggcaa

SEQ ID NO: 7382617 - DNA, 22 bp, Homo sapiens
agccaatgcgtaaaaagatcta

SEQ ID NO: 7382618 - DNA, 22 bp, Homo sapiens
acaccaggtcccgtctgtacct

SEQ ID NO: 7382619 - DNA, 21 bp, Homo sapiens
acacccacttatgcccgcttg

SEQ ID NO: 7382620 - DNA, 22 bp, Homo sapiens
acacccagattatgcacacaaa

SEQ ID NO: 7382621 - DNA, 20 bp, Homo sapiens
acagcagccttgctagaaac

SEQ ID NO: 7382622 - DNA, 22 bp, Homo sapiens
acagcagcctgcagccctgtgt

SEQ ID NO: 7382623 - DNA, 22 bp, Homo sapiens
acagcagcactattgacatttt

SEQ ID NO: 7382624 - DNA, 22 bp, Homo sapiens
acagcagcaatagcagtgacat

SEQ ID NO: 7382625 - DNA, 22 bp, Homo sapiens
acagcagatttccctgggctcc

SEQ ID NO: 7382626 - DNA, 22 bp, Homo sapiens
acagcagcaatagcagtgacat

SEQ ID NO: 7382627 - DNA, 22 bp, Homo sapiens
acagcagatctggctacaggtt

SEQ ID NO: 7382628 - DNA, 22 bp, Homo sapiens
acagcagatctgtggagcttat

SEQ ID NO: 7382629 - DNA, 22 bp, Homo sapiens
acagcagatgacaactatttat

SEQ ID NO: 7382630 - DNA, 22 bp, Homo sapiens
acagcagattacattctgctat

SEQ ID NO: 7382631 - DNA, 22 bp, Homo sapiens
acagcagagttgagtagttgca

SEQ ID NO: 7382632 - DNA, 22 bp, Homo sapiens
acagcagagtgtgagatagcca

SEQ ID NO: 7382633 - DNA, 20 bp, Homo sapiens
acagcagataccacaactat

SEQ ID NO: 7382634 - DNA, 22 bp, Homo sapiens
acagcagagtggagatgagcac

SEQ ID NO: 7382635 - DNA, 22 bp, Homo sapiens
acagcagaccactactagtagg

SEQ ID NO: 7382636 - DNA, 22 bp, Homo sapiens
acagatactcagctctatgctt

SEQ ID NO: 7382637 - DNA, 17 bp, Homo sapiens
acagcagggaagtgttg

SEQ ID NO: 7382638 - DNA, 22 bp, Homo sapiens
acagcagtggattagaggatgg

SEQ ID NO: 7382639 - DNA, 22 bp, Homo sapiens
agctgagggttcggtgtccaca

SEQ ID NO: 7382640 - DNA, 22 bp, Homo sapiens
acagaggctgcgcttgggaacg

SEQ ID NO: 7382641 - DNA, 22 bp, Homo sapiens
acagaggctgatcttcaagccc

SEQ ID NO: 7382642 - DNA, 23 bp, Homo sapiens
acagaggcttaaatgagtggcag

SEQ ID NO: 7382643 - DNA, 23 bp, Homo sapiens
acagaggcttaaatgagtggcag

SEQ ID NO: 7382644 - DNA, 22 bp, Homo sapiens
acagaggcctcgtaggtacaac

SEQ ID NO: 7382645 - DNA, 22 bp, Homo sapiens
acagaggcctcgtaggtacaac

SEQ ID NO: 7382646 - DNA, 22 bp, Homo sapiens
acagaggcctcggcctgcccag

SEQ ID NO: 7382647 - DNA, 22 bp, Homo sapiens
acagaggccgcctctctcacgg

SEQ ID NO: 7382648 - DNA, 22 bp, Homo sapiens
acagaggccccgtgggagagcc

SEQ ID NO: 7382649 - DNA, 22 bp, Homo sapiens
acagaggccccgtgggagagcc

SEQ ID NO: 7382650 - DNA, 22 bp, Homo sapiens
agcgtggatgtggggcgcggct

SEQ ID NO: 7382651 - DNA, 22 bp, Homo sapiens
agctaaatgcatttcaagactg

SEQ ID NO: 7382652 - DNA, 20 bp, Homo sapiens
agcggcagcttcctgcttcg

SEQ ID NO: 7382653 - DNA, 22 bp, Homo sapiens
acagaataactcttgcttgagt

SEQ ID NO: 7382654 - DNA, 22 bp, Homo sapiens
acagaataaggtttatctctcc

SEQ ID NO: 7382655 - DNA, 22 bp, Homo sapiens
acagaagtgagtggcaagaact

SEQ ID NO: 7382656 - DNA, 22 bp, Homo sapiens
agccaggaagagaggcctcacc

SEQ ID NO: 7382657 - DNA, 22 bp, Homo sapiens
agccaggaatgcatgctctgct

SEQ ID NO: 7382658 - DNA, 19 bp, Homo sapiens
acagaagcatagaaaagga

SEQ ID NO: 7382659 - DNA, 21 bp, Homo sapiens
acagaagcggcgagtggcccc

SEQ ID NO: 7382660 - DNA, 22 bp, Homo sapiens
acagaaggcggggacaaggcgg

SEQ ID NO: 7382661 - DNA, 22 bp, Homo sapiens
acagaagctcaagagagcagtg

SEQ ID NO: 7382662 - DNA, 22 bp, Homo sapiens
acagaatattggttactgttgc

SEQ ID NO: 7382663 - DNA, 22 bp, Homo sapiens
acagaggcagtgtgagatactg

SEQ ID NO: 7382664 - DNA, 21 bp, Homo sapiens
acagaggcatacagcttaagg

SEQ ID NO: 7382665 - DNA, 22 bp, Homo sapiens
acagaggccatgagctgccacc

SEQ ID NO: 7382666 - DNA, 22 bp, Homo sapiens
acagaatgggatttgaatattt

SEQ ID NO: 7382667 - DNA, 17 bp, Homo sapiens
acagaggcaggagtgga

SEQ ID NO: 7382668 - DNA, 22 bp, Homo sapiens
aattaattttgttcattcagtc

SEQ ID NO: 7382669 - DNA, 22 bp, Homo sapiens
aattaattttgttcattcagtc

SEQ ID NO: 7382670 - DNA, 22 bp, Homo sapiens
aattaattttgttcattcagtc

SEQ ID NO: 7382671 - DNA, 21 bp, Homo sapiens
aattacagatggaattacaga

SEQ ID NO: 7382672 - DNA, 23 bp, Homo sapiens
aattacaaccaagaactggaagg

SEQ ID NO: 7382673 - DNA, 22 bp, Homo sapiens
aattaactaaaattcactttat

SEQ ID NO: 7382674 - DNA, 22 bp, Homo sapiens
aattaactaaaattcactttat

SEQ ID NO: 7382675 - DNA, 22 bp, Homo sapiens
aattaacagagggcttattact

SEQ ID NO: 7382676 - DNA, 22 bp, Homo sapiens
agagctgcacctatgcagacct

SEQ ID NO: 7382677 - DNA, 22 bp, Homo sapiens
agagctgcaatttcatgtggtg

SEQ ID NO: 7382678 - DNA, 22 bp, Homo sapiens
agagctgcgtctattcacaatc

SEQ ID NO: 7382679 - DNA, 22 bp, Homo sapiens
agagctgcccacacagcagatt

SEQ ID NO: 7382680 - DNA, 22 bp, Homo sapiens
agagctgctcagatgtcactgc

SEQ ID NO: 7382681 - DNA, 22 bp, Homo sapiens
aattcattgccagaatctatga

SEQ ID NO: 7382682 - DNA, 22 bp, Homo sapiens
aattcattgccagaatctatga

SEQ ID NO: 7382683 - DNA, 22 bp, Homo sapiens
agaggcaaaaatctatggcaac

SEQ ID NO: 7382684 - DNA, 22 bp, Homo sapiens
agaggatggttgaggaagacct

SEQ ID NO: 7382685 - DNA, 22 bp, Homo sapiens
agaggatgattttaaggacact

SEQ ID NO: 7382686 - DNA, 22 bp, Homo sapiens
agaggatgattttaaggacact

SEQ ID NO: 7382687 - DNA, 22 bp, Homo sapiens
agacatgacagatagttgctag

SEQ ID NO: 7382688 - DNA, 22 bp, Homo sapiens
aatgctaaaacacagatttttg

SEQ ID NO: 7382689 - DNA, 22 bp, Homo sapiens
aatgctaaatgtgttatgttaa

SEQ ID NO: 7382690 - DNA, 22 bp, Homo sapiens
aatgccttggagagcctagagg

SEQ ID NO: 7382691 - DNA, 22 bp, Homo sapiens
aatgccttggagagcctagagg

SEQ ID NO: 7382692 - DNA, 22 bp, Homo sapiens
aatgctctttaacctattctga

SEQ ID NO: 7382693 - DNA, 22 bp, Homo sapiens
agacatgtcaccaattcttact

SEQ ID NO: 7382694 - DNA, 22 bp, Homo sapiens
aatgtataaccataggaaattt

SEQ ID NO: 7382695 - DNA, 22 bp, Homo sapiens
aatgtataatatttaatgcttt

SEQ ID NO: 7382696 - DNA, 22 bp, Homo sapiens
aatgtataaccataggaaattt

SEQ ID NO: 7382697 - DNA, 22 bp, Homo sapiens
agacatttattcacacatttat

SEQ ID NO: 7382698 - DNA, 22 bp, Homo sapiens
agacatttagacccctgtagtt

SEQ ID NO: 7382699 - DNA, 22 bp, Homo sapiens
agacatttatgtttctctagga

SEQ ID NO: 7382700 - DNA, 22 bp, Homo sapiens
aatgtatgacagttctagtggt

SEQ ID NO: 7382701 - DNA, 22 bp, Homo sapiens
aatgtattatacataatttgtg

SEQ ID NO: 7382702 - DNA, 22 bp, Homo sapiens
aatgtattatacataatttgtg

SEQ ID NO: 7382703 - DNA, 22 bp, Homo sapiens
agagatgaaaagggtactgagg

SEQ ID NO: 7382704 - DNA, 22 bp, Homo sapiens
agagatgaaaagtggagactgg

SEQ ID NO: 7382705 - DNA, 22 bp, Homo sapiens
agagatgaaaagggtactgagg

SEQ ID NO: 7382706 - DNA, 22 bp, Homo sapiens
aatgtgtatatgaacatacagg

SEQ ID NO: 7382707 - DNA, 22 bp, Homo sapiens
aatgtgtataagggagagctaa

SEQ ID NO: 7382708 - DNA, 22 bp, Homo sapiens
agagcaatttcttctccaagtt

SEQ ID NO: 7382709 - DNA, 22 bp, Homo sapiens
agagcaatggcatccagctgat

SEQ ID NO: 7382710 - DNA, 22 bp, Homo sapiens
agagcaaatagagaagccagct

SEQ ID NO: 7382711 - DNA, 22 bp, Homo sapiens
agagcaaagggacatggaagag

SEQ ID NO: 7382712 - DNA, 22 bp, Homo sapiens
agagcaaatagagaagccagct

SEQ ID NO: 7382713 - DNA, 22 bp, Homo sapiens
agagcaaagggacatggaagag

SEQ ID NO: 7382714 - DNA, 22 bp, Homo sapiens
agagaaggggtaaagagtcctg

SEQ ID NO: 7382715 - DNA, 22 bp, Homo sapiens
agagaagggggaaagatctcac

SEQ ID NO: 7382716 - DNA, 22 bp, Homo sapiens
aatgtgtagcatttaatgcagt

SEQ ID NO: 7382717 - DNA, 22 bp, Homo sapiens
aatgtgtagggtgcctgttttt

SEQ ID NO: 7382718 - DNA, 22 bp, Homo sapiens
aatgtgtagcatttaatgcagt

SEQ ID NO: 7382719 - DNA, 22 bp, Homo sapiens
aatgtgtacatgacagatagaa

SEQ ID NO: 7382720 - DNA, 22 bp, Homo sapiens
aatgtgtactttttcatgctca

SEQ ID NO: 7382721 - DNA, 22 bp, Homo sapiens
aatgtgtactttttcatgctca

SEQ ID NO: 7382722 - DNA, 22 bp, Homo sapiens
agagaaggcatagaacttgagt

SEQ ID NO: 7382723 - DNA, 22 bp, Homo sapiens
acaatagaaggaaactgacata

SEQ ID NO: 7382724 - DNA, 22 bp, Homo sapiens
agcaaggcagtcagctggctgg

SEQ ID NO: 7382725 - DNA, 22 bp, Homo sapiens
agcaaatacttgaataaaaaga

SEQ ID NO: 7382726 - DNA, 22 bp, Homo sapiens
agcaaatacatttttagcataa

SEQ ID NO: 7382727 - DNA, 19 bp, Homo sapiens
agcaaatataatagtgttc

SEQ ID NO: 7382728 - DNA, 22 bp, Homo sapiens
agcaaataaagacaattatgtc

SEQ ID NO: 7382729 - DNA, 23 bp, Homo sapiens
agcaaataatctgcttgcttttt

SEQ ID NO: 7382730 - DNA, 22 bp, Homo sapiens
agcaaataaagacaattatgtc

SEQ ID NO: 7382731 - DNA, 22 bp, Homo sapiens
agcaaatacatttttagcataa

SEQ ID NO: 7382732 - DNA, 19 bp, Homo sapiens
agcaaatacatcaaaattg

SEQ ID NO: 7382733 - DNA, 22 bp, Homo sapiens
agcaaataattgtctttgaggg

SEQ ID NO: 7382734 - DNA, 22 bp, Homo sapiens
agcaaagtagctgctgttctta

SEQ ID NO: 7382735 - DNA, 22 bp, Homo sapiens
acaacattcttaaatacactga

SEQ ID NO: 7382736 - DNA, 22 bp, Homo sapiens
acaacattcttaaatacactga

SEQ ID NO: 7382737 - DNA, 22 bp, Homo sapiens
acaacattcttaaatacactga

SEQ ID NO: 7382738 - DNA, 22 bp, Homo sapiens
agcaaaagatagattaacaaga

SEQ ID NO: 7382739 - DNA, 18 bp, Homo sapiens
agattttgagaaatacaa

SEQ ID NO: 7382740 - DNA, 22 bp, Homo sapiens
agcacaggctttggtgtgaggg

SEQ ID NO: 7382741 - DNA, 22 bp, Homo sapiens
agcacaggacgtagagcttgga

SEQ ID NO: 7382742 - DNA, 22 bp, Homo sapiens
agcacagggcccagcctaggcc

SEQ ID NO: 7382743 - DNA, 22 bp, Homo sapiens
acacaaattgtaggataattgc

SEQ ID NO: 7382744 - DNA, 22 bp, Homo sapiens
acacaaattgtaggataattgc

SEQ ID NO: 7382745 - DNA, 22 bp, Homo sapiens
agcacaatataaagtgaacgca

SEQ ID NO: 7382746 - DNA, 22 bp, Homo sapiens
agcacacaggccacctccactt

SEQ ID NO: 7382747 - DNA, 22 bp, Homo sapiens
agcacaatgtgaaaagagctct

SEQ ID NO: 7382748 - DNA, 22 bp, Homo sapiens
aatttcttgggagctcagagaa

SEQ ID NO: 7382749 - DNA, 22 bp, Homo sapiens
aatttcttcagctctaaaatgg

SEQ ID NO: 7382750 - DNA, 22 bp, Homo sapiens
aatttcttcagctctaaaatgg

SEQ ID NO: 7382751 - DNA, 22 bp, Homo sapiens
aatttctcaattgttacaggtg

SEQ ID NO: 7382752 - DNA, 22 bp, Homo sapiens
aatttctcggttttgatattgt

SEQ ID NO: 7382753 - DNA, 23 bp, Homo sapiens
aatttggaaatgaggctaccaag

SEQ ID NO: 7382754 - DNA, 22 bp, Homo sapiens
aatttggaagatgttgtttatc

SEQ ID NO: 7382755 - DNA, 22 bp, Homo sapiens
aatttggacttgggtgctagag

SEQ ID NO: 7382756 - DNA, 22 bp, Homo sapiens
aatttggagagaaacaagtagg

SEQ ID NO: 7382757 - DNA, 22 bp, Homo sapiens
aatttggagagagattaatgtt

SEQ ID NO: 7382758 - DNA, 22 bp, Homo sapiens
aatttggagagaaacaagtagg

SEQ ID NO: 7382759 - DNA, 22 bp, Homo sapiens
aatttggaggtatttagctgtc

SEQ ID NO: 7382760 - DNA, 22 bp, Homo sapiens
aatttggagagagattaatgtt

SEQ ID NO: 7382761 - DNA, 22 bp, Homo sapiens
aatttggagctttgtttctaga

SEQ ID NO: 7382762 - DNA, 18 bp, Homo sapiens
aatttctttgacaactta

SEQ ID NO: 7382763 - DNA, 18 bp, Homo sapiens
aatttctttgacaactta

SEQ ID NO: 7382764 - DNA, 18 bp, Homo sapiens
aatttctttgacaactta

SEQ ID NO: 7382765 - DNA, 18 bp, Homo sapiens
aatttctttgacaactta

SEQ ID NO: 7382766 - DNA, 22 bp, Homo sapiens
aatttgtacaaaatgtttataa

SEQ ID NO: 7382767 - DNA, 22 bp, Homo sapiens
aatttgtacaaaatgtttataa

SEQ ID NO: 7382768 - DNA, 22 bp, Homo sapiens
agagttaagaggaatgtgaatt

SEQ ID NO: 7382769 - DNA, 22 bp, Homo sapiens
agagttaaatgaaatggtatgt

SEQ ID NO: 7382770 - DNA, 22 bp, Homo sapiens
acaaagtcttttacaacagtca

SEQ ID NO: 7382771 - DNA, 22 bp, Homo sapiens
acaaagtctctaataatcttct

SEQ ID NO: 7382772 - DNA, 22 bp, Homo sapiens
agagttcagaaagtgcaggttt

SEQ ID NO: 7382773 - DNA, 22 bp, Homo sapiens
agagttcagctactgcaaatgt

SEQ ID NO: 7382774 - DNA, 22 bp, Homo sapiens
acaaagtttgtggtattccaag

SEQ ID NO: 7382775 - DNA, 22 bp, Homo sapiens
agatctttagtgaagctaaatc

SEQ ID NO: 7382776 - DNA, 22 bp, Homo sapiens
acaaataggtagatttgcaaca

SEQ ID NO: 7382777 - DNA, 22 bp, Homo sapiens
acaacagtaggaaaacatgtct

SEQ ID NO: 7382778 - DNA, 22 bp, Homo sapiens
agatgctgctccacaggccagg

SEQ ID NO: 7382779 - DNA, 22 bp, Homo sapiens
agatgccttttatttattgtca

SEQ ID NO: 7382780 - DNA, 22 bp, Homo sapiens
agatgcctgccagttatttagc

SEQ ID NO: 7382781 - DNA, 22 bp, Homo sapiens
agatgcctaaatctgggcaagg

SEQ ID NO: 7382782 - DNA, 22 bp, Homo sapiens
aaatattggtaggatgcttgtt

SEQ ID NO: 7382783 - DNA, 22 bp, Homo sapiens
aaatcagaaaatatggagagga

SEQ ID NO: 7382784 - DNA, 22 bp, Homo sapiens
aaatcagacacagtgaaagtta

SEQ ID NO: 7382785 - DNA, 22 bp, Homo sapiens
aaatgaggttaatacagtgctt

SEQ ID NO: 7382786 - DNA, 22 bp, Homo sapiens
aaatgaggccagatcatgcaga

SEQ ID NO: 7382787 - DNA, 20 bp, Homo sapiens
aaatgcttttgacacatatt

SEQ ID NO: 7382788 - DNA, 20 bp, Homo sapiens
aaatgcttttgacacatatt

SEQ ID NO: 7382789 - DNA, 22 bp, Homo sapiens
aaatgcttgtatatttcttggt

SEQ ID NO: 7382790 - DNA, 22 bp, Homo sapiens
aaatgcttgctcttgattattt

SEQ ID NO: 7382791 - DNA, 22 bp, Homo sapiens
aaatgcttgtaaattttccatg

SEQ ID NO: 7382792 - DNA, 21 bp, Homo sapiens
aaatgctttgtatatatctgt

SEQ ID NO: 7382793 - DNA, 22 bp, Homo sapiens
aaatgcttgcaacatcccaggt

SEQ ID NO: 7382794 - DNA, 22 bp, Homo sapiens
aaatgcttcacctcattaaact

SEQ ID NO: 7382795 - DNA, 22 bp, Homo sapiens
aaatgcttgctcttgattattt

SEQ ID NO: 7382796 - DNA, 22 bp, Homo sapiens
aaatgcttagaggtgttcaaat

SEQ ID NO: 7382797 - DNA, 22 bp, Homo sapiens
aaatgcttagaggtgttcaaat

SEQ ID NO: 7382798 - DNA, 22 bp, Homo sapiens
aaatgcacaataaagtaaaggc

SEQ ID NO: 7382799 - DNA, 22 bp, Homo sapiens
aaatgcacaataaagtaaaggc

SEQ ID NO: 7382800 - DNA, 22 bp, Homo sapiens
aaatgattgtcaaagttctgtt

SEQ ID NO: 7382801 - DNA, 22 bp, Homo sapiens
aaatgcaaggccatgtgaagga

SEQ ID NO: 7382802 - DNA, 22 bp, Homo sapiens
aagagagagttcctaggcaaaa

SEQ ID NO: 7382803 - DNA, 22 bp, Homo sapiens
aagagagagcattcttctgtta

SEQ ID NO: 7382804 - DNA, 22 bp, Homo sapiens
aagagagaccatgggggacagg

SEQ ID NO: 7382805 - DNA, 22 bp, Homo sapiens
aagagagacaataggtagcatt

SEQ ID NO: 7382806 - DNA, 22 bp, Homo sapiens
aagagagaagtctctctggttc

SEQ ID NO: 7382807 - DNA, 22 bp, Homo sapiens
aagagagacaataggtagcatt

SEQ ID NO: 7382808 - DNA, 22 bp, Homo sapiens
aaatagtcctgggaatagtact

SEQ ID NO: 7382809 - DNA, 22 bp, Homo sapiens
aaatatactagatgatgaccca

SEQ ID NO: 7382810 - DNA, 19 bp, Homo sapiens
aaatatcagagagatgata

SEQ ID NO: 7382811 - DNA, 22 bp, Homo sapiens
aaatatagtgacacttatagtc

SEQ ID NO: 7382812 - DNA, 22 bp, Homo sapiens
aagagtttccatgctctgtgct

SEQ ID NO: 7382813 - DNA, 22 bp, Homo sapiens
aagagtttttggagtgtgagtt

SEQ ID NO: 7382814 - DNA, 22 bp, Homo sapiens
aagagtttttaatgggtactgg

SEQ ID NO: 7382815 - DNA, 22 bp, Homo sapiens
aagagttttagacaaactgatt

SEQ ID NO: 7382816 - DNA, 22 bp, Homo sapiens
aaatacagtgtgtgttctttga

SEQ ID NO: 7382817 - DNA, 22 bp, Homo sapiens
aaatacagtgtgtgttctttga

SEQ ID NO: 7382818 - DNA, 22 bp, Homo sapiens
aaatacataaaggttgtaccag

SEQ ID NO: 7382819 - DNA, 22 bp, Homo sapiens
aaatacataaaggttgtaccag

SEQ ID NO: 7382820 - DNA, 22 bp, Homo sapiens
aaatacaggagtttggacttct

SEQ ID NO: 7382821 - DNA, 19 bp, Homo sapiens
aaatacagcagctgtttcc

SEQ ID NO: 7382822 - DNA, 22 bp, Homo sapiens
aaatacagattcttgtgtctat

SEQ ID NO: 7382823 - DNA, 22 bp, Homo sapiens
aaatacaaaaattagccaggca

SEQ ID NO: 7382824 - DNA, 22 bp, Homo sapiens
aaatacaaaaattagccaggca

SEQ ID NO: 7382825 - DNA, 22 bp, Homo sapiens
aagaaggcggaccagaagggag

SEQ ID NO: 7382826 - DNA, 22 bp, Homo sapiens
aaagttgtaatggaagaaatgc

SEQ ID NO: 7382827 - DNA, 22 bp, Homo sapiens
aaagttgagtgctgatctgatt

SEQ ID NO: 7382828 - DNA, 19 bp, Homo sapiens
aaagttgagaaacaatgga

SEQ ID NO: 7382829 - DNA, 22 bp, Homo sapiens
aaagttctttttctataaatcc

SEQ ID NO: 7382830 - DNA, 22 bp, Homo sapiens
aaagggaagttgcacatgttcc

SEQ ID NO: 7382831 - DNA, 22 bp, Homo sapiens
aaaggcttttggtatataggag

SEQ ID NO: 7382832 - DNA, 22 bp, Homo sapiens
aaagggaaaatatttagacata

SEQ ID NO: 7382833 - DNA, 22 bp, Homo sapiens
aaaggctttccagcgcgcggac

SEQ ID NO: 7382834 - DNA, 22 bp, Homo sapiens
aaaggctttaaagaaccagaac

SEQ ID NO: 7382835 - DNA, 22 bp, Homo sapiens
aaaggctttgagaagtcctgca

SEQ ID NO: 7382836 - DNA, 22 bp, Homo sapiens
aaagggagcatggctgcaggga

SEQ ID NO: 7382837 - DNA, 22 bp, Homo sapiens
aaagggaatgtgtaggacatgt

SEQ ID NO: 7382838 - DNA, 22 bp, Homo sapiens
aaagtcacatataacaagggca

SEQ ID NO: 7382839 - DNA, 22 bp, Homo sapiens
aaaggcttggttctttgatgac

SEQ ID NO: 7382840 - DNA, 22 bp, Homo sapiens
aaaggcttgtacagcagccttc

SEQ ID NO: 7382841 - DNA, 22 bp, Homo sapiens
aaaggcttgtccagtaagggga

SEQ ID NO: 7382842 - DNA, 22 bp, Homo sapiens
aaaggctttaaaatgtacatat

SEQ ID NO: 7382843 - DNA, 22 bp, Homo sapiens
aaaggcttgtttgaggactggt

SEQ ID NO: 7382844 - DNA, 22 bp, Homo sapiens
aaaggcttctttgctccatgtc

SEQ ID NO: 7382845 - DNA, 22 bp, Homo sapiens
aaaggcttctttgctccatgtc

SEQ ID NO: 7382846 - DNA, 22 bp, Homo sapiens
aaaggcttctattggacgttgc

SEQ ID NO: 7382847 - DNA, 22 bp, Homo sapiens
aaaggcttgactagaagggaga

SEQ ID NO: 7382848 - DNA, 22 bp, Homo sapiens
aaaggcttgagcatttgttgaa

SEQ ID NO: 7382849 - DNA, 22 bp, Homo sapiens
aaaggcttgcgattccttgtaa

SEQ ID NO: 7382850 - DNA, 22 bp, Homo sapiens
aaaggcttggtattttggagtt

SEQ ID NO: 7382851 - DNA, 22 bp, Homo sapiens
aaaggcttaatgttgttgtaat

SEQ ID NO: 7382852 - DNA, 22 bp, Homo sapiens
aaaggcttaacagaagaccttt

SEQ ID NO: 7382853 - DNA, 22 bp, Homo sapiens
aaaggcttagacacagaactgt

SEQ ID NO: 7382854 - DNA, 22 bp, Homo sapiens
aaaggcttcacttatttatttt

SEQ ID NO: 7382855 - DNA, 22 bp, Homo sapiens
aaaggcttcggatcagaaggta

SEQ ID NO: 7382856 - DNA, 22 bp, Homo sapiens
aaaggcttcagtgagtgggtat

SEQ ID NO: 7382857 - DNA, 22 bp, Homo sapiens
aaaggcttctcagaaaggcctt

SEQ ID NO: 7382858 - DNA, 22 bp, Homo sapiens
aaaggcatgcatggtctgctcc

SEQ ID NO: 7382859 - DNA, 22 bp, Homo sapiens
aaaggctctaacaaggagagag

SEQ ID NO: 7382860 - DNA, 22 bp, Homo sapiens
aaaggctcagaatcggcagacc

SEQ ID NO: 7382861 - DNA, 22 bp, Homo sapiens
aaaggctatgagatagaagata

SEQ ID NO: 7382862 - DNA, 22 bp, Homo sapiens
aaagtcttcacggcactagtgt

SEQ ID NO: 7382863 - DNA, 22 bp, Homo sapiens
aaagtctttctcatagtcacgc

SEQ ID NO: 7382864 - DNA, 22 bp, Homo sapiens
aaagtcacgctgatgggaaatg

SEQ ID NO: 7382865 - DNA, 22 bp, Homo sapiens
aacttgaatgagaacttttgcc

SEQ ID NO: 7382866 - DNA, 22 bp, Homo sapiens
aaagttctattggatagtgctg

SEQ ID NO: 7382867 - DNA, 22 bp, Homo sapiens
aaagttctctatggtgtaaaaa

SEQ ID NO: 7382868 - DNA, 22 bp, Homo sapiens
aaagttctttctcttatttggt

SEQ ID NO: 7382869 - DNA, 22 bp, Homo sapiens
aaagttcttagattaatcactg

SEQ ID NO: 7382870 - DNA, 22 bp, Homo sapiens
aaagttcttcatttttattgga

SEQ ID NO: 7382871 - DNA, 22 bp, Homo sapiens
aaagttctgatgctgatcaaag

SEQ ID NO: 7382872 - DNA, 22 bp, Homo sapiens
aaagttctggagaaaataatga

SEQ ID NO: 7382873 - DNA, 22 bp, Homo sapiens
aaagttctgggggagaagaacg

SEQ ID NO: 7382874 - DNA, 22 bp, Homo sapiens
aaagcagcacatggatatcagt

SEQ ID NO: 7382875 - DNA, 22 bp, Homo sapiens
aaattgtatattccatttgtat

SEQ ID NO: 7382876 - DNA, 22 bp, Homo sapiens
aaattgtcagaattcagaaagt

SEQ ID NO: 7382877 - DNA, 22 bp, Homo sapiens
aaattgtccttttaagaaacag

SEQ ID NO: 7382878 - DNA, 22 bp, Homo sapiens
aaattgtctctattttgattcg

SEQ ID NO: 7382879 - DNA, 22 bp, Homo sapiens
aaattagatcagtggattttct

SEQ ID NO: 7382880 - DNA, 22 bp, Homo sapiens
aaattcatttttcttagtgtgc

SEQ ID NO: 7382881 - DNA, 22 bp, Homo sapiens
aaattcatttttcttagtgtgc

SEQ ID NO: 7382882 - DNA, 22 bp, Homo sapiens
aaagcatattaggactgaatta

SEQ ID NO: 7382883 - DNA, 22 bp, Homo sapiens
aaagcatagaattagagttagg

SEQ ID NO: 7382884 - DNA, 22 bp, Homo sapiens
aaagcattgtttcaagattaac

SEQ ID NO: 7382885 - DNA, 20 bp, Homo sapiens
aaagcatttacttgtgattg

SEQ ID NO: 7382886 - DNA, 22 bp, Homo sapiens
aaaggcacaaattcagcatttt

SEQ ID NO: 7382887 - DNA, 22 bp, Homo sapiens
aaaggcacaaattcagcatttt

SEQ ID NO: 7382888 - DNA, 22 bp, Homo sapiens
aaaggcacagaagggaaaccaa

SEQ ID NO: 7382889 - DNA, 22 bp, Homo sapiens
aaaggcacacactccttgttat

SEQ ID NO: 7382890 - DNA, 22 bp, Homo sapiens
aaaggcacacactccttgttat

SEQ ID NO: 7382891 - DNA, 22 bp, Homo sapiens
aaaggcacagaagggaaaccaa

SEQ ID NO: 7382892 - DNA, 23 bp, Homo sapiens
aaaggcacagcattgtctagcag

SEQ ID NO: 7382893 - DNA, 20 bp, Homo sapiens
aaaggcacagcaacagagct

SEQ ID NO: 7382894 - DNA, 20 bp, Homo sapiens
aaaggcacagcaacagagct

SEQ ID NO: 7382895 - DNA, 22 bp, Homo sapiens
aaaggcactagaagttaccttt

SEQ ID NO: 7382896 - DNA, 22 bp, Homo sapiens
aaaggcactagaagttaccttt

SEQ ID NO: 7382897 - DNA, 23 bp, Homo sapiens
aaaggcacagcattgtctagcag

SEQ ID NO: 7382898 - DNA, 22 bp, Homo sapiens
aaaggcactggatagctgggga

SEQ ID NO: 7382899 - DNA, 22 bp, Homo sapiens
aaaggcactgatcttatccagt

SEQ ID NO: 7382900 - DNA, 22 bp, Homo sapiens
aaaggcactggatagctgggga

SEQ ID NO: 7382901 - DNA, 22 bp, Homo sapiens
aaaggcactgatcttatccagt

SEQ ID NO: 7382902 - DNA, 22 bp, Homo sapiens
aacatgaaacccaaacagaata

SEQ ID NO: 7382903 - DNA, 22 bp, Homo sapiens
aaagttttattcaagcattagt

SEQ ID NO: 7382904 - DNA, 19 bp, Homo sapiens
aaagttttattctcatttg

SEQ ID NO: 7382905 - DNA, 22 bp, Homo sapiens
aaagttttctgccttcattaga

SEQ ID NO: 7382906 - DNA, 22 bp, Homo sapiens
aaagttttctgccttcattaga

SEQ ID NO: 7382907 - DNA, 22 bp, Homo sapiens
aaataaactgaagcacagagag

SEQ ID NO: 7382908 - DNA, 22 bp, Homo sapiens
aaataaactgaagcacagagag

SEQ ID NO: 7382909 - DNA, 22 bp, Homo sapiens
aaagtcattgctgttatcaatg

SEQ ID NO: 7382910 - DNA, 22 bp, Homo sapiens
aaagtcatgtaatgatatgatt

SEQ ID NO: 7382911 - DNA, 22 bp, Homo sapiens
aaagtcatgtttttgtttagca

SEQ ID NO: 7382912 - DNA, 22 bp, Homo sapiens
aaagtcattggaatattaatga

SEQ ID NO: 7382913 - DNA, 22 bp, Homo sapiens
aaagtcattgctgttatcaatg

SEQ ID NO: 7382914 - DNA, 22 bp, Homo sapiens
aaagtcatttagccttatctcc

SEQ ID NO: 7382915 - DNA, 22 bp, Homo sapiens
aaagtcattggaatattaatga

SEQ ID NO: 7382916 - DNA, 22 bp, Homo sapiens
aaagtcattgtaatatatgcta

SEQ ID NO: 7382917 - DNA, 22 bp, Homo sapiens
aaagtcattgtaatatatgcta

SEQ ID NO: 7382918 - DNA, 22 bp, Homo sapiens
aaagtcatccaaatttttatgt

SEQ ID NO: 7382919 - DNA, 22 bp, Homo sapiens
aaagtcatcatttcttttcaaa

SEQ ID NO: 7382920 - DNA, 22 bp, Homo sapiens
aaagtcatctaggagcagattt

SEQ ID NO: 7382921 - DNA, 22 bp, Homo sapiens
aaagtcatctaggagcagattt

SEQ ID NO: 7382922 - DNA, 22 bp, Homo sapiens
aaagtcatctgtcctaggctct

SEQ ID NO: 7382923 - DNA, 22 bp, Homo sapiens
aaagtcatgtaatgatatgatt

SEQ ID NO: 7382924 - DNA, 22 bp, Homo sapiens
aaagtcatggaaaatcttggaa

SEQ ID NO: 7382925 - DNA, 22 bp, Homo sapiens
aaagtcatgatgaaccaccgta

SEQ ID NO: 7382926 - DNA, 22 bp, Homo sapiens
aaagtcatgcagttgaactttt

SEQ ID NO: 7382927 - DNA, 22 bp, Homo sapiens
aaagtacagccacatccaagta

SEQ ID NO: 7382928 - DNA, 22 bp, Homo sapiens
aaagtcatcatttcttttcaaa

SEQ ID NO: 7382929 - DNA, 22 bp, Homo sapiens
aaagtcatacatggtgcttact

SEQ ID NO: 7382930 - DNA, 22 bp, Homo sapiens
aaagtcatcagaaccttccaga

SEQ ID NO: 7382931 - DNA, 22 bp, Homo sapiens
aaagtcatacatggtgcttact

SEQ ID NO: 7382932 - DNA, 22 bp, Homo sapiens
aaagtcacttccttctgtcagc

SEQ ID NO: 7382933 - DNA, 22 bp, Homo sapiens
aaaattgtgaaggtttctgaaa

SEQ ID NO: 7382934 - DNA, 22 bp, Homo sapiens
aaaattgtcgaacagtagtaac

SEQ ID NO: 7382935 - DNA, 22 bp, Homo sapiens
aaaattgtgaaggtttctgaaa

SEQ ID NO: 7382936 - DNA, 22 bp, Homo sapiens
aaaattgtgaaggtttctgaaa

SEQ ID NO: 7382937 - DNA, 22 bp, Homo sapiens
aaaattgtcgaacagtagtaac

SEQ ID NO: 7382938 - DNA, 22 bp, Homo sapiens
aaaattgtcgaacagtagtaac

SEQ ID NO: 7382939 - DNA, 22 bp, Homo sapiens
aaaattttactggtgtttcctt

SEQ ID NO: 7382940 - DNA, 22 bp, Homo sapiens
aaaattttactggtgtttcctt

SEQ ID NO: 7382941 - DNA, 22 bp, Homo sapiens
aaaattttcagcttgacttgat

SEQ ID NO: 7382942 - DNA, 22 bp, Homo sapiens
aaagctatgaggcatgcatttc

SEQ ID NO: 7382943 - DNA, 22 bp, Homo sapiens
aaagctattcaacacgaacatg

SEQ ID NO: 7382944 - DNA, 22 bp, Homo sapiens
aaagctctgggaatgcttatct

SEQ ID NO: 7382945 - DNA, 22 bp, Homo sapiens
aaagctctcccactgtatgaag

SEQ ID NO: 7382946 - DNA, 22 bp, Homo sapiens
aaaggacatgtcaatatcaggc

SEQ ID NO: 7382947 - DNA, 22 bp, Homo sapiens
aaaggacatgtcaatatcaggc

SEQ ID NO: 7382948 - DNA, 22 bp, Homo sapiens
aaaggacacacaggaggtgtct

SEQ ID NO: 7382949 - DNA, 22 bp, Homo sapiens
aaatgtctttatctcatgtaac

SEQ ID NO: 7382950 - DNA, 23 bp, Homo sapiens
aaatgtcttctagctcttgagaa

SEQ ID NO: 7382951 - DNA, 23 bp, Homo sapiens
aaatgtcttctagctcttgagaa

SEQ ID NO: 7382952 - DNA, 22 bp, Homo sapiens
aaatgtctgtctcatgaggaaa

SEQ ID NO: 7382953 - DNA, 22 bp, Homo sapiens
aaatgtctgtatgagaaagaga

SEQ ID NO: 7382954 - DNA, 22 bp, Homo sapiens
aaatgtctgttagtcatatcat

SEQ ID NO: 7382955 - DNA, 22 bp, Homo sapiens
aaatgtctctattgcctctggt

SEQ ID NO: 7382956 - DNA, 22 bp, Homo sapiens
aaatggtgtttctaatgctaga

SEQ ID NO: 7382957 - DNA, 22 bp, Homo sapiens
aaatgtctgtaggggctgcagg

SEQ ID NO: 7382958 - DNA, 22 bp, Homo sapiens
aaatgtctgtatgagaaagaga

SEQ ID NO: 7382959 - DNA, 22 bp, Homo sapiens
aaatgtctgagacttctgaact

SEQ ID NO: 7382960 - DNA, 22 bp, Homo sapiens
aaatgtctgagacttctgaact

SEQ ID NO: 7382961 - DNA, 23 bp, Homo sapiens
aaatgtgagggaaaatctttctg

SEQ ID NO: 7382962 - DNA, 22 bp, Homo sapiens
aaagacacacagccagcaagtg

SEQ ID NO: 7382963 - DNA, 22 bp, Homo sapiens
aaatgtctttatctcatgtaac

SEQ ID NO: 7382964 - DNA, 22 bp, Homo sapiens
aaatgtctttcaatagagaaat

SEQ ID NO: 7382965 - DNA, 22 bp, Homo sapiens
aaatgtctttcaatagagaaat

SEQ ID NO: 7382966 - DNA, 22 bp, Homo sapiens
aaatgtctttcttctgctacgt

SEQ ID NO: 7382967 - DNA, 22 bp, Homo sapiens
aaatgtctttgagtttttataa

SEQ ID NO: 7382968 - DNA, 22 bp, Homo sapiens
aaatgtctttgagtatttctgc

SEQ ID NO: 7382969 - DNA, 22 bp, Homo sapiens
aaatgtctttgagtatttctgc

SEQ ID NO: 7382970 - DNA, 21 bp, Homo sapiens
aaatacagaaacttgttttca

SEQ ID NO: 7382971 - DNA, 22 bp, Homo sapiens
aaatacagagttatggacctca

SEQ ID NO: 7382972 - DNA, 22 bp, Homo sapiens
aaatacagagttatggacctca

SEQ ID NO: 7382973 - DNA, 22 bp, Homo sapiens
aaatacagagttgcttaaaagc

SEQ ID NO: 7382974 - DNA, 22 bp, Homo sapiens
aaatacagatagatttaaccca

SEQ ID NO: 7382975 - DNA, 21 bp, Homo sapiens
aaatacagatgcaaatctgtt

SEQ ID NO: 7382976 - DNA, 22 bp, Homo sapiens
aaatacaatttcaggctgtaat

SEQ ID NO: 7382977 - DNA, 22 bp, Homo sapiens
aaataacagtcagggacaacat

SEQ ID NO: 7382978 - DNA, 22 bp, Homo sapiens
aaataacagtcagggacaacat

SEQ ID NO: 7382979 - DNA, 22 bp, Homo sapiens
aaatccagtttgtcatttccca

SEQ ID NO: 7382980 - DNA, 22 bp, Homo sapiens
aaatgaactcttcctgcatccc

SEQ ID NO: 7382981 - DNA, 22 bp, Homo sapiens
aaaataagttggtcctgtcctt

SEQ ID NO: 7382982 - DNA, 22 bp, Homo sapiens
aaaatacacatactaggggaaa

SEQ ID NO: 7382983 - DNA, 22 bp, Homo sapiens
aaaatacacatactaggggaaa

SEQ ID NO: 7382984 - DNA, 22 bp, Homo sapiens
aaaataacttctactatttgca

SEQ ID NO: 7382985 - DNA, 22 bp, Homo sapiens
aaaataacttctactatttgca

SEQ ID NO: 7382986 - DNA, 22 bp, Homo sapiens
aaaagtttgtgcaaacactcag

SEQ ID NO: 7382987 - DNA, 21 bp, Homo sapiens
aaaagtttgacaggaaaggga

SEQ ID NO: 7382988 - DNA, 22 bp, Homo sapiens
aaaatctgcttccttttacaga

SEQ ID NO: 7382989 - DNA, 22 bp, Homo sapiens
aaaatctggcaacactaagttt

SEQ ID NO: 7382990 - DNA, 22 bp, Homo sapiens
aaaatactactgtcttcttccc

SEQ ID NO: 7382991 - DNA, 22 bp, Homo sapiens
aaaatactactgtcttcttccc

SEQ ID NO: 7382992 - DNA, 22 bp, Homo sapiens
aaaatactactgtcttcttccc

SEQ ID NO: 7382993 - DNA, 22 bp, Homo sapiens
aaaagtttaagactcattctag

SEQ ID NO: 7382994 - DNA, 22 bp, Homo sapiens
aaaagtttaagactcattctag

SEQ ID NO: 7382995 - DNA, 22 bp, Homo sapiens
aaaagtttaagactcattctag

SEQ ID NO: 7382996 - DNA, 22 bp, Homo sapiens
aaaagttacctctgtaatataa

SEQ ID NO: 7382997 - DNA, 22 bp, Homo sapiens
aaaagttacctctgtaatataa

SEQ ID NO: 7382998 - DNA, 22 bp, Homo sapiens
aaaagttacctctgtaatataa

SEQ ID NO: 7382999 - DNA, 22 bp, Homo sapiens
aaaagtgttcaggaagaataat

SEQ ID NO: 7383000 - DNA, 22 bp, Homo sapiens
aaaagctttgttaataggtttg

SEQ ID NO: 7383001 - DNA, 21 bp, Homo sapiens
aaaaggaaggtctgtttgggg

SEQ ID NO: 7383002 - DNA, 22 bp, Homo sapiens
aaaagctttgccagatgagttg

SEQ ID NO: 7383003 - DNA, 22 bp, Homo sapiens
aaaagctttgttaataggtttg

SEQ ID NO: 7383004 - DNA, 22 bp, Homo sapiens
aaaagtgtccagattatgaaga

SEQ ID NO: 7383005 - DNA, 22 bp, Homo sapiens
aaaagtattttgagcactttat

SEQ ID NO: 7383006 - DNA, 22 bp, Homo sapiens
aaaagtattttgagcactttat

SEQ ID NO: 7383007 - DNA, 19 bp, Homo sapiens
aaaaggaatattctttggg

SEQ ID NO: 7383008 - DNA, 22 bp, Homo sapiens
aaaatgatatcctgacttttat

SEQ ID NO: 7383009 - DNA, 22 bp, Homo sapiens
aaaatgatatcctgacttttat

SEQ ID NO: 7383010 - DNA, 18 bp, Homo sapiens
aaaatgcaggcgacatgg

SEQ ID NO: 7383011 - DNA, 18 bp, Homo sapiens
aaaatgcaggcgacatgg

SEQ ID NO: 7383012 - DNA, 22 bp, Homo sapiens
aaaatgtaaagcttgagtgtag

SEQ ID NO: 7383013 - DNA, 22 bp, Homo sapiens
aaaatgtaaagcttgagtgtag

SEQ ID NO: 7383014 - DNA, 22 bp, Homo sapiens
aaaatgtaaagcttgagtgtag

SEQ ID NO: 7383015 - DNA, 22 bp, Homo sapiens
aaagcagctttcggccctcggg

SEQ ID NO: 7383016 - DNA, 22 bp, Homo sapiens
aaagcagcctgctcatcctgga

SEQ ID NO: 7383017 - DNA, 22 bp, Homo sapiens
aaagcagcctgctcatcctgga

SEQ ID NO: 7383018 - DNA, 22 bp, Homo sapiens
aaagcagctgatctcagagcct

SEQ ID NO: 7383019 - DNA, 22 bp, Homo sapiens
aaagcagctgatagtctcatct

SEQ ID NO: 7383020 - DNA, 22 bp, Homo sapiens
aaagcagctgatagtctcatct

SEQ ID NO: 7383021 - DNA, 22 bp, Homo sapiens
aaagcagccactctctctgcct

SEQ ID NO: 7383022 - DNA, 22 bp, Homo sapiens
aaagcagcagaatctctcaggg

SEQ ID NO: 7383023 - DNA, 22 bp, Homo sapiens
aaagcagcagaatctctcaggg

SEQ ID NO: 7383024 - DNA, 22 bp, Homo sapiens
aaaatgtctgctgttggtttat

SEQ ID NO: 7383025 - DNA, 22 bp, Homo sapiens
aaagcaatggatgagaatctgt

SEQ ID NO: 7383026 - DNA, 22 bp, Homo sapiens
aaagcaatggatgagaatctgt

SEQ ID NO: 7383027 - DNA, 22 bp, Homo sapiens
aaaagcaattgcagttcttgcc

SEQ ID NO: 7383028 - DNA, 22 bp, Homo sapiens
aaaagcagtttatagtcagttg

SEQ ID NO: 7383029 - DNA, 22 bp, Homo sapiens
aaaagccaaggtcctcttcaga

SEQ ID NO: 7383030 - DNA, 22 bp, Homo sapiens
aaaagccaaggtcctcttcaga

SEQ ID NO: 7383031 - DNA, 22 bp, Homo sapiens
aaaagccatgcatacctaagag

SEQ ID NO: 7383032 - DNA, 22 bp, Homo sapiens
aaaacactgcaaagctgattgg

SEQ ID NO: 7383033 - DNA, 22 bp, Homo sapiens
aaaacacactggaccaatttaa

SEQ ID NO: 7383034 - DNA, 22 bp, Homo sapiens
aaaacacaagaagcagggtaca

SEQ ID NO: 7383035 - DNA, 22 bp, Homo sapiens
aaaacagacagccagtgtagag

SEQ ID NO: 7383036 - DNA, 23 bp, Homo sapiens
aaaacagcttcctccagtggctc

SEQ ID NO: 7383037 - DNA, 23 bp, Homo sapiens
aaaacagcttcctccagtggctc

SEQ ID NO: 7383038 - DNA, 22 bp, Homo sapiens
aaaacagtttaggcatcacagt

SEQ ID NO: 7383039 - DNA, 22 bp, Homo sapiens
aaaagagtgactgataagtata

SEQ ID NO: 7383040 - DNA, 22 bp, Homo sapiens
aaaacattctgtgaactctcaa

SEQ ID NO: 7383041 - DNA, 22 bp, Homo sapiens
aaaacatgtccatacagaaact

SEQ ID NO: 7383042 - DNA, 22 bp, Homo sapiens
aaaacatgtccatacagaaact

SEQ ID NO: 7383043 - DNA, 22 bp, Homo sapiens
aaaacattgaattgcacactat

SEQ ID NO: 7383044 - DNA, 22 bp, Homo sapiens
aaaacattttactgccatctca

SEQ ID NO: 7383045 - DNA, 22 bp, Homo sapiens
aaaacattgaattgcacactat

SEQ ID NO: 7383046 - DNA, 22 bp, Homo sapiens
aaaacattttactgccatctca

SEQ ID NO: 7383047 - DNA, 22 bp, Homo sapiens
aaaaatttatggttcttctctg

SEQ ID NO: 7383048 - DNA, 22 bp, Homo sapiens
aaaacacaagaagcagggtaca

SEQ ID NO: 7383049 - DNA, 22 bp, Homo sapiens
aaaaatttatggttcttctctg

SEQ ID NO: 7383050 - DNA, 22 bp, Homo sapiens
aaaacacaagaagcagggtaca

SEQ ID NO: 7383051 - DNA, 22 bp, Homo sapiens
aaaaatgtgaccacagggtgtt

SEQ ID NO: 7383052 - DNA, 22 bp, Homo sapiens
aaaaatgttatctactgtccga

SEQ ID NO: 7383053 - DNA, 22 bp, Homo sapiens
aaaaatgttatctactgtccga

SEQ ID NO: 7383054 - DNA, 22 bp, Homo sapiens
aaaagattgttagggagaatgt

SEQ ID NO: 7383055 - DNA, 22 bp, Homo sapiens
aaaagcaagaggctggattaaa

SEQ ID NO: 7383056 - DNA, 22 bp, Homo sapiens
aaaagagtgtttcaactttggc

SEQ ID NO: 7383057 - DNA, 20 bp, Homo sapiens
aaaagagtgcttcaactgct

SEQ ID NO: 7383058 - DNA, 22 bp, Homo sapiens
aaaagcaaggcagtctgtctga

SEQ ID NO: 7383059 - DNA, 22 bp, Homo sapiens
aaaagcaagttgcctaggttga

SEQ ID NO: 7383060 - DNA, 22 bp, Homo sapiens
aagtccagtgaaatagaatgca

SEQ ID NO: 7383061 - DNA, 22 bp, Homo sapiens
aagtaagtaagtctcttttctg

SEQ ID NO: 7383062 - DNA, 22 bp, Homo sapiens
aagtaaggccttcttgagcatg

SEQ ID NO: 7383063 - DNA, 22 bp, Homo sapiens
aagtaaggcagtgaatgagatt

SEQ ID NO: 7383064 - DNA, 22 bp, Homo sapiens
aaggttactcagaataacttcc

SEQ ID NO: 7383065 - DNA, 22 bp, Homo sapiens
aagggcagggagtttgtgtcta

SEQ ID NO: 7383066 - DNA, 22 bp, Homo sapiens
aagtctttttgaatctataact

SEQ ID NO: 7383067 - DNA, 22 bp, Homo sapiens
aagtgcatcactactcattaca

SEQ ID NO: 7383068 - DNA, 22 bp, Homo sapiens
aagtctgggcctccttcccaga

SEQ ID NO: 7383069 - DNA, 22 bp, Homo sapiens
aagtctggtgctgtcctcaccc

SEQ ID NO: 7383070 - DNA, 22 bp, Homo sapiens
aagtctttcataagtctcttat

SEQ ID NO: 7383071 - DNA, 22 bp, Homo sapiens
aagtcttttgctaagagtaatg

SEQ ID NO: 7383072 - DNA, 22 bp, Homo sapiens
aagtgctgggattataggcatg

SEQ ID NO: 7383073 - DNA, 22 bp, Homo sapiens
aagtgcttaggtcaaaggacat

SEQ ID NO: 7383074 - DNA, 22 bp, Homo sapiens
aagtgctgtacagtgtgtaaat

SEQ ID NO: 7383075 - DNA, 22 bp, Homo sapiens
aagtgctgtttctgatgaatgc

SEQ ID NO: 7383076 - DNA, 17 bp, Homo sapiens
aacagttaatgggggaa

SEQ ID NO: 7383077 - DNA, 22 bp, Homo sapiens
aacagttacccttaagatcttt

SEQ ID NO: 7383078 - DNA, 22 bp, Homo sapiens
aacagttattatcacattagtg

SEQ ID NO: 7383079 - DNA, 22 bp, Homo sapiens
aacagttatctcacatatggaa

SEQ ID NO: 7383080 - DNA, 22 bp, Homo sapiens
aacagttaagcagtcctgatat

SEQ ID NO: 7383081 - DNA, 22 bp, Homo sapiens
aacagttaacattttgggagct

SEQ ID NO: 7383082 - DNA, 22 bp, Homo sapiens
aacagttaatgaagaggaagcc

SEQ ID NO: 7383083 - DNA, 22 bp, Homo sapiens
aaggcactcattcaaggagata

SEQ ID NO: 7383084 - DNA, 22 bp, Homo sapiens
aaggcactcagccttgggacag

SEQ ID NO: 7383085 - DNA, 20 bp, Homo sapiens
aaggcactatgtctgctagc

SEQ ID NO: 7383086 - DNA, 22 bp, Homo sapiens
aaggcactagcagaattagtga

SEQ ID NO: 7383087 - DNA, 22 bp, Homo sapiens
aaggcactagcaagctgcctgg

SEQ ID NO: 7383088 - DNA, 22 bp, Homo sapiens
aaggcactgaacttaaattctg

SEQ ID NO: 7383089 - DNA, 22 bp, Homo sapiens
aaggcactgagccagccgtctc

SEQ ID NO: 7383090 - DNA, 22 bp, Homo sapiens
aaggcactgactgtgcagggga

SEQ ID NO: 7383091 - DNA, 22 bp, Homo sapiens
aaggcactgaaaaattgtgtgt

SEQ ID NO: 7383092 - DNA, 22 bp, Homo sapiens
aaggcactcattcaaggagata

SEQ ID NO: 7383093 - DNA, 22 bp, Homo sapiens
aaggcactgaaaaattgtgtgt

SEQ ID NO: 7383094 - DNA, 22 bp, Homo sapiens
aaggagtgcatgactcagagta

SEQ ID NO: 7383095 - DNA, 22 bp, Homo sapiens
aaggagtctgggccattcagag

SEQ ID NO: 7383096 - DNA, 22 bp, Homo sapiens
aaggataagaatggaaggaaca

SEQ ID NO: 7383097 - DNA, 22 bp, Homo sapiens
aaggagggttcccaggtcctgg

SEQ ID NO: 7383098 - DNA, 22 bp, Homo sapiens
aaatggaggcacgcagtggtta

SEQ ID NO: 7383099 - DNA, 22 bp, Homo sapiens
aaatggagatgataagagggtt

SEQ ID NO: 7383100 - DNA, 22 bp, Homo sapiens
aaggagaagggtaatcaacaca

SEQ ID NO: 7383101 - DNA, 22 bp, Homo sapiens
aaatggatggaattgacattta

SEQ ID NO: 7383102 - DNA, 22 bp, Homo sapiens
aaggcactgctttgctgcgccc

SEQ ID NO: 7383103 - DNA, 23 bp, Homo sapiens
aaggccagagagaggctagtgtc

SEQ ID NO: 7383104 - DNA, 22 bp, Homo sapiens
aaggccaggtccctgcagtgca

SEQ ID NO: 7383105 - DNA, 22 bp, Homo sapiens
aaggccctcatgcgtcagagcc

SEQ ID NO: 7383106 - DNA, 22 bp, Homo sapiens
aaggccctcatgcgtcagagcc

SEQ ID NO: 7383107 - DNA, 22 bp, Homo sapiens
aaggcccagcctggagcttgtt

SEQ ID NO: 7383108 - DNA, 22 bp, Homo sapiens
aaggccctggcaggaagcagga

SEQ ID NO: 7383109 - DNA, 22 bp, Homo sapiens
aaggccctggatggttttgaga

SEQ ID NO: 7383110 - DNA, 22 bp, Homo sapiens
aagggaggggatgtaagcctgg

SEQ ID NO: 7383111 - DNA, 22 bp, Homo sapiens
aagggcaggaaaagatggatgt

SEQ ID NO: 7383112 - DNA, 22 bp, Homo sapiens
aagggcaggagaagacggatat

SEQ ID NO: 7383113 - DNA, 22 bp, Homo sapiens
aagggcaggcagagatcatata

SEQ ID NO: 7383114 - DNA, 22 bp, Homo sapiens
aatgaaatgtagcttatccata

SEQ ID NO: 7383115 - DNA, 22 bp, Homo sapiens
aatgaaatgtagcttatccata

SEQ ID NO: 7383116 - DNA, 22 bp, Homo sapiens
aatgaaatgaagatatgatcag

SEQ ID NO: 7383117 - DNA, 22 bp, Homo sapiens
aatgaaatgaagatatgatcag

SEQ ID NO: 7383118 - DNA, 18 bp, Homo sapiens
aatgaaatgtacaccttt

SEQ ID NO: 7383119 - DNA, 22 bp, Homo sapiens
aatgcacatatatttccttatt

SEQ ID NO: 7383120 - DNA, 18 bp, Homo sapiens
aatgcacacatttactcc

SEQ ID NO: 7383121 - DNA, 22 bp, Homo sapiens
aatgcacacatttggtactgaa

SEQ ID NO: 7383122 - DNA, 22 bp, Homo sapiens
aatgcagaccagtatgaaaaac

SEQ ID NO: 7383123 - DNA, 22 bp, Homo sapiens
aatgcacatgttgtaataaata

SEQ ID NO: 7383124 - DNA, 22 bp, Homo sapiens
aatctgaatatttatgtgtatt

SEQ ID NO: 7383125 - DNA, 22 bp, Homo sapiens
aatctgcacaattcagtttcag

SEQ ID NO: 7383126 - DNA, 22 bp, Homo sapiens
aatctgcataagcacagttgga

SEQ ID NO: 7383127 - DNA, 22 bp, Homo sapiens
aatgaaatgaagatatgatcag

SEQ ID NO: 7383128 - DNA, 22 bp, Homo sapiens
aatgaaatgaagatatgatcag

SEQ ID NO: 7383129 - DNA, 22 bp, Homo sapiens
aatgaaatagttggctgtagag

SEQ ID NO: 7383130 - DNA, 22 bp, Homo sapiens
aatgaaatagttggctgtagag

SEQ ID NO: 7383131 - DNA, 22 bp, Homo sapiens
aatgtaaagttgggcacaaatg

SEQ ID NO: 7383132 - DNA, 22 bp, Homo sapiens
aatgtacaaaccttctttgtag

SEQ ID NO: 7383133 - DNA, 22 bp, Homo sapiens
aactttaaggctataaattatg

SEQ ID NO: 7383134 - DNA, 22 bp, Homo sapiens
aactttaaggctataaattatg

SEQ ID NO: 7383135 - DNA, 19 bp, Homo sapiens
aatgcttaggacagtgcct

SEQ ID NO: 7383136 - DNA, 19 bp, Homo sapiens
aatgcttaggacagtgcct

SEQ ID NO: 7383137 - DNA, 22 bp, Homo sapiens
aatgcttatacctaatgatctt

SEQ ID NO: 7383138 - DNA, 22 bp, Homo sapiens
aatgcataatggtttgtgacaa

SEQ ID NO: 7383139 - DNA, 22 bp, Homo sapiens
aatgcttattattaatagaatg

SEQ ID NO: 7383140 - DNA, 22 bp, Homo sapiens
aatgctttaaatcctagtgtaa

SEQ ID NO: 7383141 - DNA, 22 bp, Homo sapiens
aatgctttaattgcatgtagtg

SEQ ID NO: 7383142 - DNA, 22 bp, Homo sapiens
aatgctttagcagtgattagtg

SEQ ID NO: 7383143 - DNA, 22 bp, Homo sapiens
aatattgagaaccagcatgttt

SEQ ID NO: 7383144 - DNA, 22 bp, Homo sapiens
aatatttctgcagaatggtttt

SEQ ID NO: 7383145 - DNA, 22 bp, Homo sapiens
aatatttctgtagctatgttct

SEQ ID NO: 7383146 - DNA, 22 bp, Homo sapiens
aatatttctgtagctatgttct

SEQ ID NO: 7383147 - DNA, 22 bp, Homo sapiens
aatacatatggaattccatgtt

SEQ ID NO: 7383148 - DNA, 22 bp, Homo sapiens
aatacagtaggtaatagttcat

SEQ ID NO: 7383149 - DNA, 20 bp, Homo sapiens
aatataattctctgaattta

SEQ ID NO: 7383150 - DNA, 22 bp, Homo sapiens
aatatccaggtagatgtcttct

SEQ ID NO: 7383151 - DNA, 22 bp, Homo sapiens
aatatctagcctttagcagctt

SEQ ID NO: 7383152 - DNA, 22 bp, Homo sapiens
aataatgagcttgtctaattgt

SEQ ID NO: 7383153 - DNA, 22 bp, Homo sapiens
aataatgagacagcttatttaa

SEQ ID NO: 7383154 - DNA, 22 bp, Homo sapiens
aataatgataatggttatagct

SEQ ID NO: 7383155 - DNA, 19 bp, Homo sapiens
aataatgccagatgtctgt

SEQ ID NO: 7383156 - DNA, 22 bp, Homo sapiens
aataagaattgccagatttgaa

SEQ ID NO: 7383157 - DNA, 22 bp, Homo sapiens
aataatattcctctgtgtgcgt

SEQ ID NO: 7383158 - DNA, 22 bp, Homo sapiens
aataatatttgaagcttcaaag

SEQ ID NO: 7383159 - DNA, 22 bp, Homo sapiens
aataatgtacatacatatttcg

SEQ ID NO: 7383160 - DNA, 22 bp, Homo sapiens
aataatgtctgctattttaaaa

SEQ ID NO: 7383161 - DNA, 22 bp, Homo sapiens
aacagtttatgagatatgctat

SEQ ID NO: 7383162 - DNA, 22 bp, Homo sapiens
aacagttattatcacattagtg

SEQ ID NO: 7383163 - DNA, 22 bp, Homo sapiens
aagttacaagactaaatggaag

SEQ ID NO: 7383164 - DNA, 22 bp, Homo sapiens
aagttacagttggaactgtgaa

SEQ ID NO: 7383165 - DNA, 22 bp, Homo sapiens
acagagcacagtcgggatggga

SEQ ID NO: 7383166 - DNA, 22 bp, Homo sapiens
acagagcaattcttgggtgttt

SEQ ID NO: 7383167 - DNA, 22 bp, Homo sapiens
aagcataaaacgttacaacatg

SEQ ID NO: 7383168 - DNA, 22 bp, Homo sapiens
aagcagtttagataggcaaagg

SEQ ID NO: 7383169 - DNA, 22 bp, Homo sapiens
acagctgctctatatctcagcc

SEQ ID NO: 7383170 - DNA, 22 bp, Homo sapiens
acagctgctctatatctcagcc

SEQ ID NO: 7383171 - DNA, 22 bp, Homo sapiens
acagctgctgcttctcactggg

SEQ ID NO: 7383172 - DNA, 22 bp, Homo sapiens
acagctgctgcttctcactggg

SEQ ID NO: 7383173 - DNA, 22 bp, Homo sapiens
acagctgctgtttttgaaggac

SEQ ID NO: 7383174 - DNA, 22 bp, Homo sapiens
acagctgctgtggaggttttca

SEQ ID NO: 7383175 - DNA, 22 bp, Homo sapiens
acagctgctgtggaggttttca

SEQ ID NO: 7383176 - DNA, 22 bp, Homo sapiens
acagctgctttctcttactatg

SEQ ID NO: 7383177 - DNA, 22 bp, Homo sapiens
acacataagcctaatcatctcc

SEQ ID NO: 7383178 - DNA, 22 bp, Homo sapiens
aagatacatcaaagcaaattgg

SEQ ID NO: 7383179 - DNA, 20 bp, Homo sapiens
acacatatagcagcataaac

SEQ ID NO: 7383180 - DNA, 22 bp, Homo sapiens
acacataagcctaatcatctcc

SEQ ID NO: 7383181 - DNA, 22 bp, Homo sapiens
acacatataccactgtaaatga

SEQ ID NO: 7383182 - DNA, 22 bp, Homo sapiens
acacttgtaatggagaacacta

SEQ ID NO: 7383183 - DNA, 22 bp, Homo sapiens
acacttggagcaacacttatgg

SEQ ID NO: 7383184 - DNA, 22 bp, Homo sapiens
acacttgttaagaagaggatat

SEQ ID NO: 7383185 - DNA, 20 bp, Homo sapiens
acagaaagctgccttgtccc

SEQ ID NO: 7383186 - DNA, 22 bp, Homo sapiens
acacttcaggactctggggcaa

SEQ ID NO: 7383187 - DNA, 22 bp, Homo sapiens
acacttcagctccacaaacatt

SEQ ID NO: 7383188 - DNA, 22 bp, Homo sapiens
acacttcatgcattcttcactc

SEQ ID NO: 7383189 - DNA, 22 bp, Homo sapiens
acacttcatttacattataggc

SEQ ID NO: 7383190 - DNA, 20 bp, Homo sapiens
acacttcatttgcagcagct

SEQ ID NO: 7383191 - DNA, 22 bp, Homo sapiens
acacttcatgcattcttcactc

SEQ ID NO: 7383192 - DNA, 21 bp, Homo sapiens
acacttcagtttttaaaggga

SEQ ID NO: 7383193 - DNA, 22 bp, Homo sapiens
acacttcatagcaaggttggag

SEQ ID NO: 7383194 - DNA, 21 bp, Homo sapiens
acacttcagtttttaaaggga

SEQ ID NO: 7383195 - DNA, 18 bp, Homo sapiens
acacttcctggtggtgtg

SEQ ID NO: 7383196 - DNA, 22 bp, Homo sapiens
acacttctctttgaagaacaat

SEQ ID NO: 7383197 - DNA, 22 bp, Homo sapiens
acagaccaagtttccagcaggt

SEQ ID NO: 7383198 - DNA, 22 bp, Homo sapiens
acagagcaacttgagtatcctc

SEQ ID NO: 7383199 - DNA, 22 bp, Homo sapiens
acagagcaatgcgtgttctcta

SEQ ID NO: 7383200 - DNA, 22 bp, Homo sapiens
acagaaatatagaaggtaggaa

SEQ ID NO: 7383201 - DNA, 23 bp, Homo sapiens
acagaaagttctgctggacagag

SEQ ID NO: 7383202 - DNA, 23 bp, Homo sapiens
acagaaatcatttgtaaggtacc

SEQ ID NO: 7383203 - DNA, 22 bp, Homo sapiens
acagaaatgatgtttggcaata

SEQ ID NO: 7383204 - DNA, 22 bp, Homo sapiens
acagacattttaagacacttta

SEQ ID NO: 7383205 - DNA, 22 bp, Homo sapiens
aagatacaaatgtcaatattgg

SEQ ID NO: 7383206 - DNA, 22 bp, Homo sapiens
aagagtttccagttgtggctca

SEQ ID NO: 7383207 - DNA, 22 bp, Homo sapiens
aagataagtaacgagcctcagt

SEQ ID NO: 7383208 - DNA, 22 bp, Homo sapiens
aagataatattcattaactaga

SEQ ID NO: 7383209 - DNA, 22 bp, Homo sapiens
acacagcaaggtctgactttgg

SEQ ID NO: 7383210 - DNA, 22 bp, Homo sapiens
acacagcaaggtctgactttgg

SEQ ID NO: 7383211 - DNA, 17 bp, Homo sapiens
acacagacaggcagaca

SEQ ID NO: 7383212 - DNA, 22 bp, Homo sapiens
acacagagccagggaatacagt

SEQ ID NO: 7383213 - DNA, 22 bp, Homo sapiens
acaatatagtccatgagcatgc

SEQ ID NO: 7383214 - DNA, 22 bp, Homo sapiens
acaatatagtccatgagcatgc

SEQ ID NO: 7383215 - DNA, 22 bp, Homo sapiens
acaatgtagagtaaaatatgtt

SEQ ID NO: 7383216 - DNA, 22 bp, Homo sapiens
acaatgtctcatattcgtgttc

SEQ ID NO: 7383217 - DNA, 22 bp, Homo sapiens
acaatgtgataatttaaagata

SEQ ID NO: 7383218 - DNA, 21 bp, Homo sapiens
acaatgtcaaggtcagacatt

SEQ ID NO: 7383219 - DNA, 22 bp, Homo sapiens
acaatgtaggctgaaaaagctt

SEQ ID NO: 7383220 - DNA, 22 bp, Homo sapiens
acaaatttggtgagagtaaata

SEQ ID NO: 7383221 - DNA, 22 bp, Homo sapiens
acaaatttggtgagagtaaata

SEQ ID NO: 7383222 - DNA, 22 bp, Homo sapiens
acaaatttgaatcctgacttct

SEQ ID NO: 7383223 - DNA, 22 bp, Homo sapiens
acaaatttggtgagagtaaata

SEQ ID NO: 7383224 - DNA, 22 bp, Homo sapiens
acaaatttgtgtagttatggca

SEQ ID NO: 7383225 - DNA, 22 bp, Homo sapiens
acaacaaaatcactagtcttcc

SEQ ID NO: 7383226 - DNA, 22 bp, Homo sapiens
acaaatttattgaagggcatat

SEQ ID NO: 7383227 - DNA, 22 bp, Homo sapiens
acaaatttcataggcaaatttt

SEQ ID NO: 7383228 - DNA, 22 bp, Homo sapiens
acaaattgttgcttcatgaatg

SEQ ID NO: 7383229 - DNA, 22 bp, Homo sapiens
acaaattgttgggactcagccc

SEQ ID NO: 7383230 - DNA, 22 bp, Homo sapiens
acaacaaaatcactagtcttcc

SEQ ID NO: 7383231 - DNA, 21 bp, Homo sapiens
acaatagacataagcagagca

SEQ ID NO: 7383232 - DNA, 20 bp, Homo sapiens
acaatagatttgagcaaagt

SEQ ID NO: 7383233 - DNA, 22 bp, Homo sapiens
aagaacatgttaaaagattcac

SEQ ID NO: 7383234 - DNA, 22 bp, Homo sapiens
aagaacaggttctagaaccatt

SEQ ID NO: 7383235 - DNA, 22 bp, Homo sapiens
aatgtacaagggttccagtttt

SEQ ID NO: 7383236 - DNA, 22 bp, Homo sapiens
aagaacattttgtagaatgaca

SEQ ID NO: 7383237 - DNA, 22 bp, Homo sapiens
aagaacattttgtagaatgaca

SEQ ID NO: 7383238 - DNA, 22 bp, Homo sapiens
aagaactagtcttacagcctca

SEQ ID NO: 7383239 - DNA, 22 bp, Homo sapiens
aagaagagaaatgtgctgctgg

SEQ ID NO: 7383240 - DNA, 22 bp, Homo sapiens
acaaaaattagctgggcatggt

SEQ ID NO: 7383241 - DNA, 22 bp, Homo sapiens
aattttatctctaagcaggctt

SEQ ID NO: 7383242 - DNA, 22 bp, Homo sapiens
acaaaaagggagatgaggtaga

SEQ ID NO: 7383243 - DNA, 22 bp, Homo sapiens
aagaagagaactggcatcctaa

SEQ ID NO: 7383244 - DNA, 19 bp, Homo sapiens
aagaagcaataagctgtga

SEQ ID NO: 7383245 - DNA, 22 bp, Homo sapiens
aagaatcatcctgcaagagtct

SEQ ID NO: 7383246 - DNA, 22 bp, Homo sapiens
acaaaagaataagatgagtcat

SEQ ID NO: 7383247 - DNA, 22 bp, Homo sapiens
acaaatgaatcatacataatgt

SEQ ID NO: 7383248 - DNA, 22 bp, Homo sapiens
acaaatgaacatataagcttga

SEQ ID NO: 7383249 - DNA, 22 bp, Homo sapiens
acaaatgaacatataagcttga

SEQ ID NO: 7383250 - DNA, 22 bp, Homo sapiens
aagaatcattgtaaagttctgt

SEQ ID NO: 7383251 - DNA, 22 bp, Homo sapiens
aagaatctatggtacatccaag

SEQ ID NO: 7383252 - DNA, 22 bp, Homo sapiens
acaaatatttactgaatccact

SEQ ID NO: 7383253 - DNA, 22 bp, Homo sapiens
atgccagacattaacgactatg

SEQ ID NO: 7383254 - DNA, 22 bp, Homo sapiens
atgccaggaacaaacagtggtg

SEQ ID NO: 7383255 - DNA, 22 bp, Homo sapiens
atgccaggaacaaacagtggtg

SEQ ID NO: 7383256 - DNA, 22 bp, Homo sapiens
atgccaggctgtttggcctcag

SEQ ID NO: 7383257 - DNA, 23 bp, Homo sapiens
atgccaggctgcctggccagcct

SEQ ID NO: 7383258 - DNA, 22 bp, Homo sapiens
atgccaggagatggagcagagt

SEQ ID NO: 7383259 - DNA, 22 bp, Homo sapiens
atgccaggccccacgctgggca

SEQ ID NO: 7383260 - DNA, 22 bp, Homo sapiens
atgcaacacatttgatgagcga

SEQ ID NO: 7383261 - DNA, 22 bp, Homo sapiens
atgcaacaaattgtgtgcaata

SEQ ID NO: 7383262 - DNA, 22 bp, Homo sapiens
atgccaggtacaggggtagggt

SEQ ID NO: 7383263 - DNA, 22 bp, Homo sapiens
atgccagggtcacagtcatatt

SEQ ID NO: 7383264 - DNA, 22 bp, Homo sapiens
atgccagggtcacagtcatatt

SEQ ID NO: 7383265 - DNA, 22 bp, Homo sapiens
atgccagggtcatcccctgggt

SEQ ID NO: 7383266 - DNA, 22 bp, Homo sapiens
atgccagggtcccttcagagat

SEQ ID NO: 7383267 - DNA, 22 bp, Homo sapiens
agacataagccagtcactcact

SEQ ID NO: 7383268 - DNA, 22 bp, Homo sapiens
agacataaacttactgaaatac

SEQ ID NO: 7383269 - DNA, 20 bp, Homo sapiens
agacagtggggagctcctag

SEQ ID NO: 7383270 - DNA, 22 bp, Homo sapiens
atgcttccaacagttctgtgaa

SEQ ID NO: 7383271 - DNA, 22 bp, Homo sapiens
atgcttccaatattctcccttt

SEQ ID NO: 7383272 - DNA, 22 bp, Homo sapiens
atgcttccaaggctaagacaag

SEQ ID NO: 7383273 - DNA, 23 bp, Homo sapiens
atgcttccacagagcttgcagcc

SEQ ID NO: 7383274 - DNA, 22 bp, Homo sapiens
atgcttccactgttctgctctc

SEQ ID NO: 7383275 - DNA, 22 bp, Homo sapiens
atgcttccctcacatatcctgg

SEQ ID NO: 7383276 - DNA, 22 bp, Homo sapiens
atgcttcctaaccatggccgtg

SEQ ID NO: 7383277 - DNA, 22 bp, Homo sapiens
atgcttccctttgctccacatg

SEQ ID NO: 7383278 - DNA, 22 bp, Homo sapiens
atgcttccagattggtaggggt

SEQ ID NO: 7383279 - DNA, 20 bp, Homo sapiens
atgcttccagggtgtgtctg

SEQ ID NO: 7383280 - DNA, 22 bp, Homo sapiens
atgcttccatgaacgttcttgt

SEQ ID NO: 7383281 - DNA, 22 bp, Homo sapiens
atgcttcccctctcatttcagc

SEQ ID NO: 7383282 - DNA, 22 bp, Homo sapiens
atgcttcctcccttccactcaa

SEQ ID NO: 7383283 - DNA, 22 bp, Homo sapiens
atgcttcctctacggcctctga

SEQ ID NO: 7383284 - DNA, 22 bp, Homo sapiens
atgcttccttaccagaagatga

SEQ ID NO: 7383285 - DNA, 22 bp, Homo sapiens
atgcttcctttttcccttaagg

SEQ ID NO: 7383286 - DNA, 22 bp, Homo sapiens
atgcttctcagctcaaggcaaa

SEQ ID NO: 7383287 - DNA, 18 bp, Homo sapiens
atgcttctgatagaagca

SEQ ID NO: 7383288 - DNA, 22 bp, Homo sapiens
atgcttctgctcatatttcatt

SEQ ID NO: 7383289 - DNA, 22 bp, Homo sapiens
atgcttcttgtatttggctgac

SEQ ID NO: 7383290 - DNA, 22 bp, Homo sapiens
atgcttcttgagatagaaacac

SEQ ID NO: 7383291 - DNA, 22 bp, Homo sapiens
agagaacagacagatgcaatga

SEQ ID NO: 7383292 - DNA, 22 bp, Homo sapiens
agagaacagacagatgcaatga

SEQ ID NO: 7383293 - DNA, 22 bp, Homo sapiens
agagaacaaattaaaggtggtt

SEQ ID NO: 7383294 - DNA, 22 bp, Homo sapiens
atgctgagcagagctgacatgc

SEQ ID NO: 7383295 - DNA, 18 bp, Homo sapiens
atgctgccctctgagggt

SEQ ID NO: 7383296 - DNA, 22 bp, Homo sapiens
atgcttaatgagggtatatatg

SEQ ID NO: 7383297 - DNA, 22 bp, Homo sapiens
atgatatatgtgttgagcttgc

SEQ ID NO: 7383298 - DNA, 22 bp, Homo sapiens
atgatttaaagtcattgtgaac

SEQ ID NO: 7383299 - DNA, 22 bp, Homo sapiens
atgatttaaagtcattgtgaac

SEQ ID NO: 7383300 - DNA, 22 bp, Homo sapiens
atgattgtctataaaggaaggg

SEQ ID NO: 7383301 - DNA, 22 bp, Homo sapiens
atgaggcaatagaatattgaat

SEQ ID NO: 7383302 - DNA, 21 bp, Homo sapiens
atcttaaaaggtcttaacttt

SEQ ID NO: 7383303 - DNA, 21 bp, Homo sapiens
atcttaaaaggtcttaacttt

SEQ ID NO: 7383304 - DNA, 22 bp, Homo sapiens
atctgttcttgtgtcagtaatt

SEQ ID NO: 7383305 - DNA, 22 bp, Homo sapiens
atctgggggagctgctcatgga

SEQ ID NO: 7383306 - DNA, 22 bp, Homo sapiens
atctggggcctgggctagccat

SEQ ID NO: 7383307 - DNA, 22 bp, Homo sapiens
atgacaatatagctttgatttt

SEQ ID NO: 7383308 - DNA, 22 bp, Homo sapiens
atgaccagccgagataaacaga

SEQ ID NO: 7383309 - DNA, 22 bp, Homo sapiens
atgaccagccgagataaacaga

SEQ ID NO: 7383310 - DNA, 19 bp, Homo sapiens
atgactcttattgtctgaa

SEQ ID NO: 7383311 - DNA, 22 bp, Homo sapiens
atcttagaagtttgataaaatc

SEQ ID NO: 7383312 - DNA, 22 bp, Homo sapiens
atcttacactgttgggtttctc

SEQ ID NO: 7383313 - DNA, 22 bp, Homo sapiens
atgttcctgatcctcgttctat

SEQ ID NO: 7383314 - DNA, 22 bp, Homo sapiens
atgttcctggtatatcatgacc

SEQ ID NO: 7383315 - DNA, 22 bp, Homo sapiens
atgttccttccagagagcagaa

SEQ ID NO: 7383316 - DNA, 22 bp, Homo sapiens
agagctactgtccagttgctac

SEQ ID NO: 7383317 - DNA, 22 bp, Homo sapiens
agagctagaaggaagcatttct

SEQ ID NO: 7383318 - DNA, 22 bp, Homo sapiens
agagctaaatcagactttcttt

SEQ ID NO: 7383319 - DNA, 22 bp, Homo sapiens
attaaggaatgtaggcaagaag

SEQ ID NO: 7383320 - DNA, 22 bp, Homo sapiens
attaaggaagcctattctctcc

SEQ ID NO: 7383321 - DNA, 22 bp, Homo sapiens
attaagtgactaaagtaatgct

SEQ ID NO: 7383322 - DNA, 22 bp, Homo sapiens
atgtgcaaattattttgccaga

SEQ ID NO: 7383323 - DNA, 22 bp, Homo sapiens
atgtgcaaagggacttgcacat

SEQ ID NO: 7383324 - DNA, 18 bp, Homo sapiens
agagatggtgtagagttt

SEQ ID NO: 7383325 - DNA, 22 bp, Homo sapiens
agagatggtagaacagtcataa

SEQ ID NO: 7383326 - DNA, 22 bp, Homo sapiens
atgtgcaaagggacttgcacat

SEQ ID NO: 7383327 - DNA, 22 bp, Homo sapiens
agagccaggatctgttttgggg

SEQ ID NO: 7383328 - DNA, 22 bp, Homo sapiens
atgtagtactgggtatgtttct

SEQ ID NO: 7383329 - DNA, 21 bp, Homo sapiens
atgtagggtttgccttctcta

SEQ ID NO: 7383330 - DNA, 22 bp, Homo sapiens
atgtagtatctatatttcatgg

SEQ ID NO: 7383331 - DNA, 22 bp, Homo sapiens
atgtagtatttggaaatgtaaa

SEQ ID NO: 7383332 - DNA, 22 bp, Homo sapiens
atgtatatgaagctagtatttt

SEQ ID NO: 7383333 - DNA, 22 bp, Homo sapiens
agagatgggaaggcagacttca

SEQ ID NO: 7383334 - DNA, 22 bp, Homo sapiens
agagatgggcgggggcttctgc

SEQ ID NO: 7383335 - DNA, 22 bp, Homo sapiens
agagatggtagaacagtcataa

SEQ ID NO: 7383336 - DNA, 20 bp, Homo sapiens
agagatggggtatcaccgta

SEQ ID NO: 7383337 - DNA, 17 bp, Homo sapiens
atgtatattaactctga

SEQ ID NO: 7383338 - DNA, 17 bp, Homo sapiens
atgtatattaactctga

SEQ ID NO: 7383339 - DNA, 22 bp, Homo sapiens
agagatggcgtctcagagcctg

SEQ ID NO: 7383340 - DNA, 17 bp, Homo sapiens
atgtatattaactctga

SEQ ID NO: 7383341 - DNA, 22 bp, Homo sapiens
atgtatatgtgaaagatgttta

SEQ ID NO: 7383342 - DNA, 22 bp, Homo sapiens
atgtacatactgcattttcaaa

SEQ ID NO: 7383343 - DNA, 22 bp, Homo sapiens
agagagaagcaatcagtggcca

SEQ ID NO: 7383344 - DNA, 22 bp, Homo sapiens
agagactgtacgtggcaagtat

SEQ ID NO: 7383345 - DNA, 22 bp, Homo sapiens
atgggcagttaggaggccagga

SEQ ID NO: 7383346 - DNA, 22 bp, Homo sapiens
atgggcagtaacagtggcagtc

SEQ ID NO: 7383347 - DNA, 22 bp, Homo sapiens
attgttaataactattacattg

SEQ ID NO: 7383348 - DNA, 22 bp, Homo sapiens
agataattatttacttcaaagt

SEQ ID NO: 7383349 - DNA, 22 bp, Homo sapiens
agataattatttacttcaaagt

SEQ ID NO: 7383350 - DNA, 22 bp, Homo sapiens
agataattatgtcaatttcttg

SEQ ID NO: 7383351 - DNA, 22 bp, Homo sapiens
agatacaaaagataagatttag

SEQ ID NO: 7383352 - DNA, 22 bp, Homo sapiens
agatacacagaggtaaagatga

SEQ ID NO: 7383353 - DNA, 22 bp, Homo sapiens
attgtgtatgttaattctgtaa

SEQ ID NO: 7383354 - DNA, 22 bp, Homo sapiens
attgtgtagtagtattctgttt

SEQ ID NO: 7383355 - DNA, 22 bp, Homo sapiens
attgtgtcctcattgaccttca

SEQ ID NO: 7383356 - DNA, 22 bp, Homo sapiens
attgtggtgtcagttataggca

SEQ ID NO: 7383357 - DNA, 22 bp, Homo sapiens
attgtattctgcacctttgtta

SEQ ID NO: 7383358 - DNA, 22 bp, Homo sapiens
attgtattagcacaatacaatt

SEQ ID NO: 7383359 - DNA, 22 bp, Homo sapiens
attgtattagcacaatacaatt

SEQ ID NO: 7383360 - DNA, 22 bp, Homo sapiens
attgtattagcacaatacaatt

SEQ ID NO: 7383361 - DNA, 22 bp, Homo sapiens
attgtataagtctatttacaat

SEQ ID NO: 7383362 - DNA, 22 bp, Homo sapiens
attgtataagtctatttacaat

SEQ ID NO: 7383363 - DNA, 22 bp, Homo sapiens
attgagaattgtgagtttggag

SEQ ID NO: 7383364 - DNA, 22 bp, Homo sapiens
attgagaatgcaatctactatg

SEQ ID NO: 7383365 - DNA, 22 bp, Homo sapiens
attgagaatgaagggacatttt

SEQ ID NO: 7383366 - DNA, 22 bp, Homo sapiens
attgagaatccatttgagatga

SEQ ID NO: 7383367 - DNA, 22 bp, Homo sapiens
attgagaatattgtgacagtgt

SEQ ID NO: 7383368 - DNA, 22 bp, Homo sapiens
attgagaatatgatttagtata

SEQ ID NO: 7383369 - DNA, 22 bp, Homo sapiens
attgagggctgagaagggccct

SEQ ID NO: 7383370 - DNA, 22 bp, Homo sapiens
attgagaagaaaatctaatata

SEQ ID NO: 7383371 - DNA, 23 bp, Homo sapiens
attgagaaggatacattgttctc

SEQ ID NO: 7383372 - DNA, 22 bp, Homo sapiens
attgagaagcttgcagattttt

SEQ ID NO: 7383373 - DNA, 22 bp, Homo sapiens
attgagaaatataatctggaaa

SEQ ID NO: 7383374 - DNA, 22 bp, Homo sapiens
attgagaaaggcttatgtttgc

SEQ ID NO: 7383375 - DNA, 22 bp, Homo sapiens
attgagaaaataagtatggata

SEQ ID NO: 7383376 - DNA, 22 bp, Homo sapiens
agagcttttgggaattcaggta

SEQ ID NO: 7383377 - DNA, 22 bp, Homo sapiens
agaggaaatggataaagggtga

SEQ ID NO: 7383378 - DNA, 22 bp, Homo sapiens
agaggaaatggataaagggtga

SEQ ID NO: 7383379 - DNA, 21 bp, Homo sapiens
agaggaagaagagtgtattat

SEQ ID NO: 7383380 - DNA, 22 bp, Homo sapiens
agaggaaacataggtttttaaa

SEQ ID NO: 7383381 - DNA, 22 bp, Homo sapiens
agaggaaaatgagttccagaat

SEQ ID NO: 7383382 - DNA, 22 bp, Homo sapiens
agaggccagggacactgctcaa

SEQ ID NO: 7383383 - DNA, 22 bp, Homo sapiens
agaggaagccattgcttactga

SEQ ID NO: 7383384 - DNA, 22 bp, Homo sapiens
attatttggaataggcattgca

SEQ ID NO: 7383385 - DNA, 22 bp, Homo sapiens
attattttatgtgcggcctgat

SEQ ID NO: 7383386 - DNA, 22 bp, Homo sapiens
attatttctcactcacataata

SEQ ID NO: 7383387 - DNA, 22 bp, Homo sapiens
agaggccggccgagcccatggg

SEQ ID NO: 7383388 - DNA, 22 bp, Homo sapiens
agaggccgggtgcctgctcaga

SEQ ID NO: 7383389 - DNA, 22 bp, Homo sapiens
attctctagtctcttccataaa

SEQ ID NO: 7383390 - DNA, 22 bp, Homo sapiens
attcttctgcctactttcatcc

SEQ ID NO: 7383391 - DNA, 22 bp, Homo sapiens
attgaaaaatgactattgctta

SEQ ID NO: 7383392 - DNA, 22 bp, Homo sapiens
attctctgggttccagtaaatg

SEQ ID NO: 7383393 - DNA, 20 bp, Homo sapiens
attctctgacaccgcccccg

SEQ ID NO: 7383394 - DNA, 22 bp, Homo sapiens
attctctgaagtcaatggaaat

SEQ ID NO: 7383395 - DNA, 22 bp, Homo sapiens
attctaaatgtaatttagaatt

SEQ ID NO: 7383396 - DNA, 22 bp, Homo sapiens
attcaaagaacctttagcattg

SEQ ID NO: 7383397 - DNA, 22 bp, Homo sapiens
attcctttggactcctccttgc

SEQ ID NO: 7383398 - DNA, 22 bp, Homo sapiens
agatttcaatggatattgcaag

SEQ ID NO: 7383399 - DNA, 22 bp, Homo sapiens
agatttatgtggtcacactcag

SEQ ID NO: 7383400 - DNA, 22 bp, Homo sapiens
attttgctttatgtaaatatgt

SEQ ID NO: 7383401 - DNA, 22 bp, Homo sapiens
agatttaaatttgctacaattc

SEQ ID NO: 7383402 - DNA, 22 bp, Homo sapiens
agattctcggtccgggcagccc

SEQ ID NO: 7383403 - DNA, 22 bp, Homo sapiens
agattccaggcctggggccaag

SEQ ID NO: 7383404 - DNA, 20 bp, Homo sapiens
agattggatgttaagactgg

SEQ ID NO: 7383405 - DNA, 22 bp, Homo sapiens
agattgtagaaactgtagcatt

SEQ ID NO: 7383406 - DNA, 22 bp, Homo sapiens
agattcagttaaggctggtaga

SEQ ID NO: 7383407 - DNA, 22 bp, Homo sapiens
agatgatgataattgaaaggca

SEQ ID NO: 7383408 - DNA, 22 bp, Homo sapiens
agatgatcccaagaagatgctg

SEQ ID NO: 7383409 - DNA, 22 bp, Homo sapiens
atttacagccttgaaaacagca

SEQ ID NO: 7383410 - DNA, 22 bp, Homo sapiens
atttgaaaacctgagcctcccg

SEQ ID NO: 7383411 - DNA, 23 bp, Homo sapiens
atttgaaactttcttgtttccag

SEQ ID NO: 7383412 - DNA, 22 bp, Homo sapiens
atttctttctggccacggtttt

SEQ ID NO: 7383413 - DNA, 22 bp, Homo sapiens
atttgaaatctgggttactctg

SEQ ID NO: 7383414 - DNA, 22 bp, Homo sapiens
agatgagaatttttagagtgct

SEQ ID NO: 7383415 - DNA, 21 bp, Homo sapiens
agatgaggatactgaggccta

SEQ ID NO: 7383416 - DNA, 22 bp, Homo sapiens
attttgttgaggtaattgtcaa

SEQ ID NO: 7383417 - DNA, 21 bp, Homo sapiens
attttgtacatagaatttgtc

SEQ ID NO: 7383418 - DNA, 22 bp, Homo sapiens
agcaaggtggagaaggatgggt

SEQ ID NO: 7383419 - DNA, 22 bp, Homo sapiens
agcaaggcttcagagctgtctg

SEQ ID NO: 7383420 - DNA, 22 bp, Homo sapiens
agcaaggctgggtctaatgggg

SEQ ID NO: 7383421 - DNA, 23 bp, Homo sapiens
agcaataagaagggatacatgtg

SEQ ID NO: 7383422 - DNA, 22 bp, Homo sapiens
agcaataacagaaaactttcct

SEQ ID NO: 7383423 - DNA, 22 bp, Homo sapiens
agcaataacagaaaactttcct

SEQ ID NO: 7383424 - DNA, 22 bp, Homo sapiens
agcaaggctaaatttcagttat

SEQ ID NO: 7383425 - DNA, 22 bp, Homo sapiens
attttttctgtaaactggcctt

SEQ ID NO: 7383426 - DNA, 22 bp, Homo sapiens
caaacattgggggcttcaacac

SEQ ID NO: 7383427 - DNA, 22 bp, Homo sapiens
caaacatttgacttctctcagg

SEQ ID NO: 7383428 - DNA, 22 bp, Homo sapiens
caaacattgggggcttcaacac

SEQ ID NO: 7383429 - DNA, 22 bp, Homo sapiens
caaacattgggggcttcaacac

SEQ ID NO: 7383430 - DNA, 22 bp, Homo sapiens
agcaataatttaggcctttcct

SEQ ID NO: 7383431 - DNA, 22 bp, Homo sapiens
caaacattgctaccagaggttt

SEQ ID NO: 7383432 - DNA, 22 bp, Homo sapiens
caaacattgcactttctgctat

SEQ ID NO: 7383433 - DNA, 22 bp, Homo sapiens
caaacattttctacttccagga

SEQ ID NO: 7383434 - DNA, 22 bp, Homo sapiens
caaacattttgagtggtttctg

SEQ ID NO: 7383435 - DNA, 22 bp, Homo sapiens
caaacattttgagtggtttctg

SEQ ID NO: 7383436 - DNA, 22 bp, Homo sapiens
caaacatttgttggaacccctg

SEQ ID NO: 7383437 - DNA, 22 bp, Homo sapiens
caaacatttgttggaacccctg

SEQ ID NO: 7383438 - DNA, 22 bp, Homo sapiens
caaagtggctggccgggagatc

SEQ ID NO: 7383439 - DNA, 22 bp, Homo sapiens
caaagtggaggctctggggcca

SEQ ID NO: 7383440 - DNA, 22 bp, Homo sapiens
caaagtggagagcctgtggttg

SEQ ID NO: 7383441 - DNA, 22 bp, Homo sapiens
caaagtgggtgccctgatgctc

SEQ ID NO: 7383442 - DNA, 22 bp, Homo sapiens
caaagttttagtaaacatatat

SEQ ID NO: 7383443 - DNA, 22 bp, Homo sapiens
caaataagaaccacaggggagt

SEQ ID NO: 7383444 - DNA, 22 bp, Homo sapiens
caaataagcaattccattcttc

SEQ ID NO: 7383445 - DNA, 22 bp, Homo sapiens
agcaatgactttgaaatcatga

SEQ ID NO: 7383446 - DNA, 22 bp, Homo sapiens
agcaatgactttgaaatcatga

SEQ ID NO: 7383447 - DNA, 22 bp, Homo sapiens
agcaatgaccagtgatcttgta

SEQ ID NO: 7383448 - DNA, 20 bp, Homo sapiens
cagagctgttatggatgatg

SEQ ID NO: 7383449 - DNA, 22 bp, Homo sapiens
cagagccatggtatgggcttgt

SEQ ID NO: 7383450 - DNA, 22 bp, Homo sapiens
cagagccatccaggtgcctgtt

SEQ ID NO: 7383451 - DNA, 22 bp, Homo sapiens
cagagccatcccagcctgtggt

SEQ ID NO: 7383452 - DNA, 22 bp, Homo sapiens
cagagccatcatgatatggagt

SEQ ID NO: 7383453 - DNA, 22 bp, Homo sapiens
cagagcagtaaatctggggcac

SEQ ID NO: 7383454 - DNA, 22 bp, Homo sapiens
cagagcaggtatctttggtgaa

SEQ ID NO: 7383455 - DNA, 22 bp, Homo sapiens
cagagccaggcctgccctcttt

SEQ ID NO: 7383456 - DNA, 22 bp, Homo sapiens
cagagccagggctaggaactgg

SEQ ID NO: 7383457 - DNA, 19 bp, Homo sapiens
cagagccaggcctttggcc

SEQ ID NO: 7383458 - DNA, 20 bp, Homo sapiens
cagagccagggttttgtttt

SEQ ID NO: 7383459 - DNA, 22 bp, Homo sapiens
cagagccagtcagtcagaaact

SEQ ID NO: 7383460 - DNA, 22 bp, Homo sapiens
cagagccaggtggtgttggggc

SEQ ID NO: 7383461 - DNA, 22 bp, Homo sapiens
cagagccaggtctaggagtctc

SEQ ID NO: 7383462 - DNA, 22 bp, Homo sapiens
agccagggacgctgcaggctac

SEQ ID NO: 7383463 - DNA, 22 bp, Homo sapiens
agccaggctgcagttggctggc

SEQ ID NO: 7383464 - DNA, 22 bp, Homo sapiens
agccagggaagaggcctacctc

SEQ ID NO: 7383465 - DNA, 22 bp, Homo sapiens
agccagggctgcgagcagacag

SEQ ID NO: 7383466 - DNA, 22 bp, Homo sapiens
agccagggctgcgagcagacag

SEQ ID NO: 7383467 - DNA, 22 bp, Homo sapiens
agccaggggagtcagctgctgg

SEQ ID NO: 7383468 - DNA, 22 bp, Homo sapiens
cagagcagggtgcaccttgggc

SEQ ID NO: 7383469 - DNA, 22 bp, Homo sapiens
agccagggatgcagcacagtga

SEQ ID NO: 7383470 - DNA, 22 bp, Homo sapiens
agccagggacgctgcaggctac

SEQ ID NO: 7383471 - DNA, 22 bp, Homo sapiens
agccagggacgctgcaggctac

SEQ ID NO: 7383472 - DNA, 22 bp, Homo sapiens
agccagggctctccttcgcgtg

SEQ ID NO: 7383473 - DNA, 23 bp, Homo sapiens
agccagggcactggtggagattg

SEQ ID NO: 7383474 - DNA, 22 bp, Homo sapiens
agccagggatggcagtgcccag

SEQ ID NO: 7383475 - DNA, 22 bp, Homo sapiens
cagagtgcatggtgctgttcat

SEQ ID NO: 7383476 - DNA, 22 bp, Homo sapiens
cagaggagttcagtacacagcc

SEQ ID NO: 7383477 - DNA, 22 bp, Homo sapiens
cagaggagtgggccgttatggt

SEQ ID NO: 7383478 - DNA, 22 bp, Homo sapiens
cagaggaggcggtatacactgc

SEQ ID NO: 7383479 - DNA, 17 bp, Homo sapiens
cagaggagctttggggg

SEQ ID NO: 7383480 - DNA, 22 bp, Homo sapiens
cagaggaggccaccgcataggc

SEQ ID NO: 7383481 - DNA, 18 bp, Homo sapiens
cagaggagagacattcag

SEQ ID NO: 7383482 - DNA, 22 bp, Homo sapiens
agccctctgagctagtcaccat

SEQ ID NO: 7383483 - DNA, 22 bp, Homo sapiens
agccctctgctgttctagtctc

SEQ ID NO: 7383484 - DNA, 22 bp, Homo sapiens
agcctgcttgagagtcctggct

SEQ ID NO: 7383485 - DNA, 22 bp, Homo sapiens
cagatctgtagtaaaagatctc

SEQ ID NO: 7383486 - DNA, 22 bp, Homo sapiens
agcctattccaggatgagctca

SEQ ID NO: 7383487 - DNA, 22 bp, Homo sapiens
agcctattccaggatgagctca

SEQ ID NO: 7383488 - DNA, 17 bp, Homo sapiens
agccgcctgggtcctgt

SEQ ID NO: 7383489 - DNA, 22 bp, Homo sapiens
agcctagaagaagtggctactt

SEQ ID NO: 7383490 - DNA, 22 bp, Homo sapiens
agcctagactaagacttgctct

SEQ ID NO: 7383491 - DNA, 22 bp, Homo sapiens
cagctggcatacctgggcccgg

SEQ ID NO: 7383492 - DNA, 22 bp, Homo sapiens
cagctgctttagttttccatcc

SEQ ID NO: 7383493 - DNA, 22 bp, Homo sapiens
cagctgctttagttttccatcc

SEQ ID NO: 7383494 - DNA, 22 bp, Homo sapiens
agctgaggaggaatgatgggta

SEQ ID NO: 7383495 - DNA, 22 bp, Homo sapiens
agctctggctaagctgataaat

SEQ ID NO: 7383496 - DNA, 22 bp, Homo sapiens
cagccttttcttaaaatgcaag

SEQ ID NO: 7383497 - DNA, 22 bp, Homo sapiens
cagcctttcttgactgtgtgtt

SEQ ID NO: 7383498 - DNA, 22 bp, Homo sapiens
cagcctttgaacttcagaggtt

SEQ ID NO: 7383499 - DNA, 22 bp, Homo sapiens
cagcctttgggtcagaagattc

SEQ ID NO: 7383500 - DNA, 22 bp, Homo sapiens
cagcctttgtgaacatcaggtg

SEQ ID NO: 7383501 - DNA, 22 bp, Homo sapiens
cagcctttgtgaacatcaggtg

SEQ ID NO: 7383502 - DNA, 22 bp, Homo sapiens
cagccttttaggactatttgtg

SEQ ID NO: 7383503 - DNA, 22 bp, Homo sapiens
cagccttttccatgtattgttg

SEQ ID NO: 7383504 - DNA, 22 bp, Homo sapiens
cagcggccggtgaggaagggga

SEQ ID NO: 7383505 - DNA, 22 bp, Homo sapiens
cagcgtctcgttgtgggcctcg

SEQ ID NO: 7383506 - DNA, 22 bp, Homo sapiens
cagcgctggggtaggagcacct

SEQ ID NO: 7383507 - DNA, 22 bp, Homo sapiens
cagcctcttgcactttgaaggc

SEQ ID NO: 7383508 - DNA, 22 bp, Homo sapiens
cagcctctttccacatcaggca

SEQ ID NO: 7383509 - DNA, 22 bp, Homo sapiens
cagccttgatggatgaggaagt

SEQ ID NO: 7383510 - DNA, 22 bp, Homo sapiens
cagcctttagcattaattccaa

SEQ ID NO: 7383511 - DNA, 22 bp, Homo sapiens
cagcctttatctcctgggctca

SEQ ID NO: 7383512 - DNA, 22 bp, Homo sapiens
cagcctttaagcttggataggt

SEQ ID NO: 7383513 - DNA, 22 bp, Homo sapiens
cagcctttctgtttcctaaggt

SEQ ID NO: 7383514 - DNA, 22 bp, Homo sapiens
cagcctttccaattgctgctgc

SEQ ID NO: 7383515 - DNA, 22 bp, Homo sapiens
cagcctttatggaaaggcctgg

SEQ ID NO: 7383516 - DNA, 18 bp, Homo sapiens
cagcctctgattggttgc

SEQ ID NO: 7383517 - DNA, 22 bp, Homo sapiens
cagcctctgagccttggcagat

SEQ ID NO: 7383518 - DNA, 22 bp, Homo sapiens
cagctgccccgctggctgacca

SEQ ID NO: 7383519 - DNA, 22 bp, Homo sapiens
cagctgcccaggccacctggag

SEQ ID NO: 7383520 - DNA, 22 bp, Homo sapiens
cagctgccccataaatcacagt

SEQ ID NO: 7383521 - DNA, 22 bp, Homo sapiens
cagctgcccatcctgggaaatg

SEQ ID NO: 7383522 - DNA, 22 bp, Homo sapiens
agctctggagccggaggatttc

SEQ ID NO: 7383523 - DNA, 22 bp, Homo sapiens
cagctgcccaagccccagatgt

SEQ ID NO: 7383524 - DNA, 22 bp, Homo sapiens
cagctgccatgacatgtcctgc

SEQ ID NO: 7383525 - DNA, 22 bp, Homo sapiens
cagctgccagcttctctccatc

SEQ ID NO: 7383526 - DNA, 22 bp, Homo sapiens
cagctgccacttgctctcggct

SEQ ID NO: 7383527 - DNA, 18 bp, Homo sapiens
cagctgccagctcatgga

SEQ ID NO: 7383528 - DNA, 22 bp, Homo sapiens
cagccagtggttgaagatgcag

SEQ ID NO: 7383529 - DNA, 22 bp, Homo sapiens
cagcccacttcccagcacctac

SEQ ID NO: 7383530 - DNA, 22 bp, Homo sapiens
cagcccaggtctctcttccagt

SEQ ID NO: 7383531 - DNA, 22 bp, Homo sapiens
cagcctctctgtatctcaggat

SEQ ID NO: 7383532 - DNA, 22 bp, Homo sapiens
cagcagaaaatacctgtaactc

SEQ ID NO: 7383533 - DNA, 22 bp, Homo sapiens
cagcagaaaatgtgggtgattt

SEQ ID NO: 7383534 - DNA, 22 bp, Homo sapiens
agcgagcacattgagtgaagaa

SEQ ID NO: 7383535 - DNA, 22 bp, Homo sapiens
agcgacagaaaccaaggacaag

SEQ ID NO: 7383536 - DNA, 22 bp, Homo sapiens
agcgccactgcactccagcctg

SEQ ID NO: 7383537 - DNA, 22 bp, Homo sapiens
agcaggcctcatgcaccagcta

SEQ ID NO: 7383538 - DNA, 22 bp, Homo sapiens
cacatggcagaatcatgcatct

SEQ ID NO: 7383539 - DNA, 22 bp, Homo sapiens
cacaggctgcccgcagctggga

SEQ ID NO: 7383540 - DNA, 22 bp, Homo sapiens
cacaggctcttctcacttgatt

SEQ ID NO: 7383541 - DNA, 22 bp, Homo sapiens
cacaggctctccagggcctgga

SEQ ID NO: 7383542 - DNA, 22 bp, Homo sapiens
agcaggtggcctcctgtctgtc

SEQ ID NO: 7383543 - DNA, 22 bp, Homo sapiens
cactacaggggtccacagctga

SEQ ID NO: 7383544 - DNA, 22 bp, Homo sapiens
cactaattctggagacaactca

SEQ ID NO: 7383545 - DNA, 22 bp, Homo sapiens
cactaattaacacgtcgtctct

SEQ ID NO: 7383546 - DNA, 22 bp, Homo sapiens
cactaattaatgaaattccagg

SEQ ID NO: 7383547 - DNA, 22 bp, Homo sapiens
cactagaaccaatgacatttct

SEQ ID NO: 7383548 - DNA, 22 bp, Homo sapiens
cacattctttcacagttctgaa

SEQ ID NO: 7383549 - DNA, 22 bp, Homo sapiens
cacattgggatgaagtctaaaa

SEQ ID NO: 7383550 - DNA, 22 bp, Homo sapiens
cacctgcagggggagtcaagag

SEQ ID NO: 7383551 - DNA, 22 bp, Homo sapiens
cacgggctgtttccatgcaaaa

SEQ ID NO: 7383552 - DNA, 22 bp, Homo sapiens
cactgcactccagcccgggcaa

SEQ ID NO: 7383553 - DNA, 22 bp, Homo sapiens
cactgcactccatcctgggaaa

SEQ ID NO: 7383554 - DNA, 22 bp, Homo sapiens
cactgcactccatcctgggaaa

SEQ ID NO: 7383555 - DNA, 22 bp, Homo sapiens
cactgcacaatgtagcaaagaa

SEQ ID NO: 7383556 - DNA, 22 bp, Homo sapiens
cactgcacaggtgagatgtggg

SEQ ID NO: 7383557 - DNA, 22 bp, Homo sapiens
cactgcaccctcaaactcctgg

SEQ ID NO: 7383558 - DNA, 22 bp, Homo sapiens
cactgcactccagcactccagc

SEQ ID NO: 7383559 - DNA, 22 bp, Homo sapiens
cactgcacttcagcctgggtga

SEQ ID NO: 7383560 - DNA, 22 bp, Homo sapiens
cactgcacttcagcctgggtga

SEQ ID NO: 7383561 - DNA, 21 bp, Homo sapiens
agcattcaaaagatgccataa

SEQ ID NO: 7383562 - DNA, 21 bp, Homo sapiens
agcattcaaaagatgccataa

SEQ ID NO: 7383563 - DNA, 20 bp, Homo sapiens
agcatttagcctttatccac

SEQ ID NO: 7383564 - DNA, 22 bp, Homo sapiens
agcatttatgactaatgtaaaa

SEQ ID NO: 7383565 - DNA, 22 bp, Homo sapiens
agcatttccgccctcttctgcc

SEQ ID NO: 7383566 - DNA, 22 bp, Homo sapiens
cagaaagacctgggctcaagag

SEQ ID NO: 7383567 - DNA, 22 bp, Homo sapiens
cagaaagacctgattggcagtt

SEQ ID NO: 7383568 - DNA, 22 bp, Homo sapiens
agccaaagatcagtgtgcaagt

SEQ ID NO: 7383569 - DNA, 20 bp, Homo sapiens
agccaaaggagaacagtgct

SEQ ID NO: 7383570 - DNA, 22 bp, Homo sapiens
agccaaaggcaccagagacact

SEQ ID NO: 7383571 - DNA, 20 bp, Homo sapiens
cagaaagaaggtagattttt

SEQ ID NO: 7383572 - DNA, 22 bp, Homo sapiens
cagaaacatgtataaagttgta

SEQ ID NO: 7383573 - DNA, 22 bp, Homo sapiens
cagaaactatgtaagaaagtga

SEQ ID NO: 7383574 - DNA, 22 bp, Homo sapiens
agcattttctgagagtatagat

SEQ ID NO: 7383575 - DNA, 22 bp, Homo sapiens
cactttgcagggtggtgggagg

SEQ ID NO: 7383576 - DNA, 22 bp, Homo sapiens
cactgggtcaggatagagccca

SEQ ID NO: 7383577 - DNA, 22 bp, Homo sapiens
caatttctggaactaattctga

SEQ ID NO: 7383578 - DNA, 22 bp, Homo sapiens
caatttgacaagttgcatgttt

SEQ ID NO: 7383579 - DNA, 22 bp, Homo sapiens
caatttgacttttgaggttgta

SEQ ID NO: 7383580 - DNA, 22 bp, Homo sapiens
caatttttgtacttatagtact

SEQ ID NO: 7383581 - DNA, 22 bp, Homo sapiens
caatttttaaactatgaagttg

SEQ ID NO: 7383582 - DNA, 22 bp, Homo sapiens
caattttattggtccaaataca

SEQ ID NO: 7383583 - DNA, 18 bp, Homo sapiens
caattttacccagtccct

SEQ ID NO: 7383584 - DNA, 22 bp, Homo sapiens
caattttactcttcctcttcca

SEQ ID NO: 7383585 - DNA, 22 bp, Homo sapiens
cacacattaatatcaaaggctc

SEQ ID NO: 7383586 - DNA, 22 bp, Homo sapiens
cacacttgtgaccgatataatg

SEQ ID NO: 7383587 - DNA, 22 bp, Homo sapiens
cacagctggaatggggtacctg

SEQ ID NO: 7383588 - DNA, 22 bp, Homo sapiens
cacagctggggaagctgaggcc

SEQ ID NO: 7383589 - DNA, 21 bp, Homo sapiens
agcagacagatgcacgcacac

SEQ ID NO: 7383590 - DNA, 22 bp, Homo sapiens
agcagaccaggagtgcacaggt

SEQ ID NO: 7383591 - DNA, 22 bp, Homo sapiens
agcagagaagacacaggcttca

SEQ ID NO: 7383592 - DNA, 22 bp, Homo sapiens
agcagagacatgaaatatgctt

SEQ ID NO: 7383593 - DNA, 22 bp, Homo sapiens
caagggaaggctaagggcaaca

SEQ ID NO: 7383594 - DNA, 22 bp, Homo sapiens
caagggaagaggacagggacct

SEQ ID NO: 7383595 - DNA, 22 bp, Homo sapiens
agcaatttctcgcaccagacgc

SEQ ID NO: 7383596 - DNA, 22 bp, Homo sapiens
agcaattttcccttagtctttg

SEQ ID NO: 7383597 - DNA, 22 bp, Homo sapiens
caaggaaaacagatgatcaaca

SEQ ID NO: 7383598 - DNA, 22 bp, Homo sapiens
caagctttccattacacacatt

SEQ ID NO: 7383599 - DNA, 22 bp, Homo sapiens
caagggagttactgagggcggg

SEQ ID NO: 7383600 - DNA, 22 bp, Homo sapiens
caagggagttgctgcatgcagg

SEQ ID NO: 7383601 - DNA, 22 bp, Homo sapiens
caagggagttgctgcatgcagg

SEQ ID NO: 7383602 - DNA, 22 bp, Homo sapiens
caagtccaggtgggcaaataaa

SEQ ID NO: 7383603 - DNA, 22 bp, Homo sapiens
caagtccatcagataagcaaga

SEQ ID NO: 7383604 - DNA, 22 bp, Homo sapiens
caagtcattgtttagtcatgtt

SEQ ID NO: 7383605 - DNA, 22 bp, Homo sapiens
caagtccaagatcaagaagcca

SEQ ID NO: 7383606 - DNA, 22 bp, Homo sapiens
caagtccaggtcaatttaaagc

SEQ ID NO: 7383607 - DNA, 22 bp, Homo sapiens
caagtcatcatagaagttcccc

SEQ ID NO: 7383608 - DNA, 23 bp, Homo sapiens
caagtcatggattggagtttcag

SEQ ID NO: 7383609 - DNA, 22 bp, Homo sapiens
caagtcattactgaaatgtcac

SEQ ID NO: 7383610 - DNA, 22 bp, Homo sapiens
caatgtttttccttccttaata

SEQ ID NO: 7383611 - DNA, 22 bp, Homo sapiens
caagtctgacctctgggtgaag

SEQ ID NO: 7383612 - DNA, 22 bp, Homo sapiens
caattacttttgcaccaatata

SEQ ID NO: 7383613 - DNA, 21 bp, Homo sapiens
caattactatgaaccagttga

SEQ ID NO: 7383614 - DNA, 22 bp, Homo sapiens
caattacatttattgagcattc

SEQ ID NO: 7383615 - DNA, 22 bp, Homo sapiens
caattattcagtgacttaagag

SEQ ID NO: 7383616 - DNA, 22 bp, Homo sapiens
caattatatttagaatgataca

SEQ ID NO: 7383617 - DNA, 22 bp, Homo sapiens
caattatatttagaatgataca

SEQ ID NO: 7383618 - DNA, 22 bp, Homo sapiens
caattacttttgcaccaatata

SEQ ID NO: 7383619 - DNA, 22 bp, Homo sapiens
caattacttttgcaccaatata

SEQ ID NO: 7383620 - DNA, 23 bp, Homo sapiens
atagttatgctgcatgcatgtac

SEQ ID NO: 7383621 - DNA, 22 bp, Homo sapiens
agaaaaagtcaaggaattggac

SEQ ID NO: 7383622 - DNA, 22 bp, Homo sapiens
agaaaacttgtcacagctctca

SEQ ID NO: 7383623 - DNA, 22 bp, Homo sapiens
agaaaactgggaggagagcttc

SEQ ID NO: 7383624 - DNA, 22 bp, Homo sapiens
agaaaagcggtcaggaccctca

SEQ ID NO: 7383625 - DNA, 22 bp, Homo sapiens
agaaaagaggctttctaagcat

SEQ ID NO: 7383626 - DNA, 22 bp, Homo sapiens
agaaaaggattgatggatcaga

SEQ ID NO: 7383627 - DNA, 22 bp, Homo sapiens
atagctgtgggctatttgtggg

SEQ ID NO: 7383628 - DNA, 22 bp, Homo sapiens
atagctgttgccaatttccatg

SEQ ID NO: 7383629 - DNA, 22 bp, Homo sapiens
atagctgttgccaatttccatg

SEQ ID NO: 7383630 - DNA, 22 bp, Homo sapiens
atagctgtagaatgtatacaca

SEQ ID NO: 7383631 - DNA, 22 bp, Homo sapiens
atagctttcttaaatatataaa

SEQ ID NO: 7383632 - DNA, 22 bp, Homo sapiens
atagctttcttaaatatataaa

SEQ ID NO: 7383633 - DNA, 22 bp, Homo sapiens
atagaatagcatagaaaattga

SEQ ID NO: 7383634 - DNA, 22 bp, Homo sapiens
actttactccccaacataaatg

SEQ ID NO: 7383635 - DNA, 22 bp, Homo sapiens
atagatgtgtgtaagtacataa

SEQ ID NO: 7383636 - DNA, 20 bp, Homo sapiens
actttactgagctgtaattc

SEQ ID NO: 7383637 - DNA, 22 bp, Homo sapiens
atacacttccaaatattgatta

SEQ ID NO: 7383638 - DNA, 22 bp, Homo sapiens
atacactgttcactagatcttc

SEQ ID NO: 7383639 - DNA, 22 bp, Homo sapiens
atagaagcttttaaataacagg

SEQ ID NO: 7383640 - DNA, 22 bp, Homo sapiens
atagaagtggtctgcatttgca

SEQ ID NO: 7383641 - DNA, 22 bp, Homo sapiens
atagaacagaaacagatgcaca

SEQ ID NO: 7383642 - DNA, 22 bp, Homo sapiens
atagaacagaaacagatgcaca

SEQ ID NO: 7383643 - DNA, 22 bp, Homo sapiens
atagaacataattctcagccct

SEQ ID NO: 7383644 - DNA, 22 bp, Homo sapiens
ataaggtagcaagcacagtcct

SEQ ID NO: 7383645 - DNA, 22 bp, Homo sapiens
atacaagttgtgataatgtaaa

SEQ ID NO: 7383646 - DNA, 22 bp, Homo sapiens
atacaagttgtgataatgtaaa

SEQ ID NO: 7383647 - DNA, 17 bp, Homo sapiens
atacaaagccataaacc

SEQ ID NO: 7383648 - DNA, 20 bp, Homo sapiens
atacaaagagattgatgtat

SEQ ID NO: 7383649 - DNA, 22 bp, Homo sapiens
ataaggcagaaatagggaaagt

SEQ ID NO: 7383650 - DNA, 22 bp, Homo sapiens
ataaggacttgaattagacatt

SEQ ID NO: 7383651 - DNA, 22 bp, Homo sapiens
ataaggcacacatagatagggt

SEQ ID NO: 7383652 - DNA, 22 bp, Homo sapiens
ataaggacacccttctctttac

SEQ ID NO: 7383653 - DNA, 22 bp, Homo sapiens
ataaggaagatgtcctcatctg

SEQ ID NO: 7383654 - DNA, 22 bp, Homo sapiens
ataaggaatgatgtatcagttt

SEQ ID NO: 7383655 - DNA, 22 bp, Homo sapiens
ataagcttttgattcacttcag

SEQ ID NO: 7383656 - DNA, 22 bp, Homo sapiens
ataaggaaaattggagaaattg

SEQ ID NO: 7383657 - DNA, 22 bp, Homo sapiens
ataagcttttaaagctactttg

SEQ ID NO: 7383658 - DNA, 22 bp, Homo sapiens
ataaggaagatgtcctcatctg

SEQ ID NO: 7383659 - DNA, 22 bp, Homo sapiens
ataacagagagctactgaactg

SEQ ID NO: 7383660 - DNA, 22 bp, Homo sapiens
ataagcttcctgttagaaaccg

SEQ ID NO: 7383661 - DNA, 22 bp, Homo sapiens
atacaatagtgtttgttttgag

SEQ ID NO: 7383662 - DNA, 22 bp, Homo sapiens
atacaatcaaccacttgcgagc

SEQ ID NO: 7383663 - DNA, 20 bp, Homo sapiens
atacaatcatgaggaaaaag

SEQ ID NO: 7383664 - DNA, 22 bp, Homo sapiens
atacaattattctgcagatatt

SEQ ID NO: 7383665 - DNA, 22 bp, Homo sapiens
atacaatgataatagtacttta

SEQ ID NO: 7383666 - DNA, 22 bp, Homo sapiens
atacacgtgtgtgtacatgcac

SEQ ID NO: 7383667 - DNA, 19 bp, Homo sapiens
atacactaatataaaccac

SEQ ID NO: 7383668 - DNA, 22 bp, Homo sapiens
atacacagccattatgaattag

SEQ ID NO: 7383669 - DNA, 22 bp, Homo sapiens
atacacatttgctagagatggg

SEQ ID NO: 7383670 - DNA, 22 bp, Homo sapiens
agttcacagggaaggttattgt

SEQ ID NO: 7383671 - DNA, 22 bp, Homo sapiens
agttcacagccatgttcatgtg

SEQ ID NO: 7383672 - DNA, 22 bp, Homo sapiens
agttcacaagtgcatttcagga

SEQ ID NO: 7383673 - DNA, 22 bp, Homo sapiens
agttgaacagtatttgcttctg

SEQ ID NO: 7383674 - DNA, 22 bp, Homo sapiens
agttgaacttcctttctgggat

SEQ ID NO: 7383675 - DNA, 22 bp, Homo sapiens
agttgaatgttacagttctaaa

SEQ ID NO: 7383676 - DNA, 22 bp, Homo sapiens
agttctttgtgagtaatacaga

SEQ ID NO: 7383677 - DNA, 22 bp, Homo sapiens
ataacaatagtggtagtgctgg

SEQ ID NO: 7383678 - DNA, 22 bp, Homo sapiens
ataaattgtgcttttgacatct

SEQ ID NO: 7383679 - DNA, 22 bp, Homo sapiens
ataaattgtgcttttgacatct

SEQ ID NO: 7383680 - DNA, 22 bp, Homo sapiens
ataaattctctgatgtatagta

SEQ ID NO: 7383681 - DNA, 22 bp, Homo sapiens
agttgcagacgcagagatgttg

SEQ ID NO: 7383682 - DNA, 22 bp, Homo sapiens
agaaatcagaaccctgaagttc

SEQ ID NO: 7383683 - DNA, 22 bp, Homo sapiens
agaaatatgctgattagatgaa

SEQ ID NO: 7383684 - DNA, 22 bp, Homo sapiens
agaaatatgctgattagatgaa

SEQ ID NO: 7383685 - DNA, 22 bp, Homo sapiens
atattacacacggtatcacggg

SEQ ID NO: 7383686 - DNA, 22 bp, Homo sapiens
agaaatctttcctgaagtgttt

SEQ ID NO: 7383687 - DNA, 22 bp, Homo sapiens
atcaattcttaggaaaatagct

SEQ ID NO: 7383688 - DNA, 22 bp, Homo sapiens
agaaatgcagtttcaagacaaa

SEQ ID NO: 7383689 - DNA, 22 bp, Homo sapiens
atcaagcagtgaaaaatgctag

SEQ ID NO: 7383690 - DNA, 22 bp, Homo sapiens
atcaagtatccaggtagtgcta

SEQ ID NO: 7383691 - DNA, 22 bp, Homo sapiens
atcaatgacagttgaattctac

SEQ ID NO: 7383692 - DNA, 22 bp, Homo sapiens
atatagaaggtgctatttacat

SEQ ID NO: 7383693 - DNA, 22 bp, Homo sapiens
atatagaaggtgctatttacat

SEQ ID NO: 7383694 - DNA, 21 bp, Homo sapiens
atatagcgtgtctacatgtta

SEQ ID NO: 7383695 - DNA, 22 bp, Homo sapiens
agaaactgtgttactagaatgt

SEQ ID NO: 7383696 - DNA, 20 bp, Homo sapiens
agaaacatttcttgagaact

SEQ ID NO: 7383697 - DNA, 22 bp, Homo sapiens
atatagtttaagaaagtacagt

SEQ ID NO: 7383698 - DNA, 22 bp, Homo sapiens
agaaagaacgttggttatctta

SEQ ID NO: 7383699 - DNA, 22 bp, Homo sapiens
atattaaaactatggttttcag

SEQ ID NO: 7383700 - DNA, 22 bp, Homo sapiens
atattaatgagcaagtaagtga

SEQ ID NO: 7383701 - DNA, 22 bp, Homo sapiens
atcctgagttcctgcctctaaa

SEQ ID NO: 7383702 - DNA, 22 bp, Homo sapiens
atcctgagttctcagagtctcc

SEQ ID NO: 7383703 - DNA, 22 bp, Homo sapiens
agaagctcgggtaagctccatt

SEQ ID NO: 7383704 - DNA, 22 bp, Homo sapiens
agaagcaggcctcacagatctg

SEQ ID NO: 7383705 - DNA, 18 bp, Homo sapiens
agaagcaggtaaaattct

SEQ ID NO: 7383706 - DNA, 22 bp, Homo sapiens
agaaatgtcaggaaagaagtcc

SEQ ID NO: 7383707 - DNA, 22 bp, Homo sapiens
agaaatgtattctgtatgtttt

SEQ ID NO: 7383708 - DNA, 22 bp, Homo sapiens
agaaatggtgagtgagagcccc

SEQ ID NO: 7383709 - DNA, 22 bp, Homo sapiens
agaaatgtggatcgttttaaaa

SEQ ID NO: 7383710 - DNA, 22 bp, Homo sapiens
agaaatgttcttcatttgccat

SEQ ID NO: 7383711 - DNA, 22 bp, Homo sapiens
agaaatgtgaatttcatttcct

SEQ ID NO: 7383712 - DNA, 22 bp, Homo sapiens
agaaatgtgaatttcatttcct

SEQ ID NO: 7383713 - DNA, 22 bp, Homo sapiens
agtgtgtagcacatggtaagca

SEQ ID NO: 7383714 - DNA, 22 bp, Homo sapiens
agtgtctgttacgcttgcagaa

SEQ ID NO: 7383715 - DNA, 22 bp, Homo sapiens
agtgtctgtgatgaggtcagga

SEQ ID NO: 7383716 - DNA, 22 bp, Homo sapiens
agtgtctggtgagggctctctc

SEQ ID NO: 7383717 - DNA, 22 bp, Homo sapiens
agtgggggccaacgagggcagc

SEQ ID NO: 7383718 - DNA, 22 bp, Homo sapiens
agttacaaacactatcagttct

SEQ ID NO: 7383719 - DNA, 22 bp, Homo sapiens
actggttgaagaaaagctagta

SEQ ID NO: 7383720 - DNA, 22 bp, Homo sapiens
agttacaagctattttacttaa

SEQ ID NO: 7383721 - DNA, 22 bp, Homo sapiens
agttacaactgtttgaatgtca

SEQ ID NO: 7383722 - DNA, 22 bp, Homo sapiens
agttacaaccatgacacaagca

SEQ ID NO: 7383723 - DNA, 19 bp, Homo sapiens
agttatttctaaatttacc

SEQ ID NO: 7383724 - DNA, 22 bp, Homo sapiens
agttactcaaggctgatataag

SEQ ID NO: 7383725 - DNA, 22 bp, Homo sapiens
agtggcagaagtcactgggtag

SEQ ID NO: 7383726 - DNA, 22 bp, Homo sapiens
agtggcagacacaatgtgggca

SEQ ID NO: 7383727 - DNA, 22 bp, Homo sapiens
agtgctttccctgaaaccttcc

SEQ ID NO: 7383728 - DNA, 22 bp, Homo sapiens
agtgggagccagcagcttgggg

SEQ ID NO: 7383729 - DNA, 22 bp, Homo sapiens
agtgggagataacttaacagct

SEQ ID NO: 7383730 - DNA, 20 bp, Homo sapiens
agtgggagagggcagactgc

SEQ ID NO: 7383731 - DNA, 20 bp, Homo sapiens
agtgggagagggcagactgc

SEQ ID NO: 7383732 - DNA, 22 bp, Homo sapiens
agtgggaggcggctgacgggcg

SEQ ID NO: 7383733 - DNA, 16 bp, Homo sapiens
agtgggaggagaaaga

SEQ ID NO: 7383734 - DNA, 22 bp, Homo sapiens
agtgggaggaagtggtgatatt

SEQ ID NO: 7383735 - DNA, 22 bp, Homo sapiens
agtgggagcggcagtcggggac

SEQ ID NO: 7383736 - DNA, 20 bp, Homo sapiens
agtgctgtggctgaataaga

SEQ ID NO: 7383737 - DNA, 22 bp, Homo sapiens
agtgctgtctccttcccccggg

SEQ ID NO: 7383738 - DNA, 22 bp, Homo sapiens
agtgagcaacagaagcgtgggt

SEQ ID NO: 7383739 - DNA, 23 bp, Homo sapiens
agtgagcagctgtagggcaagga

SEQ ID NO: 7383740 - DNA, 22 bp, Homo sapiens
agtgagcatcttcaggagccaa

SEQ ID NO: 7383741 - DNA, 20 bp, Homo sapiens
agtgaggcagttcagtgggc

SEQ ID NO: 7383742 - DNA, 22 bp, Homo sapiens
agtgaggctaataggcaatggt

SEQ ID NO: 7383743 - DNA, 22 bp, Homo sapiens
agtgaggcaaagtgagaggcag

SEQ ID NO: 7383744 - DNA, 19 bp, Homo sapiens
agtgagcatggcttgactg

SEQ ID NO: 7383745 - DNA, 22 bp, Homo sapiens
agtaagttagtacctgctcaga

SEQ ID NO: 7383746 - DNA, 22 bp, Homo sapiens
agtaagttccaggttgctcttc

SEQ ID NO: 7383747 - DNA, 22 bp, Homo sapiens
agtaagttccagtttcattatg

SEQ ID NO: 7383748 - DNA, 22 bp, Homo sapiens
agtccaggagttgggtgacatt

SEQ ID NO: 7383749 - DNA, 21 bp, Homo sapiens
agtccaggaggaggccaggtt

SEQ ID NO: 7383750 - DNA, 22 bp, Homo sapiens
agtccaggaagcatcatggtct

SEQ ID NO: 7383751 - DNA, 22 bp, Homo sapiens
agtcctgttggttccagaggtg

SEQ ID NO: 7383752 - DNA, 20 bp, Homo sapiens
aggtgtccacgtggcagggt

SEQ ID NO: 7383753 - DNA, 22 bp, Homo sapiens
aggttcccagagatagagctgt

SEQ ID NO: 7383754 - DNA, 22 bp, Homo sapiens
aggttcccaggatctgtctggg

SEQ ID NO: 7383755 - DNA, 20 bp, Homo sapiens
aggttcctttgtggagaatt

SEQ ID NO: 7383756 - DNA, 22 bp, Homo sapiens
aggttctcacacgtctacaccc

SEQ ID NO: 7383757 - DNA, 22 bp, Homo sapiens
aggttccttatggggatggcta

SEQ ID NO: 7383758 - DNA, 22 bp, Homo sapiens
actcacagtgaagccagaatca

SEQ ID NO: 7383759 - DNA, 22 bp, Homo sapiens
aggtggagacccagagaaggcg

SEQ ID NO: 7383760 - DNA, 22 bp, Homo sapiens
aggtggagaagagatgggcagt

SEQ ID NO: 7383761 - DNA, 22 bp, Homo sapiens
aggtggaacgttcaggtgctag

SEQ ID NO: 7383762 - DNA, 22 bp, Homo sapiens
agggtgcagtcacaggaaatgt

SEQ ID NO: 7383763 - DNA, 22 bp, Homo sapiens
aggtgccagatgcacagctgaa

SEQ ID NO: 7383764 - DNA, 22 bp, Homo sapiens
aggtgccagatgcacagctgaa

SEQ ID NO: 7383765 - DNA, 21 bp, Homo sapiens
aggtgccaaggagaagcaggc

SEQ ID NO: 7383766 - DNA, 22 bp, Homo sapiens
aggtgcagtgaaggaaaaggaa

SEQ ID NO: 7383767 - DNA, 22 bp, Homo sapiens
aggtgcagtgtttaaaagtagc

SEQ ID NO: 7383768 - DNA, 22 bp, Homo sapiens
aggtgccaagatgtcacagaca

SEQ ID NO: 7383769 - DNA, 22 bp, Homo sapiens
agggtgcagggacaggtgtgca

SEQ ID NO: 7383770 - DNA, 22 bp, Homo sapiens
agggtgcagaaggagcctagga

SEQ ID NO: 7383771 - DNA, 22 bp, Homo sapiens
agggtgcaggggaagctgccct

SEQ ID NO: 7383772 - DNA, 22 bp, Homo sapiens
agggtgcaggtgtggagtctag

SEQ ID NO: 7383773 - DNA, 22 bp, Homo sapiens
agggtcccgtccctctgcaccc

SEQ ID NO: 7383774 - DNA, 22 bp, Homo sapiens
agggtgcaaaagcaaggacagt

SEQ ID NO: 7383775 - DNA, 22 bp, Homo sapiens
agggtgcaaaagcaaggacagt

SEQ ID NO: 7383776 - DNA, 19 bp, Homo sapiens
agggtccaggccctgtgga

SEQ ID NO: 7383777 - DNA, 22 bp, Homo sapiens
agggtcccgaaggagacagcaa

SEQ ID NO: 7383778 - DNA, 22 bp, Homo sapiens
agggtccattctttgccttttc

SEQ ID NO: 7383779 - DNA, 22 bp, Homo sapiens
agggccagtaaatgtttcctca

SEQ ID NO: 7383780 - DNA, 22 bp, Homo sapiens
agggccagttcagaggacatgg

SEQ ID NO: 7383781 - DNA, 22 bp, Homo sapiens
agggccagcccataatgccaaa

SEQ ID NO: 7383782 - DNA, 22 bp, Homo sapiens
agggccagcccataatgccaaa

SEQ ID NO: 7383783 - DNA, 22 bp, Homo sapiens
accagagaatgtgcatctctaa

SEQ ID NO: 7383784 - DNA, 22 bp, Homo sapiens
agggaggcaggaaagttgtctg

SEQ ID NO: 7383785 - DNA, 22 bp, Homo sapiens
agggaggcaggaaagttgtctg

SEQ ID NO: 7383786 - DNA, 22 bp, Homo sapiens
agggaggatctgctccttgtct

SEQ ID NO: 7383787 - DNA, 22 bp, Homo sapiens
agggaggatagtagtcagttta

SEQ ID NO: 7383788 - DNA, 22 bp, Homo sapiens
agggaggatagtagtcagttta

SEQ ID NO: 7383789 - DNA, 22 bp, Homo sapiens
agggagctgactggctgccatt

SEQ ID NO: 7383790 - DNA, 22 bp, Homo sapiens
agggcaaagccagtgactccca

SEQ ID NO: 7383791 - DNA, 20 bp, Homo sapiens
agggcaaaatccaaaagtct

SEQ ID NO: 7383792 - DNA, 22 bp, Homo sapiens
agggaggcattagctactgcga

SEQ ID NO: 7383793 - DNA, 22 bp, Homo sapiens
agggaggcattagctactgcga

SEQ ID NO: 7383794 - DNA, 22 bp, Homo sapiens
agggaggtctggctgccctgag

SEQ ID NO: 7383795 - DNA, 22 bp, Homo sapiens
agggtcagtgatgagggagccc

SEQ ID NO: 7383796 - DNA, 22 bp, Homo sapiens
aggggccacctgtggcaccctg

SEQ ID NO: 7383797 - DNA, 22 bp, Homo sapiens
acctcaggatgtggacacagaa

SEQ ID NO: 7383798 - DNA, 22 bp, Homo sapiens
acctcacaagtctctgtcagct

SEQ ID NO: 7383799 - DNA, 22 bp, Homo sapiens
aggggagccgaggggcatctgt

SEQ ID NO: 7383800 - DNA, 22 bp, Homo sapiens
aggggagcccctggtcctggtg

SEQ ID NO: 7383801 - DNA, 22 bp, Homo sapiens
aggggcaggtgctgcacttaga

SEQ ID NO: 7383802 - DNA, 22 bp, Homo sapiens
aggggagcttgaggcatggcct

SEQ ID NO: 7383803 - DNA, 22 bp, Homo sapiens
aggctgcttcagctgcagggag

SEQ ID NO: 7383804 - DNA, 22 bp, Homo sapiens
aggctgctggaggatttatgcc

SEQ ID NO: 7383805 - DNA, 22 bp, Homo sapiens
aggctctggctactacagagct

SEQ ID NO: 7383806 - DNA, 22 bp, Homo sapiens
aggctctggcaacagctggtgt

SEQ ID NO: 7383807 - DNA, 21 bp, Homo sapiens
aggctgctctttcttgtggta

SEQ ID NO: 7383808 - DNA, 22 bp, Homo sapiens
aggctggcttcccaagcgtcct

SEQ ID NO: 7383809 - DNA, 22 bp, Homo sapiens
acatttctcctacttgttattt

SEQ ID NO: 7383810 - DNA, 22 bp, Homo sapiens
acatttctcctacttgttattt

SEQ ID NO: 7383811 - DNA, 18 bp, Homo sapiens
acatttctccttctgacc

SEQ ID NO: 7383812 - DNA, 22 bp, Homo sapiens
acatttctcaggtaagtcattt

SEQ ID NO: 7383813 - DNA, 22 bp, Homo sapiens
accagacactgtgaagacaggc

SEQ ID NO: 7383814 - DNA, 22 bp, Homo sapiens
accagaaaggaataatagaatt

SEQ ID NO: 7383815 - DNA, 22 bp, Homo sapiens
accactgcccatggtgaaaact

SEQ ID NO: 7383816 - DNA, 22 bp, Homo sapiens
accacaggacccatgagtcagt

SEQ ID NO: 7383817 - DNA, 22 bp, Homo sapiens
acattaaaaaatgttgcatgaa

SEQ ID NO: 7383818 - DNA, 22 bp, Homo sapiens
acatgttttgtgccttgactag

SEQ ID NO: 7383819 - DNA, 22 bp, Homo sapiens
aggctctggacagtgaggagtt

SEQ ID NO: 7383820 - DNA, 22 bp, Homo sapiens
aggctctgaaggagaacctgtt

SEQ ID NO: 7383821 - DNA, 22 bp, Homo sapiens
acatggctcagtctcatgacag

SEQ ID NO: 7383822 - DNA, 22 bp, Homo sapiens
acatgtatacaatgtgtaatga

SEQ ID NO: 7383823 - DNA, 22 bp, Homo sapiens
acatgtatgtgtgcaaacacat

SEQ ID NO: 7383824 - DNA, 22 bp, Homo sapiens
acatgtattgacattatattct

SEQ ID NO: 7383825 - DNA, 22 bp, Homo sapiens
acatgtctacacattctgcaat

SEQ ID NO: 7383826 - DNA, 21 bp, Homo sapiens
acatgtctctaatctcagtga

SEQ ID NO: 7383827 - DNA, 22 bp, Homo sapiens
acatgtcttgtggctttgatct

SEQ ID NO: 7383828 - DNA, 22 bp, Homo sapiens
acatgtcttttaaagtctaata

SEQ ID NO: 7383829 - DNA, 20 bp, Homo sapiens
aggctcactcaccttgtgga

SEQ ID NO: 7383830 - DNA, 20 bp, Homo sapiens
aggctcactcaccttgtgga

SEQ ID NO: 7383831 - DNA, 22 bp, Homo sapiens
aggcaggtgggtcacttgagtc

SEQ ID NO: 7383832 - DNA, 22 bp, Homo sapiens
aggcaggtgggtcacttgagtc

SEQ ID NO: 7383833 - DNA, 22 bp, Homo sapiens
aggcaggtgcttatgacttgct

SEQ ID NO: 7383834 - DNA, 22 bp, Homo sapiens
aggcaggtgttgggagacacca

SEQ ID NO: 7383835 - DNA, 18 bp, Homo sapiens
aggcaggtgctggaagtc

SEQ ID NO: 7383836 - DNA, 22 bp, Homo sapiens
aggcagcaaagaaatgatgctg

SEQ ID NO: 7383837 - DNA, 22 bp, Homo sapiens
aggcagcaagattatttaatcc

SEQ ID NO: 7383838 - DNA, 22 bp, Homo sapiens
aggcagatggatgggcatttgt

SEQ ID NO: 7383839 - DNA, 22 bp, Homo sapiens
aggcagatgaacctgggttgag

SEQ ID NO: 7383840 - DNA, 22 bp, Homo sapiens
aggcagatggtaactgtgatat

SEQ ID NO: 7383841 - DNA, 22 bp, Homo sapiens
aggcagatgtgattaatttcct

SEQ ID NO: 7383842 - DNA, 22 bp, Homo sapiens
aggcagatcacaggagggcctg

SEQ ID NO: 7383843 - DNA, 22 bp, Homo sapiens
aggcagaatgttggaaaggaag

SEQ ID NO: 7383844 - DNA, 22 bp, Homo sapiens
aggcagacttaccttctgggga

SEQ ID NO: 7383845 - DNA, 22 bp, Homo sapiens
acatatattactagtaaagaca

SEQ ID NO: 7383846 - DNA, 22 bp, Homo sapiens
acatataagggatcagtgacag

SEQ ID NO: 7383847 - DNA, 22 bp, Homo sapiens
acatatatgtaaagtactttgt

SEQ ID NO: 7383848 - DNA, 22 bp, Homo sapiens
acatatatgtaaagtactttgt

SEQ ID NO: 7383849 - DNA, 22 bp, Homo sapiens
acatatatgtgcacatgtgcag

SEQ ID NO: 7383850 - DNA, 22 bp, Homo sapiens
aggcagtgtgtagctggaagag

SEQ ID NO: 7383851 - DNA, 22 bp, Homo sapiens
acatctgttcttctcttgtccc

SEQ ID NO: 7383852 - DNA, 22 bp, Homo sapiens
acatctgtttaacgaaggcatt

SEQ ID NO: 7383853 - DNA, 22 bp, Homo sapiens
acatctgtaatctagtcaaccc

SEQ ID NO: 7383854 - DNA, 22 bp, Homo sapiens
acatctgtcctctgcagagctc

SEQ ID NO: 7383855 - DNA, 20 bp, Homo sapiens
aggcagtgtagagatgagta

SEQ ID NO: 7383856 - DNA, 20 bp, Homo sapiens
aggcagtgtagagatgagta

SEQ ID NO: 7383857 - DNA, 23 bp, Homo sapiens
aggcactcgacagaaatattgga

SEQ ID NO: 7383858 - DNA, 22 bp, Homo sapiens
aggcactggtccattttctgca

SEQ ID NO: 7383859 - DNA, 22 bp, Homo sapiens
aggcactggtccattttctgca

SEQ ID NO: 7383860 - DNA, 22 bp, Homo sapiens
acagtgttcaaaccactaggct

SEQ ID NO: 7383861 - DNA, 22 bp, Homo sapiens
aggcacctcagctgagcctggg

SEQ ID NO: 7383862 - DNA, 22 bp, Homo sapiens
aggcacagcacacctggccccc

SEQ ID NO: 7383863 - DNA, 22 bp, Homo sapiens
acagtggcatctacttaatctg

SEQ ID NO: 7383864 - DNA, 22 bp, Homo sapiens
acagtggcagtcgtgttctcta

SEQ ID NO: 7383865 - DNA, 22 bp, Homo sapiens
acagtgggacagtgacggggga

SEQ ID NO: 7383866 - DNA, 22 bp, Homo sapiens
acagtggcttttgtgtctgcag

SEQ ID NO: 7383867 - DNA, 17 bp, Homo sapiens
aggaggccctggcgttt

SEQ ID NO: 7383868 - DNA, 17 bp, Homo sapiens
aggaggccctggcgttt

SEQ ID NO: 7383869 - DNA, 22 bp, Homo sapiens
aggaggccatgtactaggttcc

SEQ ID NO: 7383870 - DNA, 19 bp, Homo sapiens
aggaggccatgccactaga

SEQ ID NO: 7383871 - DNA, 22 bp, Homo sapiens
aggaggccatcagttccttcct

SEQ ID NO: 7383872 - DNA, 19 bp, Homo sapiens
aggaggccatgccactaga

SEQ ID NO: 7383873 - DNA, 22 bp, Homo sapiens
aggaggccctagagctctagag

SEQ ID NO: 7383874 - DNA, 22 bp, Homo sapiens
aggaggcccctcctgggttgct

SEQ ID NO: 7383875 - DNA, 22 bp, Homo sapiens
aggaggccctagagctctagag

SEQ ID NO: 7383876 - DNA, 22 bp, Homo sapiens
aggaggcagtctgtcccttagc

SEQ ID NO: 7383877 - DNA, 22 bp, Homo sapiens
aggaggccaggccctcaagcct

SEQ ID NO: 7383878 - DNA, 21 bp, Homo sapiens
aggaggccagtactgctgaac

SEQ ID NO: 7383879 - DNA, 22 bp, Homo sapiens
aggaggccaggccctcaagcct

SEQ ID NO: 7383880 - DNA, 22 bp, Homo sapiens
acagtgacgtttatttgagacg

SEQ ID NO: 7383881 - DNA, 22 bp, Homo sapiens
aggaggcaggaagtctatggga

SEQ ID NO: 7383882 - DNA, 22 bp, Homo sapiens
acagtgaatccaaattcctacc

SEQ ID NO: 7383883 - DNA, 22 bp, Homo sapiens
aggacttagaacattatgtact

SEQ ID NO: 7383884 - DNA, 22 bp, Homo sapiens
acaggacaaggggaagaagata

SEQ ID NO: 7383885 - DNA, 22 bp, Homo sapiens
acaggacaactcagcagccagc

SEQ ID NO: 7383886 - DNA, 22 bp, Homo sapiens
acaggaagaaagtgcagtagat

SEQ ID NO: 7383887 - DNA, 22 bp, Homo sapiens
acagcatttaaagaaaatgaac

SEQ ID NO: 7383888 - DNA, 22 bp, Homo sapiens
acagccaacgtctttcttactt

SEQ ID NO: 7383889 - DNA, 22 bp, Homo sapiens
acagcagtgtctggtactgagt

SEQ ID NO: 7383890 - DNA, 22 bp, Homo sapiens
acagcagttaacgatcagactc

SEQ ID NO: 7383891 - DNA, 22 bp, Homo sapiens
acagcagttaacgatcagactc

SEQ ID NO: 7383892 - DNA, 22 bp, Homo sapiens
acagcagtttagaggacagcca

SEQ ID NO: 7383893 - DNA, 22 bp, Homo sapiens
acaggcaagtacacaggctcat

SEQ ID NO: 7383894 - DNA, 22 bp, Homo sapiens
acaggcaagaggaaagcaagta

SEQ ID NO: 7383895 - DNA, 22 bp, Homo sapiens
acaggatgggcgcacagagcta

SEQ ID NO: 7383896 - DNA, 22 bp, Homo sapiens
acaggatggccagctgatattg

SEQ ID NO: 7383897 - DNA, 20 bp, Homo sapiens
acaggatgcctgccatttca

SEQ ID NO: 7383898 - DNA, 22 bp, Homo sapiens
acaggatgagaatatcatattt

SEQ ID NO: 7383899 - DNA, 22 bp, Homo sapiens
agcttcttttacagctcatgct

SEQ ID NO: 7383900 - DNA, 22 bp, Homo sapiens
agcttcttgtagaactcaaaag

SEQ ID NO: 7383901 - DNA, 22 bp, Homo sapiens
acaggactgtgatccagtaacc

SEQ ID NO: 7383902 - DNA, 22 bp, Homo sapiens
agcttcttcccagcctcacccg

SEQ ID NO: 7383903 - DNA, 22 bp, Homo sapiens
agcttcttccaggcagtgactc

SEQ ID NO: 7383904 - DNA, 22 bp, Homo sapiens
aggaaaggtagcgtgccagcag

SEQ ID NO: 7383905 - DNA, 19 bp, Homo sapiens
aggaaaggtggccttagca

SEQ ID NO: 7383906 - DNA, 22 bp, Homo sapiens
acagggcatgtgcaagagacat

SEQ ID NO: 7383907 - DNA, 19 bp, Homo sapiens
acagggcagcaataggata

SEQ ID NO: 7383908 - DNA, 22 bp, Homo sapiens
aggacatgaagaaagggcaagg

SEQ ID NO: 7383909 - DNA, 22 bp, Homo sapiens
aggactggcggtcggtggggat

SEQ ID NO: 7383910 - DNA, 22 bp, Homo sapiens
aggactggccctgaggggaggc

SEQ ID NO: 7383911 - DNA, 22 bp, Homo sapiens
aggactggcagtgtgaggggtc

SEQ ID NO: 7383912 - DNA, 22 bp, Homo sapiens
aggactggcagtgtgaggggtc

SEQ ID NO: 7383913 - DNA, 22 bp, Homo sapiens
aggactggtgtgtgatcagcat

SEQ ID NO: 7383914 - DNA, 22 bp, Homo sapiens
aggactggtgccagacaaggta

SEQ ID NO: 7383915 - DNA, 22 bp, Homo sapiens
aggactgggtgcagagggcatc

SEQ ID NO: 7383916 - DNA, 22 bp, Homo sapiens
aggactgggtgcagagggcatc

SEQ ID NO: 7383917 - DNA, 22 bp, Homo sapiens
acagggcctcagccagggcaga

SEQ ID NO: 7383918 - DNA, 22 bp, Homo sapiens
acagggccctgtgggccccact

SEQ ID NO: 7383919 - DNA, 22 bp, Homo sapiens
acagggccttatatccagaagg

SEQ ID NO: 7383920 - DNA, 22 bp, Homo sapiens
aggacaggattgagctgaactg

SEQ ID NO: 7383921 - DNA, 22 bp, Homo sapiens
cagctgtccttcctggtgggcg

SEQ ID NO: 7383922 - DNA, 22 bp, Homo sapiens
caggaccccatattcactgaac

SEQ ID NO: 7383923 - DNA, 22 bp, Homo sapiens
caggacctaactcacctgtctc

SEQ ID NO: 7383924 - DNA, 22 bp, Homo sapiens
caggatggtctcgatctcctga

SEQ ID NO: 7383925 - DNA, 22 bp, Homo sapiens
caggatgggatgtagtgggccc

SEQ ID NO: 7383926 - DNA, 22 bp, Homo sapiens
caggatgggatgtagtgggccc

SEQ ID NO: 7383927 - DNA, 22 bp, Homo sapiens
caggatgggtgtcggccagcac

SEQ ID NO: 7383928 - DNA, 22 bp, Homo sapiens
caggatgggtgtcggccagcac

SEQ ID NO: 7383929 - DNA, 22 bp, Homo sapiens
caggcacacaggctccctgggc

SEQ ID NO: 7383930 - DNA, 22 bp, Homo sapiens
caggcacacagggaatttggct

SEQ ID NO: 7383931 - DNA, 22 bp, Homo sapiens
caggcacacccactggtgcaga

SEQ ID NO: 7383932 - DNA, 22 bp, Homo sapiens
caggagtgaaatgaggcccagg

SEQ ID NO: 7383933 - DNA, 22 bp, Homo sapiens
caggagcccagagtcctcagct

SEQ ID NO: 7383934 - DNA, 22 bp, Homo sapiens
caggagtgaaatgaggcccagg

SEQ ID NO: 7383935 - DNA, 22 bp, Homo sapiens
caggagcccagagtcctcagct

SEQ ID NO: 7383936 - DNA, 22 bp, Homo sapiens
caggagccagctgtcccaacca

SEQ ID NO: 7383937 - DNA, 22 bp, Homo sapiens
caggatggccccggggctgtgc

SEQ ID NO: 7383938 - DNA, 22 bp, Homo sapiens
caggatggagggagggctgtta

SEQ ID NO: 7383939 - DNA, 18 bp, Homo sapiens
caggagcaggagttgaac

SEQ ID NO: 7383940 - DNA, 22 bp, Homo sapiens
caggagccagaggcggatggag

SEQ ID NO: 7383941 - DNA, 22 bp, Homo sapiens
caggagccacattccaccttga

SEQ ID NO: 7383942 - DNA, 22 bp, Homo sapiens
caggagcaggcccaaggacaca

SEQ ID NO: 7383943 - DNA, 22 bp, Homo sapiens
caggcccatgagggcagccaca

SEQ ID NO: 7383944 - DNA, 22 bp, Homo sapiens
caggcccatctgctcccaggct

SEQ ID NO: 7383945 - DNA, 22 bp, Homo sapiens
caggcccattctaggcttgcta

SEQ ID NO: 7383946 - DNA, 22 bp, Homo sapiens
agcttagaagtgtgctgagagg

SEQ ID NO: 7383947 - DNA, 22 bp, Homo sapiens
caggcccagggttattgggaaa

SEQ ID NO: 7383948 - DNA, 22 bp, Homo sapiens
caggcccaggggtctggcccac

SEQ ID NO: 7383949 - DNA, 22 bp, Homo sapiens
caggcccaggtgtcgatgttcc

SEQ ID NO: 7383950 - DNA, 22 bp, Homo sapiens
agctgtctttggagagggagag

SEQ ID NO: 7383951 - DNA, 22 bp, Homo sapiens
caggcccagtgatcagggctct

SEQ ID NO: 7383952 - DNA, 22 bp, Homo sapiens
agcttccttggcgctgaggcct

SEQ ID NO: 7383953 - DNA, 22 bp, Homo sapiens
caggctctgctgctacagctgt

SEQ ID NO: 7383954 - DNA, 21 bp, Homo sapiens
agcttcctgcagtgggaggtc

SEQ ID NO: 7383955 - DNA, 21 bp, Homo sapiens
agcttcctgcagtgggaggtc

SEQ ID NO: 7383956 - DNA, 22 bp, Homo sapiens
agcttcctgttgagagagggag

SEQ ID NO: 7383957 - DNA, 23 bp, Homo sapiens
agcttcctagtgacctggagtct

SEQ ID NO: 7383958 - DNA, 22 bp, Homo sapiens
caggcagcgctcgtggcctggc

SEQ ID NO: 7383959 - DNA, 22 bp, Homo sapiens
caggcagctagatttataacaa

SEQ ID NO: 7383960 - DNA, 22 bp, Homo sapiens
caggcagcgtcctgcttcctgt

SEQ ID NO: 7383961 - DNA, 22 bp, Homo sapiens
caggcagcctgcggtctgcaca

SEQ ID NO: 7383962 - DNA, 22 bp, Homo sapiens
caggcagccttctcgtctcaca

SEQ ID NO: 7383963 - DNA, 22 bp, Homo sapiens
caggcagggagctggaaaggat

SEQ ID NO: 7383964 - DNA, 22 bp, Homo sapiens
caggcagggagctggaaaggat

SEQ ID NO: 7383965 - DNA, 22 bp, Homo sapiens
caggcaggtcagtgaagaagga

SEQ ID NO: 7383966 - DNA, 22 bp, Homo sapiens
caggcagctcaaccttgggagc

SEQ ID NO: 7383967 - DNA, 22 bp, Homo sapiens
agctgtagggtattatcatttt

SEQ ID NO: 7383968 - DNA, 22 bp, Homo sapiens
agctgtctctggtattatgtga

SEQ ID NO: 7383969 - DNA, 22 bp, Homo sapiens
agctgtcagtgctgtgcctgta

SEQ ID NO: 7383970 - DNA, 22 bp, Homo sapiens
agctgtcctgtgggagggagtg

SEQ ID NO: 7383971 - DNA, 22 bp, Homo sapiens
agctggtggaagggagcccaaa

SEQ ID NO: 7383972 - DNA, 22 bp, Homo sapiens
caggcagtgtcccaggaagcca

SEQ ID NO: 7383973 - DNA, 22 bp, Homo sapiens
caggcaggtcagtgaagaagga

SEQ ID NO: 7383974 - DNA, 22 bp, Homo sapiens
caggcaggtcagtgaagaagga

SEQ ID NO: 7383975 - DNA, 21 bp, Homo sapiens
aggaaaggaagtccccagggt

SEQ ID NO: 7383976 - DNA, 19 bp, Homo sapiens
aggaaaggatcaaaatagc

SEQ ID NO: 7383977 - DNA, 19 bp, Homo sapiens
aggaaaggatcaaaatagc

SEQ ID NO: 7383978 - DNA, 22 bp, Homo sapiens
aggaaaggcctttgcatttggt

SEQ ID NO: 7383979 - DNA, 22 bp, Homo sapiens
aggaaaggcctcagcagaaacc

SEQ ID NO: 7383980 - DNA, 22 bp, Homo sapiens
aggaaaggcctttgcatttggt

SEQ ID NO: 7383981 - DNA, 22 bp, Homo sapiens
aggaagaaaactaattagatgg

SEQ ID NO: 7383982 - DNA, 22 bp, Homo sapiens
aggaaaggcctcagcagaaacc

SEQ ID NO: 7383983 - DNA, 21 bp, Homo sapiens
aggaaaggccagcacgtaggg

SEQ ID NO: 7383984 - DNA, 22 bp, Homo sapiens
aggaaaggattggcttctctgt

SEQ ID NO: 7383985 - DNA, 23 bp, Homo sapiens
aggaagaggcaatttctcttaga

SEQ ID NO: 7383986 - DNA, 22 bp, Homo sapiens
aggaagagctggaccagaggac

SEQ ID NO: 7383987 - DNA, 22 bp, Homo sapiens
aggaagagctggaccagaggac

SEQ ID NO: 7383988 - DNA, 22 bp, Homo sapiens
aggaagagggtggcagataatc

SEQ ID NO: 7383989 - DNA, 22 bp, Homo sapiens
aggaagagcattcacatggtag

SEQ ID NO: 7383990 - DNA, 22 bp, Homo sapiens
aggaagagcccgggtgacataa

SEQ ID NO: 7383991 - DNA, 22 bp, Homo sapiens
aggaagagcccgggtgacataa

SEQ ID NO: 7383992 - DNA, 22 bp, Homo sapiens
aggaagagctggaccagaggac

SEQ ID NO: 7383993 - DNA, 22 bp, Homo sapiens
aggaagagctggaccagaggac

SEQ ID NO: 7383994 - DNA, 20 bp, Homo sapiens
cagggctctgggcctggcct

SEQ ID NO: 7383995 - DNA, 22 bp, Homo sapiens
agctttgaaaatccaaattaca

SEQ ID NO: 7383996 - DNA, 22 bp, Homo sapiens
agctttcttctagttgtacagt

SEQ ID NO: 7383997 - DNA, 22 bp, Homo sapiens
agctttgcttctgggagccaag

SEQ ID NO: 7383998 - DNA, 22 bp, Homo sapiens
agctttgcacaacagagaggtg

SEQ ID NO: 7383999 - DNA, 22 bp, Homo sapiens
agctttgcaacctgaggccagt

SEQ ID NO: 7384000 - DNA, 22 bp, Homo sapiens
agctttgcactgagacagctca

SEQ ID NO: 7384001 - DNA, 23 bp, Homo sapiens
agctttgaggactttaaaagata

SEQ ID NO: 7384002 - DNA, 22 bp, Homo sapiens
agctttgatagtacaggggctt

SEQ ID NO: 7384003 - DNA, 22 bp, Homo sapiens
cagggcaggatgctgtgattat

SEQ ID NO: 7384004 - DNA, 22 bp, Homo sapiens
cagggcagggatgttgcggcag

SEQ ID NO: 7384005 - DNA, 22 bp, Homo sapiens
cagggcagtaacgggaacatct

SEQ ID NO: 7384006 - DNA, 22 bp, Homo sapiens
aggaagtgctaagagaacatca

SEQ ID NO: 7384007 - DNA, 22 bp, Homo sapiens
aggaagtgcagggggaagtact

SEQ ID NO: 7384008 - DNA, 22 bp, Homo sapiens
aggaagtggggttctctcactg

SEQ ID NO: 7384009 - DNA, 22 bp, Homo sapiens
aggaatattactttgcttttat

SEQ ID NO: 7384010 - DNA, 22 bp, Homo sapiens
aggacagagccctagtttcata

SEQ ID NO: 7384011 - DNA, 22 bp, Homo sapiens
aggacagagcctgtgcagaccg

SEQ ID NO: 7384012 - DNA, 22 bp, Homo sapiens
aggacagacctaggactggagc

SEQ ID NO: 7384013 - DNA, 22 bp, Homo sapiens
cagtatttgttacagcattagc

SEQ ID NO: 7384014 - DNA, 22 bp, Homo sapiens
cagtaaggatgcacataactag

SEQ ID NO: 7384015 - DNA, 22 bp, Homo sapiens
cagtaaatgcagatatagatac

SEQ ID NO: 7384016 - DNA, 22 bp, Homo sapiens
aggcaggaggatcatggatgca

SEQ ID NO: 7384017 - DNA, 17 bp, Homo sapiens
aggcaggagattggaga

SEQ ID NO: 7384018 - DNA, 22 bp, Homo sapiens
catttctgttctcttcctgtac

SEQ ID NO: 7384019 - DNA, 22 bp, Homo sapiens
ccaatgaaaggtcaattctata

SEQ ID NO: 7384020 - DNA, 22 bp, Homo sapiens
ccaatgagaggtatcagatcct

SEQ ID NO: 7384021 - DNA, 22 bp, Homo sapiens
ccaatgagacagaaagagcctc

SEQ ID NO: 7384022 - DNA, 22 bp, Homo sapiens
catttctgtcacgttcttttat

SEQ ID NO: 7384023 - DNA, 23 bp, Homo sapiens
catttctgggagatttataaaat

SEQ ID NO: 7384024 - DNA, 22 bp, Homo sapiens
ccactactttgtttttggtgct

SEQ ID NO: 7384025 - DNA, 21 bp, Homo sapiens
ccaccaggtcttctgctcggg

SEQ ID NO: 7384026 - DNA, 22 bp, Homo sapiens
ccaccatgggaagagagactaa

SEQ ID NO: 7384027 - DNA, 22 bp, Homo sapiens
ccacagtttcttcatctataaa

SEQ ID NO: 7384028 - DNA, 23 bp, Homo sapiens
ccacagttcatcgttcactcacc

SEQ ID NO: 7384029 - DNA, 22 bp, Homo sapiens
cattgctttgtgcatatttaaa

SEQ ID NO: 7384030 - DNA, 22 bp, Homo sapiens
aggcaagaacagacatgggagt

SEQ ID NO: 7384031 - DNA, 22 bp, Homo sapiens
aggcaagaacagacatgggagt

SEQ ID NO: 7384032 - DNA, 22 bp, Homo sapiens
aggcaagaacagacatgggagt

SEQ ID NO: 7384033 - DNA, 22 bp, Homo sapiens
aggcaagaccagaaagggctga

SEQ ID NO: 7384034 - DNA, 22 bp, Homo sapiens
aggcaacttgaccaggctttct

SEQ ID NO: 7384035 - DNA, 20 bp, Homo sapiens
aggcaactcaagtttttgcc

SEQ ID NO: 7384036 - DNA, 22 bp, Homo sapiens
aggcaactctgaccttatgaag

SEQ ID NO: 7384037 - DNA, 22 bp, Homo sapiens
aggcaagcttgaaattggctct

SEQ ID NO: 7384038 - DNA, 23 bp, Homo sapiens
aggcaagggtgtaaaggaaatga

SEQ ID NO: 7384039 - DNA, 22 bp, Homo sapiens
aggcaagcaccgggggcctttt

SEQ ID NO: 7384040 - DNA, 22 bp, Homo sapiens
aggcaagcccaggcacttggag

SEQ ID NO: 7384041 - DNA, 22 bp, Homo sapiens
catttcaaacagttacagctgc

SEQ ID NO: 7384042 - DNA, 22 bp, Homo sapiens
catttattggttaggccagcag

SEQ ID NO: 7384043 - DNA, 22 bp, Homo sapiens
catttattggttaggccagcag

SEQ ID NO: 7384044 - DNA, 22 bp, Homo sapiens
catttctccgccgagatcactg

SEQ ID NO: 7384045 - DNA, 22 bp, Homo sapiens
catttctcataatattagcact

SEQ ID NO: 7384046 - DNA, 22 bp, Homo sapiens
catttctcctgggtgataaatt

SEQ ID NO: 7384047 - DNA, 22 bp, Homo sapiens
catttctcctgggtgataaatt

SEQ ID NO: 7384048 - DNA, 22 bp, Homo sapiens
catttcaatgccttcaacatag

SEQ ID NO: 7384049 - DNA, 20 bp, Homo sapiens
aggcactgttgtctgtatcc

SEQ ID NO: 7384050 - DNA, 20 bp, Homo sapiens
aggcactgttgtctgtatcc

SEQ ID NO: 7384051 - DNA, 21 bp, Homo sapiens
aggcactgtttgtggtttggg

SEQ ID NO: 7384052 - DNA, 22 bp, Homo sapiens
aggcactgtgggtgtggccgga

SEQ ID NO: 7384053 - DNA, 22 bp, Homo sapiens
aggcactgttcccagttatcct

SEQ ID NO: 7384054 - DNA, 22 bp, Homo sapiens
aggcactgttcccagttatcct

SEQ ID NO: 7384055 - DNA, 22 bp, Homo sapiens
cattggccttttatcctagagg

SEQ ID NO: 7384056 - DNA, 22 bp, Homo sapiens
cattggcacaagtagcttcatc

SEQ ID NO: 7384057 - DNA, 22 bp, Homo sapiens
catttactgtaaaagattctct

SEQ ID NO: 7384058 - DNA, 22 bp, Homo sapiens
catttactgtaaaagattctct

SEQ ID NO: 7384059 - DNA, 22 bp, Homo sapiens
catttacttaaatctttacaag

SEQ ID NO: 7384060 - DNA, 22 bp, Homo sapiens
cagtgttccctgaacatatgtt

SEQ ID NO: 7384061 - DNA, 22 bp, Homo sapiens
cagtgtgtggatcctcccagga

SEQ ID NO: 7384062 - DNA, 22 bp, Homo sapiens
aggagccaggccccatggggct

SEQ ID NO: 7384063 - DNA, 22 bp, Homo sapiens
aggagccaggccccatggggct

SEQ ID NO: 7384064 - DNA, 22 bp, Homo sapiens
aggagccaggaaacctgctctg

SEQ ID NO: 7384065 - DNA, 22 bp, Homo sapiens
aggagccagaatccagactcgg

SEQ ID NO: 7384066 - DNA, 22 bp, Homo sapiens
aggagccagcgttcctcaggat

SEQ ID NO: 7384067 - DNA, 21 bp, Homo sapiens
cagtattttaagcagtgagtt

SEQ ID NO: 7384068 - DNA, 22 bp, Homo sapiens
cagtccagccccctgctaaaag

SEQ ID NO: 7384069 - DNA, 22 bp, Homo sapiens
cagtccagccccctgctaaaag

SEQ ID NO: 7384070 - DNA, 22 bp, Homo sapiens
cagtccaggcctggaggagcca

SEQ ID NO: 7384071 - DNA, 22 bp, Homo sapiens
cagtccagtccaatcctcaatg

SEQ ID NO: 7384072 - DNA, 20 bp, Homo sapiens
cagtccaggctagaaaacaa

SEQ ID NO: 7384073 - DNA, 22 bp, Homo sapiens
cataacattaagcctctatttc

SEQ ID NO: 7384074 - DNA, 22 bp, Homo sapiens
cataacatgtacatataaatgc

SEQ ID NO: 7384075 - DNA, 22 bp, Homo sapiens
cataacatgtacatataaatgc

SEQ ID NO: 7384076 - DNA, 22 bp, Homo sapiens
aggagccatgagcaggaggcaa

SEQ ID NO: 7384077 - DNA, 22 bp, Homo sapiens
cataatatactacattgatgaa

SEQ ID NO: 7384078 - DNA, 17 bp, Homo sapiens
aggagctgggggtggtg

SEQ ID NO: 7384079 - DNA, 22 bp, Homo sapiens
cataagaatatttagtggcagc

SEQ ID NO: 7384080 - DNA, 22 bp, Homo sapiens
cataagaatcttccagggcatg

SEQ ID NO: 7384081 - DNA, 22 bp, Homo sapiens
cataagaatatttagtggcagc

SEQ ID NO: 7384082 - DNA, 22 bp, Homo sapiens
cataagaaataatgatgatgac

SEQ ID NO: 7384083 - DNA, 22 bp, Homo sapiens
aggaggccgggattctggagat

SEQ ID NO: 7384084 - DNA, 22 bp, Homo sapiens
aggaggcctctatccagagaga

SEQ ID NO: 7384085 - DNA, 22 bp, Homo sapiens
aggaggcagatgcttggctgta

SEQ ID NO: 7384086 - DNA, 22 bp, Homo sapiens
aggagctgtgaatgggaggggt

SEQ ID NO: 7384087 - DNA, 22 bp, Homo sapiens
aggagctgtgaatgggaggggt

SEQ ID NO: 7384088 - DNA, 22 bp, Homo sapiens
aggagctgggttcctttggtgg

SEQ ID NO: 7384089 - DNA, 22 bp, Homo sapiens
aggagctggtagtctcattggg

SEQ ID NO: 7384090 - DNA, 22 bp, Homo sapiens
aggaggcctgcagctgccattc

SEQ ID NO: 7384091 - DNA, 22 bp, Homo sapiens
aggaggcctgttttctcctgga

SEQ ID NO: 7384092 - DNA, 22 bp, Homo sapiens
aggaggcctgtgtttgtctgta

SEQ ID NO: 7384093 - DNA, 22 bp, Homo sapiens
catacaaatgtgtccaggctct

SEQ ID NO: 7384094 - DNA, 22 bp, Homo sapiens
catacagtgtggcatgtagtct

SEQ ID NO: 7384095 - DNA, 22 bp, Homo sapiens
catacagttttccctagatgtg

SEQ ID NO: 7384096 - DNA, 22 bp, Homo sapiens
catcttcaccagagacaagcaa

SEQ ID NO: 7384097 - DNA, 22 bp, Homo sapiens
catcttcaggggctacatctgt

SEQ ID NO: 7384098 - DNA, 23 bp, Homo sapiens
aggatgtaggatgtatggcagag

SEQ ID NO: 7384099 - DNA, 22 bp, Homo sapiens
aggatgagagatacatggagca

SEQ ID NO: 7384100 - DNA, 22 bp, Homo sapiens
catcttcaggttcatggtcata

SEQ ID NO: 7384101 - DNA, 19 bp, Homo sapiens
catgagctgctcacttccc

SEQ ID NO: 7384102 - DNA, 19 bp, Homo sapiens
catgaggcagctgcacccc

SEQ ID NO: 7384103 - DNA, 22 bp, Homo sapiens
catgagataatttttctccagt

SEQ ID NO: 7384104 - DNA, 23 bp, Homo sapiens
aggatgtaggatgtatggcagag

SEQ ID NO: 7384105 - DNA, 22 bp, Homo sapiens
aggcaggtagaaggatctttat

SEQ ID NO: 7384106 - DNA, 21 bp, Homo sapiens
ccactcatgactccactcacc

SEQ ID NO: 7384107 - DNA, 22 bp, Homo sapiens
aggcaggtcccctggaaggcac

SEQ ID NO: 7384108 - DNA, 22 bp, Homo sapiens
aggcaggtgagtcaaaacagac

SEQ ID NO: 7384109 - DNA, 22 bp, Homo sapiens
aggcaggtcccctggaaggcac

SEQ ID NO: 7384110 - DNA, 22 bp, Homo sapiens
aggcaggtcccctggaaggcac

SEQ ID NO: 7384111 - DNA, 19 bp, Homo sapiens
ccagaggcagcttctgtaa

SEQ ID NO: 7384112 - DNA, 22 bp, Homo sapiens
ccagaggcagacttacactcca

SEQ ID NO: 7384113 - DNA, 22 bp, Homo sapiens
ccagaggcatgttcaaagcaat

SEQ ID NO: 7384114 - DNA, 22 bp, Homo sapiens
ccagaggcatgttcaaagcaat

SEQ ID NO: 7384115 - DNA, 19 bp, Homo sapiens
aggcaggtgcagaggtccc

SEQ ID NO: 7384116 - DNA, 22 bp, Homo sapiens
ccagaggatgctggtcagcctc

SEQ ID NO: 7384117 - DNA, 20 bp, Homo sapiens
ccagaggctgacagactttg

SEQ ID NO: 7384118 - DNA, 22 bp, Homo sapiens
ccagaggctggcaagggctcct

SEQ ID NO: 7384119 - DNA, 18 bp, Homo sapiens
ccagaggcccgggcaggc

SEQ ID NO: 7384120 - DNA, 16 bp, Homo sapiens
ccagaggcctggcctc

SEQ ID NO: 7384121 - DNA, 22 bp, Homo sapiens
ccagaggcggaggtttgcagtg

SEQ ID NO: 7384122 - DNA, 21 bp, Homo sapiens
ccagaggcctctcttggccac

SEQ ID NO: 7384123 - DNA, 22 bp, Homo sapiens
ccagaggtggtgggtgctacag

SEQ ID NO: 7384124 - DNA, 22 bp, Homo sapiens
ccagccctcggtagtcccatag

SEQ ID NO: 7384125 - DNA, 22 bp, Homo sapiens
ccagccctcggtagtcccatag

SEQ ID NO: 7384126 - DNA, 23 bp, Homo sapiens
aggccctgcctgtccctcttttt

SEQ ID NO: 7384127 - DNA, 22 bp, Homo sapiens
aggccctgctgaggcctccctc

SEQ ID NO: 7384128 - DNA, 22 bp, Homo sapiens
aggccctgcggaaatgatcatt

SEQ ID NO: 7384129 - DNA, 22 bp, Homo sapiens
aggccctgcccagtgccacaag

SEQ ID NO: 7384130 - DNA, 18 bp, Homo sapiens
ccagccctgcagcacctg

SEQ ID NO: 7384131 - DNA, 22 bp, Homo sapiens
ccagccctgattagagaatgtc

SEQ ID NO: 7384132 - DNA, 22 bp, Homo sapiens
aggccctgacctgggagatcta

SEQ ID NO: 7384133 - DNA, 22 bp, Homo sapiens
aggccctgacctgggagatcta

SEQ ID NO: 7384134 - DNA, 22 bp, Homo sapiens
ccagccagctggttggacgcct

SEQ ID NO: 7384135 - DNA, 22 bp, Homo sapiens
aggcctggtgtgccggatgcag

SEQ ID NO: 7384136 - DNA, 22 bp, Homo sapiens
aggcctgggcaagaaggggcgt

SEQ ID NO: 7384137 - DNA, 22 bp, Homo sapiens
ccaggcacaggtgggcctcaga

SEQ ID NO: 7384138 - DNA, 22 bp, Homo sapiens
ccaggcactgctcgaggtgcta

SEQ ID NO: 7384139 - DNA, 22 bp, Homo sapiens
aggccctggacactcaagccgg

SEQ ID NO: 7384140 - DNA, 22 bp, Homo sapiens
aggccctggacactcaagccgg

SEQ ID NO: 7384141 - DNA, 22 bp, Homo sapiens
aggccctgctgaggcctccctc

SEQ ID NO: 7384142 - DNA, 22 bp, Homo sapiens
aggccctgctttccagagctca

SEQ ID NO: 7384143 - DNA, 21 bp, Homo sapiens
aggccctggaggtcagagaaa

SEQ ID NO: 7384144 - DNA, 21 bp, Homo sapiens
aggccctggaggtcagagaaa

SEQ ID NO: 7384145 - DNA, 22 bp, Homo sapiens
ccaggaggtggagattgcagtg

SEQ ID NO: 7384146 - DNA, 22 bp, Homo sapiens
ccaggaggtggaggttgcggtg

SEQ ID NO: 7384147 - DNA, 22 bp, Homo sapiens
ccaggaggtggagattgcagtg

SEQ ID NO: 7384148 - DNA, 22 bp, Homo sapiens
ccaggaggtgctggaagaaagc

SEQ ID NO: 7384149 - DNA, 22 bp, Homo sapiens
ccaggaggtggcaggacttgcc

SEQ ID NO: 7384150 - DNA, 22 bp, Homo sapiens
ccaggaggggtctctgtctccc

SEQ ID NO: 7384151 - DNA, 22 bp, Homo sapiens
ccaggaggatgaggggcataga

SEQ ID NO: 7384152 - DNA, 22 bp, Homo sapiens
ccaggaggatgaggggcataga

SEQ ID NO: 7384153 - DNA, 22 bp, Homo sapiens
ccaggaggtgaaacttcaccag

SEQ ID NO: 7384154 - DNA, 22 bp, Homo sapiens
ccaggaggtctgagtgtggaca

SEQ ID NO: 7384155 - DNA, 22 bp, Homo sapiens
ccaggagggtggttactcaatc

SEQ ID NO: 7384156 - DNA, 22 bp, Homo sapiens
ccaggaggtctgagtgtggaca

SEQ ID NO: 7384157 - DNA, 22 bp, Homo sapiens
aggctctggttcatcatgatgg

SEQ ID NO: 7384158 - DNA, 22 bp, Homo sapiens
aggctcagattcacatttggtt

SEQ ID NO: 7384159 - DNA, 22 bp, Homo sapiens
ccaggcgtggcttcagcagccc

SEQ ID NO: 7384160 - DNA, 20 bp, Homo sapiens
ccaggcctgggcctgctcta

SEQ ID NO: 7384161 - DNA, 20 bp, Homo sapiens
ccaggcctgggcctgctcta

SEQ ID NO: 7384162 - DNA, 22 bp, Homo sapiens
ccaggttcaaatagctgtgtga

SEQ ID NO: 7384163 - DNA, 22 bp, Homo sapiens
ccagggcagaaaaagagggaat

SEQ ID NO: 7384164 - DNA, 22 bp, Homo sapiens
ccagggcagcagaattggggca

SEQ ID NO: 7384165 - DNA, 22 bp, Homo sapiens
ccagggcagaaaaagagggaat

SEQ ID NO: 7384166 - DNA, 22 bp, Homo sapiens
ccagggcagcagaattggggca

SEQ ID NO: 7384167 - DNA, 22 bp, Homo sapiens
aggctgcagcttgtctcgtggg

SEQ ID NO: 7384168 - DNA, 22 bp, Homo sapiens
aggctgccctgccgccagtggg

SEQ ID NO: 7384169 - DNA, 22 bp, Homo sapiens
aggctgccctgccgccagtggg

SEQ ID NO: 7384170 - DNA, 22 bp, Homo sapiens
cccacacacatttatgatagga

SEQ ID NO: 7384171 - DNA, 22 bp, Homo sapiens
cccacacatttttcacttaccg

SEQ ID NO: 7384172 - DNA, 22 bp, Homo sapiens
cccacacatttttcacttaccg

SEQ ID NO: 7384173 - DNA, 22 bp, Homo sapiens
ccagtgtattatttgagaaatt

SEQ ID NO: 7384174 - DNA, 22 bp, Homo sapiens
cccaccctgggaagctaggcag

SEQ ID NO: 7384175 - DNA, 22 bp, Homo sapiens
cccacgttgaaccgcttacaga

SEQ ID NO: 7384176 - DNA, 22 bp, Homo sapiens
cccacgtcgaacttgctccaga

SEQ ID NO: 7384177 - DNA, 22 bp, Homo sapiens
ccctgaggatagggcaggaccc

SEQ ID NO: 7384178 - DNA, 21 bp, Homo sapiens
cccctgggagccctgtcagta

SEQ ID NO: 7384179 - DNA, 22 bp, Homo sapiens
cccctgggtccaggcttctctg

SEQ ID NO: 7384180 - DNA, 22 bp, Homo sapiens
agggcagctgtgagccactgtg

SEQ ID NO: 7384181 - DNA, 18 bp, Homo sapiens
ccctgaggctagcatgct

SEQ ID NO: 7384182 - DNA, 22 bp, Homo sapiens
ccctgaggcacaggccacgtat

SEQ ID NO: 7384183 - DNA, 22 bp, Homo sapiens
ccctgaggcaaaggctagagtt

SEQ ID NO: 7384184 - DNA, 22 bp, Homo sapiens
ccctgaggggagtggtgaggtg

SEQ ID NO: 7384185 - DNA, 22 bp, Homo sapiens
ccctgaggctgaggataggtgg

SEQ ID NO: 7384186 - DNA, 22 bp, Homo sapiens
ccctgatagcccctatcatcag

SEQ ID NO: 7384187 - DNA, 23 bp, Homo sapiens
agggcccaagcctggacagcagg

SEQ ID NO: 7384188 - DNA, 20 bp, Homo sapiens
agggcccaggaagagagtta

SEQ ID NO: 7384189 - DNA, 22 bp, Homo sapiens
cccaggtggcagaagctgcagt

SEQ ID NO: 7384190 - DNA, 21 bp, Homo sapiens
agggagctttaggtagaagtt

SEQ ID NO: 7384191 - DNA, 22 bp, Homo sapiens
agggagctttcaggtagcttaa

SEQ ID NO: 7384192 - DNA, 22 bp, Homo sapiens
agggagcttgtgtttcttttag

SEQ ID NO: 7384193 - DNA, 22 bp, Homo sapiens
cccaggtgtttgtggcagaggt

SEQ ID NO: 7384194 - DNA, 22 bp, Homo sapiens
agggcagactaggatggaagtg

SEQ ID NO: 7384195 - DNA, 22 bp, Homo sapiens
agggaaaggtagtgaggtcaca

SEQ ID NO: 7384196 - DNA, 21 bp, Homo sapiens
agggaaaaggctgagtgaggg

SEQ ID NO: 7384197 - DNA, 22 bp, Homo sapiens
aggcttttctccagaatgtact

SEQ ID NO: 7384198 - DNA, 22 bp, Homo sapiens
cccagagtggagggtgcagaat

SEQ ID NO: 7384199 - DNA, 22 bp, Homo sapiens
aggcttggctctcctatgagaa

SEQ ID NO: 7384200 - DNA, 22 bp, Homo sapiens
aggctttcctgtcactcatgct

SEQ ID NO: 7384201 - DNA, 22 bp, Homo sapiens
agggaaaggtagtgaggtcaca

SEQ ID NO: 7384202 - DNA, 22 bp, Homo sapiens
agggaaagtaagcatttcatta

SEQ ID NO: 7384203 - DNA, 22 bp, Homo sapiens
cccaggaacagcacagaacagc

SEQ ID NO: 7384204 - DNA, 22 bp, Homo sapiens
cccaggaagttgagactgcagt

SEQ ID NO: 7384205 - DNA, 22 bp, Homo sapiens
agggaccacatcccctctgtgg

SEQ ID NO: 7384206 - DNA, 22 bp, Homo sapiens
agggaccagcgtgagtctgagg

SEQ ID NO: 7384207 - DNA, 22 bp, Homo sapiens
agggacccatagagagaccagt

SEQ ID NO: 7384208 - DNA, 22 bp, Homo sapiens
agggaccaggggtagctgagat

SEQ ID NO: 7384209 - DNA, 22 bp, Homo sapiens
agggaccaggggtagctgagat

SEQ ID NO: 7384210 - DNA, 22 bp, Homo sapiens
agggactatttacccatctcac

SEQ ID NO: 7384211 - DNA, 22 bp, Homo sapiens
agggagccttcctggctgtggt

SEQ ID NO: 7384212 - DNA, 22 bp, Homo sapiens
agggagctgagctgtgagcagc

SEQ ID NO: 7384213 - DNA, 22 bp, Homo sapiens
agggagctgagagctactattt

SEQ ID NO: 7384214 - DNA, 22 bp, Homo sapiens
cccaggcctggtctgggccagt

SEQ ID NO: 7384215 - DNA, 22 bp, Homo sapiens
cccaggcctggtctgggccagt

SEQ ID NO: 7384216 - DNA, 17 bp, Homo sapiens
cccaggccgccgggagc

SEQ ID NO: 7384217 - DNA, 22 bp, Homo sapiens
cccaggcctggtctgggccagt

SEQ ID NO: 7384218 - DNA, 22 bp, Homo sapiens
agggagctgctctgcttccgtg

SEQ ID NO: 7384219 - DNA, 21 bp, Homo sapiens
agggagctggccacacagcct

SEQ ID NO: 7384220 - DNA, 22 bp, Homo sapiens
agggagctggtatttataatga

SEQ ID NO: 7384221 - DNA, 22 bp, Homo sapiens
agggagctgtggtcagctcagt

SEQ ID NO: 7384222 - DNA, 22 bp, Homo sapiens
agggcccatgtgggagcacttg

SEQ ID NO: 7384223 - DNA, 19 bp, Homo sapiens
ccctggcaggcaagcctgg

SEQ ID NO: 7384224 - DNA, 22 bp, Homo sapiens
ccctggccagggcacagggagg

SEQ ID NO: 7384225 - DNA, 22 bp, Homo sapiens
agggcctggcttcactttctca

SEQ ID NO: 7384226 - DNA, 22 bp, Homo sapiens
agggcctgtgcttcctgagata

SEQ ID NO: 7384227 - DNA, 22 bp, Homo sapiens
agggcctgtgctgagtagacga

SEQ ID NO: 7384228 - DNA, 22 bp, Homo sapiens
cctacagttatattcttgattg

SEQ ID NO: 7384229 - DNA, 22 bp, Homo sapiens
cctcagggtctctcacagcacc

SEQ ID NO: 7384230 - DNA, 18 bp, Homo sapiens
aggggcagcttgtgtgga

SEQ ID NO: 7384231 - DNA, 22 bp, Homo sapiens
cctcctggtccagcatctcttt

SEQ ID NO: 7384232 - DNA, 22 bp, Homo sapiens
aggggaatgggtagactgttga

SEQ ID NO: 7384233 - DNA, 22 bp, Homo sapiens
agggggtgcccagatgaaggat

SEQ ID NO: 7384234 - DNA, 22 bp, Homo sapiens
agggggtgcatttgtgaatgaa

SEQ ID NO: 7384235 - DNA, 22 bp, Homo sapiens
cctctgtgtcctggtcattgaa

SEQ ID NO: 7384236 - DNA, 22 bp, Homo sapiens
cctctgtgtgtgcatgcatgcg

SEQ ID NO: 7384237 - DNA, 22 bp, Homo sapiens
cctcttaattgtactccttcag

SEQ ID NO: 7384238 - DNA, 22 bp, Homo sapiens
aggtttctgcagcatagtggca

SEQ ID NO: 7384239 - DNA, 22 bp, Homo sapiens
aggtttctggatttattatggc

SEQ ID NO: 7384240 - DNA, 22 bp, Homo sapiens
aggtttcttcttaggaatatgt

SEQ ID NO: 7384241 - DNA, 19 bp, Homo sapiens
cgcaggagccgaggtgacc

SEQ ID NO: 7384242 - DNA, 22 bp, Homo sapiens
cctgttcttgtctcattggcta

SEQ ID NO: 7384243 - DNA, 22 bp, Homo sapiens
cgcagctgtccatgtgtggggg

SEQ ID NO: 7384244 - DNA, 18 bp, Homo sapiens
cctgttacacactggggt

SEQ ID NO: 7384245 - DNA, 22 bp, Homo sapiens
cctgttcaagttgcagggctgg

SEQ ID NO: 7384246 - DNA, 22 bp, Homo sapiens
cctgttcaccctccatgcacag

SEQ ID NO: 7384247 - DNA, 19 bp, Homo sapiens
cctgttcttggctgaggct

SEQ ID NO: 7384248 - DNA, 22 bp, Homo sapiens
cctgttctgtggctctcaaagg

SEQ ID NO: 7384249 - DNA, 22 bp, Homo sapiens
cctgttctgttaattaaacttt

SEQ ID NO: 7384250 - DNA, 22 bp, Homo sapiens
cctgttctaatcttggggcaga

SEQ ID NO: 7384251 - DNA, 22 bp, Homo sapiens
cctgttctgtagtgagtttgag

SEQ ID NO: 7384252 - DNA, 22 bp, Homo sapiens
cgggcgcactccgggcagctgt

SEQ ID NO: 7384253 - DNA, 23 bp, Homo sapiens
agtacaataagtataattctttc

SEQ ID NO: 7384254 - DNA, 22 bp, Homo sapiens
cgggcagatcacacagggcttg

SEQ ID NO: 7384255 - DNA, 22 bp, Homo sapiens
cgggcaaggcgagactaggccc

SEQ ID NO: 7384256 - DNA, 22 bp, Homo sapiens
agtacacagtatatggtgagat

SEQ ID NO: 7384257 - DNA, 22 bp, Homo sapiens
agtacacagagttattttgtgt

SEQ ID NO: 7384258 - DNA, 22 bp, Homo sapiens
agtacacacagtagaatagagt

SEQ ID NO: 7384259 - DNA, 22 bp, Homo sapiens
ctaagcaagaatgagtgcaaca

SEQ ID NO: 7384260 - DNA, 22 bp, Homo sapiens
ctaaacttttataacattgaga

SEQ ID NO: 7384261 - DNA, 22 bp, Homo sapiens
ctaagaaatgttgtgaatgcca

SEQ ID NO: 7384262 - DNA, 22 bp, Homo sapiens
ctaaggaatcctaaaacagctg

SEQ ID NO: 7384263 - DNA, 22 bp, Homo sapiens
ctaaggaacagatgtcagcaga

SEQ ID NO: 7384264 - DNA, 22 bp, Homo sapiens
agtatgcatatttcaaagtaag

SEQ ID NO: 7384265 - DNA, 22 bp, Homo sapiens
agtatggggctgtgtgtgcaca

SEQ ID NO: 7384266 - DNA, 22 bp, Homo sapiens
agtatgtagtgcaatcagtcag

SEQ ID NO: 7384267 - DNA, 22 bp, Homo sapiens
agtatgtcagagtgaaaatggt

SEQ ID NO: 7384268 - DNA, 22 bp, Homo sapiens
agtatgtgtccccccaggagcc

SEQ ID NO: 7384269 - DNA, 22 bp, Homo sapiens
agtatttagagacacaagatgg

SEQ ID NO: 7384270 - DNA, 22 bp, Homo sapiens
ctacatttttcaccgagcctct

SEQ ID NO: 7384271 - DNA, 22 bp, Homo sapiens
ctacatttggagagtataggaa

SEQ ID NO: 7384272 - DNA, 22 bp, Homo sapiens
ctacatttgttcaaataagctg

SEQ ID NO: 7384273 - DNA, 22 bp, Homo sapiens
ctacatttcccagctgccttcc

SEQ ID NO: 7384274 - DNA, 22 bp, Homo sapiens
ctacatttgttctatagctttt

SEQ ID NO: 7384275 - DNA, 22 bp, Homo sapiens
ctacatttgttctatagctttt

SEQ ID NO: 7384276 - DNA, 22 bp, Homo sapiens
ctacatttgttcaaataagctg

SEQ ID NO: 7384277 - DNA, 22 bp, Homo sapiens
ctacattttgtgattatgaaat

SEQ ID NO: 7384278 - DNA, 22 bp, Homo sapiens
ctacattttaataagctgctta

SEQ ID NO: 7384279 - DNA, 22 bp, Homo sapiens
agtccagggcttagtcagcggg

SEQ ID NO: 7384280 - DNA, 22 bp, Homo sapiens
agtccaggtggaccttggccag

SEQ ID NO: 7384281 - DNA, 22 bp, Homo sapiens
cctgggcttctgtctagatgtt

SEQ ID NO: 7384282 - DNA, 22 bp, Homo sapiens
cctgggctcaggcttgggcagc

SEQ ID NO: 7384283 - DNA, 22 bp, Homo sapiens
cctgtctccctggcatggctca

SEQ ID NO: 7384284 - DNA, 22 bp, Homo sapiens
cctgtgccaaaatctaggcagt

SEQ ID NO: 7384285 - DNA, 22 bp, Homo sapiens
cctgtgccaaaaggctgcttat

SEQ ID NO: 7384286 - DNA, 22 bp, Homo sapiens
aggtaggatagataggaagacc

SEQ ID NO: 7384287 - DNA, 22 bp, Homo sapiens
aggtaggatagataggaagacc

SEQ ID NO: 7384288 - DNA, 21 bp, Homo sapiens
cctgccaggaaactgagtgtc

SEQ ID NO: 7384289 - DNA, 22 bp, Homo sapiens
cctgccagctgtgggccagcct

SEQ ID NO: 7384290 - DNA, 22 bp, Homo sapiens
cctgccagctgggtaccttcat

SEQ ID NO: 7384291 - DNA, 22 bp, Homo sapiens
aggtagggttaatggagatata

SEQ ID NO: 7384292 - DNA, 22 bp, Homo sapiens
aggtagggaagaaggcatgaaa

SEQ ID NO: 7384293 - DNA, 22 bp, Homo sapiens
cctgccagatcccctgagctga

SEQ ID NO: 7384294 - DNA, 22 bp, Homo sapiens
cctgccagcatggcttatctcc

SEQ ID NO: 7384295 - DNA, 22 bp, Homo sapiens
cctgccagcatcttcagcccct

SEQ ID NO: 7384296 - DNA, 19 bp, Homo sapiens
aggtcattgatagtgcagg

SEQ ID NO: 7384297 - DNA, 22 bp, Homo sapiens
aggtcattaaagttaaatgagg

SEQ ID NO: 7384298 - DNA, 22 bp, Homo sapiens
cctggatagctactggccaggc

SEQ ID NO: 7384299 - DNA, 22 bp, Homo sapiens
cctggctctgcagccactccag

SEQ ID NO: 7384300 - DNA, 19 bp, Homo sapiens
aggtccctgtcacctctca

SEQ ID NO: 7384301 - DNA, 22 bp, Homo sapiens
aggtcccagtctgtgatgactc

SEQ ID NO: 7384302 - DNA, 21 bp, Homo sapiens
aggtcccaggtttgggcagca

SEQ ID NO: 7384303 - DNA, 22 bp, Homo sapiens
aggtccctcagaggcctcaccg

SEQ ID NO: 7384304 - DNA, 22 bp, Homo sapiens
aggtccctcgcacatgcagggt

SEQ ID NO: 7384305 - DNA, 22 bp, Homo sapiens
agttaactctgaaaagacattt

SEQ ID NO: 7384306 - DNA, 22 bp, Homo sapiens
agttagagacacatgcacatgc

SEQ ID NO: 7384307 - DNA, 22 bp, Homo sapiens
ctgagcagatgaccagccccag

SEQ ID NO: 7384308 - DNA, 22 bp, Homo sapiens
ctgaggagaggtggcctgtgtt

SEQ ID NO: 7384309 - DNA, 22 bp, Homo sapiens
agtgtctgcttatcagttcttg

SEQ ID NO: 7384310 - DNA, 22 bp, Homo sapiens
agtgtctgctcagacagctaca

SEQ ID NO: 7384311 - DNA, 23 bp, Homo sapiens
ctgaaattcagatgctaaagata

SEQ ID NO: 7384312 - DNA, 22 bp, Homo sapiens
ctgaaattctgcctctgcacaa

SEQ ID NO: 7384313 - DNA, 22 bp, Homo sapiens
ctgaaattattgtttaatcaaa

SEQ ID NO: 7384314 - DNA, 20 bp, Homo sapiens
agtgtctgggcctcaggccc

SEQ ID NO: 7384315 - DNA, 22 bp, Homo sapiens
ctgaagctttacttcaaataca

SEQ ID NO: 7384316 - DNA, 22 bp, Homo sapiens
ctgaatccattcatgcaagata

SEQ ID NO: 7384317 - DNA, 22 bp, Homo sapiens
ctgacttttttcagccacagtg

SEQ ID NO: 7384318 - DNA, 17 bp, Homo sapiens
ctgaaatattatgataa

SEQ ID NO: 7384319 - DNA, 22 bp, Homo sapiens
ctctttggttaatcacacagat

SEQ ID NO: 7384320 - DNA, 22 bp, Homo sapiens
ctctggcttgttaatgcatatt

SEQ ID NO: 7384321 - DNA, 22 bp, Homo sapiens
ctctggcttgttaatgcatatt

SEQ ID NO: 7384322 - DNA, 22 bp, Homo sapiens
ctctggctttgctcatgcatcc

SEQ ID NO: 7384323 - DNA, 22 bp, Homo sapiens
ctctgcctgtctcatcctgcaa

SEQ ID NO: 7384324 - DNA, 22 bp, Homo sapiens
ctctgcattttaacagatgatt

SEQ ID NO: 7384325 - DNA, 22 bp, Homo sapiens
ctctgccaagatgacaggtaag

SEQ ID NO: 7384326 - DNA, 22 bp, Homo sapiens
ctctgagcccgctgcagcccca

SEQ ID NO: 7384327 - DNA, 22 bp, Homo sapiens
ctctcagggcaggtggcctttc

SEQ ID NO: 7384328 - DNA, 22 bp, Homo sapiens
ctctcaggtagagcccaagaat

SEQ ID NO: 7384329 - DNA, 15 bp, Homo sapiens
ctctcaggcaggcag

SEQ ID NO: 7384330 - DNA, 17 bp, Homo sapiens
ctctgcagtgcatggct

SEQ ID NO: 7384331 - DNA, 22 bp, Homo sapiens
ctctgcaggccttgagtgtggt

SEQ ID NO: 7384332 - DNA, 22 bp, Homo sapiens
ctctgcaggggaggcatgcact

SEQ ID NO: 7384333 - DNA, 22 bp, Homo sapiens
ctctgcaggcacccagggtggg

SEQ ID NO: 7384334 - DNA, 22 bp, Homo sapiens
ctctgcaggcacccagggtggg

SEQ ID NO: 7384335 - DNA, 21 bp, Homo sapiens
ctctgcagccctgcttccagg

SEQ ID NO: 7384336 - DNA, 22 bp, Homo sapiens
ctctcagatggagtgtgaatgg

SEQ ID NO: 7384337 - DNA, 22 bp, Homo sapiens
ctctcagacacccatttggaaa

SEQ ID NO: 7384338 - DNA, 22 bp, Homo sapiens
ctctcagaagtagcacgtgggc

SEQ ID NO: 7384339 - DNA, 22 bp, Homo sapiens
ctcctgggtcattgccagcaaa

SEQ ID NO: 7384340 - DNA, 22 bp, Homo sapiens
agtggcagagctgtgtcttgaa

SEQ ID NO: 7384341 - DNA, 22 bp, Homo sapiens
ctcctgggggacagcggcaggg

SEQ ID NO: 7384342 - DNA, 22 bp, Homo sapiens
ctcctggctttcccagaccagg

SEQ ID NO: 7384343 - DNA, 22 bp, Homo sapiens
ctccagggaaaggggcgtccgc

SEQ ID NO: 7384344 - DNA, 20 bp, Homo sapiens
ctccagggaacagactggag

SEQ ID NO: 7384345 - DNA, 18 bp, Homo sapiens
ctccagggaactcagtca

SEQ ID NO: 7384346 - DNA, 22 bp, Homo sapiens
ctcctgccaccgcggtgtcctg

SEQ ID NO: 7384347 - DNA, 22 bp, Homo sapiens
ctccctctctaaggcaaagaga

SEQ ID NO: 7384348 - DNA, 22 bp, Homo sapiens
agtcttctcatttcacatgctt

SEQ ID NO: 7384349 - DNA, 18 bp, Homo sapiens
agtcttctgatccatttt

SEQ ID NO: 7384350 - DNA, 22 bp, Homo sapiens
agtcttatggttaaatagatgc

SEQ ID NO: 7384351 - DNA, 22 bp, Homo sapiens
agtcttatgtttgtgaagaact

SEQ ID NO: 7384352 - DNA, 22 bp, Homo sapiens
ctccaggctggggtgcaggttg

SEQ ID NO: 7384353 - DNA, 22 bp, Homo sapiens
ctcattagacaggtatacttta

SEQ ID NO: 7384354 - DNA, 22 bp, Homo sapiens
ctcatgtcaggggtgtcaatgt

SEQ ID NO: 7384355 - DNA, 22 bp, Homo sapiens
ctcatgtcttcacccattctaa

SEQ ID NO: 7384356 - DNA, 22 bp, Homo sapiens
ctcatggcagagtcacctgtcc

SEQ ID NO: 7384357 - DNA, 22 bp, Homo sapiens
ctcattgcaacctccgcctccc

SEQ ID NO: 7384358 - DNA, 22 bp, Homo sapiens
ctcattctttcacagtctgtgg

SEQ ID NO: 7384359 - DNA, 22 bp, Homo sapiens
ctcattgcaacctccgcctccc

SEQ ID NO: 7384360 - DNA, 22 bp, Homo sapiens
ctcagtgttggagaccttcagg

SEQ ID NO: 7384361 - DNA, 22 bp, Homo sapiens
ctcatgagactgatgtattaaa

SEQ ID NO: 7384362 - DNA, 18 bp, Homo sapiens
ctcagtgtttgctgaaaa

SEQ ID NO: 7384363 - DNA, 22 bp, Homo sapiens
agtccctgtactttccactgcc

SEQ ID NO: 7384364 - DNA, 22 bp, Homo sapiens
agtcccttgagggagtactgtt

SEQ ID NO: 7384365 - DNA, 22 bp, Homo sapiens
ctgcagagcaagtaacatcctc

SEQ ID NO: 7384366 - DNA, 22 bp, Homo sapiens
ctgcagagagtgccgggcagcc

SEQ ID NO: 7384367 - DNA, 22 bp, Homo sapiens
ctgcagagagtgccgggcagcc

SEQ ID NO: 7384368 - DNA, 22 bp, Homo sapiens
ctgcacacatatggcttctctc

SEQ ID NO: 7384369 - DNA, 22 bp, Homo sapiens
ctgcagagaattgtggggcttc

SEQ ID NO: 7384370 - DNA, 22 bp, Homo sapiens
ctgcagagacctaggtcaggtt

SEQ ID NO: 7384371 - DNA, 22 bp, Homo sapiens
ctgcatcctggaaatagctaag

SEQ ID NO: 7384372 - DNA, 22 bp, Homo sapiens
ctgcattcatatcagatagaag

SEQ ID NO: 7384373 - DNA, 22 bp, Homo sapiens
ctgaggagcaaccccgtgccct

SEQ ID NO: 7384374 - DNA, 22 bp, Homo sapiens
ctgaggagccccctctcagcat

SEQ ID NO: 7384375 - DNA, 22 bp, Homo sapiens
agttatattccatagattcaga

SEQ ID NO: 7384376 - DNA, 22 bp, Homo sapiens
ctgaggagctgaaggccctcca

SEQ ID NO: 7384377 - DNA, 22 bp, Homo sapiens
agttatttactcctttgtctct

SEQ ID NO: 7384378 - DNA, 20 bp, Homo sapiens
ctgcaagcaggttattccag

SEQ ID NO: 7384379 - DNA, 22 bp, Homo sapiens
ctgcaagattggaagatgcaat

SEQ ID NO: 7384380 - DNA, 22 bp, Homo sapiens
agttatttcagtaacataatag

SEQ ID NO: 7384381 - DNA, 22 bp, Homo sapiens
agttatttcagtaacataatag

SEQ ID NO: 7384382 - DNA, 23 bp, Homo sapiens
ctgatccaggaggtctgtcgtga

SEQ ID NO: 7384383 - DNA, 22 bp, Homo sapiens
ataaatggctttcattcctagg

SEQ ID NO: 7384384 - DNA, 22 bp, Homo sapiens
ataaatgtgaaatgagcagtta

SEQ ID NO: 7384385 - DNA, 22 bp, Homo sapiens
ataaatgcctcagaatcatccc

SEQ ID NO: 7384386 - DNA, 22 bp, Homo sapiens
ataaatgattcagcaggaaata

SEQ ID NO: 7384387 - DNA, 22 bp, Homo sapiens
ctgcctctgcgtcccacagagt

SEQ ID NO: 7384388 - DNA, 22 bp, Homo sapiens
ctgcctctccccagagtggccc

SEQ ID NO: 7384389 - DNA, 22 bp, Homo sapiens
ataaatctcttaagactcaaca

SEQ ID NO: 7384390 - DNA, 22 bp, Homo sapiens
ctgcctctcagcctgaccgcca

SEQ ID NO: 7384391 - DNA, 22 bp, Homo sapiens
ctgcctctcaggtccctgagat

SEQ ID NO: 7384392 - DNA, 22 bp, Homo sapiens
ctgcctctccccagagtggccc

SEQ ID NO: 7384393 - DNA, 22 bp, Homo sapiens
ataacagctcttaaacaccata

SEQ ID NO: 7384394 - DNA, 22 bp, Homo sapiens
ataaccatgattaatctaagaa

SEQ ID NO: 7384395 - DNA, 22 bp, Homo sapiens
ataaccttggctagtattgtgc

SEQ ID NO: 7384396 - DNA, 22 bp, Homo sapiens
ataaatgtttgttgaatgaata

SEQ ID NO: 7384397 - DNA, 23 bp, Homo sapiens
ataaattactatctccctagagc

SEQ ID NO: 7384398 - DNA, 22 bp, Homo sapiens
ataaattaggatctggggttcc

SEQ ID NO: 7384399 - DNA, 21 bp, Homo sapiens
ataagcatgctgattacattt

SEQ ID NO: 7384400 - DNA, 22 bp, Homo sapiens
ataagagctacagccagttctg

SEQ ID NO: 7384401 - DNA, 20 bp, Homo sapiens
ataatttaccctgcaccact

SEQ ID NO: 7384402 - DNA, 22 bp, Homo sapiens
ataatttactaagctctacctt

SEQ ID NO: 7384403 - DNA, 22 bp, Homo sapiens
ataatttggcttcctagatgta

SEQ ID NO: 7384404 - DNA, 22 bp, Homo sapiens
atacaaagctaaatatggtttc

SEQ ID NO: 7384405 - DNA, 22 bp, Homo sapiens
atacaaagctttctgtctggta

SEQ ID NO: 7384406 - DNA, 22 bp, Homo sapiens
ataacttcagtttctgtgtcct

SEQ ID NO: 7384407 - DNA, 22 bp, Homo sapiens
ataagaataattaagttagtcc

SEQ ID NO: 7384408 - DNA, 22 bp, Homo sapiens
ataagaaacattattctttcca

SEQ ID NO: 7384409 - DNA, 23 bp, Homo sapiens
ataagaaaacagtaggctcagag

SEQ ID NO: 7384410 - DNA, 22 bp, Homo sapiens
atacaaatttatagatgcattt

SEQ ID NO: 7384411 - DNA, 22 bp, Homo sapiens
atacaaatttatagatgcattt

SEQ ID NO: 7384412 - DNA, 22 bp, Homo sapiens
atacaaattataggccccatcc

SEQ ID NO: 7384413 - DNA, 22 bp, Homo sapiens
atacaactgctctcagataagt

SEQ ID NO: 7384414 - DNA, 22 bp, Homo sapiens
atagcagtaacactgacatttt

SEQ ID NO: 7384415 - DNA, 19 bp, Homo sapiens
atagcagctatacccagat

SEQ ID NO: 7384416 - DNA, 19 bp, Homo sapiens
atagcagctatacccagat

SEQ ID NO: 7384417 - DNA, 22 bp, Homo sapiens
ctggctggccggagcgaggcgg

SEQ ID NO: 7384418 - DNA, 22 bp, Homo sapiens
atagcagcatcagtttatctcc

SEQ ID NO: 7384419 - DNA, 22 bp, Homo sapiens
atagcaaggtatgactggagcc

SEQ ID NO: 7384420 - DNA, 22 bp, Homo sapiens
atagcaaatattttaatgagca

SEQ ID NO: 7384421 - DNA, 22 bp, Homo sapiens
atagcaaattctttaggtgctt

SEQ ID NO: 7384422 - DNA, 22 bp, Homo sapiens
atagcaaagtgcaggggcagca

SEQ ID NO: 7384423 - DNA, 22 bp, Homo sapiens
ctggctcccgaagccctcagtg

SEQ ID NO: 7384424 - DNA, 22 bp, Homo sapiens
ctggctcccagctttcagggag

SEQ ID NO: 7384425 - DNA, 22 bp, Homo sapiens
atagattagccctatagtttta

SEQ ID NO: 7384426 - DNA, 22 bp, Homo sapiens
atagattagccctatagtttta

SEQ ID NO: 7384427 - DNA, 22 bp, Homo sapiens
atagattatttgctcattactt

SEQ ID NO: 7384428 - DNA, 22 bp, Homo sapiens
atactcaaggttaatgattgaa

SEQ ID NO: 7384429 - DNA, 20 bp, Homo sapiens
ctggcccatctaccgctctg

SEQ ID NO: 7384430 - DNA, 20 bp, Homo sapiens
ctggcccatctaccgctctg

SEQ ID NO: 7384431 - DNA, 22 bp, Homo sapiens
ctggcccatggtgagctctggg

SEQ ID NO: 7384432 - DNA, 22 bp, Homo sapiens
ctggcccattgccttctctctc

SEQ ID NO: 7384433 - DNA, 22 bp, Homo sapiens
ctggcccatggtgagctctggg

SEQ ID NO: 7384434 - DNA, 22 bp, Homo sapiens
ctggcccattgccttctctctc

SEQ ID NO: 7384435 - DNA, 22 bp, Homo sapiens
atagcaaaagcatgtgcaatac

SEQ ID NO: 7384436 - DNA, 22 bp, Homo sapiens
atagcaaactggagcttgcttt

SEQ ID NO: 7384437 - DNA, 22 bp, Homo sapiens
atagcaaactggcagcttgtgg

SEQ ID NO: 7384438 - DNA, 22 bp, Homo sapiens
ctggcccagttctgcgttttgc

SEQ ID NO: 7384439 - DNA, 22 bp, Homo sapiens
atagcaaaggacaatagtcagt

SEQ ID NO: 7384440 - DNA, 22 bp, Homo sapiens
atagcaaagcctggcacaatga

SEQ ID NO: 7384441 - DNA, 22 bp, Homo sapiens
atacctatgtgacagtattatt

SEQ ID NO: 7384442 - DNA, 22 bp, Homo sapiens
atacctttaggcattttgcatc

SEQ ID NO: 7384443 - DNA, 22 bp, Homo sapiens
ataccttttactcattatccat

SEQ ID NO: 7384444 - DNA, 22 bp, Homo sapiens
ataccttatttcctggtgacat

SEQ ID NO: 7384445 - DNA, 21 bp, Homo sapiens
atacattctattaagcattta

SEQ ID NO: 7384446 - DNA, 22 bp, Homo sapiens
atacattcatcacttttggtcc

SEQ ID NO: 7384447 - DNA, 22 bp, Homo sapiens
atacattcagcagtgctcatga

SEQ ID NO: 7384448 - DNA, 22 bp, Homo sapiens
atacattcctactgactagcta

SEQ ID NO: 7384449 - DNA, 22 bp, Homo sapiens
atacatagttctgtgaaaagta

SEQ ID NO: 7384450 - DNA, 22 bp, Homo sapiens
atacataggatatgtacgtgca

SEQ ID NO: 7384451 - DNA, 22 bp, Homo sapiens
atacagtagggaccatgtctga

SEQ ID NO: 7384452 - DNA, 22 bp, Homo sapiens
atacagtgaatacttacagtgt

SEQ ID NO: 7384453 - DNA, 22 bp, Homo sapiens
atacagtgagaataattcttag

SEQ ID NO: 7384454 - DNA, 22 bp, Homo sapiens
atacagttagaaaaaaagcctt

SEQ ID NO: 7384455 - DNA, 22 bp, Homo sapiens
atacagtgtactatttagcagt

SEQ ID NO: 7384456 - DNA, 22 bp, Homo sapiens
atacagtgccccttttcacatg

SEQ ID NO: 7384457 - DNA, 17 bp, Homo sapiens
atacagtttattttaca

SEQ ID NO: 7384458 - DNA, 22 bp, Homo sapiens
atacatagcagagtcaattaat

SEQ ID NO: 7384459 - DNA, 22 bp, Homo sapiens
atacatagcagagtcaattaat

SEQ ID NO: 7384460 - DNA, 22 bp, Homo sapiens
atacatagctgaaaacttgtag

SEQ ID NO: 7384461 - DNA, 22 bp, Homo sapiens
atacatagcagggtagtagatc

SEQ ID NO: 7384462 - DNA, 22 bp, Homo sapiens
ctgctgcaggatgggcactctg

SEQ ID NO: 7384463 - DNA, 22 bp, Homo sapiens
ctgctgcagatgacagacccaa

SEQ ID NO: 7384464 - DNA, 18 bp, Homo sapiens
ctgctgcaggcactcagg

SEQ ID NO: 7384465 - DNA, 22 bp, Homo sapiens
ctggaagtttccttcctggtca

SEQ ID NO: 7384466 - DNA, 18 bp, Homo sapiens
ctggaagttagtctttgg

SEQ ID NO: 7384467 - DNA, 22 bp, Homo sapiens
ctggaatgtagagacagcttag

SEQ ID NO: 7384468 - DNA, 22 bp, Homo sapiens
ctggaatgaagctatgtacatt

SEQ ID NO: 7384469 - DNA, 22 bp, Homo sapiens
ctggaatgtatgtatcttaaga

SEQ ID NO: 7384470 - DNA, 19 bp, Homo sapiens
atacagatgtatccatgat

SEQ ID NO: 7384471 - DNA, 22 bp, Homo sapiens
cttagaagtaatttaccttctc

SEQ ID NO: 7384472 - DNA, 22 bp, Homo sapiens
cttagaagtgggctataattag

SEQ ID NO: 7384473 - DNA, 22 bp, Homo sapiens
cttagagatgggttttacttag

SEQ ID NO: 7384474 - DNA, 20 bp, Homo sapiens
cttagaaatttttaccctgg

SEQ ID NO: 7384475 - DNA, 22 bp, Homo sapiens
cttagaaattgttactcattca

SEQ ID NO: 7384476 - DNA, 22 bp, Homo sapiens
cttagaagaatgcctaggacag

SEQ ID NO: 7384477 - DNA, 22 bp, Homo sapiens
cttagaaggaacagtttagtgc

SEQ ID NO: 7384478 - DNA, 22 bp, Homo sapiens
cttagaaggatgtttgctgttt

SEQ ID NO: 7384479 - DNA, 20 bp, Homo sapiens
cttagaagggacatcctggg

SEQ ID NO: 7384480 - DNA, 22 bp, Homo sapiens
cttagaaattgttactcattca

SEQ ID NO: 7384481 - DNA, 22 bp, Homo sapiens
cttcccaagactgtattgcaag

SEQ ID NO: 7384482 - DNA, 22 bp, Homo sapiens
cttcccaagctttagttatttt

SEQ ID NO: 7384483 - DNA, 22 bp, Homo sapiens
cttccagtgcataggtagatca

SEQ ID NO: 7384484 - DNA, 22 bp, Homo sapiens
cttccagtctagagctatctgt

SEQ ID NO: 7384485 - DNA, 22 bp, Homo sapiens
cttccagtctagagctatctgt

SEQ ID NO: 7384486 - DNA, 22 bp, Homo sapiens
cttccagtagtatcattctcat

SEQ ID NO: 7384487 - DNA, 23 bp, Homo sapiens
cttccagtactgcacactcaagg

SEQ ID NO: 7384488 - DNA, 22 bp, Homo sapiens
atctctgatttacagcatctct

SEQ ID NO: 7384489 - DNA, 22 bp, Homo sapiens
atctctgcgtccccagcatcga

SEQ ID NO: 7384490 - DNA, 22 bp, Homo sapiens
atctgaagtggagaaaaatata

SEQ ID NO: 7384491 - DNA, 22 bp, Homo sapiens
atctgaaagctaggagttctca

SEQ ID NO: 7384492 - DNA, 22 bp, Homo sapiens
atctgaagaatgaatggaatta

SEQ ID NO: 7384493 - DNA, 22 bp, Homo sapiens
cttcttgattgctttcaaacca

SEQ ID NO: 7384494 - DNA, 22 bp, Homo sapiens
cttcttaatgcataaactgtgt

SEQ ID NO: 7384495 - DNA, 22 bp, Homo sapiens
cttcttaatgacagattaaaat

SEQ ID NO: 7384496 - DNA, 22 bp, Homo sapiens
atctgcagtttgttttctcttg

SEQ ID NO: 7384497 - DNA, 22 bp, Homo sapiens
atctgagtgttggatttattgt

SEQ ID NO: 7384498 - DNA, 22 bp, Homo sapiens
atctgcaggaatgtgtgcagag

SEQ ID NO: 7384499 - DNA, 22 bp, Homo sapiens
atctgcagaggacaggcgagga

SEQ ID NO: 7384500 - DNA, 22 bp, Homo sapiens
atctgcacttaagcgaggcctg

SEQ ID NO: 7384501 - DNA, 18 bp, Homo sapiens
ctgtgggaaggctttcta

SEQ ID NO: 7384502 - DNA, 18 bp, Homo sapiens
ctgtgggaagagtttggg

SEQ ID NO: 7384503 - DNA, 20 bp, Homo sapiens
atcagacttttaggaacata

SEQ ID NO: 7384504 - DNA, 22 bp, Homo sapiens
atccagggataaaagtaaggtt

SEQ ID NO: 7384505 - DNA, 22 bp, Homo sapiens
atccagggtgtggagagagctc

SEQ ID NO: 7384506 - DNA, 22 bp, Homo sapiens
atccatacagtggaatattatt

SEQ ID NO: 7384507 - DNA, 22 bp, Homo sapiens
atatgcacatacatacataggt

SEQ ID NO: 7384508 - DNA, 22 bp, Homo sapiens
atattatagacagagtcttctg

SEQ ID NO: 7384509 - DNA, 22 bp, Homo sapiens
ctgggctgagcctgggctgtgt

SEQ ID NO: 7384510 - DNA, 22 bp, Homo sapiens
atattataagttatttcaagtt

SEQ ID NO: 7384511 - DNA, 22 bp, Homo sapiens
atatgcatgcatgcttgtgaga

SEQ ID NO: 7384512 - DNA, 22 bp, Homo sapiens
atatgccattagctagaaataa

SEQ ID NO: 7384513 - DNA, 22 bp, Homo sapiens
atatgtttttggaaagaacaca

SEQ ID NO: 7384514 - DNA, 22 bp, Homo sapiens
atattgggagctgagatctatt

SEQ ID NO: 7384515 - DNA, 18 bp, Homo sapiens
atattgggagcaggggca

SEQ ID NO: 7384516 - DNA, 23 bp, Homo sapiens
atattgggagatagggcctttaa

SEQ ID NO: 7384517 - DNA, 22 bp, Homo sapiens
atattgctagcctatgagttca

SEQ ID NO: 7384518 - DNA, 22 bp, Homo sapiens
atattggtgattagccaatgct

SEQ ID NO: 7384519 - DNA, 22 bp, Homo sapiens
atattggtgaaatgctagcaaa

SEQ ID NO: 7384520 - DNA, 22 bp, Homo sapiens
atattgggtgtgggcatcaggg

SEQ ID NO: 7384521 - DNA, 22 bp, Homo sapiens
atattggggataattgtgctgc

SEQ ID NO: 7384522 - DNA, 22 bp, Homo sapiens
atattgggatgtttggaaatgc

SEQ ID NO: 7384523 - DNA, 22 bp, Homo sapiens
atattgggattttaggttaaag

SEQ ID NO: 7384524 - DNA, 22 bp, Homo sapiens
atattgggcagggaagccagtg

SEQ ID NO: 7384525 - DNA, 22 bp, Homo sapiens
atatttaaacagggtaccaata

SEQ ID NO: 7384526 - DNA, 22 bp, Homo sapiens
atattgttagtaatatttcgaa

SEQ ID NO: 7384527 - DNA, 22 bp, Homo sapiens
atattgtgtgtacaagtagtta

SEQ ID NO: 7384528 - DNA, 22 bp, Homo sapiens
atcaaagtgatttgtaaacagg

SEQ ID NO: 7384529 - DNA, 22 bp, Homo sapiens
atcaaaatggaagaatttggct

SEQ ID NO: 7384530 - DNA, 22 bp, Homo sapiens
atcaaaatgctccagtgatggt

SEQ ID NO: 7384531 - DNA, 22 bp, Homo sapiens
atcaaagaatgtgactgaaata

SEQ ID NO: 7384532 - DNA, 22 bp, Homo sapiens
atatttaactggtcccaatata

SEQ ID NO: 7384533 - DNA, 22 bp, Homo sapiens
atcagaatagtgggggacagtc

SEQ ID NO: 7384534 - DNA, 21 bp, Homo sapiens
atcagaaaatgtaatggagca

SEQ ID NO: 7384535 - DNA, 22 bp, Homo sapiens
atcaagaaaagtgctttcggct

SEQ ID NO: 7384536 - DNA, 22 bp, Homo sapiens
atcaaattggaatgaaaggctc

SEQ ID NO: 7384537 - DNA, 22 bp, Homo sapiens
atcaaattatgtgctacaagaa

SEQ ID NO: 7384538 - DNA, 22 bp, Homo sapiens
atcaaataaaggtacctagctt

SEQ ID NO: 7384539 - DNA, 22 bp, Homo sapiens
atcaaatacaaagggcataagg

SEQ ID NO: 7384540 - DNA, 22 bp, Homo sapiens
atcaaatacaaagggcataagg

SEQ ID NO: 7384541 - DNA, 22 bp, Homo sapiens
atcaaatataataattttcgct

SEQ ID NO: 7384542 - DNA, 22 bp, Homo sapiens
gccccaggttgcctgtcccagg

SEQ ID NO: 7384543 - DNA, 22 bp, Homo sapiens
atttctgttgcttataaattac

SEQ ID NO: 7384544 - DNA, 22 bp, Homo sapiens
atttctgtgcagtaaatggtga

SEQ ID NO: 7384545 - DNA, 22 bp, Homo sapiens
atttccatgtccaaaaattagt

SEQ ID NO: 7384546 - DNA, 22 bp, Homo sapiens
atttccattatcatgacaaatt

SEQ ID NO: 7384547 - DNA, 21 bp, Homo sapiens
gcccacagtgaggaggatccc

SEQ ID NO: 7384548 - DNA, 22 bp, Homo sapiens
gcccacagtctatcagtttgcg

SEQ ID NO: 7384549 - DNA, 22 bp, Homo sapiens
atttcatgttgatctttcgagg

SEQ ID NO: 7384550 - DNA, 22 bp, Homo sapiens
atttcatgttaactgaacagaa

SEQ ID NO: 7384551 - DNA, 22 bp, Homo sapiens
atttcatgtttcatctacctaa

SEQ ID NO: 7384552 - DNA, 22 bp, Homo sapiens
gccacaggtgggctctgggaaa

SEQ ID NO: 7384553 - DNA, 22 bp, Homo sapiens
gccacaggtggaattaagaaat

SEQ ID NO: 7384554 - DNA, 22 bp, Homo sapiens
gccacaggtactatgggagaga

SEQ ID NO: 7384555 - DNA, 22 bp, Homo sapiens
gccacaggtcggctagagggtc

SEQ ID NO: 7384556 - DNA, 22 bp, Homo sapiens
gccacaggtaggaacctacctc

SEQ ID NO: 7384557 - DNA, 22 bp, Homo sapiens
gccaggctggtcttgaactcct

SEQ ID NO: 7384558 - DNA, 22 bp, Homo sapiens
atttggaagcatttccaaagca

SEQ ID NO: 7384559 - DNA, 22 bp, Homo sapiens
atttggaaggagctgcacagca

SEQ ID NO: 7384560 - DNA, 22 bp, Homo sapiens
atttggaagcttgaagattatt

SEQ ID NO: 7384561 - DNA, 22 bp, Homo sapiens
atttggaaggcgtttctctgta

SEQ ID NO: 7384562 - DNA, 22 bp, Homo sapiens
atttggaaggtttacaaagaga

SEQ ID NO: 7384563 - DNA, 22 bp, Homo sapiens
atttggaaggtttacaaagaga

SEQ ID NO: 7384564 - DNA, 22 bp, Homo sapiens
atttggaagtttttgtgggaat

SEQ ID NO: 7384565 - DNA, 22 bp, Homo sapiens
atttggaatagctgtagaaata

SEQ ID NO: 7384566 - DNA, 22 bp, Homo sapiens
atttggaagtttggagtgaagg

SEQ ID NO: 7384567 - DNA, 22 bp, Homo sapiens
gcctgagagtctccagaccttg

SEQ ID NO: 7384568 - DNA, 22 bp, Homo sapiens
gcctgagaaggacacagcaggt

SEQ ID NO: 7384569 - DNA, 22 bp, Homo sapiens
atttggaatggtctggcatttg

SEQ ID NO: 7384570 - DNA, 22 bp, Homo sapiens
atttggaatgggagcctggcat

SEQ ID NO: 7384571 - DNA, 22 bp, Homo sapiens
atttggaatgctagtgaatgta

SEQ ID NO: 7384572 - DNA, 22 bp, Homo sapiens
gcctggattacaaacagccaac

SEQ ID NO: 7384573 - DNA, 22 bp, Homo sapiens
attttacttagtgtaatgtcca

SEQ ID NO: 7384574 - DNA, 22 bp, Homo sapiens
gcctcttgtttccttacatgga

SEQ ID NO: 7384575 - DNA, 22 bp, Homo sapiens
gcctcaaaagtgttgtagaggg

SEQ ID NO: 7384576 - DNA, 22 bp, Homo sapiens
gcctcaaatgtggagcactatt

SEQ ID NO: 7384577 - DNA, 22 bp, Homo sapiens
gcctcaaatgtggagcactatt

SEQ ID NO: 7384578 - DNA, 22 bp, Homo sapiens
gcctattatcagagctagtgat

SEQ ID NO: 7384579 - DNA, 22 bp, Homo sapiens
gcctattaaagagcttggagca

SEQ ID NO: 7384580 - DNA, 22 bp, Homo sapiens
gcctatatgttaataggaggga

SEQ ID NO: 7384581 - DNA, 22 bp, Homo sapiens
atttggaaatgtaagaatgcaa

SEQ ID NO: 7384582 - DNA, 22 bp, Homo sapiens
atttggaacaaatattagtaaa

SEQ ID NO: 7384583 - DNA, 22 bp, Homo sapiens
atttggaacttataataagttt

SEQ ID NO: 7384584 - DNA, 22 bp, Homo sapiens
atttggaactgggcatgcaaac

SEQ ID NO: 7384585 - DNA, 22 bp, Homo sapiens
atttggaagaaatctgtcacag

SEQ ID NO: 7384586 - DNA, 22 bp, Homo sapiens
atttggaaaagcggtaacttgc

SEQ ID NO: 7384587 - DNA, 22 bp, Homo sapiens
atttggaaaagtttcttcaact

SEQ ID NO: 7384588 - DNA, 22 bp, Homo sapiens
atttggaaatacgcgcttttgg

SEQ ID NO: 7384589 - DNA, 22 bp, Homo sapiens
atttggaaatgcatctcttgag

SEQ ID NO: 7384590 - DNA, 22 bp, Homo sapiens
atttggaaacatgctgaccatg

SEQ ID NO: 7384591 - DNA, 19 bp, Homo sapiens
atttggaaataaggtcttc

SEQ ID NO: 7384592 - DNA, 22 bp, Homo sapiens
atttggaaacaaatggtttcgc

SEQ ID NO: 7384593 - DNA, 22 bp, Homo sapiens
atttggaaacaattatattctt

SEQ ID NO: 7384594 - DNA, 22 bp, Homo sapiens
atttggaaaatctggttataga

SEQ ID NO: 7384595 - DNA, 22 bp, Homo sapiens
atttttgccctgcagtacataa

SEQ ID NO: 7384596 - DNA, 22 bp, Homo sapiens
atttttgagctgtgaacatagc

SEQ ID NO: 7384597 - DNA, 22 bp, Homo sapiens
atttttcagcttcattgaggca

SEQ ID NO: 7384598 - DNA, 22 bp, Homo sapiens
atttttcaactttggaaatggc

SEQ ID NO: 7384599 - DNA, 22 bp, Homo sapiens
atttttcagcttcattgaggca

SEQ ID NO: 7384600 - DNA, 22 bp, Homo sapiens
atttttcaactttggaaatggc

SEQ ID NO: 7384601 - DNA, 22 bp, Homo sapiens
attttagagctccaagtacagc

SEQ ID NO: 7384602 - DNA, 22 bp, Homo sapiens
attttagagaaacaaacgtagg

SEQ ID NO: 7384603 - DNA, 22 bp, Homo sapiens
attttactttgtgaatattgac

SEQ ID NO: 7384604 - DNA, 22 bp, Homo sapiens
caaacattcaagtacaagtctt

SEQ ID NO: 7384605 - DNA, 22 bp, Homo sapiens
caaacattcagatgcaatggta

SEQ ID NO: 7384606 - DNA, 22 bp, Homo sapiens
caaagaggttttgagggcagct

SEQ ID NO: 7384607 - DNA, 22 bp, Homo sapiens
caaagcaggaagaatattgaaa

SEQ ID NO: 7384608 - DNA, 22 bp, Homo sapiens
caaagccaggctttctaatgta

SEQ ID NO: 7384609 - DNA, 22 bp, Homo sapiens
caaagccatagagtagataaga

SEQ ID NO: 7384610 - DNA, 21 bp, Homo sapiens
caaagccaggcaactctctcc

SEQ ID NO: 7384611 - DNA, 22 bp, Homo sapiens
caaaattagaaatgcagctgtt

SEQ ID NO: 7384612 - DNA, 22 bp, Homo sapiens
caaaattagggagtgagctgga

SEQ ID NO: 7384613 - DNA, 22 bp, Homo sapiens
caaaattagggagtgagctgga

SEQ ID NO: 7384614 - DNA, 22 bp, Homo sapiens
caaaattgatgaatgtatgatt

SEQ ID NO: 7384615 - DNA, 22 bp, Homo sapiens
caaacaatttgcatttccttag

SEQ ID NO: 7384616 - DNA, 22 bp, Homo sapiens
caaaatgatgtgattttattgt

SEQ ID NO: 7384617 - DNA, 22 bp, Homo sapiens
caaaatagatgttaacctggaa

SEQ ID NO: 7384618 - DNA, 22 bp, Homo sapiens
caaaatgttctggcacctttaa

SEQ ID NO: 7384619 - DNA, 22 bp, Homo sapiens
caaaattagaaatgcagctgtt

SEQ ID NO: 7384620 - DNA, 22 bp, Homo sapiens
caaatgctactaataggcaagt

SEQ ID NO: 7384621 - DNA, 22 bp, Homo sapiens
gctgacctgaatcattcggggt

SEQ ID NO: 7384622 - DNA, 22 bp, Homo sapiens
gctgactgatggacacagcacc

SEQ ID NO: 7384623 - DNA, 22 bp, Homo sapiens
gctgacccctacaggttgtgtt

SEQ ID NO: 7384624 - DNA, 22 bp, Homo sapiens
gctctttagcgggggccaggcc

SEQ ID NO: 7384625 - DNA, 22 bp, Homo sapiens
gctctttactgtgagggtggtc

SEQ ID NO: 7384626 - DNA, 22 bp, Homo sapiens
gctctttaattcattcatggat

SEQ ID NO: 7384627 - DNA, 22 bp, Homo sapiens
gctcttgtcaaaaattagttga

SEQ ID NO: 7384628 - DNA, 22 bp, Homo sapiens
caaatagactctagaatttatt

SEQ ID NO: 7384629 - DNA, 22 bp, Homo sapiens
caaatagaactcacagacaaga

SEQ ID NO: 7384630 - DNA, 22 bp, Homo sapiens
caaatagaactcacagacaaga

SEQ ID NO: 7384631 - DNA, 22 bp, Homo sapiens
caaatagacaagatggcaggaa

SEQ ID NO: 7384632 - DNA, 21 bp, Homo sapiens
caaatagacatggctagagga

SEQ ID NO: 7384633 - DNA, 22 bp, Homo sapiens
caaatagaaggtactcagagaa

SEQ ID NO: 7384634 - DNA, 22 bp, Homo sapiens
caaatagaaggtactcagagaa

SEQ ID NO: 7384635 - DNA, 22 bp, Homo sapiens
caaatactttatatacttcaaa

SEQ ID NO: 7384636 - DNA, 22 bp, Homo sapiens
caaatactgggtaagttaattt

SEQ ID NO: 7384637 - DNA, 22 bp, Homo sapiens
caaagcttcatctgttgttttg

SEQ ID NO: 7384638 - DNA, 22 bp, Homo sapiens
caaagcttggagaagcagctgg

SEQ ID NO: 7384639 - DNA, 22 bp, Homo sapiens
caaaggaaatactaatctggaa

SEQ ID NO: 7384640 - DNA, 22 bp, Homo sapiens
caaaggcaacatatacttgttt

SEQ ID NO: 7384641 - DNA, 22 bp, Homo sapiens
caaaggaagctccttgatggcg

SEQ ID NO: 7384642 - DNA, 22 bp, Homo sapiens
caaatacaaatacgggcagctt

SEQ ID NO: 7384643 - DNA, 22 bp, Homo sapiens
caaatacaaatacgggcagctt

SEQ ID NO: 7384644 - DNA, 22 bp, Homo sapiens
gcagtgtggccccagtatcacg

SEQ ID NO: 7384645 - DNA, 22 bp, Homo sapiens
gcagtgtgtctggagtacatgg

SEQ ID NO: 7384646 - DNA, 22 bp, Homo sapiens
gcatacagagaggatgtggcat

SEQ ID NO: 7384647 - DNA, 22 bp, Homo sapiens
gcatacatgggtgcagggacat

SEQ ID NO: 7384648 - DNA, 18 bp, Homo sapiens
gcatacagaggggaagta

SEQ ID NO: 7384649 - DNA, 22 bp, Homo sapiens
gcatacagtccttgtattcttc

SEQ ID NO: 7384650 - DNA, 22 bp, Homo sapiens
attgtacttttattacatgtag

SEQ ID NO: 7384651 - DNA, 22 bp, Homo sapiens
attgtacttttattacatgtag

SEQ ID NO: 7384652 - DNA, 22 bp, Homo sapiens
attgtcattccagtcattgtta

SEQ ID NO: 7384653 - DNA, 22 bp, Homo sapiens
attgtcattggcttctatgtct

SEQ ID NO: 7384654 - DNA, 22 bp, Homo sapiens
attgtcctatctcagtgccatg

SEQ ID NO: 7384655 - DNA, 22 bp, Homo sapiens
attgtcagctcgaaatgcatca

SEQ ID NO: 7384656 - DNA, 20 bp, Homo sapiens
attgtcagccttcagaggag

SEQ ID NO: 7384657 - DNA, 22 bp, Homo sapiens
attgtatttgtacaagacatgt

SEQ ID NO: 7384658 - DNA, 22 bp, Homo sapiens
attgtatttgtacaagacatgt

SEQ ID NO: 7384659 - DNA, 22 bp, Homo sapiens
attgtcacttaaaagtgcatgt

SEQ ID NO: 7384660 - DNA, 22 bp, Homo sapiens
gccacagggcgagcggaggcca

SEQ ID NO: 7384661 - DNA, 22 bp, Homo sapiens
gccacagggattgttttgtgag

SEQ ID NO: 7384662 - DNA, 22 bp, Homo sapiens
gccacagggaggcgttttcagg

SEQ ID NO: 7384663 - DNA, 22 bp, Homo sapiens
gccacagggcagatgcgcagag

SEQ ID NO: 7384664 - DNA, 22 bp, Homo sapiens
attgtctgtactttaaaaatgt

SEQ ID NO: 7384665 - DNA, 22 bp, Homo sapiens
attgtcttggcattcaaattag

SEQ ID NO: 7384666 - DNA, 22 bp, Homo sapiens
attgtcttctgtcttatagttc

SEQ ID NO: 7384667 - DNA, 22 bp, Homo sapiens
attgtctttgtttaagggatac

SEQ ID NO: 7384668 - DNA, 22 bp, Homo sapiens
gccaaagagctgagtacatgta

SEQ ID NO: 7384669 - DNA, 22 bp, Homo sapiens
attgtgcaatgttttacaattt

SEQ ID NO: 7384670 - DNA, 22 bp, Homo sapiens
gcagctgccttcagctggatgg

SEQ ID NO: 7384671 - DNA, 22 bp, Homo sapiens
gcagctgcctattcagggcttg

SEQ ID NO: 7384672 - DNA, 22 bp, Homo sapiens
gcagctgctggaagttcctgcc

SEQ ID NO: 7384673 - DNA, 22 bp, Homo sapiens
gcagctgctggaagttcctgcc

SEQ ID NO: 7384674 - DNA, 22 bp, Homo sapiens
gcagctgctcccttttacagtg

SEQ ID NO: 7384675 - DNA, 22 bp, Homo sapiens
gcagctgctcacattctcacaa

SEQ ID NO: 7384676 - DNA, 22 bp, Homo sapiens
gcagctgcgctggtgtggggca

SEQ ID NO: 7384677 - DNA, 22 bp, Homo sapiens
gcagctgcgaagaagtctatct

SEQ ID NO: 7384678 - DNA, 19 bp, Homo sapiens
gcagctgcttgaaaagaaa

SEQ ID NO: 7384679 - DNA, 22 bp, Homo sapiens
gcagctgctgtggcatcaagct

SEQ ID NO: 7384680 - DNA, 22 bp, Homo sapiens
gcagctgctgggatcatttagg

SEQ ID NO: 7384681 - DNA, 22 bp, Homo sapiens
gcagctgctggagggaggcagg

SEQ ID NO: 7384682 - DNA, 22 bp, Homo sapiens
attccttggaacagatgcgaag

SEQ ID NO: 7384683 - DNA, 22 bp, Homo sapiens
attccttgctctcatcaacctt

SEQ ID NO: 7384684 - DNA, 22 bp, Homo sapiens
attccttgcacatcagatagtt

SEQ ID NO: 7384685 - DNA, 22 bp, Homo sapiens
attctttaattcaattgaagga

SEQ ID NO: 7384686 - DNA, 19 bp, Homo sapiens
attcttcagcagtgagacc

SEQ ID NO: 7384687 - DNA, 22 bp, Homo sapiens
attccttgggaattattgaatg

SEQ ID NO: 7384688 - DNA, 22 bp, Homo sapiens
attccttggcattctggacttg

SEQ ID NO: 7384689 - DNA, 22 bp, Homo sapiens
attccttgtatatctacatgca

SEQ ID NO: 7384690 - DNA, 22 bp, Homo sapiens
attccttgggctgccttattat

SEQ ID NO: 7384691 - DNA, 22 bp, Homo sapiens
attgacctggcagactggactg

SEQ ID NO: 7384692 - DNA, 22 bp, Homo sapiens
attgatgttactattctggtct

SEQ ID NO: 7384693 - DNA, 22 bp, Homo sapiens
attgatgttagaatctactcct

SEQ ID NO: 7384694 - DNA, 22 bp, Homo sapiens
attgatcatgcagatgcttcac

SEQ ID NO: 7384695 - DNA, 22 bp, Homo sapiens
gcaggcctgcccagcaggatgg

SEQ ID NO: 7384696 - DNA, 22 bp, Homo sapiens
attgatttaggcttgttatgac

SEQ ID NO: 7384697 - DNA, 22 bp, Homo sapiens
attcacattgagcttcactgtg

SEQ ID NO: 7384698 - DNA, 22 bp, Homo sapiens
attcacatgcccaagcagcacc

SEQ ID NO: 7384699 - DNA, 22 bp, Homo sapiens
attcacatgtgcttcttatcac

SEQ ID NO: 7384700 - DNA, 22 bp, Homo sapiens
attcacattttatttcactgga

SEQ ID NO: 7384701 - DNA, 22 bp, Homo sapiens
attcacatttacaaagcactca

SEQ ID NO: 7384702 - DNA, 22 bp, Homo sapiens
attcacatttagcctctgacat

SEQ ID NO: 7384703 - DNA, 22 bp, Homo sapiens
attcagaaagatatgcctggtt

SEQ ID NO: 7384704 - DNA, 22 bp, Homo sapiens
attcacttattctcaaagtcct

SEQ ID NO: 7384705 - DNA, 22 bp, Homo sapiens
attcagaaagttgtcatatttg

SEQ ID NO: 7384706 - DNA, 22 bp, Homo sapiens
attcagaaagggttgcctggtt

SEQ ID NO: 7384707 - DNA, 22 bp, Homo sapiens
gcacgaggcaccgctgttttgt

SEQ ID NO: 7384708 - DNA, 19 bp, Homo sapiens
gcacgctggcttgataggg

SEQ ID NO: 7384709 - DNA, 22 bp, Homo sapiens
attcaagtaaacactgaaggaa

SEQ ID NO: 7384710 - DNA, 22 bp, Homo sapiens
attcaagattaattctatgtca

SEQ ID NO: 7384711 - DNA, 19 bp, Homo sapiens
attcacatccctgggaagg

SEQ ID NO: 7384712 - DNA, 22 bp, Homo sapiens
attcagactgtctaaatggttt

SEQ ID NO: 7384713 - DNA, 22 bp, Homo sapiens
attcagaatggcaaacttctag

SEQ ID NO: 7384714 - DNA, 22 bp, Homo sapiens
attcagaagcaatcacagtgag

SEQ ID NO: 7384715 - DNA, 22 bp, Homo sapiens
gcagcagagaccccaggaagga

SEQ ID NO: 7384716 - DNA, 22 bp, Homo sapiens
gcagcagagaacacaatgatgg

SEQ ID NO: 7384717 - DNA, 20 bp, Homo sapiens
gcagcagacagacaggggac

SEQ ID NO: 7384718 - DNA, 22 bp, Homo sapiens
gcagcagaggccctactctttg

SEQ ID NO: 7384719 - DNA, 22 bp, Homo sapiens
gcagcagaggccctactctttg

SEQ ID NO: 7384720 - DNA, 22 bp, Homo sapiens
gcagcagagctttgtcctggct

SEQ ID NO: 7384721 - DNA, 17 bp, Homo sapiens
gcagcagagagaccctc

SEQ ID NO: 7384722 - DNA, 21 bp, Homo sapiens
gcagcagaggcttgacagaca

SEQ ID NO: 7384723 - DNA, 22 bp, Homo sapiens
gcagcagatgctttcatggaca

SEQ ID NO: 7384724 - DNA, 22 bp, Homo sapiens
gcagcagagtttgggagatggt

SEQ ID NO: 7384725 - DNA, 22 bp, Homo sapiens
gcagcagagtttgggagatggt

SEQ ID NO: 7384726 - DNA, 22 bp, Homo sapiens
gcagcagagtagacagagccct

SEQ ID NO: 7384727 - DNA, 22 bp, Homo sapiens
gcagcagagtagacagagccct

SEQ ID NO: 7384728 - DNA, 23 bp, Homo sapiens
attagaaaggctttctggtgaaa

SEQ ID NO: 7384729 - DNA, 22 bp, Homo sapiens
attagaaaccaagaggcaggct

SEQ ID NO: 7384730 - DNA, 22 bp, Homo sapiens
attagaaaatacatgggctgtc

SEQ ID NO: 7384731 - DNA, 22 bp, Homo sapiens
attagaaaatctggaggtgggg

SEQ ID NO: 7384732 - DNA, 22 bp, Homo sapiens
attagaaaaactcaagggctct

SEQ ID NO: 7384733 - DNA, 22 bp, Homo sapiens
gatttctcaatcctagtactat

SEQ ID NO: 7384734 - DNA, 22 bp, Homo sapiens
gatttccatgattgggccagaa

SEQ ID NO: 7384735 - DNA, 22 bp, Homo sapiens
gatattgataataaccatgaat

SEQ ID NO: 7384736 - DNA, 22 bp, Homo sapiens
attacaatcgagagaaacaaat

SEQ ID NO: 7384737 - DNA, 22 bp, Homo sapiens
gatatgtattgaatgatcattt

SEQ ID NO: 7384738 - DNA, 22 bp, Homo sapiens
attacatatgttggcaacattt

SEQ ID NO: 7384739 - DNA, 22 bp, Homo sapiens
attagtggtatctatcatagaa

SEQ ID NO: 7384740 - DNA, 22 bp, Homo sapiens
attagtgactctcacatatgcc

SEQ ID NO: 7384741 - DNA, 22 bp, Homo sapiens
attagtgatatgtgactagacc

SEQ ID NO: 7384742 - DNA, 22 bp, Homo sapiens
attagttgatctatatccaaag

SEQ ID NO: 7384743 - DNA, 22 bp, Homo sapiens
attcaaagtctagatgtagtgt

SEQ ID NO: 7384744 - DNA, 22 bp, Homo sapiens
attcaaattaagttaattcagc

SEQ ID NO: 7384745 - DNA, 22 bp, Homo sapiens
attagtcagtatttgtttgcca

SEQ ID NO: 7384746 - DNA, 22 bp, Homo sapiens
attaggacacatacatgtacag

SEQ ID NO: 7384747 - DNA, 22 bp, Homo sapiens
attaggacagagatgtcaagag

SEQ ID NO: 7384748 - DNA, 22 bp, Homo sapiens
attaggaagtaagtatcacaag

SEQ ID NO: 7384749 - DNA, 22 bp, Homo sapiens
atggcttctgtcttggaaattt

SEQ ID NO: 7384750 - DNA, 22 bp, Homo sapiens
atggcttctgtcttggaaactt

SEQ ID NO: 7384751 - DNA, 21 bp, Homo sapiens
atggcttttttaaagcttgtg

SEQ ID NO: 7384752 - DNA, 22 bp, Homo sapiens
atggccagagaggccagcctgg

SEQ ID NO: 7384753 - DNA, 22 bp, Homo sapiens
atggcttatgaataacagtagg

SEQ ID NO: 7384754 - DNA, 22 bp, Homo sapiens
atggcttcctctggattggatt

SEQ ID NO: 7384755 - DNA, 17 bp, Homo sapiens
atggcttccattgacca

SEQ ID NO: 7384756 - DNA, 22 bp, Homo sapiens
atggcttctagcattgtcacaa

SEQ ID NO: 7384757 - DNA, 22 bp, Homo sapiens
atggccaaggggcctaggcagg

SEQ ID NO: 7384758 - DNA, 22 bp, Homo sapiens
atggccaaagccacagcagagg

SEQ ID NO: 7384759 - DNA, 22 bp, Homo sapiens
atggccaactgaaatgaaagat

SEQ ID NO: 7384760 - DNA, 22 bp, Homo sapiens
gagatggggtcttgctatgttg

SEQ ID NO: 7384761 - DNA, 22 bp, Homo sapiens
gagatggggaataggagcaagc

SEQ ID NO: 7384762 - DNA, 22 bp, Homo sapiens
gagatggagtctttttctgtca

SEQ ID NO: 7384763 - DNA, 22 bp, Homo sapiens
gagagtcactgtctgcatttcc

SEQ ID NO: 7384764 - DNA, 23 bp, Homo sapiens
gagagcaatgagatgtaaacact

SEQ ID NO: 7384765 - DNA, 23 bp, Homo sapiens
gagagcaatgagatgtaaacact

SEQ ID NO: 7384766 - DNA, 22 bp, Homo sapiens
gagagcaatggggacgggcagg

SEQ ID NO: 7384767 - DNA, 22 bp, Homo sapiens
gagagcaatggggacgggcagg

SEQ ID NO: 7384768 - DNA, 22 bp, Homo sapiens
gagagcagactctcaaagctgg

SEQ ID NO: 7384769 - DNA, 22 bp, Homo sapiens
gagacatggcaaaagcactggt

SEQ ID NO: 7384770 - DNA, 22 bp, Homo sapiens
gagagagagctaatattaagct

SEQ ID NO: 7384771 - DNA, 22 bp, Homo sapiens
gagagagaggtgctgccaggca

SEQ ID NO: 7384772 - DNA, 22 bp, Homo sapiens
atggtcttgtgagagtaacagt

SEQ ID NO: 7384773 - DNA, 22 bp, Homo sapiens
gaggagaagctattggaaggac

SEQ ID NO: 7384774 - DNA, 18 bp, Homo sapiens
atggtctcatactgggag

SEQ ID NO: 7384775 - DNA, 22 bp, Homo sapiens
gaggaaggctaaggggcttaga

SEQ ID NO: 7384776 - DNA, 22 bp, Homo sapiens
gaggagaagctattggaaggac

SEQ ID NO: 7384777 - DNA, 22 bp, Homo sapiens
gaggcagcctcagtggacctcg

SEQ ID NO: 7384778 - DNA, 22 bp, Homo sapiens
gaggcagccagaggttctcatt

SEQ ID NO: 7384779 - DNA, 22 bp, Homo sapiens
gaggcagcctcagtggacctcg

SEQ ID NO: 7384780 - DNA, 22 bp, Homo sapiens
gaggcagcattcgcatagacag

SEQ ID NO: 7384781 - DNA, 22 bp, Homo sapiens
gaggcagcatggtaccttggag

SEQ ID NO: 7384782 - DNA, 22 bp, Homo sapiens
gaggcagcattcgcatagacag

SEQ ID NO: 7384783 - DNA, 22 bp, Homo sapiens
gaggcagcatggtaccttggag

SEQ ID NO: 7384784 - DNA, 22 bp, Homo sapiens
gaggcagcatctatggtgggaa

SEQ ID NO: 7384785 - DNA, 22 bp, Homo sapiens
atggtgtatgtaaagtctgagg

SEQ ID NO: 7384786 - DNA, 22 bp, Homo sapiens
atggtgtattcatgtttttaaa

SEQ ID NO: 7384787 - DNA, 22 bp, Homo sapiens
atggtgtatctatccttgttct

SEQ ID NO: 7384788 - DNA, 22 bp, Homo sapiens
atggtgtaagactgtatttctt

SEQ ID NO: 7384789 - DNA, 22 bp, Homo sapiens
atggtgtacagcaatgtgtcag

SEQ ID NO: 7384790 - DNA, 22 bp, Homo sapiens
gaggcacatatatacagagccc

SEQ ID NO: 7384791 - DNA, 22 bp, Homo sapiens
gaggcagcagggctggttcctt

SEQ ID NO: 7384792 - DNA, 22 bp, Homo sapiens
atgggctgtgggaccctggacc

SEQ ID NO: 7384793 - DNA, 22 bp, Homo sapiens
atgggaagctgacctgcatgga

SEQ ID NO: 7384794 - DNA, 22 bp, Homo sapiens
atgggaaggttttgagagcggg

SEQ ID NO: 7384795 - DNA, 22 bp, Homo sapiens
atgggacatagatccttgaggt

SEQ ID NO: 7384796 - DNA, 22 bp, Homo sapiens
atgggacaggtactagaaaggg

SEQ ID NO: 7384797 - DNA, 22 bp, Homo sapiens
atgggacagggctggctggtcc

SEQ ID NO: 7384798 - DNA, 22 bp, Homo sapiens
atgggacaggcatgggacttag

SEQ ID NO: 7384799 - DNA, 22 bp, Homo sapiens
atgggacaaacctttgatttga

SEQ ID NO: 7384800 - DNA, 22 bp, Homo sapiens
atgggacaatttgaacacagtg

SEQ ID NO: 7384801 - DNA, 22 bp, Homo sapiens
atgggacacagtccgccctcta

SEQ ID NO: 7384802 - DNA, 22 bp, Homo sapiens
atgggacacacaaggaagtaaa

SEQ ID NO: 7384803 - DNA, 22 bp, Homo sapiens
atgggacacgttttaaggaaaa

SEQ ID NO: 7384804 - DNA, 22 bp, Homo sapiens
atgggacagcatcttggtatta

SEQ ID NO: 7384805 - DNA, 22 bp, Homo sapiens
gatatattttccatggtctgca

SEQ ID NO: 7384806 - DNA, 22 bp, Homo sapiens
gatatgtaccacctcttaaaag

SEQ ID NO: 7384807 - DNA, 22 bp, Homo sapiens
gatatgtatgaggagtatgtat

SEQ ID NO: 7384808 - DNA, 18 bp, Homo sapiens
gatatggaaggccatgcc

SEQ ID NO: 7384809 - DNA, 22 bp, Homo sapiens
gataatttgatacctcaatcag

SEQ ID NO: 7384810 - DNA, 22 bp, Homo sapiens
gataatttctccatctcaaggt

SEQ ID NO: 7384811 - DNA, 22 bp, Homo sapiens
atgtttaaaggagtcagagact

SEQ ID NO: 7384812 - DNA, 22 bp, Homo sapiens
atgttggagtcgtaaggcatgg

SEQ ID NO: 7384813 - DNA, 22 bp, Homo sapiens
atgtttaaagggttgagaaata

SEQ ID NO: 7384814 - DNA, 22 bp, Homo sapiens
atgtttaaagggttgagaaata

SEQ ID NO: 7384815 - DNA, 19 bp, Homo sapiens
gagttcctgcaaggcctcc

SEQ ID NO: 7384816 - DNA, 22 bp, Homo sapiens
gataatgatgacaatgacaacc

SEQ ID NO: 7384817 - DNA, 22 bp, Homo sapiens
gataatattagaagatacaaat

SEQ ID NO: 7384818 - DNA, 22 bp, Homo sapiens
atgtttaatcggctgcctttcc

SEQ ID NO: 7384819 - DNA, 22 bp, Homo sapiens
gagttcagtagttatagtctag

SEQ ID NO: 7384820 - DNA, 20 bp, Homo sapiens
atgtgtcttagagcatcagg

SEQ ID NO: 7384821 - DNA, 22 bp, Homo sapiens
atgttattttggaaaatacaaa

SEQ ID NO: 7384822 - DNA, 22 bp, Homo sapiens
atgttctttcagccagtgcatc

SEQ ID NO: 7384823 - DNA, 22 bp, Homo sapiens
atgtagctgcagatgataatgc

SEQ ID NO: 7384824 - DNA, 22 bp, Homo sapiens
atgtagatgcaatggatgtcct

SEQ ID NO: 7384825 - DNA, 20 bp, Homo sapiens
atgtagatgaaagcaaaggc

SEQ ID NO: 7384826 - DNA, 22 bp, Homo sapiens
atgtagatgcaccaagactgct

SEQ ID NO: 7384827 - DNA, 22 bp, Homo sapiens
atgtagatgttcacttgatttt

SEQ ID NO: 7384828 - DNA, 22 bp, Homo sapiens
atgtagatttgcttctcctgcc

SEQ ID NO: 7384829 - DNA, 22 bp, Homo sapiens
atgtagatgttggtttaaattt

SEQ ID NO: 7384830 - DNA, 22 bp, Homo sapiens
gaggcagcggctcacagagaaa

SEQ ID NO: 7384831 - DNA, 22 bp, Homo sapiens
gaggcagcgggtcaggaccgtg

SEQ ID NO: 7384832 - DNA, 22 bp, Homo sapiens
atgtagaaataatttcagttcc

SEQ ID NO: 7384833 - DNA, 22 bp, Homo sapiens
atgtagacctttctttgtgatt

SEQ ID NO: 7384834 - DNA, 22 bp, Homo sapiens
atgtctctcaggtttaacttta

SEQ ID NO: 7384835 - DNA, 22 bp, Homo sapiens
atgtctctctctgagtgccaga

SEQ ID NO: 7384836 - DNA, 19 bp, Homo sapiens
atgtctctgtagcacatac

SEQ ID NO: 7384837 - DNA, 19 bp, Homo sapiens
atgtctctgtagcacatac

SEQ ID NO: 7384838 - DNA, 22 bp, Homo sapiens
gagggctctgtctggaagggaa

SEQ ID NO: 7384839 - DNA, 22 bp, Homo sapiens
gagggcgcttcagagagatgaa

SEQ ID NO: 7384840 - DNA, 22 bp, Homo sapiens
atgtctgagtctgctccagttg

SEQ ID NO: 7384841 - DNA, 22 bp, Homo sapiens
gacaatttctcaatatagaaac

SEQ ID NO: 7384842 - DNA, 22 bp, Homo sapiens
gacaattaggttaagagcaaga

SEQ ID NO: 7384843 - DNA, 22 bp, Homo sapiens
gacaattgcttttgccgaataa

SEQ ID NO: 7384844 - DNA, 22 bp, Homo sapiens
gacacaaagtttgtcagaaatt

SEQ ID NO: 7384845 - DNA, 22 bp, Homo sapiens
gacacaaagtttgtcagaaatt

SEQ ID NO: 7384846 - DNA, 22 bp, Homo sapiens
gacataaagttcttgcttgaat

SEQ ID NO: 7384847 - DNA, 22 bp, Homo sapiens
gacatttatgaaggagatatgc

SEQ ID NO: 7384848 - DNA, 22 bp, Homo sapiens
gacatttattagaaaactatca

SEQ ID NO: 7384849 - DNA, 22 bp, Homo sapiens
gacatttcaatctcattatggg

SEQ ID NO: 7384850 - DNA, 22 bp, Homo sapiens
gacatttcaatctcattatggg

SEQ ID NO: 7384851 - DNA, 22 bp, Homo sapiens
gaccaaggccctcagtgggagg

SEQ ID NO: 7384852 - DNA, 22 bp, Homo sapiens
gaccaaggaagaggggagccag

SEQ ID NO: 7384853 - DNA, 22 bp, Homo sapiens
atgctatgtaactggcagatag

SEQ ID NO: 7384854 - DNA, 22 bp, Homo sapiens
atgctattccagaatgtaaatt

SEQ ID NO: 7384855 - DNA, 22 bp, Homo sapiens
atgctcctcgagtgtctcacag

SEQ ID NO: 7384856 - DNA, 22 bp, Homo sapiens
atgctcagggcacactctggac

SEQ ID NO: 7384857 - DNA, 22 bp, Homo sapiens
atgctcagagaaatataaagtt

SEQ ID NO: 7384858 - DNA, 22 bp, Homo sapiens
atgctcagcctgaggtggggag

SEQ ID NO: 7384859 - DNA, 22 bp, Homo sapiens
atgctcagacaccgggcggggg

SEQ ID NO: 7384860 - DNA, 22 bp, Homo sapiens
atgctattccagaatgtaaatt

SEQ ID NO: 7384861 - DNA, 22 bp, Homo sapiens
atgctattgaaaagaaataaga

SEQ ID NO: 7384862 - DNA, 22 bp, Homo sapiens
atgctattttacataggaatgg

SEQ ID NO: 7384863 - DNA, 22 bp, Homo sapiens
gaccctggagttagtcctgtgt

SEQ ID NO: 7384864 - DNA, 22 bp, Homo sapiens
gactggagataaaaccatgagt

SEQ ID NO: 7384865 - DNA, 22 bp, Homo sapiens
gacgcctcttccctgctgcact

SEQ ID NO: 7384866 - DNA, 22 bp, Homo sapiens
gacggagctggttgctgcggct

SEQ ID NO: 7384867 - DNA, 22 bp, Homo sapiens
gacgcactgaaggctggttacc

SEQ ID NO: 7384868 - DNA, 22 bp, Homo sapiens
gaagtcttcattctctctgaga

SEQ ID NO: 7384869 - DNA, 22 bp, Homo sapiens
gaagtcttgaaacacaaactag

SEQ ID NO: 7384870 - DNA, 22 bp, Homo sapiens
gaataatattgactttgcaggc

SEQ ID NO: 7384871 - DNA, 22 bp, Homo sapiens
gaataatagcagaaattagcag

SEQ ID NO: 7384872 - DNA, 22 bp, Homo sapiens
gaatacaaacttaaggctttac

SEQ ID NO: 7384873 - DNA, 22 bp, Homo sapiens
gaatacaaagcagaactcatac

SEQ ID NO: 7384874 - DNA, 22 bp, Homo sapiens
gacaataaagtgatacatggga

SEQ ID NO: 7384875 - DNA, 22 bp, Homo sapiens
gacaataagaaaagaggaggca

SEQ ID NO: 7384876 - DNA, 22 bp, Homo sapiens
gacaataagaacagatactgtg

SEQ ID NO: 7384877 - DNA, 22 bp, Homo sapiens
gacaatgagtgaggcacctggg

SEQ ID NO: 7384878 - DNA, 22 bp, Homo sapiens
gaattttatcttattacttgca

SEQ ID NO: 7384879 - DNA, 19 bp, Homo sapiens
gaattttaggacttcagca

SEQ ID NO: 7384880 - DNA, 22 bp, Homo sapiens
gaatcagaatctctaaggtggg

SEQ ID NO: 7384881 - DNA, 22 bp, Homo sapiens
gaatcacggtattctgcacggg

SEQ ID NO: 7384882 - DNA, 22 bp, Homo sapiens
atgcacagacccaaaggccatc

SEQ ID NO: 7384883 - DNA, 22 bp, Homo sapiens
gaaggcttagaaacaagggagc

SEQ ID NO: 7384884 - DNA, 16 bp, Homo sapiens
gaaggcttactgcagg

SEQ ID NO: 7384885 - DNA, 22 bp, Homo sapiens
gaaggcttatgtgtgactttcg

SEQ ID NO: 7384886 - DNA, 22 bp, Homo sapiens
atgcacaatgttttgatttgag

SEQ ID NO: 7384887 - DNA, 22 bp, Homo sapiens
gaaggcaagatctcagtggagg

SEQ ID NO: 7384888 - DNA, 22 bp, Homo sapiens
gaacaatagtggtaacaaagcc

SEQ ID NO: 7384889 - DNA, 22 bp, Homo sapiens
gaacaatagtggtaacaaagcc

SEQ ID NO: 7384890 - DNA, 22 bp, Homo sapiens
gaacaatacaggctttattcct

SEQ ID NO: 7384891 - DNA, 22 bp, Homo sapiens
gaaggctggctttctgagagca

SEQ ID NO: 7384892 - DNA, 22 bp, Homo sapiens
gaaggctggaaggcaagtagga

SEQ ID NO: 7384893 - DNA, 22 bp, Homo sapiens
gaacaaattctcatcaacttgt

SEQ ID NO: 7384894 - DNA, 22 bp, Homo sapiens
gaacaaattggagaaatcagga

SEQ ID NO: 7384895 - DNA, 22 bp, Homo sapiens
gaaatatacatgaagtcggctg

SEQ ID NO: 7384896 - DNA, 22 bp, Homo sapiens
gaaatagaggacagctggatca

SEQ ID NO: 7384897 - DNA, 22 bp, Homo sapiens
atgatatttgcaatgtgcttgc

SEQ ID NO: 7384898 - DNA, 22 bp, Homo sapiens
atgatattttagtaaagtgata

SEQ ID NO: 7384899 - DNA, 19 bp, Homo sapiens
atgatctgcccttgtaata

SEQ ID NO: 7384900 - DNA, 22 bp, Homo sapiens
atgatcagggcagaagcagaag

SEQ ID NO: 7384901 - DNA, 22 bp, Homo sapiens
atgatgaggtcccaagatctca

SEQ ID NO: 7384902 - DNA, 22 bp, Homo sapiens
gaaatttattatctacatcatt

SEQ ID NO: 7384903 - DNA, 22 bp, Homo sapiens
gaaagtatttaagtccatattt

SEQ ID NO: 7384904 - DNA, 22 bp, Homo sapiens
gaaatactgtaaagttattatt

SEQ ID NO: 7384905 - DNA, 22 bp, Homo sapiens
gaaatagaagctgccaatttct

SEQ ID NO: 7384906 - DNA, 22 bp, Homo sapiens
gaaatagacactttctatgaat

SEQ ID NO: 7384907 - DNA, 22 bp, Homo sapiens
gaaatacagttgggaggaggta

SEQ ID NO: 7384908 - DNA, 22 bp, Homo sapiens
gaaaatgttagcttcatagtca

SEQ ID NO: 7384909 - DNA, 22 bp, Homo sapiens
gaaaatgttagcttcatagtca

SEQ ID NO: 7384910 - DNA, 22 bp, Homo sapiens
gaaacaggtggcaggctagatt

SEQ ID NO: 7384911 - DNA, 22 bp, Homo sapiens
gaaacatacgatttaggagaaa

SEQ ID NO: 7384912 - DNA, 22 bp, Homo sapiens
gaaacattcatatgagaaacct

SEQ ID NO: 7384913 - DNA, 22 bp, Homo sapiens
gaaacattcagtcaacagtgtt

SEQ ID NO: 7384914 - DNA, 20 bp, Homo sapiens
gaaacattggcagcaactga

SEQ ID NO: 7384915 - DNA, 22 bp, Homo sapiens
gaaacattcatatgagaaacct

SEQ ID NO: 7384916 - DNA, 22 bp, Homo sapiens
gaaacattgagcagaaggagaa

SEQ ID NO: 7384917 - DNA, 22 bp, Homo sapiens
gaaacattggtctgccccttat

SEQ ID NO: 7384918 - DNA, 22 bp, Homo sapiens
gaaacattgtgttctacagatt

SEQ ID NO: 7384919 - DNA, 22 bp, Homo sapiens
gaaacatttgttgagtacttgc

SEQ ID NO: 7384920 - DNA, 22 bp, Homo sapiens
gaaacatttgttgagtacttgc

SEQ ID NO: 7384921 - DNA, 22 bp, Homo sapiens
atgacaggaataactatgatgg

SEQ ID NO: 7384922 - DNA, 22 bp, Homo sapiens
atgacagcattttcttctaagg

SEQ ID NO: 7384923 - DNA, 22 bp, Homo sapiens
atctggctcacttagtctagga

SEQ ID NO: 7384924 - DNA, 22 bp, Homo sapiens
atctggctattgacatgttata

SEQ ID NO: 7384925 - DNA, 22 bp, Homo sapiens
ctttcctagaaatatatactta

SEQ ID NO: 7384926 - DNA, 22 bp, Homo sapiens
ctttcccacgcagtggatgaga

SEQ ID NO: 7384927 - DNA, 22 bp, Homo sapiens
cttctttaatgtatacaaaaga

SEQ ID NO: 7384928 - DNA, 22 bp, Homo sapiens
cttctttaatgtatacaaaaga

SEQ ID NO: 7384929 - DNA, 22 bp, Homo sapiens
atgaactgcagtataaacttgg

SEQ ID NO: 7384930 - DNA, 22 bp, Homo sapiens
atgaactgagcttaattgctga

SEQ ID NO: 7384931 - DNA, 22 bp, Homo sapiens
atgaacatgtgactcagacctg

SEQ ID NO: 7384932 - DNA, 22 bp, Homo sapiens
ctttctgaaagacattttaact

SEQ ID NO: 7384933 - DNA, 22 bp, Homo sapiens
atgaaacagagtacttaatata

SEQ ID NO: 7384934 - DNA, 22 bp, Homo sapiens
atgaaaatgtacatgtgtataa

SEQ ID NO: 7384935 - DNA, 22 bp, Homo sapiens
atgaaaatactgtggttgatag

SEQ ID NO: 7384936 - DNA, 22 bp, Homo sapiens
atgaaaatgtacatgtgtataa

SEQ ID NO: 7384937 - DNA, 22 bp, Homo sapiens
atgaaattaatcaacacataca

SEQ ID NO: 7384938 - DNA, 22 bp, Homo sapiens
atgaacagtacaaagcacagac

SEQ ID NO: 7384939 - DNA, 20 bp, Homo sapiens
atgaaattcctgttttctga

SEQ ID NO: 7384940 - DNA, 22 bp, Homo sapiens
cagcagcttttgcattctcatt

SEQ ID NO: 7384941 - DNA, 22 bp, Homo sapiens
cagcagcttctgttgatcagaa

SEQ ID NO: 7384942 - DNA, 22 bp, Homo sapiens
cagcagctttgccaagtcagcc

SEQ ID NO: 7384943 - DNA, 20 bp, Homo sapiens
cagcaggaaaagtgcctcag

SEQ ID NO: 7384944 - DNA, 22 bp, Homo sapiens
cagcaggaaggtttcccctgca

SEQ ID NO: 7384945 - DNA, 22 bp, Homo sapiens
cagcaggacatggaggagtaaa

SEQ ID NO: 7384946 - DNA, 22 bp, Homo sapiens
cagcagctggtgagacacagcc

SEQ ID NO: 7384947 - DNA, 22 bp, Homo sapiens
cagcagctgcgtgcccaggccg

SEQ ID NO: 7384948 - DNA, 22 bp, Homo sapiens
cagcaggcggcccgcgggcccg

SEQ ID NO: 7384949 - DNA, 22 bp, Homo sapiens
gtcccagagagcactagtccat

SEQ ID NO: 7384950 - DNA, 22 bp, Homo sapiens
cagcccaggctcagatgttggg

SEQ ID NO: 7384951 - DNA, 22 bp, Homo sapiens
cagccaggttcaagtccttata

SEQ ID NO: 7384952 - DNA, 22 bp, Homo sapiens
cagccagggagggcaaatgaga

SEQ ID NO: 7384953 - DNA, 22 bp, Homo sapiens
gtctgtacccacgtcctgctag

SEQ ID NO: 7384954 - DNA, 22 bp, Homo sapiens
cagccctcatcccgcctgcgtt

SEQ ID NO: 7384955 - DNA, 22 bp, Homo sapiens
gtctgtctcctgggtgcgcacc

SEQ ID NO: 7384956 - DNA, 22 bp, Homo sapiens
gtctgtctcctgggtgcgcacc

SEQ ID NO: 7384957 - DNA, 22 bp, Homo sapiens
gtctgtctctctccagagtgca

SEQ ID NO: 7384958 - DNA, 22 bp, Homo sapiens
gtctgtctgccaggttaggctg

SEQ ID NO: 7384959 - DNA, 22 bp, Homo sapiens
gtctgtctgttgttgagaagca

SEQ ID NO: 7384960 - DNA, 22 bp, Homo sapiens
gtctgtctgttgttgagaagca

SEQ ID NO: 7384961 - DNA, 22 bp, Homo sapiens
gtctgcttttctgccctttcat

SEQ ID NO: 7384962 - DNA, 22 bp, Homo sapiens
gtcccttcctcattccacttta

SEQ ID NO: 7384963 - DNA, 22 bp, Homo sapiens
gtccctgggtctaaggcagtaa

SEQ ID NO: 7384964 - DNA, 22 bp, Homo sapiens
gtccctggggaatcagctggag

SEQ ID NO: 7384965 - DNA, 19 bp, Homo sapiens
gtccctgggcagaggcacc

SEQ ID NO: 7384966 - DNA, 22 bp, Homo sapiens
cagccaggcctggtgaccaaag

SEQ ID NO: 7384967 - DNA, 22 bp, Homo sapiens
cagcctgtagaatacagtaaat

SEQ ID NO: 7384968 - DNA, 22 bp, Homo sapiens
cagcctgtctgggcagagtgga

SEQ ID NO: 7384969 - DNA, 22 bp, Homo sapiens
cagcctgtagtctggtccaggt

SEQ ID NO: 7384970 - DNA, 22 bp, Homo sapiens
cagcctgtagtctggtccaggt

SEQ ID NO: 7384971 - DNA, 22 bp, Homo sapiens
cagcctgtcggctccttcattc

SEQ ID NO: 7384972 - DNA, 22 bp, Homo sapiens
cagcctgctagggcaatgcctt

SEQ ID NO: 7384973 - DNA, 22 bp, Homo sapiens
cagcctggacagcgaccagagt

SEQ ID NO: 7384974 - DNA, 22 bp, Homo sapiens
gtgcccagtcctgccttgacag

SEQ ID NO: 7384975 - DNA, 22 bp, Homo sapiens
cagcctgtggcagaggtctaat

SEQ ID NO: 7384976 - DNA, 22 bp, Homo sapiens
cagctactcctcccatgacttc

SEQ ID NO: 7384977 - DNA, 22 bp, Homo sapiens
cagctagcggtgctggcggctc

SEQ ID NO: 7384978 - DNA, 22 bp, Homo sapiens
cagccctgccatggagcctcct

SEQ ID NO: 7384979 - DNA, 23 bp, Homo sapiens
cagccctgaaatcgaggtgacac

SEQ ID NO: 7384980 - DNA, 23 bp, Homo sapiens
cagccctgaaatcgaggtgacac

SEQ ID NO: 7384981 - DNA, 22 bp, Homo sapiens
cagccctgctcttagtgtctcc

SEQ ID NO: 7384982 - DNA, 22 bp, Homo sapiens
cagccctgctggcaatgatgag

SEQ ID NO: 7384983 - DNA, 22 bp, Homo sapiens
cagcctgcatttgtatctgtat

SEQ ID NO: 7384984 - DNA, 16 bp, Homo sapiens
cagcctgcagtggtca

SEQ ID NO: 7384985 - DNA, 22 bp, Homo sapiens
cagccctggaacagctgactca

SEQ ID NO: 7384986 - DNA, 22 bp, Homo sapiens
cagccctggcagctttcagggt

SEQ ID NO: 7384987 - DNA, 22 bp, Homo sapiens
cagccctggcccaggtgcctta

SEQ ID NO: 7384988 - DNA, 22 bp, Homo sapiens
gtgcccagttgaggccaggact

SEQ ID NO: 7384989 - DNA, 22 bp, Homo sapiens
gtgcccagtgcaggcccgcagg

SEQ ID NO: 7384990 - DNA, 22 bp, Homo sapiens
ggggagcaatagttgaggtgtg

SEQ ID NO: 7384991 - DNA, 22 bp, Homo sapiens
ggggagcagaagcagcaacaac

SEQ ID NO: 7384992 - DNA, 22 bp, Homo sapiens
ggggagcagaagcagcaacaac

SEQ ID NO: 7384993 - DNA, 22 bp, Homo sapiens
ggggagcaattgcccccttaga

SEQ ID NO: 7384994 - DNA, 18 bp, Homo sapiens
ggggagcagactgaactc

SEQ ID NO: 7384995 - DNA, 22 bp, Homo sapiens
ggggagcaggctgggctgtctg

SEQ ID NO: 7384996 - DNA, 22 bp, Homo sapiens
ggggagagtcctttccagttcc

SEQ ID NO: 7384997 - DNA, 22 bp, Homo sapiens
ggggagagtattttattcaagt

SEQ ID NO: 7384998 - DNA, 22 bp, Homo sapiens
ggggagagtattttattcaagt

SEQ ID NO: 7384999 - DNA, 19 bp, Homo sapiens
cagaggcaccaggtataga

SEQ ID NO: 7385000 - DNA, 19 bp, Homo sapiens
cagaggcaccaggtataga

SEQ ID NO: 7385001 - DNA, 16 bp, Homo sapiens
cagaggcacctggctc

SEQ ID NO: 7385002 - DNA, 16 bp, Homo sapiens
cagaggcacctggctc

SEQ ID NO: 7385003 - DNA, 22 bp, Homo sapiens
cagaggcacagtgcgggccact

SEQ ID NO: 7385004 - DNA, 22 bp, Homo sapiens
cagaggcacagtgcgggccact

SEQ ID NO: 7385005 - DNA, 19 bp, Homo sapiens
cagaggcaccaggtataga

SEQ ID NO: 7385006 - DNA, 22 bp, Homo sapiens
cagaggcacagcttcttttaat

SEQ ID NO: 7385007 - DNA, 22 bp, Homo sapiens
cagaggcacagcttcttttaat

SEQ ID NO: 7385008 - DNA, 22 bp, Homo sapiens
cagaggcacaagaaagcaaggc

SEQ ID NO: 7385009 - DNA, 22 bp, Homo sapiens
cagaggcacaagaaagcaaggc

SEQ ID NO: 7385010 - DNA, 21 bp, Homo sapiens
cagagggcttttctctgttct

SEQ ID NO: 7385011 - DNA, 22 bp, Homo sapiens
cagagggctgtgtaaggatgtt

SEQ ID NO: 7385012 - DNA, 22 bp, Homo sapiens
cagagggctcttggctgcctgc

SEQ ID NO: 7385013 - DNA, 22 bp, Homo sapiens
ggtcattttcactttcaagtta

SEQ ID NO: 7385014 - DNA, 22 bp, Homo sapiens
cagagtcagctagtcttgggat

SEQ ID NO: 7385015 - DNA, 22 bp, Homo sapiens
cagagtctggactgcaggctcc

SEQ ID NO: 7385016 - DNA, 22 bp, Homo sapiens
cagaggtacaagctaagttggg

SEQ ID NO: 7385017 - DNA, 22 bp, Homo sapiens
cagaggtacagccattgaagat

SEQ ID NO: 7385018 - DNA, 22 bp, Homo sapiens
cagaggtaccagcagcctctgg

SEQ ID NO: 7385019 - DNA, 22 bp, Homo sapiens
ggtcagtgagacaatttaagcc

SEQ ID NO: 7385020 - DNA, 22 bp, Homo sapiens
ggtcagtgtttcatctgtgaaa

SEQ ID NO: 7385021 - DNA, 22 bp, Homo sapiens
ggtcagtgtatgtattgataag

SEQ ID NO: 7385022 - DNA, 22 bp, Homo sapiens
ggtcagtggagccggaaagacc

SEQ ID NO: 7385023 - DNA, 22 bp, Homo sapiens
ggtcagtgctgccagagtgacc

SEQ ID NO: 7385024 - DNA, 22 bp, Homo sapiens
ggtcagtggacaaaggagtttc

SEQ ID NO: 7385025 - DNA, 22 bp, Homo sapiens
ggtcagtggccaggaagcagtc

SEQ ID NO: 7385026 - DNA, 22 bp, Homo sapiens
ggtgctgatgaagatgtagcct

SEQ ID NO: 7385027 - DNA, 22 bp, Homo sapiens
ggtgctgactgaggatggcttg

SEQ ID NO: 7385028 - DNA, 22 bp, Homo sapiens
cagcaaggactgggcatgtgaa

SEQ ID NO: 7385029 - DNA, 19 bp, Homo sapiens
ggtgctgacatcatgcttt

SEQ ID NO: 7385030 - DNA, 22 bp, Homo sapiens
ggtgctgacattcagagtctgg

SEQ ID NO: 7385031 - DNA, 22 bp, Homo sapiens
ggtgctgatgttattgatgctg

SEQ ID NO: 7385032 - DNA, 22 bp, Homo sapiens
ggtgctgattaagaactgtata

SEQ ID NO: 7385033 - DNA, 21 bp, Homo sapiens
cagcaaggaagtcgagtaggt

SEQ ID NO: 7385034 - DNA, 22 bp, Homo sapiens
cagcaagatggtgaatgagacg

SEQ ID NO: 7385035 - DNA, 22 bp, Homo sapiens
ggtgacgaatccatagcatcga

SEQ ID NO: 7385036 - DNA, 22 bp, Homo sapiens
ggtgacattatcattattttaa

SEQ ID NO: 7385037 - DNA, 22 bp, Homo sapiens
ggtgacatgcacctatcccttg

SEQ ID NO: 7385038 - DNA, 22 bp, Homo sapiens
ggtgacatctagagacatccaa

SEQ ID NO: 7385039 - DNA, 22 bp, Homo sapiens
ggtgacatcagtaaccgtggtt

SEQ ID NO: 7385040 - DNA, 22 bp, Homo sapiens
ggtgacatagttacttcaggct

SEQ ID NO: 7385041 - DNA, 22 bp, Homo sapiens
ggtgacctcacctggtcccacc

SEQ ID NO: 7385042 - DNA, 22 bp, Homo sapiens
ggtgacctcacctggtcccacc

SEQ ID NO: 7385043 - DNA, 22 bp, Homo sapiens
ggtgacagttccggaggtacag

SEQ ID NO: 7385044 - DNA, 22 bp, Homo sapiens
cagagctggggactgttggatg

SEQ ID NO: 7385045 - DNA, 22 bp, Homo sapiens
cagaggagaattgcgggatcat

SEQ ID NO: 7385046 - DNA, 22 bp, Homo sapiens
cagaggacttcccactcatctg

SEQ ID NO: 7385047 - DNA, 22 bp, Homo sapiens
cagaggcaaaagaggtggaggt

SEQ ID NO: 7385048 - DNA, 22 bp, Homo sapiens
cagaggcaaaagaggtggaggt

SEQ ID NO: 7385049 - DNA, 22 bp, Homo sapiens
cagaggcaaaagaggtggaggt

SEQ ID NO: 7385050 - DNA, 20 bp, Homo sapiens
cagaggcaaggagacttgga

SEQ ID NO: 7385051 - DNA, 20 bp, Homo sapiens
cagaggcaaggagacttgga

SEQ ID NO: 7385052 - DNA, 22 bp, Homo sapiens
gggctgacgaaggccatgtgtg

SEQ ID NO: 7385053 - DNA, 22 bp, Homo sapiens
cagagcctcatcatccactcca

SEQ ID NO: 7385054 - DNA, 22 bp, Homo sapiens
gggccaccccactgcccacgct

SEQ ID NO: 7385055 - DNA, 22 bp, Homo sapiens
gggccagacccttggcgatctg

SEQ ID NO: 7385056 - DNA, 22 bp, Homo sapiens
gggccagagcttggcagctggg

SEQ ID NO: 7385057 - DNA, 22 bp, Homo sapiens
gggcaggtatttatcttctatt

SEQ ID NO: 7385058 - DNA, 22 bp, Homo sapiens
cagagacaggagtgctcccagt

SEQ ID NO: 7385059 - DNA, 22 bp, Homo sapiens
gggcagcatcaggaggggcttt

SEQ ID NO: 7385060 - DNA, 22 bp, Homo sapiens
gggcagcatcaggaggggcttt

SEQ ID NO: 7385061 - DNA, 22 bp, Homo sapiens
gggcagcagagccctgccgagt

SEQ ID NO: 7385062 - DNA, 22 bp, Homo sapiens
gggcagcagaggatcccttaat

SEQ ID NO: 7385063 - DNA, 22 bp, Homo sapiens
gggcagcattctgtgggcaggt

SEQ ID NO: 7385064 - DNA, 22 bp, Homo sapiens
gggcagcattctgtgggcaggt

SEQ ID NO: 7385065 - DNA, 22 bp, Homo sapiens
gggcagcatgtcactagcatgg

SEQ ID NO: 7385066 - DNA, 22 bp, Homo sapiens
cagagacaggaatcagctgcag

SEQ ID NO: 7385067 - DNA, 22 bp, Homo sapiens
cagagacagcaagttgatttcc

SEQ ID NO: 7385068 - DNA, 22 bp, Homo sapiens
cagaccatcttgaagcaaactg

SEQ ID NO: 7385069 - DNA, 23 bp, Homo sapiens
cagaccctcaatccacttgtttt

SEQ ID NO: 7385070 - DNA, 21 bp, Homo sapiens
cagaccctctagaggccacct

SEQ ID NO: 7385071 - DNA, 21 bp, Homo sapiens
cagaccctctagaggccacct

SEQ ID NO: 7385072 - DNA, 22 bp, Homo sapiens
cagaccctcttctattggtggg

SEQ ID NO: 7385073 - DNA, 22 bp, Homo sapiens
cagaccctgggccacagaggag

SEQ ID NO: 7385074 - DNA, 22 bp, Homo sapiens
cagaccctgggccacagaggag

SEQ ID NO: 7385075 - DNA, 22 bp, Homo sapiens
cagaccctgggccacagaggag

SEQ ID NO: 7385076 - DNA, 22 bp, Homo sapiens
cagaccctgggccacagaggag

SEQ ID NO: 7385077 - DNA, 22 bp, Homo sapiens
cagacccttttctgagaggacc

SEQ ID NO: 7385078 - DNA, 22 bp, Homo sapiens
ggcttcaccaggtgcatgcatg

SEQ ID NO: 7385079 - DNA, 22 bp, Homo sapiens
ggcttcaaatggagcaaccaga

SEQ ID NO: 7385080 - DNA, 22 bp, Homo sapiens
ggcttcagatttctcagttgtt

SEQ ID NO: 7385081 - DNA, 22 bp, Homo sapiens
cagactctcttccatgcatcac

SEQ ID NO: 7385082 - DNA, 21 bp, Homo sapiens
caataaactgcacattgagac

SEQ ID NO: 7385083 - DNA, 22 bp, Homo sapiens
caataaagaagatttttgcaat

SEQ ID NO: 7385084 - DNA, 22 bp, Homo sapiens
caatgtcttctatagttactca

SEQ ID NO: 7385085 - DNA, 22 bp, Homo sapiens
caatgtctgggagacctgtgat

SEQ ID NO: 7385086 - DNA, 21 bp, Homo sapiens
caatgtctgctctctgcctag

SEQ ID NO: 7385087 - DNA, 21 bp, Homo sapiens
caatgtctgctctctgcctag

SEQ ID NO: 7385088 - DNA, 21 bp, Homo sapiens
caatgtctgctctctgcctag

SEQ ID NO: 7385089 - DNA, 22 bp, Homo sapiens
caatgtgtgtgtttttctcaac

SEQ ID NO: 7385090 - DNA, 22 bp, Homo sapiens
caatgtgtgtgtttttctcaac

SEQ ID NO: 7385091 - DNA, 22 bp, Homo sapiens
caatgtcagagaagctcatatc

SEQ ID NO: 7385092 - DNA, 22 bp, Homo sapiens
caatgtctgaccgttttgccca

SEQ ID NO: 7385093 - DNA, 22 bp, Homo sapiens
caatgtctagtttcccaaatcc

SEQ ID NO: 7385094 - DNA, 22 bp, Homo sapiens
caatgtcaaggagaccaaaacg

SEQ ID NO: 7385095 - DNA, 22 bp, Homo sapiens
caatgtatcaagaagcatcagt

SEQ ID NO: 7385096 - DNA, 18 bp, Homo sapiens
gctttgcagaaatacaga

SEQ ID NO: 7385097 - DNA, 22 bp, Homo sapiens
gctttgcccaagggccctaccc

SEQ ID NO: 7385098 - DNA, 22 bp, Homo sapiens
gctttgcccctttagtgggtgc

SEQ ID NO: 7385099 - DNA, 22 bp, Homo sapiens
gctttgcctccaaagaaaaagt

SEQ ID NO: 7385100 - DNA, 22 bp, Homo sapiens
gctttgccacattcttcacatt

SEQ ID NO: 7385101 - DNA, 22 bp, Homo sapiens
gctttgcctgtagcattggcct

SEQ ID NO: 7385102 - DNA, 22 bp, Homo sapiens
gctttgccttgaactctcatgt

SEQ ID NO: 7385103 - DNA, 22 bp, Homo sapiens
gctttgcctgccatatggggtc

SEQ ID NO: 7385104 - DNA, 22 bp, Homo sapiens
gctttgcctcttctccttccag

SEQ ID NO: 7385105 - DNA, 22 bp, Homo sapiens
gctttcttatttagaagatttg

SEQ ID NO: 7385106 - DNA, 22 bp, Homo sapiens
gctttcttcatactcaagcatc

SEQ ID NO: 7385107 - DNA, 22 bp, Homo sapiens
gctttcttggttctgcaggggc

SEQ ID NO: 7385108 - DNA, 22 bp, Homo sapiens
gctttcttttcaagaatgtatt

SEQ ID NO: 7385109 - DNA, 22 bp, Homo sapiens
caagtatatttgaacatgtaaa

SEQ ID NO: 7385110 - DNA, 22 bp, Homo sapiens
caagtaaagaatcacatttctt

SEQ ID NO: 7385111 - DNA, 22 bp, Homo sapiens
caagtaaagaatcacatttctt

SEQ ID NO: 7385112 - DNA, 22 bp, Homo sapiens
caaggttattatgtgcatctgt

SEQ ID NO: 7385113 - DNA, 22 bp, Homo sapiens
caaggtgatacttacattagtg

SEQ ID NO: 7385114 - DNA, 22 bp, Homo sapiens
caagtcaactcaaattgttatc

SEQ ID NO: 7385115 - DNA, 22 bp, Homo sapiens
caagtcaactcaaattgttatc

SEQ ID NO: 7385116 - DNA, 22 bp, Homo sapiens
gctgttctgcaccagacttcag

SEQ ID NO: 7385117 - DNA, 22 bp, Homo sapiens
gctgttctgcgtcccaggctgg

SEQ ID NO: 7385118 - DNA, 22 bp, Homo sapiens
gctgttctgtccccatgggtaa

SEQ ID NO: 7385119 - DNA, 22 bp, Homo sapiens
gctgttctctgtaacatgcatt

SEQ ID NO: 7385120 - DNA, 20 bp, Homo sapiens
gctgttctgaagcagaaggc

SEQ ID NO: 7385121 - DNA, 19 bp, Homo sapiens
gctgttctgaccatcaccc

SEQ ID NO: 7385122 - DNA, 22 bp, Homo sapiens
gctgttctagcttcagtttcgc

SEQ ID NO: 7385123 - DNA, 22 bp, Homo sapiens
gctgttctaggagctgtgagca

SEQ ID NO: 7385124 - DNA, 22 bp, Homo sapiens
gctgttctccgatgaccccgtg

SEQ ID NO: 7385125 - DNA, 22 bp, Homo sapiens
caagtttaaggcactgataagt

SEQ ID NO: 7385126 - DNA, 22 bp, Homo sapiens
gctgttctttgcatctctggtg

SEQ ID NO: 7385127 - DNA, 22 bp, Homo sapiens
gctgttctttggtcaaaggtat

SEQ ID NO: 7385128 - DNA, 18 bp, Homo sapiens
gctgttcttcgcactggc

SEQ ID NO: 7385129 - DNA, 22 bp, Homo sapiens
gctgttctttcagcccagggct

SEQ ID NO: 7385130 - DNA, 21 bp, Homo sapiens
gctgttctttcagctggtctt

SEQ ID NO: 7385131 - DNA, 22 bp, Homo sapiens
gctggaggaggaagtgtgaggg

SEQ ID NO: 7385132 - DNA, 22 bp, Homo sapiens
caagccagtgacagccagggaa

SEQ ID NO: 7385133 - DNA, 22 bp, Homo sapiens
gctggaggatggactggaagaa

SEQ ID NO: 7385134 - DNA, 22 bp, Homo sapiens
gctggaggatcacttgagccca

SEQ ID NO: 7385135 - DNA, 22 bp, Homo sapiens
caagccagctcctgccacagag

SEQ ID NO: 7385136 - DNA, 22 bp, Homo sapiens
caagccagtcagctcagtagat

SEQ ID NO: 7385137 - DNA, 22 bp, Homo sapiens
caagcatactgtgagagtttta

SEQ ID NO: 7385138 - DNA, 22 bp, Homo sapiens
caaatgtatgttttcctatgta

SEQ ID NO: 7385139 - DNA, 22 bp, Homo sapiens
caaatgtataaatgtactttct

SEQ ID NO: 7385140 - DNA, 22 bp, Homo sapiens
caaatgtggtttctcagcattc

SEQ ID NO: 7385141 - DNA, 22 bp, Homo sapiens
caaatgtgtaaggaagtgttag

SEQ ID NO: 7385142 - DNA, 22 bp, Homo sapiens
caaatgtggtttctcagcattc

SEQ ID NO: 7385143 - DNA, 22 bp, Homo sapiens
caagcaggaggagaagtttctg

SEQ ID NO: 7385144 - DNA, 22 bp, Homo sapiens
caagatttaagagtcagccttg

SEQ ID NO: 7385145 - DNA, 22 bp, Homo sapiens
caaggcaggaagcctgtcttat

SEQ ID NO: 7385146 - DNA, 22 bp, Homo sapiens
caaggccctgcaacctgacttg

SEQ ID NO: 7385147 - DNA, 22 bp, Homo sapiens
caaggccctgcaacctgacttg

SEQ ID NO: 7385148 - DNA, 21 bp, Homo sapiens
gctggctgtcccagggaagca

SEQ ID NO: 7385149 - DNA, 22 bp, Homo sapiens
gctggctggctgtgcaaaggca

SEQ ID NO: 7385150 - DNA, 22 bp, Homo sapiens
gctggctgtatcacctggccag

SEQ ID NO: 7385151 - DNA, 22 bp, Homo sapiens
gctggctgtatcacctggccag

SEQ ID NO: 7385152 - DNA, 22 bp, Homo sapiens
cacaggaatcagcattaatggc

SEQ ID NO: 7385153 - DNA, 22 bp, Homo sapiens
cacaggaaggccttctcacaat

SEQ ID NO: 7385154 - DNA, 22 bp, Homo sapiens
ggaggcagaatagagtgtgggt

SEQ ID NO: 7385155 - DNA, 22 bp, Homo sapiens
ggaggccaaggcaggtggatca

SEQ ID NO: 7385156 - DNA, 22 bp, Homo sapiens
ggaggccaaggcaggcggatca

SEQ ID NO: 7385157 - DNA, 22 bp, Homo sapiens
ggaggccaaggagggcggatca

SEQ ID NO: 7385158 - DNA, 22 bp, Homo sapiens
ggaggcaggaaagacaggttca

SEQ ID NO: 7385159 - DNA, 22 bp, Homo sapiens
ggaggcaggaaagacaggttca

SEQ ID NO: 7385160 - DNA, 22 bp, Homo sapiens
ggaggcaggaaagacaggttca

SEQ ID NO: 7385161 - DNA, 22 bp, Homo sapiens
ggaggccaaggaggagcttgcc

SEQ ID NO: 7385162 - DNA, 22 bp, Homo sapiens
ggaggccaaagtgtgggcggct

SEQ ID NO: 7385163 - DNA, 22 bp, Homo sapiens
cacaggcttgtcagcatgaggc

SEQ ID NO: 7385164 - DNA, 19 bp, Homo sapiens
ggagccgccgcccttcatt

SEQ ID NO: 7385165 - DNA, 22 bp, Homo sapiens
ggagcaggcagggccgtgtctg

SEQ ID NO: 7385166 - DNA, 22 bp, Homo sapiens
ggagcctgcgggagctcccatt

SEQ ID NO: 7385167 - DNA, 19 bp, Homo sapiens
ggagcctggagcacgtgcc

SEQ ID NO: 7385168 - DNA, 23 bp, Homo sapiens
ggagctgctgttgggggagctgc

SEQ ID NO: 7385169 - DNA, 22 bp, Homo sapiens
ggagcctgagcggcccagggcc

SEQ ID NO: 7385170 - DNA, 22 bp, Homo sapiens
ggagcctgacagtgcccagcat

SEQ ID NO: 7385171 - DNA, 22 bp, Homo sapiens
ggagcctgacagtgcccagcat

SEQ ID NO: 7385172 - DNA, 22 bp, Homo sapiens
ggaaggggagctggaaagggta

SEQ ID NO: 7385173 - DNA, 22 bp, Homo sapiens
ggaaggggagctggaaagggta

SEQ ID NO: 7385174 - DNA, 22 bp, Homo sapiens
cacacagctcaggggcactgcc

SEQ ID NO: 7385175 - DNA, 22 bp, Homo sapiens
cacacagctcaggggcactgcc

SEQ ID NO: 7385176 - DNA, 22 bp, Homo sapiens
ggctggtgttgagtgcctgtag

SEQ ID NO: 7385177 - DNA, 22 bp, Homo sapiens
ggcttaaaaggaaaatgagagt

SEQ ID NO: 7385178 - DNA, 22 bp, Homo sapiens
ggcttaaaactttgaaagtgtt

SEQ ID NO: 7385179 - DNA, 22 bp, Homo sapiens
ggcttaaagaattaacagagat

SEQ ID NO: 7385180 - DNA, 22 bp, Homo sapiens
ggcttaaagttttctagaataa

SEQ ID NO: 7385181 - DNA, 22 bp, Homo sapiens
ggctgtcttgggagctcccccg

SEQ ID NO: 7385182 - DNA, 23 bp, Homo sapiens
cagaaagtttgagaagatacatc

SEQ ID NO: 7385183 - DNA, 22 bp, Homo sapiens
cagaaaggtatgtgtgcctttg

SEQ ID NO: 7385184 - DNA, 22 bp, Homo sapiens
cagaaaggtatgtgtgcctttg

SEQ ID NO: 7385185 - DNA, 22 bp, Homo sapiens
cagaaaggtatgtgtgcctttg

SEQ ID NO: 7385186 - DNA, 22 bp, Homo sapiens
cagaaaggactttggttggctt

SEQ ID NO: 7385187 - DNA, 22 bp, Homo sapiens
cagaaaggacagagtgagggtg

SEQ ID NO: 7385188 - DNA, 22 bp, Homo sapiens
cagaaataaacttctcacatcg

SEQ ID NO: 7385189 - DNA, 23 bp, Homo sapiens
cagaaagtttgagaagatacatc

SEQ ID NO: 7385190 - DNA, 22 bp, Homo sapiens
cagaaataaagtggacagagta

SEQ ID NO: 7385191 - DNA, 22 bp, Homo sapiens
cagaaatagacaatggcagtgg

SEQ ID NO: 7385192 - DNA, 22 bp, Homo sapiens
cagaaagcgggatgcagcatgt

SEQ ID NO: 7385193 - DNA, 23 bp, Homo sapiens
cagaaagccctttccccacagta

SEQ ID NO: 7385194 - DNA, 22 bp, Homo sapiens
ggctgcctactttcccagagtt

SEQ ID NO: 7385195 - DNA, 22 bp, Homo sapiens
ggctgcctagacttggaatttc

SEQ ID NO: 7385196 - DNA, 22 bp, Homo sapiens
ggctgcctatagaattattagt

SEQ ID NO: 7385197 - DNA, 22 bp, Homo sapiens
ggctgcctagacttggaatttc

SEQ ID NO: 7385198 - DNA, 22 bp, Homo sapiens
ggctgcctaacccttaagtgtc

SEQ ID NO: 7385199 - DNA, 22 bp, Homo sapiens
cagaaaaggaagagctatgtaa

SEQ ID NO: 7385200 - DNA, 22 bp, Homo sapiens
ggctgccccagtgctcatggct

SEQ ID NO: 7385201 - DNA, 22 bp, Homo sapiens
ggctcagggaatgaggaagaat

SEQ ID NO: 7385202 - DNA, 22 bp, Homo sapiens
ggcctgtggtttctagtaggtt

SEQ ID NO: 7385203 - DNA, 22 bp, Homo sapiens
ggcctgaggccaccagcagccc

SEQ ID NO: 7385204 - DNA, 22 bp, Homo sapiens
ggcctgaggccaccagcagccc

SEQ ID NO: 7385205 - DNA, 20 bp, Homo sapiens
ggcctgagcatggctggcag

SEQ ID NO: 7385206 - DNA, 19 bp, Homo sapiens
ggcctgaggccacagatcc

SEQ ID NO: 7385207 - DNA, 22 bp, Homo sapiens
ggctgagcgtggctgccgtggg

SEQ ID NO: 7385208 - DNA, 22 bp, Homo sapiens
ggctccagggtacccctggatg

SEQ ID NO: 7385209 - DNA, 19 bp, Homo sapiens
cacatacagaaaagagtaa

SEQ ID NO: 7385210 - DNA, 22 bp, Homo sapiens
cacatacatgcacacctaaata

SEQ ID NO: 7385211 - DNA, 22 bp, Homo sapiens
cacatacttgtgtgtacatatg

SEQ ID NO: 7385212 - DNA, 22 bp, Homo sapiens
cacataaatggtgccatgtttt

SEQ ID NO: 7385213 - DNA, 22 bp, Homo sapiens
cacagttttgcccagggcttct

SEQ ID NO: 7385214 - DNA, 22 bp, Homo sapiens
cacagtttggttttgctgtaat

SEQ ID NO: 7385215 - DNA, 22 bp, Homo sapiens
cacagtgttccagagcagtggt

SEQ ID NO: 7385216 - DNA, 22 bp, Homo sapiens
ggaggtggaggttgcagtgagc

SEQ ID NO: 7385217 - DNA, 22 bp, Homo sapiens
cacagggaaccaaggctgggcc

SEQ ID NO: 7385218 - DNA, 22 bp, Homo sapiens
ggcaggcatggccactccctag

SEQ ID NO: 7385219 - DNA, 22 bp, Homo sapiens
ggcaggcatggggtctgccatt

SEQ ID NO: 7385220 - DNA, 22 bp, Homo sapiens
ggcaggcagtgtggtgtgaaac

SEQ ID NO: 7385221 - DNA, 22 bp, Homo sapiens
ggcaggcaggagctctgtctcc

SEQ ID NO: 7385222 - DNA, 22 bp, Homo sapiens
cacatttctaggaaattaaatg

SEQ ID NO: 7385223 - DNA, 22 bp, Homo sapiens
cacatttagaggttagcatggt

SEQ ID NO: 7385224 - DNA, 23 bp, Homo sapiens
ggccactgaattttctgcatctt

SEQ ID NO: 7385225 - DNA, 22 bp, Homo sapiens
ggccaagaatgataggctcagt

SEQ ID NO: 7385226 - DNA, 22 bp, Homo sapiens
ggccaagatggaaggagagatg

SEQ ID NO: 7385227 - DNA, 17 bp, Homo sapiens
ggcatttgtcaggcaga

SEQ ID NO: 7385228 - DNA, 22 bp, Homo sapiens
ggcattcaaagaatggtaatta

SEQ ID NO: 7385229 - DNA, 22 bp, Homo sapiens
ggcatttgagccattggcctgt

SEQ ID NO: 7385230 - DNA, 22 bp, Homo sapiens
ggccctgttagagctcccacaa

SEQ ID NO: 7385231 - DNA, 22 bp, Homo sapiens
ggccctgtgatggatgtattag

SEQ ID NO: 7385232 - DNA, 19 bp, Homo sapiens
ggccctgtaggatgtgagt

SEQ ID NO: 7385233 - DNA, 22 bp, Homo sapiens
ggccccaggtagaagatataga

SEQ ID NO: 7385234 - DNA, 22 bp, Homo sapiens
ggccctgtctgtctgcccagct

SEQ ID NO: 7385235 - DNA, 22 bp, Homo sapiens
ggccctgtcctggctgtctccg

SEQ ID NO: 7385236 - DNA, 22 bp, Homo sapiens
ggccactgctctccagcctggg

SEQ ID NO: 7385237 - DNA, 22 bp, Homo sapiens
ggccactgccctggctacaccg

SEQ ID NO: 7385238 - DNA, 22 bp, Homo sapiens
cacgcacgctgggtggaggcgc

SEQ ID NO: 7385239 - DNA, 22 bp, Homo sapiens
cacgaggccatctccttctgga

SEQ ID NO: 7385240 - DNA, 22 bp, Homo sapiens
ggccgtgctccaaagtcatcgt

SEQ ID NO: 7385241 - DNA, 22 bp, Homo sapiens
cacctgggtcattgctggtgtt

SEQ ID NO: 7385242 - DNA, 22 bp, Homo sapiens
tcttcccattagtaatgaagtg

SEQ ID NO: 7385243 - DNA, 21 bp, Homo sapiens
tcttcccattatgttccaatt

SEQ ID NO: 7385244 - DNA, 22 bp, Homo sapiens
tcttcctagaaggaagaaatct

SEQ ID NO: 7385245 - DNA, 19 bp, Homo sapiens
tcttccctggctgtcagtc

SEQ ID NO: 7385246 - DNA, 22 bp, Homo sapiens
ccaggcagggagctgtttggcc

SEQ ID NO: 7385247 - DNA, 22 bp, Homo sapiens
ccaggccagcgctggctggagg

SEQ ID NO: 7385248 - DNA, 22 bp, Homo sapiens
ccaggccagcctggagcatggc

SEQ ID NO: 7385249 - DNA, 22 bp, Homo sapiens
ccaggccagcaggcacacctgc

SEQ ID NO: 7385250 - DNA, 22 bp, Homo sapiens
tcttcccagaggaggtgccagc

SEQ ID NO: 7385251 - DNA, 22 bp, Homo sapiens
ccaggatggggagcagatagaa

SEQ ID NO: 7385252 - DNA, 22 bp, Homo sapiens
ccaggatgacccccactttcct

SEQ ID NO: 7385253 - DNA, 22 bp, Homo sapiens
tcttcacattcacgtaacatag

SEQ ID NO: 7385254 - DNA, 22 bp, Homo sapiens
tcttagaatgtcaactgatgtt

SEQ ID NO: 7385255 - DNA, 22 bp, Homo sapiens
ccaggagggaccgcggcatccc

SEQ ID NO: 7385256 - DNA, 22 bp, Homo sapiens
ccaggaggttgaggctgcagtg

SEQ ID NO: 7385257 - DNA, 22 bp, Homo sapiens
ccaggagggaggagttcctgag

SEQ ID NO: 7385258 - DNA, 22 bp, Homo sapiens
ccaggaggttgaggctgcagtg

SEQ ID NO: 7385259 - DNA, 22 bp, Homo sapiens
ccaggccagggctgcagcgagc

SEQ ID NO: 7385260 - DNA, 22 bp, Homo sapiens
ccaggccagggctgcagcgagc

SEQ ID NO: 7385261 - DNA, 22 bp, Homo sapiens
ccaggccaggagagcgaggttt

SEQ ID NO: 7385262 - DNA, 21 bp, Homo sapiens
ccaggccaggcctacggggat

SEQ ID NO: 7385263 - DNA, 22 bp, Homo sapiens
ccaggccattcccagagttgct

SEQ ID NO: 7385264 - DNA, 22 bp, Homo sapiens
ccaggcccaccttggccactta

SEQ ID NO: 7385265 - DNA, 22 bp, Homo sapiens
ccaggcccagggtactgaccaa

SEQ ID NO: 7385266 - DNA, 22 bp, Homo sapiens
tctttcaatccattcatatgtc

SEQ ID NO: 7385267 - DNA, 22 bp, Homo sapiens
ccaggcccccgagcagaagaca

SEQ ID NO: 7385268 - DNA, 22 bp, Homo sapiens
ccaggccccagggctggctttc

SEQ ID NO: 7385269 - DNA, 22 bp, Homo sapiens
ccaggcctggaccatgccaggg

SEQ ID NO: 7385270 - DNA, 22 bp, Homo sapiens
tctttcttcagccctgtaagat

SEQ ID NO: 7385271 - DNA, 22 bp, Homo sapiens
tctttcttattatgctcaatgt

SEQ ID NO: 7385272 - DNA, 22 bp, Homo sapiens
tctttcttattatgctcaatgt

SEQ ID NO: 7385273 - DNA, 22 bp, Homo sapiens
tctttcttgcaaggatgcagga

SEQ ID NO: 7385274 - DNA, 22 bp, Homo sapiens
tctttcttggtattctgagcta

SEQ ID NO: 7385275 - DNA, 22 bp, Homo sapiens
ccaggctctgcgctggacatgg

SEQ ID NO: 7385276 - DNA, 22 bp, Homo sapiens
ccaggctggagtgcaatggcgt

SEQ ID NO: 7385277 - DNA, 22 bp, Homo sapiens
tctttggctttgccacacccaa

SEQ ID NO: 7385278 - DNA, 22 bp, Homo sapiens
tctttggcttgtctcctcagtt

SEQ ID NO: 7385279 - DNA, 22 bp, Homo sapiens
tctttggccttaggagcccttg

SEQ ID NO: 7385280 - DNA, 22 bp, Homo sapiens
tctttgggagaaggggtcccag

SEQ ID NO: 7385281 - DNA, 22 bp, Homo sapiens
tctttggtcagaaagattacac

SEQ ID NO: 7385282 - DNA, 19 bp, Homo sapiens
ccaggactttgcagacact

SEQ ID NO: 7385283 - DNA, 22 bp, Homo sapiens
ccaggagaagcatctgagtgta

SEQ ID NO: 7385284 - DNA, 22 bp, Homo sapiens
ccaggacttcgaggctacagtg

SEQ ID NO: 7385285 - DNA, 20 bp, Homo sapiens
ccaggactgctggggactct

SEQ ID NO: 7385286 - DNA, 22 bp, Homo sapiens
ccaggacttattacagtataac

SEQ ID NO: 7385287 - DNA, 22 bp, Homo sapiens
tctggcctatttctgtcagatc

SEQ ID NO: 7385288 - DNA, 22 bp, Homo sapiens
tctggccctgctgctgtgagca

SEQ ID NO: 7385289 - DNA, 22 bp, Homo sapiens
ccagctgctgtgcagggaggct

SEQ ID NO: 7385290 - DNA, 22 bp, Homo sapiens
ccagctgctgcaccgtgcatgg

SEQ ID NO: 7385291 - DNA, 22 bp, Homo sapiens
ccagctgctgtgaggaccacag

SEQ ID NO: 7385292 - DNA, 22 bp, Homo sapiens
ccagctgctctcttctccgcca

SEQ ID NO: 7385293 - DNA, 22 bp, Homo sapiens
ccagctgctgacatgggcaggt

SEQ ID NO: 7385294 - DNA, 22 bp, Homo sapiens
ccagctgctatcatgccatttc

SEQ ID NO: 7385295 - DNA, 17 bp, Homo sapiens
ccagctgctccctcaga

SEQ ID NO: 7385296 - DNA, 21 bp, Homo sapiens
ccagctgctccttgaggttcc

SEQ ID NO: 7385297 - DNA, 22 bp, Homo sapiens
ccagctgctaacacaaaggagt

SEQ ID NO: 7385298 - DNA, 22 bp, Homo sapiens
ccagctgcggtctcccaaagtt

SEQ ID NO: 7385299 - DNA, 22 bp, Homo sapiens
ccagctgcgggcatcgagagtt

SEQ ID NO: 7385300 - DNA, 18 bp, Homo sapiens
ccagctgcgctgaaccga

SEQ ID NO: 7385301 - DNA, 21 bp, Homo sapiens
ccagctgcctgcactttggac

SEQ ID NO: 7385302 - DNA, 22 bp, Homo sapiens
ccagctgcccactatgtgttct

SEQ ID NO: 7385303 - DNA, 22 bp, Homo sapiens
ccagctgcctaagcaatccata

SEQ ID NO: 7385304 - DNA, 22 bp, Homo sapiens
ccagctgcccaagaggcatcct

SEQ ID NO: 7385305 - DNA, 22 bp, Homo sapiens
ccagctctgccaagcgtcagct

SEQ ID NO: 7385306 - DNA, 22 bp, Homo sapiens
ccagctctgattttgacctcca

SEQ ID NO: 7385307 - DNA, 22 bp, Homo sapiens
ccagctgcagaatgttggggaa

SEQ ID NO: 7385308 - DNA, 22 bp, Homo sapiens
ccagctgcatgacattaggtga

SEQ ID NO: 7385309 - DNA, 22 bp, Homo sapiens
ccagctgcatcctattcactgc

SEQ ID NO: 7385310 - DNA, 20 bp, Homo sapiens
ccagctgcagttcttaatga

SEQ ID NO: 7385311 - DNA, 20 bp, Homo sapiens
ccagctgcagttcttaatga

SEQ ID NO: 7385312 - DNA, 22 bp, Homo sapiens
ccagctgcaggggagcagtgga

SEQ ID NO: 7385313 - DNA, 22 bp, Homo sapiens
ccagctgcaggggagcagtgga

SEQ ID NO: 7385314 - DNA, 22 bp, Homo sapiens
ccagctgcaggtgttccagatg

SEQ ID NO: 7385315 - DNA, 22 bp, Homo sapiens
tctcagaattgtgtccactggg

SEQ ID NO: 7385316 - DNA, 22 bp, Homo sapiens
tctcagagaaatgtgtcaccat

SEQ ID NO: 7385317 - DNA, 19 bp, Homo sapiens
tctcagactgtgcttctgt

SEQ ID NO: 7385318 - DNA, 22 bp, Homo sapiens
tctcagactatagtagagattc

SEQ ID NO: 7385319 - DNA, 22 bp, Homo sapiens
tctcagactatagtagagattc

SEQ ID NO: 7385320 - DNA, 22 bp, Homo sapiens
tctcagaagggtggtgctggag

SEQ ID NO: 7385321 - DNA, 22 bp, Homo sapiens
ccagagagaaaatggagggcca

SEQ ID NO: 7385322 - DNA, 18 bp, Homo sapiens
tctggaacaacttcatgt

SEQ ID NO: 7385323 - DNA, 18 bp, Homo sapiens
tctggaacaacttcatgt

SEQ ID NO: 7385324 - DNA, 22 bp, Homo sapiens
tctggaaataaaattatagttg

SEQ ID NO: 7385325 - DNA, 22 bp, Homo sapiens
tctgctttcttgcgcagatgtg

SEQ ID NO: 7385326 - DNA, 22 bp, Homo sapiens
ccaggggaaacagggagcactc

SEQ ID NO: 7385327 - DNA, 22 bp, Homo sapiens
ccagggcttcagaggttttggc

SEQ ID NO: 7385328 - DNA, 22 bp, Homo sapiens
tgacaatagcgatttatcttgc

SEQ ID NO: 7385329 - DNA, 22 bp, Homo sapiens
tgacaagctttacagaattgaa

SEQ ID NO: 7385330 - DNA, 22 bp, Homo sapiens
ccaggctggagtgcagtggcac

SEQ ID NO: 7385331 - DNA, 22 bp, Homo sapiens
ccaggctggagtgcagtagtgt

SEQ ID NO: 7385332 - DNA, 22 bp, Homo sapiens
tgacaactttacaaaattcttc

SEQ ID NO: 7385333 - DNA, 22 bp, Homo sapiens
tgaatgatacagaattatgtag

SEQ ID NO: 7385334 - DNA, 22 bp, Homo sapiens
tgaggcagaaaatagcagttca

SEQ ID NO: 7385335 - DNA, 22 bp, Homo sapiens
tgaggcagaaattcctgttttc

SEQ ID NO: 7385336 - DNA, 22 bp, Homo sapiens
tgaggcagaaattcctgttttc

SEQ ID NO: 7385337 - DNA, 22 bp, Homo sapiens
tgaggcagcaattgattattca

SEQ ID NO: 7385338 - DNA, 22 bp, Homo sapiens
tgaggcagcaattgattattca

SEQ ID NO: 7385339 - DNA, 22 bp, Homo sapiens
tgaggcagagtaagatacatga

SEQ ID NO: 7385340 - DNA, 22 bp, Homo sapiens
tgaggcagatatttattgggtt

SEQ ID NO: 7385341 - DNA, 20 bp, Homo sapiens
tgagaaggggtcagctgtac

SEQ ID NO: 7385342 - DNA, 22 bp, Homo sapiens
ccaggggctggtgctgagctgg

SEQ ID NO: 7385343 - DNA, 22 bp, Homo sapiens
ccaggggctgcagatccatggt

SEQ ID NO: 7385344 - DNA, 22 bp, Homo sapiens
ccaggggctctcagggtgtgtg

SEQ ID NO: 7385345 - DNA, 22 bp, Homo sapiens
ccagggtaccccaagggcaggt

SEQ ID NO: 7385346 - DNA, 22 bp, Homo sapiens
ccagggtcacaaataactgcag

SEQ ID NO: 7385347 - DNA, 22 bp, Homo sapiens
ccatgcccttgtcatctccagg

SEQ ID NO: 7385348 - DNA, 22 bp, Homo sapiens
ccatgctctggggaggtcaagc

SEQ ID NO: 7385349 - DNA, 22 bp, Homo sapiens
ccatgctgaccctgtgcaggca

SEQ ID NO: 7385350 - DNA, 22 bp, Homo sapiens
ccatgtggggtcagtgtttggg

SEQ ID NO: 7385351 - DNA, 22 bp, Homo sapiens
tgaggtatgctgaactctgttt

SEQ ID NO: 7385352 - DNA, 22 bp, Homo sapiens
tgaggtatgatttacatgcagt

SEQ ID NO: 7385353 - DNA, 22 bp, Homo sapiens
tgaggtatgaggttctatgatc

SEQ ID NO: 7385354 - DNA, 22 bp, Homo sapiens
tgaggtattttttaaagcacaa

SEQ ID NO: 7385355 - DNA, 22 bp, Homo sapiens
tgaggtcagcccttcctatgat

SEQ ID NO: 7385356 - DNA, 22 bp, Homo sapiens
tgaggtagtaaaggtgttagtt

SEQ ID NO: 7385357 - DNA, 22 bp, Homo sapiens
tgaggtagtgcttgtcatgttt

SEQ ID NO: 7385358 - DNA, 20 bp, Homo sapiens
tgaggtatcaattcaaggca

SEQ ID NO: 7385359 - DNA, 22 bp, Homo sapiens
tgaggtatccagtgaagcagcc

SEQ ID NO: 7385360 - DNA, 22 bp, Homo sapiens
tgaggtagtttgttgtacagta

SEQ ID NO: 7385361 - DNA, 21 bp, Homo sapiens
tgaggtagtgtttgtcaagtt

SEQ ID NO: 7385362 - DNA, 22 bp, Homo sapiens
tgaggtagggaaggctggtatt

SEQ ID NO: 7385363 - DNA, 22 bp, Homo sapiens
ccatgcttaaataagaggcagc

SEQ ID NO: 7385364 - DNA, 22 bp, Homo sapiens
tgagggccgaggagctgtgggt

SEQ ID NO: 7385365 - DNA, 23 bp, Homo sapiens
tgaggctgattgatttttgctca

SEQ ID NO: 7385366 - DNA, 23 bp, Homo sapiens
tgaggctgattgatttttgctca

SEQ ID NO: 7385367 - DNA, 22 bp, Homo sapiens
tgagggctgcttccagagctag

SEQ ID NO: 7385368 - DNA, 22 bp, Homo sapiens
tgaggcagcctgcattaaagag

SEQ ID NO: 7385369 - DNA, 22 bp, Homo sapiens
tgaggcagcattcttcaagaca

SEQ ID NO: 7385370 - DNA, 22 bp, Homo sapiens
tgaggcagcaattgtattgtat

SEQ ID NO: 7385371 - DNA, 22 bp, Homo sapiens
tgaggcagcccactttccttag

SEQ ID NO: 7385372 - DNA, 22 bp, Homo sapiens
tgaggcagcccactttccttag

SEQ ID NO: 7385373 - DNA, 22 bp, Homo sapiens
ccattattataggaggctcatt

SEQ ID NO: 7385374 - DNA, 22 bp, Homo sapiens
ccattcactgaacaaggctaaa

SEQ ID NO: 7385375 - DNA, 22 bp, Homo sapiens
ccattaaagcaccactgtaata

SEQ ID NO: 7385376 - DNA, 22 bp, Homo sapiens
ccattaaaatggaatgtagtga

SEQ ID NO: 7385377 - DNA, 22 bp, Homo sapiens
tgattttacttagcatgatgtt

SEQ ID NO: 7385378 - DNA, 23 bp, Homo sapiens
tgattttaaaaagtaagttatca

SEQ ID NO: 7385379 - DNA, 23 bp, Homo sapiens
tgattttaaaaagtaagttatca

SEQ ID NO: 7385380 - DNA, 22 bp, Homo sapiens
tgcaaatattagcattcgatat

SEQ ID NO: 7385381 - DNA, 18 bp, Homo sapiens
tgcaaaggacactgagat

SEQ ID NO: 7385382 - DNA, 22 bp, Homo sapiens
tgcaaataaatttctgttcatt

SEQ ID NO: 7385383 - DNA, 23 bp, Homo sapiens
tgcaaataacaaggagtttaagg

SEQ ID NO: 7385384 - DNA, 22 bp, Homo sapiens
tgcacacatgtttacaagcatc

SEQ ID NO: 7385385 - DNA, 22 bp, Homo sapiens
tgcacacctctccaccactctc

SEQ ID NO: 7385386 - DNA, 22 bp, Homo sapiens
tgcacacatatgagcatgtgtg

SEQ ID NO: 7385387 - DNA, 22 bp, Homo sapiens
cccagacataacagcagagagg

SEQ ID NO: 7385388 - DNA, 22 bp, Homo sapiens
ccctgagagtgagtgccacctt

SEQ ID NO: 7385389 - DNA, 18 bp, Homo sapiens
ccctgagatgatgctgtg

SEQ ID NO: 7385390 - DNA, 22 bp, Homo sapiens
ccctgagatgcctcaccctagt

SEQ ID NO: 7385391 - DNA, 22 bp, Homo sapiens
tggagcagaaatggcctcttgt

SEQ ID NO: 7385392 - DNA, 22 bp, Homo sapiens
tggagcaggactgctgccctca

SEQ ID NO: 7385393 - DNA, 16 bp, Homo sapiens
tggagcaggcaggatg

SEQ ID NO: 7385394 - DNA, 22 bp, Homo sapiens
ccctgaggaaagggtggagggc

SEQ ID NO: 7385395 - DNA, 22 bp, Homo sapiens
ccctgaggaccaggaaggaggg

SEQ ID NO: 7385396 - DNA, 18 bp, Homo sapiens
ccctgaagggcaagataa

SEQ ID NO: 7385397 - DNA, 22 bp, Homo sapiens
ccctgacttgatctttgacttg

SEQ ID NO: 7385398 - DNA, 20 bp, Homo sapiens
ccctgagacaaaggaggggc

SEQ ID NO: 7385399 - DNA, 22 bp, Homo sapiens
ccctgagaagatcattgccacg

SEQ ID NO: 7385400 - DNA, 22 bp, Homo sapiens
ccctgagaggttgagtgtctgc

SEQ ID NO: 7385401 - DNA, 22 bp, Homo sapiens
ccctgagagcagggtctttctc

SEQ ID NO: 7385402 - DNA, 20 bp, Homo sapiens
ccctgagacgactgagctcc

SEQ ID NO: 7385403 - DNA, 20 bp, Homo sapiens
ccctgagacgactgagctcc

SEQ ID NO: 7385404 - DNA, 20 bp, Homo sapiens
ccctgagaccagagagcagc

SEQ ID NO: 7385405 - DNA, 22 bp, Homo sapiens
ccctctccctgcagaatgtggc

SEQ ID NO: 7385406 - DNA, 22 bp, Homo sapiens
ccctctcctggctgcatggagc

SEQ ID NO: 7385407 - DNA, 19 bp, Homo sapiens
ccctcttgcacaaagcaaa

SEQ ID NO: 7385408 - DNA, 22 bp, Homo sapiens
ccctcgccgcagctgcttcccg

SEQ ID NO: 7385409 - DNA, 22 bp, Homo sapiens
ccctcctctccctaagagtcac

SEQ ID NO: 7385410 - DNA, 22 bp, Homo sapiens
ccctcctctccctaagagtcac

SEQ ID NO: 7385411 - DNA, 22 bp, Homo sapiens
tgctgtgttaaatacaagcatg

SEQ ID NO: 7385412 - DNA, 23 bp, Homo sapiens
tgctggcttttatctggtcccta

SEQ ID NO: 7385413 - DNA, 22 bp, Homo sapiens
tgctggcttttccttcaggcag

SEQ ID NO: 7385414 - DNA, 22 bp, Homo sapiens
tgctggctttctgtccctggca

SEQ ID NO: 7385415 - DNA, 21 bp, Homo sapiens
tgctggccatgtgctgggcat

SEQ ID NO: 7385416 - DNA, 22 bp, Homo sapiens
tgctggcctcggcgctgggcct

SEQ ID NO: 7385417 - DNA, 21 bp, Homo sapiens
tgctggcctcaagggtgactt

SEQ ID NO: 7385418 - DNA, 22 bp, Homo sapiens
tgctggcctcggcgctgggcct

SEQ ID NO: 7385419 - DNA, 18 bp, Homo sapiens
cccggctaatttttggta

SEQ ID NO: 7385420 - DNA, 22 bp, Homo sapiens
tgctgggatatagcttctaggg

SEQ ID NO: 7385421 - DNA, 22 bp, Homo sapiens
ccccacccacctaagagaaact

SEQ ID NO: 7385422 - DNA, 22 bp, Homo sapiens
ccccaccctcgctccatttcgg

SEQ ID NO: 7385423 - DNA, 21 bp, Homo sapiens
tgctggccatgtgctgggcat

SEQ ID NO: 7385424 - DNA, 22 bp, Homo sapiens
ccccacaggtgtctgaggcagg

SEQ ID NO: 7385425 - DNA, 22 bp, Homo sapiens
ccccacagccgccagcagggag

SEQ ID NO: 7385426 - DNA, 22 bp, Homo sapiens
ccccacagtccgtgaggagcca

SEQ ID NO: 7385427 - DNA, 22 bp, Homo sapiens
ccccacactctttacattcata

SEQ ID NO: 7385428 - DNA, 22 bp, Homo sapiens
cccattcatcctcgcttccttc

SEQ ID NO: 7385429 - DNA, 22 bp, Homo sapiens
cccagtttcaactttccagtgg

SEQ ID NO: 7385430 - DNA, 22 bp, Homo sapiens
cccagggttgcctgcctctgct

SEQ ID NO: 7385431 - DNA, 22 bp, Homo sapiens
cccagggtggatgcaagcagca

SEQ ID NO: 7385432 - DNA, 22 bp, Homo sapiens
cccaggtagtgagaaatggagg

SEQ ID NO: 7385433 - DNA, 22 bp, Homo sapiens
cccaggtagttggaagagacaa

SEQ ID NO: 7385434 - DNA, 19 bp, Homo sapiens
cccagggtttcctctctcc

SEQ ID NO: 7385435 - DNA, 22 bp, Homo sapiens
cccagggtccctgctctctgtg

SEQ ID NO: 7385436 - DNA, 22 bp, Homo sapiens
cccagggtccggataaccctgg

SEQ ID NO: 7385437 - DNA, 22 bp, Homo sapiens
cccagggtgctaattaaatatg

SEQ ID NO: 7385438 - DNA, 22 bp, Homo sapiens
cccagggtgcggccctggctgg

SEQ ID NO: 7385439 - DNA, 22 bp, Homo sapiens
cccagggtagctgagctggcag

SEQ ID NO: 7385440 - DNA, 22 bp, Homo sapiens
cccaggggttctgagcagcagc

SEQ ID NO: 7385441 - DNA, 22 bp, Homo sapiens
cccagggtaatcatgtgaagcc

SEQ ID NO: 7385442 - DNA, 22 bp, Homo sapiens
tgccttcaatcaggatggtctc

SEQ ID NO: 7385443 - DNA, 22 bp, Homo sapiens
tgccttcctaatggtggggttt

SEQ ID NO: 7385444 - DNA, 22 bp, Homo sapiens
tgccttcactgagcttatggga

SEQ ID NO: 7385445 - DNA, 17 bp, Homo sapiens
cccagggaccactgctt

SEQ ID NO: 7385446 - DNA, 22 bp, Homo sapiens
cccagggacagatgggcagcta

SEQ ID NO: 7385447 - DNA, 22 bp, Homo sapiens
tgccctggtgaagtgctctcct

SEQ ID NO: 7385448 - DNA, 23 bp, Homo sapiens
cccagggacacgatgacacctcc

SEQ ID NO: 7385449 - DNA, 22 bp, Homo sapiens
cccagggaaggcagatggagga

SEQ ID NO: 7385450 - DNA, 22 bp, Homo sapiens
tgccaggagagtgcatgcaggg

SEQ ID NO: 7385451 - DNA, 22 bp, Homo sapiens
tgccaggagagtgcatgcaggg

SEQ ID NO: 7385452 - DNA, 22 bp, Homo sapiens
tgccaggaggaggtgggacaga

SEQ ID NO: 7385453 - DNA, 22 bp, Homo sapiens
tgccaggacaaggaccacatgg

SEQ ID NO: 7385454 - DNA, 22 bp, Homo sapiens
tgccaggacaaggaccacatgg

SEQ ID NO: 7385455 - DNA, 22 bp, Homo sapiens
tgccaggaagtgtgtgggcctg

SEQ ID NO: 7385456 - DNA, 22 bp, Homo sapiens
tgccaggaagtgtgtgggcctg

SEQ ID NO: 7385457 - DNA, 19 bp, Homo sapiens
tgccaggaatactccagaa

SEQ ID NO: 7385458 - DNA, 22 bp, Homo sapiens
tgccagctcctgcagctcctgt

SEQ ID NO: 7385459 - DNA, 22 bp, Homo sapiens
tgccaggatataagagtgcgat

SEQ ID NO: 7385460 - DNA, 22 bp, Homo sapiens
tgccaggagtcaggccaggcag

SEQ ID NO: 7385461 - DNA, 22 bp, Homo sapiens
tgccaggaggggacacctcctc

SEQ ID NO: 7385462 - DNA, 22 bp, Homo sapiens
tgccaggagtcaggccaggcag

SEQ ID NO: 7385463 - DNA, 22 bp, Homo sapiens
tgccaggatggccagggggcca

SEQ ID NO: 7385464 - DNA, 22 bp, Homo sapiens
cccaggagacctgtgaaaggac

SEQ ID NO: 7385465 - DNA, 22 bp, Homo sapiens
cccaggagagaggccagttggc

SEQ ID NO: 7385466 - DNA, 22 bp, Homo sapiens
tgccctggggagcccagccagg

SEQ ID NO: 7385467 - DNA, 22 bp, Homo sapiens
tgccctgggctttgctatgact

SEQ ID NO: 7385468 - DNA, 22 bp, Homo sapiens
tgccatagcaatggtaagctga

SEQ ID NO: 7385469 - DNA, 22 bp, Homo sapiens
tgccagttgggaaaacagacat

SEQ ID NO: 7385470 - DNA, 22 bp, Homo sapiens
tgcccagccagtttatggtaat

SEQ ID NO: 7385471 - DNA, 22 bp, Homo sapiens
tgccatattgcaaagtgtctgc

SEQ ID NO: 7385472 - DNA, 22 bp, Homo sapiens
tgccatagcaatggtaagctga

SEQ ID NO: 7385473 - DNA, 22 bp, Homo sapiens
tgccatattattgagcatatta

SEQ ID NO: 7385474 - DNA, 22 bp, Homo sapiens
tgcccagcgcccacattctgtc

SEQ ID NO: 7385475 - DNA, 22 bp, Homo sapiens
tgcccagctattcctttcttag

SEQ ID NO: 7385476 - DNA, 22 bp, Homo sapiens
tgcccagcccctatccctggga

SEQ ID NO: 7385477 - DNA, 22 bp, Homo sapiens
tgcccagcctaaacttggcaag

SEQ ID NO: 7385478 - DNA, 22 bp, Homo sapiens
tgcccagcttcttacttttaaa

SEQ ID NO: 7385479 - DNA, 22 bp, Homo sapiens
tgcccagctgtcaaagtagata

SEQ ID NO: 7385480 - DNA, 22 bp, Homo sapiens
cctcttctaggtttcagcctgc

SEQ ID NO: 7385481 - DNA, 22 bp, Homo sapiens
cctcttctaggacgtccttgtg

SEQ ID NO: 7385482 - DNA, 22 bp, Homo sapiens
tgggagtggggcatagaaggta

SEQ ID NO: 7385483 - DNA, 22 bp, Homo sapiens
cctgagccgagcgctctttctc

SEQ ID NO: 7385484 - DNA, 22 bp, Homo sapiens
cctgagcctcttgcacgctcag

SEQ ID NO: 7385485 - DNA, 22 bp, Homo sapiens
cctgagccaagagtcagaatct

SEQ ID NO: 7385486 - DNA, 22 bp, Homo sapiens
cctgagcattagacatccatca

SEQ ID NO: 7385487 - DNA, 22 bp, Homo sapiens
cctgagcagggctctgcagggc

SEQ ID NO: 7385488 - DNA, 22 bp, Homo sapiens
cctgagcctgagtggtgcaggg

SEQ ID NO: 7385489 - DNA, 22 bp, Homo sapiens
tgggcccaagagagtctccaac

SEQ ID NO: 7385490 - DNA, 22 bp, Homo sapiens
cctgagcctggctcatgcactc

SEQ ID NO: 7385491 - DNA, 22 bp, Homo sapiens
cctgagcacacatcagaatcac

SEQ ID NO: 7385492 - DNA, 22 bp, Homo sapiens
cctgagcaaaggcccagaggga

SEQ ID NO: 7385493 - DNA, 22 bp, Homo sapiens
tgggcccatcattgctgtgggc

SEQ ID NO: 7385494 - DNA, 22 bp, Homo sapiens
cctgagctagggaaggaagacc

SEQ ID NO: 7385495 - DNA, 22 bp, Homo sapiens
cctgagctggcagtgacctgga

SEQ ID NO: 7385496 - DNA, 22 bp, Homo sapiens
tggctgagagaagacggggaag

SEQ ID NO: 7385497 - DNA, 22 bp, Homo sapiens
tggctgagaccttcccaaattc

SEQ ID NO: 7385498 - DNA, 22 bp, Homo sapiens
tggctgagaccatcagggtgta

SEQ ID NO: 7385499 - DNA, 22 bp, Homo sapiens
tggctgagaccatcagggtgta

SEQ ID NO: 7385500 - DNA, 19 bp, Homo sapiens
tggctctgtcgaaggcaca

SEQ ID NO: 7385501 - DNA, 22 bp, Homo sapiens
tggctggctgtcaaggaaagcc

SEQ ID NO: 7385502 - DNA, 22 bp, Homo sapiens
tggcttcatctgcagcactgcc

SEQ ID NO: 7385503 - DNA, 22 bp, Homo sapiens
tggcttcatggcaagtcttagt

SEQ ID NO: 7385504 - DNA, 22 bp, Homo sapiens
tggcttcaggcagaatttagac

SEQ ID NO: 7385505 - DNA, 22 bp, Homo sapiens
tggcttcattctgtagttaaaa

SEQ ID NO: 7385506 - DNA, 22 bp, Homo sapiens
tggcttcattctcctgtgaata

SEQ ID NO: 7385507 - DNA, 22 bp, Homo sapiens
tggcttcatggctgtgcaatct

SEQ ID NO: 7385508 - DNA, 22 bp, Homo sapiens
tggcttcattcagcatgacagt

SEQ ID NO: 7385509 - DNA, 22 bp, Homo sapiens
cctctgcccttttcctgtatca

SEQ ID NO: 7385510 - DNA, 22 bp, Homo sapiens
cctctgcctgcacatcatcctg

SEQ ID NO: 7385511 - DNA, 20 bp, Homo sapiens
cctctgccccggggctgcta

SEQ ID NO: 7385512 - DNA, 18 bp, Homo sapiens
cctctgcctttgtagagc

SEQ ID NO: 7385513 - DNA, 22 bp, Homo sapiens
cctctgcgcccttgatcagcca

SEQ ID NO: 7385514 - DNA, 22 bp, Homo sapiens
cctctgcctttagtgaaagttg

SEQ ID NO: 7385515 - DNA, 20 bp, Homo sapiens
cctctgcctttctagtctga

SEQ ID NO: 7385516 - DNA, 22 bp, Homo sapiens
cctctgctctggtccatgtgct

SEQ ID NO: 7385517 - DNA, 22 bp, Homo sapiens
tgggaaggataccttggaacat

SEQ ID NO: 7385518 - DNA, 22 bp, Homo sapiens
tgggaaggatacgttacaagat

SEQ ID NO: 7385519 - DNA, 22 bp, Homo sapiens
tgggaaggacagaacataattg

SEQ ID NO: 7385520 - DNA, 22 bp, Homo sapiens
tgggaaggaatggtgattaata

SEQ ID NO: 7385521 - DNA, 22 bp, Homo sapiens
cccttcccttctgggagatcca

SEQ ID NO: 7385522 - DNA, 21 bp, Homo sapiens
cccttctgctccagctttgcc

SEQ ID NO: 7385523 - DNA, 19 bp, Homo sapiens
tggagcagggcccttgttt

SEQ ID NO: 7385524 - DNA, 18 bp, Homo sapiens
tggagcaggtaggcatga

SEQ ID NO: 7385525 - DNA, 22 bp, Homo sapiens
tggagcaggccggaagtggctt

SEQ ID NO: 7385526 - DNA, 22 bp, Homo sapiens
tggagcaggcatctttctctct

SEQ ID NO: 7385527 - DNA, 22 bp, Homo sapiens
tggagcagggcatcactgtgcg

SEQ ID NO: 7385528 - DNA, 23 bp, Homo sapiens
ccctgcagtcagggtgagatggt

SEQ ID NO: 7385529 - DNA, 22 bp, Homo sapiens
ccctgcaggggacctgcagcct

SEQ ID NO: 7385530 - DNA, 22 bp, Homo sapiens
ccctgcagcttttgcatagtca

SEQ ID NO: 7385531 - DNA, 22 bp, Homo sapiens
tggcagggttggccaccttacc

SEQ ID NO: 7385532 - DNA, 21 bp, Homo sapiens
cctagcctcttacccagcttt

SEQ ID NO: 7385533 - DNA, 22 bp, Homo sapiens
cctagatgggatggcggccggg

SEQ ID NO: 7385534 - DNA, 22 bp, Homo sapiens
cctagaggctgcaaggagaggc

SEQ ID NO: 7385535 - DNA, 22 bp, Homo sapiens
cctagagctctgctttatctaa

SEQ ID NO: 7385536 - DNA, 22 bp, Homo sapiens
cctagactagaggcagggagcc

SEQ ID NO: 7385537 - DNA, 22 bp, Homo sapiens
cctcaggcttcgtcttccaccc

SEQ ID NO: 7385538 - DNA, 22 bp, Homo sapiens
cctcaggcttacgggcaatgga

SEQ ID NO: 7385539 - DNA, 22 bp, Homo sapiens
cctcaggctgggctgcccctgg

SEQ ID NO: 7385540 - DNA, 22 bp, Homo sapiens
cctcaggctgggctgcccctgg

SEQ ID NO: 7385541 - DNA, 22 bp, Homo sapiens
cctcaggctgctcacacttgtc

SEQ ID NO: 7385542 - DNA, 22 bp, Homo sapiens
cctcaggctgctcacacttgtc

SEQ ID NO: 7385543 - DNA, 22 bp, Homo sapiens
cctcaggcctgccagagcccca

SEQ ID NO: 7385544 - DNA, 22 bp, Homo sapiens
cctcaggcctgccagagcccca

SEQ ID NO: 7385545 - DNA, 22 bp, Homo sapiens
cctcaggctagctactgtccct

SEQ ID NO: 7385546 - DNA, 19 bp, Homo sapiens
tggcccagatggtcctggg

SEQ ID NO: 7385547 - DNA, 22 bp, Homo sapiens
tggcccagatctctgaccttga

SEQ ID NO: 7385548 - DNA, 22 bp, Homo sapiens
tggcccagatctctgaccttga

SEQ ID NO: 7385549 - DNA, 20 bp, Homo sapiens
tggcccagcacgacgaggac

SEQ ID NO: 7385550 - DNA, 22 bp, Homo sapiens
tggcccagcactccaagtaggg

SEQ ID NO: 7385551 - DNA, 22 bp, Homo sapiens
tggcccagcagttctgccccag

SEQ ID NO: 7385552 - DNA, 22 bp, Homo sapiens
tggcccagcagttctgccccag

SEQ ID NO: 7385553 - DNA, 22 bp, Homo sapiens
tggcccagagcactgctgggca

SEQ ID NO: 7385554 - DNA, 21 bp, Homo sapiens
tggctctgggtaggagagtgc

SEQ ID NO: 7385555 - DNA, 20 bp, Homo sapiens
cctcagtgtcctggactggg

SEQ ID NO: 7385556 - DNA, 18 bp, Homo sapiens
cctcagggagagagacgc

SEQ ID NO: 7385557 - DNA, 22 bp, Homo sapiens
cctcagtgttaggataagagaa

SEQ ID NO: 7385558 - DNA, 22 bp, Homo sapiens
taggctttagtccctggaatta

SEQ ID NO: 7385559 - DNA, 22 bp, Homo sapiens
tagggaagagcattcaaccttt

SEQ ID NO: 7385560 - DNA, 22 bp, Homo sapiens
tagggaagctcctgattcccct

SEQ ID NO: 7385561 - DNA, 22 bp, Homo sapiens
cagggctgtaaattagtgctga

SEQ ID NO: 7385562 - DNA, 22 bp, Homo sapiens
cagggggtgcaggccctgtgac

SEQ ID NO: 7385563 - DNA, 22 bp, Homo sapiens
cagggggctcaaaggagagtgc

SEQ ID NO: 7385564 - DNA, 22 bp, Homo sapiens
cagggctgtggctttgtgctgt

SEQ ID NO: 7385565 - DNA, 22 bp, Homo sapiens
cagggggtggtccaggctgcgc

SEQ ID NO: 7385566 - DNA, 22 bp, Homo sapiens
cagggtagggcaagggaacctg

SEQ ID NO: 7385567 - DNA, 22 bp, Homo sapiens
cagggtccggctgcctggctgt

SEQ ID NO: 7385568 - DNA, 22 bp, Homo sapiens
cagggtggggaaatagcgccct

SEQ ID NO: 7385569 - DNA, 22 bp, Homo sapiens
cagggtccccgggtctcctgtg

SEQ ID NO: 7385570 - DNA, 22 bp, Homo sapiens
cagggagcagcgctggggcctc

SEQ ID NO: 7385571 - DNA, 22 bp, Homo sapiens
cagggagcagcccctagaagta

SEQ ID NO: 7385572 - DNA, 22 bp, Homo sapiens
cagggagcagcgctggggcctc

SEQ ID NO: 7385573 - DNA, 22 bp, Homo sapiens
cagggagcaggctctgtccatc

SEQ ID NO: 7385574 - DNA, 22 bp, Homo sapiens
cagggagcactgcgagcggcag

SEQ ID NO: 7385575 - DNA, 22 bp, Homo sapiens
cagggagcactgcgagcggcag

SEQ ID NO: 7385576 - DNA, 22 bp, Homo sapiens
cagggagcagcatgggcaaagg

SEQ ID NO: 7385577 - DNA, 23 bp, Homo sapiens
tagattgctacaagtcattgaat

SEQ ID NO: 7385578 - DNA, 22 bp, Homo sapiens
tagattgcatatggaatgtatt

SEQ ID NO: 7385579 - DNA, 23 bp, Homo sapiens
tagattgctacaagtcattgaat

SEQ ID NO: 7385580 - DNA, 22 bp, Homo sapiens
cagggccattggaacaaagagg

SEQ ID NO: 7385581 - DNA, 22 bp, Homo sapiens
cagggccattggaacaaagagg

SEQ ID NO: 7385582 - DNA, 22 bp, Homo sapiens
cagggccattggaacaaagagg

SEQ ID NO: 7385583 - DNA, 22 bp, Homo sapiens
cagggagcctccaaagctttca

SEQ ID NO: 7385584 - DNA, 22 bp, Homo sapiens
cagggagccccaattccatgcc

SEQ ID NO: 7385585 - DNA, 22 bp, Homo sapiens
cagggagccaccagataattac

SEQ ID NO: 7385586 - DNA, 20 bp, Homo sapiens
cagggcctaagagctgaaaa

SEQ ID NO: 7385587 - DNA, 22 bp, Homo sapiens
cagggcccagtccctgctgtca

SEQ ID NO: 7385588 - DNA, 22 bp, Homo sapiens
cagggcccaagacacaatgagg

SEQ ID NO: 7385589 - DNA, 22 bp, Homo sapiens
taggccaaggacagtaaggaca

SEQ ID NO: 7385590 - DNA, 22 bp, Homo sapiens
taggccaagttgatcagacatc

SEQ ID NO: 7385591 - DNA, 22 bp, Homo sapiens
taggccaaatgacttgatgttt

SEQ ID NO: 7385592 - DNA, 22 bp, Homo sapiens
tagcttgactattctatgatgt

SEQ ID NO: 7385593 - DNA, 22 bp, Homo sapiens
tagcttctcttttcaacatctt

SEQ ID NO: 7385594 - DNA, 22 bp, Homo sapiens
tagcttctatacaacttcagca

SEQ ID NO: 7385595 - DNA, 22 bp, Homo sapiens
caggtgcctcaggatgagacaa

SEQ ID NO: 7385596 - DNA, 22 bp, Homo sapiens
caggtgcctcaggatgagacaa

SEQ ID NO: 7385597 - DNA, 22 bp, Homo sapiens
caggtgacaagacaggtaatat

SEQ ID NO: 7385598 - DNA, 22 bp, Homo sapiens
caggtcagaggtagatgagatg

SEQ ID NO: 7385599 - DNA, 23 bp, Homo sapiens
caggtattgatttttcttctagg

SEQ ID NO: 7385600 - DNA, 22 bp, Homo sapiens
caggtaaaaataaatttgtgag

SEQ ID NO: 7385601 - DNA, 22 bp, Homo sapiens
caggtaggaggctccctagtcc

SEQ ID NO: 7385602 - DNA, 22 bp, Homo sapiens
caggtagctgcagagactattt

SEQ ID NO: 7385603 - DNA, 22 bp, Homo sapiens
caggtagctgctggccatgtac

SEQ ID NO: 7385604 - DNA, 22 bp, Homo sapiens
caggtagcttttgatattaggg

SEQ ID NO: 7385605 - DNA, 22 bp, Homo sapiens
tcaagcaactgaattctaaaag

SEQ ID NO: 7385606 - DNA, 22 bp, Homo sapiens
tcaagcaaagatacaaatggaa

SEQ ID NO: 7385607 - DNA, 22 bp, Homo sapiens
tcaacaaatacttaaagcagag

SEQ ID NO: 7385608 - DNA, 22 bp, Homo sapiens
tcaagcatcttggtctacgatc

SEQ ID NO: 7385609 - DNA, 23 bp, Homo sapiens
tcaagcaataattggtaatagtg

SEQ ID NO: 7385610 - DNA, 22 bp, Homo sapiens
tcaagcagagtcaaaagtacca

SEQ ID NO: 7385611 - DNA, 19 bp, Homo sapiens
tcaagcagtctgatttagg

SEQ ID NO: 7385612 - DNA, 22 bp, Homo sapiens
tcaagcagggtagcaagctggt

SEQ ID NO: 7385613 - DNA, 19 bp, Homo sapiens
tcaaaacacaaatggttga

SEQ ID NO: 7385614 - DNA, 22 bp, Homo sapiens
tcaaaaattttctgaggatgag

SEQ ID NO: 7385615 - DNA, 22 bp, Homo sapiens
tattttaggtaatatccattgt

SEQ ID NO: 7385616 - DNA, 22 bp, Homo sapiens
tattttaggtaatatccattgt

SEQ ID NO: 7385617 - DNA, 22 bp, Homo sapiens
tattttcaccatgtatccctgt

SEQ ID NO: 7385618 - DNA, 22 bp, Homo sapiens
tattttatctgccagagtggag

SEQ ID NO: 7385619 - DNA, 22 bp, Homo sapiens
tcaaaaatgttttatattggta

SEQ ID NO: 7385620 - DNA, 22 bp, Homo sapiens
tattttaaagactgccagccta

SEQ ID NO: 7385621 - DNA, 22 bp, Homo sapiens
tattttaaagtgaagggtcttg

SEQ ID NO: 7385622 - DNA, 22 bp, Homo sapiens
cagtcaggctgcgcttctctga

SEQ ID NO: 7385623 - DNA, 22 bp, Homo sapiens
cagtcaggaatgcctccttcct

SEQ ID NO: 7385624 - DNA, 22 bp, Homo sapiens
cagtcagggacaccagctagga

SEQ ID NO: 7385625 - DNA, 22 bp, Homo sapiens
cagtcatccaggaaatgtatcc

SEQ ID NO: 7385626 - DNA, 22 bp, Homo sapiens
cagtcaccttgaggactcagac

SEQ ID NO: 7385627 - DNA, 22 bp, Homo sapiens
tacattgtttgagatagtttgt

SEQ ID NO: 7385628 - DNA, 22 bp, Homo sapiens
tacatttcagagctcctctctg

SEQ ID NO: 7385629 - DNA, 22 bp, Homo sapiens
tacattgtgatgtttcaataca

SEQ ID NO: 7385630 - DNA, 22 bp, Homo sapiens
tacatttcctgtcagagatata

SEQ ID NO: 7385631 - DNA, 22 bp, Homo sapiens
caggcctttctggggaagtgag

SEQ ID NO: 7385632 - DNA, 22 bp, Homo sapiens
caggcctttcttggggcttaga

SEQ ID NO: 7385633 - DNA, 22 bp, Homo sapiens
caggccttttttcctgcagtgt

SEQ ID NO: 7385634 - DNA, 22 bp, Homo sapiens
tactttaaaaactgataattca

SEQ ID NO: 7385635 - DNA, 22 bp, Homo sapiens
tactttaaaaactgataattca

SEQ ID NO: 7385636 - DNA, 22 bp, Homo sapiens
caggctacatttgctctgagaa

SEQ ID NO: 7385637 - DNA, 22 bp, Homo sapiens
tactttaaagaggtgtaatgag

SEQ ID NO: 7385638 - DNA, 20 bp, Homo sapiens
caggcctctgggggccctgg

SEQ ID NO: 7385639 - DNA, 22 bp, Homo sapiens
caggcctctccttagtctggca

SEQ ID NO: 7385640 - DNA, 19 bp, Homo sapiens
caggcctctggtctgctgt

SEQ ID NO: 7385641 - DNA, 22 bp, Homo sapiens
caggcctctatggtcagctgag

SEQ ID NO: 7385642 - DNA, 22 bp, Homo sapiens
caggcctcgaggagacagctac

SEQ ID NO: 7385643 - DNA, 22 bp, Homo sapiens
caggcctctatggtcagctgag

SEQ ID NO: 7385644 - DNA, 22 bp, Homo sapiens
caggcctcgaggagacagctac

SEQ ID NO: 7385645 - DNA, 22 bp, Homo sapiens
caggcccagcccttagccaggt

SEQ ID NO: 7385646 - DNA, 22 bp, Homo sapiens
caggcctgaccctgagcttcac

SEQ ID NO: 7385647 - DNA, 19 bp, Homo sapiens
caggcctcttaccctctct

SEQ ID NO: 7385648 - DNA, 22 bp, Homo sapiens
caggctttactttctctctgaa

SEQ ID NO: 7385649 - DNA, 22 bp, Homo sapiens
caggcttttatgaatttcagtg

SEQ ID NO: 7385650 - DNA, 22 bp, Homo sapiens
cagggaagaatagttagcaaag

SEQ ID NO: 7385651 - DNA, 22 bp, Homo sapiens
cagggaagagccgatgctgcag

SEQ ID NO: 7385652 - DNA, 22 bp, Homo sapiens
cagggacagagactgcaccttg

SEQ ID NO: 7385653 - DNA, 22 bp, Homo sapiens
cagggacaatggcagagcctga

SEQ ID NO: 7385654 - DNA, 22 bp, Homo sapiens
cagggaaggctgcaaatgttaa

SEQ ID NO: 7385655 - DNA, 22 bp, Homo sapiens
caggctgcatggaggggtacag

SEQ ID NO: 7385656 - DNA, 22 bp, Homo sapiens
caggctgccaaggctggggagg

SEQ ID NO: 7385657 - DNA, 22 bp, Homo sapiens
tagaaaagtatgggactgacat

SEQ ID NO: 7385658 - DNA, 22 bp, Homo sapiens
tagaaacaaaatctgatgactc

SEQ ID NO: 7385659 - DNA, 22 bp, Homo sapiens
tagaaaatgttccactgccatt

SEQ ID NO: 7385660 - DNA, 22 bp, Homo sapiens
taagtcataagtcaacaaagga

SEQ ID NO: 7385661 - DNA, 22 bp, Homo sapiens
taagtcatcccataacagtgct

SEQ ID NO: 7385662 - DNA, 22 bp, Homo sapiens
taagtcatcgcaggagtttggt

SEQ ID NO: 7385663 - DNA, 22 bp, Homo sapiens
taagtcatgattctgtgttact

SEQ ID NO: 7385664 - DNA, 22 bp, Homo sapiens
taagtcataagtcatgatgtta

SEQ ID NO: 7385665 - DNA, 22 bp, Homo sapiens
taagtcatagagcggaagacca

SEQ ID NO: 7385666 - DNA, 22 bp, Homo sapiens
taagtcatagattaatggccac

SEQ ID NO: 7385667 - DNA, 22 bp, Homo sapiens
taagtcatatgtgtcccaagtc

SEQ ID NO: 7385668 - DNA, 22 bp, Homo sapiens
taagtcatcacattgcagagat

SEQ ID NO: 7385669 - DNA, 22 bp, Homo sapiens
taagtcgtggatgattcttcgg

SEQ ID NO: 7385670 - DNA, 22 bp, Homo sapiens
taagtcatggagctgggattga

SEQ ID NO: 7385671 - DNA, 22 bp, Homo sapiens
taagtcattaggctgagttcaa

SEQ ID NO: 7385672 - DNA, 18 bp, Homo sapiens
taagtcatttgaaatgcc

SEQ ID NO: 7385673 - DNA, 22 bp, Homo sapiens
taagtcatttggagccactgga

SEQ ID NO: 7385674 - DNA, 18 bp, Homo sapiens
taagtcattttgccagca

SEQ ID NO: 7385675 - DNA, 22 bp, Homo sapiens
cagctcacagccacgccattcc

SEQ ID NO: 7385676 - DNA, 22 bp, Homo sapiens
cagctcacccatcacgtctgct

SEQ ID NO: 7385677 - DNA, 22 bp, Homo sapiens
gtgcttcctgtattgattccat

SEQ ID NO: 7385678 - DNA, 22 bp, Homo sapiens
gtgcttcctgcctggtgccttt

SEQ ID NO: 7385679 - DNA, 22 bp, Homo sapiens
gtgcttcctcagtgtttaagga

SEQ ID NO: 7385680 - DNA, 22 bp, Homo sapiens
gtgcttcctccttaaactgtca

SEQ ID NO: 7385681 - DNA, 20 bp, Homo sapiens
gtgcttcctcgcaagttgca

SEQ ID NO: 7385682 - DNA, 22 bp, Homo sapiens
gtgcttcctctgccaacactct

SEQ ID NO: 7385683 - DNA, 22 bp, Homo sapiens
gtgcttcccattagaactgtga

SEQ ID NO: 7385684 - DNA, 22 bp, Homo sapiens
gtgcttccccaagccacagcct

SEQ ID NO: 7385685 - DNA, 22 bp, Homo sapiens
gtgcttcctaggtaagtaggta

SEQ ID NO: 7385686 - DNA, 22 bp, Homo sapiens
gtgcttcctcagaggttcccat

SEQ ID NO: 7385687 - DNA, 20 bp, Homo sapiens
gtgcttcagaagccattgct

SEQ ID NO: 7385688 - DNA, 22 bp, Homo sapiens
gtgcttccatctagagggtcac

SEQ ID NO: 7385689 - DNA, 22 bp, Homo sapiens
taatacaaggcaggaagcagta

SEQ ID NO: 7385690 - DNA, 22 bp, Homo sapiens
taatacaatggagttgggcccc

SEQ ID NO: 7385691 - DNA, 22 bp, Homo sapiens
taatacaaggcaggaagcagta

SEQ ID NO: 7385692 - DNA, 22 bp, Homo sapiens
caggcagcagaggagtgtggga

SEQ ID NO: 7385693 - DNA, 22 bp, Homo sapiens
taataattagttattgatcgtg

SEQ ID NO: 7385694 - DNA, 22 bp, Homo sapiens
caggcagcagaggagtgtggga

SEQ ID NO: 7385695 - DNA, 22 bp, Homo sapiens
caggcagcagaggagtgtggga

SEQ ID NO: 7385696 - DNA, 22 bp, Homo sapiens
caggcaccccaggtgagcactg

SEQ ID NO: 7385697 - DNA, 22 bp, Homo sapiens
caggcagagctgaagatagatg

SEQ ID NO: 7385698 - DNA, 22 bp, Homo sapiens
caggcagatgctgacaagagtt

SEQ ID NO: 7385699 - DNA, 22 bp, Homo sapiens
caggccagggttgagaagagaa

SEQ ID NO: 7385700 - DNA, 20 bp, Homo sapiens
tacaaacctccacactggtg

SEQ ID NO: 7385701 - DNA, 22 bp, Homo sapiens
tacaaaaaattgatactgacga

SEQ ID NO: 7385702 - DNA, 22 bp, Homo sapiens
tacaaaaaattgatactgacga

SEQ ID NO: 7385703 - DNA, 22 bp, Homo sapiens
tacaaaaggaagagggatctta

SEQ ID NO: 7385704 - DNA, 22 bp, Homo sapiens
caggcatttcgcaaaggctgag

SEQ ID NO: 7385705 - DNA, 21 bp, Homo sapiens
caggccaaaaggttcaacatt

SEQ ID NO: 7385706 - DNA, 22 bp, Homo sapiens
tacaaaaaattgatactgacga

SEQ ID NO: 7385707 - DNA, 22 bp, Homo sapiens
tacaaaaaattgatactgacga

SEQ ID NO: 7385708 - DNA, 22 bp, Homo sapiens
caggccattaccgctgagaccc

SEQ ID NO: 7385709 - DNA, 22 bp, Homo sapiens
caggcccacgaggcacacagag

SEQ ID NO: 7385710 - DNA, 22 bp, Homo sapiens
caggcccactgcttgtctagtc

SEQ ID NO: 7385711 - DNA, 22 bp, Homo sapiens
caggcccactgcttgtctagtc

SEQ ID NO: 7385712 - DNA, 22 bp, Homo sapiens
caggccagggttgagaagagaa

SEQ ID NO: 7385713 - DNA, 19 bp, Homo sapiens
caggccagtgtcagggggc

SEQ ID NO: 7385714 - DNA, 22 bp, Homo sapiens
taatgtctttaagagcattggg

SEQ ID NO: 7385715 - DNA, 22 bp, Homo sapiens
taatgtcttgtgagagctggag

SEQ ID NO: 7385716 - DNA, 22 bp, Homo sapiens
taatgtcttcttttaatttggc

SEQ ID NO: 7385717 - DNA, 22 bp, Homo sapiens
taatgtcttgccttcctccccc

SEQ ID NO: 7385718 - DNA, 22 bp, Homo sapiens
taatgtcttagtaccttaattt

SEQ ID NO: 7385719 - DNA, 22 bp, Homo sapiens
taatgtctgtgtttcagtgcag

SEQ ID NO: 7385720 - DNA, 22 bp, Homo sapiens
taatgtctccagggttgaccta

SEQ ID NO: 7385721 - DNA, 22 bp, Homo sapiens
taatgtctgatagtgatggctc

SEQ ID NO: 7385722 - DNA, 22 bp, Homo sapiens
taatgtcaaggtgatagatttg

SEQ ID NO: 7385723 - DNA, 22 bp, Homo sapiens
taatgtctatgggccagataat

SEQ ID NO: 7385724 - DNA, 22 bp, Homo sapiens
taatgtctagatcagacctcga

SEQ ID NO: 7385725 - DNA, 22 bp, Homo sapiens
caggcatggagaggcagagact

SEQ ID NO: 7385726 - DNA, 22 bp, Homo sapiens
caggcatggatctggaatcatt

SEQ ID NO: 7385727 - DNA, 22 bp, Homo sapiens
taatccaatggcacaatgtatg

SEQ ID NO: 7385728 - DNA, 22 bp, Homo sapiens
catggccacatctagctgcaag

SEQ ID NO: 7385729 - DNA, 23 bp, Homo sapiens
tccaggagaattccagggcccgg

SEQ ID NO: 7385730 - DNA, 23 bp, Homo sapiens
tccaggagaattccagggcccgg

SEQ ID NO: 7385731 - DNA, 22 bp, Homo sapiens
catggcagggctgtgggcaggt

SEQ ID NO: 7385732 - DNA, 22 bp, Homo sapiens
catggcagctttgggaggagga

SEQ ID NO: 7385733 - DNA, 22 bp, Homo sapiens
catgcattcagaatctctcaca

SEQ ID NO: 7385734 - DNA, 22 bp, Homo sapiens
catgcatgccgggctgacagag

SEQ ID NO: 7385735 - DNA, 22 bp, Homo sapiens
catgcaggtctggagcttgggg

SEQ ID NO: 7385736 - DNA, 22 bp, Homo sapiens
catgcaggttatatgtgcttct

SEQ ID NO: 7385737 - DNA, 22 bp, Homo sapiens
catgacagatgcaaaggattgg

SEQ ID NO: 7385738 - DNA, 22 bp, Homo sapiens
catgacagatgcaaaggattgg

SEQ ID NO: 7385739 - DNA, 22 bp, Homo sapiens
catgacagtcctgaagagaacg

SEQ ID NO: 7385740 - DNA, 22 bp, Homo sapiens
tcagtcaggttctgatttctgg

SEQ ID NO: 7385741 - DNA, 19 bp, Homo sapiens
tcagtcatatatctgcacc

SEQ ID NO: 7385742 - DNA, 22 bp, Homo sapiens
tcagtcagaatcaccagacttt

SEQ ID NO: 7385743 - DNA, 22 bp, Homo sapiens
tcagtcatctctgacagctagc

SEQ ID NO: 7385744 - DNA, 22 bp, Homo sapiens
tcagggagcctggacttcaagg

SEQ ID NO: 7385745 - DNA, 22 bp, Homo sapiens
tcagggagatttggggactcaa

SEQ ID NO: 7385746 - DNA, 19 bp, Homo sapiens
tcagggagtttacagcatg

SEQ ID NO: 7385747 - DNA, 22 bp, Homo sapiens
tcagggagtagtttgtgctatg

SEQ ID NO: 7385748 - DNA, 22 bp, Homo sapiens
tcagtgcctactttgatcaatt

SEQ ID NO: 7385749 - DNA, 19 bp, Homo sapiens
tcagtgctcctatgtcctt

SEQ ID NO: 7385750 - DNA, 22 bp, Homo sapiens
tcagtgctctgaggtccagggt

SEQ ID NO: 7385751 - DNA, 22 bp, Homo sapiens
tcagtgctgctttatgacagtt

SEQ ID NO: 7385752 - DNA, 22 bp, Homo sapiens
tcagtgccaattctgccatggg

SEQ ID NO: 7385753 - DNA, 22 bp, Homo sapiens
tcagtgcattgttcattgtagg

SEQ ID NO: 7385754 - DNA, 22 bp, Homo sapiens
tcagtcccttctccaggtcagc

SEQ ID NO: 7385755 - DNA, 22 bp, Homo sapiens
catgaacattcagaaatacagc

SEQ ID NO: 7385756 - DNA, 22 bp, Homo sapiens
catgaacaaattctgtttgagg

SEQ ID NO: 7385757 - DNA, 22 bp, Homo sapiens
catgaacaatttgctcactgat

SEQ ID NO: 7385758 - DNA, 22 bp, Homo sapiens
catgaacaccaggcatgaacaa

SEQ ID NO: 7385759 - DNA, 21 bp, Homo sapiens
catgaacatgcttatcctcag

SEQ ID NO: 7385760 - DNA, 22 bp, Homo sapiens
catgaacagctaacattttggg

SEQ ID NO: 7385761 - DNA, 22 bp, Homo sapiens
catgaaaataacattgttgtga

SEQ ID NO: 7385762 - DNA, 22 bp, Homo sapiens
catgaaatttgaagtacagcaa

SEQ ID NO: 7385763 - DNA, 22 bp, Homo sapiens
catctgttaaagtctaatgaaa

SEQ ID NO: 7385764 - DNA, 22 bp, Homo sapiens
catctgaaatctgcctacaagc

SEQ ID NO: 7385765 - DNA, 22 bp, Homo sapiens
catctgcaggggaagccagttt

SEQ ID NO: 7385766 - DNA, 19 bp, Homo sapiens
catctggatgattctcctg

SEQ ID NO: 7385767 - DNA, 22 bp, Homo sapiens
tcagggagagtgacccatccac

SEQ ID NO: 7385768 - DNA, 22 bp, Homo sapiens
tcaggcctccaggttaccattt

SEQ ID NO: 7385769 - DNA, 22 bp, Homo sapiens
tcaggccctttgctgctgcccc

SEQ ID NO: 7385770 - DNA, 22 bp, Homo sapiens
tcaggcccttctcccaggactc

SEQ ID NO: 7385771 - DNA, 22 bp, Homo sapiens
tcaggccccttgtcagctctgt

SEQ ID NO: 7385772 - DNA, 22 bp, Homo sapiens
tcaggccccatcccagacttat

SEQ ID NO: 7385773 - DNA, 22 bp, Homo sapiens
catagaaatcaggtgagaatct

SEQ ID NO: 7385774 - DNA, 22 bp, Homo sapiens
catagaaatcaggtgagaatct

SEQ ID NO: 7385775 - DNA, 22 bp, Homo sapiens
catagaaagtattatggaattt

SEQ ID NO: 7385776 - DNA, 22 bp, Homo sapiens
catagaaagtattatggaattt

SEQ ID NO: 7385777 - DNA, 22 bp, Homo sapiens
catagaaacttgcagcaagcac

SEQ ID NO: 7385778 - DNA, 22 bp, Homo sapiens
catagaaactgagacaaggatt

SEQ ID NO: 7385779 - DNA, 22 bp, Homo sapiens
catagaaaagagtaggtaatgt

SEQ ID NO: 7385780 - DNA, 22 bp, Homo sapiens
catagaaactgagacaaggatt

SEQ ID NO: 7385781 - DNA, 22 bp, Homo sapiens
tcaggcagagtggaagctgcaa

SEQ ID NO: 7385782 - DNA, 22 bp, Homo sapiens
tcaggcccagagtcacggatcc

SEQ ID NO: 7385783 - DNA, 22 bp, Homo sapiens
tcaggccaggagatcagattga

SEQ ID NO: 7385784 - DNA, 22 bp, Homo sapiens
cataattaggcagttgatcatt

SEQ ID NO: 7385785 - DNA, 22 bp, Homo sapiens
tcagcagtcaaagagaatctct

SEQ ID NO: 7385786 - DNA, 22 bp, Homo sapiens
tcagcagtagagggggcacagt

SEQ ID NO: 7385787 - DNA, 22 bp, Homo sapiens
tcagcagtcaaagagaatctct

SEQ ID NO: 7385788 - DNA, 22 bp, Homo sapiens
tcagcagtcacatgttgtccca

SEQ ID NO: 7385789 - DNA, 22 bp, Homo sapiens
cataacatccttgctactttga

SEQ ID NO: 7385790 - DNA, 22 bp, Homo sapiens
tcagcagtcctccaggatcaag

SEQ ID NO: 7385791 - DNA, 22 bp, Homo sapiens
cataatatctccgattacttgc

SEQ ID NO: 7385792 - DNA, 22 bp, Homo sapiens
cataatatctccgattacttgc

SEQ ID NO: 7385793 - DNA, 22 bp, Homo sapiens
cataatatctccgattacttgc

SEQ ID NO: 7385794 - DNA, 22 bp, Homo sapiens
cataatgaacattagctactgt

SEQ ID NO: 7385795 - DNA, 22 bp, Homo sapiens
cataatgtgtgtcatacagact

SEQ ID NO: 7385796 - DNA, 22 bp, Homo sapiens
cataatgtctgacacagtaaga

SEQ ID NO: 7385797 - DNA, 22 bp, Homo sapiens
cataatcagatgtgtacataag

SEQ ID NO: 7385798 - DNA, 17 bp, Homo sapiens
tcagcagtaatggtggg

SEQ ID NO: 7385799 - DNA, 22 bp, Homo sapiens
cagttgtccccaaaatatacgg

SEQ ID NO: 7385800 - DNA, 22 bp, Homo sapiens
cagttactgtatgtcaaagact

SEQ ID NO: 7385801 - DNA, 22 bp, Homo sapiens
tcaatgaaagagcatgcatttt

SEQ ID NO: 7385802 - DNA, 17 bp, Homo sapiens
cagttgaaatgtttgga

SEQ ID NO: 7385803 - DNA, 22 bp, Homo sapiens
cagttgaatggtcagacaaggc

SEQ ID NO: 7385804 - DNA, 22 bp, Homo sapiens
tcaatgaaagagcatgcatttt

SEQ ID NO: 7385805 - DNA, 23 bp, Homo sapiens
cataaaatattagtatggtagca

SEQ ID NO: 7385806 - DNA, 23 bp, Homo sapiens
cataaaatattagtatggtagca

SEQ ID NO: 7385807 - DNA, 23 bp, Homo sapiens
cataaaatattagtatggtagca

SEQ ID NO: 7385808 - DNA, 22 bp, Homo sapiens
cataaaagccacctatttaaag

SEQ ID NO: 7385809 - DNA, 22 bp, Homo sapiens
ccacactccccgcaggcgtagg

SEQ ID NO: 7385810 - DNA, 22 bp, Homo sapiens
tcctgggagacccagctgtgga

SEQ ID NO: 7385811 - DNA, 22 bp, Homo sapiens
ccactgtttttcagttaacttt

SEQ ID NO: 7385812 - DNA, 22 bp, Homo sapiens
ccacttcatcccagctcagata

SEQ ID NO: 7385813 - DNA, 22 bp, Homo sapiens
tctaagaagggttttaaatatt

SEQ ID NO: 7385814 - DNA, 22 bp, Homo sapiens
ccactgggggctgctcccaggt

SEQ ID NO: 7385815 - DNA, 22 bp, Homo sapiens
ccactgctaacttgctgcagct

SEQ ID NO: 7385816 - DNA, 22 bp, Homo sapiens
tctaagggaaggtgatatgtta

SEQ ID NO: 7385817 - DNA, 22 bp, Homo sapiens
tctaagtttggtgattaccaat

SEQ ID NO: 7385818 - DNA, 22 bp, Homo sapiens
tctaagttttaattggcaatgt

SEQ ID NO: 7385819 - DNA, 22 bp, Homo sapiens
ccagacaggggctgttcctgct

SEQ ID NO: 7385820 - DNA, 22 bp, Homo sapiens
ccagagaattttagacaaaaat

SEQ ID NO: 7385821 - DNA, 19 bp, Homo sapiens
tccttaaaaaagcagttct

SEQ ID NO: 7385822 - DNA, 22 bp, Homo sapiens
tccttgtaaaggagctctaaca

SEQ ID NO: 7385823 - DNA, 22 bp, Homo sapiens
tcctttatcaaggagccttaga

SEQ ID NO: 7385824 - DNA, 22 bp, Homo sapiens
tcctttatctgctcagaaagta

SEQ ID NO: 7385825 - DNA, 22 bp, Homo sapiens
tcctttatgtgagttgtttccc

SEQ ID NO: 7385826 - DNA, 19 bp, Homo sapiens
tccttccccccagcacaga

SEQ ID NO: 7385827 - DNA, 22 bp, Homo sapiens
cattagaattaggttgtttacc

SEQ ID NO: 7385828 - DNA, 22 bp, Homo sapiens
cattagaagaacagttatatta

SEQ ID NO: 7385829 - DNA, 21 bp, Homo sapiens
cattacatggttttagtgaac

SEQ ID NO: 7385830 - DNA, 21 bp, Homo sapiens
cattacatggttttagtgaac

SEQ ID NO: 7385831 - DNA, 22 bp, Homo sapiens
cattagcattacttcaaagagt

SEQ ID NO: 7385832 - DNA, 22 bp, Homo sapiens
cattagcattacttcaaagagt

SEQ ID NO: 7385833 - DNA, 22 bp, Homo sapiens
cattaggtatttaagcacacag

SEQ ID NO: 7385834 - DNA, 22 bp, Homo sapiens
cattctcaatagtagatgagta

SEQ ID NO: 7385835 - DNA, 22 bp, Homo sapiens
cattcttgaaccaggcactgtg

SEQ ID NO: 7385836 - DNA, 22 bp, Homo sapiens
cattctctgatcttcacatacc

SEQ ID NO: 7385837 - DNA, 22 bp, Homo sapiens
cattcttacacaatattttaat

SEQ ID NO: 7385838 - DNA, 22 bp, Homo sapiens
cattcttatatttactcattca

SEQ ID NO: 7385839 - DNA, 22 bp, Homo sapiens
tccaggagattcattaggtcat

SEQ ID NO: 7385840 - DNA, 22 bp, Homo sapiens
tccaggagacacaaggtacata

SEQ ID NO: 7385841 - DNA, 17 bp, Homo sapiens
tccaggagaggcaatgg

SEQ ID NO: 7385842 - DNA, 22 bp, Homo sapiens
catgggaggttggcttggcatg

SEQ ID NO: 7385843 - DNA, 22 bp, Homo sapiens
catgggaggtctgcaaggtgct

SEQ ID NO: 7385844 - DNA, 23 bp, Homo sapiens
catgggagtgagaatgccagctc

SEQ ID NO: 7385845 - DNA, 21 bp, Homo sapiens
tccaggagcacgggactagga

SEQ ID NO: 7385846 - DNA, 22 bp, Homo sapiens
catgggaggcctgctgctggtg

SEQ ID NO: 7385847 - DNA, 22 bp, Homo sapiens
tccattttcatctcatgtataa

SEQ ID NO: 7385848 - DNA, 22 bp, Homo sapiens
tcccaaaatacttttctctcct

SEQ ID NO: 7385849 - DNA, 22 bp, Homo sapiens
cattgcactcctgcctgggcaa

SEQ ID NO: 7385850 - DNA, 22 bp, Homo sapiens
cattgcactccagcctgggcca

SEQ ID NO: 7385851 - DNA, 22 bp, Homo sapiens
cattgcactccagcctgggcaa

SEQ ID NO: 7385852 - DNA, 22 bp, Homo sapiens
tcccactcactgtctctgacac

SEQ ID NO: 7385853 - DNA, 22 bp, Homo sapiens
tcccactcagtccttttcagtt

SEQ ID NO: 7385854 - DNA, 22 bp, Homo sapiens
cattgtcacccaaagctcatag

SEQ ID NO: 7385855 - DNA, 22 bp, Homo sapiens
cattgtgtatttctgtagtact

SEQ ID NO: 7385856 - DNA, 22 bp, Homo sapiens
catttaatctggctcatgagca

SEQ ID NO: 7385857 - DNA, 22 bp, Homo sapiens
tccctccttaataagaggtctg

SEQ ID NO: 7385858 - DNA, 22 bp, Homo sapiens
tccctggggttcctccagccac

SEQ ID NO: 7385859 - DNA, 22 bp, Homo sapiens
tccctgctttcttgtgagggga

SEQ ID NO: 7385860 - DNA, 22 bp, Homo sapiens
tccctggaacagagagacaacg

SEQ ID NO: 7385861 - DNA, 22 bp, Homo sapiens
catttattgagtggccacagtg

SEQ ID NO: 7385862 - DNA, 22 bp, Homo sapiens
catttattcagctcagtcggtt

SEQ ID NO: 7385863 - DNA, 22 bp, Homo sapiens
catttattcatttgctagggct

SEQ ID NO: 7385864 - DNA, 22 bp, Homo sapiens
catttattcatgatctgtagct

SEQ ID NO: 7385865 - DNA, 22 bp, Homo sapiens
catttattcatgatctgtagct

SEQ ID NO: 7385866 - DNA, 22 bp, Homo sapiens
catttattcatttgctagggct

SEQ ID NO: 7385867 - DNA, 18 bp, Homo sapiens
ctgcactgtgggtagctc

SEQ ID NO: 7385868 - DNA, 22 bp, Homo sapiens
ctgcactgtgtaacagataact

SEQ ID NO: 7385869 - DNA, 22 bp, Homo sapiens
ctgcactgagctctcccagccc

SEQ ID NO: 7385870 - DNA, 22 bp, Homo sapiens
ctgcactgctgatcccaggtct

SEQ ID NO: 7385871 - DNA, 22 bp, Homo sapiens
ctgcactgtgtattccttggct

SEQ ID NO: 7385872 - DNA, 18 bp, Homo sapiens
ctgcacttcagcttgggc

SEQ ID NO: 7385873 - DNA, 22 bp, Homo sapiens
ctgcactgacttccccggctgc

SEQ ID NO: 7385874 - DNA, 22 bp, Homo sapiens
ctgcactgagcatctaacctta

SEQ ID NO: 7385875 - DNA, 19 bp, Homo sapiens
ctgcactgagaaaaggagg

SEQ ID NO: 7385876 - DNA, 22 bp, Homo sapiens
ctgcactgagaccctctttgct

SEQ ID NO: 7385877 - DNA, 22 bp, Homo sapiens
ctgcaccacagcctgaggcagc

SEQ ID NO: 7385878 - DNA, 22 bp, Homo sapiens
ctgcacatagtaagtactcaat

SEQ ID NO: 7385879 - DNA, 22 bp, Homo sapiens
ctgcacatgtccctaagtgtca

SEQ ID NO: 7385880 - DNA, 22 bp, Homo sapiens
ctgcacagagcggcagttctta

SEQ ID NO: 7385881 - DNA, 22 bp, Homo sapiens
ctgcacacatcgcactgcccgt

SEQ ID NO: 7385882 - DNA, 22 bp, Homo sapiens
ctgcacacatcgcactgcccgt

SEQ ID NO: 7385883 - DNA, 22 bp, Homo sapiens
ctgcacacatatggcttctctc

SEQ ID NO: 7385884 - DNA, 20 bp, Homo sapiens
ctgcaaaatgacattaggaa

SEQ ID NO: 7385885 - DNA, 22 bp, Homo sapiens
ctgaggccggagcactgaagag

SEQ ID NO: 7385886 - DNA, 22 bp, Homo sapiens
ctgcacaggggatgagggcagt

SEQ ID NO: 7385887 - DNA, 22 bp, Homo sapiens
ctgcacagctgggcaagatata

SEQ ID NO: 7385888 - DNA, 22 bp, Homo sapiens
ctgcacagctgggcaagatata

SEQ ID NO: 7385889 - DNA, 22 bp, Homo sapiens
ctgcacagctggccagggagag

SEQ ID NO: 7385890 - DNA, 22 bp, Homo sapiens
ctgaggcatgggaagttgggtg

SEQ ID NO: 7385891 - DNA, 18 bp, Homo sapiens
ctgaggccaactacactg

SEQ ID NO: 7385892 - DNA, 22 bp, Homo sapiens
ctgaggccagctgcagagctct

SEQ ID NO: 7385893 - DNA, 22 bp, Homo sapiens
ctgaggccagagtgggcctctt

SEQ ID NO: 7385894 - DNA, 22 bp, Homo sapiens
ctgaggccagaacccgaccctg

SEQ ID NO: 7385895 - DNA, 17 bp, Homo sapiens
ctgaggcccagggccca

SEQ ID NO: 7385896 - DNA, 17 bp, Homo sapiens
ctgaggcccagggccca

SEQ ID NO: 7385897 - DNA, 18 bp, Homo sapiens
ctgaggcccagagagggc

SEQ ID NO: 7385898 - DNA, 22 bp, Homo sapiens
ctgaggccagctgcagagctct

SEQ ID NO: 7385899 - DNA, 22 bp, Homo sapiens
ctgaggccggagcactgaagag

SEQ ID NO: 7385900 - DNA, 22 bp, Homo sapiens
ctgaggcccctcttgtgagcat

SEQ ID NO: 7385901 - DNA, 22 bp, Homo sapiens
ctgaggcccctctcttgagctt

SEQ ID NO: 7385902 - DNA, 19 bp, Homo sapiens
ctgaggcccatgtaccatg

SEQ ID NO: 7385903 - DNA, 22 bp, Homo sapiens
ctgagccatccataccagctta

SEQ ID NO: 7385904 - DNA, 22 bp, Homo sapiens
ctgagccatgagcctgcgccca

SEQ ID NO: 7385905 - DNA, 20 bp, Homo sapiens
ctgagccaactctcttcttg

SEQ ID NO: 7385906 - DNA, 22 bp, Homo sapiens
ctgaccttcccaggggctggaa

SEQ ID NO: 7385907 - DNA, 22 bp, Homo sapiens
ctgaccttcgggcgggctgcgg

SEQ ID NO: 7385908 - DNA, 22 bp, Homo sapiens
ctgactgtaattctgttcttaa

SEQ ID NO: 7385909 - DNA, 22 bp, Homo sapiens
ctgagccctgcctcttgtcact

SEQ ID NO: 7385910 - DNA, 22 bp, Homo sapiens
ctgagcccttgaacccaagtcc

SEQ ID NO: 7385911 - DNA, 22 bp, Homo sapiens
ctgagcctcctgcttctatttc

SEQ ID NO: 7385912 - DNA, 22 bp, Homo sapiens
ctgagcctcctgcttctatttc

SEQ ID NO: 7385913 - DNA, 22 bp, Homo sapiens
ctctttcctcgatgggctcctg

SEQ ID NO: 7385914 - DNA, 22 bp, Homo sapiens
ctctttagtggtgatgatgcta

SEQ ID NO: 7385915 - DNA, 22 bp, Homo sapiens
ctctttagtttgaaatccacat

SEQ ID NO: 7385916 - DNA, 22 bp, Homo sapiens
ctctttggatagaattacaaag

SEQ ID NO: 7385917 - DNA, 22 bp, Homo sapiens
ctctttggatagaattacaaag

SEQ ID NO: 7385918 - DNA, 19 bp, Homo sapiens
ctctttggagatccttgga

SEQ ID NO: 7385919 - DNA, 22 bp, Homo sapiens
ctctttggatgtttatgataag

SEQ ID NO: 7385920 - DNA, 22 bp, Homo sapiens
ctctttggccagaaaatgtttt

SEQ ID NO: 7385921 - DNA, 22 bp, Homo sapiens
ctctttggagaagcacgtatta

SEQ ID NO: 7385922 - DNA, 22 bp, Homo sapiens
ctctttgaaatccatcactgct

SEQ ID NO: 7385923 - DNA, 22 bp, Homo sapiens
ctgacatttactgagcacttac

SEQ ID NO: 7385924 - DNA, 22 bp, Homo sapiens
ctgacaggttggtagctttgga

SEQ ID NO: 7385925 - DNA, 20 bp, Homo sapiens
ctgaccagcagcctgtctcc

SEQ ID NO: 7385926 - DNA, 22 bp, Homo sapiens
ctgaccctagcatctctgtgca

SEQ ID NO: 7385927 - DNA, 18 bp, Homo sapiens
ctgaccctggctctgggt

SEQ ID NO: 7385928 - DNA, 22 bp, Homo sapiens
ctgacaggctgagatccctggt

SEQ ID NO: 7385929 - DNA, 22 bp, Homo sapiens
ctgacagggtagacagagggca

SEQ ID NO: 7385930 - DNA, 22 bp, Homo sapiens
tttgcctagtagattacctgtt

SEQ ID NO: 7385931 - DNA, 22 bp, Homo sapiens
tttgcctgggaattctagtgta

SEQ ID NO: 7385932 - DNA, 20 bp, Homo sapiens
tttgcccttcctctgccttt

SEQ ID NO: 7385933 - DNA, 22 bp, Homo sapiens
tttgccaggtaagtactatgct

SEQ ID NO: 7385934 - DNA, 22 bp, Homo sapiens
tttgctaagagaactcgtggac

SEQ ID NO: 7385935 - DNA, 22 bp, Homo sapiens
tttgctaaaatgtattgggatt

SEQ ID NO: 7385936 - DNA, 22 bp, Homo sapiens
tttgctaaaaggccattgattt

SEQ ID NO: 7385937 - DNA, 22 bp, Homo sapiens
tttgctaaaagtgatgaagaca

SEQ ID NO: 7385938 - DNA, 20 bp, Homo sapiens
ctctgctttccacctttcag

SEQ ID NO: 7385939 - DNA, 20 bp, Homo sapiens
ctctgcccccagactgacag

SEQ ID NO: 7385940 - DNA, 22 bp, Homo sapiens
ctctgcccccagctggtgcttg

SEQ ID NO: 7385941 - DNA, 22 bp, Homo sapiens
ctctgcccccagctggtgcttg

SEQ ID NO: 7385942 - DNA, 22 bp, Homo sapiens
ctctgcccgtgcctttcccagt

SEQ ID NO: 7385943 - DNA, 22 bp, Homo sapiens
tttgcattttgataagatcact

SEQ ID NO: 7385944 - DNA, 22 bp, Homo sapiens
tttgcaaagtgcttgcagagta

SEQ ID NO: 7385945 - DNA, 22 bp, Homo sapiens
ctctgccctcgcacatctgcca

SEQ ID NO: 7385946 - DNA, 22 bp, Homo sapiens
tttccttgttcatttgccctat

SEQ ID NO: 7385947 - DNA, 22 bp, Homo sapiens
tttccttgttattatttgtcct

SEQ ID NO: 7385948 - DNA, 22 bp, Homo sapiens
tttcctttatgacatcaccact

SEQ ID NO: 7385949 - DNA, 22 bp, Homo sapiens
tttcctttatgacatcaccact

SEQ ID NO: 7385950 - DNA, 22 bp, Homo sapiens
ctctgccaccatgcttcctgac

SEQ ID NO: 7385951 - DNA, 22 bp, Homo sapiens
ctctgccactcgaagtcaagga

SEQ ID NO: 7385952 - DNA, 20 bp, Homo sapiens
ctctgcagcaaggcctgggt

SEQ ID NO: 7385953 - DNA, 22 bp, Homo sapiens
tttcctttccaaaattctgcct

SEQ ID NO: 7385954 - DNA, 20 bp, Homo sapiens
tttcctttcattttagtacc

SEQ ID NO: 7385955 - DNA, 22 bp, Homo sapiens
tttcctttccaaaattctgcct

SEQ ID NO: 7385956 - DNA, 22 bp, Homo sapiens
ctctgccatcagtttttctttg

SEQ ID NO: 7385957 - DNA, 22 bp, Homo sapiens
ctctgccatctcactgggtcct

SEQ ID NO: 7385958 - DNA, 22 bp, Homo sapiens
ctctgccatcttggagctcaag

SEQ ID NO: 7385959 - DNA, 22 bp, Homo sapiens
ctctgccagccaaaatttatga

SEQ ID NO: 7385960 - DNA, 22 bp, Homo sapiens
ctctgccagccaaagtcatcac

SEQ ID NO: 7385961 - DNA, 22 bp, Homo sapiens
ctctgccagtttctggcctcag

SEQ ID NO: 7385962 - DNA, 22 bp, Homo sapiens
ctctgccatcttggagctcaag

SEQ ID NO: 7385963 - DNA, 22 bp, Homo sapiens
ctctgccatttatcagaactgt

SEQ ID NO: 7385964 - DNA, 22 bp, Homo sapiens
ctctgcccacgtcttgcccaga

SEQ ID NO: 7385965 - DNA, 21 bp, Homo sapiens
ctctgcccagggcctcctgcc

SEQ ID NO: 7385966 - DNA, 22 bp, Homo sapiens
tttgtacacaggatgttataat

SEQ ID NO: 7385967 - DNA, 22 bp, Homo sapiens
tttgtacatataaatcttgtat

SEQ ID NO: 7385968 - DNA, 22 bp, Homo sapiens
ttttaagaactgttctgtgctt

SEQ ID NO: 7385969 - DNA, 22 bp, Homo sapiens
ttttaagaggaggctgtttgaa

SEQ ID NO: 7385970 - DNA, 22 bp, Homo sapiens
ttttaatactgctattgtagga

SEQ ID NO: 7385971 - DNA, 22 bp, Homo sapiens
ttttaatactgctattgtagga

SEQ ID NO: 7385972 - DNA, 22 bp, Homo sapiens
ttttagatagtttaactgcact

SEQ ID NO: 7385973 - DNA, 21 bp, Homo sapiens
ctcttcagtggtgagctcttc

SEQ ID NO: 7385974 - DNA, 20 bp, Homo sapiens
ctcttcaaatattttattct

SEQ ID NO: 7385975 - DNA, 22 bp, Homo sapiens
ctcttattgatgaaggtgctaa

SEQ ID NO: 7385976 - DNA, 22 bp, Homo sapiens
ctctttagtcacagggcttcat

SEQ ID NO: 7385977 - DNA, 22 bp, Homo sapiens
ctctttagtctgtgtggagaag

SEQ ID NO: 7385978 - DNA, 22 bp, Homo sapiens
ctctttaaagtaaaatttgtct

SEQ ID NO: 7385979 - DNA, 22 bp, Homo sapiens
ctctttaagctcctaacagcca

SEQ ID NO: 7385980 - DNA, 22 bp, Homo sapiens
ttttcagttatagaatggtaga

SEQ ID NO: 7385981 - DNA, 22 bp, Homo sapiens
ctcttcttgctagactgagtgc

SEQ ID NO: 7385982 - DNA, 22 bp, Homo sapiens
ctcttcttggaatgctgactgt

SEQ ID NO: 7385983 - DNA, 22 bp, Homo sapiens
ttttcagtaatgtctacataat

SEQ ID NO: 7385984 - DNA, 22 bp, Homo sapiens
ttttcagtggcttgcatatgtt

SEQ ID NO: 7385985 - DNA, 22 bp, Homo sapiens
ctcccaggactcagaggagaag

SEQ ID NO: 7385986 - DNA, 22 bp, Homo sapiens
ctccattgttcgcgcagctgca

SEQ ID NO: 7385987 - DNA, 22 bp, Homo sapiens
ctcccacatggaatagcaggga

SEQ ID NO: 7385988 - DNA, 22 bp, Homo sapiens
ctcccagggccatcgagtcact

SEQ ID NO: 7385989 - DNA, 22 bp, Homo sapiens
tttaagttccttttcaacaact

SEQ ID NO: 7385990 - DNA, 22 bp, Homo sapiens
ctcccaggcacagggaggagcc

SEQ ID NO: 7385991 - DNA, 22 bp, Homo sapiens
ctcccaggcagggctgcccact

SEQ ID NO: 7385992 - DNA, 22 bp, Homo sapiens
tttaatatccagtggatacaaa

SEQ ID NO: 7385993 - DNA, 22 bp, Homo sapiens
tttaatatctcacacttccatg

SEQ ID NO: 7385994 - DNA, 23 bp, Homo sapiens
ttgtgggcagattccatggggag

SEQ ID NO: 7385995 - DNA, 22 bp, Homo sapiens
ttgtgggcttgcctggctcttg

SEQ ID NO: 7385996 - DNA, 22 bp, Homo sapiens
ttgtgggccattcagctgctct

SEQ ID NO: 7385997 - DNA, 22 bp, Homo sapiens
ttgtggggcaacagcaggtgaa

SEQ ID NO: 7385998 - DNA, 22 bp, Homo sapiens
ttgtattttgttatgctactgc

SEQ ID NO: 7385999 - DNA, 23 bp, Homo sapiens
ttgtatttttagtagagacaggg

SEQ ID NO: 7386000 - DNA, 20 bp, Homo sapiens
ctccagcccctgccctggtc

SEQ ID NO: 7386001 - DNA, 22 bp, Homo sapiens
ctccagccagagtgcctctgtt

SEQ ID NO: 7386002 - DNA, 22 bp, Homo sapiens
ttgtcttagagtgaaaacttta

SEQ ID NO: 7386003 - DNA, 19 bp, Homo sapiens
ttgtcttagctgcataaga

SEQ ID NO: 7386004 - DNA, 22 bp, Homo sapiens
ctcatttatttctcccaaaaca

SEQ ID NO: 7386005 - DNA, 22 bp, Homo sapiens
ctcatttaacagattaaaaagt

SEQ ID NO: 7386006 - DNA, 22 bp, Homo sapiens
ctcatttacctttgcaatcaag

SEQ ID NO: 7386007 - DNA, 22 bp, Homo sapiens
ctcatttacctttgcaatcaag

SEQ ID NO: 7386008 - DNA, 22 bp, Homo sapiens
ctcatttactcatctgcaaaac

SEQ ID NO: 7386009 - DNA, 22 bp, Homo sapiens
ctcatttaacagattaaaaagt

SEQ ID NO: 7386010 - DNA, 23 bp, Homo sapiens
ctccaagggagggcaaacaacag

SEQ ID NO: 7386011 - DNA, 22 bp, Homo sapiens
ctccaaggaagccccaagggat

SEQ ID NO: 7386012 - DNA, 19 bp, Homo sapiens
ctccacagggattgtgatt

SEQ ID NO: 7386013 - DNA, 22 bp, Homo sapiens
ctccacagctcaggctcagagt

SEQ ID NO: 7386014 - DNA, 22 bp, Homo sapiens
ctccaaggtttcagaacaaatg

SEQ ID NO: 7386015 - DNA, 22 bp, Homo sapiens
ctccacagcccctccagtggca

SEQ ID NO: 7386016 - DNA, 22 bp, Homo sapiens
ctccacagagatgctgattgta

SEQ ID NO: 7386017 - DNA, 22 bp, Homo sapiens
ttggtcagcactgatgtttcag

SEQ ID NO: 7386018 - DNA, 22 bp, Homo sapiens
ttggtcagctaataaggacagg

SEQ ID NO: 7386019 - DNA, 22 bp, Homo sapiens
ttggtcagatgtgtctcctcct

SEQ ID NO: 7386020 - DNA, 22 bp, Homo sapiens
ttggtcagattgggcttccatt

SEQ ID NO: 7386021 - DNA, 22 bp, Homo sapiens
ctccacagttgctgcttttaat

SEQ ID NO: 7386022 - DNA, 22 bp, Homo sapiens
ctcctcccaattgccaagtgct

SEQ ID NO: 7386023 - DNA, 22 bp, Homo sapiens
tttattgttgttagtcataagt

SEQ ID NO: 7386024 - DNA, 22 bp, Homo sapiens
tttatttaaagtcgtgtgttaa

SEQ ID NO: 7386025 - DNA, 22 bp, Homo sapiens
tttattgtttagaagggggctg

SEQ ID NO: 7386026 - DNA, 22 bp, Homo sapiens
tttatttaccttatgtcctcca

SEQ ID NO: 7386027 - DNA, 22 bp, Homo sapiens
tttatttaccttatgtcctcca

SEQ ID NO: 7386028 - DNA, 16 bp, Homo sapiens
tttatttactagtgtt

SEQ ID NO: 7386029 - DNA, 17 bp, Homo sapiens
ctcctggcagcctcagg

SEQ ID NO: 7386030 - DNA, 22 bp, Homo sapiens
ctccccattatgcagtcattat

SEQ ID NO: 7386031 - DNA, 22 bp, Homo sapiens
ctcccccttagctcttgtcttt

SEQ ID NO: 7386032 - DNA, 22 bp, Homo sapiens
ctcccctccttaggtcttctag

SEQ ID NO: 7386033 - DNA, 20 bp, Homo sapiens
ctcccctctacagagggctg

SEQ ID NO: 7386034 - DNA, 22 bp, Homo sapiens
tttagtatcctatctcatttaa

SEQ ID NO: 7386035 - DNA, 22 bp, Homo sapiens
tttagtattctctatttccatc

SEQ ID NO: 7386036 - DNA, 23 bp, Homo sapiens
tttagtcagttgacagccatata

SEQ ID NO: 7386037 - DNA, 22 bp, Homo sapiens
tttagtgataagaattatgaaa

SEQ ID NO: 7386038 - DNA, 22 bp, Homo sapiens
tttagtagaatagtatatcaaa

SEQ ID NO: 7386039 - DNA, 22 bp, Homo sapiens
ctctccaggggtagatgccttc

SEQ ID NO: 7386040 - DNA, 22 bp, Homo sapiens
ctctctggaagggggagctgat

SEQ ID NO: 7386041 - DNA, 22 bp, Homo sapiens
tttccttgggtctcttagtggc

SEQ ID NO: 7386042 - DNA, 18 bp, Homo sapiens
tttccttgtatgaacata

SEQ ID NO: 7386043 - DNA, 22 bp, Homo sapiens
tttccttgcctcctgtccttct

SEQ ID NO: 7386044 - DNA, 22 bp, Homo sapiens
tttcctaaggtagtgataattt

SEQ ID NO: 7386045 - DNA, 20 bp, Homo sapiens
tttcctaagtggtttgctga

SEQ ID NO: 7386046 - DNA, 22 bp, Homo sapiens
tttcctaagatagatacttcag

SEQ ID NO: 7386047 - DNA, 22 bp, Homo sapiens
tttcctaactcatcggatgtac

SEQ ID NO: 7386048 - DNA, 22 bp, Homo sapiens
tttcctaaggctcattttaaaa

SEQ ID NO: 7386049 - DNA, 22 bp, Homo sapiens
tttcctaacacaatgcatgaga

SEQ ID NO: 7386050 - DNA, 22 bp, Homo sapiens
tttccagagcatgtctgctcag

SEQ ID NO: 7386051 - DNA, 22 bp, Homo sapiens
tttcacatacagtgtatagtag

SEQ ID NO: 7386052 - DNA, 22 bp, Homo sapiens
tttcacatagaaagtgatttac

SEQ ID NO: 7386053 - DNA, 22 bp, Homo sapiens
tttcacataaatattatgccta

SEQ ID NO: 7386054 - DNA, 22 bp, Homo sapiens
tttcacataaatggagtaaaga

SEQ ID NO: 7386055 - DNA, 22 bp, Homo sapiens
tttcacagtagaaatcattatg

SEQ ID NO: 7386056 - DNA, 22 bp, Homo sapiens
tttcacagtagaaatcattatg

SEQ ID NO: 7386057 - DNA, 20 bp, Homo sapiens
tttcacagtccctgtttcct

SEQ ID NO: 7386058 - DNA, 22 bp, Homo sapiens
tttcacaaactcagggtgtgtg

SEQ ID NO: 7386059 - DNA, 22 bp, Homo sapiens
tttcacaggtacaaacactcct

SEQ ID NO: 7386060 - DNA, 22 bp, Homo sapiens
tttcaattaggatgtttccatg

SEQ ID NO: 7386061 - DNA, 22 bp, Homo sapiens
cctgtcactctgagccgctccg

SEQ ID NO: 7386062 - DNA, 22 bp, Homo sapiens
cctgtcactgttgcagccagct

SEQ ID NO: 7386063 - DNA, 22 bp, Homo sapiens
tgtttataatatgcagtgagca

SEQ ID NO: 7386064 - DNA, 17 bp, Homo sapiens
cctgtcttgtttctgcc

SEQ ID NO: 7386065 - DNA, 21 bp, Homo sapiens
cctgtcttggactgaggcacc

SEQ ID NO: 7386066 - DNA, 23 bp, Homo sapiens
cctgtctgtgctgggtggacaca

SEQ ID NO: 7386067 - DNA, 22 bp, Homo sapiens
ttaaagtttcagaaacttggtc

SEQ ID NO: 7386068 - DNA, 22 bp, Homo sapiens
cctgtgggagcccaggcagata

SEQ ID NO: 7386069 - DNA, 22 bp, Homo sapiens
cctgtgggtcacatgggtgact

SEQ ID NO: 7386070 - DNA, 22 bp, Homo sapiens
ttaaagctgctgaatcctattt

SEQ ID NO: 7386071 - DNA, 22 bp, Homo sapiens
ttaaagctgagccctcagaagc

SEQ ID NO: 7386072 - DNA, 21 bp, Homo sapiens
ttaaagctatggtagtgggct

SEQ ID NO: 7386073 - DNA, 22 bp, Homo sapiens
ttaaagctggcgttacagtttg

SEQ ID NO: 7386074 - DNA, 22 bp, Homo sapiens
ttaaagctgtagagttacttgc

SEQ ID NO: 7386075 - DNA, 22 bp, Homo sapiens
ttaaagcttgattcgaagctta

SEQ ID NO: 7386076 - DNA, 22 bp, Homo sapiens
ttaaagctaggtggaacaaatt

SEQ ID NO: 7386077 - DNA, 22 bp, Homo sapiens
cctgtgccctcagcctggctct

SEQ ID NO: 7386078 - DNA, 22 bp, Homo sapiens
cctgtgccatcctgagcatccc

SEQ ID NO: 7386079 - DNA, 22 bp, Homo sapiens
cctgtgccctggaaggagagag

SEQ ID NO: 7386080 - DNA, 22 bp, Homo sapiens
ccttcctttcagggctatgcct

SEQ ID NO: 7386081 - DNA, 22 bp, Homo sapiens
ccttcctttgcaggtcaggtca

SEQ ID NO: 7386082 - DNA, 22 bp, Homo sapiens
ccttccttcaagcacacatcta

SEQ ID NO: 7386083 - DNA, 22 bp, Homo sapiens
ccttccttgtctacaaaagctc

SEQ ID NO: 7386084 - DNA, 22 bp, Homo sapiens
ccttccttgagaagcaattcct

SEQ ID NO: 7386085 - DNA, 22 bp, Homo sapiens
ccttccttgtctacaaaagctc

SEQ ID NO: 7386086 - DNA, 22 bp, Homo sapiens
ccttccttttactgtctccgga

SEQ ID NO: 7386087 - DNA, 22 bp, Homo sapiens
ccttcctttgcatcatttctag

SEQ ID NO: 7386088 - DNA, 22 bp, Homo sapiens
ttactaagagaagtaaatattt

SEQ ID NO: 7386089 - DNA, 22 bp, Homo sapiens
ttacttttgcaccaaactaata

SEQ ID NO: 7386090 - DNA, 21 bp, Homo sapiens
ttacttttgcaccaacctaat

SEQ ID NO: 7386091 - DNA, 22 bp, Homo sapiens
ttacttttgcaccaaactaata

SEQ ID NO: 7386092 - DNA, 22 bp, Homo sapiens
ttacttttgcaccaaactaata

SEQ ID NO: 7386093 - DNA, 23 bp, Homo sapiens
ttacttttgcaccaacctaatat

SEQ ID NO: 7386094 - DNA, 21 bp, Homo sapiens
ttacttttgcagcaacctaat

SEQ ID NO: 7386095 - DNA, 22 bp, Homo sapiens
ttagaaaaaggctgtggtctta

SEQ ID NO: 7386096 - DNA, 22 bp, Homo sapiens
ttagaaaaatgttcagtagttt

SEQ ID NO: 7386097 - DNA, 22 bp, Homo sapiens
ttagaaaacataagtggtaaag

SEQ ID NO: 7386098 - DNA, 22 bp, Homo sapiens
ttagaagtacataagacaagga

SEQ ID NO: 7386099 - DNA, 22 bp, Homo sapiens
ttagaagtacatttagaacata

SEQ ID NO: 7386100 - DNA, 22 bp, Homo sapiens
ttagaagtcatctagtctaaaa

SEQ ID NO: 7386101 - DNA, 22 bp, Homo sapiens
ttagaagtcagtatataggtgg

SEQ ID NO: 7386102 - DNA, 22 bp, Homo sapiens
ttagaagtgaaatagctgtaca

SEQ ID NO: 7386103 - DNA, 22 bp, Homo sapiens
ttagaagtgaaatgctgcagag

SEQ ID NO: 7386104 - DNA, 22 bp, Homo sapiens
ttagaagtgaaatgctgcagag

SEQ ID NO: 7386105 - DNA, 20 bp, Homo sapiens
ttagaagtggctatttcctc

SEQ ID NO: 7386106 - DNA, 22 bp, Homo sapiens
ttagaatttctgctcactttga

SEQ ID NO: 7386107 - DNA, 22 bp, Homo sapiens
ttagacaagggctccttaaaag

SEQ ID NO: 7386108 - DNA, 22 bp, Homo sapiens
ttagaagtgggcctatagtcct

SEQ ID NO: 7386109 - DNA, 22 bp, Homo sapiens
ttagaagtggtaagtagaaaga

SEQ ID NO: 7386110 - DNA, 22 bp, Homo sapiens
ttagaagttcaggtctgtaatc

SEQ ID NO: 7386111 - DNA, 22 bp, Homo sapiens
ccttcattattcctgaactgtt

SEQ ID NO: 7386112 - DNA, 22 bp, Homo sapiens
ccttccccaggtgctcactgtc

SEQ ID NO: 7386113 - DNA, 20 bp, Homo sapiens
ccttccccacccgctgaggt

SEQ ID NO: 7386114 - DNA, 19 bp, Homo sapiens
ccttccccttcagcctctg

SEQ ID NO: 7386115 - DNA, 22 bp, Homo sapiens
cctgtgtcttccccactggtgt

SEQ ID NO: 7386116 - DNA, 22 bp, Homo sapiens
tgtgttctgaaggagaagagtg

SEQ ID NO: 7386117 - DNA, 22 bp, Homo sapiens
cctgggctgtacctgtgcgcgg

SEQ ID NO: 7386118 - DNA, 22 bp, Homo sapiens
cctgggctgttgcatcatcctt

SEQ ID NO: 7386119 - DNA, 22 bp, Homo sapiens
tgtgttctcctacagataagga

SEQ ID NO: 7386120 - DNA, 22 bp, Homo sapiens
cctgggctctatcctgacccag

SEQ ID NO: 7386121 - DNA, 22 bp, Homo sapiens
tgtgtctggataggtaatggat

SEQ ID NO: 7386122 - DNA, 22 bp, Homo sapiens
tgttacaatattatcaactgag

SEQ ID NO: 7386123 - DNA, 20 bp, Homo sapiens
tgttccaagctaatgaatga

SEQ ID NO: 7386124 - DNA, 23 bp, Homo sapiens
tgttccagatacgccttttcctc

SEQ ID NO: 7386125 - DNA, 23 bp, Homo sapiens
tgttccagatacgccttttcctc

SEQ ID NO: 7386126 - DNA, 18 bp, Homo sapiens
tgttccaaggaaggaatc

SEQ ID NO: 7386127 - DNA, 22 bp, Homo sapiens
tgttccaagctgctggataagc

SEQ ID NO: 7386128 - DNA, 20 bp, Homo sapiens
tgttccaaggagttgagggg

SEQ ID NO: 7386129 - DNA, 22 bp, Homo sapiens
tgttccaataaggagttgaaat

SEQ ID NO: 7386130 - DNA, 22 bp, Homo sapiens
cctggttcagtctttctatgct

SEQ ID NO: 7386131 - DNA, 22 bp, Homo sapiens
cctggtggagaggggcggagcg

SEQ ID NO: 7386132 - DNA, 22 bp, Homo sapiens
cctggtggcttctgggtggacg

SEQ ID NO: 7386133 - DNA, 22 bp, Homo sapiens
tgtgtagtgattttcttccaac

SEQ ID NO: 7386134 - DNA, 22 bp, Homo sapiens
cctgggcaatatagtgaggccc

SEQ ID NO: 7386135 - DNA, 22 bp, Homo sapiens
cctgggcaacatagtgagaccc

SEQ ID NO: 7386136 - DNA, 22 bp, Homo sapiens
cctgggcaacatagtgagacct

SEQ ID NO: 7386137 - DNA, 22 bp, Homo sapiens
tgtgtctgaacatgctttgtaa

SEQ ID NO: 7386138 - DNA, 22 bp, Homo sapiens
tgtgtctgaacatgctttgtaa

SEQ ID NO: 7386139 - DNA, 23 bp, Homo sapiens
tgtgtctgaggatatatgtgcat

SEQ ID NO: 7386140 - DNA, 22 bp, Homo sapiens
tgtgtctgcactgagtcctcac

SEQ ID NO: 7386141 - DNA, 22 bp, Homo sapiens
tgtgtattaatgtttgtatatg

SEQ ID NO: 7386142 - DNA, 22 bp, Homo sapiens
tgtgtattaatgtttgtatatg

SEQ ID NO: 7386143 - DNA, 22 bp, Homo sapiens
tgtgtatatgtaaatatagttg

SEQ ID NO: 7386144 - DNA, 22 bp, Homo sapiens
tgggggactgcactggcgtcag

SEQ ID NO: 7386145 - DNA, 22 bp, Homo sapiens
tggggcttctcctgtaggctca

SEQ ID NO: 7386146 - DNA, 22 bp, Homo sapiens
cctttctacagatgcctcttgc

SEQ ID NO: 7386147 - DNA, 16 bp, Homo sapiens
cctttctctgccttcc

SEQ ID NO: 7386148 - DNA, 22 bp, Homo sapiens
cctttcccgctttgagggcaag

SEQ ID NO: 7386149 - DNA, 22 bp, Homo sapiens
cctttccccgcgggaggtgcca

SEQ ID NO: 7386150 - DNA, 22 bp, Homo sapiens
ttaggaatttatcacagactgg

SEQ ID NO: 7386151 - DNA, 22 bp, Homo sapiens
cctttctctggcagcaggacag

SEQ ID NO: 7386152 - DNA, 23 bp, Homo sapiens
cgcccagcctcagtgacctgggc

SEQ ID NO: 7386153 - DNA, 22 bp, Homo sapiens
cgcatgagacctgccggccatc

SEQ ID NO: 7386154 - DNA, 22 bp, Homo sapiens
cgcagctggatatcatgtgcct

SEQ ID NO: 7386155 - DNA, 22 bp, Homo sapiens
ttaggcctttgattggggtgct

SEQ ID NO: 7386156 - DNA, 22 bp, Homo sapiens
cgcagctgccttgtcagccgtt

SEQ ID NO: 7386157 - DNA, 22 bp, Homo sapiens
cgcagctgctgctctgaaacag

SEQ ID NO: 7386158 - DNA, 22 bp, Homo sapiens
ttcaagtttcgcaaggacatat

SEQ ID NO: 7386159 - DNA, 22 bp, Homo sapiens
ttcaagtttactttgaagttta

SEQ ID NO: 7386160 - DNA, 22 bp, Homo sapiens
ttcaagtttttaaaggcagtta

SEQ ID NO: 7386161 - DNA, 22 bp, Homo sapiens
ttcaagttttgacttagtcctt

SEQ ID NO: 7386162 - DNA, 22 bp, Homo sapiens
ttcaagttagagatatatttag

SEQ ID NO: 7386163 - DNA, 22 bp, Homo sapiens
ttcaatagaaatgacattcttt

SEQ ID NO: 7386164 - DNA, 22 bp, Homo sapiens
ttcacacacagcttcctattgt

SEQ ID NO: 7386165 - DNA, 22 bp, Homo sapiens
cgcccagggcaggaggccgctc

SEQ ID NO: 7386166 - DNA, 22 bp, Homo sapiens
cgccccagtctgtaggtgcccc

SEQ ID NO: 7386167 - DNA, 22 bp, Homo sapiens
cgccccagtctgtaggtgcccc

SEQ ID NO: 7386168 - DNA, 22 bp, Homo sapiens
cgcccaggctggagtgcagtgg

SEQ ID NO: 7386169 - DNA, 22 bp, Homo sapiens
cgcccaggctggagtgcagtga

SEQ ID NO: 7386170 - DNA, 22 bp, Homo sapiens
cgcccagctgaaatctccaggc

SEQ ID NO: 7386171 - DNA, 20 bp, Homo sapiens
cgcccaggagggcccatgtg

SEQ ID NO: 7386172 - DNA, 22 bp, Homo sapiens
cgcccaggctggagagcagtgg

SEQ ID NO: 7386173 - DNA, 22 bp, Homo sapiens
ttcaacaaaatatatttttcca

SEQ ID NO: 7386174 - DNA, 22 bp, Homo sapiens
ttcaaatttggtatgcaagcca

SEQ ID NO: 7386175 - DNA, 22 bp, Homo sapiens
ttcaaattaccacatttgctta

SEQ ID NO: 7386176 - DNA, 22 bp, Homo sapiens
ttcaagttaactctccttgtac

SEQ ID NO: 7386177 - DNA, 22 bp, Homo sapiens
cgccccggacgtctgaccaaac

SEQ ID NO: 7386178 - DNA, 22 bp, Homo sapiens
cgccccagtctgtaggtgcccc

SEQ ID NO: 7386179 - DNA, 22 bp, Homo sapiens
ttcagcaaacacgatgcttgtt

SEQ ID NO: 7386180 - DNA, 22 bp, Homo sapiens
ttcaggcccaacgcacagcttc

SEQ ID NO: 7386181 - DNA, 22 bp, Homo sapiens
ttcaggcctctaaagggaaagc

SEQ ID NO: 7386182 - DNA, 22 bp, Homo sapiens
ttcaggcctaatttctagcccc

SEQ ID NO: 7386183 - DNA, 22 bp, Homo sapiens
ttcaggcccagcacagcgcgtg

SEQ ID NO: 7386184 - DNA, 22 bp, Homo sapiens
ttcaggcccaacgcacagcttc

SEQ ID NO: 7386185 - DNA, 20 bp, Homo sapiens
ttcagagtcagcaaatgcag

SEQ ID NO: 7386186 - DNA, 22 bp, Homo sapiens
ttcagataaattgttttgtgat

SEQ ID NO: 7386187 - DNA, 22 bp, Homo sapiens
ttcagaggacaaccagccatct

SEQ ID NO: 7386188 - DNA, 22 bp, Homo sapiens
ttcacactgtttttcatagtgg

SEQ ID NO: 7386189 - DNA, 22 bp, Homo sapiens
ttcatgaaagacagcaactgtg

SEQ ID NO: 7386190 - DNA, 22 bp, Homo sapiens
ctaaaaatccacactaggtgaa

SEQ ID NO: 7386191 - DNA, 22 bp, Homo sapiens
ctaaaattacctaccagtttag

SEQ ID NO: 7386192 - DNA, 22 bp, Homo sapiens
ttcatgaagggtgaatatagtc

SEQ ID NO: 7386193 - DNA, 22 bp, Homo sapiens
ctaaataatccctctggtctta

SEQ ID NO: 7386194 - DNA, 22 bp, Homo sapiens
ctaaagctcaacaggcactatt

SEQ ID NO: 7386195 - DNA, 22 bp, Homo sapiens
ttctctaaagagttaggccaag

SEQ ID NO: 7386196 - DNA, 22 bp, Homo sapiens
ttctctggagggctgcccggcc

SEQ ID NO: 7386197 - DNA, 22 bp, Homo sapiens
ctagaaaaatactttattgtga

SEQ ID NO: 7386198 - DNA, 22 bp, Homo sapiens
ctactggccatctgatctacaa

SEQ ID NO: 7386199 - DNA, 22 bp, Homo sapiens
ctacctttctgactcttgggat

SEQ ID NO: 7386200 - DNA, 22 bp, Homo sapiens
ctacatttcatccagggagagc

SEQ ID NO: 7386201 - DNA, 22 bp, Homo sapiens
ctacatttacacagttaggctt

SEQ ID NO: 7386202 - DNA, 22 bp, Homo sapiens
ctacaggctcagggagccctct

SEQ ID NO: 7386203 - DNA, 22 bp, Homo sapiens
ctacagcagagaccagccacat

SEQ ID NO: 7386204 - DNA, 22 bp, Homo sapiens
ctacagcagagctacactaact

SEQ ID NO: 7386205 - DNA, 22 bp, Homo sapiens
ttccaggagacttccagaaata

SEQ ID NO: 7386206 - DNA, 22 bp, Homo sapiens
ttccaggatgggctgtcctact

SEQ ID NO: 7386207 - DNA, 22 bp, Homo sapiens
ctacaacattatgctttctgtc

SEQ ID NO: 7386208 - DNA, 22 bp, Homo sapiens
ttctctggatgtttctcagtca

SEQ ID NO: 7386209 - DNA, 22 bp, Homo sapiens
ctatgtatgcgattagaatttt

SEQ ID NO: 7386210 - DNA, 22 bp, Homo sapiens
ctatgctttagtaatattctca

SEQ ID NO: 7386211 - DNA, 22 bp, Homo sapiens
ctatgcttacctctatggatac

SEQ ID NO: 7386212 - DNA, 22 bp, Homo sapiens
ctattaaatactcttcaaattg

SEQ ID NO: 7386213 - DNA, 19 bp, Homo sapiens
ctatgtttatatatccagt

SEQ ID NO: 7386214 - DNA, 22 bp, Homo sapiens
ctatgtttatctgtatttctgt

SEQ ID NO: 7386215 - DNA, 22 bp, Homo sapiens
ctattaaatactcttcaaattg

SEQ ID NO: 7386216 - DNA, 22 bp, Homo sapiens
ctcacaccagcttacaagactt

SEQ ID NO: 7386217 - DNA, 22 bp, Homo sapiens
ctcacaggcatctcatcaggct

SEQ ID NO: 7386218 - DNA, 22 bp, Homo sapiens
ctcacaggtaccagcaccctcc

SEQ ID NO: 7386219 - DNA, 22 bp, Homo sapiens
ctcaaaagacttaaacataaga

SEQ ID NO: 7386220 - DNA, 22 bp, Homo sapiens
ctattattaatgtggggctttg

SEQ ID NO: 7386221 - DNA, 22 bp, Homo sapiens
ctattagttaggaagacaagca

SEQ ID NO: 7386222 - DNA, 22 bp, Homo sapiens
ctgggtgccaattcatgtttat

SEQ ID NO: 7386223 - DNA, 22 bp, Homo sapiens
ctgggtgccacgggcaccctgg

SEQ ID NO: 7386224 - DNA, 22 bp, Homo sapiens
ctgtcctgaaagggagattggg

SEQ ID NO: 7386225 - DNA, 22 bp, Homo sapiens
ctgtcctgcagttgggggcagg

SEQ ID NO: 7386226 - DNA, 22 bp, Homo sapiens
ctgtcctgccagtcctggactc

SEQ ID NO: 7386227 - DNA, 22 bp, Homo sapiens
ctgtcctgcccaccctgcaggg

SEQ ID NO: 7386228 - DNA, 22 bp, Homo sapiens
ctgtcctgatggtgccactggt

SEQ ID NO: 7386229 - DNA, 22 bp, Homo sapiens
ctgtcctgagttcttggaggtc

SEQ ID NO: 7386230 - DNA, 22 bp, Homo sapiens
ctgtcctgagataaagatgagg

SEQ ID NO: 7386231 - DNA, 22 bp, Homo sapiens
ctgtcctggtgctggggatccc

SEQ ID NO: 7386232 - DNA, 21 bp, Homo sapiens
ctgtcctggtctagaggcaca

SEQ ID NO: 7386233 - DNA, 22 bp, Homo sapiens
ctgtcctggccgcccttgtgag

SEQ ID NO: 7386234 - DNA, 22 bp, Homo sapiens
ctgtcctggagggcataggacg

SEQ ID NO: 7386235 - DNA, 22 bp, Homo sapiens
ctgtgagggtcacagccatgcc

SEQ ID NO: 7386236 - DNA, 22 bp, Homo sapiens
ctgtcctgtgcattgtcagatg

SEQ ID NO: 7386237 - DNA, 22 bp, Homo sapiens
ctgtgccactgccccaggcctc

SEQ ID NO: 7386238 - DNA, 22 bp, Homo sapiens
ctgtgccattctttgtagcatg

SEQ ID NO: 7386239 - DNA, 22 bp, Homo sapiens
ctgtgccagcctgtcccaggag

SEQ ID NO: 7386240 - DNA, 22 bp, Homo sapiens
ctgtgccctctttgctggcctt

SEQ ID NO: 7386241 - DNA, 22 bp, Homo sapiens
ctgtgtctaatcaggtcagtca

SEQ ID NO: 7386242 - DNA, 22 bp, Homo sapiens
ctgtgtagtcaggtggtcccac

SEQ ID NO: 7386243 - DNA, 22 bp, Homo sapiens
ctgtgtagctctgggtgcaagt

SEQ ID NO: 7386244 - DNA, 22 bp, Homo sapiens
ctgtgtagtatttgtacacata

SEQ ID NO: 7386245 - DNA, 22 bp, Homo sapiens
ctgtgtagtcaggtggtcccac

SEQ ID NO: 7386246 - DNA, 20 bp, Homo sapiens
ctgtgtagtgctcaggtaag

SEQ ID NO: 7386247 - DNA, 22 bp, Homo sapiens
ctgtggtggcctccctgccatg

SEQ ID NO: 7386248 - DNA, 22 bp, Homo sapiens
ctgtgtagagcggctgcgagcg

SEQ ID NO: 7386249 - DNA, 22 bp, Homo sapiens
ctgtgtagcctcatgtgggctt

SEQ ID NO: 7386250 - DNA, 22 bp, Homo sapiens
ctgtgtctccttggtgggatat

SEQ ID NO: 7386251 - DNA, 22 bp, Homo sapiens
ctgtgtctccttggtgggatat

SEQ ID NO: 7386252 - DNA, 22 bp, Homo sapiens
ctgtgtctcatccgcctctggc

SEQ ID NO: 7386253 - DNA, 22 bp, Homo sapiens
ctgtgtcttcaatgtactggga

SEQ ID NO: 7386254 - DNA, 22 bp, Homo sapiens
ctgttcacagaatcctcccctg

SEQ ID NO: 7386255 - DNA, 22 bp, Homo sapiens
ctgttctgaactgcctgcatgc

SEQ ID NO: 7386256 - DNA, 22 bp, Homo sapiens
ctgttgagtaatttatatcagg

SEQ ID NO: 7386257 - DNA, 22 bp, Homo sapiens
ctgttgctcccagggagagggt

SEQ ID NO: 7386258 - DNA, 22 bp, Homo sapiens
ctgttctgctgcataaaaactt

SEQ ID NO: 7386259 - DNA, 22 bp, Homo sapiens
ctgttctgtaagctgctgttgt

SEQ ID NO: 7386260 - DNA, 22 bp, Homo sapiens
cttgtcctttacttgagactca

SEQ ID NO: 7386261 - DNA, 22 bp, Homo sapiens
cttgtatagggaaagataaatc

SEQ ID NO: 7386262 - DNA, 22 bp, Homo sapiens
cttgtattctgcctaaccttca

SEQ ID NO: 7386263 - DNA, 22 bp, Homo sapiens
cttgtattcttgtacctttcaa

SEQ ID NO: 7386264 - DNA, 22 bp, Homo sapiens
cttgtcactctggctccagagc

SEQ ID NO: 7386265 - DNA, 22 bp, Homo sapiens
cttgtagaattgaaatggtctc

SEQ ID NO: 7386266 - DNA, 22 bp, Homo sapiens
cttgcctacttgtcaaccagca

SEQ ID NO: 7386267 - DNA, 22 bp, Homo sapiens
cttgcaaacactcaaagccatc

SEQ ID NO: 7386268 - DNA, 22 bp, Homo sapiens
cttcctgggcaatgttctgctt

SEQ ID NO: 7386269 - DNA, 22 bp, Homo sapiens
cttcctggatgagcaggctgat

SEQ ID NO: 7386270 - DNA, 22 bp, Homo sapiens
cttatatttgtcaactttacaa

SEQ ID NO: 7386271 - DNA, 22 bp, Homo sapiens
cttatattttaggaacagacaa

SEQ ID NO: 7386272 - DNA, 22 bp, Homo sapiens
cttattgtgtctttgaataagt

SEQ ID NO: 7386273 - DNA, 22 bp, Homo sapiens
cttattgtcttacagtaataga

SEQ ID NO: 7386274 - DNA, 22 bp, Homo sapiens
cttattctactccacaagctct

SEQ ID NO: 7386275 - DNA, 22 bp, Homo sapiens
cttattggagagttgggccctt

SEQ ID NO: 7386276 - DNA, 22 bp, Homo sapiens
cttattggtgctttttctcata

SEQ ID NO: 7386277 - DNA, 22 bp, Homo sapiens
cttattggtgctttttctcata

SEQ ID NO: 7386278 - DNA, 22 bp, Homo sapiens
cttattggtggagtcaggccct

SEQ ID NO: 7386279 - DNA, 22 bp, Homo sapiens
cttattggtcccaggaggagaa

SEQ ID NO: 7386280 - DNA, 22 bp, Homo sapiens
cttattgggatgagaggatgca

SEQ ID NO: 7386281 - DNA, 22 bp, Homo sapiens
cttcagaaccagccagaagagg

SEQ ID NO: 7386282 - DNA, 22 bp, Homo sapiens
cttcagaactataaaaagtact

SEQ ID NO: 7386283 - DNA, 22 bp, Homo sapiens
cttcagaagaaaagcagtgtgt

SEQ ID NO: 7386284 - DNA, 22 bp, Homo sapiens
cttcagaagcctgcagcctttg

SEQ ID NO: 7386285 - DNA, 22 bp, Homo sapiens
cttcaaaagccagaagcctgcg

SEQ ID NO: 7386286 - DNA, 22 bp, Homo sapiens
cttcagctgcagttatgtttag

SEQ ID NO: 7386287 - DNA, 22 bp, Homo sapiens
ctggctcagttcttggttttca

SEQ ID NO: 7386288 - DNA, 22 bp, Homo sapiens
ctggctcagtgccttcagaagt

SEQ ID NO: 7386289 - DNA, 22 bp, Homo sapiens
ctggctcatccaggtgttgctc

SEQ ID NO: 7386290 - DNA, 22 bp, Homo sapiens
ctggctcatagagcagctccaa

SEQ ID NO: 7386291 - DNA, 23 bp, Homo sapiens
ctggctcatcctggttgcagtgg

SEQ ID NO: 7386292 - DNA, 22 bp, Homo sapiens
ctggctcattttagcatcaggt

SEQ ID NO: 7386293 - DNA, 22 bp, Homo sapiens
ctggctcatgtgatgagggcaa

SEQ ID NO: 7386294 - DNA, 22 bp, Homo sapiens
ctggcctgtgggctgtctccgg

SEQ ID NO: 7386295 - DNA, 22 bp, Homo sapiens
ctggcctgtgggctgtctccgg

SEQ ID NO: 7386296 - DNA, 22 bp, Homo sapiens
ctggctcacctccgctccagca

SEQ ID NO: 7386297 - DNA, 22 bp, Homo sapiens
ctggctcagggtggtctgggtc

SEQ ID NO: 7386298 - DNA, 22 bp, Homo sapiens
ctggctcaggaaagttgctgct

SEQ ID NO: 7386299 - DNA, 22 bp, Homo sapiens
ctggctcactagccctgccctg

SEQ ID NO: 7386300 - DNA, 22 bp, Homo sapiens
ctggctcactagccctgccctg

SEQ ID NO: 7386301 - DNA, 22 bp, Homo sapiens
ctggctcagacagctgtgcagt

SEQ ID NO: 7386302 - DNA, 23 bp, Homo sapiens
ctggccctggctctgtgatcatg

SEQ ID NO: 7386303 - DNA, 19 bp, Homo sapiens
ctggccaggccaggggccc

SEQ ID NO: 7386304 - DNA, 22 bp, Homo sapiens
ctggcccagtctcagagtgtca

SEQ ID NO: 7386305 - DNA, 22 bp, Homo sapiens
ctggccctcagactcatgggca

SEQ ID NO: 7386306 - DNA, 22 bp, Homo sapiens
ctggccctcggagtccagctgc

SEQ ID NO: 7386307 - DNA, 22 bp, Homo sapiens
ctggccctcgtcagtttcactg

SEQ ID NO: 7386308 - DNA, 22 bp, Homo sapiens
ctggccctggagggctgtgcga

SEQ ID NO: 7386309 - DNA, 22 bp, Homo sapiens
ctggccctggagggctgtgcga

SEQ ID NO: 7386310 - DNA, 22 bp, Homo sapiens
ctggccctgcctaatgtacttg

SEQ ID NO: 7386311 - DNA, 22 bp, Homo sapiens
ctggcaggcaaattggtgggag

SEQ ID NO: 7386312 - DNA, 22 bp, Homo sapiens
ctggcaggagctgtggccgtag

SEQ ID NO: 7386313 - DNA, 22 bp, Homo sapiens
ctggcaggctctctggtcggtt

SEQ ID NO: 7386314 - DNA, 22 bp, Homo sapiens
ctggcaggcggcagagcccagg

SEQ ID NO: 7386315 - DNA, 22 bp, Homo sapiens
ctggccagcctcccaggtaccc

SEQ ID NO: 7386316 - DNA, 22 bp, Homo sapiens
ctggccaggcatcccctgatcc

SEQ ID NO: 7386317 - DNA, 22 bp, Homo sapiens
ctggccagctgacagcagggct

SEQ ID NO: 7386318 - DNA, 22 bp, Homo sapiens
ctggccactgcacctcttcctt

SEQ ID NO: 7386319 - DNA, 22 bp, Homo sapiens
ctgcatccatgttgctgcaaag

SEQ ID NO: 7386320 - DNA, 22 bp, Homo sapiens
ctgccagaaggttcctgctgca

SEQ ID NO: 7386321 - DNA, 22 bp, Homo sapiens
ctgccagagatctgggcagagt

SEQ ID NO: 7386322 - DNA, 22 bp, Homo sapiens
ctgccagacacgttatgctcat

SEQ ID NO: 7386323 - DNA, 22 bp, Homo sapiens
ctgggcaggagggctctatgga

SEQ ID NO: 7386324 - DNA, 22 bp, Homo sapiens
ctgggaggcccacgttgggaag

SEQ ID NO: 7386325 - DNA, 22 bp, Homo sapiens
ctggctttaaaatgctcctgga

SEQ ID NO: 7386326 - DNA, 22 bp, Homo sapiens
ctggctttcattcattcaggcc

SEQ ID NO: 7386327 - DNA, 22 bp, Homo sapiens
ctggctttccttgtctgcatcc

SEQ ID NO: 7386328 - DNA, 22 bp, Homo sapiens
ctggctttacctcactggggct

SEQ ID NO: 7386329 - DNA, 22 bp, Homo sapiens
ctggctttaggttggagagctg

SEQ ID NO: 7386330 - DNA, 22 bp, Homo sapiens
ctggctttctgcaaatctccat

SEQ ID NO: 7386331 - DNA, 22 bp, Homo sapiens
ctggctttctgcacagaattgg

SEQ ID NO: 7386332 - DNA, 22 bp, Homo sapiens
ctggctttgctggactgggagt

SEQ ID NO: 7386333 - DNA, 22 bp, Homo sapiens
ctgggagctgaggctgacgctg

SEQ ID NO: 7386334 - DNA, 22 bp, Homo sapiens
ctgggagctagctctgagctga

SEQ ID NO: 7386335 - DNA, 22 bp, Homo sapiens
ctgggagctcagccctggggtg

SEQ ID NO: 7386336 - DNA, 22 bp, Homo sapiens
ctggcttttggaggagggtcag

SEQ ID NO: 7386337 - DNA, 22 bp, Homo sapiens
ctggcttttcctaaactgggaa

SEQ ID NO: 7386338 - DNA, 22 bp, Homo sapiens
ctggctttggaacaaatcatag

SEQ ID NO: 7386339 - DNA, 22 bp, Homo sapiens
ctgggctgcagttcctggtcct

SEQ ID NO: 7386340 - DNA, 20 bp, Homo sapiens
ctggggaggaggatgtgttc

SEQ ID NO: 7386341 - DNA, 22 bp, Homo sapiens
ctgggctgcgggcgcccctcca

SEQ ID NO: 7386342 - DNA, 22 bp, Homo sapiens
ctgggctgccaggtaggcacac

SEQ ID NO: 7386343 - DNA, 22 bp, Homo sapiens
ctgggtaaaggctgcttttcta

SEQ ID NO: 7386344 - DNA, 22 bp, Homo sapiens
gagcttcttgtttcttcatctg

SEQ ID NO: 7386345 - DNA, 22 bp, Homo sapiens
gagcttttcttccagttaatga

SEQ ID NO: 7386346 - DNA, 22 bp, Homo sapiens
gagctgtgttgtctagtaccga

SEQ ID NO: 7386347 - DNA, 22 bp, Homo sapiens
gagcttaaaacatagccagact

SEQ ID NO: 7386348 - DNA, 22 bp, Homo sapiens
gagctgagaagcagcgcttgat

SEQ ID NO: 7386349 - DNA, 19 bp, Homo sapiens
gagctgagagtagcactgg

SEQ ID NO: 7386350 - DNA, 22 bp, Homo sapiens
gagctcttcctttcaggaggcc

SEQ ID NO: 7386351 - DNA, 22 bp, Homo sapiens
gagctcttgcttctagtccagg

SEQ ID NO: 7386352 - DNA, 22 bp, Homo sapiens
gagctctttaccaggtcaggac

SEQ ID NO: 7386353 - DNA, 22 bp, Homo sapiens
gagcccttttcctagatactgt

SEQ ID NO: 7386354 - DNA, 22 bp, Homo sapiens
gagccgaggcgcacagctcggg

SEQ ID NO: 7386355 - DNA, 22 bp, Homo sapiens
gagccaggtttgaatctcagtc

SEQ ID NO: 7386356 - DNA, 22 bp, Homo sapiens
gagcctggagctggaacgaagc

SEQ ID NO: 7386357 - DNA, 22 bp, Homo sapiens
gagcctggattgaagtgggtgg

SEQ ID NO: 7386358 - DNA, 22 bp, Homo sapiens
gagctacagagtttggtgttca

SEQ ID NO: 7386359 - DNA, 20 bp, Homo sapiens
gagctacacaaatgctgctt

SEQ ID NO: 7386360 - DNA, 22 bp, Homo sapiens
gagctagactgggctctgatgt

SEQ ID NO: 7386361 - DNA, 22 bp, Homo sapiens
gagctagaattaggccaatttc

SEQ ID NO: 7386362 - DNA, 22 bp, Homo sapiens
gagctagacagcaagggcctgc

SEQ ID NO: 7386363 - DNA, 22 bp, Homo sapiens
gagctcttagatagggcaggaa

SEQ ID NO: 7386364 - DNA, 22 bp, Homo sapiens
gagctcttatagttctagcagt

SEQ ID NO: 7386365 - DNA, 22 bp, Homo sapiens
gaggagcttgcatttaagtgcc

SEQ ID NO: 7386366 - DNA, 22 bp, Homo sapiens
gaggagctgtctttgtgatctt

SEQ ID NO: 7386367 - DNA, 22 bp, Homo sapiens
gaggaaaagagacaggttattg

SEQ ID NO: 7386368 - DNA, 22 bp, Homo sapiens
gaggaaaagagacaggttattg

SEQ ID NO: 7386369 - DNA, 20 bp, Homo sapiens
gaggaaaagctgccaggcct

SEQ ID NO: 7386370 - DNA, 22 bp, Homo sapiens
gaggaaaatattcagggaggtt

SEQ ID NO: 7386371 - DNA, 22 bp, Homo sapiens
gaggaaaatgcaacaggaatgc

SEQ ID NO: 7386372 - DNA, 22 bp, Homo sapiens
gaggagccctgttccccaggcc

SEQ ID NO: 7386373 - DNA, 22 bp, Homo sapiens
gaggaaaatattcagggaggtt

SEQ ID NO: 7386374 - DNA, 22 bp, Homo sapiens
gaggaaaataacaactaagggc

SEQ ID NO: 7386375 - DNA, 22 bp, Homo sapiens
gaggaggcactagttagtgaca

SEQ ID NO: 7386376 - DNA, 22 bp, Homo sapiens
gaggaggcacttgagcagatgt

SEQ ID NO: 7386377 - DNA, 22 bp, Homo sapiens
gaggaggccagtggaaggaagc

SEQ ID NO: 7386378 - DNA, 22 bp, Homo sapiens
gaggaggctaagtgggctctgg

SEQ ID NO: 7386379 - DNA, 22 bp, Homo sapiens
gaggaggctatcagcaatcagg

SEQ ID NO: 7386380 - DNA, 22 bp, Homo sapiens
gaggcagagactccaccttcag

SEQ ID NO: 7386381 - DNA, 22 bp, Homo sapiens
gaggccagatgtcatgtcttat

SEQ ID NO: 7386382 - DNA, 22 bp, Homo sapiens
gaggccagcgcgcagcactttt

SEQ ID NO: 7386383 - DNA, 22 bp, Homo sapiens
gaggcaccagacatggcctcat

SEQ ID NO: 7386384 - DNA, 22 bp, Homo sapiens
gaggcacatcacttggtgcatt

SEQ ID NO: 7386385 - DNA, 22 bp, Homo sapiens
gaggcacatgactcaccaatgg

SEQ ID NO: 7386386 - DNA, 23 bp, Homo sapiens
gaggcactcaggaaatgtgagtg

SEQ ID NO: 7386387 - DNA, 22 bp, Homo sapiens
gaggcacctcgcgggaggaggc

SEQ ID NO: 7386388 - DNA, 22 bp, Homo sapiens
gaggcactgcagtacagtgact

SEQ ID NO: 7386389 - DNA, 22 bp, Homo sapiens
gaggcactgagagtgggggatg

SEQ ID NO: 7386390 - DNA, 22 bp, Homo sapiens
gaggcactgaccattttcatat

SEQ ID NO: 7386391 - DNA, 22 bp, Homo sapiens
gaggcactgaatacttgagggt

SEQ ID NO: 7386392 - DNA, 22 bp, Homo sapiens
gaggcagagaccttcaggacct

SEQ ID NO: 7386393 - DNA, 22 bp, Homo sapiens
gagccagccgcaagagctgtga

SEQ ID NO: 7386394 - DNA, 22 bp, Homo sapiens
gagccagactgcctgaagctca

SEQ ID NO: 7386395 - DNA, 22 bp, Homo sapiens
gagccagaaaagctgcctgact

SEQ ID NO: 7386396 - DNA, 22 bp, Homo sapiens
gagccaggggtcagctccgagg

SEQ ID NO: 7386397 - DNA, 22 bp, Homo sapiens
gagccacagtggattgattcca

SEQ ID NO: 7386398 - DNA, 22 bp, Homo sapiens
gagcagctgcagtgcagaccct

SEQ ID NO: 7386399 - DNA, 22 bp, Homo sapiens
gagcagccctagggcataagca

SEQ ID NO: 7386400 - DNA, 22 bp, Homo sapiens
gagcagctggctgtattggttt

SEQ ID NO: 7386401 - DNA, 22 bp, Homo sapiens
gagcagctggaggccttgttgg

SEQ ID NO: 7386402 - DNA, 22 bp, Homo sapiens
gagcagctggaggccttgttgg

SEQ ID NO: 7386403 - DNA, 22 bp, Homo sapiens
gagcagctgttctgacttgtct

SEQ ID NO: 7386404 - DNA, 20 bp, Homo sapiens
gagcagctgtttgcattgca

SEQ ID NO: 7386405 - DNA, 22 bp, Homo sapiens
gagcagctgttctgacttgtct

SEQ ID NO: 7386406 - DNA, 22 bp, Homo sapiens
gagcagcaagcactcaaaggct

SEQ ID NO: 7386407 - DNA, 22 bp, Homo sapiens
gagcagcacttgaggcatgtca

SEQ ID NO: 7386408 - DNA, 23 bp, Homo sapiens
gagatttagcagacaaagctctt

SEQ ID NO: 7386409 - DNA, 22 bp, Homo sapiens
gagcagagtctatttccacact

SEQ ID NO: 7386410 - DNA, 22 bp, Homo sapiens
gagcagatctcaggccttctgt

SEQ ID NO: 7386411 - DNA, 22 bp, Homo sapiens
gagcagcagctgggccaggttc

SEQ ID NO: 7386412 - DNA, 22 bp, Homo sapiens
gagcagcaggtggctgtgatgg

SEQ ID NO: 7386413 - DNA, 22 bp, Homo sapiens
gagcagcaggtggggctggctt

SEQ ID NO: 7386414 - DNA, 22 bp, Homo sapiens
gagcagcatctccggcttaaag

SEQ ID NO: 7386415 - DNA, 22 bp, Homo sapiens
gagcagcagttgttacaatgat

SEQ ID NO: 7386416 - DNA, 20 bp, Homo sapiens
gagatggacagatgaagggg

SEQ ID NO: 7386417 - DNA, 20 bp, Homo sapiens
gagatggacagatgaagggg

SEQ ID NO: 7386418 - DNA, 22 bp, Homo sapiens
gagatggaatctgtgtggaggg

SEQ ID NO: 7386419 - DNA, 22 bp, Homo sapiens
gagatggaaaactgctggtagt

SEQ ID NO: 7386420 - DNA, 22 bp, Homo sapiens
gagatggagtctttttctgtca

SEQ ID NO: 7386421 - DNA, 22 bp, Homo sapiens
gagatggagaaggaagctgttt

SEQ ID NO: 7386422 - DNA, 22 bp, Homo sapiens
gagatggagaaggaagctgttt

SEQ ID NO: 7386423 - DNA, 22 bp, Homo sapiens
gagattataagatagagtcatt

SEQ ID NO: 7386424 - DNA, 22 bp, Homo sapiens
gagattatggagaggacattct

SEQ ID NO: 7386425 - DNA, 22 bp, Homo sapiens
gacctctgaaggcagagcaggg

SEQ ID NO: 7386426 - DNA, 22 bp, Homo sapiens
gacctctgggtgatgcccaggc

SEQ ID NO: 7386427 - DNA, 22 bp, Homo sapiens
gacctccgtgtacacctcccag

SEQ ID NO: 7386428 - DNA, 22 bp, Homo sapiens
gagaatttgtcttgaattttaa

SEQ ID NO: 7386429 - DNA, 22 bp, Homo sapiens
gagacaaaagttggagtgcaag

SEQ ID NO: 7386430 - DNA, 22 bp, Homo sapiens
gagaattagggcgtaattcaga

SEQ ID NO: 7386431 - DNA, 22 bp, Homo sapiens
gagaagggggctcgagtgtcct

SEQ ID NO: 7386432 - DNA, 22 bp, Homo sapiens
gagaagggcttgggagtcaaca

SEQ ID NO: 7386433 - DNA, 22 bp, Homo sapiens
gagaagggcttgggagtcaaca

SEQ ID NO: 7386434 - DNA, 22 bp, Homo sapiens
gagaagggatatgccactctcg

SEQ ID NO: 7386435 - DNA, 22 bp, Homo sapiens
gagaagggatatggcttcttga

SEQ ID NO: 7386436 - DNA, 22 bp, Homo sapiens
gagaggcatggaacagattctt

SEQ ID NO: 7386437 - DNA, 22 bp, Homo sapiens
gagaggcatggaacagattctt

SEQ ID NO: 7386438 - DNA, 22 bp, Homo sapiens
gagagggatactgagttttggt

SEQ ID NO: 7386439 - DNA, 22 bp, Homo sapiens
gagagggagccagccaggaacc

SEQ ID NO: 7386440 - DNA, 22 bp, Homo sapiens
gagaggcttaagggctgtgaag

SEQ ID NO: 7386441 - DNA, 22 bp, Homo sapiens
gagatcggtaaagagcatgcac

SEQ ID NO: 7386442 - DNA, 20 bp, Homo sapiens
gagatgcaagtgtatctgac

SEQ ID NO: 7386443 - DNA, 22 bp, Homo sapiens
gagatgcagaaccctcaggagc

SEQ ID NO: 7386444 - DNA, 22 bp, Homo sapiens
ctttcaagtgatggggcatata

SEQ ID NO: 7386445 - DNA, 18 bp, Homo sapiens
ctttatgtgcagagcttt

SEQ ID NO: 7386446 - DNA, 18 bp, Homo sapiens
ctttatgtgcagagcttt

SEQ ID NO: 7386447 - DNA, 22 bp, Homo sapiens
ctttcacacacatacatttgga

SEQ ID NO: 7386448 - DNA, 22 bp, Homo sapiens
ctttcagatagtctgagatata

SEQ ID NO: 7386449 - DNA, 22 bp, Homo sapiens
ctttcagaagtatattctggaa

SEQ ID NO: 7386450 - DNA, 18 bp, Homo sapiens
ctttcagatggatatgct

SEQ ID NO: 7386451 - DNA, 18 bp, Homo sapiens
ctttcagtaatttcagcc

SEQ ID NO: 7386452 - DNA, 22 bp, Homo sapiens
ctttcagtcagttaactcagaa

SEQ ID NO: 7386453 - DNA, 22 bp, Homo sapiens
ctttcagtctttacaaggttgc

SEQ ID NO: 7386454 - DNA, 22 bp, Homo sapiens
ctttcagttaatgactccatag

SEQ ID NO: 7386455 - DNA, 22 bp, Homo sapiens
ctttcagttacagttacacaca

SEQ ID NO: 7386456 - DNA, 22 bp, Homo sapiens
ctttcagttacagttacacaca

SEQ ID NO: 7386457 - DNA, 22 bp, Homo sapiens
gaaatcaaggctacattcaggt

SEQ ID NO: 7386458 - DNA, 22 bp, Homo sapiens
ctttcatttgataagaatgcca

SEQ ID NO: 7386459 - DNA, 22 bp, Homo sapiens
ctttccaactctagtgaaattt

SEQ ID NO: 7386460 - DNA, 22 bp, Homo sapiens
gaacagggttgggtgagagagg

SEQ ID NO: 7386461 - DNA, 22 bp, Homo sapiens
gaacatttggatttgtaaattt

SEQ ID NO: 7386462 - DNA, 22 bp, Homo sapiens
gaaatgcatggatcttggcaga

SEQ ID NO: 7386463 - DNA, 22 bp, Homo sapiens
gaagcccagtgtcttcttttct

SEQ ID NO: 7386464 - DNA, 22 bp, Homo sapiens
gaagccaggggcctgacaggca

SEQ ID NO: 7386465 - DNA, 22 bp, Homo sapiens
gaagccatctttgttccccacc

SEQ ID NO: 7386466 - DNA, 22 bp, Homo sapiens
gaagccagatttggggcatatc

SEQ ID NO: 7386467 - DNA, 22 bp, Homo sapiens
gaagatttttcttaatgctccg

SEQ ID NO: 7386468 - DNA, 22 bp, Homo sapiens
gaagatttttcttaatgctccg

SEQ ID NO: 7386469 - DNA, 22 bp, Homo sapiens
gaagattttctcctttaaatga

SEQ ID NO: 7386470 - DNA, 22 bp, Homo sapiens
gaagatttgttgtaatttttag

SEQ ID NO: 7386471 - DNA, 22 bp, Homo sapiens
gaagatttgcccatgcactttt

SEQ ID NO: 7386472 - DNA, 22 bp, Homo sapiens
gaagatttgaaacacatagaca

SEQ ID NO: 7386473 - DNA, 22 bp, Homo sapiens
gaagatttggattccatgtcac

SEQ ID NO: 7386474 - DNA, 22 bp, Homo sapiens
gaagatttgcccatgcactttt

SEQ ID NO: 7386475 - DNA, 22 bp, Homo sapiens
gaagaggctttcctagggcaag

SEQ ID NO: 7386476 - DNA, 22 bp, Homo sapiens
gaagataattcctacttataac

SEQ ID NO: 7386477 - DNA, 22 bp, Homo sapiens
gaagattagggttagcataagt

SEQ ID NO: 7386478 - DNA, 22 bp, Homo sapiens
gaagattagaccatttccagct

SEQ ID NO: 7386479 - DNA, 22 bp, Homo sapiens
gaagattaaatggctcccatat

SEQ ID NO: 7386480 - DNA, 22 bp, Homo sapiens
gaagattaaatgaagtgacctg

SEQ ID NO: 7386481 - DNA, 22 bp, Homo sapiens
gaagattaaacatatttagtgt

SEQ ID NO: 7386482 - DNA, 22 bp, Homo sapiens
gaagattacctgagaccacttg

SEQ ID NO: 7386483 - DNA, 22 bp, Homo sapiens
gaagattaatgagaaacctgct

SEQ ID NO: 7386484 - DNA, 22 bp, Homo sapiens
gaagatgttatggagagctcag

SEQ ID NO: 7386485 - DNA, 22 bp, Homo sapiens
gaagatttctttatgaaagatg

SEQ ID NO: 7386486 - DNA, 22 bp, Homo sapiens
gaagatttctttatgaaagatg

SEQ ID NO: 7386487 - DNA, 22 bp, Homo sapiens
gaagatttctgatgagttactt

SEQ ID NO: 7386488 - DNA, 22 bp, Homo sapiens
gaagatttcagttaagtatcta

SEQ ID NO: 7386489 - DNA, 22 bp, Homo sapiens
gaagatttaagcacaatagtct

SEQ ID NO: 7386490 - DNA, 22 bp, Homo sapiens
gaagatttataaggaccttatt

SEQ ID NO: 7386491 - DNA, 22 bp, Homo sapiens
gaagatttataggagcctatta

SEQ ID NO: 7386492 - DNA, 22 bp, Homo sapiens
gaagagctgtgattcaggctta

SEQ ID NO: 7386493 - DNA, 22 bp, Homo sapiens
gaagagcttagacagaatcaaa

SEQ ID NO: 7386494 - DNA, 22 bp, Homo sapiens
gaagagctgtgattcaggctta

SEQ ID NO: 7386495 - DNA, 22 bp, Homo sapiens
gaagagctgctcagaacatgat

SEQ ID NO: 7386496 - DNA, 22 bp, Homo sapiens
gaagagctgtcagaaaagctaa

SEQ ID NO: 7386497 - DNA, 22 bp, Homo sapiens
gaagaggcaattgaataagcta

SEQ ID NO: 7386498 - DNA, 22 bp, Homo sapiens
gaagagctatgtccagggagca

SEQ ID NO: 7386499 - DNA, 22 bp, Homo sapiens
gaagagctaaaggcacaggctt

SEQ ID NO: 7386500 - DNA, 22 bp, Homo sapiens
gaagagctatgtccagggagca

SEQ ID NO: 7386501 - DNA, 22 bp, Homo sapiens
gacaggtgggtacctttatgga

SEQ ID NO: 7386502 - DNA, 22 bp, Homo sapiens
gacaggtggggaaactaaggta

SEQ ID NO: 7386503 - DNA, 18 bp, Homo sapiens
gacaggtgggtgagacca

SEQ ID NO: 7386504 - DNA, 22 bp, Homo sapiens
gacaggtgtgtgtatattaggg

SEQ ID NO: 7386505 - DNA, 22 bp, Homo sapiens
gacaggtgggttctcgtatctg

SEQ ID NO: 7386506 - DNA, 22 bp, Homo sapiens
gaccctggctagggcttaacct

SEQ ID NO: 7386507 - DNA, 22 bp, Homo sapiens
gaccctgtggctctgtggcaga

SEQ ID NO: 7386508 - DNA, 22 bp, Homo sapiens
gaccctgtttctacaaataatt

SEQ ID NO: 7386509 - DNA, 22 bp, Homo sapiens
gaccctggtgggcactggcacc

SEQ ID NO: 7386510 - DNA, 22 bp, Homo sapiens
gacccttagaatgtgatcttat

SEQ ID NO: 7386511 - DNA, 22 bp, Homo sapiens
gacccttggctgcagcatcaca

SEQ ID NO: 7386512 - DNA, 22 bp, Homo sapiens
gacctcagattttcccaggcca

SEQ ID NO: 7386513 - DNA, 22 bp, Homo sapiens
gacaggccccctcaggactgat

SEQ ID NO: 7386514 - DNA, 22 bp, Homo sapiens
gacaataaaatgatcttacagt

SEQ ID NO: 7386515 - DNA, 22 bp, Homo sapiens
gacaaggcagaaagcttaaagg

SEQ ID NO: 7386516 - DNA, 22 bp, Homo sapiens
gaagttttctgaggctgtagct

SEQ ID NO: 7386517 - DNA, 22 bp, Homo sapiens
gaagcctcaacatctctgcgtc

SEQ ID NO: 7386518 - DNA, 22 bp, Homo sapiens
gaaggaaaacagatctgcctga

SEQ ID NO: 7386519 - DNA, 22 bp, Homo sapiens
gaaggaaaaatactctgtaagg

SEQ ID NO: 7386520 - DNA, 22 bp, Homo sapiens
gaagctttgtcttgtctcctgg

SEQ ID NO: 7386521 - DNA, 22 bp, Homo sapiens
gaaggaaaggtctcatgccttt

SEQ ID NO: 7386522 - DNA, 22 bp, Homo sapiens
gaatatattggtgaaaatagtt

SEQ ID NO: 7386523 - DNA, 22 bp, Homo sapiens
gaatacattggaaatcagaata

SEQ ID NO: 7386524 - DNA, 22 bp, Homo sapiens
gacaactgatgtgcttgtggga

SEQ ID NO: 7386525 - DNA, 22 bp, Homo sapiens
gacaactgccccattttaaatg

SEQ ID NO: 7386526 - DNA, 22 bp, Homo sapiens
gacaagcaggctcctgaagaaa

SEQ ID NO: 7386527 - DNA, 22 bp, Homo sapiens
gacaactgtcagtatattgtta

SEQ ID NO: 7386528 - DNA, 22 bp, Homo sapiens
ggcttctcctggaagtacagag

SEQ ID NO: 7386529 - DNA, 22 bp, Homo sapiens
ggcttctctgtctagtttctac

SEQ ID NO: 7386530 - DNA, 22 bp, Homo sapiens
ggctgagcaattttgatgacat

SEQ ID NO: 7386531 - DNA, 22 bp, Homo sapiens
ggctgctggagttgggtctctc

SEQ ID NO: 7386532 - DNA, 22 bp, Homo sapiens
ggctgctggcagatgtagttta

SEQ ID NO: 7386533 - DNA, 22 bp, Homo sapiens
ggctgctggattgtgtatctgt

SEQ ID NO: 7386534 - DNA, 22 bp, Homo sapiens
ggctggcttggtgagctgtcac

SEQ ID NO: 7386535 - DNA, 22 bp, Homo sapiens
ggctccagatgtctcctggcaa

SEQ ID NO: 7386536 - DNA, 18 bp, Homo sapiens
ggctccaggacctaccca

SEQ ID NO: 7386537 - DNA, 22 bp, Homo sapiens
ggctccaggagggccttggcca

SEQ ID NO: 7386538 - DNA, 22 bp, Homo sapiens
ggctccaggagatgctgggcag

SEQ ID NO: 7386539 - DNA, 22 bp, Homo sapiens
ggcgggaagttcttgcccactt

SEQ ID NO: 7386540 - DNA, 22 bp, Homo sapiens
ggctccagatgtcccctggcaa

SEQ ID NO: 7386541 - DNA, 22 bp, Homo sapiens
ggctctttggcgggccttgaac

SEQ ID NO: 7386542 - DNA, 22 bp, Homo sapiens
ggctctttaacttgtctaaatt

SEQ ID NO: 7386543 - DNA, 19 bp, Homo sapiens
gggcaaagtgatcgtcctg

SEQ ID NO: 7386544 - DNA, 22 bp, Homo sapiens
gggcaaaggcagaaagcggtgt

SEQ ID NO: 7386545 - DNA, 22 bp, Homo sapiens
gggatttggaatctcctaatgc

SEQ ID NO: 7386546 - DNA, 22 bp, Homo sapiens
gggcaaagtggtggaggcagtt

SEQ ID NO: 7386547 - DNA, 22 bp, Homo sapiens
gggcaaagtggtggaggcagtt

SEQ ID NO: 7386548 - DNA, 22 bp, Homo sapiens
gggagctgtgggattggttgag

SEQ ID NO: 7386549 - DNA, 19 bp, Homo sapiens
gggagctgtctgcccgtgg

SEQ ID NO: 7386550 - DNA, 22 bp, Homo sapiens
gggcacaggaatttgggatgtg

SEQ ID NO: 7386551 - DNA, 22 bp, Homo sapiens
gggcacaggagaaggatctggc

SEQ ID NO: 7386552 - DNA, 22 bp, Homo sapiens
gggcagctctggctgtgggaag

SEQ ID NO: 7386553 - DNA, 22 bp, Homo sapiens
gggcagctctggctgtgggaag

SEQ ID NO: 7386554 - DNA, 22 bp, Homo sapiens
gggcagctctgcccatcagagg

SEQ ID NO: 7386555 - DNA, 22 bp, Homo sapiens
gggcagctctttggtatccttc

SEQ ID NO: 7386556 - DNA, 21 bp, Homo sapiens
gggcagctctgttttattttc

SEQ ID NO: 7386557 - DNA, 22 bp, Homo sapiens
gggcagctgcagggatggtgac

SEQ ID NO: 7386558 - DNA, 22 bp, Homo sapiens
gggcagctgcccctctctgggc

SEQ ID NO: 7386559 - DNA, 22 bp, Homo sapiens
gggcagctggatagttttaaat

SEQ ID NO: 7386560 - DNA, 22 bp, Homo sapiens
gggcagctggccaggtattctg

SEQ ID NO: 7386561 - DNA, 22 bp, Homo sapiens
gggcagctggcttataggtttg

SEQ ID NO: 7386562 - DNA, 22 bp, Homo sapiens
gggcaggaacaaatcaaatgat

SEQ ID NO: 7386563 - DNA, 23 bp, Homo sapiens
gggcagcttaagcttgtttttct

SEQ ID NO: 7386564 - DNA, 22 bp, Homo sapiens
gggcagctgtcttggttctcaa

SEQ ID NO: 7386565 - DNA, 22 bp, Homo sapiens
gggcagctgtatctgagcttat

SEQ ID NO: 7386566 - DNA, 22 bp, Homo sapiens
gggcagctgccactccgcttgc

SEQ ID NO: 7386567 - DNA, 22 bp, Homo sapiens
gggcagctgccaagtgcatcgc

SEQ ID NO: 7386568 - DNA, 22 bp, Homo sapiens
gggcagctgccagaggccatgg

SEQ ID NO: 7386569 - DNA, 22 bp, Homo sapiens
gggcagctgccagaggccatgg

SEQ ID NO: 7386570 - DNA, 22 bp, Homo sapiens
gggcagctgcccctctctgggc

SEQ ID NO: 7386571 - DNA, 22 bp, Homo sapiens
gggcaggaggctaattctgcat

SEQ ID NO: 7386572 - DNA, 22 bp, Homo sapiens
gggcaggatgcagtttcagaga

SEQ ID NO: 7386573 - DNA, 22 bp, Homo sapiens
gggcaggctgagcatgtcacct

SEQ ID NO: 7386574 - DNA, 16 bp, Homo sapiens
gggcaggaatcagggt

SEQ ID NO: 7386575 - DNA, 22 bp, Homo sapiens
gggcaggagaaggtggatgtcc

SEQ ID NO: 7386576 - DNA, 22 bp, Homo sapiens
gggcaggagagaacagtcatgg

SEQ ID NO: 7386577 - DNA, 22 bp, Homo sapiens
gggcaggaggctaattctgcat

SEQ ID NO: 7386578 - DNA, 22 bp, Homo sapiens
gggcaggagagaacagtcatgg

SEQ ID NO: 7386579 - DNA, 22 bp, Homo sapiens
gggcaggagagggccacctgga

SEQ ID NO: 7386580 - DNA, 22 bp, Homo sapiens
gggagctgtaagggacaggtag

SEQ ID NO: 7386581 - DNA, 22 bp, Homo sapiens
gggagctgtagtccagataccg

SEQ ID NO: 7386582 - DNA, 22 bp, Homo sapiens
gggagctggggcatttataccc

SEQ ID NO: 7386583 - DNA, 22 bp, Homo sapiens
gggagctggttcctgccctcca

SEQ ID NO: 7386584 - DNA, 18 bp, Homo sapiens
gggagctgggaagctggt

SEQ ID NO: 7386585 - DNA, 18 bp, Homo sapiens
gggagctgggaagctggt

SEQ ID NO: 7386586 - DNA, 22 bp, Homo sapiens
gggagaggttacccgagcaact

SEQ ID NO: 7386587 - DNA, 22 bp, Homo sapiens
gggagaggttacccgagcaact

SEQ ID NO: 7386588 - DNA, 22 bp, Homo sapiens
gggagagcgggaggtgccacag

SEQ ID NO: 7386589 - DNA, 22 bp, Homo sapiens
gggagagagagctcatgttgaa

SEQ ID NO: 7386590 - DNA, 22 bp, Homo sapiens
gggagagagaaaacgtggcgca

SEQ ID NO: 7386591 - DNA, 22 bp, Homo sapiens
gggagagagagctcatgttgaa

SEQ ID NO: 7386592 - DNA, 22 bp, Homo sapiens
gggagacacgctgcaggcataa

SEQ ID NO: 7386593 - DNA, 22 bp, Homo sapiens
gggagacaagaagtagcctgct

SEQ ID NO: 7386594 - DNA, 22 bp, Homo sapiens
gggagacaagaagtagcctgct

SEQ ID NO: 7386595 - DNA, 19 bp, Homo sapiens
gggagacagctctgggctg

SEQ ID NO: 7386596 - DNA, 22 bp, Homo sapiens
gggagacaaaggtgaggttctt

SEQ ID NO: 7386597 - DNA, 22 bp, Homo sapiens
gggacaggctgagacttgagct

SEQ ID NO: 7386598 - DNA, 22 bp, Homo sapiens
gggacaggctgagacttgagct

SEQ ID NO: 7386599 - DNA, 22 bp, Homo sapiens
ggcctgagggtgggctctcagt

SEQ ID NO: 7386600 - DNA, 21 bp, Homo sapiens
ggcctgagtataggacaggcc

SEQ ID NO: 7386601 - DNA, 21 bp, Homo sapiens
ggcctgagcacctgtccacct

SEQ ID NO: 7386602 - DNA, 22 bp, Homo sapiens
ggcgagcagagccattgcctat

SEQ ID NO: 7386603 - DNA, 22 bp, Homo sapiens
ggcgagcagagcactgccagga

SEQ ID NO: 7386604 - DNA, 22 bp, Homo sapiens
ggcgagcagcgctgtgtcaggt

SEQ ID NO: 7386605 - DNA, 22 bp, Homo sapiens
ggcgagcagttcccagggaggt

SEQ ID NO: 7386606 - DNA, 22 bp, Homo sapiens
ggcgagcatgagtcactctggg

SEQ ID NO: 7386607 - DNA, 22 bp, Homo sapiens
ggcctttagtggttctggagtc

SEQ ID NO: 7386608 - DNA, 22 bp, Homo sapiens
ggcctttaagcaattgaaaaga

SEQ ID NO: 7386609 - DNA, 22 bp, Homo sapiens
ggcctttgcgtccacgccgctt

SEQ ID NO: 7386610 - DNA, 22 bp, Homo sapiens
ggcctctggttcgtggtgacct

SEQ ID NO: 7386611 - DNA, 22 bp, Homo sapiens
ggcctctggttcgtggtgacct

SEQ ID NO: 7386612 - DNA, 21 bp, Homo sapiens
ggcctctgtcatcctgggaag

SEQ ID NO: 7386613 - DNA, 22 bp, Homo sapiens
ggcctcagggttgggcccatta

SEQ ID NO: 7386614 - DNA, 22 bp, Homo sapiens
ggcctcagtgggccgctgcagg

SEQ ID NO: 7386615 - DNA, 22 bp, Homo sapiens
ggcctcatcacagtgcattagt

SEQ ID NO: 7386616 - DNA, 22 bp, Homo sapiens
ggcctcagtttcttcaactgta

SEQ ID NO: 7386617 - DNA, 22 bp, Homo sapiens
ggcctcagtttctccatgggtt

SEQ ID NO: 7386618 - DNA, 23 bp, Homo sapiens
ggcctcagcgcacagaaactgct

SEQ ID NO: 7386619 - DNA, 22 bp, Homo sapiens
ggcctcagggttgggcccatta

SEQ ID NO: 7386620 - DNA, 18 bp, Homo sapiens
ggcctcagcctggccgga

SEQ ID NO: 7386621 - DNA, 21 bp, Homo sapiens
ggcctcagccacctggctctg

SEQ ID NO: 7386622 - DNA, 22 bp, Homo sapiens
ggcaggtggaagttggcagagc

SEQ ID NO: 7386623 - DNA, 22 bp, Homo sapiens
ggcaggcagaggctgagacagg

SEQ ID NO: 7386624 - DNA, 21 bp, Homo sapiens
ggcaggtgggtctctgttgct

SEQ ID NO: 7386625 - DNA, 22 bp, Homo sapiens
ggcagtcttatcagcattggac

SEQ ID NO: 7386626 - DNA, 22 bp, Homo sapiens
ggcagtctcctgccctctaacc

SEQ ID NO: 7386627 - DNA, 22 bp, Homo sapiens
ggcagtctgcaatttcattagc

SEQ ID NO: 7386628 - DNA, 22 bp, Homo sapiens
ggcagtctagtgtccttgggcc

SEQ ID NO: 7386629 - DNA, 22 bp, Homo sapiens
ggcagtgaatgaaacagaggct

SEQ ID NO: 7386630 - DNA, 22 bp, Homo sapiens
ggcatggacgtctctgaggcca

SEQ ID NO: 7386631 - DNA, 22 bp, Homo sapiens
ggccacacggagaggctggtct

SEQ ID NO: 7386632 - DNA, 22 bp, Homo sapiens
ggccacacagatgactgctttc

SEQ ID NO: 7386633 - DNA, 22 bp, Homo sapiens
ggccaaggtgttctgatatgcc

SEQ ID NO: 7386634 - DNA, 22 bp, Homo sapiens
ggcattagacggggacatctgc

SEQ ID NO: 7386635 - DNA, 22 bp, Homo sapiens
ggccagggggcttcagactcca

SEQ ID NO: 7386636 - DNA, 22 bp, Homo sapiens
ggccaggtggctgtcctggcgt

SEQ ID NO: 7386637 - DNA, 22 bp, Homo sapiens
ggccagtcccctaatccagggc

SEQ ID NO: 7386638 - DNA, 22 bp, Homo sapiens
ggccatgcctggtctggcacca

SEQ ID NO: 7386639 - DNA, 22 bp, Homo sapiens
ggcacagccctctctgtggaca

SEQ ID NO: 7386640 - DNA, 22 bp, Homo sapiens
ggcacagcaggagctatgtgaa

SEQ ID NO: 7386641 - DNA, 22 bp, Homo sapiens
ggcacagcgactaccatcgaaa

SEQ ID NO: 7386642 - DNA, 22 bp, Homo sapiens
ggcacagctacttgctcactct

SEQ ID NO: 7386643 - DNA, 22 bp, Homo sapiens
ggcacagctcaggtcccagctc

SEQ ID NO: 7386644 - DNA, 22 bp, Homo sapiens
ggcacagctgatgcagacacac

SEQ ID NO: 7386645 - DNA, 22 bp, Homo sapiens
ggcagaggaaggatgaattcac

SEQ ID NO: 7386646 - DNA, 22 bp, Homo sapiens
ggcagaggagctggaaacatgg

SEQ ID NO: 7386647 - DNA, 22 bp, Homo sapiens
ggcagaggaggggtgaatttgc

SEQ ID NO: 7386648 - DNA, 20 bp, Homo sapiens
ggcagagggcctgggagaag

SEQ ID NO: 7386649 - DNA, 20 bp, Homo sapiens
ggcagagggcctgggagaag

SEQ ID NO: 7386650 - DNA, 20 bp, Homo sapiens
ggcagagggcctgggagaag

SEQ ID NO: 7386651 - DNA, 22 bp, Homo sapiens
ggcagaggtagctggaaccagg

SEQ ID NO: 7386652 - DNA, 22 bp, Homo sapiens
ggcagaggtagctggaaccagg

SEQ ID NO: 7386653 - DNA, 22 bp, Homo sapiens
ggcaggagggcggacaatgacc

SEQ ID NO: 7386654 - DNA, 22 bp, Homo sapiens
ggcaggaggtgagtggcgggtg

SEQ ID NO: 7386655 - DNA, 22 bp, Homo sapiens
ggcaggagggcggacaatgacc

SEQ ID NO: 7386656 - DNA, 22 bp, Homo sapiens
ggcaggagggcggacaatgacc

SEQ ID NO: 7386657 - DNA, 22 bp, Homo sapiens
ggcaggcaagtctgctctgtga

SEQ ID NO: 7386658 - DNA, 22 bp, Homo sapiens
ggcaggcagaaaaatagaatat

SEQ ID NO: 7386659 - DNA, 22 bp, Homo sapiens
ggcaggcactgtgctaggcgct

SEQ ID NO: 7386660 - DNA, 22 bp, Homo sapiens
ggcaggcaccagctcagcaata

SEQ ID NO: 7386661 - DNA, 22 bp, Homo sapiens
ggcaaaggaaccaggccacact

SEQ ID NO: 7386662 - DNA, 22 bp, Homo sapiens
ggcaaatattatctttgctggt

SEQ ID NO: 7386663 - DNA, 22 bp, Homo sapiens
ggcaacattctccagatccttt

SEQ ID NO: 7386664 - DNA, 22 bp, Homo sapiens
ggcaagagggcagatggagtgc

SEQ ID NO: 7386665 - DNA, 22 bp, Homo sapiens
ggcaagaggtccaagaggtctc

SEQ ID NO: 7386666 - DNA, 22 bp, Homo sapiens
ggcaagaggtccaagaggtctc

SEQ ID NO: 7386667 - DNA, 22 bp, Homo sapiens
ggcaagagggcagatggagtgc

SEQ ID NO: 7386668 - DNA, 19 bp, Homo sapiens
ggcaagcacaaaagctttg

SEQ ID NO: 7386669 - DNA, 23 bp, Homo sapiens
ggagtgcaatggcgccatctcgg

SEQ ID NO: 7386670 - DNA, 22 bp, Homo sapiens
ggagtgagtactggagtagctg

SEQ ID NO: 7386671 - DNA, 22 bp, Homo sapiens
ggagtgagtactggagtagctg

SEQ ID NO: 7386672 - DNA, 23 bp, Homo sapiens
ggagtgcaatggcgccatctcgg

SEQ ID NO: 7386673 - DNA, 22 bp, Homo sapiens
ggcaaacaggagagtaaagaga

SEQ ID NO: 7386674 - DNA, 22 bp, Homo sapiens
ggcaaaaaccataattactttt

SEQ ID NO: 7386675 - DNA, 22 bp, Homo sapiens
ggcaaaaaccgcaataacttct

SEQ ID NO: 7386676 - DNA, 22 bp, Homo sapiens
ggcaaaaaccacaattactttt

SEQ ID NO: 7386677 - DNA, 22 bp, Homo sapiens
ggcaaaaacagcaatgactttt

SEQ ID NO: 7386678 - DNA, 19 bp, Homo sapiens
ggagccagctgtggaaggc

SEQ ID NO: 7386679 - DNA, 22 bp, Homo sapiens
ggagtaggccccgggagagagt

SEQ ID NO: 7386680 - DNA, 22 bp, Homo sapiens
ggagccagctccctccttgtga

SEQ ID NO: 7386681 - DNA, 19 bp, Homo sapiens
ggagccagctgtggaaggc

SEQ ID NO: 7386682 - DNA, 23 bp, Homo sapiens
ggagccagcctgtggggagcggg

SEQ ID NO: 7386683 - DNA, 23 bp, Homo sapiens
ggagccagcctgtggggagcggg

SEQ ID NO: 7386684 - DNA, 22 bp, Homo sapiens
ggagccagcagggtgacactga

SEQ ID NO: 7386685 - DNA, 22 bp, Homo sapiens
ggagccagcagggtgacactga

SEQ ID NO: 7386686 - DNA, 22 bp, Homo sapiens
ggagccagcagggtgacactga

SEQ ID NO: 7386687 - DNA, 22 bp, Homo sapiens
ggagccagaggctgctgctgtg

SEQ ID NO: 7386688 - DNA, 22 bp, Homo sapiens
ggagccagaggctgctgctgtg

SEQ ID NO: 7386689 - DNA, 22 bp, Homo sapiens
ggagccagaggctgctgctgtg

SEQ ID NO: 7386690 - DNA, 22 bp, Homo sapiens
ggagccagaggctgctgctgtg

SEQ ID NO: 7386691 - DNA, 22 bp, Homo sapiens
ggagccagagtttaatgtggag

SEQ ID NO: 7386692 - DNA, 22 bp, Homo sapiens
ggagccagagtctgcagtgtaa

SEQ ID NO: 7386693 - DNA, 22 bp, Homo sapiens
ggagccagagggatgcagttga

SEQ ID NO: 7386694 - DNA, 22 bp, Homo sapiens
ggagccagagtctgcagtgtaa

SEQ ID NO: 7386695 - DNA, 22 bp, Homo sapiens
ggagtcagaatggcagggtggt

SEQ ID NO: 7386696 - DNA, 22 bp, Homo sapiens
ggagtcacctgggaggactggg

SEQ ID NO: 7386697 - DNA, 22 bp, Homo sapiens
ggagtcagaacccaggcttcta

SEQ ID NO: 7386698 - DNA, 20 bp, Homo sapiens
ggagtcaccaagagagaccc

SEQ ID NO: 7386699 - DNA, 22 bp, Homo sapiens
ggagtcagcctgtcagagtgta

SEQ ID NO: 7386700 - DNA, 22 bp, Homo sapiens
ggagtcagaggaaggcttgctc

SEQ ID NO: 7386701 - DNA, 22 bp, Homo sapiens
ggagtcagtgatcgcgtgtctc

SEQ ID NO: 7386702 - DNA, 21 bp, Homo sapiens
ggagtcagggtctggctgggg

SEQ ID NO: 7386703 - DNA, 22 bp, Homo sapiens
ggagtcaggcagacctagttat

SEQ ID NO: 7386704 - DNA, 22 bp, Homo sapiens
ggagtcaggagcaggctgggct

SEQ ID NO: 7386705 - DNA, 22 bp, Homo sapiens
ggagtgaggcatttgtagctga

SEQ ID NO: 7386706 - DNA, 22 bp, Homo sapiens
ggagtccatgcagcttgagaca

SEQ ID NO: 7386707 - DNA, 22 bp, Homo sapiens
gtccctgcatctgcaggccatg

SEQ ID NO: 7386708 - DNA, 17 bp, Homo sapiens
gtcctgggaggagagag

SEQ ID NO: 7386709 - DNA, 22 bp, Homo sapiens
gtcccctcagccacccatgggg

SEQ ID NO: 7386710 - DNA, 22 bp, Homo sapiens
gtcccctcattttagagaaaga

SEQ ID NO: 7386711 - DNA, 22 bp, Homo sapiens
gtcccctcaaaattcatatgtt

SEQ ID NO: 7386712 - DNA, 22 bp, Homo sapiens
gtccccagctgtgacgagagcc

SEQ ID NO: 7386713 - DNA, 22 bp, Homo sapiens
gtccctctgctctagagagcca

SEQ ID NO: 7386714 - DNA, 22 bp, Homo sapiens
gtccacactgaggccttctcca

SEQ ID NO: 7386715 - DNA, 22 bp, Homo sapiens
gtcccattccctgtatcttaga

SEQ ID NO: 7386716 - DNA, 22 bp, Homo sapiens
gtcccatttcaagaaattcatg

SEQ ID NO: 7386717 - DNA, 23 bp, Homo sapiens
gtatttcagcattctcagttaaa

SEQ ID NO: 7386718 - DNA, 19 bp, Homo sapiens
gtatttcaggacaagacgt

SEQ ID NO: 7386719 - DNA, 22 bp, Homo sapiens
gtatttcagttcctcttgtgac

SEQ ID NO: 7386720 - DNA, 22 bp, Homo sapiens
gtatttcatcttgaaaaccagt

SEQ ID NO: 7386721 - DNA, 22 bp, Homo sapiens
gtcattttctagaattatttga

SEQ ID NO: 7386722 - DNA, 22 bp, Homo sapiens
gtcattttgctgcatatttaga

SEQ ID NO: 7386723 - DNA, 22 bp, Homo sapiens
gtcatttttttcgtaatagtgg

SEQ ID NO: 7386724 - DNA, 22 bp, Homo sapiens
gtcatttttcactgcatataga

SEQ ID NO: 7386725 - DNA, 22 bp, Homo sapiens
gtccaattctccttccctgggt

SEQ ID NO: 7386726 - DNA, 22 bp, Homo sapiens
gtccaaaagagccagccgggcg

SEQ ID NO: 7386727 - DNA, 22 bp, Homo sapiens
gtacatttatttttgcagcata

SEQ ID NO: 7386728 - DNA, 22 bp, Homo sapiens
gtacatttcagtttccttaaga

SEQ ID NO: 7386729 - DNA, 22 bp, Homo sapiens
gtacatttcatttaaatgatgt

SEQ ID NO: 7386730 - DNA, 22 bp, Homo sapiens
gtacatttcatttaaatgatgt

SEQ ID NO: 7386731 - DNA, 22 bp, Homo sapiens
gtacatttcatttaaatgatgt

SEQ ID NO: 7386732 - DNA, 22 bp, Homo sapiens
gtacatttaggattcattgaaa

SEQ ID NO: 7386733 - DNA, 22 bp, Homo sapiens
gtacccaaagcccattgggcca

SEQ ID NO: 7386734 - DNA, 22 bp, Homo sapiens
gtacattttgaggttaaaacaa

SEQ ID NO: 7386735 - DNA, 20 bp, Homo sapiens
gtacattttcaggaggggat

SEQ ID NO: 7386736 - DNA, 22 bp, Homo sapiens
gtacattttgaggttaaaacaa

SEQ ID NO: 7386737 - DNA, 22 bp, Homo sapiens
gtacattttgaggttaaaacaa

SEQ ID NO: 7386738 - DNA, 22 bp, Homo sapiens
gtacatttctcttgttcttatt

SEQ ID NO: 7386739 - DNA, 22 bp, Homo sapiens
gtacattttactttgtttgaat

SEQ ID NO: 7386740 - DNA, 22 bp, Homo sapiens
gtacatttctcccaacactaaa

SEQ ID NO: 7386741 - DNA, 22 bp, Homo sapiens
gtacatttctcccaacactaaa

SEQ ID NO: 7386742 - DNA, 22 bp, Homo sapiens
ggtttcactagaagaaggaatt

SEQ ID NO: 7386743 - DNA, 22 bp, Homo sapiens
ggtttcacaatttagagcagtg

SEQ ID NO: 7386744 - DNA, 22 bp, Homo sapiens
ggtttcagccctgctgttcctg

SEQ ID NO: 7386745 - DNA, 22 bp, Homo sapiens
gtagacaaatttcttctctcaa

SEQ ID NO: 7386746 - DNA, 22 bp, Homo sapiens
gtagaaatggtgtgtttcttct

SEQ ID NO: 7386747 - DNA, 22 bp, Homo sapiens
gtagaaattccatttactttga

SEQ ID NO: 7386748 - DNA, 22 bp, Homo sapiens
gtagacaaatttcttctctcaa

SEQ ID NO: 7386749 - DNA, 22 bp, Homo sapiens
gtagacaagcacaggactcaga

SEQ ID NO: 7386750 - DNA, 22 bp, Homo sapiens
gtattattaagtgtatttgacc

SEQ ID NO: 7386751 - DNA, 22 bp, Homo sapiens
gtattattgtcatgaaataata

SEQ ID NO: 7386752 - DNA, 22 bp, Homo sapiens
gtattattgtcatgaaataata

SEQ ID NO: 7386753 - DNA, 22 bp, Homo sapiens
gtattgcaattactcttcttct

SEQ ID NO: 7386754 - DNA, 21 bp, Homo sapiens
gtattgcagagttatgtgctc

SEQ ID NO: 7386755 - DNA, 22 bp, Homo sapiens
gtattgggtgagggcaaagggt

SEQ ID NO: 7386756 - DNA, 20 bp, Homo sapiens
gtattggggcctggaggaag

SEQ ID NO: 7386757 - DNA, 22 bp, Homo sapiens
gtattgggattatgggtgtgag

SEQ ID NO: 7386758 - DNA, 22 bp, Homo sapiens
gtatttaattccattaagttag

SEQ ID NO: 7386759 - DNA, 23 bp, Homo sapiens
gtgacccaaggaccttccagaat

SEQ ID NO: 7386760 - DNA, 22 bp, Homo sapiens
gtgaagatgcctcaggtgaccc

SEQ ID NO: 7386761 - DNA, 22 bp, Homo sapiens
gtgaagcacatgggcgttgggt

SEQ ID NO: 7386762 - DNA, 22 bp, Homo sapiens
gtgaagcagggaaggaaaggat

SEQ ID NO: 7386763 - DNA, 22 bp, Homo sapiens
gtgaagcacgctgccgcactgg

SEQ ID NO: 7386764 - DNA, 22 bp, Homo sapiens
gtgaagcagagtgtggaagcaa

SEQ ID NO: 7386765 - DNA, 22 bp, Homo sapiens
gtgaagcagttgcgtgggttcc

SEQ ID NO: 7386766 - DNA, 22 bp, Homo sapiens
gtgaagcataactgaaggattt

SEQ ID NO: 7386767 - DNA, 22 bp, Homo sapiens
gtgaagcatatgcttctctgcc

SEQ ID NO: 7386768 - DNA, 22 bp, Homo sapiens
gtgaaccaagaagtcaaagcga

SEQ ID NO: 7386769 - DNA, 22 bp, Homo sapiens
gtgaaattgtatttggcattga

SEQ ID NO: 7386770 - DNA, 22 bp, Homo sapiens
gtgaacctctgaaaggcagtga

SEQ ID NO: 7386771 - DNA, 22 bp, Homo sapiens
gtctgcccttggctcagccata

SEQ ID NO: 7386772 - DNA, 22 bp, Homo sapiens
gtctgcctcagccgggggccgc

SEQ ID NO: 7386773 - DNA, 22 bp, Homo sapiens
gtctgcctctttctttctgggt

SEQ ID NO: 7386774 - DNA, 22 bp, Homo sapiens
gtctgcctgctagtggctgcct

SEQ ID NO: 7386775 - DNA, 22 bp, Homo sapiens
gtctgctgtaggtaggacagca

SEQ ID NO: 7386776 - DNA, 22 bp, Homo sapiens
gtctgccccagaccctgaccca

SEQ ID NO: 7386777 - DNA, 22 bp, Homo sapiens
gtctgccctgcagacatgcctc

SEQ ID NO: 7386778 - DNA, 22 bp, Homo sapiens
gtctgccctgagctcccagtgc

SEQ ID NO: 7386779 - DNA, 22 bp, Homo sapiens
gtctgcccggccttcctccacc

SEQ ID NO: 7386780 - DNA, 22 bp, Homo sapiens
gtgagcaggatttcatggtgta

SEQ ID NO: 7386781 - DNA, 22 bp, Homo sapiens
gtgcacagatttaattttattc

SEQ ID NO: 7386782 - DNA, 22 bp, Homo sapiens
gtgcagagaggaccttggggag

SEQ ID NO: 7386783 - DNA, 22 bp, Homo sapiens
gtgcagagaaggagcagtagtt

SEQ ID NO: 7386784 - DNA, 22 bp, Homo sapiens
gtgcactgtctggtcaagagca

SEQ ID NO: 7386785 - DNA, 22 bp, Homo sapiens
gtgcagaagtaacaattaaaga

SEQ ID NO: 7386786 - DNA, 22 bp, Homo sapiens
gtgcagaagtaacaattaaaga

SEQ ID NO: 7386787 - DNA, 22 bp, Homo sapiens
gtgactgttgtttgctacgtgc

SEQ ID NO: 7386788 - DNA, 22 bp, Homo sapiens
gtgagcagcctcacctgagggt

SEQ ID NO: 7386789 - DNA, 22 bp, Homo sapiens
gtgagactcgcctttgtgtagc

SEQ ID NO: 7386790 - DNA, 23 bp, Homo sapiens
gtgagcagcccactaggaatgcc

SEQ ID NO: 7386791 - DNA, 22 bp, Homo sapiens
gtgcagagtgctacattttatt

SEQ ID NO: 7386792 - DNA, 20 bp, Homo sapiens
gtgcagaggcagcctgtggg

SEQ ID NO: 7386793 - DNA, 20 bp, Homo sapiens
gtgcagaggcagcctgtggg

SEQ ID NO: 7386794 - DNA, 22 bp, Homo sapiens
gtgcagaggacgtggcggcctc

SEQ ID NO: 7386795 - DNA, 22 bp, Homo sapiens
gtgcagaggacgtggcggcctc

SEQ ID NO: 7386796 - DNA, 22 bp, Homo sapiens
gtgccacagaccaccgtgctgg

SEQ ID NO: 7386797 - DNA, 22 bp, Homo sapiens
gtgccaatgcactctagcctgg

SEQ ID NO: 7386798 - DNA, 22 bp, Homo sapiens
gtgcattctctgattttcacaa

SEQ ID NO: 7386799 - DNA, 22 bp, Homo sapiens
gtgcattccaccgtgcaggttg

SEQ ID NO: 7386800 - DNA, 22 bp, Homo sapiens
gtgcattctatcaaatggtaca

SEQ ID NO: 7386801 - DNA, 22 bp, Homo sapiens
gtgcattccaaggcactttaga

SEQ ID NO: 7386802 - DNA, 19 bp, Homo sapiens
gtgcattccaaagcaccat

SEQ ID NO: 7386803 - DNA, 22 bp, Homo sapiens
gtgcataatttggcaatagaat

SEQ ID NO: 7386804 - DNA, 19 bp, Homo sapiens
gtgcagttcagagttcaat

SEQ ID NO: 7386805 - DNA, 22 bp, Homo sapiens
ggtccttgggtctcctgtgttt

SEQ ID NO: 7386806 - DNA, 20 bp, Homo sapiens
ggtccttgtcacaaggagag

SEQ ID NO: 7386807 - DNA, 22 bp, Homo sapiens
ggtcagagccgttagcattcag

SEQ ID NO: 7386808 - DNA, 22 bp, Homo sapiens
ggtcagagggtgggctgcctgt

SEQ ID NO: 7386809 - DNA, 22 bp, Homo sapiens
ggtcagagggtgggctgcctgt

SEQ ID NO: 7386810 - DNA, 22 bp, Homo sapiens
ggtcagaggggattccttggga

SEQ ID NO: 7386811 - DNA, 22 bp, Homo sapiens
ggtcacgtgaccgcacctgcct

SEQ ID NO: 7386812 - DNA, 22 bp, Homo sapiens
gggtggcacaggtgcagagggt

SEQ ID NO: 7386813 - DNA, 22 bp, Homo sapiens
gggtggcaggattggcaggagt

SEQ ID NO: 7386814 - DNA, 22 bp, Homo sapiens
ggtgtgtgtggattagcatgcc

SEQ ID NO: 7386815 - DNA, 19 bp, Homo sapiens
ggtgtgtgctggggcctgt

SEQ ID NO: 7386816 - DNA, 22 bp, Homo sapiens
ggtgtgggcagatgccctactt

SEQ ID NO: 7386817 - DNA, 22 bp, Homo sapiens
ggtggcctagggcccagcctgt

SEQ ID NO: 7386818 - DNA, 22 bp, Homo sapiens
ggtggcctgaattagctcaggg

SEQ ID NO: 7386819 - DNA, 22 bp, Homo sapiens
ggtggcctctgcaggcctcgac

SEQ ID NO: 7386820 - DNA, 22 bp, Homo sapiens
gggctgaggaacatattttgtt

SEQ ID NO: 7386821 - DNA, 22 bp, Homo sapiens
gggctgagagctggaatctgag

SEQ ID NO: 7386822 - DNA, 22 bp, Homo sapiens
gggccaaggggagctggaaggg

SEQ ID NO: 7386823 - DNA, 22 bp, Homo sapiens
gggcatgtaggaatccatggag

SEQ ID NO: 7386824 - DNA, 22 bp, Homo sapiens
gggccaagggtgcgtggcagga

SEQ ID NO: 7386825 - DNA, 22 bp, Homo sapiens
ggggttgatcacagaggggtct

SEQ ID NO: 7386826 - DNA, 20 bp, Homo sapiens
ggggttgaccctcttggact

SEQ ID NO: 7386827 - DNA, 22 bp, Homo sapiens
gggtaggagaggtgtctgtgtg

SEQ ID NO: 7386828 - DNA, 22 bp, Homo sapiens
gggtaggcaaagcaatgacgtt

SEQ ID NO: 7386829 - DNA, 22 bp, Homo sapiens
ggggaagagcattgcacggtgt

SEQ ID NO: 7386830 - DNA, 22 bp, Homo sapiens
ggggaaggaaagttattagcag

SEQ ID NO: 7386831 - DNA, 22 bp, Homo sapiens
ggggaagatttttaattagtaa

SEQ ID NO: 7386832 - DNA, 22 bp, Homo sapiens
gcagtgggagcttaggcagtgc

SEQ ID NO: 7386833 - DNA, 22 bp, Homo sapiens
gcagtgggagcttaggcagtgc

SEQ ID NO: 7386834 - DNA, 22 bp, Homo sapiens
gcagtggctaggagtctggcgt

SEQ ID NO: 7386835 - DNA, 22 bp, Homo sapiens
gcatgcagggagggtctggctg

SEQ ID NO: 7386836 - DNA, 22 bp, Homo sapiens
gcagtggatggccagcaggggc

SEQ ID NO: 7386837 - DNA, 22 bp, Homo sapiens
gcagtggcaccgctggctctgg

SEQ ID NO: 7386838 - DNA, 22 bp, Homo sapiens
gccacaggcttaggagggaggt

SEQ ID NO: 7386839 - DNA, 19 bp, Homo sapiens
gccacattcttccaggtgt

SEQ ID NO: 7386840 - DNA, 22 bp, Homo sapiens
gccacattagccctcaccatct

SEQ ID NO: 7386841 - DNA, 22 bp, Homo sapiens
gccacatgtcatgtgctcagta

SEQ ID NO: 7386842 - DNA, 22 bp, Homo sapiens
gccaccagtgggggcctgggca

SEQ ID NO: 7386843 - DNA, 22 bp, Homo sapiens
gcatgcatgtgtgcagacagtc

SEQ ID NO: 7386844 - DNA, 22 bp, Homo sapiens
gcatgctgctgaggctggaata

SEQ ID NO: 7386845 - DNA, 21 bp, Homo sapiens
gcatgcctgcatcttagtgtt

SEQ ID NO: 7386846 - DNA, 21 bp, Homo sapiens
gcatgcctgcatcttagtgtt

SEQ ID NO: 7386847 - DNA, 20 bp, Homo sapiens
gcatgcttggagagagagaa

SEQ ID NO: 7386848 - DNA, 21 bp, Homo sapiens
gccagcctgtttacctgtggt

SEQ ID NO: 7386849 - DNA, 22 bp, Homo sapiens
gccagctgaagccctggtggaa

SEQ ID NO: 7386850 - DNA, 22 bp, Homo sapiens
gccaggcactgctctaagccct

SEQ ID NO: 7386851 - DNA, 20 bp, Homo sapiens
gccaggcactgttctcaata

SEQ ID NO: 7386852 - DNA, 22 bp, Homo sapiens
gccaggcagacaggtcatcagg

SEQ ID NO: 7386853 - DNA, 21 bp, Homo sapiens
gccagcggccgccctccagga

SEQ ID NO: 7386854 - DNA, 22 bp, Homo sapiens
gccagctcccaagtgagcccct

SEQ ID NO: 7386855 - DNA, 22 bp, Homo sapiens
gccaggcaggtgtcggagccct

SEQ ID NO: 7386856 - DNA, 18 bp, Homo sapiens
gccaggcagggtggggaa

SEQ ID NO: 7386857 - DNA, 22 bp, Homo sapiens
gccaggcagttcaagtacacca

SEQ ID NO: 7386858 - DNA, 22 bp, Homo sapiens
gccaggcagctgggagggtgcc

SEQ ID NO: 7386859 - DNA, 22 bp, Homo sapiens
gccaggcagctagcaacccctg

SEQ ID NO: 7386860 - DNA, 22 bp, Homo sapiens
gccaggcaggccacgctgtgtt

SEQ ID NO: 7386861 - DNA, 22 bp, Homo sapiens
gccaggcagcagcgaggatggt

SEQ ID NO: 7386862 - DNA, 22 bp, Homo sapiens
gccaggcagcagcgaggatggt

SEQ ID NO: 7386863 - DNA, 22 bp, Homo sapiens
gccaggcagatatgtgagctta

SEQ ID NO: 7386864 - DNA, 22 bp, Homo sapiens
gccaggcagatatgtgagctta

SEQ ID NO: 7386865 - DNA, 22 bp, Homo sapiens
gccaggcagccaccctctgcga

SEQ ID NO: 7386866 - DNA, 22 bp, Homo sapiens
gccaggcatgggcttctgggcg

SEQ ID NO: 7386867 - DNA, 22 bp, Homo sapiens
gccaggcatgtcctctgcagaa

SEQ ID NO: 7386868 - DNA, 22 bp, Homo sapiens
gccagggaacccaagggcctca

SEQ ID NO: 7386869 - DNA, 21 bp, Homo sapiens
gccagggaagagagttggctg

SEQ ID NO: 7386870 - DNA, 17 bp, Homo sapiens
gccagggagaggaagcc

SEQ ID NO: 7386871 - DNA, 22 bp, Homo sapiens
gcctcctgggttcatgccattc

SEQ ID NO: 7386872 - DNA, 22 bp, Homo sapiens
gcctcctggttgcttctccaac

SEQ ID NO: 7386873 - DNA, 22 bp, Homo sapiens
gcctcctggggtgccatcatct

SEQ ID NO: 7386874 - DNA, 22 bp, Homo sapiens
gcctcctggattttagtgccat

SEQ ID NO: 7386875 - DNA, 22 bp, Homo sapiens
gcctcctggaagtcacatgttt

SEQ ID NO: 7386876 - DNA, 22 bp, Homo sapiens
gcctcctgacttacactgagct

SEQ ID NO: 7386877 - DNA, 22 bp, Homo sapiens
gcctcctgagaagccacaggct

SEQ ID NO: 7386878 - DNA, 22 bp, Homo sapiens
gcctcctcacaatgtacccacg

SEQ ID NO: 7386879 - DNA, 22 bp, Homo sapiens
gcctcctccttcccgagggtct

SEQ ID NO: 7386880 - DNA, 22 bp, Homo sapiens
gcctcctgaaaggaagagctcc

SEQ ID NO: 7386881 - DNA, 22 bp, Homo sapiens
gcctcctcttgagggtcaggga

SEQ ID NO: 7386882 - DNA, 22 bp, Homo sapiens
gccctgttatccagatgaggat

SEQ ID NO: 7386883 - DNA, 22 bp, Homo sapiens
gccctgtgtgtttgcactgatt

SEQ ID NO: 7386884 - DNA, 22 bp, Homo sapiens
gccctgtgtatcccctgtgctt

SEQ ID NO: 7386885 - DNA, 22 bp, Homo sapiens
gcctcccttggtgtctcccggg

SEQ ID NO: 7386886 - DNA, 22 bp, Homo sapiens
gccctggatgctcatggcatca

SEQ ID NO: 7386887 - DNA, 22 bp, Homo sapiens
gccctggatgtacaggcatgtt

SEQ ID NO: 7386888 - DNA, 22 bp, Homo sapiens
gccctggatggcaggagccatc

SEQ ID NO: 7386889 - DNA, 22 bp, Homo sapiens
gccctggatgtacaggcatgtt

SEQ ID NO: 7386890 - DNA, 22 bp, Homo sapiens
gccctgtgcttggatggcagat

SEQ ID NO: 7386891 - DNA, 22 bp, Homo sapiens
gccctgtggattaatgagcagg

SEQ ID NO: 7386892 - DNA, 22 bp, Homo sapiens
gccccagcctcccgagtagctg

SEQ ID NO: 7386893 - DNA, 22 bp, Homo sapiens
gccctggagctagactaggaca

SEQ ID NO: 7386894 - DNA, 20 bp, Homo sapiens
gccctggagccttgtcctgg

SEQ ID NO: 7386895 - DNA, 17 bp, Homo sapiens
gccctggagccaggcta

SEQ ID NO: 7386896 - DNA, 22 bp, Homo sapiens
gccccagctctgccacaactag

SEQ ID NO: 7386897 - DNA, 22 bp, Homo sapiens
gccccaggataaatttgtaaga

SEQ ID NO: 7386898 - DNA, 22 bp, Homo sapiens
gccccaggggaggtgccctgca

SEQ ID NO: 7386899 - DNA, 22 bp, Homo sapiens
gccccaggataaatttgtaaga

SEQ ID NO: 7386900 - DNA, 15 bp, Homo sapiens
gccccaggaatcaaa

SEQ ID NO: 7386901 - DNA, 15 bp, Homo sapiens
gccccaggaatcaaa

SEQ ID NO: 7386902 - DNA, 22 bp, Homo sapiens
gcccagcacagctggaagagtc

SEQ ID NO: 7386903 - DNA, 21 bp, Homo sapiens
gcccagcaaggtgagaaggcc

SEQ ID NO: 7386904 - DNA, 22 bp, Homo sapiens
gccagggttgccaatgggggca

SEQ ID NO: 7386905 - DNA, 22 bp, Homo sapiens
gccagggttcgaatccgtatgg

SEQ ID NO: 7386906 - DNA, 22 bp, Homo sapiens
gccagggttcaagctattctcc

SEQ ID NO: 7386907 - DNA, 22 bp, Homo sapiens
gccagggtcctgaagaccaagt

SEQ ID NO: 7386908 - DNA, 22 bp, Homo sapiens
gccagggtggcagaaggcccca

SEQ ID NO: 7386909 - DNA, 22 bp, Homo sapiens
gcccagccctgaggtcacagct

SEQ ID NO: 7386910 - DNA, 22 bp, Homo sapiens
gcccagcctccaagctccaagg

SEQ ID NO: 7386911 - DNA, 22 bp, Homo sapiens
gccccaccgagggtgcagtcct

SEQ ID NO: 7386912 - DNA, 22 bp, Homo sapiens
gccccacagcctgcggtctcag

SEQ ID NO: 7386913 - DNA, 22 bp, Homo sapiens
gcccagctggcttccagcacat

SEQ ID NO: 7386914 - DNA, 22 bp, Homo sapiens
gcccagcttttcacttccacac

SEQ ID NO: 7386915 - DNA, 22 bp, Homo sapiens
gcaggcagtcatctttcatatt

SEQ ID NO: 7386916 - DNA, 22 bp, Homo sapiens
gcaggcagttatttagtagaat

SEQ ID NO: 7386917 - DNA, 22 bp, Homo sapiens
gcaggcagagtcaatttgatcc

SEQ ID NO: 7386918 - DNA, 22 bp, Homo sapiens
gcaggcagaggtggaggagaca

SEQ ID NO: 7386919 - DNA, 22 bp, Homo sapiens
gcaggcagatcacctgtcagga

SEQ ID NO: 7386920 - DNA, 22 bp, Homo sapiens
gcaggcagatcacctgtcagga

SEQ ID NO: 7386921 - DNA, 22 bp, Homo sapiens
gcagggacctgccactgctgtc

SEQ ID NO: 7386922 - DNA, 22 bp, Homo sapiens
gcagatggctgagcctgcagat

SEQ ID NO: 7386923 - DNA, 21 bp, Homo sapiens
gcagatgggaagagacgaggc

SEQ ID NO: 7386924 - DNA, 22 bp, Homo sapiens
gcagatggtgccatgtcttgtg

SEQ ID NO: 7386925 - DNA, 22 bp, Homo sapiens
gcagatggtggaggcaagaggc

SEQ ID NO: 7386926 - DNA, 23 bp, Homo sapiens
gcagatggccccagagtgctgcc

SEQ ID NO: 7386927 - DNA, 23 bp, Homo sapiens
gcagatggccccagagtgctgcc

SEQ ID NO: 7386928 - DNA, 22 bp, Homo sapiens
gcagatggcagcccaggctggg

SEQ ID NO: 7386929 - DNA, 22 bp, Homo sapiens
gcagatggcagcccaggctggg

SEQ ID NO: 7386930 - DNA, 22 bp, Homo sapiens
gcagatggcagcccaggctggg

SEQ ID NO: 7386931 - DNA, 22 bp, Homo sapiens
gcagccctcgggtactcacgtg

SEQ ID NO: 7386932 - DNA, 22 bp, Homo sapiens
gcagccctaacctgtcatagtg

SEQ ID NO: 7386933 - DNA, 22 bp, Homo sapiens
gcagccctggcctggcctactt

SEQ ID NO: 7386934 - DNA, 20 bp, Homo sapiens
gcagctgtgcattcttagga

SEQ ID NO: 7386935 - DNA, 20 bp, Homo sapiens
gcagctgtgcattcttagga

SEQ ID NO: 7386936 - DNA, 22 bp, Homo sapiens
gcagctgtcggaaagctaagtg

SEQ ID NO: 7386937 - DNA, 22 bp, Homo sapiens
gcagacggagtatcttgtacat

SEQ ID NO: 7386938 - DNA, 22 bp, Homo sapiens
gcagagaaggattgaaaccaga

SEQ ID NO: 7386939 - DNA, 19 bp, Homo sapiens
gcagacaggtccagagagg

SEQ ID NO: 7386940 - DNA, 19 bp, Homo sapiens
gcagacaggtccagagagg

SEQ ID NO: 7386941 - DNA, 23 bp, Homo sapiens
gcacatagtaagtaagcagacat

SEQ ID NO: 7386942 - DNA, 22 bp, Homo sapiens
gcagaggtctcttcaaaataat

SEQ ID NO: 7386943 - DNA, 22 bp, Homo sapiens
gcagatggagacgaggttccgc

SEQ ID NO: 7386944 - DNA, 22 bp, Homo sapiens
gcagatggactgtatgacctga

SEQ ID NO: 7386945 - DNA, 22 bp, Homo sapiens
gcagatggagacgaggttccgc

SEQ ID NO: 7386946 - DNA, 22 bp, Homo sapiens
gcagagttcctggaaagcaacc

SEQ ID NO: 7386947 - DNA, 22 bp, Homo sapiens
gcagaggccatcaactttgcca

SEQ ID NO: 7386948 - DNA, 22 bp, Homo sapiens
gcagaggccaggccaccagcaa

SEQ ID NO: 7386949 - DNA, 22 bp, Homo sapiens
gcagaggccaggccaccagcaa

SEQ ID NO: 7386950 - DNA, 22 bp, Homo sapiens
gcagaggccaggccaccagcaa

SEQ ID NO: 7386951 - DNA, 22 bp, Homo sapiens
gcagagggtcctgtgccagcag

SEQ ID NO: 7386952 - DNA, 22 bp, Homo sapiens
gcagagggtcctgtgccagcag

SEQ ID NO: 7386953 - DNA, 22 bp, Homo sapiens
gcagaggcacagccccagatga

SEQ ID NO: 7386954 - DNA, 22 bp, Homo sapiens
gcagaggcacagccccagatga

SEQ ID NO: 7386955 - DNA, 21 bp, Homo sapiens
gcagaggcacggcaccaaggg

SEQ ID NO: 7386956 - DNA, 21 bp, Homo sapiens
gcagaggcacggcaccaaggg

SEQ ID NO: 7386957 - DNA, 22 bp, Homo sapiens
gcagaggcatttctgacgctgc

SEQ ID NO: 7386958 - DNA, 22 bp, Homo sapiens
gcagaggcagggccctcctcca

SEQ ID NO: 7386959 - DNA, 22 bp, Homo sapiens
gcagaggatcaggctctggaaa

SEQ ID NO: 7386960 - DNA, 22 bp, Homo sapiens
gcagagcagtactctcttgact

SEQ ID NO: 7386961 - DNA, 22 bp, Homo sapiens
gcagagcaggggctgaacctgg

SEQ ID NO: 7386962 - DNA, 22 bp, Homo sapiens
gcagagcaggaaggaagtcagg

SEQ ID NO: 7386963 - DNA, 22 bp, Homo sapiens
gcagagcagaggtgcaggttgg

SEQ ID NO: 7386964 - DNA, 18 bp, Homo sapiens
gcagagcagaagctcaag

SEQ ID NO: 7386965 - DNA, 22 bp, Homo sapiens
gcagagcagagcctgcattggc

SEQ ID NO: 7386966 - DNA, 22 bp, Homo sapiens
gcacacatgcatgcacaggagt

SEQ ID NO: 7386967 - DNA, 22 bp, Homo sapiens
gcacacatgcgtgtatatgggt

SEQ ID NO: 7386968 - DNA, 22 bp, Homo sapiens
gcacacagaatcagtgggcata

SEQ ID NO: 7386969 - DNA, 22 bp, Homo sapiens
gcacacagtactatatgctaca

SEQ ID NO: 7386970 - DNA, 22 bp, Homo sapiens
gcaaatatttctaattcctgaa

SEQ ID NO: 7386971 - DNA, 22 bp, Homo sapiens
gcaaatattcaagacttttcca

SEQ ID NO: 7386972 - DNA, 22 bp, Homo sapiens
gcaaatattcaagacttttcca

SEQ ID NO: 7386973 - DNA, 22 bp, Homo sapiens
gcacaggtcaggagatgagatt

SEQ ID NO: 7386974 - DNA, 22 bp, Homo sapiens
gcacagggctgccaggcggctt

SEQ ID NO: 7386975 - DNA, 22 bp, Homo sapiens
gcacacggcagcctcctcctga

SEQ ID NO: 7386976 - DNA, 22 bp, Homo sapiens
gcacactggagcctggaagatt

SEQ ID NO: 7386977 - DNA, 22 bp, Homo sapiens
gcacactcctggatcctagaga

SEQ ID NO: 7386978 - DNA, 22 bp, Homo sapiens
gcaaaggccactggggcgatgg

SEQ ID NO: 7386979 - DNA, 22 bp, Homo sapiens
gcaaaggcttcttttattctcc

SEQ ID NO: 7386980 - DNA, 22 bp, Homo sapiens
gcaaaggctagagacacaggga

SEQ ID NO: 7386981 - DNA, 22 bp, Homo sapiens
gcaaataatatactttgatctc

SEQ ID NO: 7386982 - DNA, 22 bp, Homo sapiens
gcaaagtgcttcagtgggagct

SEQ ID NO: 7386983 - DNA, 22 bp, Homo sapiens
gcaaagtgaaatggggcagaga

SEQ ID NO: 7386984 - DNA, 22 bp, Homo sapiens
gcaaagcaatcaggagtagcat

SEQ ID NO: 7386985 - DNA, 22 bp, Homo sapiens
gcaaagaaagttttaatgaggt

SEQ ID NO: 7386986 - DNA, 22 bp, Homo sapiens
gcaaagaaagccaaggtctaac

SEQ ID NO: 7386987 - DNA, 22 bp, Homo sapiens
gcaaactgttggagtagagtct

SEQ ID NO: 7386988 - DNA, 22 bp, Homo sapiens
gcaaagatattagaatagagta

SEQ ID NO: 7386989 - DNA, 22 bp, Homo sapiens
gcaaagatattagaatagagta

SEQ ID NO: 7386990 - DNA, 22 bp, Homo sapiens
gcaaagaaatgtcagtgagagg

SEQ ID NO: 7386991 - DNA, 22 bp, Homo sapiens
gcaaagaatgcagatttgcctc

SEQ ID NO: 7386992 - DNA, 22 bp, Homo sapiens
gaggcccagagaggttgcatga

SEQ ID NO: 7386993 - DNA, 22 bp, Homo sapiens
gaggcccagagaggttgcatga

SEQ ID NO: 7386994 - DNA, 22 bp, Homo sapiens
gaggcccaaggactctgtcccg

SEQ ID NO: 7386995 - DNA, 22 bp, Homo sapiens
gaggccagtgaaatgttataaa

SEQ ID NO: 7386996 - DNA, 22 bp, Homo sapiens
gaggccagtgtgctgtgttttc

SEQ ID NO: 7386997 - DNA, 22 bp, Homo sapiens
gctggctttgcactgggtgcat

SEQ ID NO: 7386998 - DNA, 22 bp, Homo sapiens
gctggctgtgggctccacgctc

SEQ ID NO: 7386999 - DNA, 21 bp, Homo sapiens
gctggctggctgaccggcctt

SEQ ID NO: 7387000 - DNA, 22 bp, Homo sapiens
gctggctgttgaataatggcat

SEQ ID NO: 7387001 - DNA, 22 bp, Homo sapiens
gctggcttgacagaggcctggg

SEQ ID NO: 7387002 - DNA, 22 bp, Homo sapiens
gctggcttaatagggatgggct

SEQ ID NO: 7387003 - DNA, 22 bp, Homo sapiens
gctggctggaatgggagaagaa

SEQ ID NO: 7387004 - DNA, 22 bp, Homo sapiens
gctggctggaggtgaggaagaa

SEQ ID NO: 7387005 - DNA, 22 bp, Homo sapiens
gctggctgcgtcatcacagggc

SEQ ID NO: 7387006 - DNA, 22 bp, Homo sapiens
gctggctgcgtcatcacagggc

SEQ ID NO: 7387007 - DNA, 22 bp, Homo sapiens
gctggagacctcagagaaccca

SEQ ID NO: 7387008 - DNA, 22 bp, Homo sapiens
gctgctttaggttgagctcagc

SEQ ID NO: 7387009 - DNA, 22 bp, Homo sapiens
gctgctttacaggtgggggagc

SEQ ID NO: 7387010 - DNA, 20 bp, Homo sapiens
gctgtgcctccagctggtgg

SEQ ID NO: 7387011 - DNA, 19 bp, Homo sapiens
gctgtgcccctgccgcttg

SEQ ID NO: 7387012 - DNA, 18 bp, Homo sapiens
gctttatttcttggggaa

SEQ ID NO: 7387013 - DNA, 18 bp, Homo sapiens
gctttatttcttggggaa

SEQ ID NO: 7387014 - DNA, 22 bp, Homo sapiens
gcttgctggtgcctgcaggctc

SEQ ID NO: 7387015 - DNA, 19 bp, Homo sapiens
gcttgctgctaggtaggga

SEQ ID NO: 7387016 - DNA, 22 bp, Homo sapiens
gcttggaagtaggattgggaga

SEQ ID NO: 7387017 - DNA, 22 bp, Homo sapiens
gcttgcaagtgtcaagctatta

SEQ ID NO: 7387018 - DNA, 22 bp, Homo sapiens
gcttgcattctggatctatggt

SEQ ID NO: 7387019 - DNA, 22 bp, Homo sapiens
gcttgctagaagcttaaaggta

SEQ ID NO: 7387020 - DNA, 22 bp, Homo sapiens
gcttgcctggcatttctggggc

SEQ ID NO: 7387021 - DNA, 22 bp, Homo sapiens
gctgtgtgaccctagccagtag

SEQ ID NO: 7387022 - DNA, 22 bp, Homo sapiens
gctgtgtgaaaactgggcctgg

SEQ ID NO: 7387023 - DNA, 18 bp, Homo sapiens
ggaatgtggacaggctgg

SEQ ID NO: 7387024 - DNA, 22 bp, Homo sapiens
ggaatgaatttccagctgggtc

SEQ ID NO: 7387025 - DNA, 22 bp, Homo sapiens
ggaatgagctcggagcagaagg

SEQ ID NO: 7387026 - DNA, 22 bp, Homo sapiens
ggacaaagcctggtggcaggtg

SEQ ID NO: 7387027 - DNA, 22 bp, Homo sapiens
ggaagcagcctgaagccaaggg

SEQ ID NO: 7387028 - DNA, 22 bp, Homo sapiens
ggaagatgagaagtggggctcc

SEQ ID NO: 7387029 - DNA, 22 bp, Homo sapiens
ggaagattcagttatctcatga

SEQ ID NO: 7387030 - DNA, 22 bp, Homo sapiens
ggaagattcagttatctcatga

SEQ ID NO: 7387031 - DNA, 18 bp, Homo sapiens
ggaagattggctatgtgc

SEQ ID NO: 7387032 - DNA, 22 bp, Homo sapiens
ggaagattcagcatatatgagt

SEQ ID NO: 7387033 - DNA, 22 bp, Homo sapiens
ggaagagggaaccacgactgta

SEQ ID NO: 7387034 - DNA, 22 bp, Homo sapiens
ggaagaggctggtagtgcccgt

SEQ ID NO: 7387035 - DNA, 22 bp, Homo sapiens
ggaagaggctggtagtgcccgt

SEQ ID NO: 7387036 - DNA, 22 bp, Homo sapiens
ggaagaggctctcattgagggc

SEQ ID NO: 7387037 - DNA, 22 bp, Homo sapiens
ggaagaggctctcattgagggc

SEQ ID NO: 7387038 - DNA, 22 bp, Homo sapiens
ggaagaggctgagccaggtccc

SEQ ID NO: 7387039 - DNA, 22 bp, Homo sapiens
ggaagaggctctcattgagggc

SEQ ID NO: 7387040 - DNA, 22 bp, Homo sapiens
ggaagaggctgaggccatgctg

SEQ ID NO: 7387041 - DNA, 22 bp, Homo sapiens
ggaagaggaggagccaggcttt

SEQ ID NO: 7387042 - DNA, 22 bp, Homo sapiens
ggaagaggaggagccaggcttt

SEQ ID NO: 7387043 - DNA, 22 bp, Homo sapiens
gctttctaggcagagatgactg

SEQ ID NO: 7387044 - DNA, 18 bp, Homo sapiens
gctttcaatttctttcct

SEQ ID NO: 7387045 - DNA, 20 bp, Homo sapiens
gctttcaagcttgtcattgt

SEQ ID NO: 7387046 - DNA, 22 bp, Homo sapiens
gctttattttgtgagggattac

SEQ ID NO: 7387047 - DNA, 22 bp, Homo sapiens
gctttattttgtgagggattac

SEQ ID NO: 7387048 - DNA, 18 bp, Homo sapiens
gctttctatgcgacagta

SEQ ID NO: 7387049 - DNA, 22 bp, Homo sapiens
gctttggaacttaaatccttgg

SEQ ID NO: 7387050 - DNA, 22 bp, Homo sapiens
ggacatgattagcagggagagc

SEQ ID NO: 7387051 - DNA, 22 bp, Homo sapiens
ggagacagtatggcttgtagct

SEQ ID NO: 7387052 - DNA, 22 bp, Homo sapiens
ggagacagtatggcttgtagct

SEQ ID NO: 7387053 - DNA, 22 bp, Homo sapiens
ggacacaggcagctgggtgggt

SEQ ID NO: 7387054 - DNA, 22 bp, Homo sapiens
ggagcagcactgccacacagag

SEQ ID NO: 7387055 - DNA, 22 bp, Homo sapiens
ggagcagcactgattagcggtt

SEQ ID NO: 7387056 - DNA, 22 bp, Homo sapiens
ggagcaggctctgtggtttcca

SEQ ID NO: 7387057 - DNA, 22 bp, Homo sapiens
ggagcagggaattacagcgcag

SEQ ID NO: 7387058 - DNA, 22 bp, Homo sapiens
ggagagagacctccatgcccag

SEQ ID NO: 7387059 - DNA, 22 bp, Homo sapiens
ggagagagagattgtgtttatt

SEQ ID NO: 7387060 - DNA, 22 bp, Homo sapiens
ggagcagggcagtgaattctgg

SEQ ID NO: 7387061 - DNA, 22 bp, Homo sapiens
ggagcagggaattacagcgcag

SEQ ID NO: 7387062 - DNA, 22 bp, Homo sapiens
ggagcagtggtcattcagctgg

SEQ ID NO: 7387063 - DNA, 22 bp, Homo sapiens
ggagcagttgttgagcaagcca

SEQ ID NO: 7387064 - DNA, 22 bp, Homo sapiens
ggagccagagcactggggagcc

SEQ ID NO: 7387065 - DNA, 22 bp, Homo sapiens
ggagccagagcactggggagcc

SEQ ID NO: 7387066 - DNA, 22 bp, Homo sapiens
ggagcatgtggggtgagcaggg

SEQ ID NO: 7387067 - DNA, 22 bp, Homo sapiens
ggagagaactgacctgaaagga

SEQ ID NO: 7387068 - DNA, 22 bp, Homo sapiens
ggagagaactggctccttctag

SEQ ID NO: 7387069 - DNA, 22 bp, Homo sapiens
gctccctggtagccatgctctc

SEQ ID NO: 7387070 - DNA, 21 bp, Homo sapiens
gctccctgctcagctcctggg

SEQ ID NO: 7387071 - DNA, 22 bp, Homo sapiens
gctccctggtattgctgccact

SEQ ID NO: 7387072 - DNA, 22 bp, Homo sapiens
gctccctggtagccatgctctc

SEQ ID NO: 7387073 - DNA, 23 bp, Homo sapiens
gctccctgtccctgcacttaggc

SEQ ID NO: 7387074 - DNA, 22 bp, Homo sapiens
gctccctgcactctgcagccct

SEQ ID NO: 7387075 - DNA, 22 bp, Homo sapiens
gctccctgactcagttcctgag

SEQ ID NO: 7387076 - DNA, 17 bp, Homo sapiens
gctccctgaggacagct

SEQ ID NO: 7387077 - DNA, 17 bp, Homo sapiens
gctccctgaggacagct

SEQ ID NO: 7387078 - DNA, 22 bp, Homo sapiens
gctccaggtggcttatttgtat

SEQ ID NO: 7387079 - DNA, 22 bp, Homo sapiens
gctccaggtgaatcctctcacc

SEQ ID NO: 7387080 - DNA, 22 bp, Homo sapiens
gctccaggtatttgccctttta

SEQ ID NO: 7387081 - DNA, 22 bp, Homo sapiens
gctcccacctttgctatcagta

SEQ ID NO: 7387082 - DNA, 22 bp, Homo sapiens
gctccaggaggctcccgcgtct

SEQ ID NO: 7387083 - DNA, 22 bp, Homo sapiens
gctccagggtggatgacaattc

SEQ ID NO: 7387084 - DNA, 22 bp, Homo sapiens
gctccagggagtacatttatca

SEQ ID NO: 7387085 - DNA, 22 bp, Homo sapiens
gctcagctacttacaggtggct

SEQ ID NO: 7387086 - DNA, 18 bp, Homo sapiens
gctcagctatgggaggtt

SEQ ID NO: 7387087 - DNA, 22 bp, Homo sapiens
gctcagagttaattggatgggt

SEQ ID NO: 7387088 - DNA, 18 bp, Homo sapiens
gcctctgttgcttgcctg

SEQ ID NO: 7387089 - DNA, 22 bp, Homo sapiens
gccttggaaagctggagcagtt

SEQ ID NO: 7387090 - DNA, 22 bp, Homo sapiens
gcgtggcttagagtggggtacc

SEQ ID NO: 7387091 - DNA, 22 bp, Homo sapiens
gccttttaaggcagagggagat

SEQ ID NO: 7387092 - DNA, 22 bp, Homo sapiens
gcctttgaattgttgtggtgag

SEQ ID NO: 7387093 - DNA, 22 bp, Homo sapiens
gcctttcatgcttggagggcca

SEQ ID NO: 7387094 - DNA, 18 bp, Homo sapiens
gcctttgaatgagggatt

SEQ ID NO: 7387095 - DNA, 17 bp, Homo sapiens
gcctttatacatgctgc

SEQ ID NO: 7387096 - DNA, 22 bp, Homo sapiens
gcctttagactttgggacttat

SEQ ID NO: 7387097 - DNA, 22 bp, Homo sapiens
gcctttaaagctggcaggcttt

SEQ ID NO: 7387098 - DNA, 22 bp, Homo sapiens
gccttgtttcattacacgtggt

SEQ ID NO: 7387099 - DNA, 22 bp, Homo sapiens
gcctttatatccctgatatcta

SEQ ID NO: 7387100 - DNA, 22 bp, Homo sapiens
gcctttatattacatttggaag

SEQ ID NO: 7387101 - DNA, 22 bp, Homo sapiens
gcctttatattacatttggaag

SEQ ID NO: 7387102 - DNA, 22 bp, Homo sapiens
gcctttatatttttctggtgtt

SEQ ID NO: 7387103 - DNA, 17 bp, Homo sapiens
gcctttatacatgctgc

SEQ ID NO: 7387104 - DNA, 17 bp, Homo sapiens
gcctttatacatgctgc

SEQ ID NO: 7387105 - DNA, 22 bp, Homo sapiens
gcctttatatccctgatatcta

SEQ ID NO: 7387106 - DNA, 22 bp, Homo sapiens
gcctttatccctgtacaaggtg

SEQ ID NO: 7387107 - DNA, 22 bp, Homo sapiens
gcctttatatttttctggtgtt

SEQ ID NO: 7387108 - DNA, 22 bp, Homo sapiens
gcctttatcagtttcatggctt

SEQ ID NO: 7387109 - DNA, 22 bp, Homo sapiens
gcctttatcagtttcatggctt

SEQ ID NO: 7387110 - DNA, 22 bp, Homo sapiens
gcctttattttcaacggagtgt

SEQ ID NO: 7387111 - DNA, 22 bp, Homo sapiens
gcctttattttcaacggagtgt

SEQ ID NO: 7387112 - DNA, 22 bp, Homo sapiens
gcctttattgtttattcagtgc

SEQ ID NO: 7387113 - DNA, 22 bp, Homo sapiens
gcctttattgtttattcagtgc

SEQ ID NO: 7387114 - DNA, 22 bp, Homo sapiens
gcctttatttacgaaagggaaa

SEQ ID NO: 7387115 - DNA, 22 bp, Homo sapiens
gcctttatttacgaaagggaaa

SEQ ID NO: 7387116 - DNA, 22 bp, Homo sapiens
gcctttatgtctgaaaatcagc

SEQ ID NO: 7387117 - DNA, 22 bp, Homo sapiens
gcctttatgtctgaaaatcagc

SEQ ID NO: 7387118 - DNA, 23 bp, Homo sapiens
gcctttattaggcacaggggtac

SEQ ID NO: 7387119 - DNA, 23 bp, Homo sapiens
gcctttattaggcacaggggtac

SEQ ID NO: 7387120 - DNA, 22 bp, Homo sapiens
gcctttattgtttattcagtgc

SEQ ID NO: 7387121 - DNA, 22 bp, Homo sapiens
gcctttatccctgtacaaggtg

SEQ ID NO: 7387122 - DNA, 22 bp, Homo sapiens
gcctttatccctgtacaaggtg

SEQ ID NO: 7387123 - DNA, 22 bp, Homo sapiens
gcctttatcttcctgattcaga

SEQ ID NO: 7387124 - DNA, 22 bp, Homo sapiens
gcctttatcttcctgattcaga

SEQ ID NO: 7387125 - DNA, 22 bp, Homo sapiens
gcctttatcttgggccaagttt

SEQ ID NO: 7387126 - DNA, 22 bp, Homo sapiens
gcctttatcttgggccaagttt

SEQ ID NO: 7387127 - DNA, 22 bp, Homo sapiens
gctgaggctcaagtcatgggtc

SEQ ID NO: 7387128 - DNA, 22 bp, Homo sapiens
gctgaggcctcagaaggctgag

SEQ ID NO: 7387129 - DNA, 22 bp, Homo sapiens
gctgaggccagtttaatgagga

SEQ ID NO: 7387130 - DNA, 22 bp, Homo sapiens
gctgaggctgggagcagcctgt

SEQ ID NO: 7387131 - DNA, 22 bp, Homo sapiens
gctgaggctgggagcagcctgt

SEQ ID NO: 7387132 - DNA, 21 bp, Homo sapiens
gctgagacgcaacctcagtga

SEQ ID NO: 7387133 - DNA, 22 bp, Homo sapiens
gctgagaatgttcctactggta

SEQ ID NO: 7387134 - DNA, 22 bp, Homo sapiens
gctccctgttctcagccatgat

SEQ ID NO: 7387135 - DNA, 22 bp, Homo sapiens
gctcccttaggccttgccggga

SEQ ID NO: 7387136 - DNA, 22 bp, Homo sapiens
gctcccttagtccttgccggga

SEQ ID NO: 7387137 - DNA, 22 bp, Homo sapiens
gctgcctgtgcgggtcgctagg

SEQ ID NO: 7387138 - DNA, 19 bp, Homo sapiens
gctgcctgtcttagccagt

SEQ ID NO: 7387139 - DNA, 22 bp, Homo sapiens
gctgcctgtctgctgacccagg

SEQ ID NO: 7387140 - DNA, 22 bp, Homo sapiens
gctgcctgtgtggccactcact

SEQ ID NO: 7387141 - DNA, 22 bp, Homo sapiens
gctgcctgttgaagggtctgtg

SEQ ID NO: 7387142 - DNA, 22 bp, Homo sapiens
gctgccttcagttctgattcat

SEQ ID NO: 7387143 - DNA, 22 bp, Homo sapiens
gctgccttatgtctattagtat

SEQ ID NO: 7387144 - DNA, 22 bp, Homo sapiens
gctgccttaacttcttcgctgt

SEQ ID NO: 7387145 - DNA, 22 bp, Homo sapiens
gctgccttagagggagtggttc

SEQ ID NO: 7387146 - DNA, 22 bp, Homo sapiens
gctgcccttcgtcatctataaa

SEQ ID NO: 7387147 - DNA, 22 bp, Homo sapiens
gctgccctgtttagccagggtt

SEQ ID NO: 7387148 - DNA, 22 bp, Homo sapiens
gctgcctcactccagcccaata

SEQ ID NO: 7387149 - DNA, 22 bp, Homo sapiens
gctgcctagttctttatgtgaa

SEQ ID NO: 7387150 - DNA, 22 bp, Homo sapiens
gctgcctacgcttgagccctgg

SEQ ID NO: 7387151 - DNA, 22 bp, Homo sapiens
gctgcctccaatctgtgccccg

SEQ ID NO: 7387152 - DNA, 22 bp, Homo sapiens
gctgccctagaagtacagagag

SEQ ID NO: 7387153 - DNA, 22 bp, Homo sapiens
gctgccctacccgaggcactct

SEQ ID NO: 7387154 - DNA, 22 bp, Homo sapiens
gctgccctacccgaggcactct

SEQ ID NO: 7387155 - DNA, 19 bp, Homo sapiens
gctgagggccacccagccc

SEQ ID NO: 7387156 - DNA, 23 bp, Homo sapiens
tccagctcccttcaatggcactg

SEQ ID NO: 7387157 - DNA, 22 bp, Homo sapiens
tccagctcagatgcagggatca

SEQ ID NO: 7387158 - DNA, 22 bp, Homo sapiens
tccagcagtccatgtgagacac

SEQ ID NO: 7387159 - DNA, 22 bp, Homo sapiens
tccagctctgcttcacagtctc

SEQ ID NO: 7387160 - DNA, 22 bp, Homo sapiens
tccagctctggcttggctagct

SEQ ID NO: 7387161 - DNA, 22 bp, Homo sapiens
tccagcttttaccaaatgagca

SEQ ID NO: 7387162 - DNA, 22 bp, Homo sapiens
tccaggaggctctggttgacgt

SEQ ID NO: 7387163 - DNA, 22 bp, Homo sapiens
tccagagatcacactgggcagg

SEQ ID NO: 7387164 - DNA, 22 bp, Homo sapiens
tccagagatctctcttccctgt

SEQ ID NO: 7387165 - DNA, 22 bp, Homo sapiens
tcattgaagtgactgaaagatt

SEQ ID NO: 7387166 - DNA, 22 bp, Homo sapiens
tcattgaatttggttcaatatg

SEQ ID NO: 7387167 - DNA, 20 bp, Homo sapiens
tccagagagtggcaaagctc

SEQ ID NO: 7387168 - DNA, 22 bp, Homo sapiens
tccagaatactctgaaatcatt

SEQ ID NO: 7387169 - DNA, 22 bp, Homo sapiens
tcattgcatttattcactggca

SEQ ID NO: 7387170 - DNA, 23 bp, Homo sapiens
tccagcagccaagaagggtagaa

SEQ ID NO: 7387171 - DNA, 22 bp, Homo sapiens
tccagcagaccatcaaggctca

SEQ ID NO: 7387172 - DNA, 23 bp, Homo sapiens
tccagcagagccttccaggaggg

SEQ ID NO: 7387173 - DNA, 22 bp, Homo sapiens
tccaggagtcctgggtggcccc

SEQ ID NO: 7387174 - DNA, 22 bp, Homo sapiens
tccaggagtctagcctcaggcc

SEQ ID NO: 7387175 - DNA, 22 bp, Homo sapiens
tccaggagtcagacagatggtg

SEQ ID NO: 7387176 - DNA, 22 bp, Homo sapiens
tccaggaggttgagactgcagt

SEQ ID NO: 7387177 - DNA, 22 bp, Homo sapiens
tccaggcataatgcccagtggt

SEQ ID NO: 7387178 - DNA, 22 bp, Homo sapiens
tccaggattgcaggtgcacaac

SEQ ID NO: 7387179 - DNA, 22 bp, Homo sapiens
tccaggattgtcagccagaagg

SEQ ID NO: 7387180 - DNA, 20 bp, Homo sapiens
tccaggcagctcagagtgtc

SEQ ID NO: 7387181 - DNA, 22 bp, Homo sapiens
tccaggagtttgagactgcagt

SEQ ID NO: 7387182 - DNA, 21 bp, Homo sapiens
tccaggagttctaataggtgt

SEQ ID NO: 7387183 - DNA, 22 bp, Homo sapiens
tccaggagtgctggttagagta

SEQ ID NO: 7387184 - DNA, 22 bp, Homo sapiens
tccaggagtgataaggccactg

SEQ ID NO: 7387185 - DNA, 22 bp, Homo sapiens
tccaggagtgataaggccactg

SEQ ID NO: 7387186 - DNA, 22 bp, Homo sapiens
tccaggagtggggcagaggtct

SEQ ID NO: 7387187 - DNA, 22 bp, Homo sapiens
tccaggcatcccccaggacaga

SEQ ID NO: 7387188 - DNA, 22 bp, Homo sapiens
tccaggctctcaggtgtcagca

SEQ ID NO: 7387189 - DNA, 19 bp, Homo sapiens
tccaggctgagagtcagct

SEQ ID NO: 7387190 - DNA, 22 bp, Homo sapiens
tccagtttccaatcactgcacg

SEQ ID NO: 7387191 - DNA, 21 bp, Homo sapiens
tcccacagaaactgcgaaatt

SEQ ID NO: 7387192 - DNA, 21 bp, Homo sapiens
tcccacagaaactgcgaaatt

SEQ ID NO: 7387193 - DNA, 22 bp, Homo sapiens
tcccaatgtggtttctgcaaga

SEQ ID NO: 7387194 - DNA, 22 bp, Homo sapiens
tcccacagcttcgtgcttcccc

SEQ ID NO: 7387195 - DNA, 21 bp, Homo sapiens
tcccacagcgccagctcctgt

SEQ ID NO: 7387196 - DNA, 22 bp, Homo sapiens
tcccacagatgctgtccagagt

SEQ ID NO: 7387197 - DNA, 22 bp, Homo sapiens
tcccagggatcctccgggtcgc

SEQ ID NO: 7387198 - DNA, 22 bp, Homo sapiens
tcccagggactgggctaggctt

SEQ ID NO: 7387199 - DNA, 22 bp, Homo sapiens
tcccacaggtggagcttgcagt

SEQ ID NO: 7387200 - DNA, 22 bp, Homo sapiens
tcccacagggcttctctgtaca

SEQ ID NO: 7387201 - DNA, 22 bp, Homo sapiens
tcccacaggggctctgtgggtt

SEQ ID NO: 7387202 - DNA, 22 bp, Homo sapiens
tcccacaggaaagtagacattg

SEQ ID NO: 7387203 - DNA, 22 bp, Homo sapiens
tcccacaggagcctgagtccca

SEQ ID NO: 7387204 - DNA, 22 bp, Homo sapiens
tcccagggttacagccagggca

SEQ ID NO: 7387205 - DNA, 22 bp, Homo sapiens
tcccagggtgcgcctgccctcg

SEQ ID NO: 7387206 - DNA, 22 bp, Homo sapiens
tcccagggtgcgcctgccctcg

SEQ ID NO: 7387207 - DNA, 22 bp, Homo sapiens
tcccagggttacagccagggca

SEQ ID NO: 7387208 - DNA, 22 bp, Homo sapiens
tcccagggtgaaatgcagtagg

SEQ ID NO: 7387209 - DNA, 22 bp, Homo sapiens
tcccagggattaggacatggat

SEQ ID NO: 7387210 - DNA, 21 bp, Homo sapiens
tcccagggtcttatgggatgt

SEQ ID NO: 7387211 - DNA, 22 bp, Homo sapiens
tcccagggtcctcttctggaat

SEQ ID NO: 7387212 - DNA, 22 bp, Homo sapiens
tcccagggattaggacatggat

SEQ ID NO: 7387213 - DNA, 22 bp, Homo sapiens
tcccagtttttctccactaagg

SEQ ID NO: 7387214 - DNA, 20 bp, Homo sapiens
tccccagggcatcaggagca

SEQ ID NO: 7387215 - DNA, 22 bp, Homo sapiens
tccccaggagttttactttgca

SEQ ID NO: 7387216 - DNA, 22 bp, Homo sapiens
tccccaggagcaatgattcagt

SEQ ID NO: 7387217 - DNA, 22 bp, Homo sapiens
tccccaggagttttactttgca

SEQ ID NO: 7387218 - DNA, 22 bp, Homo sapiens
tccccagggctgcagagggtgt

SEQ ID NO: 7387219 - DNA, 22 bp, Homo sapiens
tccccaggggcatctctctgct

SEQ ID NO: 7387220 - DNA, 22 bp, Homo sapiens
tccccagggctgcagagggtgt

SEQ ID NO: 7387221 - DNA, 20 bp, Homo sapiens
tccccagggcatcaggagca

SEQ ID NO: 7387222 - DNA, 22 bp, Homo sapiens
tccccaggggcctgggcacagt

SEQ ID NO: 7387223 - DNA, 22 bp, Homo sapiens
tccccagggtccctgcttccat

SEQ ID NO: 7387224 - DNA, 22 bp, Homo sapiens
tccccaggggcatctctctgct

SEQ ID NO: 7387225 - DNA, 22 bp, Homo sapiens
tccccaggggcctgggcacagt

SEQ ID NO: 7387226 - DNA, 22 bp, Homo sapiens
tccccaggggcatctctctgct

SEQ ID NO: 7387227 - DNA, 22 bp, Homo sapiens
tccccactcaccactggccaaa

SEQ ID NO: 7387228 - DNA, 22 bp, Homo sapiens
tccccaggaaattctgattctt

SEQ ID NO: 7387229 - DNA, 22 bp, Homo sapiens
tccccaggaaggcccttcctgg

SEQ ID NO: 7387230 - DNA, 22 bp, Homo sapiens
tccccaggactaagttgcaatc

SEQ ID NO: 7387231 - DNA, 22 bp, Homo sapiens
tccccaggaatcaggtggttgc

SEQ ID NO: 7387232 - DNA, 22 bp, Homo sapiens
tccccaggagcaatgattcagt

SEQ ID NO: 7387233 - DNA, 22 bp, Homo sapiens
tccccaggactaagttgcaatc

SEQ ID NO: 7387234 - DNA, 22 bp, Homo sapiens
tccccaggaatcaggtggttgc

SEQ ID NO: 7387235 - DNA, 22 bp, Homo sapiens
tccccaggaaggcccttcctgg

SEQ ID NO: 7387236 - DNA, 22 bp, Homo sapiens
tccccacctaagatacccatct

SEQ ID NO: 7387237 - DNA, 22 bp, Homo sapiens
tccccacacagatacagagtag

SEQ ID NO: 7387238 - DNA, 22 bp, Homo sapiens
tccccacactttcactcctggc

SEQ ID NO: 7387239 - DNA, 22 bp, Homo sapiens
tccccacagcagaagatctgag

SEQ ID NO: 7387240 - DNA, 22 bp, Homo sapiens
tccccacatctctgcatcaggc

SEQ ID NO: 7387241 - DNA, 21 bp, Homo sapiens
tccccacatttctaaacagac

SEQ ID NO: 7387242 - DNA, 22 bp, Homo sapiens
tccccaccccagaactactagg

SEQ ID NO: 7387243 - DNA, 22 bp, Homo sapiens
tcacaattcagaaaccaagtag

SEQ ID NO: 7387244 - DNA, 20 bp, Homo sapiens
tcacaatatgagctcataca

SEQ ID NO: 7387245 - DNA, 22 bp, Homo sapiens
tcacaaaaggccatgtggcttc

SEQ ID NO: 7387246 - DNA, 22 bp, Homo sapiens
tcacaaaggatgatgaattctg

SEQ ID NO: 7387247 - DNA, 22 bp, Homo sapiens
tcacaaaagcttttgaatttgg

SEQ ID NO: 7387248 - DNA, 20 bp, Homo sapiens
tcaattttctacaacatttg

SEQ ID NO: 7387249 - DNA, 22 bp, Homo sapiens
tcacaagatatttcagtccttt

SEQ ID NO: 7387250 - DNA, 22 bp, Homo sapiens
tcacaaggataagccacatata

SEQ ID NO: 7387251 - DNA, 22 bp, Homo sapiens
tcacaaagtgaagtgtgtcatg

SEQ ID NO: 7387252 - DNA, 22 bp, Homo sapiens
tcacaaatagctatattaagga

SEQ ID NO: 7387253 - DNA, 22 bp, Homo sapiens
tcacaggctctccaccatgagg

SEQ ID NO: 7387254 - DNA, 22 bp, Homo sapiens
tcacaggctggtctccgaggac

SEQ ID NO: 7387255 - DNA, 22 bp, Homo sapiens
tcacaggctaaatttatgcagg

SEQ ID NO: 7387256 - DNA, 22 bp, Homo sapiens
tcacaggctccagggcctggat

SEQ ID NO: 7387257 - DNA, 22 bp, Homo sapiens
tcacagggtatctgggatggat

SEQ ID NO: 7387258 - DNA, 22 bp, Homo sapiens
tcacaggtacagctaatgctac

SEQ ID NO: 7387259 - DNA, 22 bp, Homo sapiens
tcacagctattctcatgtattt

SEQ ID NO: 7387260 - DNA, 22 bp, Homo sapiens
tcacaggcccaaaccacgctta

SEQ ID NO: 7387261 - DNA, 22 bp, Homo sapiens
tcaataaaattgttttcctatc

SEQ ID NO: 7387262 - DNA, 22 bp, Homo sapiens
tcaataaatagcttggctcagc

SEQ ID NO: 7387263 - DNA, 22 bp, Homo sapiens
tcaataaatccctctgaccctg

SEQ ID NO: 7387264 - DNA, 22 bp, Homo sapiens
tcaagttcacagtctggtcgct

SEQ ID NO: 7387265 - DNA, 20 bp, Homo sapiens
tcaagttttgcttgacaaga

SEQ ID NO: 7387266 - DNA, 22 bp, Homo sapiens
tcaatttcttggtttgataata

SEQ ID NO: 7387267 - DNA, 22 bp, Homo sapiens
tcaattttatgaaacaaagtga

SEQ ID NO: 7387268 - DNA, 22 bp, Homo sapiens
tcaatttcccctattgatagac

SEQ ID NO: 7387269 - DNA, 22 bp, Homo sapiens
tcaatttctcagaaatggtctt

SEQ ID NO: 7387270 - DNA, 22 bp, Homo sapiens
tcaatttcattctattagttaa

SEQ ID NO: 7387271 - DNA, 22 bp, Homo sapiens
tcaatttcaacagctgataaga

SEQ ID NO: 7387272 - DNA, 22 bp, Homo sapiens
tcaatttcaacagctgataaga

SEQ ID NO: 7387273 - DNA, 22 bp, Homo sapiens
tcaatacacatgccgctgttct

SEQ ID NO: 7387274 - DNA, 17 bp, Homo sapiens
tcaatacactgctttta

SEQ ID NO: 7387275 - DNA, 22 bp, Homo sapiens
tcaaggcatacatttagaagag

SEQ ID NO: 7387276 - DNA, 20 bp, Homo sapiens
tcaaggccacactgccgtgc

SEQ ID NO: 7387277 - DNA, 22 bp, Homo sapiens
tcaaggcacttcatgtctcagt

SEQ ID NO: 7387278 - DNA, 22 bp, Homo sapiens
tcaaggcacttcatgtctcagt

SEQ ID NO: 7387279 - DNA, 22 bp, Homo sapiens
tcaaggcacttcatgtctcagt

SEQ ID NO: 7387280 - DNA, 22 bp, Homo sapiens
tcaaggcaaagtaaatattcaa

SEQ ID NO: 7387281 - DNA, 22 bp, Homo sapiens
tcaaggcaaagtaaatattcaa

SEQ ID NO: 7387282 - DNA, 22 bp, Homo sapiens
tcaagataccaccattatatgt

SEQ ID NO: 7387283 - DNA, 22 bp, Homo sapiens
tcaagataccaccattatatgt

SEQ ID NO: 7387284 - DNA, 22 bp, Homo sapiens
tcaagataagtcagtatatcaa

SEQ ID NO: 7387285 - DNA, 22 bp, Homo sapiens
tcaagcttgtcataaacagctc

SEQ ID NO: 7387286 - DNA, 22 bp, Homo sapiens
tcaagacagtgtgatactggcc

SEQ ID NO: 7387287 - DNA, 18 bp, Homo sapiens
tcaagacatcatgaaata

SEQ ID NO: 7387288 - DNA, 20 bp, Homo sapiens
tcaagacagacatggagttt

SEQ ID NO: 7387289 - DNA, 22 bp, Homo sapiens
tatttcttgagtggtcagtttc

SEQ ID NO: 7387290 - DNA, 22 bp, Homo sapiens
tatttcttgagactcgtcttcc

SEQ ID NO: 7387291 - DNA, 22 bp, Homo sapiens
tatttcttcgggattcaagcta

SEQ ID NO: 7387292 - DNA, 22 bp, Homo sapiens
tatttctgggagttcagaaatt

SEQ ID NO: 7387293 - DNA, 22 bp, Homo sapiens
tatttctgtcagccagatatgg

SEQ ID NO: 7387294 - DNA, 22 bp, Homo sapiens
tatttctgtatgcataaaagga

SEQ ID NO: 7387295 - DNA, 20 bp, Homo sapiens
tatttctgggcaaccattta

SEQ ID NO: 7387296 - DNA, 22 bp, Homo sapiens
tatttctgtatgcataaaagga

SEQ ID NO: 7387297 - DNA, 22 bp, Homo sapiens
tcagagcactggtgctaccttg

SEQ ID NO: 7387298 - DNA, 22 bp, Homo sapiens
tcagagccaatcatggtgcatt

SEQ ID NO: 7387299 - DNA, 22 bp, Homo sapiens
tcagagcttcacctgttacatt

SEQ ID NO: 7387300 - DNA, 22 bp, Homo sapiens
tcagagccctgctcctccccaa

SEQ ID NO: 7387301 - DNA, 22 bp, Homo sapiens
tcagcaagtggaccatcctggg

SEQ ID NO: 7387302 - DNA, 22 bp, Homo sapiens
tcagaggaactggactaaagcc

SEQ ID NO: 7387303 - DNA, 22 bp, Homo sapiens
tcagaggaacactgtttcatgc

SEQ ID NO: 7387304 - DNA, 22 bp, Homo sapiens
tcagaggaaagggaacatagtc

SEQ ID NO: 7387305 - DNA, 22 bp, Homo sapiens
tcagaaaagaccacattattct

SEQ ID NO: 7387306 - DNA, 22 bp, Homo sapiens
tcacttttgatccctatgcagt

SEQ ID NO: 7387307 - DNA, 22 bp, Homo sapiens
tcacattttctactactgtacg

SEQ ID NO: 7387308 - DNA, 22 bp, Homo sapiens
tcacattttctactactgtacg

SEQ ID NO: 7387309 - DNA, 22 bp, Homo sapiens
tcaccagacgcgtgggtctgag

SEQ ID NO: 7387310 - DNA, 22 bp, Homo sapiens
tcaccagacagttactgcatgt

SEQ ID NO: 7387311 - DNA, 23 bp, Homo sapiens
tcaccagaaggggtcaataaaga

SEQ ID NO: 7387312 - DNA, 22 bp, Homo sapiens
tcacattttttactggacttaa

SEQ ID NO: 7387313 - DNA, 22 bp, Homo sapiens
tcaccaaggcattttcacagca

SEQ ID NO: 7387314 - DNA, 22 bp, Homo sapiens
tcaccagatgatttttcttcag

SEQ ID NO: 7387315 - DNA, 22 bp, Homo sapiens
tcaccagatctctctgtaatgg

SEQ ID NO: 7387316 - DNA, 22 bp, Homo sapiens
tcaccaggattcctatcagtag

SEQ ID NO: 7387317 - DNA, 22 bp, Homo sapiens
tcaccaggcaactatgtactcc

SEQ ID NO: 7387318 - DNA, 22 bp, Homo sapiens
tcaccaggctagagtgcagtgg

SEQ ID NO: 7387319 - DNA, 22 bp, Homo sapiens
tcaccaggattgggctgtaggc

SEQ ID NO: 7387320 - DNA, 22 bp, Homo sapiens
tcacccaggctggagtgcagtg

SEQ ID NO: 7387321 - DNA, 22 bp, Homo sapiens
tcactttagaggaaacattgag

SEQ ID NO: 7387322 - DNA, 20 bp, Homo sapiens
tcacttcttccttttgtcta

SEQ ID NO: 7387323 - DNA, 22 bp, Homo sapiens
tcactgaaacctccacctctcg

SEQ ID NO: 7387324 - DNA, 22 bp, Homo sapiens
tcactgaaagaatgacattatg

SEQ ID NO: 7387325 - DNA, 22 bp, Homo sapiens
tcactgaaagtaattctagtga

SEQ ID NO: 7387326 - DNA, 22 bp, Homo sapiens
tcactgaaccagggatctctag

SEQ ID NO: 7387327 - DNA, 22 bp, Homo sapiens
tcactgaatttcaagctagtgg

SEQ ID NO: 7387328 - DNA, 22 bp, Homo sapiens
tcactgaatacttgtctcatcc

SEQ ID NO: 7387329 - DNA, 22 bp, Homo sapiens
tcactgaagtcttcaagtagga

SEQ ID NO: 7387330 - DNA, 22 bp, Homo sapiens
tcactgaaggaagacactgtca

SEQ ID NO: 7387331 - DNA, 21 bp, Homo sapiens
tcagggaagtgtgcagaaggg

SEQ ID NO: 7387332 - DNA, 22 bp, Homo sapiens
tcagggaataagtagatgagtg

SEQ ID NO: 7387333 - DNA, 22 bp, Homo sapiens
tcagggaatcagactctgcagc

SEQ ID NO: 7387334 - DNA, 22 bp, Homo sapiens
tcagggaagaaatgggacttta

SEQ ID NO: 7387335 - DNA, 17 bp, Homo sapiens
tcagggaatgaggttgt

SEQ ID NO: 7387336 - DNA, 22 bp, Homo sapiens
tcaggttctggtgagggccctt

SEQ ID NO: 7387337 - DNA, 22 bp, Homo sapiens
tcagtctttcgaattcagccag

SEQ ID NO: 7387338 - DNA, 22 bp, Homo sapiens
tcagtgaaatgcatattcttcg

SEQ ID NO: 7387339 - DNA, 22 bp, Homo sapiens
tcagtgaaatgcatattcttcg

SEQ ID NO: 7387340 - DNA, 21 bp, Homo sapiens
tcagtgcaattctatggggaa

SEQ ID NO: 7387341 - DNA, 20 bp, Homo sapiens
tcagtgcagattgtccaagt

SEQ ID NO: 7387342 - DNA, 20 bp, Homo sapiens
tcagtgtcagtagccactac

SEQ ID NO: 7387343 - DNA, 22 bp, Homo sapiens
tcagtgtatggagtgctggatt

SEQ ID NO: 7387344 - DNA, 22 bp, Homo sapiens
tcagtgtagggcagacccctgg

SEQ ID NO: 7387345 - DNA, 20 bp, Homo sapiens
tcagtgtatcctcagtggct

SEQ ID NO: 7387346 - DNA, 21 bp, Homo sapiens
tcagtgtatttaagaatgttg

SEQ ID NO: 7387347 - DNA, 22 bp, Homo sapiens
tcagtgtaagttatgtagatgt

SEQ ID NO: 7387348 - DNA, 22 bp, Homo sapiens
tcagtgtaagtttttggatagg

SEQ ID NO: 7387349 - DNA, 18 bp, Homo sapiens
tcagtgtagatctgtgta

SEQ ID NO: 7387350 - DNA, 22 bp, Homo sapiens
tcagtgtagcagacttgtagcc

SEQ ID NO: 7387351 - DNA, 22 bp, Homo sapiens
tcagtggttaagttctgtccac

SEQ ID NO: 7387352 - DNA, 22 bp, Homo sapiens
tcagtgttacattatatagaac

SEQ ID NO: 7387353 - DNA, 22 bp, Homo sapiens
tcagtgtctagggacagtaatc

SEQ ID NO: 7387354 - DNA, 18 bp, Homo sapiens
tcattagggattgcaaag

SEQ ID NO: 7387355 - DNA, 22 bp, Homo sapiens
tcattattctctttaatgttct

SEQ ID NO: 7387356 - DNA, 22 bp, Homo sapiens
tcattcaagatttcaatagatt

SEQ ID NO: 7387357 - DNA, 21 bp, Homo sapiens
tcattcacagggtattgtata

SEQ ID NO: 7387358 - DNA, 23 bp, Homo sapiens
tcatggaactgggcaatcttgaa

SEQ ID NO: 7387359 - DNA, 23 bp, Homo sapiens
tcatggaactgggcaatcttgaa

SEQ ID NO: 7387360 - DNA, 22 bp, Homo sapiens
tcatggaaacagcaatgctaat

SEQ ID NO: 7387361 - DNA, 22 bp, Homo sapiens
tcatgctttgttaatgtggcac

SEQ ID NO: 7387362 - DNA, 22 bp, Homo sapiens
tcatgcttattgcatatttgga

SEQ ID NO: 7387363 - DNA, 22 bp, Homo sapiens
tcatgcttaaaagacacttgag

SEQ ID NO: 7387364 - DNA, 22 bp, Homo sapiens
tcatgcttaaaagacacttgag

SEQ ID NO: 7387365 - DNA, 21 bp, Homo sapiens
tcatatttctcttgctattgt

SEQ ID NO: 7387366 - DNA, 22 bp, Homo sapiens
tcatatttagttcacgctcaat

SEQ ID NO: 7387367 - DNA, 22 bp, Homo sapiens
tcatatttaggcctttaattca

SEQ ID NO: 7387368 - DNA, 22 bp, Homo sapiens
tcatatttaggcctttaattca

SEQ ID NO: 7387369 - DNA, 21 bp, Homo sapiens
tcatatttctcttgctattgt

SEQ ID NO: 7387370 - DNA, 22 bp, Homo sapiens
tcatatattttggcagtgatca

SEQ ID NO: 7387371 - DNA, 22 bp, Homo sapiens
tcatatgattgtaatgagaata

SEQ ID NO: 7387372 - DNA, 18 bp, Homo sapiens
tcatagattcaagagtat

SEQ ID NO: 7387373 - DNA, 22 bp, Homo sapiens
tcatataactggatattttcaa

SEQ ID NO: 7387374 - DNA, 22 bp, Homo sapiens
tcatataagtttaaaactatct

SEQ ID NO: 7387375 - DNA, 22 bp, Homo sapiens
tcagctcatctgagtgtcagcg

SEQ ID NO: 7387376 - DNA, 17 bp, Homo sapiens
tcagctcagagcacctg

SEQ ID NO: 7387377 - DNA, 22 bp, Homo sapiens
tcagcctttgaagggctgcagg

SEQ ID NO: 7387378 - DNA, 22 bp, Homo sapiens
tcagccttgtggccctgctcca

SEQ ID NO: 7387379 - DNA, 22 bp, Homo sapiens
tcagcctttatctttctcccat

SEQ ID NO: 7387380 - DNA, 22 bp, Homo sapiens
tcagccttgcttctggactggt

SEQ ID NO: 7387381 - DNA, 20 bp, Homo sapiens
tcagccttgaatgcttgaaa

SEQ ID NO: 7387382 - DNA, 20 bp, Homo sapiens
tcagccttctcatcctgggg

SEQ ID NO: 7387383 - DNA, 22 bp, Homo sapiens
tcagccttctgaggacctggga

SEQ ID NO: 7387384 - DNA, 18 bp, Homo sapiens
tcagcctgttgtctgcct

SEQ ID NO: 7387385 - DNA, 20 bp, Homo sapiens
tcagccttctcatcctgggg

SEQ ID NO: 7387386 - DNA, 22 bp, Homo sapiens
tcagctctaagttttatgcaaa

SEQ ID NO: 7387387 - DNA, 21 bp, Homo sapiens
tcagcaggcaccagaaggctg

SEQ ID NO: 7387388 - DNA, 22 bp, Homo sapiens
tcagcaggcacggacaggctgc

SEQ ID NO: 7387389 - DNA, 21 bp, Homo sapiens
tcagcagcttttgcagtccct

SEQ ID NO: 7387390 - DNA, 22 bp, Homo sapiens
tcagcagaaaggcactagatga

SEQ ID NO: 7387391 - DNA, 22 bp, Homo sapiens
tcagcagaacaaggaagcttaa

SEQ ID NO: 7387392 - DNA, 21 bp, Homo sapiens
tcagcagaaggaccactaggg

SEQ ID NO: 7387393 - DNA, 21 bp, Homo sapiens
tcagcagaaagcaaggtcagt

SEQ ID NO: 7387394 - DNA, 22 bp, Homo sapiens
tcaggaagccggttaaatagat

SEQ ID NO: 7387395 - DNA, 22 bp, Homo sapiens
tcaggaagcatcctgaggtgtc

SEQ ID NO: 7387396 - DNA, 22 bp, Homo sapiens
tcaggaagggctcagtctgtgc

SEQ ID NO: 7387397 - DNA, 22 bp, Homo sapiens
tcaggaaggcacttggtgtgtt

SEQ ID NO: 7387398 - DNA, 22 bp, Homo sapiens
tcaggaagctgctctgggtggt

SEQ ID NO: 7387399 - DNA, 22 bp, Homo sapiens
tcaggaggtttggattcagtta

SEQ ID NO: 7387400 - DNA, 22 bp, Homo sapiens
tcaggaggttgaccacggggca

SEQ ID NO: 7387401 - DNA, 17 bp, Homo sapiens
tcaggaggtgtttctag

SEQ ID NO: 7387402 - DNA, 22 bp, Homo sapiens
tcaggaggtgtaggtcaagtga

SEQ ID NO: 7387403 - DNA, 22 bp, Homo sapiens
tcaggccttcagacctggcccg

SEQ ID NO: 7387404 - DNA, 22 bp, Homo sapiens
tcaggccttcagacctggcccg

SEQ ID NO: 7387405 - DNA, 22 bp, Homo sapiens
tcaggcctggagaaaggaatga

SEQ ID NO: 7387406 - DNA, 22 bp, Homo sapiens
tcagggaaaagtcacactgggt

SEQ ID NO: 7387407 - DNA, 22 bp, Homo sapiens
tcagggaaaggggagagtcatt

SEQ ID NO: 7387408 - DNA, 22 bp, Homo sapiens
tcagggaaattcaagggagatt

SEQ ID NO: 7387409 - DNA, 22 bp, Homo sapiens
tcagggaaatagcagggctgaa

SEQ ID NO: 7387410 - DNA, 19 bp, Homo sapiens
tcaggcagttattcacaaa

SEQ ID NO: 7387411 - DNA, 22 bp, Homo sapiens
tcaggcagtggtaaatgagtta

SEQ ID NO: 7387412 - DNA, 22 bp, Homo sapiens
tcaggcagtggtaaatgagtta

SEQ ID NO: 7387413 - DNA, 22 bp, Homo sapiens
tcaggccaaggtagacatgact

SEQ ID NO: 7387414 - DNA, 22 bp, Homo sapiens
tcaggccaaagaaacagcatga

SEQ ID NO: 7387415 - DNA, 22 bp, Homo sapiens
tcaggccacggctcactgagac

SEQ ID NO: 7387416 - DNA, 22 bp, Homo sapiens
tcaggcctgcaaatgaatggta

SEQ ID NO: 7387417 - DNA, 22 bp, Homo sapiens
tcaggcctgcaggcttcctgga

SEQ ID NO: 7387418 - DNA, 22 bp, Homo sapiens
tcaggcctgcaggcttcctgga

SEQ ID NO: 7387419 - DNA, 22 bp, Homo sapiens
tcaggatgaagtcagaggggtc

SEQ ID NO: 7387420 - DNA, 22 bp, Homo sapiens
tcaggatgacttcaaggaggaa

SEQ ID NO: 7387421 - DNA, 22 bp, Homo sapiens
tcaggatgaccacgagcctcta

SEQ ID NO: 7387422 - DNA, 22 bp, Homo sapiens
tcaggatgaccacgagcctcta

SEQ ID NO: 7387423 - DNA, 22 bp, Homo sapiens
tcaggatggtgtggaggaaata

SEQ ID NO: 7387424 - DNA, 22 bp, Homo sapiens
tcaggatggcacccaagctctt

SEQ ID NO: 7387425 - DNA, 22 bp, Homo sapiens
tcaggatgagtcatcaagctgc

SEQ ID NO: 7387426 - DNA, 22 bp, Homo sapiens
tcaggatgagctcataactatg

SEQ ID NO: 7387427 - DNA, 22 bp, Homo sapiens
tcaggatggagtctatccagtg

SEQ ID NO: 7387428 - DNA, 22 bp, Homo sapiens
tcaggatggagggaagcacaga

SEQ ID NO: 7387429 - DNA, 20 bp, Homo sapiens
tcaggcagtggggaaaggca

SEQ ID NO: 7387430 - DNA, 20 bp, Homo sapiens
tcaggatgtgctgagtgaag

SEQ ID NO: 7387431 - DNA, 22 bp, Homo sapiens
tcaggatgttaatatagcatta

SEQ ID NO: 7387432 - DNA, 22 bp, Homo sapiens
taggcactagacatggttacca

SEQ ID NO: 7387433 - DNA, 22 bp, Homo sapiens
taggcacaagaccatgcaaagg

SEQ ID NO: 7387434 - DNA, 22 bp, Homo sapiens
taggcactgagtacatattggt

SEQ ID NO: 7387435 - DNA, 22 bp, Homo sapiens
tagggacactgctcatgagttc

SEQ ID NO: 7387436 - DNA, 22 bp, Homo sapiens
tagggagaggaagcaggccgct

SEQ ID NO: 7387437 - DNA, 22 bp, Homo sapiens
tagggagatgcaagggacggag

SEQ ID NO: 7387438 - DNA, 22 bp, Homo sapiens
tagggaggctacttcttgtagg

SEQ ID NO: 7387439 - DNA, 22 bp, Homo sapiens
tagggaggagggttttcaaatc

SEQ ID NO: 7387440 - DNA, 22 bp, Homo sapiens
tagggagctctggcagaaggaa

SEQ ID NO: 7387441 - DNA, 22 bp, Homo sapiens
tagggagcagccctgccactcc

SEQ ID NO: 7387442 - DNA, 22 bp, Homo sapiens
tagctttgtttatcaaggggca

SEQ ID NO: 7387443 - DNA, 22 bp, Homo sapiens
tagcttttaagtcataacctca

SEQ ID NO: 7387444 - DNA, 22 bp, Homo sapiens
tagctttgttagaatgtcttca

SEQ ID NO: 7387445 - DNA, 16 bp, Homo sapiens
tagctttgtgttgtgg

SEQ ID NO: 7387446 - DNA, 22 bp, Homo sapiens
tagctttgtgtcctgatttagc

SEQ ID NO: 7387447 - DNA, 22 bp, Homo sapiens
tagctttgtgtatgatgtctgt

SEQ ID NO: 7387448 - DNA, 22 bp, Homo sapiens
tagctttgtgaagtttacagac

SEQ ID NO: 7387449 - DNA, 22 bp, Homo sapiens
tagctttgtcctccaccctcag

SEQ ID NO: 7387450 - DNA, 22 bp, Homo sapiens
tagctttgtattatcagcattg

SEQ ID NO: 7387451 - DNA, 22 bp, Homo sapiens
tagctttagtgaaaaatatcag

SEQ ID NO: 7387452 - DNA, 22 bp, Homo sapiens
tagctttagaaatattctcaga

SEQ ID NO: 7387453 - DNA, 22 bp, Homo sapiens
tagctttgggaatgctctcctg

SEQ ID NO: 7387454 - DNA, 22 bp, Homo sapiens
tagctttggattctttggggaa

SEQ ID NO: 7387455 - DNA, 22 bp, Homo sapiens
tagctttgctggcaagcatgtc

SEQ ID NO: 7387456 - DNA, 22 bp, Homo sapiens
tagctttgcctgttaatcacaa

SEQ ID NO: 7387457 - DNA, 22 bp, Homo sapiens
tagctttgcctgaagtaatcag

SEQ ID NO: 7387458 - DNA, 22 bp, Homo sapiens
tagctttgcccgtgctggattt

SEQ ID NO: 7387459 - DNA, 22 bp, Homo sapiens
tagctttgccatctgtcacata

SEQ ID NO: 7387460 - DNA, 22 bp, Homo sapiens
tagctttgccacacatgtagat

SEQ ID NO: 7387461 - DNA, 22 bp, Homo sapiens
tagctttgcaaaggaagtttta

SEQ ID NO: 7387462 - DNA, 22 bp, Homo sapiens
tagctttgaccaacgactggtc

SEQ ID NO: 7387463 - DNA, 22 bp, Homo sapiens
tagctttgacagttgcaggcag

SEQ ID NO: 7387464 - DNA, 22 bp, Homo sapiens
tagctttgaagttatttaacag

SEQ ID NO: 7387465 - DNA, 22 bp, Homo sapiens
tagctttgaacttctgggctca

SEQ ID NO: 7387466 - DNA, 22 bp, Homo sapiens
taggatgaaaagtgttctttga

SEQ ID NO: 7387467 - DNA, 22 bp, Homo sapiens
taggatgaaaatccagcttata

SEQ ID NO: 7387468 - DNA, 22 bp, Homo sapiens
taggatgatcttgtagagagat

SEQ ID NO: 7387469 - DNA, 22 bp, Homo sapiens
taggatgaggggtggccaagta

SEQ ID NO: 7387470 - DNA, 22 bp, Homo sapiens
taggatggtacaaggcaggggt

SEQ ID NO: 7387471 - DNA, 21 bp, Homo sapiens
taggatgaaagtgagtgagaa

SEQ ID NO: 7387472 - DNA, 20 bp, Homo sapiens
taggatgaaagtggtttctg

SEQ ID NO: 7387473 - DNA, 22 bp, Homo sapiens
taggatgaagtagttatacagc

SEQ ID NO: 7387474 - DNA, 22 bp, Homo sapiens
taggatgacacagcaagtatag

SEQ ID NO: 7387475 - DNA, 22 bp, Homo sapiens
taggatgacaccaccaagacct

SEQ ID NO: 7387476 - DNA, 22 bp, Homo sapiens
taggatgactgatagtgattcc

SEQ ID NO: 7387477 - DNA, 22 bp, Homo sapiens
taggacataagtattctaactt

SEQ ID NO: 7387478 - DNA, 22 bp, Homo sapiens
taggaaacatttgaagaggatt

SEQ ID NO: 7387479 - DNA, 22 bp, Homo sapiens
taggaaaatatctcttattggg

SEQ ID NO: 7387480 - DNA, 22 bp, Homo sapiens
tagcagaaccagtcagtgagcc

SEQ ID NO: 7387481 - DNA, 22 bp, Homo sapiens
tagcagaagaaattcagagttg

SEQ ID NO: 7387482 - DNA, 22 bp, Homo sapiens
tagcagaagttgcaaactaggg

SEQ ID NO: 7387483 - DNA, 22 bp, Homo sapiens
tagcagaagtcaccccgccact

SEQ ID NO: 7387484 - DNA, 21 bp, Homo sapiens
tagcagagagttaacttctcc

SEQ ID NO: 7387485 - DNA, 22 bp, Homo sapiens
tagcagagaggtttcagctaat

SEQ ID NO: 7387486 - DNA, 22 bp, Homo sapiens
tagcagagaggggacagtggca

SEQ ID NO: 7387487 - DNA, 22 bp, Homo sapiens
tagcagaggaaaagagaacatt

SEQ ID NO: 7387488 - DNA, 22 bp, Homo sapiens
tagcagaggaaatccagagtaa

SEQ ID NO: 7387489 - DNA, 22 bp, Homo sapiens
tagcagagctgggactagatta

SEQ ID NO: 7387490 - DNA, 22 bp, Homo sapiens
tagcagaggaaaagagaacatt

SEQ ID NO: 7387491 - DNA, 22 bp, Homo sapiens
tagcagaggctgtctgacttaa

SEQ ID NO: 7387492 - DNA, 22 bp, Homo sapiens
tagcagaggcaaggatgtgaat

SEQ ID NO: 7387493 - DNA, 22 bp, Homo sapiens
tagcagaggctactgctccttg

SEQ ID NO: 7387494 - DNA, 22 bp, Homo sapiens
tagcagagcagggatcagagcc

SEQ ID NO: 7387495 - DNA, 22 bp, Homo sapiens
tagcagagcagggatcagagcc

SEQ ID NO: 7387496 - DNA, 22 bp, Homo sapiens
tagcagagcgggtgcgaggcgg

SEQ ID NO: 7387497 - DNA, 22 bp, Homo sapiens
tagcagagctgcaatatagacc

SEQ ID NO: 7387498 - DNA, 22 bp, Homo sapiens
tagcagagcacatcttcattct

SEQ ID NO: 7387499 - DNA, 19 bp, Homo sapiens
tagcagagatgactccagc

SEQ ID NO: 7387500 - DNA, 19 bp, Homo sapiens
tagcagagatgactccagc

SEQ ID NO: 7387501 - DNA, 21 bp, Homo sapiens
tagcagagatcattttctcct

SEQ ID NO: 7387502 - DNA, 22 bp, Homo sapiens
tagcagagatatgggcatagat

SEQ ID NO: 7387503 - DNA, 19 bp, Homo sapiens
tagcagagatgactccagc

SEQ ID NO: 7387504 - DNA, 22 bp, Homo sapiens
tagcagagggtagtgccggggc

SEQ ID NO: 7387505 - DNA, 22 bp, Homo sapiens
tagcagaggtaagtgtggcaat

SEQ ID NO: 7387506 - DNA, 22 bp, Homo sapiens
tagcagagtagtgcctccagat

SEQ ID NO: 7387507 - DNA, 22 bp, Homo sapiens
tagcagagtaatactttggagc

SEQ ID NO: 7387508 - DNA, 22 bp, Homo sapiens
tagcagagtgattggccatgag

SEQ ID NO: 7387509 - DNA, 22 bp, Homo sapiens
tagcagagtatcttgcaaatta

SEQ ID NO: 7387510 - DNA, 22 bp, Homo sapiens
tagctgaatgtgaccttaaaga

SEQ ID NO: 7387511 - DNA, 22 bp, Homo sapiens
tagccttttgggaagggctatt

SEQ ID NO: 7387512 - DNA, 22 bp, Homo sapiens
tagaaacagaatatgagtgaga

SEQ ID NO: 7387513 - DNA, 22 bp, Homo sapiens
tagaaacaatgacatgcttgta

SEQ ID NO: 7387514 - DNA, 22 bp, Homo sapiens
tagaaacaatgacatgcttgta

SEQ ID NO: 7387515 - DNA, 22 bp, Homo sapiens
tagaaacaagtttctctttggg

SEQ ID NO: 7387516 - DNA, 22 bp, Homo sapiens
tagaaacatataggatggcagg

SEQ ID NO: 7387517 - DNA, 22 bp, Homo sapiens
tagaaacagatgtttttgaaga

SEQ ID NO: 7387518 - DNA, 22 bp, Homo sapiens
tagaaacattcagttgcagtcc

SEQ ID NO: 7387519 - DNA, 22 bp, Homo sapiens
tagaaacattcagttgcagtcc

SEQ ID NO: 7387520 - DNA, 22 bp, Homo sapiens
tagaaacatatgtttgagacat

SEQ ID NO: 7387521 - DNA, 22 bp, Homo sapiens
tagaaacatatgtttgagacat

SEQ ID NO: 7387522 - DNA, 22 bp, Homo sapiens
tagaaacatcagctaaccaaaa

SEQ ID NO: 7387523 - DNA, 22 bp, Homo sapiens
tagaaactcacgttatcattgc

SEQ ID NO: 7387524 - DNA, 22 bp, Homo sapiens
tagaaacattcagttgcagtcc

SEQ ID NO: 7387525 - DNA, 22 bp, Homo sapiens
tagaaacccaggatttgtattt

SEQ ID NO: 7387526 - DNA, 22 bp, Homo sapiens
tactttggggacaatatggaat

SEQ ID NO: 7387527 - DNA, 22 bp, Homo sapiens
tactttgcagcttgataaaatg

SEQ ID NO: 7387528 - DNA, 22 bp, Homo sapiens
tactttgtggagattaaaaata

SEQ ID NO: 7387529 - DNA, 22 bp, Homo sapiens
tacattttctaggggaccaaga

SEQ ID NO: 7387530 - DNA, 22 bp, Homo sapiens
tacattttctaggggaccaaga

SEQ ID NO: 7387531 - DNA, 22 bp, Homo sapiens
taccaaaagcttgtttcataca

SEQ ID NO: 7387532 - DNA, 22 bp, Homo sapiens
taccaaagatacataaatgtga

SEQ ID NO: 7387533 - DNA, 22 bp, Homo sapiens
taccaaagaatattttaaatag

SEQ ID NO: 7387534 - DNA, 22 bp, Homo sapiens
tagaaaagccccagctggaggg

SEQ ID NO: 7387535 - DNA, 22 bp, Homo sapiens
tactttttagcacagtgtgtgc

SEQ ID NO: 7387536 - DNA, 22 bp, Homo sapiens
tactttttatgataagaactga

SEQ ID NO: 7387537 - DNA, 22 bp, Homo sapiens
tacttttctataggtttgaaat

SEQ ID NO: 7387538 - DNA, 22 bp, Homo sapiens
tagaaatcacaaaccagtagtt

SEQ ID NO: 7387539 - DNA, 22 bp, Homo sapiens
tagaaagtggttgagagtttag

SEQ ID NO: 7387540 - DNA, 22 bp, Homo sapiens
tagaaatgagccatggtagagc

SEQ ID NO: 7387541 - DNA, 22 bp, Homo sapiens
tagaaatgattggttgagctct

SEQ ID NO: 7387542 - DNA, 22 bp, Homo sapiens
tagaaatgcagtgtactgtgtc

SEQ ID NO: 7387543 - DNA, 22 bp, Homo sapiens
tagaaatgcagtgtactgtgtc

SEQ ID NO: 7387544 - DNA, 22 bp, Homo sapiens
tagaaatgcccagattctgcta

SEQ ID NO: 7387545 - DNA, 19 bp, Homo sapiens
tagaaagccagaaaacaga

SEQ ID NO: 7387546 - DNA, 22 bp, Homo sapiens
tagaaagaacttcatgtaaaac

SEQ ID NO: 7387547 - DNA, 22 bp, Homo sapiens
tagaaagcgttaaatctacaga

SEQ ID NO: 7387548 - DNA, 22 bp, Homo sapiens
tagaaaggagcattttagacta

SEQ ID NO: 7387549 - DNA, 22 bp, Homo sapiens
tagaaagtactaaatttaactg

SEQ ID NO: 7387550 - DNA, 21 bp, Homo sapiens
tagaaagtcaaagctatcagc

SEQ ID NO: 7387551 - DNA, 21 bp, Homo sapiens
tagaggcaggagggactgcag

SEQ ID NO: 7387552 - DNA, 21 bp, Homo sapiens
tagaggcaggagggactgcag

SEQ ID NO: 7387553 - DNA, 21 bp, Homo sapiens
tagaggcaggagggactgcag

SEQ ID NO: 7387554 - DNA, 22 bp, Homo sapiens
tagacagatgttttctggctgt

SEQ ID NO: 7387555 - DNA, 22 bp, Homo sapiens
tagaggcagaagaaattgacaa

SEQ ID NO: 7387556 - DNA, 22 bp, Homo sapiens
tagaggcataagagggaagcag

SEQ ID NO: 7387557 - DNA, 22 bp, Homo sapiens
tagaggcataagagggaagcag

SEQ ID NO: 7387558 - DNA, 22 bp, Homo sapiens
tagaggcataagagggaagcag

SEQ ID NO: 7387559 - DNA, 22 bp, Homo sapiens
tagaggcattaatgaataaaca

SEQ ID NO: 7387560 - DNA, 22 bp, Homo sapiens
tagaggcattaatgaataaaca

SEQ ID NO: 7387561 - DNA, 22 bp, Homo sapiens
tagaggcattgcttaatttcag

SEQ ID NO: 7387562 - DNA, 22 bp, Homo sapiens
tagaggcattgcttaatttcag

SEQ ID NO: 7387563 - DNA, 22 bp, Homo sapiens
tagagggaagactgctagattt

SEQ ID NO: 7387564 - DNA, 22 bp, Homo sapiens
tagacaatatttgaaagtagtg

SEQ ID NO: 7387565 - DNA, 22 bp, Homo sapiens
tagacaaactgatacttggcga

SEQ ID NO: 7387566 - DNA, 19 bp, Homo sapiens
tagaatgcccacttaaaaa

SEQ ID NO: 7387567 - DNA, 22 bp, Homo sapiens
tatgtacagtccttaacttaaa

SEQ ID NO: 7387568 - DNA, 22 bp, Homo sapiens
tatgtacataacatgaaatgca

SEQ ID NO: 7387569 - DNA, 22 bp, Homo sapiens
tatgtacaccaaggattgaaaa

SEQ ID NO: 7387570 - DNA, 22 bp, Homo sapiens
tatgtacaagcacacatgtgac

SEQ ID NO: 7387571 - DNA, 22 bp, Homo sapiens
tatgagaatctgcagtatgctt

SEQ ID NO: 7387572 - DNA, 22 bp, Homo sapiens
tatgtctttttctcactatagt

SEQ ID NO: 7387573 - DNA, 22 bp, Homo sapiens
tatgtcttttgcttgcaaatag

SEQ ID NO: 7387574 - DNA, 22 bp, Homo sapiens
tatgtctttagtatcttttgga

SEQ ID NO: 7387575 - DNA, 22 bp, Homo sapiens
tatgtctttagtatcttttgga

SEQ ID NO: 7387576 - DNA, 22 bp, Homo sapiens
tatgtctttagtatcttttgga

SEQ ID NO: 7387577 - DNA, 22 bp, Homo sapiens
tatgtctttattctctgatgcg

SEQ ID NO: 7387578 - DNA, 22 bp, Homo sapiens
tatgtctttgtccatgtgcagt

SEQ ID NO: 7387579 - DNA, 22 bp, Homo sapiens
tatgtctttgtcccactcccag

SEQ ID NO: 7387580 - DNA, 22 bp, Homo sapiens
tatgtcttttccaatgctgtct

SEQ ID NO: 7387581 - DNA, 22 bp, Homo sapiens
tatgtcttaactctagaaaggt

SEQ ID NO: 7387582 - DNA, 22 bp, Homo sapiens
tatgtcttaatccttccttagg

SEQ ID NO: 7387583 - DNA, 22 bp, Homo sapiens
tatgtcttaatccttccttagg

SEQ ID NO: 7387584 - DNA, 22 bp, Homo sapiens
tatgtcttactacagcaattaa

SEQ ID NO: 7387585 - DNA, 22 bp, Homo sapiens
tatgtcttagaacaaaacagtg

SEQ ID NO: 7387586 - DNA, 22 bp, Homo sapiens
tatgtcttcgtcacctatctca

SEQ ID NO: 7387587 - DNA, 22 bp, Homo sapiens
tatgtcttgaaatgagaagcca

SEQ ID NO: 7387588 - DNA, 22 bp, Homo sapiens
tatgtcttccctagcaggcaga

SEQ ID NO: 7387589 - DNA, 22 bp, Homo sapiens
tatgtcttcgtcacctatctca

SEQ ID NO: 7387590 - DNA, 22 bp, Homo sapiens
tatgtcttgtgtttgctaatct

SEQ ID NO: 7387591 - DNA, 22 bp, Homo sapiens
tatgtcttgtgtttgctaatct

SEQ ID NO: 7387592 - DNA, 22 bp, Homo sapiens
tatgtcttgcatttttcaaact

SEQ ID NO: 7387593 - DNA, 22 bp, Homo sapiens
tattacagttcgagtttctagg

SEQ ID NO: 7387594 - DNA, 22 bp, Homo sapiens
tattagaaaggctattgcatag

SEQ ID NO: 7387595 - DNA, 22 bp, Homo sapiens
tattagaaaggctattgcatag

SEQ ID NO: 7387596 - DNA, 22 bp, Homo sapiens
tattagcagttgtatgtgtctg

SEQ ID NO: 7387597 - DNA, 22 bp, Homo sapiens
tatttattggacagtgttgctg

SEQ ID NO: 7387598 - DNA, 22 bp, Homo sapiens
tatttctcagcattttacatcc

SEQ ID NO: 7387599 - DNA, 19 bp, Homo sapiens
tatttcaaagtgccgtcta

SEQ ID NO: 7387600 - DNA, 20 bp, Homo sapiens
tatttacaacttagagcctc

SEQ ID NO: 7387601 - DNA, 22 bp, Homo sapiens
tatttatcgagtgtctactatg

SEQ ID NO: 7387602 - DNA, 22 bp, Homo sapiens
tattattttagcactgaggatt

SEQ ID NO: 7387603 - DNA, 19 bp, Homo sapiens
tattatttgtagcaaggcc

SEQ ID NO: 7387604 - DNA, 22 bp, Homo sapiens
tattattgcaagtatataaagt

SEQ ID NO: 7387605 - DNA, 23 bp, Homo sapiens
tattagggccaggactggcaaat

SEQ ID NO: 7387606 - DNA, 22 bp, Homo sapiens
tattattaaatggcagaatttt

SEQ ID NO: 7387607 - DNA, 22 bp, Homo sapiens
tattcttgtcttttccagaaat

SEQ ID NO: 7387608 - DNA, 22 bp, Homo sapiens
tattcttactctcgactgcatt

SEQ ID NO: 7387609 - DNA, 22 bp, Homo sapiens
tattctctccccaatcttgctt

SEQ ID NO: 7387610 - DNA, 22 bp, Homo sapiens
tatctacagttaatatgtcatc

SEQ ID NO: 7387611 - DNA, 22 bp, Homo sapiens
tatcctactccttcacaccttg

SEQ ID NO: 7387612 - DNA, 22 bp, Homo sapiens
tatccgtgatgtttataaacca

SEQ ID NO: 7387613 - DNA, 22 bp, Homo sapiens
tatctaaatggaatattccaga

SEQ ID NO: 7387614 - DNA, 20 bp, Homo sapiens
tatctaaatgcttacattac

SEQ ID NO: 7387615 - DNA, 22 bp, Homo sapiens
tatgagaactgacagagtgcca

SEQ ID NO: 7387616 - DNA, 22 bp, Homo sapiens
tatgagaaattgctgatatttg

SEQ ID NO: 7387617 - DNA, 22 bp, Homo sapiens
tatgagaaaggagaatgacttt

SEQ ID NO: 7387618 - DNA, 22 bp, Homo sapiens
tatgagaaaataaatatctgtt

SEQ ID NO: 7387619 - DNA, 22 bp, Homo sapiens
tatgacctctcctattgcctta

SEQ ID NO: 7387620 - DNA, 22 bp, Homo sapiens
tatgacattgctttttagaact

SEQ ID NO: 7387621 - DNA, 22 bp, Homo sapiens
tatgacatttctctgatttgtg

SEQ ID NO: 7387622 - DNA, 22 bp, Homo sapiens
tatgacaccattttggtcagtg

SEQ ID NO: 7387623 - DNA, 22 bp, Homo sapiens
tatgacattgctttttagaact

SEQ ID NO: 7387624 - DNA, 22 bp, Homo sapiens
tatccatagtttatagatcaag

SEQ ID NO: 7387625 - DNA, 22 bp, Homo sapiens
tatccatagtttatagatcaag

SEQ ID NO: 7387626 - DNA, 22 bp, Homo sapiens
tatccatggccaatcaaataca

SEQ ID NO: 7387627 - DNA, 22 bp, Homo sapiens
tatcccaggaggccacctgtca

SEQ ID NO: 7387628 - DNA, 22 bp, Homo sapiens
tatccaaagtggcatattatag

SEQ ID NO: 7387629 - DNA, 22 bp, Homo sapiens
tatccaaagtttctcagaaact

SEQ ID NO: 7387630 - DNA, 22 bp, Homo sapiens
tatccaaagtggcatattatag

SEQ ID NO: 7387631 - DNA, 22 bp, Homo sapiens
tatatattcttaagtagtgtag

SEQ ID NO: 7387632 - DNA, 19 bp, Homo sapiens
tatatattttggggttgtg

SEQ ID NO: 7387633 - DNA, 22 bp, Homo sapiens
tatatcatggagattaacattc

SEQ ID NO: 7387634 - DNA, 22 bp, Homo sapiens
tatatctaggaaccctgagatt

SEQ ID NO: 7387635 - DNA, 22 bp, Homo sapiens
tatatcatggagattaacattc

SEQ ID NO: 7387636 - DNA, 22 bp, Homo sapiens
tatatatatgcacacacaccta

SEQ ID NO: 7387637 - DNA, 22 bp, Homo sapiens
tatatatgagcatgtgaggaca

SEQ ID NO: 7387638 - DNA, 22 bp, Homo sapiens
tatagtgtctctagatcaaaga

SEQ ID NO: 7387639 - DNA, 22 bp, Homo sapiens
tatagcagtataacatgtttac

SEQ ID NO: 7387640 - DNA, 22 bp, Homo sapiens
taggtctggcagaagaaaaatg

SEQ ID NO: 7387641 - DNA, 22 bp, Homo sapiens
taggtctctcttcttgatggga

SEQ ID NO: 7387642 - DNA, 21 bp, Homo sapiens
taggtatttctatcatgtctc

SEQ ID NO: 7387643 - DNA, 22 bp, Homo sapiens
taggggtgtttcgagagaggtt

SEQ ID NO: 7387644 - DNA, 22 bp, Homo sapiens
tataaattaatgtgcccatgag

SEQ ID NO: 7387645 - DNA, 22 bp, Homo sapiens
tataaattattaggctgctaaa

SEQ ID NO: 7387646 - DNA, 22 bp, Homo sapiens
tataaatgccaggactttagat

SEQ ID NO: 7387647 - DNA, 22 bp, Homo sapiens
tataaatgccaggactttagat

SEQ ID NO: 7387648 - DNA, 22 bp, Homo sapiens
tataaatgcacttttgaaatat

SEQ ID NO: 7387649 - DNA, 22 bp, Homo sapiens
tataaagtttcgaaagatgtat

SEQ ID NO: 7387650 - DNA, 22 bp, Homo sapiens
tataaagtttcgaaagatgtat

SEQ ID NO: 7387651 - DNA, 22 bp, Homo sapiens
tataaatctttgttcctagaat

SEQ ID NO: 7387652 - DNA, 22 bp, Homo sapiens
tataaatgcacttttgaaatat

SEQ ID NO: 7387653 - DNA, 22 bp, Homo sapiens
tataaatgcacttttgaaatat

SEQ ID NO: 7387654 - DNA, 22 bp, Homo sapiens
tataatttatcatgtcacagtt

SEQ ID NO: 7387655 - DNA, 20 bp, Homo sapiens
tataaattcagagctttggt

SEQ ID NO: 7387656 - DNA, 20 bp, Homo sapiens
tataaattcagagctttggt

SEQ ID NO: 7387657 - DNA, 20 bp, Homo sapiens
tataaattcagagctttggt

SEQ ID NO: 7387658 - DNA, 22 bp, Homo sapiens
tataaattattaggctgctaaa

SEQ ID NO: 7387659 - DNA, 23 bp, Homo sapiens
tatacacatgtggcagtatagtg

SEQ ID NO: 7387660 - DNA, 22 bp, Homo sapiens
tatacaatggctgaatcatcca

SEQ ID NO: 7387661 - DNA, 22 bp, Homo sapiens
tatacaatggctgaatcatcca

SEQ ID NO: 7387662 - DNA, 22 bp, Homo sapiens
tatacaatgagtacattctggg

SEQ ID NO: 7387663 - DNA, 22 bp, Homo sapiens
tatacaatgagtacattctggg

SEQ ID NO: 7387664 - DNA, 22 bp, Homo sapiens
tataatttttctgtggccagtt

SEQ ID NO: 7387665 - DNA, 22 bp, Homo sapiens
tatacaagtaatgctgaatgat

SEQ ID NO: 7387666 - DNA, 22 bp, Homo sapiens
tataatttatcatgtcacagtt

SEQ ID NO: 7387667 - DNA, 22 bp, Homo sapiens
tacagtaagatgaaatagcaat

SEQ ID NO: 7387668 - DNA, 22 bp, Homo sapiens
tacaggcatgaatgaaatctgt

SEQ ID NO: 7387669 - DNA, 22 bp, Homo sapiens
tacaggcatgtagcatggtgat

SEQ ID NO: 7387670 - DNA, 22 bp, Homo sapiens
tacaggcccatagtccctgctt

SEQ ID NO: 7387671 - DNA, 22 bp, Homo sapiens
tacaggagcacaaaagagttga

SEQ ID NO: 7387672 - DNA, 22 bp, Homo sapiens
tacagtaatctggacatgattt

SEQ ID NO: 7387673 - DNA, 22 bp, Homo sapiens
tacatactttttcttgcaagca

SEQ ID NO: 7387674 - DNA, 22 bp, Homo sapiens
tacatagctcctagtgatgcat

SEQ ID NO: 7387675 - DNA, 22 bp, Homo sapiens
tacataggtacagcctttttta

SEQ ID NO: 7387676 - DNA, 22 bp, Homo sapiens
tacatctttgtctatgaccagc

SEQ ID NO: 7387677 - DNA, 22 bp, Homo sapiens
tacatctatctagatgctcaga

SEQ ID NO: 7387678 - DNA, 18 bp, Homo sapiens
tacatctatatagtgttt

SEQ ID NO: 7387679 - DNA, 22 bp, Homo sapiens
tacatcattttggagatgagca

SEQ ID NO: 7387680 - DNA, 22 bp, Homo sapiens
tacattctcttcccattgtctc

SEQ ID NO: 7387681 - DNA, 22 bp, Homo sapiens
tacattctggaaaggcacagac

SEQ ID NO: 7387682 - DNA, 16 bp, Homo sapiens
tacattctgatcactg

SEQ ID NO: 7387683 - DNA, 22 bp, Homo sapiens
tacattctgaaataaatggttt

SEQ ID NO: 7387684 - DNA, 22 bp, Homo sapiens
tacattctactttttcactccc

SEQ ID NO: 7387685 - DNA, 22 bp, Homo sapiens
tacattctatatctgttacatc

SEQ ID NO: 7387686 - DNA, 23 bp, Homo sapiens
tacattctgtatttttatagagt

SEQ ID NO: 7387687 - DNA, 22 bp, Homo sapiens
tacattctggtggagaaagtaa

SEQ ID NO: 7387688 - DNA, 22 bp, Homo sapiens
tacattctggtggagaaagtaa

SEQ ID NO: 7387689 - DNA, 22 bp, Homo sapiens
tacatttcctgtcagagatata

SEQ ID NO: 7387690 - DNA, 22 bp, Homo sapiens
tacatttggatgtgcttaagtg

SEQ ID NO: 7387691 - DNA, 20 bp, Homo sapiens
tacaacaagtagagacatac

SEQ ID NO: 7387692 - DNA, 22 bp, Homo sapiens
tacaacagacctagatgaatga

SEQ ID NO: 7387693 - DNA, 22 bp, Homo sapiens
tacaacaggaatttcaactttg

SEQ ID NO: 7387694 - DNA, 22 bp, Homo sapiens
tacaacagacaggaataagatt

SEQ ID NO: 7387695 - DNA, 22 bp, Homo sapiens
tacaaagtcccattgccatgga

SEQ ID NO: 7387696 - DNA, 20 bp, Homo sapiens
tacagaaacaggacttttgg

SEQ ID NO: 7387697 - DNA, 22 bp, Homo sapiens
tacactgagcaggaagaagtgg

SEQ ID NO: 7387698 - DNA, 22 bp, Homo sapiens
tacaacagtaatcaaggttttt

SEQ ID NO: 7387699 - DNA, 22 bp, Homo sapiens
tacaacataacgggcattcagt

SEQ ID NO: 7387700 - DNA, 21 bp, Homo sapiens
tacactcatcctctcccaagg

SEQ ID NO: 7387701 - DNA, 22 bp, Homo sapiens
tacactgaaagagaggattgaa

SEQ ID NO: 7387702 - DNA, 22 bp, Homo sapiens
tacactgaagtgtcttggtata

SEQ ID NO: 7387703 - DNA, 22 bp, Homo sapiens
tacagaagcttttgaaaagatg

SEQ ID NO: 7387704 - DNA, 22 bp, Homo sapiens
tacagagtatttttaatatggt

SEQ ID NO: 7387705 - DNA, 22 bp, Homo sapiens
tacagcaatgcctgaaatagta

SEQ ID NO: 7387706 - DNA, 22 bp, Homo sapiens
tacagattttgtgaagaagtgt

SEQ ID NO: 7387707 - DNA, 22 bp, Homo sapiens
tacagattttgtgaagaagtgt

SEQ ID NO: 7387708 - DNA, 22 bp, Homo sapiens
tacagattgaggtttttaatat

SEQ ID NO: 7387709 - DNA, 22 bp, Homo sapiens
tacagatttggggagtaaagtt

SEQ ID NO: 7387710 - DNA, 22 bp, Homo sapiens
taagggaacagcttcaaactca

SEQ ID NO: 7387711 - DNA, 22 bp, Homo sapiens
taagggttcagaatgcagtggt

SEQ ID NO: 7387712 - DNA, 22 bp, Homo sapiens
taaggcttcagcattcaaaaca

SEQ ID NO: 7387713 - DNA, 22 bp, Homo sapiens
taaggcccgtgagtttcatatc

SEQ ID NO: 7387714 - DNA, 19 bp, Homo sapiens
taaggccaaaagtaagtgt

SEQ ID NO: 7387715 - DNA, 22 bp, Homo sapiens
taaggccaaactattatagttc

SEQ ID NO: 7387716 - DNA, 22 bp, Homo sapiens
taatacctggccttgatacagt

SEQ ID NO: 7387717 - DNA, 22 bp, Homo sapiens
taatacctagagatgatacaaa

SEQ ID NO: 7387718 - DNA, 22 bp, Homo sapiens
taatacatgtattccagagagt

SEQ ID NO: 7387719 - DNA, 22 bp, Homo sapiens
taatacatcattcatctaagga

SEQ ID NO: 7387720 - DNA, 22 bp, Homo sapiens
taattactggaaatttcaaata

SEQ ID NO: 7387721 - DNA, 22 bp, Homo sapiens
taattactaagggctgcatacc

SEQ ID NO: 7387722 - DNA, 22 bp, Homo sapiens
taattactaagggctgcatacc

SEQ ID NO: 7387723 - DNA, 22 bp, Homo sapiens
taatgtttccagtctatgatgg

SEQ ID NO: 7387724 - DNA, 22 bp, Homo sapiens
taattagtgtccagcttctgct

SEQ ID NO: 7387725 - DNA, 22 bp, Homo sapiens
taattatacaaaaaggcatgca

SEQ ID NO: 7387726 - DNA, 19 bp, Homo sapiens
taatactggctgtagctgg

SEQ ID NO: 7387727 - DNA, 22 bp, Homo sapiens
taatagaatagtggaaacattg

SEQ ID NO: 7387728 - DNA, 22 bp, Homo sapiens
taatagctgttattgttataac

SEQ ID NO: 7387729 - DNA, 22 bp, Homo sapiens
taatagctgtgggaaataaaag

SEQ ID NO: 7387730 - DNA, 22 bp, Homo sapiens
taattattatgacaacaattgc

SEQ ID NO: 7387731 - DNA, 22 bp, Homo sapiens
taattatgtatgcaagctcagt

SEQ ID NO: 7387732 - DNA, 22 bp, Homo sapiens
tacaaaaaattgatactgacga

SEQ ID NO: 7387733 - DNA, 22 bp, Homo sapiens
tacaaactccgaagtttgtacc

SEQ ID NO: 7387734 - DNA, 22 bp, Homo sapiens
tacaaactctttatatttcata

SEQ ID NO: 7387735 - DNA, 22 bp, Homo sapiens
tacaaagaggtaattgcatata

SEQ ID NO: 7387736 - DNA, 20 bp, Homo sapiens
tacaaagagcccctctcttc

SEQ ID NO: 7387737 - DNA, 22 bp, Homo sapiens
tacaaacttgttttaagtaagt

SEQ ID NO: 7387738 - DNA, 22 bp, Homo sapiens
tacaaagtagaaattcagtaaa

SEQ ID NO: 7387739 - DNA, 22 bp, Homo sapiens
tacaaagtcacattgaaatgaa

SEQ ID NO: 7387740 - DNA, 22 bp, Homo sapiens
tacaaagtcaccagcttcttgc

SEQ ID NO: 7387741 - DNA, 22 bp, Homo sapiens
tacaaaggacagcagaaaaata

SEQ ID NO: 7387742 - DNA, 22 bp, Homo sapiens
tacaaagcctggtagatatctg

SEQ ID NO: 7387743 - DNA, 22 bp, Homo sapiens
tacaaagatagtgttagagtaa

SEQ ID NO: 7387744 - DNA, 22 bp, Homo sapiens
tacaaagatagtgttagagtaa

SEQ ID NO: 7387745 - DNA, 22 bp, Homo sapiens
gttaatttagtagagtccagat

SEQ ID NO: 7387746 - DNA, 22 bp, Homo sapiens
gttaatttagtagagtccagat

SEQ ID NO: 7387747 - DNA, 22 bp, Homo sapiens
gttacaaactcaggtgccaaaa

SEQ ID NO: 7387748 - DNA, 22 bp, Homo sapiens
gttaatttgcagctttcgagct

SEQ ID NO: 7387749 - DNA, 18 bp, Homo sapiens
gttaattttgaagttcat

SEQ ID NO: 7387750 - DNA, 22 bp, Homo sapiens
gttacaaaggaagcttcactgc

SEQ ID NO: 7387751 - DNA, 22 bp, Homo sapiens
gttacaaaggaagcttcactgc

SEQ ID NO: 7387752 - DNA, 22 bp, Homo sapiens
gttacaaagcacttcaagtgaa

SEQ ID NO: 7387753 - DNA, 22 bp, Homo sapiens
gttacaaagcacttcaagtgaa

SEQ ID NO: 7387754 - DNA, 22 bp, Homo sapiens
gttaagaattcgttctcatgtt

SEQ ID NO: 7387755 - DNA, 22 bp, Homo sapiens
gttaagaatgcattatgcatat

SEQ ID NO: 7387756 - DNA, 22 bp, Homo sapiens
gttaagaatcaagacttatctt

SEQ ID NO: 7387757 - DNA, 22 bp, Homo sapiens
gttaagaacttgttgaaggtct

SEQ ID NO: 7387758 - DNA, 22 bp, Homo sapiens
gttaagaagctagagatgaaca

SEQ ID NO: 7387759 - DNA, 22 bp, Homo sapiens
gttaagaagctagagatgaaca

SEQ ID NO: 7387760 - DNA, 22 bp, Homo sapiens
gttaagaacttgttgaaggtct

SEQ ID NO: 7387761 - DNA, 22 bp, Homo sapiens
gttaactaaaggctgctatttc

SEQ ID NO: 7387762 - DNA, 22 bp, Homo sapiens
gttaactttcaggtgcatgttt

SEQ ID NO: 7387763 - DNA, 22 bp, Homo sapiens
gttaacttccccatgtctgcat

SEQ ID NO: 7387764 - DNA, 22 bp, Homo sapiens
gttaactttttacagaaatgaa

SEQ ID NO: 7387765 - DNA, 22 bp, Homo sapiens
gtgtggcttgggtgaggcgcct

SEQ ID NO: 7387766 - DNA, 22 bp, Homo sapiens
gtgtggctacctcagaggagca

SEQ ID NO: 7387767 - DNA, 22 bp, Homo sapiens
gtgtgcctcccattagggtgta

SEQ ID NO: 7387768 - DNA, 18 bp, Homo sapiens
gtgtggctgagatgaggc

SEQ ID NO: 7387769 - DNA, 22 bp, Homo sapiens
gtgtggctgtttagtgactttc

SEQ ID NO: 7387770 - DNA, 22 bp, Homo sapiens
gttgaggtgatgccagccctgc

SEQ ID NO: 7387771 - DNA, 22 bp, Homo sapiens
gttcacatggcattttcacatc

SEQ ID NO: 7387772 - DNA, 22 bp, Homo sapiens
gttcacatgtgttatcttcttt

SEQ ID NO: 7387773 - DNA, 22 bp, Homo sapiens
gttcacatgctctcatgctttt

SEQ ID NO: 7387774 - DNA, 22 bp, Homo sapiens
gttcaatttcagcatccattga

SEQ ID NO: 7387775 - DNA, 22 bp, Homo sapiens
gttacaaaggactgggggccac

SEQ ID NO: 7387776 - DNA, 22 bp, Homo sapiens
gttacaaaggactgggggccac

SEQ ID NO: 7387777 - DNA, 22 bp, Homo sapiens
gttgccttcactggtcttggca

SEQ ID NO: 7387778 - DNA, 22 bp, Homo sapiens
gttggggaaggtgggagaatgt

SEQ ID NO: 7387779 - DNA, 22 bp, Homo sapiens
gttgccaggacagcgcggcccg

SEQ ID NO: 7387780 - DNA, 22 bp, Homo sapiens
gttgccaggggctgctgtcacc

SEQ ID NO: 7387781 - DNA, 22 bp, Homo sapiens
gttgtacaaaatatcagtgagg

SEQ ID NO: 7387782 - DNA, 20 bp, Homo sapiens
gtttccaaattgtgcatttt

SEQ ID NO: 7387783 - DNA, 18 bp, Homo sapiens
gtttcatgcatgtgaaac

SEQ ID NO: 7387784 - DNA, 18 bp, Homo sapiens
gtttcatgcatgtgaaac

SEQ ID NO: 7387785 - DNA, 22 bp, Homo sapiens
gtttcatggagagctgaatatt

SEQ ID NO: 7387786 - DNA, 18 bp, Homo sapiens
gttttgaattgtcttaca

SEQ ID NO: 7387787 - DNA, 22 bp, Homo sapiens
gttttgaaatgaaagaaccaag

SEQ ID NO: 7387788 - DNA, 22 bp, Homo sapiens
gtttccaggcgatatcagctgc

SEQ ID NO: 7387789 - DNA, 22 bp, Homo sapiens
gtttccaagttttctttgagct

SEQ ID NO: 7387790 - DNA, 22 bp, Homo sapiens
gtttccaagttttctttgagct

SEQ ID NO: 7387791 - DNA, 22 bp, Homo sapiens
gtttccaaccccaccaaagtgc

SEQ ID NO: 7387792 - DNA, 21 bp, Homo sapiens
gtttccaacaaacctctgctt

SEQ ID NO: 7387793 - DNA, 22 bp, Homo sapiens
gtttccaactagtatgatcagg

SEQ ID NO: 7387794 - DNA, 22 bp, Homo sapiens
gtttccaagatgctgccatcag

SEQ ID NO: 7387795 - DNA, 22 bp, Homo sapiens
gtttccagctttctgatgcttg

SEQ ID NO: 7387796 - DNA, 22 bp, Homo sapiens
taaacaagctggactgataagt

SEQ ID NO: 7387797 - DNA, 22 bp, Homo sapiens
taaacaattcctctctaggcat

SEQ ID NO: 7387798 - DNA, 22 bp, Homo sapiens
taaaatttgtccctgagtgttg

SEQ ID NO: 7387799 - DNA, 22 bp, Homo sapiens
taaaattgcggtgaatatttcc

SEQ ID NO: 7387800 - DNA, 22 bp, Homo sapiens
taaaatgtgtttctgtatggtt

SEQ ID NO: 7387801 - DNA, 22 bp, Homo sapiens
taaaatggtaactttcatttgc

SEQ ID NO: 7387802 - DNA, 19 bp, Homo sapiens
taaaatgtctgtggtcagt

SEQ ID NO: 7387803 - DNA, 22 bp, Homo sapiens
taaaagttttagttgtacataa

SEQ ID NO: 7387804 - DNA, 22 bp, Homo sapiens
taaaatagaggatgtcatgcta

SEQ ID NO: 7387805 - DNA, 22 bp, Homo sapiens
gtttttattgtgtaaatgtggg

SEQ ID NO: 7387806 - DNA, 22 bp, Homo sapiens
taaaagttttagttgtacataa

SEQ ID NO: 7387807 - DNA, 22 bp, Homo sapiens
gtttttatctaatagcagttat

SEQ ID NO: 7387808 - DNA, 22 bp, Homo sapiens
taaagtcaaggtactgtttcac

SEQ ID NO: 7387809 - DNA, 22 bp, Homo sapiens
taaagtatccagttattcttct

SEQ ID NO: 7387810 - DNA, 22 bp, Homo sapiens
taaagtatattttttctcaata

SEQ ID NO: 7387811 - DNA, 22 bp, Homo sapiens
taaagtataagcattggagtat

SEQ ID NO: 7387812 - DNA, 22 bp, Homo sapiens
taaaggttagtagcagggaaac

SEQ ID NO: 7387813 - DNA, 22 bp, Homo sapiens
taaaggttataaaggttagggg

SEQ ID NO: 7387814 - DNA, 22 bp, Homo sapiens
taaaggttgaaaactgactgcc

SEQ ID NO: 7387815 - DNA, 22 bp, Homo sapiens
taaaggtagtgtgacatattgt

SEQ ID NO: 7387816 - DNA, 22 bp, Homo sapiens
taaattaaagattggagaagga

SEQ ID NO: 7387817 - DNA, 20 bp, Homo sapiens
taaattagccttgaagatta

SEQ ID NO: 7387818 - DNA, 22 bp, Homo sapiens
taaattagagccaggtaagttt

SEQ ID NO: 7387819 - DNA, 22 bp, Homo sapiens
taaattactcaatgcacataaa

SEQ ID NO: 7387820 - DNA, 22 bp, Homo sapiens
taaattaaagattggagaagga

SEQ ID NO: 7387821 - DNA, 22 bp, Homo sapiens
taaagtggaaggatccactaag

SEQ ID NO: 7387822 - DNA, 23 bp, Homo sapiens
taaagtggcgctgttactgccag

SEQ ID NO: 7387823 - DNA, 22 bp, Homo sapiens
taaagtgggcaaactctcatgg

SEQ ID NO: 7387824 - DNA, 22 bp, Homo sapiens
taaattatgtcacatgactctg

SEQ ID NO: 7387825 - DNA, 22 bp, Homo sapiens
taaattatgttccatgtccttt

SEQ ID NO: 7387826 - DNA, 22 bp, Homo sapiens
taaattatgtcacatgactctg

SEQ ID NO: 7387827 - DNA, 22 bp, Homo sapiens
taaattatgtcacatgactctg

SEQ ID NO: 7387828 - DNA, 22 bp, Homo sapiens
taaattatgttccatgtccttt

SEQ ID NO: 7387829 - DNA, 22 bp, Homo sapiens
taaattatgttccatgtccttt

SEQ ID NO: 7387830 - DNA, 22 bp, Homo sapiens
taaattagggactttagttaat

SEQ ID NO: 7387831 - DNA, 20 bp, Homo sapiens
taaattagccttgaagatta

SEQ ID NO: 7387832 - DNA, 22 bp, Homo sapiens
taaattatggctggcagagcag

SEQ ID NO: 7387833 - DNA, 22 bp, Homo sapiens
taaattatggctggcagagcag

SEQ ID NO: 7387834 - DNA, 22 bp, Homo sapiens
taacattaaaagagataattga

SEQ ID NO: 7387835 - DNA, 22 bp, Homo sapiens
taaccatattcacactatgccc

SEQ ID NO: 7387836 - DNA, 22 bp, Homo sapiens
taaccatattttccattaagtt

SEQ ID NO: 7387837 - DNA, 22 bp, Homo sapiens
taaccaaagggcctaaggaatg

SEQ ID NO: 7387838 - DNA, 22 bp, Homo sapiens
taaattctacaacttcaaagat

SEQ ID NO: 7387839 - DNA, 22 bp, Homo sapiens
taaattgaaaatctacagaaca

SEQ ID NO: 7387840 - DNA, 22 bp, Homo sapiens
taaatttacccaaggaacatgt

SEQ ID NO: 7387841 - DNA, 22 bp, Homo sapiens
taaattgcataagtacaaatga

SEQ ID NO: 7387842 - DNA, 22 bp, Homo sapiens
taactgatattgaaaaacatca

SEQ ID NO: 7387843 - DNA, 22 bp, Homo sapiens
taactgattcctttttgaaaat

SEQ ID NO: 7387844 - DNA, 22 bp, Homo sapiens
taactactaattgatgataatg

SEQ ID NO: 7387845 - DNA, 22 bp, Homo sapiens
taacctgaggagaacagtgctt

SEQ ID NO: 7387846 - DNA, 22 bp, Homo sapiens
ttcctcagccagcacttagggg

SEQ ID NO: 7387847 - DNA, 22 bp, Homo sapiens
ttcctcagctggcctgattggg

SEQ ID NO: 7387848 - DNA, 22 bp, Homo sapiens
ttcctcagagagacagaaacta

SEQ ID NO: 7387849 - DNA, 22 bp, Homo sapiens
ttcctaggatggtgaagcagga

SEQ ID NO: 7387850 - DNA, 22 bp, Homo sapiens
ttcctcagttagtgcctgaggc

SEQ ID NO: 7387851 - DNA, 22 bp, Homo sapiens
ttcctcagctgtgtcctggcga

SEQ ID NO: 7387852 - DNA, 22 bp, Homo sapiens
ttcctcagctgtgtcctggcga

SEQ ID NO: 7387853 - DNA, 22 bp, Homo sapiens
ttcctccagaagctgtagggga

SEQ ID NO: 7387854 - DNA, 22 bp, Homo sapiens
ttccacagtcatcctgggaatt

SEQ ID NO: 7387855 - DNA, 22 bp, Homo sapiens
ttcctaactctggcacctagtc

SEQ ID NO: 7387856 - DNA, 22 bp, Homo sapiens
ttcctaagtcctgccagcagtc

SEQ ID NO: 7387857 - DNA, 22 bp, Homo sapiens
ttctaagaggctaatgaagaat

SEQ ID NO: 7387858 - DNA, 22 bp, Homo sapiens
ttctaagattcatgaggacagg

SEQ ID NO: 7387859 - DNA, 22 bp, Homo sapiens
ttctaagagtcattaatggcct

SEQ ID NO: 7387860 - DNA, 22 bp, Homo sapiens
ttctaagagagtacaagcaatt

SEQ ID NO: 7387861 - DNA, 22 bp, Homo sapiens
ttcctgaacatttctaagttga

SEQ ID NO: 7387862 - DNA, 22 bp, Homo sapiens
ttcctgtggtgtttcccagaca

SEQ ID NO: 7387863 - DNA, 22 bp, Homo sapiens
ttctagaaactggagcaaacag

SEQ ID NO: 7387864 - DNA, 22 bp, Homo sapiens
ttctaggggagaggaagaagtg

SEQ ID NO: 7387865 - DNA, 22 bp, Homo sapiens
ttctagattgcctgtaagtaaa

SEQ ID NO: 7387866 - DNA, 22 bp, Homo sapiens
ttctaagtttctcagtttcagt

SEQ ID NO: 7387867 - DNA, 22 bp, Homo sapiens
ttctaagtctgctgtcttcatc

SEQ ID NO: 7387868 - DNA, 21 bp, Homo sapiens
ttctaagtgttaccttttctt

SEQ ID NO: 7387869 - DNA, 22 bp, Homo sapiens
ttctaagtgttgacaaagtcta

SEQ ID NO: 7387870 - DNA, 22 bp, Homo sapiens
ttctaattgtgtttgcatatct

SEQ ID NO: 7387871 - DNA, 22 bp, Homo sapiens
ttctaattgcaagttttagtat

SEQ ID NO: 7387872 - DNA, 22 bp, Homo sapiens
ttcaacaagtcttttttcactg

SEQ ID NO: 7387873 - DNA, 22 bp, Homo sapiens
ttcaacaagtagtacacacagt

SEQ ID NO: 7387874 - DNA, 22 bp, Homo sapiens
ttcaacaacttggttcaaatgg

SEQ ID NO: 7387875 - DNA, 22 bp, Homo sapiens
ttcaacaaggctgtcaaaagtt

SEQ ID NO: 7387876 - DNA, 22 bp, Homo sapiens
ttcaacaaactgttcacgaatg

SEQ ID NO: 7387877 - DNA, 22 bp, Homo sapiens
ttcaacaaaatatatttttcca

SEQ ID NO: 7387878 - DNA, 21 bp, Homo sapiens
ttcaacaaagggaataagttt

SEQ ID NO: 7387879 - DNA, 22 bp, Homo sapiens
ttcaacaattaagtatcagcct

SEQ ID NO: 7387880 - DNA, 22 bp, Homo sapiens
ttcaacactgaggttgctgcag

SEQ ID NO: 7387881 - DNA, 22 bp, Homo sapiens
ttcacagtgagctatgtcttgt

SEQ ID NO: 7387882 - DNA, 22 bp, Homo sapiens
ttcacaataatgtccatcctct

SEQ ID NO: 7387883 - DNA, 22 bp, Homo sapiens
ttcacaaagctggagcatttcc

SEQ ID NO: 7387884 - DNA, 22 bp, Homo sapiens
ttcacaaagctggagcatttcc

SEQ ID NO: 7387885 - DNA, 22 bp, Homo sapiens
ttcacaaaatggtttgttgatg

SEQ ID NO: 7387886 - DNA, 22 bp, Homo sapiens
ttcacaaaaatgctgaacagtt

SEQ ID NO: 7387887 - DNA, 22 bp, Homo sapiens
ttcaatttagtgatgttgttgg

SEQ ID NO: 7387888 - DNA, 22 bp, Homo sapiens
ttcaatttcataatatctagct

SEQ ID NO: 7387889 - DNA, 22 bp, Homo sapiens
ttcaatttcataatatctagct

SEQ ID NO: 7387890 - DNA, 22 bp, Homo sapiens
ttcaatgtggttataataacta

SEQ ID NO: 7387891 - DNA, 22 bp, Homo sapiens
ttcaagaagcccaaagactagc

SEQ ID NO: 7387892 - DNA, 22 bp, Homo sapiens
ttcaagaaggtacatttacatc

SEQ ID NO: 7387893 - DNA, 22 bp, Homo sapiens
ttcacattgaaggtgctttctt

SEQ ID NO: 7387894 - DNA, 22 bp, Homo sapiens
ttcacattctcacaagaggaaa

SEQ ID NO: 7387895 - DNA, 22 bp, Homo sapiens
ttcagtatgattcctccagtag

SEQ ID NO: 7387896 - DNA, 22 bp, Homo sapiens
ttcagtaaggataataaacaga

SEQ ID NO: 7387897 - DNA, 22 bp, Homo sapiens
ttcagtatacttcataacattt

SEQ ID NO: 7387898 - DNA, 22 bp, Homo sapiens
ttcatgttcatgcttaggaaaa
